United States Patent 9,675,668 (MODIFIED POLYNUCLEOTIDES ENCODING HEPATITIS A VIRUS CELLULAR RECEPTOR 2) - sequence listing, part 23

SEQ ID NO: 48764 - DNA, 1026 bp, Artificial Sequence
  Description of Artificial Sequence: Synthetic coding sequence
atgggcagacgatgttgtaggcgcagggttttagcagctgcctgcctgggagcggcactgttgttgctctgtgccgcacctaggtctctgaggccggctttcggaaatcgtgcccttggcagcagttggctgggcggagagaagcgctcacctttgcaaaagctgtacgacctggaccaagatccaagatcaacactcgcgaaggtgcaccgccagagacgcgatttactgaacagcgcatgttcacgtcatagtcggcgacaaaggttattgcagcccgaggatctacggcacgtactcgttgacgacgcacatgggctgttgtattgctacgtgcccaaggtggcatgcaccaattggaaacgtgtcctgctcgctctgtcaggccaggctcgcggagaccctagagcaatcagcgctcaggaagctcatgctccaggtcgactgcctagccttgcagacttctccccagctgagataaaccgccgattgcgggcttacctggcttttctcttcgttagagagcctttcgaaagactggcatccgcgtatcgcaacaagttagctcgcccatacagcgccgcattccagagacgttacggtgctaggatcgtccagcgcctgcgcccacgtgctcttccagacgcacgcgcaagagggcatgacgtgaggtttgcggaatttctcgcctatctgttagaccctcggacgcggagagaggaacctttcaacgaacactgggagagggctcatgcactgtgccacccttgcagattgagatatgacgtagttgggaaattcgaaaccctagccgaggacgcagcgtttgtgctgggcctggctggagcaagcgacttgagtttccccggtccaccaaggccaaggggcgctgccgctagccgtgatctcgctgccaggctgttcagggacatctcccccttttatcagagaagactctttgacctctacaagatggatttcctgctctttaactattctgccccaagctatctgcggctcctgtag

SEQ ID NO: 48765 - DNA, 678 bp, Artificial Sequence
  Description of Artificial Sequence: Synthetic coding sequence
atgggtcggaggtgttgcaggcggagagtactggctgccgcttgtcttggcgcagcccttctgttactgtgtgcagcccctagaagtcttcgtcctgcattcggcaatagggctctgggaagctcatggctcggcggtgagaaaagaagtcctctccaaaagctgtacgaccttgatcaggatccacgctctaccctagcaaaagtccatcggcagcggagagatctgttgaactcagcatgtagcaggcattccaggagacagagattgttgcagccagaagacctgaggcatgtgcttgtggacgacgcacatggactcctctactgctatgtgccaaaggttgcctgcacaaactggaaaagggttttactcgcactgtcggggcaggccagaggcgacccccgagcaatatccgcacaggaagcccacgccccaggccgacttccttccttggctgattttagtcccgctgagatcaaccggagactgagagcctatctggcatttctttttgtcagagagccttttgaacgactagcatcagcttaccgtaacaaactggcccgaactaggagcgctacgcgggtggctagcgctactactagctgggctagcagcagaagatggagacgaaccaggccctcctgctgggcctggagagctcatcctacctag

SEQ ID NO: 48766 - DNA, 1161 bp, Artificial Sequence
  Description of Artificial Sequence: Synthetic coding sequence
atgttgttgccaaaaaaaatgaagcttctcctgtttctggtctctcagatggcaattctggccttattcttccatatgtactctcacaacatcagttcgctgagtatgaaggcccaaccagagaggatgcatgtgcttgtgctctcatcttggcggtctggcagcagctttgttgggcagctttttggccagcatcccgatgtgttttacttgatggagcccgcttggcatgtttggatgacgttcaaacagagtaccgcgtggatgctgcacatggcagtcagagacctcatcagggccgtttttctttgtgacatgtctgtgtttgatgcatacatggagcctggtcctaggcgccagagctcgctgttccagtgggagaacagtagagcactgtgtagcgctcctgcctgtgacattatcccccaggatgagataatccctcgtgcacactgtagactgctctgctctcaacagccctttgaggtagtggaaaaagcttgccggtcctacagtcacgtggtgctgaaagaggtgcggtttttcaatctacagtccttgtatccattgctgaaagaccctagtctgaacttgcatatcgtccacctggtgagggacccacgagccgttttccgctctagagaacggaccaaaggcgatcttatgatcgactctcggattgtgatgggccaacatgaacagaagctgaagaaagaggaccagccgtactacgtgatgcaggtgatttgtcagagccagctggagatctataaaaccatccaatcactcccgaaagctctgcaagagagatatctccttgttaggtatgaagacctcgcacgcgcacccgtggcgcaaacctcgcgcatgtatgaatttgtcggcttagagttccttcctcacctccagacctgggtgcataatattaccaggggtaaggggatgggtgaccacgccttccacaccaacgccagagacgctctgaacgtcagccaggcctggcgctggtcactgccttatgagaaggtaagccgcctgcaaaaggcttgtggcgacgccatgaacctgctcggttatcggcacgtgcgctctgaacaggagcagcggaacctcctgctggacctgcttagcacctggacagtgcccgagcagatccactag

SEQ ID NO: 48767 - DNA, 1161 bp, Artificial Sequence
  Description of Artificial Sequence: Synthetic coding sequence
atgctcctgcccaaaaaaatgaaacttctgcttttccttgtgtcgcagatggccatccttgcgctgttctttcacatgtactcccataacatctcttccctgtccatgaaggcacagccagagaggatgcacgtcctggttctatcatcctggcgctccgggagctccttcgtgggacaattatttggccagcatccagacgttttctatcttatggagccagcctggcatgtgtggatgactttcaaacaatcgactgcatggatgctccacatggcagtacgggatctaattcgggcagtatttctgtgcgatatgtccgtgttcgacgcttacatggagcctggaccaagacggcaaagcagtttgttccagtgggagaactcaagagccctttgtagtgcgccagcgtgtgatatcatcccccaggatgaaatcattcccagggcacattgtcgcctcctgtgctcgcaacagccttttgaggtggtggagaaggcttgtcgctcttactcccacgtggtcctgaaggaggtgagattttttaatctccagagcttgtatccactgctgaaggacccaagcctgaaccttcacattgtgcacctcgtccgagatcccagagctgtatttcgtagccgcgagcgcacgaagggcgatctcatgattgacagtagaatcgttatggggcaacacgagcagaaattgaaaaaagaggaccaaccgtattatgtgatgcaggttatctgtcagagccaactcgaaatctacaaaaccatccaatcgttgcccaaagctttgcaggaaagatacctgctggtaagatacgaggatctcgcacgcgctccagtggctcagacatctagaatgtacgagttcgttggcctggaatttttgccccacctgcagacatgggtgcacaacatcacccgcggaaaagggatgggcgatcacgctttccacacaaatgcaagggacgctttgaatgtcagtcaggcctggcgatggtctctcccctacgagaaggtgtcccgcttgcagaaagcctgcggagatgccatgaatctgctgggctatcgacacgtacggagcgagcaagagcagaggaacctcctcttggatctgctgagtacatggacagtgcctgagcagattcactag

SEQ ID NO: 48768 - DNA, 918 bp, Artificial Sequence
  Description of Artificial Sequence: Synthetic coding sequence
atgctggggagaaacacgtggaaaacctccgcattcagttttcttgtcgaacaaatgtgggcgccactgtggagtcgaagtatgaggccagggagatggtgcagccagaggagctgtgcctggcagacatctaacaacactctgcaccctctgtggaccgtcccagtttctgtgccagggggaactagacagagccccattaatatacagtggcgtgactccgtctacgatccacagttgaagcccctcagggtgtcttatgaggccgcatcctgcctgtatatatggaacacaggatacctctttcaagttgagttcgatgatgctaccgaggccagtggtatctcgggagggccactcgagaaccactataggctgaagcagttccactttcattggggagcggtgaatgaagggggatcagagcacactgtcgatggacatgcttatcccgcagagctgcacttggtgcactggaatagtgtaaaataccagaactataaggaggctgtcgtcggtgagaatggcctggcggtgattggggtgtttctgaagcttggagctcatcaccagacattgcagagacttgtggatattctccccgagatcaagcataaggatgcgagagccgcaatgcggccatttgaccccagcaccctgctgcccacgtgttgggattactggacgtatgccggttcactgactactccaccccttacagagagtgtaacatggatcattcaaaaggaacctgtggaagtcgccccttctcagttatccgcattccggacacttctcttttctgctctgggggaagaagagaaaatgatggtaaacaactacaggccgctgcagcctctgatgaaccggaaggtttgggccagttttcaggcaaccaatgagggtactcgcagctag

SEQ ID NO: 48769 - DNA, 714 bp, Artificial Sequence
  Description of Artificial Sequence: Synthetic coding sequence
atggataaggtgtgcgctgtgttcggcggaagccggggtattgggcgtgccgtcgcacaactgatggcccgaaaagggtaccgcctagctgtgatagccaggaatctggagggagcaaaggccgctgctggcgatttgggtggtgaccacctcgctttttcatgcgatgtggccaaagagcacgacgtgcaaaacacctttgaagaactggaaaaacatctcggcagggtgaattttcttgttaacgctgccggaataaatcgggacggtttattggttagaaccaagactgaagacatggtgagtcagttgcacaccaacttactagggagtatgcttacctgtaaagcagccatgcgcactatgatacagcagcagggcggaagcattgtcaacgtcgggtctatcgttggcctcaaaggcaatagcgggcagtctgtgtactctgcttccaagggagggctggtcgggttcagtagagcactggcaaaggaggtagctagaaaaaaaattagggtcaatgtggtggccccaggctttgtgcataccgatatgaccaaagatctgaaagaagaacacctcaagaagaacatacccctcggcagattcggagagaccattgaggtggcccatgcagtggtctttcttctggagagcccctacattaccgggcacgtgttagtggtggacggaggactccaactgattctgtag

SEQ ID NO: 48770 - DNA, 540 bp, Artificial Sequence
  Description of Artificial Sequence: Synthetic coding sequence
atggataaagtatgtgctgtcttcggtggcagtaggggcataggtagggctgtggcacaattaatggctcgaaaaggataccgactagctgttatcgcaaggaatctggaaggcgctaaggcagcggcaggtgacctgggcggtgaccacctcgcattcagttgtgatgttgccaaggaacacgacgtccagaacacctttgaggaactcgagaagcatctgggcagagtaaactttctggtgaatgccgctgggatcaacagagacggactacttgtaagaacgaaaacagaggatatggtgagtcagctgcacacaaatctcctcggcagcatgctgacatgcaaagccgcaatgcgcacaatgatccagcagcagggcggaagcatcgtgaatgtcggcagtattgtgggtctcaaaggcaacagcggccagagcgtttactccgcttctaagggagggctcgtgggattttcacgcgctctggcgaaagaagtggccaggaagaagattagggtcaacgtggtagcaccaggttag

SEQ ID NO: 48771 - DNA, 1872 bp, Artificial Sequence
  Description of Artificial Sequence: Synthetic coding sequence
atgaccgcacagtcccgtagtcccactacacccacttttcctggtccatcccagcgaacgcccctgactccctgccccgtgcagacccctagactgggcaaggcactgatccattgttggaccgatccaggtcagcctctgggtgagcagcagcgcgttaggagacagcgaaccgaaacatccgagccaactatgagactgcaccgtctgagggctcggctcagcgccgtcgcctgtggtctgctgcttctgttggtccgaggtcaaggccaggattctgcaagcccgataaggaccacacacaccggccaggtcctgggatcgctagtgcatgtgaaaggcgcaaacgctggagtccagacatttttgggcatcccattcgctaagccacccctgggccctctgcgctttgctcctcctgaacccccagagtcatggagcggagtgagagatggcaccacacaccctgccatgtgcctgcaggacctaactgcagtagaaagcgagtttctgagccagttcaacatgacctttccctctgattcaatgagcgaggactgcctgtacctcagcatttacaccccagcccactcgcatgaagggtccaacctgcctgtgatggtgtggatccatggcggagccctggtgtttggcatggcctcactatatgatggatcaatgttggctgccctcgagaatgtggtggtagtgatcattcagtatcgcctcggcgtgctgggctttttttctaccggagataagcatgcgacaggtaattgggggtacctcgatcaagtcgctgctctccgttgggtccagcaaaacatagcccactttggcggaaatccagaccgggttaccatcttcggagagagtgccggagggacttcggtgtccagcctggtcgtgtcaccaatttctcagggcctattccacggagcgataatggagtccggagtggctctgctgccaggcctgatcgcgagctcggctgacgtcatcagtactgtggtcgcaaacttatcggcttgtgatcaagtggactcagaggcgctggtgggctgcctccgcggaaagtctaaggaagaaattctggccatcaataagcctttcaagatgataccaggggtcgtggacggggtcttcctcccacggcacccgcaggagcttcttgccagcgcagacttccagcctgtgcccagcatagtaggtgtgaataataacgagttcggatggctgatcccaaaggtgatgcggatctacgatacccagaaggagatggaccgggaggcatcgcaagctgctttgcagaaaatgctcactctgttgatgctcccacccacttttggcgacttactgagagaagagtatattggagacaacggcgatccccagacactgcaggcccagttccaggagatgatggccgattccatgtttgtgatccccgcactgcaggtggcacactttcaatgctccagggcccctgtgtacttttacgagtttcaacaccagccttcatggctgaaaaatataaggccgcctcatatgaaggctgatcacggcgatgaactcccttttgtgtttaggtcattcttcggaggcaactatataaagttcaccgaagaagaggaacagctatcacgaaagatgatgaaatattgggccaactttgcccgaaacggcaacccgaatggcgaaggacttccccactggcccctctttgaccaggaggagcaatatctccaattaaacctgcagcccgctgtgggtagagccctcaaagcacacagactgcagttctggaaaaaggccttgccccaaaaaatccaggagctggaggaacccgaagaacgacatacagagctctag

SEQ ID NO: 48772 - DNA, 1824 bp, Artificial Sequence
  Description of Artificial Sequence: Synthetic coding sequence
atgaccgcccagagcaggtcacccacaaccccaacatttccaggccctagtcagcgcactcccctcaccccctgtcccgtccagaccccccgtttgggcaaggcactgatacattgctggacagatcccggtcagcccttaggtgaacagcaaagagtgcgccgacaaaggacagagactagcgagcctacaatgcgcctccatagactccgcgcacgcctgtcagccgtcgcctgtggactcctcctactgctggtccgcggacagggccaggacagtgcctctccaatcagaacaacacacacaggacaggtcttgggttccttagttcatgttaagggagccaacgctggtgttcagacctttctgggcatcccttttgcgaagcccccacttggccctctcagattcgctccgcctgagcccccagagagctggagcggcgtcagagatgggacaacacatcccgcaatgtgcttacaggatttgactgccgtggagtccgagttcctgtcccaattcaacatgacttttccttccgactcaatgtctgaggattgcctgtacctgtcaatctacacacctgcacatagtcatgaagggtccaatcttcccgtgatggtctggattcatggcggtgcccttgttttcggcatggccagtttatatgatggcagtatgctcgcggcactggaaaacgttgtcgtcgtcatcatccagtacagactgggggtgctgggattttttagcaccggtgataaacacgcaacaggtaactggggctatctggatcaggtggccgcattgcggtgggtgcaacaaaacattgcccattttgggggtaatcccgatagggtgacaatttttggagagtctgccggtgggacgtctgttagtagcctggttgtaagccccatctcccaaggcctattccacggcgcaattatggagtccggggtcgcgcttctgcctgggctgattgcaagctccgcagacgtgatctccactgtggtggcaaacttatccgcttgcgaccaagttgattctgaggctctggtgggatgtctgcgcggaaaatctaaggaggagatccttgccataaacaagccatttaagatgattccaggggtggtcgacggagtcttcttaccaagacacccgcaggagcttttagcaagcgccgatttccagcctgtgcccagcattgtgggggtaaacaataatgaattcgggtggttgatcccaaaggtgatgcgcatctacgatactcagaaggaaatggacagggaggcctcacaggctgctctgcagaaaatgctcactttgttgatgctgccccctacttttggggatttgttaagggaagaatatatcggtgacaacggagacccccagaccctgcaggcccagttccaggaaatgatggccgacagtatgtttgtgatcccggctctccaggttgcccacttccagtgctcgagggcgccagtgtatttctacgagtttcaacaccagccttcctggctgaaaaacatccgaccacctcatatgaaagccgatcacgtgaagttcactgaggaggaggaacagctctcccgaaaaatgatgaagtattgggccaattttgccagaaacggcaatccaaacggcgagggactcccgcactggcctctttttgaccaggaggaacagtacctccagcttaacctgcaacctgcagtggggagggcactgaaggcgcaccggctccagttttggaagaaggctttgcctcagaagattcaagagctagaagagcccgaggagagacacacagagctgtag

SEQ ID NO: 48773 - DNA, 903 bp, Artificial Sequence
  Description of Artificial Sequence: Synthetic coding sequence
atggagatacccatgggtacccagggttgtttttcaaagtcactactcttgtccgcttccatcttagtgctctggatgctgcagggcagtcaggccgctctgtacatacagaaaatccctgaacagccgcagaaaaaccaggatcttcttctgtctgtgcaaggtgtgccggatactttccaggactttaactggtatctgggggaggaaacttatggcggtaccaggctatttacgtatattcctggcatccagcgtccccagcgagacggctctgccatgggccagagggatatcgttggattccctaatggaagcatgctccttcgaagagcgcaaccaaccgattctggcacttatcaggtggcaattacaattaattcagaatggactatgaaagccaagaccgaggtacaggtggcagaaaagaacaaagagcttcctagcactcacctgcctactaacgccggaattctagccgcaacaattattgggtccctggccgctggtgccctcctcattagttgtatcgcctacctcttggtcacccgcaattggcgcggacagtcacacagattgcccgcaccacggggtcaagggagtctttctatcttgtgctcagcagtgtctcctgttccaagcgtgactccaagcacctggatggccactacggagaagcccgagttgggacccgctcacgatgcaggcgacaataatatctacgaggtcatgccgtctcctgtgctcctcgtcagccccatcagtgacacaaggtccatcaacccagctaggcctctacctactcctccccatttacaggcagagccagagaatcatcagtaccagcaggacctgctcaatccagatcccgcaccctattgtcaactggtgccaacctcttag

SEQ ID NO: 48774 - DNA, 900 bp, Artificial Sequence
  Description of Artificial Sequence: Synthetic coding sequence
atggaaattccaatgggaacccaggggtgcttcagcaaatcactgctcctgtctgcctccatcttggttttatggatgttacagggctcccaggccgctctgtatatccagaagattccagaacaaccccaaaaaaaccaggacctgttgctgtccgtacagggcgtgccagatactttccaagattttaattggtacttgggagaagagacctatggcggaactagactgtttacatacatcccaggcattcaaagaccacaacgcgatgggtccgccatgggtcagcgggacatcgttggattccccaatggaagtatgctcctgcggcgagctcagccaacagacagtgggacctaccaggtggcgattactattaacagcgagtggaccatgaaagccaagaccgaggttcaagtcgcagagaaaaacaaggaactgccctccactcatctccctacgaacgcgggtatcttggcagctacgattataggatccttggcagcaggagcacttctcattagctgcatcgcctaccttcttgtgaccagaaactggcgaggacagagccaccggttacccgcaccacgcggacagggatccctgagcatcctctgttccgctgtgtctccggtgccatccgtgacgcctagtacatggatggccaccactgagaagccagaacttggacccgctcacgacgccggtgacaataatatctatgaggtgatgccttctccggtcctcctagtgtctcccatctccgacaccaggtccataaatcctgctcgacctctgcctacccccccacatcttcaagcagagccggagaatcaccagtaccaagatctgcttaacccggatccagctccatattgccaattagtgcctacaagctag

SEQ ID NO: 48775 - DNA, 879 bp, Artificial Sequence
  Description of Artificial Sequence: Synthetic coding sequence
atgggcccaccttccgcgtgtccccatagagaatgcatcccttggcagggactcctgctcacagctagtctcctgacgttctggaatgccccaacgactgcttggctgttcattgcaagcgccccattcgaagtggcagaaggcgaaaacgtgcacctgtccgtggtctatctccctgagaatttgtattcctatgggtggtataaggggaaaacagtggagcctaatcagttgatcgccgcatatgtcatcgacacccacgtcaggacaccaggacccgcttatagcggcagggagacaatttccccttccggagatctgcatttccagaacgtaaccctggaggacaccggctactatacactgcaggtgacttacagaaactcccagattgaacaggcttcccaccatttacgggtctacgaatccgtggcacagccatccatccaggcttcatctactaccgtgaccgagaaagggtccgtagtccttacttgtcacaccaacaataccggaactagttttcagtggatttttaataaccagcgtttacaggtgactaaacgaatgaaactgtcatggttcaaccatatgctaaccatagatccaatccgccaggaggacgcaggagagtaccagtgtgaggtttccaaccccgttagctccaatcgatcagaccccttgaagttgaccgtcaagtatgacaatactcttggcatcctgatcggagtcctggtcggcagcctgctggtggcagcgttagtatgcttcctattgctgcggaagaccggacgtgccagcgaccagagtgacttccgcgagcaacaaccacctgcttccacacctgggcacggtccctccgactcttctatatcgtag

SEQ ID NO: 48776 - DNA, 882 bp, Artificial Sequence
  Description of Artificial Sequence: Synthetic coding sequence
atggggcctccatcagcttgtccccatagggaatgcataccatggcagggtctgttgctgacagcaagcttgcttactttctggaacgctccaactactgcgtggctgtttattgccagcgctccatttgaagtcgctgagggggagaacgtacatctcagtgtggtgtatctgcccgaaaatctgtatagctacggctggtataagggcaagaccgtcgagcctaatcagctgatcgccgcatacgttattgatacccacgttagaacccctggccctgcgtatagcggacgggagacaatcagtccgtcaggagatttacactttcagaatgtaacattggaggacacaggttactacacccttcaagtgacctacaggaacagtcagatagaacaagcaagtcatcacctgagggtttacgagtccgtggcccagccaagtattcaggcctcgagtaccaccgtcacagaaaaaggaagcgttgtgctgacgtgccacacgaacaacacagggacttcatttcagtggatttttaataatcagcgcctgcaggtcacaaagaggatgaagcttagctggtttaaccacatgttgactatcgaccccataagacaggaggacgccggagaatatcaatgtgaggtctccaatcctgtgagcagcaatcgatcagaccctctgaaactcacagtcaaatcggacgacaacacccttgggattctcattggcgtgctcgtgggctctctgctcgtagccgctctggtttgcttcctgttgctgagaaaaacgggacgcgcatctgatcagagcgattttagggagcaacagcccccagctagtacacccggacatggtccctccgacagcagtatttcctag

SEQ ID NO: 48777 - DNA, 900 bp, Artificial Sequence
  Description of Artificial Sequence: Synthetic coding sequence
atgatggcgtatatgaatcctgggcctcactattctgtgaacgctcttgcactttctggcccttcagttgatctcatgcatcaggcagtcccgtacccgtcagctcccaggaagcaacgtagggagcggactacctttacccgttctcaactcgaagaactggaagccctcttcgctaagactcagtacccggatgtttatgccagagaagaggtcgccctgaaaattaacctgcccgaatccagagttcaggtgtggttcaagaatagaagagcaaagtgtaggcagcagagacagcagcagaaacagcagcagcagccaccgggaggccaggcaaaggccagaccagccaaaagaaaggcaggcacatcgccacgaccttctacggacgtctgtcctgatccacttggaatttcagattcatattctcccccactgccgggaccttctgggtccccaaccaccgctgtagccaccgtgagtatatggtctccagcctccgagtctccactgcccgaggcgcagagagctgggctagtagctagcggcccttccctgactagcgctccttatgctatgacctatgccccagccagcgccttttgctcgtcccccagcgcttatgggtccccttcaagctatttctcaggtctggatccttatttaagccccatggtcccacagctgggcggtcctgccctcagcccgcttagcggtccgagcgtgggcccaagcttggcccagagcccaacatcattgtccggccagagctatggtgcctattctccagtcgattctttggaattcaaggatccaactggcacgtggaagtttacatataatcctatggatccattggattataaggaccaatccgcatggaaattccaaatcctctag

SEQ ID NO: 48778 - DNA, 639 bp, Artificial Sequence
  Description of Artificial Sequence: Synthetic coding sequence
atggggcctcctagtgctagcccccatcgggaatgtatcccgtggcagggtctgctgcttacggctagtctgctgaatttctggaacccccctacgaccgccaagctgacgattgaatccatgcccctgtccgtggccgagggtaaggaagtcctcttgttagtgcataacctgcctcaacacttattcggttactcatggtacaagggcgagagagtagacggaaatagccttatcgtggggtacgtgattggcacccaacaggcaacccctggagccgcatactctggcagggagacgatttacacaaacgcctcgctgctgattcagaacgtgacccaaaacgacattggcttctataccctgcaggtgatcaaaagcgaccttgtcaatgaagaggcgacaggacagtttcatgtctatcaggaaaacgcccctggcttgcctgttggcgcagtggcaggaatagtgacaggcgtgctggtgggagtggccttggtggccgcactggtatgctttctattgttagcgaaaaccggccgaccatggtccctgccccagctgtgcttgctggacgttcctagccttcactgtccgggtcccccaacgcagcctcaagactcttcatttcacctatag

SEQ ID NO: 48779 - DNA, 759 bp, Artificial Sequence
  Description of Artificial Sequence: Synthetic coding sequence
atgggacccccatcggcctcaccccacagggagtgtattccttggcaaggacttctacttacagcctctcttctcaacttctggaaccctccgactactgctaaactgacaatcgagagtatgcctctgtccgtggcagaaggcaaggaggtgctactgctcgtgcataacctgccacagcatctattcggctattcctggtacaaaggcgaacgcgttgatggcaacagcctgatcgttggttacgtaataggcactcagcaggcaaccccaggagcggcatactcaggccgagagaccatatacacaaacgcttctctactcatccaaaacgtaacacagaatgatatcggattctatacccttcaggtcatcaagagtgatctggtgaatgaagaggccacaggacagttccacgtttatcaggagaacgcaccgggtctacccgtcggggctgtggcgggaattgtgactggcgtactcgtcggcgtggccctggttgccgctttagtctgcttcttactgctggcgaagaccggcaggactagtatccaaagggatctgaaggaacagcagccccaggccctcgctccgggaagaggcccatcacacagtagcgccttcagcatgtcacctctcagtacagctcaggccccactacccaacccaagaacagcagcaagcatctatgaggaactgttaaagcatgacacaaacatttactgccgaatggaccacaaagcagaagtcgcctcttag

SEQ ID NO: 48780 - DNA, 534 bp, Artificial Sequence
  Description of Artificial Sequence: Synthetic coding sequence
atggggccaccttccgcatcccctcaccgggagtgcatcccttggcagggcttgttgcttactgcctccctgctgaacttctggaatcccccaaccactgcgaagctcactatcgaatctatgcccctatctgtcgcagagggcaaagaggtgcttctactggtccacaatctccctcaacacctgtttggttatagctggtataaaggagaacgcgtggacggaaactcgctgatcgtgggatacgtaattggaacccagcaggctacacccggagcagcatattccggacgcgagacaatctatacgaatgccagtctcctcatccagaatgtgacgcagaatgacatcggtttttatacactacaagtgattaagtccgacctggtgaacgaagaagccaccggccagttccacgtctatcctgaactccctaaaccgagtatctcctctaataatagtaatccaaaggaggacaaggatgccgtcgcattcacttgtgaacctgaaatccactcgacgacatgtctgtag

SEQ ID NO: 48781 - DNA, 774 bp, Artificial Sequence
  Description of Artificial Sequence: Synthetic coding sequence
atggctgccccttgggcctcgctgcggctggtcgctcccatgtggaatggaaggatcagaggtatccaccgcctgggcgctgccgtcgcacccgagggcaaccagaagaagaagcggaccatcctgcagtttcttaccaactatttctatgatgttgaagcccttcgcgattatctacttcagcgggaaatgtacaaggtacacgaaaaaaacagatcatacacctggctggaaaagcagcatgggccatacggcgcaggagctttttttatactgaaacagggaggcgcagtaaaattccgcgacaaggaatggatccggccagacaagtatggacatttttcgcaggagttctggaacttttgcgaagtgccggtcgaagctgtggacgctggagattgcgacataaactacgaaggcttggataatctccttagactgaaagagctccaatctctgagcctccagcggtgttgtcacgtggatgactggtgcttgagtaggctctatcctctggcggattctctccaggagttatcactggctgggtgtccaagaatttccgaacgtggactcgcatgcctgcaccatctgcagaatctgagacggcttgatattagcgatcttcccgcagtgagtaacccaggccttactcagatactggtggaggagatgctccctaactgcgaagtagtgggggtcgactgggcggaaggcctgaagagcggcccagaggagcagccacgtgacacagcctcacctgtgccagcatag

SEQ ID NO: 48782 - DNA, 798 bp, Artificial Sequence
  Description of Artificial Sequence: Synthetic coding sequence
atgggatcccctagcgcctgcccctatcgggtttgcatcccctggcagggactgctcttgaccgcttcactgctcactttctggaatttacctaactctgctcaaacaaatatcgatgtggttccattcaatgtggctgagggcaaggaagtcctacttgtggtccacaacgagagccagaacctctacggatacaactggtacaagggagaaagggtgcacgcaaattatagaatcattggatatgtgaagaacatctcacaggagaatgcccctggcccagcccataatgggagggagactatttaccctaacgggacacttctgattcagaacgtgacgcacaacgatgctggattctacaccctgcacgtgattaaagagaatctcgttaatgaggaagtgacacgtcagttttatgtgttttctgaacccccaaagccctcaattactagtaacaatttcaaccccgtcgaaaataaagatatcgtcgtcctcacctgccagccagagacccagaacactacctatctgtggtgggtgaacaaccagtccctactcgtgtcccccagactgttattatctaccgacaacagaactttagtgctcctgagtgccacaaagaacgatatcgggccttacgaatgcgaaatccagaacccagtgggagcttcccggagtgacccagttaccttaaatgtgaggtacgagtccgttcaagcctcttctcctgatctgtccgccggaacagcggtctcaataatgataggcgtgctcgccggaatggccctgatttag

SEQ ID NO: 48783 - DNA, 519 bp, Artificial Sequence
  Description of Artificial Sequence: Synthetic coding sequence
atgggcagccccagcgcgtgtccctatcgtgtgtgcatcccctggcagggccttctcctgaccgcctctctgctgactttctggaatttacccaacagtgcacagacaaatattgacgtcgtacccttcaacgtggctgaagggaaggaggtcctgctcgtcgtacacaacgaaagtcagaacttgtatggctacaactggtataagggagagagagtgcatgctaattatagaatcattggctatgtcaagaacataagccaagaaaatgctccaggccctgcccacaacggtcgggaaacaatctacccaaatggaactctcctgattcagaatgtgacacataatgacgcaggattttacaccctgcacgtcataaaggagaacctcgttaacgaggaagtgactcgccagttctacgtgttctacgagtccgtccaagcctcaagtccagatctctccgcaggcactgcagtgtcgatcatgatcggggtcctggcaggaatggccctcatctag

SEQ ID NO: 48784 - DNA, 798 bp, Artificial Sequence
  Description of Artificial Sequence: Synthetic coding sequence
atgggttctccctccgcatgcccctatagagtgtgcatcccatggcagggtctgttgctgaccgctagtctgctgaccttctggaaccttccaaactctgcgcagacaaacatcgacgttgttccattcaacgtcgccgaggggaaggaagtgctgttggtggtgcacaatgagagtcagaacctgtatggctataattggtacaagggtgagcgggtacatgccaattacaggatcatcggctatgtgaaaaatattagtcaggaaaatgcgccagggcctgcccacaatggacgtgaaacgatttatcccaacggaacactccttatccaaaacgtgacccacaacgatgccggattttacacgttgcatgttatcaaagagaatcttgtcaacgaagaagtgacacgccagttttatgtgtttagcgaaccccctaagccttctattacatccaacaactttaatcccgtggaaaataaagacatcgttgtgctgacatgtcaacccgagactcagaacacaacttacctgtggtgggttaataaccaatctctccttgtttcaccacgactcctgctgtccacagataacagaacacttgtgctgctgtccgctaccaaaaatgatatcggtccttacgaatgtgagatacagaatcctgtaggggcttcccggagtgaccccgtcaccctgaacgtacgctacgagagcgttcaagcctccagccccgacttgtcggctgggactgccgtgtccatcatgatcggcgttctcgccggaatggctctcatttag

SEQ ID NO: 48785 - DNA, 735 bp, Artificial Sequence
  Description of Artificial Sequence: Synthetic coding sequence
atgggaagcccttctgcatgcccataccgggtgtgcattccatggcaggggttgctgctgaccgcaagcttgctcaccttttggaaccttccaaactctgcacagacaaacatcgatgtggtgcctttcaacgtggcagagggaaaggaggtcctacttgtagttcacaacgagagccagaacctatatggatataattggtataaaggcgagagggtccatgctaacggacgggagacaatatacccgaacggtacgctgctaattcagaacgttacacacaacgacgcgggattttacactctacacgtgatcaaagaaaatcttgtgaatgaagaagttacaagacagttctacgtgtttagcgaaccgccaaaaccgtccattacctccaacaactttaaccctgtagaaaataaggacatcgtggtgttgacttgccagccggaaacacaaaatacaacatacctgtggtgggtgaataaccagtcattgctggtatcccccagactcttgcttagtactgataatcggacactcgttttgctgagcgctacgaaaaacgacatcgggccttatgagtgtgaaattcagaaccccgtcggggctagtagaagtgatcctgtgactcttaacgtaaggtatgaatctgtgcaggctagttctccagacctgtccgcaggaacagctgtgtcaattatgatcggagtgctggccggaatggccctcatatag

SEQ ID NO: 48786 - DNA, 2361 bp, Artificial Sequence
  Description of Artificial Sequence: Synthetic coding sequence
atgaaaggaactggcattatggactgcgcccctaaggccctgttagcaagagcactgtacgacaactgccccgactgctccgatgaactggctttctctcgcggtgacatcttaaccatcttggagcagcacgtgcctgagtctgagggttggtggaagtgtcttctgcatgggcgtcagggcctggcgcctgcaaatagactgcaaatactgacagaggtggccgctgaccggccttgcccaccatttctgcggggactcgaggaagcaccagcttcatctgaggaaacatatcaggtccctacactaccaaggccccctacacctggacctgtctacgagcagatgaggtcctgggccgaaggccctcagcctccgactgcccaggtgtacgaattccctgatcctccaacgtccgcgagaattatctgtgagaagacgctctccttccctaaacaggcgatcctgactctgcccagaccagtgagagcctcattgcccaccctgcctagccaggtttacgatgttccgacccaacatagagggccagtcgtgctgaaggagccagaaaagcagcagttgtacgatatccccgcatccccaaaaaaagccggtcttcatcccccagatagccaggcatcaggacagggagtgccactgatcagtgttaccacactcagacggggtggctacagcacactgcccaacccccagaagtccgaatggatttatgacacccctgtttcccccggaaaggcctctgtccgaaacacgcccttaaccagtttcgcagaggaatcaaggccacacgccctaccctcctccagttctacgttctataatccgccatctgggcgaagtcgcagtctgacacctcaactgaacaacaacgtgcccatgcagaaaaagctcagcctgccagagattccaagttatggtttcctagtccctcggggaacattccccctggatgaggacgtcagctataaggtaccatcctcattcttaattccaagagtggagcagcaaaatacgaagcccaatatttacgatatccctaaggcaacctcctcagtctcacaggcgggaaaggaactggagaaggcaaaggaggtgagcgaaaacagcgctggtcacaattcctcttggttctcgaggagaacgacctccccctcccctgagcccgacagactttccggatcatccagtgatagtcgggcttctatagtttcaagctgctcgacgaccagcactgatgactcttcatcctcaagctcagaagaaagtgctaaagaactctccttggatttggatgtggcaaaagaaacggtcatggccctgcagcacaaggtggtatcatccgtggccggtcttatgctttttgtgtctaggaagtggcgctttcgtgactatctcgaagctaatattgatgccatccaccgcagtacggatcacattgaggagagtgtgagggagtttcttgatttcgcgcgaggcgtccacgggacagcttgtaatttgaccgactcaaatctccagaatagaatccgggatcagatgcagaccatcagcaatagctataggatcctcctggaaaccaaagagagcctggataatagaaattggcctctggaagtcctggtaacagactcagtgcagaattcacctgacgacctggaaaggttcgttatggtcgctcgcatgcttcccgaggatatcaagagatttgcctccattgtcatagcaaatgggcgacttctttttaagcgaaactgtgaaaaagaggagacagtgcaactgactcctaacgccgagttcaaatgtgagaagtatatccaaccgccacagagagaaacagagagtcatcagaaatccaccccctcaacgaagcagcgggaggatgaacactcaagcgagctgctcaaaaagaacagagccaacatatgcggacagaacccaggcccattgatcccccaaccgtcaagtcagcagacgccagagcgaaagcctagactgtcagagcattgtagactgtacttcggcgctctgttcaaagccatctccgcatttcatgggagcctctccagctctcagcctgcagaaatcatcactcagtcaaaactggtcatcatggtcgggcagaagctagtagacactctttgtatggaaactcaggagagggacgtgcggaacgagattctgaggggctcatctcatctgtgttcgctgctcaaggatgtggcattggcaacaaagaacgcagtccttacgtatccctctcccgcagcactgggccacctgcaagcagaagccgaaaagttggagcagcacaccagacaattccggggtaccttgggttag

SEQ ID NO: 48787 - DNA, 2361 bp, Artificial Sequence
  Description of Artificial Sequence: Synthetic coding sequence
atgaaaggaaccggcattatggactgtgcccctaaggcactactcgccagggccctgtacgacaactgtcctgactgctcagacgaattggccttttcccggggagacatcctgactatcctcgagcagcatgtgccagaatcagaggggtggtggaaatgcctgctgcacggcaggcaaggcctggctccggctaaccggctacagatcctgacggaggtcgccgctgaccgcccatgtccgccatttctaagaggattggaagaagctccagcttccagtgaggagacctatcaggtgcccaccctgcctcgaccacccacccccggtcctgtctacgaacagatgaggtcctgggctgaaggccctcagccccctactgcccaagtgtatgagttcccagaccccccaacctccgccagaatcatttgcgaaaagacactgtctttccccaagcaggccattttgaccttgcctcgtccagtgcgggctagtctgccgactctgccaagccaggtttatgacgtgcccacgcagcatcgaggccctgtggtgcttaaagagccagaaaagcaacagctctacgatattcccgcaagccccaaaaaggcgggactccacccaccagacagccaggccagtgggcagggcgtcccactcatatcagtcacaacactcaggagagggggttactcaacactgccaaacccgcagaagtccgagtggatctatgatacccctgtgtcccctggaaaggcaagtgtgcgcaacacgccactgacctccttcgcggaggagtcccgaccgcatgccttgccttctagtagttcgacattctacaaccctcctagcggacgctcacggagcctcaccccccagctgaacaataacgttcccatgcagaagaaactgagtcttcccgagattccttcctacggcttccttgtgccccgaggaacattccctctcgatgaagatgtatcttacaaggtgcccagtagctttctaattcctcgcgttgaacagcagaacaccaaaccaaatatctacgacatacccaaagcgacaagctccgtctcacaggctggcaaagaattggaaaaagctaaggaagtcagtgaaaacagcgccggacataattcatcctggttctcccggaggacaacctcaccgagcccagaacctgacagactgtctggaagctctagcgatagtcgggcatcaatcgtttcatcctgtagtactacatccaccgacgactccagttccagcagttctgaggagtcagccaaggagctgtcattagatctggacgtggccaaggagacagtgatggcgttgcagcacaaagtcgtgtcttccgtggcgggactgatgctgttcgtttcaagaaagtggcgcttcagggattaccttgaggccaatatcgacgctattcaccgatctacagaccatattgaggagtcggtgcgtgagtttctggatttcgccagaggcgtgcacgggactgcatgcaacctcacggactctaacttacagaatcgcatccgcgaccaaatgcaaacaattagtaactcctatcggatactacttgagactaaggaaagcctcgacaatagaaactggccgttggaggtgctcgtgacagactcagtgcagaattctccagacgacctcgaacggtttgtgatggttgcacgaatgctgcctgaagatataaagaggtttgctagtatagtaatcgcgaacggcaggctcctcttcaagaggaattgcgaaaaggaggaaacagtacagctgacacccaatgcagaattcaagtgtgaaaagtatatccaaccccctcaacgggagactgaatcacaccagaaaagtactccctccacgaagcagagggaggacgagcatagttctgagttactcaagaagaatcgggcaaatatctgtggccaaaatcccggtcccttgattccccaaccatctagccagcaaacgcccgaacgaaagccccgactgtcggagcactgtcggttatactttggtgctctgtttaaagcaatctccgcattccatggatccctttcaagctctcaacctgcagaaattatcactcaatccaagctagttattatggtcggtcagaagctagtggacaccctttgcatggaaacacaggaaagagatgtgagaaatgagatcctgagaggaagtagccatctgtgctctctgctgaaagacgtcgctctggctacaaagaatgctgtcctgacttacccaagccctgcagccctgggacaccttcaggctgaagccgaaaaactggagcagcacaccagacagtttcggggtaccctgggttag

SEQ ID NO: 48788 - DNA, 1050 bp, Artificial Sequence
  Description of Artificial Sequence: Synthetic coding sequence
atgaaagggacagggattatggattgtgccccaaaagcattactcgcgagggccttgtatgacaactgcccagattgcagtgacgaacttgcattttctagaggagatatcctcactattctcgaacagcatgtccccgaatccgagggctggtggaagtgtcttctccacgggcgacagggactggcacccgcaaaccgcctgcaaatcctgaccgaagtggctgcagataggccgtgccctccctttctcaggggccttgaggaagctcccgcaagcagcgaagagacataccaggttcctaccctgccacgcccacccacgcctgggccagtttatgaacaaatgcgctcatgggcggaaggtccccagcctcccaccgctcaggtgtacgagttccccgacccacctacatcggctcgaattatctgtgagaagacgctatccttccctaagcaggctatattaacacttccgcgacccgttcgagctagtctcccaaccttgccttcacaagtctacgatgtgcccacacagcatagaggcccagttgtgttgaaggaacccgagaagcagcagctctacgatatccctgctagccccaaaaaggccggactgcacccacccgattcacaagccagtaatcctggcccattaatacctcaacccagctcacagcaaacacccgagcggaagcccagactgagcgaacactgccgcttgtatttcggtgcactattcaaggcaatatcggccttccatggaagcttgtcgtccagtcagccagcagagataatcacacaatccaaactcgtaataatggtggggcagaaattggttgatactttgtgtatggaaacccaggaaagagacgtacggaacgaaatccttcgcggatccagtcatctgtgttctctgcttaaggacgtagctctcgcaaccaagaatgcggtccttacatatcctagtcctgctgcactgggtcatcttcaggcagaagctgaaaaattggaacaacatactaggcagttccgcggtactcttggctag

SEQ ID NO: 48789 - DNA, 687 bp, Artificial Sequence
  Description of Artificial Sequence: Synthetic coding sequence
atgtcttcttccgaggaggtctcttggatctcatggttttgcggactcaggggtaacgaattcttctgcgaggttgatgaggattatatccaggacaaatttaaccttaccgggctcaacgaacaagtcccgcattacagacaagcccttgatatgattctggaccttgagcccgacgaagagttggaagacaaccccaatcaatccgacctcattgaacaagcagccgaaatgctatacggtctaatccacgccagatatatcctcaccaacagggggatagcccagatgctggaaaaatatcagcagggtgatttcgggtactgtcctcgcgtgtattgtgagaaccagcctatgctcccaatcggtctgagcgacatcccaggtgaggccatggtgaagttgtactgccccaagtgcatggacgtctatacaccaaagagctcacggcatcaccacactgatggtgcatactttggaaccggctttccccacatgcttttcatggtacatccggagtatcgccctaaaagaccagctaaccagttcgtgccttcatcctgctctcgacatccagatgtaccgctgctgccgagacgacggccattctgtaggatgcacttcagactgagagaagtatatcaccagcagttgattcccgtccatggagatcatcacctcttgtag

SEQ ID NO: 48790 - DNA, 1182 bp, Artificial Sequence
  Description of Artificial Sequence: Synthetic coding sequence
atgtacgcttggttcttcctgccatcgtttagccagtcgccacctaccttcggcttcctactggatatcgatggggtgctggtgagagggcatagggtgattcctgccgctttgaaggcgttcaggcggttagtgaacagtcagggacagctcagagtacctgtcgtgttcgttactaacgcgggaaatattctccagcactctaaggcccaggaattatcggcccttctgggatgcgaagtggatgccgaccaggttatcttatcccactctccaatgaagttattttccgaatatcacgagaaacgaatgttggtcagtggtcaaggccctgttatggagaatgctcagggcctcgggtttcggaatgtagtgaccgtcgacgagctccgaatggcttttccactcctcgacatggtcgacttggagcgccgactgaaaaccactccccttcctcgcaacgactttcccaggatcgaaggtgtgcttttactcggtgagcccgtaaggtgggagacatccctccagctgatcatggacgttctgctgagtaatgggtccccaggagcaggcttagcaacacctccatatccccacctccccgtgctggcctccaatatggatttattatggatggcagaagccaagatgccaaggttcggccatggaactttcctgctgtgtcttgaaacaatttatcagaaagtgaccggtaaggagctccgctacgaagggctcatgggaaagcctagtatattgacataccagtatgccgaagacctaatccgaagacaggcagagaggcggggttgggccgctcctattaggaaactgtacgccgtgggggataatccaatgagcgacgtatacggagccaatctgtttcaccagtacctgcagaaggctacacatgacggagcccctgagctcggggctgggggaactcgacagcagcaaccttctgcaagtcaatcgtgtatctctattcttgtctgcacaggagtctataatccaagaaatccccagtccactgaacctgtgctagggggaggagagcccccttttcacggtcatcgcgacttgtgttttagtcccggactcatggaggcgagccatgttgtaaatgacgtaaacgaagcagtgcagctagtgttccgcaaggagggatgggctctggagtag

SEQ ID NO: 48791 - DNA, 1272 bp, Artificial Sequence
  Description of Artificial Sequence: Synthetic coding sequence
atggctgcatggggatgtgtggccgcactgggcgcagctagggggctgtgttggagggctgcccgtgcagcagcaggtttgcaggggaggccagcacgcaggtgctacgcagtggggccagcgcagagcccacccactttcggctttctgttagatattgacggcgttctggtccgcggacatagagtgatccccgcagccctgaaggcattcagacgcctcgtgaactctcagggccagctgagggtgcccgtggtctttgtgacaaacgcaggcaacatccttcagcattccaaggcccaggaactttcagccctcctgggttgcgaggtagatgccgatcaggttatcctgagtcattcccccatgaagctgttttcggagtaccatgaaaagagaatgctggtctcggggcagggtccggtgatggagaacgcccaaggactcggcttccggaatgtcgtgaccgtcgatgagttgaggatggccttccccctgcttgatatggtggatctcgaacgaaggttgaaaaccactccccttccacgcaacgactttcccagaatcgagggagtgctgcttctgggggagccagtgaggtgggagacctccttacagttgatcatggacgtactcctgagcaacggatcacccggtgccggactcgctactcctccataccctcacctccccgtgctggcctcgaacatggatttgctttggatggctgaagccaagatgccccgttttgggcatggaacttttctgttgtgtctggaaactatttatcagaaggtgaccgggaaggaacttcgatacgaggggctgatgggcaagccatctatcttaacttatcagtacgccgaagaccttataagacgacaggccgagaggaggggttgggctgcccctattagaaaattgtacgcagttggggataatcccatgagcgacgtttatggcgctaacctttttcaccaatatttacagaaagctacacacgacggcgctccggagctgggtgccggaggcactagacaacaacagccaagtgccagccagtcatgcatctccatcttggtctgcacgggggtgtacaatccacgtaacccccaaagtactgaacccgtcctcgggggaggggaaccaccatttcacggccacagagacttgtgcttctcccctggcttgatggaggccagtcacgtcgtaaatgacgtcaacgaggccgtccagctcgtgtttcgcaaagaaggctgggcacttgagtag

SEQ ID NO: 48792 - DNA, 789 bp, Artificial Sequence
  Description of Artificial Sequence: Synthetic coding sequence
atgactcaacccgttccacggctttccgtgcccgcagccctcgccctcgggtctgccgcattgggagcagctttcgctacaggactcttcttgggtaggcggtgccccccatggcgcggtcgccgtgagcagtgtttgttgccccctgaggattcccgcctctggcaatacctgttatccagatccatgagagagcatccggctctgcgcagtttacgcctgttgactttagaacaaccccagggggactcgatgatgacctgtgagcaagctcagttactcgcaaatttggcgcgtttgatccaagctaaaaaagctctggacttgggcacatttactggctattccgcccttgctcttgctctggcccttccagctgacggaagggtggtaacctgtgaggtggatgctcaacctccagagttgggacgcccattgtggcgccaggccgaagccgagcataagattgatcttcgccttaaacctgcattggagacgctggacgaactcttggccgctggggaagctggcaccttcgacgtggcagttgtggatgcagataaagagaattgttcagcgtactatgagcgatgtcttcagctccttagaccaggtggcatactggcggtcctgcgggtgctgtggaggggaaaggtgctgcaacctccaaagggcgacgtggccgcagaatgtgtgcggaacctcaacgaaagaataaggagggatgtgagggtgtacatctcgctgttaccgctcggggatggactgaccttggccttcaaaatctag

SEQ ID NO: 48793 - DNA, 864 bp, Artificial Sequence
  Description of Artificial Sequence: Synthetic coding sequence
atgacgcagccagtgcccaggctatccgtgcctgccgctttggccctcggttccgctgcacttggagccgcttttgctacggggctgtttctgggccgacgctgcccgccatggaggggcaggagggagcagtgcttgctgccccctgaagactcacgtctctggcagtatttgctcagtagatcaatgagagaacaccccgctcttcgttccctgcgcctcctcaccttggagcaaccccagggcgattcgatgatgacctgtgaacaggcccagctcttggctaatttagctaggctgatccaggccaaaaaggctctggatctcggcacattcacggggtatagcgctctggctctggctctagctttgcccgcagatggacgtgtcgtgacatgcgaagtggatgctgggcgtgggggagcacaagacaggccgccagcagaggcccgtcttggcgatcccggacgggctgccggagggggacgaggcagacatctgagacgcggtaggggtggatgcgggcagggggagctcctgcgcctgctccgggctctccctgccgctgctgcgactagaaggcaccccaggagaccacaatctcccgttgctagggagggggcagccacatctgaacggggtagagggggacgagtctgcgcaaagccgaaaagaacgcatcccgcagggagacagggcctccaccagccgcctgcccctggccgatggacacacttgggcctgcaggatctcggcttggccccttctgaatgggccaggggcagggtggcttgggagccgcaggagctcaccctgagttttaaatttgagaacaaggtgggattgggacatacaacatcttag

SEQ ID NO: 48794 - DNA, 966 bp, Artificial Sequence
  Description of Artificial Sequence: Synthetic coding sequence
atggacgtgcgggcattgccatggcttccgtggctactatggctcctctgtagaggcggaggggatgcggacagtagggcgccttttactccgacatggcccagatctagggaacgcgaagcggctgcctttagagaatccctgaataggcatcggtacttgaatagtttattcccctcagaaaactcaacagctttctacgggatcaaccagtttagttatttgtttcctgaggaattcaaagctatttacctgcgctcaaaacccagcaaatttccaaggtactcagcagaggtgcatatgtcaatccctaatgtgtctctgccactccgattcgactggagagacaagcaagttgtgactcaggtgagaaatcaacagatgtgcggtggatgctgggccttttctgtcgtgggtgccgtggagtccgcatacgctataaaaggaaagccccttgaggatctgagcgtccaacaggtgatcgactgctcctataacaactatggctgcaacggaggtagcacactcaacgctttgaactggttaaacaagatgcaggttaagcttgtcaaggattcagagtatccattcaaggcacagaacggcttatgccactatttttccggaagtcacagtgggttttctattaaggggtacagcgcctacgacttttcagaccaggaggacgaaatggccaaggctctccttaccttcgggcctctggtggtaattgtggacgctgtgtcttggcaggactatctggggggaatcatccagcaccactgtagttcaggagaagccaaccatgcagtattgatcacagggtttgataagacaggcagcactccctattggatcgtccgcaattcttggggatcgtcctggggtgttgacgggtatgcgcatgttaagatgggtagtaacgtgtgtggaattgcagacagcgtttcttccatcttcgtgtag

SEQ ID NO: 48795 - DNA, 1593 bp, Artificial Sequence
  Description of Artificial Sequence: Synthetic coding sequence
atggctgcgtaccagcaggaggagcagatgcagcttcccagggccgacgctatcaggagccgtctcattgataccttttccctcatcgagcacctacaaggtctttctcaggccgtgccccgtcacaccatcagagagttgctggatcccagtaggcagaaaaaactcgtcctgggggaccagcaccaattggtgaggttttccattaaacctcagcgaatagaacagatctctcacgcccagcgattgctgtctcggctccatgttcggtgttcccagaggccaccactcagcttgtgggcgggatgggtactggaatgtccactgttcaagaactttattatattccttgtattcctcaataccataatccttatggtggaaatcgaattactggagagtacgaacacaaaactctggcctcttaagctgactctcgaggtagccgcatggttcattctgctgatctttatccttgaaatcttactgaaatggctctccaacttctccgttttctggaaatctgcctggaacgtctttgacttcgtcgttacaatgctctctctccttcccgaagtagtcgttcttgtcggtgtaaccggtcagtctgtgtggcttcagctgcttagaatatgccgagtgctgcgttccttgaagctcttggcccagttcaggcagattcaaataatcattttagtgttggttcgcgcactaaagtcaatgacttttctgctgatgctgctgctgatctttttttacatcttcgcagtcacgggggtctatgtgttttccgaatacacccgcagcccgaggcaagacctcgagtaccacgtgtttttttctgacctgccgaactctctggtaactgtttttattctgttcacactcgaccactggtacgccctgttgcaggatgtgtggaaggtcccggaggtgagcaggatttttagctctatctacttcattctttggttgcttctgggaagtataatctttcggtctattattgttgctatgatggtgacaaacttccagaacataagaaaggagctgaacgaggagatggcacggcgagaggtacaactgaaagccgatatgtttaagcgccaaattattcagagacggaaaaacatgagtcatgaggcactcacatcctcacactctaaaattgaggactccagccgcggagcatcccaacagagagagtccttagacttgagcgaagtcagcgaggtggaatccaattacggtgccacagaggaggatctgatcacttctgcatcgaaaactgaggagactctgtccaagaagcgcgaatatcagtcctcctcctgcgtcagcagtacttcttccagttatagcagctcctctgaaagccgcttttctgagtctattgggcgtctggactgggagactctggtgcatgagaacctgcccggtttaatggagatggaccaggatgatcgggtttggccaagagactcactgttcaggtatttcgagttgctggaaaagctgcagtacaacctggaggagcggaaaaaactgcaggagtttgctgtgcaggccctcatgaatttggaagataaatag

SEQ ID NO: 48796 - DNA, 1593 bp, Artificial Sequence
  Description of Artificial Sequence: Synthetic coding sequence
atggctgcttaccagcaagaagagcagatgcagctgcctcgggcagacgctattcgttcccggctgatagatacattctctctgatcgagcacctgcagggcctgagccaggcagtcccacgacacactattagagagctgctggatccctcaagacagaaaaagctggtgttaggcgatcagcatcagctggtccggttttccattaagcctcaacggatcgaacagatctctcacgcacagcgcctactcagtcgcctccacgtgcgctgctcccaaaggccacccctgtccttatgggccggatgggtgctggagtgtccgcttttcaaaaattttattatcttcctcgtctttctcaacactatcattctcatggtcgagatcgaactgctggagtccaccaacaccaagctttggcctcttaagctgacactggaagttgctgcatggttcatcctacttatcttcatcctggagattctgctgaaatggcttagtaactttagtgtgttttggaagtctgcctggaacgtttttgattttgtggtgacgatgctgtccctactccccgaggtggttgtcctggtaggcgtgacgggacagagcgtctggctccagctcctcagaatttgcagggttttaaggtcccttaaactcctcgcacagttcagacagattcagatcatcatcctcgttctggtacgagccctaaagtcaatgacttttctgctgatgctgcttctcatcttcttctatatcttcgccgttactggagtgtatgtgttcagtgaatatacacgcagccccagacaagacctagagtatcacgtgttcttcagcgatcttcctaacagcctagtcaccgttttcatcctcttcacactggaccactggtacgccctgctacaggatgtatggaaggttccagaagtctcacgcattttcagtagcatctatttcatcctgtggctgctgctgggctccatcattttccgctccatcatcgtagccatgatggtcacgaacttccagaacattagaaaggagctaaacgaggagatggcacgtcgggaggtccaactcaaggcggatatgtttaagagacaaattatccagcgaaggaaaaacatgagtcacgaagctcttacgagttctcacagtaaaatcgaggactcgtcaagaggcgcatcccagcagcgggaatccctagacctgagcgaagtgagcgaggtggagagcaattatggcgcaaccgaggaagatctgatcacctcagcatccaaaacagaggagaccctgtccaaaaaacgcgagtaccagagctcttcatgcgtcagctcgacaagcagcagctatagttcttctagcgaaagtagatttagcgagtcgattgggaggttggactgggagaccctcgttcacgagaacctcccaggcctcatggagatggatcaggatgacagggtttggcccagggattcactgttcaggtactttgagttactggaaaagttacagtacaacctggaagagcgaaaaaaacttcaagagtttgccgtgcaagccctgatgaacctggaggacaaatag

SEQ ID NO: 48797 - DNA, 1587 bp, Artificial Sequence
  Description of Artificial Sequence: Synthetic coding sequence
atggcggcttatcagcaagaggaacagatgcagctccctagagcggatgccatacgatccagactcatcgacaccttctcattgatcgagcatttgcagggcctgagccaggcagtccccaggcatactatccgggaactgcttgatcccagcagacagaaaaagctcgtgctgggggaccagcaccaactcgtgaggttcagcattaagccgcagcgcatagagcaaatcagccatgcccaaaggcttctgagccggctgcacgtccgctgtagtcagaggccacccctgagcctctgggctggctgggtgctcgaatgcccactatttaagaatttcatcatcttcctagtgttcctcaataccatcattctgatggtggaaattgaattgctggaatcgaccaataccaagctgtggccacttaaactaactctggaagtcgccgcttggtttatcctgctgatcttcatcttggaaatccttctgaagtggctctcaaatttttccgtgttctggaaaagtgcttggaatgtctttgatttcgtggtgacaatgctttcattgctgcctgaagtcgtggtcctcgtcggtgttacagggcaatccgtctggctccaactgctcagaatttgccgcgtgctaaggtctctcaagcttctggctcagtttaggcagatccagatcatcatcctcgttctagtgcgggcactgaagtctatgacatttttgttgatgctgctgctcatcttcttttatatatttgccgtgaccggagtctacgttttttccgagtatacccggtcaccgaggcaggatctggaataccacgtcttctttagtgatctgcctaactctttggtgacagtctttattcttttcaccctcgatcactggtatgctcttctgcaggatgtgtggaaggtgcccgaggtgtcccgaattttctcctccatttacttcattctttggctcctcctgggatcaatcatttttagatcaatcatagtcgccatgatggtgactaactttcaaaatattcgaaaggagctgaacgaggagatggcacgtcgggaagtccagctaaaagctgatatgtttaaaaggcagatcatccagcgccgaaagaatatgagccacgaggccttaacgtcttcccactccaagattgaagatcggggagccagccagcagagggaaagcctggacctgagcgaagtgagtgaggtcgaatcgaattacggcgctacagaggaggacctcatcacctcagcttccaagacggaggagactttgtccaagaagcgggaataccagtcatcttcatgtgtgagtagcacttctagctcctatagttcaagctccgaatcccggttctctgaatctatcgggaggctcgactgggagacccttgtgcacgagaacctcccgggactcatggaaatggaccaggatgacagggtgtggcccagggatagtctctttagatatttcgaacttctcgaaaaactgcaatacaaccttgaggagcggaagaaacttcaggagttcgcagtgcaggcactgatgaatcttgaggacaaatag

SEQ ID NO: 48798 - DNA, 1245 bp, Artificial Sequence
  Description of Artificial Sequence: Synthetic coding sequence
atggccgcttaccagcaggaagagcagatgcagctccctcgtgctgacgctatccgctctcggctgatcgacaccttttctttgatagaacatctgcagggcctgagccaggcagtgcctcgccatacaatacgggaattactagacccctcgaggcagaaaaagttagttctaggcgaccagcaccagttagtcagattctcgatcaagccccagcgcatcgaacagatctcgcatgcccaaaggctactgtccagactgcacgtgcggtgtagccagcggcctccacttagtctatgggccggttgggtgcttgaatgtcccctcttcaaaaacttcatcatattcctagtgtttctgaacaccatcatactaatggtggagatagaactgcttgaatccactaacactaagctctggcccctgaagctgacgctcgaggtggcagcctggttcatcctactgatcttcatactggaaatcctgctgaaatggctgagcaattttagtgtgttttggaaaagcgcttggaatgtgttcgattttgtggtaacaatgttgagcctgcttcctgaagtagtagtcttggtgggagtgaccgggcaatccgtttggctccagctgctcagaatatgccgcgtgcttagatccctgaagttgttggcccagttccgccagatccagatcatcatcctcgtgttagtgagagccctgaagagcatgactttcctgctcatgttgctgctaattttcttttacatctttgctgtcacaggagtgtacgtgttcagcgagtacactcggagcccacgccaggatctcgaataccacgtgtttttttctgatttacctaactctcttgtgacagtctttatcctcttcacacttgaccattggtatgcccttctccaggacgtttggaaggtccccgaggtgtcaaggattttttctagcatatacttcatcctttggctgttacttggatcaattattttccggtctatcatcgtagccatgatggtaaccaactttcagaacatccgcaaggagttgaacgaggaaatggccaggcgcgaagttcagcttaaggcagatatgttcaagaggcagattatccaaaggaggaaaaacatgtcccacgaggctctgacaagttcgcactctaagatcgaggacagaagcttcggcctgggggatagttgcgccaggaaaagcgcccgagctaacggcaatggctctggctag

SEQ ID NO: 48799 - DNA, 1587 bp, Artificial Sequence
  Description of Artificial Sequence: Synthetic coding sequence
atggcagcataccagcaggaagagcagatgcaactgcccagggccgacgcgatcaggtcgcgcctgatcgacacattctctctgatcgagcaccttcagggactgagccaggctgttccgagacatactataagggagcttttagatcctagtcgccaaaaaaaactggttctgggggaccagcaccagcttgtcaggttcagtatcaaacctcaacgaatcgaacagatctctcacgctcaacggctcctgagcaggcttcacgtccggtgtagccagaggccacccctgtccctgtgggccggatgggtcctggagtgccctctgtttaagaacttcataatctttctcgtgttcttaaacaccatcatactgatggtggagatcgagttactcgaaagtaccaacaccaaattatggccccttaagctaaccctggaagtagccgcttggttcatacttctgatttttatcttggaaattcttctgaaatggctgtctaatttcagtgttttctggaaatccgcctggaacgtctttgacttcgtggtaacaatgctgtccctgctcccggaagtggtggtgctggttggggtcaccggacaatcggtctggttgcagttgctcagaatttgtcgagtgttgagatccttgaagttgctcgcacagttccgacagatccaaatcatcatcctggtcttggttagggcgttgaagagtatgacttttctgttgatgctactgttgatcttcttttacatttttgccgtcactggcgtgtacgtctttagtgagtacactcgaagccccaggcaagacctggagtaccatgtctttttttccgatctgcccaattcgctggtgacagtttttatccttttcactctggatcactggtacgctcttttacaggatgtctggaaggtgcccgaagtctccaggatctttagttctatatacttcatcttatggctgctgctgggaagcataatttttagatctatcatcgtggccatgatggtaacaaacttccaaaacattcgtaaagaacttaacgaagaaatggcacgccgagaggtccagcttaaagcagacatgttcaaacgccagatcattcagcggcgtaaaaatatgagccatgaggctctgacctccagccatagcaagatagaagacagaggagcttcccagcaaagagagagtctcgacctgagcgaggtgtccgaggtcgaaagtaattacggggctaccgaggaggacctaattacgagcgccagcaaaaccgaagagacactttcgaagaaacgcgaatatcagagcagttcatgtgttagtagtacttctagcagttatagttcctccagcgagtctcgattcagcgaatctataggcaggctggattgggaaactctagtccatgagaacttgccgggtctgatggagatggatcaggacgatagagtatggcctcgggacagtctcttccgctattttgagctgctggagaaactgcaatacaacttggaagagaggaaaaagctccaagaattcgctgtgcaggcactaatgaatttggaggacaaatag

SEQ ID NO: 48800 - DNA, 195 bp, Artificial Sequence
  Description of Artificial Sequence: Synthetic coding sequence
atggctgcctaccaacaggaagaacagatgcaacttcccagggccgacgctattagaagtcgtctcatcgacacatttagcctcattgagcatctgcagggactgagccaagcagtgccaaggcacacgattcgtgaactcttggaccccagccgccagaaaaagctggtgttgggggaccagcaccaactttag

SEQ ID NO: 48801 - DNA, 147 bp, Artificial Sequence
  Description of Artificial Sequence: Synthetic coding sequence
atggcggcatatcaacaggaagaacaaatgcagcttcccagagcagacgcaatcagatcgcgactgatcgacacattttccctgatcgagcatttacaggggctgagtcaggctgtgcctcggcatacaatccgtgaactgctgtag

SEQ ID NO: 48802 - DNA, 243 bp, Artificial Sequence
  Description of Artificial Sequence: Synthetic coding sequence
atggctgcctatcagcaagaagagcagatgcaattgccccgagccgatgctatccgcagtcgactgattgatacattttccctgatcgaacacctccagggactgtcacaggccgttccgagacataccatcagagagcttctggaccctagcaggcagaaaaaattggtgctcggtgatcagcatcagctcgtgagattcagcattaagcctcagcgtattgagcaaataagccatgcctag

SEQ ID NO: 48803 - DNA, 1449 bp, Artificial Sequence
  Description of Artificial Sequence: Synthetic coding sequence
atggctgctgcagccgcaggcgcaggctctggaccgtgggccgcacaggagaaacagttccccccagctctgctgtcgtttttcatctacaacccccgattcggacccagagaaggccaggaagagaataagattctattctatcacccaaatgaagttgaaaagaatgaaaagatacgcaacgtgggcctctgcgaggccatcgtccagtttacacggaccttctccccgtctaaaccggcaaagagcctccatacccagaaaaaccggcagtttttcaacgagccagaagagaacttctggatggtaatggttgtacgaaatcccattatcgagaaacagtcaaaagacggaaaaccggtcattgaatatcaggaggaggagctgttggacaaggtctatagctcagtccttcggcagtgctattcaatgtataaactgtttaatgggaccttcctaaaggctatggaagacggaggcgtgaaactcctgaaagaacgcttagagaagtttttccaccgctacctccaaaccctgcacttacagtcctgtgacctgctggatattttcgggggtatttccttttttcccttggataagatgacatatttgaaaatccagtcattcatcaatagaatggaagagtctctcaacatcgtgaaatatacggcattcctttataatgatcagctcatctggtccgggttagagcaggacgacatgcgaatcctatataaatacttgactacttccctgtttccacgtcatatcgaacccgaactggcgggtcgcgactctcctattcgggctgaaatgcctggaaatctgcaacactatggcaggtttctgacaggcccactgaaccttaacgaccccgatgccaagtgccggtttccaaaaatcttcgtgaatacggatgacacttacgaggaactgcacctgatcgtgtacaaggcaatgagcgcagccgtgtgctttatgattgatgcaagcgtgcacccgaccctggacttttgcaggcgcctagacagcatcgtgggcccacagctcaccgtgctggcctctgatatctgcgaacagtttaatattaacaaaaggatgtctggtagtgagaaggaaccacagtttaaatttatctattttaatcacatgaatttagcagagaagagtaccgtccatatgaggaagacgccatccgtttcattgactagcgtgcaccccgacctgatgaagatcctcggtgacatcaacagcgacttcacccgcgtggacgaagatgaggaaataatcgtgaaagccatgtcagactattgggtcgtggggaaaaagtctgacaggcgggaattgtacgttattctgaaccagaaaaatgcaaatctgattgaggtgaatgaggaggtgaagaaactttgcgctactcaatttaacaacatcttctttctggattag

SEQ ID NO: 48804 - DNA, 1020 bp, Artificial Sequence
  Description of Artificial Sequence: Synthetic coding sequence
atgtataagttgtttaatggcacctttctgaaagccatggaggatggcggagtgaaattgttaaaagagagattggagaagtttttccacaggtacctccaaaccttgcatttgcagtcctgcgatttactggatatctttggaggaatctcctttttccctctggacaagatgacatacttgaagattcaatctttcataaatcgcatggaggagagtttgaatatcgttaagtatacggcatttttgtacaatgatcaactcatttggtctgggctagaacaggatgacatgagaatcctgtacaagtatctcacaacctcactctttccccgacatatcgagccagaactggctggcagagattctcctataagggccgagatgcctgggaacctacagcactacggacgttttttgaccggccctttaaacctcaacgatccagacgcgaagtgtagattccctaagatattcgttaacacagatgatacctacgaagaattgcacctcatcgtctacaaagctatgagtgcggctgtgtgttttatgatcgacgctagcgtgcacccaaccctcgacttttgcagacggttagattctatcgttggtccacagttgacagtgttagccagcgatatttgtgaacagtttaacatcaacaaacggatgagcggatccgagaaagaaccccagttcaaattcatctactttaaccatatgaacttggcagagaagagcactgtgcatatgagaaagaccccaagcgtgagcctgactagcgtgcatcccgatctcatgaaaatccttggagacattaattccgacttcacccgcgtggacgaagatgaggaaattattgtcaaagcaatgtcggattactgggtcgtgggcaaaaaaagtgacaggcgagaactgtacgtgatacttaaccaaaaaaatgctaacctgattgaggtcaatgaggaggttaagaagctttgcgccactcagttcaataatattttcttcttagattag

SEQ ID NO: 48805 - DNA, 1449 bp, Artificial Sequence
  Description of Artificial Sequence: Synthetic coding sequence
atggctgccgctgccgctggggctgggtccggcccttgggcagcccaagagaaacagtttccccctgctcttctaagttttttcatctacaatcccaggttcggcccacgtgagggacaggaagaaaacaagatcctgttttaccatcccaatgaagttgagaagaatgagaagatcagaaacgtgggtttatgcgaagctattgtgcagttcacacgcacattttctccaagcaagcccgctaagtcgcttcacactcaaaagaacagacagttctttaatgaacctgaagagaatttctggatggttatggtggtgcgtaatcccatcatcgaaaagcagagcaaagatggcaaacccgtgatcgagtatcaggaagaagagttattggacaaagtgtatagtagtgtgcttagacagtgttatagcatgtataagttatttaacggcacgtttctgaaggccatggaagatggtggcgttaagctcctcaaagaacggctggaaaaattcttccaccgctacctgcaaactttgcaccttcagtcatgtgatctgttggacatctttggaggcatctccttcttcccactagacaagatgacttaccttaagattcaatcattcataaatagaatggaagaatcactgaatatcgttaaatacaccgccttcctgtacaacgaccagttaatctggtcagggctggagcaggatgacatgcggattctttataagtatctgacaacatctttattcccaaggcacatcgaacccgaactggccggtagggatagcccgattcgcgcagaaatgcctggcaacctgcagcactacggcagatttcttacggggccactgaatttgaatgatcctgacgcgaagtgtaggttccctaaaattttcgtgaacactgacgacacatacgaggaactgcacctgatcgtatacaaggccatgtctgctgccgtgtgttttatgatagacgcctccgtccatccaacactcgacttctgccggaggctggactctatcgttggaccccaattgacagttctagcatcggacatttgcgagcagttcaatatcaataagagaatgtccggcagcgagaaagaaccccagtttaaatttatttactttaaccacatgaacctggcagagaagtccactgtgcacatgcggaaaactcccagtgttagtctcacctccgtacatcccgacctgatgaaaattcttggcgatatcaatagcgattttactcgggtggacgaagatgaagagataattgtgaaggccatgtctgattactgggtcgtcggtaaaaaatccgatcgcagggagctttatgtgattctgaaccagaagaatgccaacctcattgaagttaacgaggaggttaagaaactgtgtgccacacaattcaacaacatctttttccttgattag

SEQ ID NO: 48806 - DNA, 1020 bp, Artificial Sequence
  Description of Artificial Sequence: Synthetic coding sequence
atgtataagcttttcaacggcactttcctcaaggccatggaagatggcggagtgaaacttctcaaggaacgtttagaaaagtttttccatagatatctgcagactctgcatctgcaatcatgtgacctgttggatatctttggtggcatcagcttctttcctctggataaaatgacatatctcaagatccaaagcttcatcaatcgcatggaagagtctctgaatatcgtgaaatacacagctttcctgtacaatgaccaattgatttggagcggtttagagcaggacgacatgagaatattatataaatatttgaccacttcgctattccctagacacattgaacctgagcttgcaggcagggactcgcccattcgagccgagatgcccggtaatcttcagcactacggcaggttcctaaccggcccattaaacctgaacgatcccgatgcgaagtgtcgcttcccaaaaatcttcgtgaacaccgacgacacttacgaagaactgcatttaattgtgtataaagccatgagcgccgcagtctgctttatgattgatgcctccgtgcaccctactttagatttctgcaggcgcttagactctatcgtggggccacagctgacagtcctcgcctctgacatttgcgagcaatttaacattaataagcggatgtcaggcagtgagaaagagccacagtttaaattcatctattttaatcacatgaatctggctgaaaaatcaactgtgcatatgagaaagacgccatcagtgtcgctgacatcagtccacccggaccttatgaaaatactgggagacattaatagcgacttcaccagagtggacgaggatgaggaaataatcgtaaaggcgatgtccgactattgggtcgtcggtaaaaaaagcgacaggagggaattgtatgtgattctcaatcagaaaaacgccaaccttatagaggtcaacgaggaagtcaagaaactatgcgctacgcagttcaataacatttttttcctggattag

SEQ ID NO: 48807 - DNA, 3066 bp, Artificial Sequence
  Description of Artificial Sequence: Synthetic coding sequence
atggccggtatctcttacgtcgcaagttttttcctgttactgaccaagctctctatcgggcagcgagaggtcaccgtccaaaagggaccattgttccgagcggaggggtatcccgtgtcaattgggtgcaatgtgaccggacatcagggacccagcgagcagcactttcagtggagtgtctatctgcccactaaccctacacaggaagtgcaaatcatctcaaccaaagatgcggcattcagttacgccgtgtacacacagagagtgcgctccggcgatgtctacgtggagcgagtgcagggaaactccgtcttactacacatttctaagctgcagatgaaggatgctggcgaatacgagtgccacacacctaacacagacgagaagtactacgggtcatactccgctaaaacaaatcttattgtgataccagacacactgagtgccactatgtcttcccagacgctcggaaaggaagaaggagaaccgctcgcactcacttgcgaagcttccaaagcaaccgcgcagcacactcatctgtccgtgacatggtatctgacccaagacggcggtggatctcaggccaccgagattataagcctctccaaagattttattctagtgcctggaccactctatactgagcgattcgctgcctcggatgtacagctgaataaactgggaccaactacgtttaggttgagcatagaacgcctgcagtcatccgaccagggccaactgttctgcgaggccaccgaatggatccaggaccctgatgagacctggatgttcattaccaaaaaacagactgaccaaacgactttgaggatacagcccgcagtcaaagacttccaggtgaatatcacagccgacagcttgttcgccgaaggaaagccgctggagcttgtgtgtcttgtggttagcagcggtcgggacccgcagttacaaggaatctggtttttcaatgggactgagatcgctcacattgacgccggaggggtgctgggtctaaagaatgactataaagaacgcgcttcccaaggagaactccaggtgtccaaactaggccctaaagcattcagcttgaaaattttctccctgggcccagaagacgagggggcataccgctgcgtggtcgcagaggtgatgaagacgcggaccggctcctggcaggtcttgcagcgcaagcaaagtcccgatagtcacgtccacctgcggaaaccagcagcaaggagcgtggtgatgagtactaagaacaagcagcaagtcgtttgggagggcgagaccctcgcatttctctgcaaggctgggggagccgagtccccgcttagcgtgtcctggtggcatatccctcgcgatcagacccagccagagttcgtcgcaggcatgggtcaggatggtatagtgcagttaggagcatcatatggggtcccaagttatcacggcaacactcgcctggagaagatggattgggctacgtttcaactggagatcaccttcactgctatcacagattccggaacctacgaatgcagagtctcagaaaaatctagaaatcaggccagagatttatcatggacccagaagataagtgtcacagtgaaaagcttggaatccagcctgcaggtgagccttatgagccggcagccacaggtgatgttgacaaacactttcgacttatcttgtgtggtcagagctgggtactccgacctgaaggtacctcttacagtcacctggcagtttcagcccgctagttctcacatctttcaccaattgattcgcataactcacaatggaaccatcgagtggggcaactttttgtccaggttccagaaaaagaccaaggtgtcacagtctctctttcgcagtcaactcctggttcatgacgccactgaggaggagaccggtgtgtaccaatgtgaagtggaagtttatgatcgcaatagcttgtacaacaaccgccctccgcgagcctccgcaatatcacacccgttgcggattgcggtcaccctccccgaatccaagctgaaggtaaatagtcgttctcaggtgcaggagctatctatcaactccaatacggatatcgaatgctctatactgagccgatccaacggtaacctacagctggccattatttggtacttctctccagtttctacgaacgcgtcttggctgaagatcctggaaatggaccagacaaacgtgataaaaaccggagacgagtttcatactccacagaggaagcagaagttccacacagagaaagttagccaggatcttttccagctgcacattctgaacgtggaagactctgatcggggaaagtaccactgcgcagtggaggagtggctcctgtctacaaatggaacctggcataaactaggcgagaagaagtccggcctgactgaattgaagctgaagcctaccggcagcaaagtgcgtgtctccaaggtttattggacagagaatgtaactgaacacagggaagtggcgattaggtgtagccttgaatcagttggttcaagtgctacgctgtatagtgttatgtggtattggaaccgcgagaactcaggcagcaagcttctcgtgcatctgcaacacgacgggctacttgaatacggggaagagggactaaggagacacctgcattgctatcggagcagctctactgattttgttctgaagttacaccaggtggagatggaggacgcaggaatgtactggtgcagagtggctgaatggcagctgcacggccacccctctaaatggataaatcaagcttccgacgagtcccaacggatggttttaaccgtgctgccttctgagcctacccttccgtcaaggatctgctcttccgcccctcttttatacttcctgtttatctgtccatttgtgttgttactactcttgctcatcagcttgctttgcctctattggaaagcacgcaaactcagtaccctgcggagtaataccagaaaagaaaaagccctgtgggtggacctgaaggaggctggtggggttacgactaacagaagagaagacgaggaggaagacgaagggaattag

SEQ ID NO: 48808 - DNA, 3066 bp, Artificial Sequence
  Description of Artificial Sequence: Synthetic coding sequence
atggccggaatcagctacgtcgctagtttctttctgctacttacaaagctgagcataggccagagagaggtgactgtgcagaagggtccactcttcagggcggagggttatcccgtgtcgatcggctgtaatgttacaggacaccaaggccctagcgaacaacactttcagtggtctgtctatttgcctaccaatcctacacaggaagtccaaataatcagtacaaaagatgcagcattttcctatgcagtctatacccagagagtgcgttcaggggatgtgtacgtggagagagtgcagggcaattcggtcctgctccatatttccaaactgcagatgaaggatgccggtgagtatgagtgccacaccccaaacactgacgagaaatattacgggtcttacagcgcaaagacaaacttgatagtaatccccgataccctgtccgcaaccatgtcctcacagaccctgggcaaagaggagggtgaacctctggccctgacatgcgaggcctccaaggcaacagcacaacatacccacctctccgtcacatggtacttaactcaagacggcggtggttcccaggctacggaaatcattagcctgagcaaagacttcatcctggtgcctgggccactttatactgaacgctttgcagcctccgatgttcagctaaacaagctgggacctactacttttagactgtccattgagaggctccagtccagcgatcaaggccaactcttctgtgaagcgacagagtggatacaagatccagacgagacctggatgttcatcacaaaaaagcagaccgatcaaactacccttcggatccagcctgcagtcaaggacttccaggtgaacatcactgctgattccctctttgcagagggaaagcctcttgaactggtctgcttagtggtgagtagcggtagggatccacagctccagggcatctggttctttaatggtacggaaatagcccacatagacgcaggaggtgtgctcggcttgaagaacgactacaaagagcgagcttctcagggggaacttcaggtgtcaaagctcggtcccaaagctttcagtttaaaaattttttcactcggacctgaagatgagggggcatatcgatgcgtggtggcagaggtaatgaagacccgtaccggtagttggcaggtgctgcagaggaaacagagccctgactctcacgtacatcttagaaagcccgctgctcgctccgtggtgatgtcgactaaaaacaagcagcaggtggtctgggagggagagacattggccttcctttgcaaggctggaggcgctgaatctccgttatcggtgtcatggtggcatataccgcgagaccagacccagcctgagtttgtagctggaatgggacaagacgggatcgtccagcttggggcttcgtacggagtgccatcttatcatggtaacactcggttggagaagatggactgggccacattccagttagagatcacttttacagctatcaccgattctggcacatacgagtgtcgtgtgtctgagaaatcccggaaccaggcaagagatctgtcctggacccagaaaatttccgtgacagtgaaaagcctcgaaagtagtcttcaagttagtctcatgagcagacagcctcaggtcatgttgaccaatacctttgacctttcctgcgtggtgcgcgcaggttactccgatctgaaagtgcccctgaccgtgacctggcaattccagccagcctcctcacacatttttcaccaactgattagaattacacacaatggcactattgagtgggggaatttcctgagtcgttttcaaaaaaaaacaaaggtcagccaaagtctgtttcggtctcagctgcttgtgcacgacgccacagaggaggagacgggagtctaccagtgtgaggtggaggtttatgaccggaattcactatacaacaataggccccctcgcgcaagtgccatctcccatcctctcagaatcgctgtgacattacctgaatccaagctgaaggtgaactctcggtcgcaagtccaggagctctcaatcaactcaaatactgatattgagtgcagcatcttatctaggagcaatggcaatctgcagctcgctatcatatggtatttcagtcctgtgtctactaacgcctcctggctcaagattctggagatggaccaaacgaacgttatcaaaaccggtgatgaattccataccccccaaaggaagcagaagtttcacaccgaaaaggtgtcccaggacctcttccagctacacatcctgaacgtggaggactccgatcgagggaagtatcattgtgccgtggaggaatggctactgagtacaaatgggacatggcataagttgggtgaaaaaaaatccggtcttacagagttgaaattgaagccgaccggatccaaagttcgcgtgagcaaggtatattggacagagaacgtcactgagcatagggaggtcgcgatccgctgcagcctcgaaagcgtcgggtcttccgccacgctttacagcgtgatgtggtactggaacagagagaacagtggctccaaactacttgtgcacttacagcacgatggactactagagtacggggaggaagggttaagaaggcacctccactgctatcgtagctcctccacagacttcgtgctgaaactgcatcaggtggaaatggaggacgcaggaatgtactggtgcagagtggctgagtggcagctgcacgggcacccttctaagtggatcaaccaggcttccgacgagtcgcagcgaatggtgctgaccgtactgcctagcgaacccacactcccgtcaagaatctgcagttcagctcctctcctctactttcttttcatctgtccttttgtcctcttgctgttactgttaatcagtttgctttgtctgtactggaaggctcgcaaactgtcaaccctccgatcgaatactaggaaagagaaagccttatgggtagatctgaaagaagccggaggagtgacaacaaaccgacgtgaagatgaagaggaggacgaaggaaactag

SEQ ID NO: 48809 - DNA, 546 bp, Artificial Sequence
  Description of Artificial Sequence: Synthetic coding sequence
atgctgctcgagcctggcaggggttgctgcgcactcgccatcctgctggccattgtggacatacagagcgggggatgtatcaatataacatcaagcgcctcacaggagggtactcgtttaaatcttatatgtactgtgtggcataaaaaagaagaggccgagggatttgtggtttttctctgcaaggaccggtctggagactgttctcctgagacaagtctgaagcaactacggctgaaaagggaccctgggatcgacggcgttggggaaatctctagccagctgatgttcaccatttcccaggtgacccctctccacagtggcacataccaatgctgcgcaaggtcacagaaaagtgggattcggctgcaaggccatttcttcagtatactgttcacggaaactgggaactataccgtgaccggtctgaagcaaaggcagcacttggaattcagtcataacgagggaactctaagtagtggattcttacaagaaaaggtgtgggttatgctcgtgacctcactggtcgccctacaggctctctag

SEQ ID NO: 48810 - DNA, 546 bp, Artificial Sequence
  Description of Artificial Sequence: Synthetic coding sequence
atgctgctggaacctggacgcggttgttgtgcgctcgcaatcctcttggctatcgtcgatatacagtctgggggttgtattaatatcacctccagtgcctcacaggaaggaactcgactgaacctgatctgcacagtctggcataaaaaggaggaagcagagggtttcgtggtgttcctgtgcaaagatcggagcggcgactgctcacctgagactagcctcaagcagctgagactgaaaagagacccaggaatcgacggggtgggtgaaatcagttcccagctgatgttcacaatcagtcaggttacaccactccacagcggaacataccagtgctgcgccagaagccagaagagtgggatacggctccagggacacttcttttccattctcttcaccgaaaccggcaactacacagttaccggcctgaagcaacggcagcatttagagttcagtcataacgaagggactctgtcatccggctttctgcaagagaaggtgtgggtgatgcttgtcacaagcctggtggctctgcaggccctgtag

SEQ ID NO: 48811 - DNA, 378 bp, Artificial Sequence
  Description of Artificial Sequence: Synthetic coding sequence
atgttgctggaaccaggcagagggtgttgcgcactcgcaatcttgcttgccattgtggacattcaatccggcgagaccgggaattacaccgtgaccggactgaagcagcgtcagcacctggaattctcccataatgagggcaccctctccagcggattcctgcaagagaaagtgtgggttatgttagtcaccagcctggtcgccttgcaggggatgtccaagcgggctgtgtctacgccctctaacgagggggctatcatttttctgcctccttggctcttctcaaggagaagacgactggagcgaatgtcacggggacgcgagaaatgctactcatcccctggctacccacaggagtcaagcaatcaatttcactag

SEQ ID NO: 48812 - DNA, 546 bp, Artificial Sequence
  Description of Artificial Sequence: Synthetic coding sequence
atgctccttgaacccggacgaggctgctgcgccttggctattctgctggccatcgtcgacattcagtccggaggctgcatcaatatcacctcctccgcctctcaagaaggcactagattaaatctaatttgcacagtgtggcataagaaggaggaagctgagggctttgtcgtgttcctctgcaaagataggtccggggactgctctccagagactagcctcaagcagctcaggctgaaaagagatcccggaattgacggagtgggcgaaatttccagccagctaatgtttacaatctctcaggtgacaccactgcactctggaacataccaatgttgcgcccgatctcaaaagtcaggaatcagactgcaggggcacttctttagcatactgtttacagagacgggcaactacactgtcacaggcctgaagcagcgccagcatctcgaattcagccacaacgaggggaccttaagcagcggcttcctgcaggaaaaggtatgggtgatgctggtcaccagcctggtggcccttcaggcactgtag

SEQ ID NO: 48813 - DNA, 516 bp, Artificial Sequence
  Description of Artificial Sequence: Synthetic coding sequence
atggaagctccgggtccccgtgcactgcgcactgctctgtgcggaggatgttgctgtctcctgctctgtgcccagctagcagtagctggtaagggagcccgtggatttggcagaggggctttaatccggctcaacatctggcccgctgtgcagggggcttgcaaacagctggaggtttgcgagcattgcgtggaaggcgaccgggctcgcaacttgtcatcctgcatgtgggaacagtgccgcccagaagagcccggacattgtgtagcccagagtgaggtggtgaaggaaggttgctcaatttacaaccgcagcgaagcgtgccctgggaagggagtgctcgccccaaagccctcctgcatgggtcttccctctcactccctgccccctaggcgcaagcagccactcagcggaggagggttttgttcccccatccccggaccagggatcagctcagcattcagtagtctgcgatctcctctcttatcacttccaattagcagctcagaaaactag

SEQ ID NO: 48814 - DNA, 522 bp, Artificial Sequence
  Description of Artificial Sequence: Synthetic coding sequence
atggaggcccctggaccaagggcccttcgcaccgccctctgcggaggctgttgttgccttttgctctgcgcccagcttgccgtcgctggcaaaggcgcacgagggtttggaagaggggctctcatccggctgaatatatggcctgccgttcagggtgcatgcaagcagctggaggtttgcgagcattgcgtcgagggcgatagggctcgtaacctcagctcttgcatgtgggagcagtgtcgtccagaggaacctgggcactgcgttgcccagtcagaagtggttaaggaaggttgtagtatttataatcgcagcgaagcctgtccagccgctcaccaccaccccacctacgaaccaaaaaccgtgactacaggctctccaccagtgccggaggctcatagtcctgggttcgacggagccagcttcattgggggagtggtgttggtgctatccctgcaggccgtagctttctttgtgttgcacttcctgaaggccaaggactctacatatcagaccctttag

SEQ ID NO: 48815 - DNA, 525 bp, Artificial Sequence
  Description of Artificial Sequence: Synthetic coding sequence
atggaagctcctggtccgagagccctgcgcaccgctttgtgcggcggatgctgctgtctgcttctgtgtgcccagcttgcagttgcaggaaagggcgctcgaggttttggcaggggcgcactgataaggctgaatatctggcctgcggtccaaggtgcctgtaagcagctggaggtatgtgagcattgcgtggaaggcgatagagcaagaaatctcagctcctgtatgtgggagcagtgtagacccgaagagccaggtcactgtgtggctcagtctgaagtggtgaaggagggttgttccatttataatagaagcgaggcttgtccagcggcacatcatcatccaacatatgagcctaagacggtcaccaccggcagccctcccgtccccgaagctcacagccccggttttgatggtgctagcttcatcggaggggtagtcctcgttctctccctgcaagccgtggcttttttcgtgctgcactttctaaaagccaaagattccacctaccagacactgatctag

SEQ ID NO: 48816 - DNA, 1986 bp, Artificial Sequence
  Description of Artificial Sequence: Synthetic coding sequence
atggctttcgatgtatcttgcttcttctgggtggtacttttcagcgctggttgtaaggtcattacttcatgggaccagatgtgtatcgaaaaggaggccaataagacatacaactgcgagaacctggggttatcagagatccctgacacacttcctaacacgactgagttcctcgaattcagcttcaattttttgcctaccattcacaacaggactttttctcggctaatgaatttgacattcttagatctcacccgttgtcagatcaattggatccacgaggacactttccagagtcaccatcagctgtccaccctggtgctcacaggcaaccctctgatctttatggcggaaacttctctgaacggtccaaaatcacttaagcacctgtttctgattcagaccggcatttctaacctagagtttattcctgtccataaccttgagaatcttgagtctttgtacctgggatccaatcacatcagctccattaagttcccgaaagacttcccagctagaaatctcaaggttctcgacttccagaataacgcgatacactatattagcagggaagacatgcggtctctcgaacaagctattaacctgagcttgaactttaatgggaataacgtcaaaggcatcgagttgggcgcattcgattcaaccatttttcagtcactaaacttcggtgggacacctaacctgtccgtgatattcaacggtctgcaaaactccacgacccagtctttgtggttgggaacatttgaggacatcgatgacgaggacattagctcggcaatgctgaaggggttatgtgaaatgtccgtcgaatcccttaaccttcaagaacaccgcttctctgacataagctccaccaccttccagtgctttacgcagctgcaggaactcgacctgacagctacccatctgaaaggattacccagcgggatgaaagggctgaacctgcttaagaagctggtgctgagcgtcaaccatttcgatcagctgtgccaaattagcgccgcaaatttcccgtccctaacccatctctacatcagaggaaacgtcaagaagctccacctgggcgttggctgcctcgagaaactcgggaacctgcaaacgcttgacctatctcacaatgatattgaggcgagcgattgttgctctttgcagttaaaaaatctgtctcatctacaaacgctgaatctcagtcacaatgagccccttggccttcagtcccaggctttcaaagagtgcccgcagctcgagttgctggacctagcctttacacgactgcacatcaacgcccctcaatctccattccagaatctgcactttctccaggtcctgaatctcacatattgctttctggatacctccaaccagcatctcttggccggattgcccgtccttcggcatctcaatctaaagggtaatcattttcaagatggcacaatcacaaaaaccaacttgctacaaacagttgggtctttggaggtactgattctctcatcttgtgggttactgagcatcgaccagcaggcatttcacagtctgggcaagatgtcccatgtggacctgagccacaatagcttgacatgcgattcaattgactccctgtctcatcttaagggaatttacctaaacctggcagccaattccatcaacataatttctccacgcctgctgcctatcctgagtcagcaatccaccataaacttatcgcacaatccattggattgcacatgttctaatattcacttcctgacatggtataaggagaacttgcataagctagagggatccgaagagacgacctgtgcaaacccaccatccctgaggggcgttaagcttagtgatgtcaaactctcatgcggtattacagcgatcggcatattcttccttattgtctttttactgttgctggccattctgttgttcttcgcggtaaagtatctgctccggtggaaatatcaacacatctag

SEQ ID NO: 48817 - DNA, 816 bp, Artificial Sequence
  Description of Artificial Sequence: Synthetic coding sequence
atgtctgctcctcgccttctgatcagcattattatcatggtgagcgcgtcttccagctcctgtatggggggaaagcagatgacacagaactactctacgatctttgccgaaggtaacatttctcagcccgtccttatggatattaacgccgtgctgtgttgtccacctatcgccctgcgcaacctgatcatcatcacttgggaaatcatattgagggggcagccttcttgtactaaggcatataagaaggaaacaaacgaaactaaggaaaccaattgcacggtggagaggatcacctgggtgtcacgacctgaccagaacagcgatctgcaaatcagaccggtggacaccactcacgatggctattatcgcggtattgtggtgacccccgacggaaactttcacaggggataccacttgcaggtgttagtgacacctgaagtgaatctctttcagagtcgcaacatcactgccgtgtgcaaggctgtcacgggaaagccggcagcccagatttcgtggatccccgaggggtctatattagccacaaagcaggagtactggggcaacgggactgtgacggtgaagtccacatgcccctgggaagggcacaaatctacggtgacctgccatgtgtcccatctgacaggtaataaaagtctgagcgttaagctcaactctgggctacgaacctccgggagcccagctttgagcctgctcattatcctgtatgtgaagctctcgttgtttgtggtgattctggttaccacgggttttgtgttctttcaaagaattaatcacgtgagaaaagttctgtag

SEQ ID NO: 48818 - DNA, 753 bp, Artificial Sequence
  Description of Artificial Sequence: Synthetic coding sequence
atgggagggaagcaaatgacacagaactacagcacaattttcgctgaaggcaacattagtcagcctgtgctgatggacatcaacgccgtgctctgctgtccgccaattgccttgcgaaacctcataattattacctgggagattattttgcgaggacagccttcatgcaccaaggcatacaagaaagaaacaaatgaaactaaggagaccaactgcaccgtggaacgcattacttgggtctctcgcccagatcagaattccgatcttcagattagaccagtggataccactcatgatggctactacaggggcatcgtggtgactccagacggcaattttcaccgcggttaccacctgcaggttctggtcacacctgaggtgaacctgtttcagagccggaatatcaccgccgtatgcaaagccgtaacggggaaaccagctgcacagattagctggattcccgaaggatcgatactcgcaacaaagcaggagtactggggtaacgggacagtcaccgtcaagtcaacatgtccttgggagggacacaaatccacagtgacatgtcacgtctcccacctgacggggaataaatctctttcagtgaagctaaacagtggcctgagaacttctggatctccagctttatccctgttgattattttgtacgtgaagctcagcctgtttgtcgtaatcctggtgactaccggcttcgtcttttttcagaggattaatcatgtaaggaaagtgctgtag

SEQ ID NO: 48819 - DNA, 753 bp, Artificial Sequence
  Description of Artificial Sequence: Synthetic coding sequence
atgggaggcaagcagatgacacaaaactacagtaccatctttgcagagggcaacattagccagcctgtcctgatggatattaacgctgttctgtgttgccctcctatcgccttacggaatttaattattattacttgggagattattctgagggggcagcccagttgcactaaggcgtacaagaaagagactaatgaaaccaaagaaacaaactgtacagtggagcgaatcacgtgggtgagccgtccagatcagaactctgatctgcaaatccgccctgttgatacgacgcatgacggttactaccgtgggattgtcgtgaccccggacggaaactttcatcgcggataccacttgcaggtgctggtgacacccgaggtgaacctgttccagtctcggaatatcactgccgtttgtaaggcagtgactggcaagcctgctgctcagatcagctggattccagagggctccatcctggcaaccaaacaggaatattggggaaatggtacagtgaccgtcaagtcaacctgtccctgggaaggacataagagcacagttacctgccatgtcagccacctgacaggcaataaatcactgagcgtgaagcttaacagcgggctcagaacctcaggatctcccgcattgtcgctgctgatcatcttgtatgtcaaactctccctgttcgtcgttatactcgtgaccaccgggtttgtgtttttccagcgtataaatcacgtacgtaaagttctatag

SEQ ID NO: 48820 - DNA, 531 bp, Artificial Sequence
  Description of Artificial Sequence: Synthetic coding sequence
atgcggatttttgccgtgtttatatttatgacatattggcatctactgaatgccccatataacaagattaaccagcggatcttagtcgtagaccccgtgaccagtgaacacgagctcacttgccaggcggaagggtatccgaaagccgaggtcatctggacaagcagcgatcatcaggtgctgtcgggaaagaccaccaccaccaactccaagcgggaggaaaagctttttaacgtgactagtactttgcgtattaacaccaccacaaatgagattttttactgtacgttccggaggctggaccccgaagaaaaccacacagctgagctcgtcattccagaacttccactcgctcaccccccaaatgagcgcacccacctggttatccttggagcgattctgctctgccttggggtggctctgacatttatattcagacttcgaaaggggagaatgatggacgtcaaaaagtgcgggatccaggatacaaattccaaaaaacagtccgacactcatctggaagagacatag

SEQ ID NO: 48821 - DNA, 873 bp, Artificial Sequence
  Description of Artificial Sequence: Synthetic coding sequence
atgcggatcttcgccgtgttcatcttcatgacctattggcacttactgaacgcctttaccgttactgtgccaaaggatctttacgtcgtggaatacgggtcaaatatgactatcgaatgcaagttccccgtcgagaaacagctggacctggctgccctaatagtatattgggaaatggaagataagaatattattcagttcgtccacggagaggaagacttgaaagtccaacacagtagctacaggcagagggctagactgctcaaggatcaattatcacttggaaacgctgcgctgcagataaccgatgtgaagctccaggatgccggagtgtacaggtgcatgattagctacggaggcgcagattataaaagaatcaccgttaaggttaacgccccatacaataaaatcaatcagcgcattcttgtggtggatccagtgacaagcgaacacgagctcacctgtcaggccgagggatatccaaaggctgaggtgatctggactagcagcgatcaccaggttctgagcggtaaaacaaccaccacaaattcaaaacgcgaggaaaaactttttaacgtgactagcacattgcggattaatacgaccaccaacgagatattttattgcacatttagacggctcgatcccgaggaaaatcatactgctgagcttgtcatcccagagctgcccctcgctcacccgcctaacgaacgaacgcatctggtcatcctgggtgctattctgctctgcctcggtgtggcactcaccttcattttcagattaaggaagggtaggatgatggatgttaaaaagtgtggcatccaggacacaaacagcaagaaacaatcagacacccacttggaggaaacctag

SEQ ID NO: 48822 - DNA, 585 bp, Artificial Sequence
  Description of Artificial Sequence: Synthetic coding sequence
atgtggcttagcccttcactgttgctgttgattttacccggttattctatagccgctaagatcacgggccctaccactgttaacgggtctgaacaagggtcccttactgttcagtgtgcatatggttccggctgggagacatacctgaagtggagatgtcagggagccgactggaactattgcaacatcctggtgaaaacgaacggttccgaacaggaagtgaagaaaaatagagtttccatccgggacaaccagaaaaaccacgtgttcactgtcaccatggagaatttgaagagagacgatgcagacagctattggtgtggaactgagcggcctgggatagatcttggcgtaaaggtccaagtgactattaatcctggcacacagaccgccgttagcgaatggaccaccaccacagcttcattggcgtttacagccgcagccactcaaaagacaagctcccccctgacacgtagccccttaaagtccacccactttctcttcctctttctgttggaactgcctttacttttatctatgctcgggacggtgctctgggtaaaccggcctcagcggagaagttag

SEQ ID NO: 48823 - DNA, 702 bp, Artificial Sequence
  Description of Artificial Sequence: Synthetic coding sequence
atgagactactggtcctgctctggggatgcctgctcctaccagggtatgaggccctggaagggccagaagaaatcagcggttttgagggtgatacagtatctctgcagtgtacataccgcgaggagctccgtgatcaccgtaagtactggtgccgaaagggaggaattctttttagtagatgttcgggaaccatttatgctgaagaagaggggcaggagaccatgaaagggagagtgtccattcgcgatagcagacaggaactgagtctaatcgtaacactgtggaacctgaccttacaagatgccggtgaatactggtgtggggtggaaaagcggggacccgatgaatcactgctcatctctctgtttgtgttccctggatcatcaaggccgccaatgcagctcgatagcacctccgcagaagataccagtccagccctaagcagcgggtctagcaagcccagagtcagcatcccgatggtccggatcctggctcccgttctcgttctgctatcgctgttatctgccgcaggactcatcgcgttctgttctcacttgttgttatggaggaaggaggctcagcaggccactgaaacacagagaaacgagaagttttgcttatctcgtttgaatcacaggacaagcgaactcgaccccgacgaggcatttgaaatttctagccttacatttttaagcgtatag

SEQ ID NO: 48824 - DNA, 999 bp, Artificial Sequence
  Description of Artificial Sequence: Synthetic coding sequence
atgagactgttggttctcctgtggggctgcctgcttctgccaggatacgaagctctagaagggccagaggaaatctctggatttgagggcgacactgtgagtttgcaatgtacataccgcgaggaattgagggaccatagaaagtattggtgtagaaaaggcggaatcctgttttcccgctgctcaggaacaatctacgccgaggaggaagggcaggagacaatgaaggggcgagtgagcatacgtgactcaagacaggagctttctctcattgtgacactgtggaacctaactcttcaggatgcaggcgagtactggtgcggtgttgagaaacgaggccctgatgagagtctcctgatctcactttttgtattccctggcccatgctgccccccatcccctagtcccacgttccagcccctcgccaccacacgcctgcagccgaaggcaaaggcgcagcaaacccagccgcctggccttacatcccctggactctatcccgctgctacaaccgcgaaacaggggaagactggcgctgaagcccctcccttaccgggtacatcccaatatggtcacgagaggacaagtcagtataccggcacaagcccacatcctgccacatctccgccagctggtagcagcaggccccctatgcagcttgacagtacgtcagctgaagacacaagcccagctctaagctcagggtcatcaaagcccagagttagcatccccatggtcaggatcttggcaccggttttagtcctcctctccctgctttcggctgccggactaattgccttctgttctcacttattactttggcgaaaagaagctcaacaggcaaccgaaactcaacggaatgagaaattttgtctgtctcgactgacagcagaagagaaggaggctccttcacaggccccagaaggcgatgtgatatcgatgcctccccttcatacctctgaggaggaacttggattttccaagtttgtcagtgcttag

SEQ ID NO: 48825 - DNA, 822 bp, Artificial Sequence
  Description of Artificial Sequence: Synthetic coding sequence
atgcgcttgctcgtgcttctctggggatgtctgctgttgccgggttatgaggccctcgagggacccgaagagataagtgggttcgagggggacacagtgagcttacagtgtacatatcgggaggaattgcgcgatcatcgcaagtattggtgcagaaaggggggaattctttttagtcgatgcagcggaaccatctatgcggaggaagagggacaggaaaccatgaaaggtcgagtgagcatcagagattctaggcaggagctttcactcattgtgacactgtggaatctgaccttacaggatgctggggagtactggtgcggggtcgagaaacgcggacccgatgaaagcttgctgattagtttgttcgtcttcccagcgagcccaggcctttaccccgcagccacaaccgcaaaacagggcaagactggggcagaagcaccacctttgcccggtacatcacagtacggtcatgagcgcacaagccagtatactggcacatccccccacccggctacaagccctccggcaggcagcagtaggcccccaatgcagctggatagcacatccgcggaggacacatcaccggcactctctagcggctcatctaagccacgggtgtctatccccatggttaggattcttgcgcctgtgctggtcttgctgtccttactgagtgccgctggcttgatcgccttttgtagtcatctgctgctgtggagaaaggaagcacagcaggctactgaaacacagcgaaatgaaaagttctgcctgtccagattgaattccctcatgtttagcttgtcgttgccttggctttag

SEQ ID NO: 48826 - DNA, 924 bp, Artificial Sequence
  Description of Artificial Sequence: Synthetic coding sequence
atgcggctgctggtcctcttgtggggctgcttgctgctgccgggatatgaagccttggaaggacctgaggaaattagcggcttcgagggggatacggtgagcttacaatgtacctatcgcgaggaacttcgcgatcatcgcaagtactggtgcaggaagggagggatcctgttctcccggtgctcagggacaatatacgccgaggaagagggacaagagactatgaaagggagggtgagtatacgcgactccagacaggaacttagtctgattgtgaccctctggaatcttactctgcaggatgcaggggaatattggtgtggcgttgaaaaaagaggccctgatgagtctctgctaatttctctgttcgtgttccccggaccgtgctgtccaccctcaccatccccaactttccagccgttagcaaccaccaggctacagcccaaggctaaagctcagcagacacagcccccaggacttacgtcacccggtctgtaccctgccgctacgaccgccaaacagggaaagacaggcgctgaggcgcctcccttgcctggtacgagccagtacggccacgagcggacatctcaatacaccggcacatccccacacccagcaacgagcccccctgctggcagctcccggcctcctatgcagctggattccacctccgctgaggatacgtcccccgctctctctagcggatcatctaaaccacgggtgtcaattcccatggttcggatcctagcccctgtcttggtgctgttgagcctgctgtccgcggctggcctgatagccttctgctctcatctcctactgtggcggaaagaggcacagcaggctacagaaactcaacgaaacgagaagttctgtctcagccgcctgaactcccttatgttcagcttatccctcccctggctgtag

SEQ ID NO: 48827 - DNA, 561 bp, Artificial Sequence
  Description of Artificial Sequence: Synthetic coding sequence
atgtggctgccttgggccttgctattactgtgggttcctgctagcacatctatgacccccgctagcattactgcagccaaaacttccacaatcacaacagcctttccccctgtgtcttctaccactctgtttgctgtcggagcgacgcatagcgcttctatccaggaggagactgaggaagtcgtaaatagtcaactacctctgctccttagcctgctggcacttctgttattgcttttggtcggcgcttccctcctggcctggaggatgtttcagaaatggatcaaggctggtgaccacagtgaacttagccaaaaccctaagcaggcagccacccagtccgagcttcactatgctaacctggagctcctgatgtggcctttgcaggagaaacctgccccaccccgagaggtggaggttgaatattccaccgttgcctcccctagagaagaactgcattatgctagtgtggttttcgattccaacactaatcggatagccgcacagcgcccacgggaggaagagcctgacagcgactatagcgtcattcgtaaaacttag

SEQ ID NO: 48828 - DNA, 900 bp, Artificial Sequence
  Description of Artificial Sequence: Synthetic coding sequence
atgtggctcccgtgggccctgctactgctctgggtaccagggtgttttgcactgagtaagtgtcgcacagtggccggaccagtgggtggatccctgagcgtgcagtgtccctacgaaaaagagcaccgtacactaaacaagtactggtgcagaccaccgcagatctttctgtgtgacaagattgtagagactaagggctcagcagggaagcggaacggacgcgtgagcatcagagacagtcccgcaaacctgagcttcaccgtgacactggagaatttgaccgaggaggatgccggaacatattggtgcggagtggacacgccttggctaagagactttcatgaccctgtcgtggaggtggaggtgagtgtgttccctgctagcacaagtatgacacccgcatcaatcacggcagctaagaccagcaccattacaactgcatttcctcccgtttcctctaccaccctgtttgcagtgggcgcaacccacagtgctagcatacaggaagagacagaagaggtggtgaacagtcaattaccacttctcttgagtctgctggctctgttactgctccttctagtcggcgcaagtctgctggcctggaggatgttccagaagtggatcaaggctggcgaccacagtgagctgagtcagaaccccaagcaggctgcaactcagtccgagttgcattatgccaacctggagctgcttatgtggcccctgcaagagaagcctgctccgcctagggaagtggaggtggaatattctaccgtggcctctcctagggaagagctgcactatgcttctgttgtgtttgattccaacactaaccggattgcggcacagcgccctcgagaggaagagcccgacagtgattactctgtcatccgcaaaacatag

SEQ ID NO: 48829 - DNA, 312 bp, Artificial Sequence
  Description of Artificial Sequence: Synthetic coding sequence
atgtggctgccatgggccctgctgcttctttgggttcccgcaggcgaccatagcgagttgtcacaaaaccccaagcaagctgcaacacagagcgaactgcattatgcaaacctggagctactgatgtggcccctccaggagaaacctgcaccacccagagaagtggaggtggaatattcaaccgtcgcatcgcccagagaagagctgcactatgccagcgtggtttttgattccaataccaatagaatagccgcacagcgtccgagagaggaagaacctgactcagattactcagtgattcgtaagacgtag

SEQ ID NO: 48830 - DNA, 453 bp, Artificial Sequence
  Description of Artificial Sequence: Synthetic coding sequence
atgtggctgccatgggccctgctcctgctgtgggtccctgcctctacttccatgaccccggcttctatcacagccgctaaaacttcaaccattacaactgccttccccccagtgtcttcaacgactcttttcgcagttggagccacacattcagcatccatccaggaggaaaccgaagaagtcgttaacagtcagttgccactcctgttgagcctgctcgctctgctgctgcttctcctggtcggggcatctctgcttgcgtggagaatgtttcagaagtggatcaaagccggagaccactctgagctctcccagaaccccaagcaggcgtctcctcgggaggagttacactacgcgagtgtagtattcgattccaacacaaatcgaattgccgcacaacgtcccagggaggaggaacctgacagcgactactcagtgatcaggaaaacctag

SEQ ID NO: 48831 - DNA, 675 bp, Artificial Sequence
  Description of Artificial Sequence: Synthetic coding sequence
atgacagccagagcttgggcaagctggcgctcctcggcactgctgctcttgctggtgccaggctacttcccactctcacatcctatgactgtcgccggaccagtgggcggttccctctctgtgcagtgccgttatgagaaagagcaccgtacactgaacaagttttggtgtagacctcctcagatactgaggtgtgacaaaatcgttgagactaaagggagtgctggcaaaaggaacggacgtgtgtctattagggattctcctgctaacctgtccttcaccgtcacattagagaacctgacagaggaagacgccggtacctattggtgcggtgtggacaccccatggttaagggacttccacgatccaatcgtggaagtggaagtgtcggtctttcccgctggtacgactacggctagttcgccacagagttccatgggtacatccggaccccctactaaactgcccgtccatacttggcccagcgtcacacgcaaagacagcccggagcccagcccgcatcccggttccctgttctcaaatgtgcgcttcttgctcctggtattactcgagctgcctctcttgttgagcatgttaggggcagttctgtgggtgaatagaccccagcgaagtagccggtctcggcagaactggcctaaaggggaaaatcaatag

SEQ ID NO: 48832 - DNA, 618 bp, Artificial Sequence
  Description of Artificial Sequence: Synthetic coding sequence
atgtggttgttgcccgctctcctcctcttgtgtctctccggctgtctcagtttgaaggggccagggtctgtgaccggtacggctggtgacagcctcactgtgtggtgccaatacgaaagcatgtataaaggatataacaaatattggtgtaggggacagtatgacacatcttgcgagtctatcgtggagacgaaaggcgaggagaaagtagagcggaacggccgtgtaagtatccgcgatcaccccgaggctctcgccttcacagtcaccatgcaaaacctgaatgaagacgatgcgggatcttactggtgtaagattcagacagtctgggtactagattcctggagcagggatccatcagatctagtgcgcgtctatgttagtcccgcaatcactaccccaaggaggaccacccaccccgctacacctcctattttcctggtggttaaccctggacgcaatctcagcactggagaggtgctgacacagaatagcgggttccggctgtcttctcctcattttttgttagttgtcttactgaagctgcccctacttctgtctatgctcggtgccgtgttctgggtgaatagacctcagtgggctcctccaggcagatag

SEQ ID NO: 48833 - DNA, 699 bp, Artificial Sequence
  Description of Artificial Sequence: Synthetic coding sequence
atgacccaagcacccctccatatcctgggctttcagctcggaccccgattcgctgaggacggcagccagggggaccggaatatgtggctgctcccagccctgctcctcctctgtctcagcggctgcctgtccttgaaaggaccaggttcagtgacgggcactgctggcgactccctcaccgtgtggtgtcagtacgaatcaatgtacaaggggtacaataagtactggtgcagggggcagtacgacacctcctgtgagagtatcgtggaaaccaagggcgaagaaaaggtcgagagaaacgggcgtgtttcaataagggatcacccagaggccctcgcctttaccgttacaatgcagaacctcaacgaggatgatgccggtagttattggtgtaagattcagacagtttgggtcctagacagctggagcagagatccatcagatctggtgcgcgtttacgttagtcccgcaatcacaacgcctcggaggacaacccaccccgctacaccccctatctttctggtggtcaaccccggacgcaacctgtctaccggcgaggtgctgacacagaattcagggtttcggctttcgtctccacatttcctactcgtagtgctcttgaagttgcctctgctattgagcatgttgggggctgttttttgggtgaaccgaccgcagtgggcccctcccggtaggtag

SEQ ID NO: 48834 - DNA, 369 bp, Artificial Sequence
  Description of Artificial Sequence: Synthetic coding sequence
atgtgccacctgcaggaggaagccggagggagatggaagggcggaggatgcctgtcacttaagggcccaggaagtgtcaccggtactgccggagattcgctgaccgtgtggtgtcagtacgaaagtatgtacaaaggctacaataaatactggtgccgaggccaatatgatacaagctgtgagtcaatcgtcgaaacgaagggcgaagagaaggtggagcggaatggcagggtttcaatacgtgatcacccagaggctttggcatttacagtgaccatgcagaacttgaatgaagacgatgccggaagctactggtgtaaaatacagacagtctgggtcttggattcctggtccagggacccaagttag

SEQ ID NO: 48835 - DNA, 741 bp, Artificial Sequence
  Description of Artificial Sequence: Synthetic coding sequence
atgtctgagaacaccaaagagacgtggacttctaggaaatggatgacacaggctcccctccatatcctgggcttccagctgggccctaggttcgcggaagatgggtctcagggtgaccggaacatgtggctgctgcccgcactgctcctcctctgtctcagcggttgcttgtctttaaagggtcccggaagtgtgactgggaccgccggagacagtctgaccgtgtggtgtcagtacgagagtatgtataaaggatataacaagtactggtgccgagggcaatatgatacctcctgcgagtccatagtggaaactaaaggcgaggagaaggtggagagaaatggacgggtaagcattagggatcatccagaggcccttgctttcacagtgactatgcagaacctcaacgaggatgatgccggatcttactggtgcaagatccagaccgtctgggtgctggactcttggagtcgggaccccagtgacctggtaagggtttacgtgtcaccggcaataaccactccacggagaacgacccatccagctacaccccctatcttcttggtggtcaaccctggaaggaacctgagcacaggtgaggtgctcactcagaactccggattcaggttgtcatcaccccactttctcctggtcgttctgcttaagttaccccttctcctgtccatgttgggggctgtgttttgggtgaacaggccacagtgggcacctcctggacgatag

SEQ ID NO: 48836 - DNA, 300 bp, Artificial Sequence
  Description of Artificial Sequence: Synthetic coding sequence
atgggttgtgatcgtaactgcggtttgattgccggtgctgttattggggcagtgctcgcagtgttcgggggaattctgatgccagtgggcgatctacttatccagaagactataaaaaagcaggtcgtcctggaggaaggcacaattgcattcaagaactgggtgaaaacaggcactgaagtatatcgacaattttggatttttgacgtgcagaacccacaagaagttatgatgaatagctcctgcattccatatctctccaaaagcatctgtagtaatgatccccagtttacttactag

SEQ ID NO: 48837 - DNA, 186 bp, Artificial Sequence
  Description of Artificial Sequence: Synthetic coding sequence
atgaaaaggttcctttttctgctcctgacaatttctcttctggtgatggtccaaatccagaccggcttatcagggcagaatgacacctcccagacctcctcaccctctgcttcaagcaatatcagcggtggtatcttcctctttttcgtggctaacgccatcatccacttattttgtttctcttag

SEQ ID NO: 48838 - DNA, 1038 bp, Artificial Sequence
  Description of Artificial Sequence: Synthetic coding sequence
atggcccagcatcacctttggattctgctgctgtgcctgcaaacctggcccgaagcggcaggtaaggatagcgagatattcaccgtgaatggaatactgggagagtcagtgacattcccagtcaatatccaggagccccgacaagtgaaaatcattgcatggactagcaagactagcgtggcctacgtcacaccaggagattccgaaaccgcacccgttgttactgttacacatcgtaattattacgagcgaattcacgctttaggccctaactacaacctcgtaattagcgatctgagaatggaggacgcgggtgattacaaggctgatataaacacacaagcagacccatacacaactacaaaaaggtacaacctgcagatatataggagactgggaaagccaaaaattacgcagtccctgatggcctctgtcaatagcacttgcaacgtcacactgacctgcagcgtggaaaaggaagagaagaatgtgacttataattggtccccacttggcgaggagggtaatgtcctccagatttttcagacacccgaggatcaggaactcacctacacatgtactgcacagaacccagtttctaacaactccgactctatcagcgcaagacagttgtgcgccgatatcgcgatgggattcagaacacatcataccgggctgctgtccgtcttggccatgttcttcttgctcgtgctgattctcagttctgtttttctctttcgccttttcaagaggagacaaggtcgcattttccccgagggcagctgtctgaacaccttcaccaagaacccctatgcagcttccaaaaagaccatctacacttatatcatggctagccggaatacacaaccggctgagtcccggatctatgacgaaatcttgcagtcgaaagtgcttccatcaaaggaagagcccgtgaacacggtttacagtgaagtgcaattcgcagacaagatgggcaaagcctcaactcaggacagcaagccacccggtacgtcaagttatgaaatcgtgatttag

SEQ ID NO: 48839 - DNA, 843 bp, Artificial Sequence
  Description of Artificial Sequence: Synthetic coding sequence
atggctcaacaccacctgtggatcttgttgctatgcctgcagacttggcccgaggcggcagggaaggacagtgaaatctttacggtaaatggtattttgggggaaagcgtgacctttccagtaaacattcaagaaccaagacaggtaaaaatcattgcttggaccagcaagacgagtgtagcatacgtaacacccggagacagcgagactgccccagtggttaccgtgacacataggaattattacgagaggatccatgcgttgggcccaaactataatctcgtgatctctgacctacggatggaagacgctggagactataaagccgacattaacacccaggctgacccctacaccaccaccaagcgctacaacctacagatctatcgaagacttgggaaaccaaaaattacacaatccctgatggccagcgttaactcgacctgtaatgttacactgacctgttctgttgagaaggaagagaagaacgtcacctacaactggtctcccctgggcgaggaagggaacgtcctacagatttttcagacgcctgaggaccaggaactgacgtacacttgcacggctcagaatcctgtcagcaataactccgatagcatctccgcgagacagctgtgcgcagatatcgccatgggatttcgcacccaccacactgggttgcttagcgtgctggccatgttctttctcctggtccttatcctgtcttccgtgtttcttttccgcctgtttaaacggagacaaggccgaatcttcccagagggaaagatgtggaagctcacattctctccgcctggcaccgaggcaatatatccacggttcagctag

SEQ ID NO: 48840 - DNA, 726 bp, Artificial Sequence
  Description of Artificial Sequence: Synthetic coding sequence
atggcccaacaccatctctggatactgctgctctgccttcagacctggcccgaggccgcagggaaggatagcgaaatcttcactgtgaatggcatcctgggagagagtgttactttccccgttaacattcaggagccgagacaggtaaagatcattgcctggacaagcaaaactagcgtggcctatgtgacacccggtgactctgaaactgcaccagttgtgaccgtgacccaccgcaattactacgaacggatccacgctctggggcctaactacaacctggtgatttccgacctgcggatggaggatgcaggagactacaaagcagacattaatacgcaggctgatccctacaccactaccaagcgatataatctgcagatctaccgcaggttgggaaaaccgaagatcacgcagagtctcatggcttcagttaactccacgtgcaatgtcacacttacttgcagcgtggaaaaggaagaaaagaatgtaacatataactggtcgcccctgggggaagagggaaatgtgttacaaattttccaaacgcccgaagatcaggaactcacatatacatgtaccgcccaaaatcctgtgtccaataactccgattccatcagcgctagacagctgtgcgctgggaaccaactgtgtcctagcctgctagtatcgctgagagatcactctgaggaactgcagggactaaacgtggggcatatcctgtag

SEQ ID NO: 48841 - DNA, 1020 bp, Artificial Sequence
  Description of Artificial Sequence: Synthetic coding sequence
atggcccagcatcacctgtggattctcctcctatgcctgcagacctggcctgaggccgctggtaaagactccgaaatcttcaccgtgaatggaatactcggggagtccgtcacatttcccgtcaacatccaggagcccagacaggtgaagattatagcctggacttctaaaacgtcagtagcctatgtcaccccaggagatagtgaaactgccccagtagtgacagtcacgcatagaaattactatgagcgaatacatgcactaggtcctaattataatcttgtgatatctgacctgcgtatggaagatgccggtgactataaagccgatataaacacccaagcagatccttacacaactaccaaacgctataacctgcagatttacagaaggctggggaagccaaaaatcactcagtcgctcatggcctccgtgaatagtacttgtaacgtgacgctgacgtgttcagtagagaaggaggagaaaaatgtgacctataattggagcccactcggggaggaagggaacgtgctgcagattttccagacccccgaggaccaggagctgacatacacttgtactgcccaaaatcctgtcagtaacaatagcgactctatatccgccaggcaattgtgcgctgacatcgccatggggtttagaacgcatcacactggtcttctatccgtgcttgccatgttttttctgttagtgctgattctctcatcagtgttcctttttcggctcttcaaacggaggcagggttcatgtctgaacacctttacaaagaatccatacgccgctagcaaaaagactatatacacttacatcatggctagccggaacactcagcccgcagagtctcggatctacgatgagatattgcagtctaaggtgctcccaagcaaagaggaaccagtgaatactgtgtactcagaggtgcaatttgccgacaaaatgggaaaagccagcactcaagacagtaagccgcctggaaccagttcctacgagattgtgatctag

SEQ ID NO: 48842 - DNA, 819 bp, Artificial Sequence
  Description of Artificial Sequence: Synthetic coding sequence
atggcacaacaccatctgtggattctgctcttgtgtctgcaaacctggccagaggcggctggcaaagattcagagatattcacagtcaatgggattttgggagagagcgtgactttcccggttaatatccaggaaccacgacaagttaagattatcgcatggaccagcaagacgtcggtggcatacgtaaccccaggcgattcagaaaccgctccagtcgtgaccgttacccatcgcaattactacgagagaattcatgctctcggccctaattacaatctggtgatcagcgatctgcgcatggaggacgcaggcgactacaaagctgatataaatacccaggctgatccatatacaaccactaaacggtacaatctccagatctaccgcagattgggaaaacctaagatcacgcagtccctgatggcctcagtgaattccacatgtaatgtgactttgacctgcagcgtcgaaaaagaagaaaaaaacgttacctacaattggtccccattaggcgaggagggaaacgtgcttcagatttttcaaactccagaagatcaggagcttacctatacatgtactgcccagaacccagttagtaacaattctgactccattagcgccaggcagttatgtgccgacattgcaatgggctttcggacacatcacacggggctgttgagtgtgcttgctatgtttttcctgctggtgctgattctgtcctccgtcttcctgtttcgtctgtttaagcggagacagggggcttcactccagggcagagcatccgagcatagcctgttccgaagtgccgtatgctag

SEQ ID NO: 48843 - DNA, 987 bp, Artificial Sequence
  Description of Artificial Sequence: Synthetic coding sequence
atggcacagcaccacctctggatattgctcctttgcttacaaacatggcctgaagctgccggaaaagactcagaaattttcactgtgaatggcatactgggcgaaagtgttacttttccggtaaatatacaggaacctcggcaagtgaagatcatcgcctggacttctaagaccagcgtcgcatacgtgacacctggcgactccgaaacggcccctgtggtgaccgtgacacaccgtaattattatgagcgaatccacgccctggggccaaattacaacctcgttatctcagacctgcgcatggaagacgccggtgattacaaagcggacataaacactcaagcagatccttacactactaccaagagatacaacctgcagatatatcggaggctcggaaaaccaaagatcactcagtccttgatggccagtgtgaattccacttgtaacgttaccttgacctgttccgtggagaaggaagagaaaaatgtaacatataattggagtcctttaggtgaagaaggaaatgtgttacaaatttttcagacgccagaggaccaggagctgacatatacatgtacagcgcaaaacccagtctccaataacagcgacagcatctctgccaggcagctatgcgctgatatcgctatgggtttcaggacgcaccatactggtctgctgagcgtgttggcaatgttcttcctcttggtgctgatattgtccagcgtttttcttttccgtctcttcaaaagaagacaggatgccgcttccaaaaaaacgatatatacctacatcatggctagcagaaatactcagccagcagaatcgcggatctacgacgagatcctgcagagcaaagtgctgcccagtaaggaggaaccagtaaataccgtctatagtgaagtgcagtttgctgataaaatgggaaaagcctccactcaggacagcaagccgccaggaacttcctcctacgaaatagtcatttag

SEQ ID NO: 48844 - DNA, 645 bp, Artificial Sequence
  Description of Artificial Sequence: Synthetic coding sequence
atggcgcagcatcacctctggatccttctgctgtgtttgcagacctgtcgtctggggaaacccaagatcacccagagcctgatggcttcggtgaatagcacctgtaacgtgacactgacatgcagcgtcgagaaggaggaaaaaaacgtgacttacaactggagccctctcggggaagagggtaacgtattacagatttttcagaccccagaggaccaggagctgacatatacatgtacggcccagaatcctgtgagtaacaattccgacagtattagcgcccgtcagctctgtgctgacattgcgatgggtttcaggactcaccatacaggcttgttgtccgtgctggccatgttctttctgttggttctgatactgtcctcagtttttcttttccgcctgttcaagcgcaggcaggacgccgctagtaaaaaaactatttacacatacatcatggcgtccaggaacacacaacccgcagaaagccggatttacgacgagatcttgcagagcaaagtactcccctccaaagaagaaccggtaaataccgtttattctgaagtgcagtttgctgataaaatgggaaaggcatctacgcaggactctaagcccccaggcaccagctcatacgagattgtcatctag

SEQ ID NO: 48845 - DNA, 1959 bp, Artificial Sequence
  Description of Artificial Sequence: Synthetic coding sequence
atggccacttctatggggctgctgctgctgctgctgcttctgctgactcagccgggagcagggacaggcgctgataccgaagccgtggtgtgtgtgggaaccgcctgttacacagcccacagtggcaagctgtctgccgctgaggctcagaatcactgtaatcaaaatggcggtaatcttgctactgtcaaaagcaaggaggaagcccagcacgttcagcgagtcctcgcacagctgcttcgtagggaagccgcactcaccgctcgtatgtcaaaattctggatcggactgcagagagaaaagggaaagtgtctggatccaagcttgcccttaaagggattctcttgggtaggcggaggcgaggatacaccatattccaattggcacaaggagctgagaaactcctgcatctctaaacggtgtgtgtcccttcttctggacctctctcaacccctcctgccttcaaggctccctaaatggagcgagggaccatgtgggtcacctggaagccctggtagtaatatcgagggttttgtttgtaagttctcctttaagggcatgtgccggcctcttgccctgggaggccctggacaggtcacgtacactaccccattccagacaaccagcagttcactggaagctgtaccgtttgccagcgccgctaatgttgcatgcggagagggtgacaaggatgaaacccagagccactatttcttatgcaaagagaaggcacctgatgtgttcgattggggcagcagcggtcccctgtgcgttagtccaaaatatgggtgtaatttcaacaacgggggttgccaccaagactgctttgagggtggagacggatcattcctgtgtgggtgccgccctggattcagactccttgacgatctcgtgacttgtgcttctagaaatccatgcagttcctccccttgccgcggtggcgctacatgtgtcctgggccctcatggaaaaaattatacgtgcagatgccctcagggataccagctagacagctcccagctcgattgtgtcgacgtcgacgagtgtcaagactctccttgtgctcaggagtgcgtcaacacaccagggggattccgctgtgagtgttgggtgggatacgaacctgggggtccaggagagggtgcttgccaggacgtcgatgagtgcgcgttgggcagaagcccgtgtgcccaggggtgcacaaacaccgatggatcgtttcattgtagttgtgaggaaggctacgtgttagccggtgaagatgggactcaatgccaggacgtggacgagtgcgtaggaccaggagggcctctttgtgattccctgtgctttaatacacagggctccttccactgtggatgcttgccaggatgggtgcttgccccaaacggggtgtcttgcaccatgggtcccgtaagtctgggccctccatctggaccacctgacgaggaggacaagggcgagaaagagggcagtacagtgcctcgggctgcaaccgcctcgcccacccggggtcctgaaggtacgccaaaggccactcctacaaccagccgtccctctttaagcagcgacgcaccaattaccagtgcccctctgaagatgcttgctccaagcggctcacccggagtatggcgcgaaccttcgattcaccatgcaacagctgcttccggccctcaggaacctgctggcggtgacagctcagtggcaacccagaataacgatgggacggacggtcagaaacttcttttattttacattttaggaacagttgtggctatcttgttactcctggccctcgcactggggcttctggtgtacaggaaaaggagggcaaagcgggaagagaaaaaagagaaaaagccccagaacgcagctgactcttatagctgggtccccgagcgggcagagtctcgcgctatggagaaccaatactcgccaaccccaggtacagactgctag

SEQ ID NO: 48846 - DNA, 1044 bp, Artificial Sequence
  Description of Artificial Sequence: Synthetic coding sequence
atggccacttctatgggcttgctgttactgcttttgctgttgcttacccagccaggggctgggacaggagccgatactgaagcagtcgtatgtgttggcactgcatgttataccgctcactctggaaaactgagtgctgccgaggcccagaaccattgtaatcagaacgggggaaatctagccactgtgaaaagtaaagaggaagcacagcatgtgcagcgcgtcctggcacagctgttgagaagggaagctgccctgaccgctagaatgagtaagttttggattgggttgcaaagagaaaaagggaagtgcctggatccatcattaccactcaaggggttttcttgggtgggtgggggtgaagatactccatactcaaattggcacaaggagctgaggaactcctgcatttcaaaaaggtgcgtgagcctccttctggacctctctcagccccttctcccttctcggctacctaagtggtccgagggtccttgcgggagtcccggatcccctggatctaatatcgaaggatttgtttgtaagttctcctttaagggcatgtgtcgtccattggcactcggtgggccaggtcaggtaacctatacaacaccctttcagaccactagtagttctttagaggcagtccccttcgcgtcggccgcaaacgtcgcatgtggcgagggcgacaaggacgaaacccagtcgcactacttcctgtgtaaggagaaggcgccagacgtctttgattgggggagtagtggaccactctgtgtatctcctaagtatggctgtaacttcaataatggtggatgccatcaagattgctttgagggcggtgacggcagcttcctctgtggatgccgacctggcttcaggttactggacgatctggtcacttgtgcctcccggaatccttgttccagctccccctgcaggggaggcgcaaccggcctgtctcaagccgagtctgaggaaggtggcgaggaaggcgaggaggccccagagtgcggtagacagttgctccttggatctagagctagctag

SEQ ID NO: 48847 - DNA, 447 bp, Artificial Sequence
  Description of Artificial Sequence: Synthetic coding sequence
atgcccgtgttaaaacagctgggaccagctcagccgaagaaaaggcctgacagaggcgcactgtctatctcagccccactcggcgattttaggcacacgctccatgtagggaggggtggagatgcttttggggatacctcatttctttcccgtcacggaggcggaccccctcctgagcctagggcccctcctgccggtgcacccaggagccccccacctcccgctgtacctcagagtgcggcaccgagccctgccgatcctttgcttagttttcatttggatctagggccatccatgcttgatgccgtgcttggggtgatggatgccgctagacccgaggctgctgcggctaagccggacgccgagcccagaccagggacccaacctccccaagcgcgatgcaggcccaacgccgacctggaattgaacgatgtgatcggactgtag

SEQ ID NO: 48848 - DNA, 240 bp, Artificial Sequence
  Description of Artificial Sequence: Synthetic coding sequence
atgagtgagttttggcacaaactgggatgttgcgtggtggaaaagccacagcctaaaaagaagcggcgacggattgacagaactatgattggggaaccgatgaatttcgtgcatctgactcacattggctctggtgagatgggggctggcgatgggctcgctatgactggtgccgtgcaggagcagatgaggagcaagggcaatcgtgatagaccatggagcaactcccgcggactctag

SEQ ID NO: 48849 - DNA, 240 bp, Artificial Sequence
  Description of Artificial Sequence: Synthetic coding sequence
atgagtgagttttggcacaagctgggttgttgtgtagttgagaagccgcaacctaaaaagaaacggcgtcgtatcgacagaacaatgatcggggagcccatgaactttgtccatctgacacacatcggtagtggtgagatgggagcaggcgacgggttggccatgactggtgctgttcaggagcagatgaggtccaaggggaatagagaccgtccctggtccaactcacggggactatag

SEQ ID NO: 48850 - DNA, 255 bp, Artificial Sequence
  Description of Artificial Sequence: Synthetic coding sequence
atgtccgagttttggctgtgctttaactgttgcatcgctgaacaaccccagcccaaaagacgccgaagaatagacaggtctatgataggcgaacccacaaactttgtccataccgctcacgtcgggtcgggcgacctattttccggcatgaatagtgttagcagtatccaaaatcaaatgcagtctaagggaggatacgggggaggaatgcccgcaaacgtccagatgcagctggttgatacgaaagccggatag

SEQ ID NO: 48851 - DNA, 255 bp, Artificial Sequence
  Description of Artificial Sequence: Synthetic coding sequence
atgtccgagttctggctttgctttaactgctgcatcgccgaacagccacagccaaagagaaggcgtcggattgacagatccatgattggcgagccaactaatttcgttcataccgcccatgtcggatcaggcgacctattctcaggcatgaattccgttagttccatccagaatcagatgcagtcaaaaggcggttatggcggtggcatgcccgcaaacgtgcaaatgcagcttgtcgacactaaagcagggtag

SEQ ID NO: 48852 - DNA, 255 bp, Artificial Sequence
  Description of Artificial Sequence: Synthetic coding sequence
atgtcagagttttggctgtgttttaactgctgcatagcagaacagcctcagcctaaaagacgtaggagaatcgaccggtctatgataggcgaacccactaattttgtgcatacggcccatgtgggtagtggcgatttgtttagtgggatgaattcagtaagctccatccagaaccaaatgcagtccaagggagggtatggagggggaatgccagctaatgtgcaaatgcagttagtggacacaaaagcgggttag

SEQ ID NO: 48853 - DNA, 1482 bp, Artificial Sequence
  Description of Artificial Sequence: Synthetic coding sequence
atgtttcctgtgttcccgtgtactctgctggctcctccctttccagtcctagggctagatagcagaggcgttggaggcttaatgaactcctttcccccaccgcaggggcacgctcagaaccctctgcaggtcggtgctgaattacagtcaaggttcttcgcttcacagggctgcgcccagtccccttttcaagctgccccagcacctccgcctaccccacaggccccagccgctgaacccctgcaagtggatctcttacctgtgttggcagccgctcaggagagcgctgccgctgctgcagctgccgctgctgccgctgctgccgtggccgcagctcctcctgcccctgccgctgcctcgaccgttgacaccgcggctcttaaacagccgccagccccaccgccacctccccctccggtcagcgctcccgctgccgaggcagcacctcccgcaagcgccgctacaatcgcagcagctgctgccaccgcagtagtggctcccacctcaaccgtggccgtggcccctgtggctagcgcactcgagaagaagacgaaaagcaaggggccttacatctgcgccctgtgtgcaaaggagtttaaaaacggatacaacttgcgcaggcacgaagctattcacaccggcgcaaaggcaggcagggtccccagcggggctatgaaaatgcccacaatggtgcctctgtccttactttcagtccctcagttgtcgggagccggaggcggaggaggagaggccggagctggagggggagcagcggcagtggccgctgggggtgtagttaccaccacggccagtggtaagcgcatccgaaagaatcacgcgtgcgaaatgtgcggcaaagcgtttagggatgtgtaccacctgaatcgccacaaactcagtcattcagatgaaaagccgtatcagtgcccagtgtgtcaacaacggttcaaacggaaagatagaatgagctatcacgtacgcagccacgacggggctgtccataagccctacaactgtagccactgtggaaaatctttttcacgtccagatcaccttaatagccatgttcggcaggtgcacagcactgagaggccttttaaatgtgaaaaatgtgaggccgcttttgctaccaaagatagactgagggcccatacagtccggcacgaggagaaggttccctgccatgtctgcggcaagatgttatctagcgcatatatttccgaccatatgaaagtacactcccaggggccacaccacgtctgcgaattatgcaacaaagggtttactaccgcggcttacctgcgaatccatgccgtcaaagaccacgggctgcaggccccaagagccgatcgtatcctgtgcaaattgtgctcggtgcactgtaaaaccccagcacagctagctggacatatgcagacccacctcgggggagcagcacccccagtccctggagatgccccacaaccacaacctacctgctag

SEQ ID NO: 48854 - DNA, 549 bp, Artificial Sequence
  Description of Artificial Sequence: Synthetic coding sequence
atgctcccgaccgccgctgggttcagtatttggggacagcctggggctgcccgagaggcgccaagatgccagacaaaaatatcttcatgttcatgccctacctcgtctgtgtccgcagcccacggacccggacctaacgaaagggccagaggcttaggcggtctgccagaccctgcactgtctcctcgtgttcccttccagggatacgcccgaattgtattcgcgatcatctccttctattttatgccttgttgccccttgactgcttccagtttttacctgctgtccggcctccttgacgccttcgatggtcacgccgcacgagccctcaatcaggggactagattcggtgccatgcttgacatgctaactgaccgatgttccacaatgtgtctcctcgttaatctggctcttttatatccgggtgccactctgtttttccagatctctatgtccctggacgtcgcttcacattggctccacttacatcggtccgccgctatcttgggcgcttgggccacatggcgccactactcaggcgtgggatag

SEQ ID NO: 48855 - DNA, 1215 bp, Artificial Sequence
  Description of Artificial Sequence: Synthetic coding sequence
atgatttggaagaggtccgctgtgcttagattctacagcgtctgcggcctgctcctgcaggccgctgctagcaaaaataaggtcaaggggtcccaaggccaatttcctctaacgcagaacgtaaccgttgtagagggtgggacagccatcctgacctgtcgagtggatcaaaatgacaatacttctcttcagtggagcaatcctgctcaacagaccctgtatttcgacgataagaaggcacttcgggacaaccggatcgaattagtccgcgcaagctggcatgaactcagcatttcagtgtccgatgtcagtctgagtgatgaagggcagtacacatgcagtctttttactatgcctgtcaaaaccagtaaggcgtatctgaccgtcttgggggtacccgaaaagccacagatttctggattcagctcgccagtgatggaaggcgaccttatgcagctaacctgtaagacctccggatcaaaaccagccgcagacatccgctggttcaagaacgataaggagattaaagacgtcaagtacttgaaagaggaagacgccaaccggaaaacgttcacggtgtcttcaactcttgactttagggtcgatcgcagcgacgacggggtagctgtaatttgccgtgtggatcacgaatccctgaatgctaccccccaggtcgccatgcaagtgttagagatacattatactccttccgtgaaaatcattccgagcacacctttccctcaggagggccaacctcttattctgacctgcgagtcaaaaggtaaacctctccccgaacccgttctgtggaccaaagacggaggcgagctgcctgacccagatagaatggtggtttctggtcgcgagttgaacatcctgttcctcaataagactgacaatgggacctacaggtgtgaggctaccaatactattggtcaaagttcagccgagtacgtgctcattgtccatgaccctaatgccctagccggacagaacggtcccgatcatgctctgattggcggaatcgtagccgtggttgtgtttgtgactctatgctctatattcctcttgggaaggtatctcgctcgtcacaaaggaacctacctcaccaacgaggcaaaaggagccgaagatgctccggatgccgatactgcgatcatcaacgccgagggctcacaagtgaatgcagaggaaaaaaaggagtattttatctag

SEQ ID NO: 48856 - DNA, 1314 bp, Artificial Sequence
  Description of Artificial Sequence: Synthetic coding sequence
atgtttgtgctgttcctgtgcaacttatccctggttcccgcagccgcaagtaagaacaaagtgaaaggctctcaggggcaattcccattaacccagaacgtgactgtcgttgagggcggaacagccattctgacttgcagggtggatcagaacgacaatacatctctgcagtggtctaatcccgcacagcaaacactgtatttcgatgacaaaaaggctctccgggataacagaatcgaactcgtgcgagcctcttggcatgagctatccatctcagtgtcggatgtctcattgtcagatgaaggtcagtatacctgttctctgttcaccatgcccgtgaaaacatcaaaagcatatctgacagttctgggggtccctgagaagcctcagatttccggcttttcctcccctgtgatggaaggcgacctaatgcagctgacttgtaagactagcggctccaagcctgcagccgacatacgctggtttaagaacgacaaggagatcaaggatgtgaaatacttaaaggaagaggacgcgaatagaaagacttttacggtatcctctacactggacttccgcgtggaccgttcggacgatggcgtggccgtcatctgccgcgtagatcacgagagccttaacgccactcctcaggtagctatgcaagttctggaaatccactacaccccctctgtcaagataatcccaagcacccctttcccccaggaaggtcaaccactgattctgacctgcgagtccaagggcaagccactgcctgaacctgtgctctggactaaggacgggggagagcttcccgacccagatcgaatggtcgtgtcgggcagggaactcaacattctttttcttaacaagacggacaatggaacttatcgatgtgaggcaaccaatacaattggacaatcgagcgcagaatatgtactcatcgtgcacgatgtgccaaatactctcctgccaaccactataattccaagtcttaccacagctactgttaccacgacagtggcgatcacgacctcaccaaccacctctgctaccacatccagtatcagggaccctaatgctttggccggacagaatggaccggaccatgcacttataggagggattgtggccgtggtggtgttcgtcaccctgtgctcgatcttcctcttggggagatacctagcacgtcataaggggacatatctgacgaatgaggctaagggggctgaagatgctcccgacgccgacactgccatcatcaacgccgagggaagccaggtgaatgcagaggagaagaaggagtatttcatatag

SEQ ID NO: 48857 - DNA, 1308 bp, Artificial Sequence
  Description of Artificial Sequence: Synthetic coding sequence
atgatctggaaacgcagtgctgtcttgcgattttattccgtttgcgggcttctactccagggctctcagggtcagtttccactaacacagaatgtcacagttgttgagggaggcacggcaatcctgacttgtagagtcgatcagaacgataatactagcctgcagtggtctaatccggcacagcagactctctatttcgatgacaagaaagctctgcgggataataggatagagttggtaagagcctcctggcatgagttgtccattagcgtgtcggacgtaagtctcagcgacgagggtcaatacacttgcagcctgttcactatgcccgttaagacgtcaaaggcctatctcactgtcttgggggtgccggagaaaccgcaaatttccggttttagtagccccgtgatggaaggggacctgatgcaacttacatgcaaaacaagtggatcaaagcctgctgctgacattaggtggtttaaaaacgacaaggagattaaggatgtgaagtatttgaaggaagaggatgccaatcgaaagactttcactgtatcatccacactcgattttcgcgtcgatcggagtgatgatggggttgctgtgatctgccgcgttgatcacgagtctctcaacgctactccacaggtcgcaatgcaggtgctggagattcattacacaccctcggtgaagatcatcccttctaccccatttcctcaggaaggccagccactaatccttacctgcgagtctaaagggaagccgttgcctgagcccgttctctggactaaagacggcggtgaactgcccgatcctgaccgaatggtggtgtcgggcagagagctgaacattttgttcctgaacaaaaccgataacgggacataccgctgcgaggcaacgaataccatcggacaaagctccgccgaatacgtcttgatcgtccacgacgtgcccaacaccctgcttcccacaacaataataccttctctaaccactgccaccgtgactacaacagtggccataactactagtccaacaaccagtgcgacaacatcgagcattagggatccaaacgcgctcgccggtcaaaatggaccggaccacgcacttatcggaggaattgtggctgtcgtggtcttcgtgaccttgtgctctatttttctgttgggaagatatctagcacgacataaggggacttacctgaccaatgaagccaagggggcagaagacgcgcctgacgcagacactgctattatcaatgccgaagggagccaggtcaacgctgaggaaaaaaaggaatattttatctag

SEQ ID NO: 48858 - DNA, 1299 bp, Artificial Sequence
  Description of Artificial Sequence: Synthetic coding sequence
atgggtgcaccagcagctagcttgttgttgctactgctgctcttcgcctgttgctgggcccctggaggagcaaacttgtctcaggacggctactggcaggaacaggatctggaactgggcacactcgcaccattggacgaggcaatctcctccacagtgtggtcatctcccgacatgctggcttctcaggactcacaaccttggactagcgacgagactgtagtggctggtggtaccgttgtgctgaaatgccaggttaaagaccacgaagactcctccttgcaatggtccaacccagcccagcaaactctctacttcggcgaaaagcgggctttacgagacaatcgcatacagctagtcacaagcacacctcatgagttatctatctctatctccaatgtagccctggccgatgagggcgagtatacttgctccatttttactatgccagtccgcacggccaaaagccttgtgaccgtgcttgggatcccccagaaacctatcattactggttataagagctcacttcgtgagaaggatacagccacgttgaattgccagtcttccggatcaaagcctgccgcaaggctgacctggagaaaaggggaccaggagctgcatggtgaaccaacacgcatccaagaggatcccaacggaaagacattcacggtcagcagttctgtcacatttcaggtgacaagagaagatgacggggctagtattgtgtgttccgtcaaccacgagtctctgaaaggggctgaccgaagtactagtcaaaggatcgaagttctttacaccccaactgcaatgattagaccggatccccctcaccccagagaaggccagaagttgctcctgcactgcgagggaagaggaaatcctgttccacagcagtacctgtgggaaaaggagggctcagtcccacccctgaaaatgacgcaagagagcgcccttatctttccatttttgaataagagcgacagtggcacgtacggttgcaccgccacgtccaacatgggcagctacaaagcctactatacactgaatgtgaacgatcctagccccgtgcctagtagctcaagcacataccatgcgattataggtggcatcgtggcgttcattgtatttcttctgcttattatgttgatttttctgggtcactatttgatcaggcataaggggacctacctcacccacgaagctaagggcagcgatgacgccccagacgcagatacggctattattaacgccgaaggtggccagtctggaggggacgataaaaaggagtacttcatctag

SEQ ID NO: 48859 - DNA, 1197 bp, Artificial Sequence
  Description of Artificial Sequence: Synthetic coding sequence
atgggcgcacctgccgcttcactgctactactgctactcctgttcgcatgttgctgggcccctggcggagccaatctttcgcaggacgattctcagccatggacaagtgatgaaacagtcgtggccggaggaaccgtggtgctcaaatgtcaggtgaaagatcatgaggatagcagcctgcaatggtcaaaccctgcccagcaaactctctatttcggcgagaaaagggcattgcgcgacaaccgaattcagctagttacgtcaaccccacacgagctgtcgatctccatcagcaatgtggctctcgccgacgagggggaatatacttgctcaatcttcacaatgcccgtgcggaccgctaagagcctggtgaccgttctgggcatcccacagaaacctatcatcactggctacaagtcgtcactgcgggaaaaagatacggcgaccctgaattgtcagagtagcgggagcaaacctgccgcaagactgacttggaggaagggcgaccaagaacttcacggcgagcctacaaggatccaggaggacccaaacggaaagaccttcactgttagttcgtccgtaacctttcaggtgacacgcgaggacgacggagctagtattgtatgcagcgtgaatcacgagagtctgaaaggcgctgaccgcagtaccagccaaagaattgaagtcctctacacacctacagccatgatccggccagatccacctcatcccagggaaggccagaaattactcttgcactgcgaaggacggggaaaccccgtgcctcaacagtacttatgggaaaaggaaggatctgtgccgcctctgaagatgacccaagagtccgctttaatctttccatttctgaataaaagtgactctggaacttatggttgtacggcgacttcgaacatgggaagctacaaagcttattacacactcaacgtgaacgacccaagtccggtgccttcgtcctcctccacctatcacgctatcattggtggcatcgtggctttcattgttttccttctccttattatgctcatcttcttgggccactacctgatcagacacaaagggacctatctgactcacgaggccaagggatctgatgacgcgccagatgccgacacagccatcataaacgcagaagggggtcagagcggtggcgacgacaaaaaggagtattttatctag

SEQ ID NO: 48860 - DNA, 705 bp, Artificial Sequence
  Description of Artificial Sequence: Synthetic coding sequence
atgggagcaccagctgcgagtcttcttcttttactgctgctctttgcatgctgttgggcacccggaggagctaatctgtctcaggacgattctcagccatggacaagcgatgaaactgtcgtcgccggtggcaccgtggtcctgaagtgccaagtgaaagaccacgaggattcctcactgcagtggtcaaacccagcccagcagacactttatttcggtgagaaacgggcactgcgagataatcgcatccagttggtcacgtcgactccacacgagctcagcattagtatcagtaatgtggccctcgctgacgagggcgaatacacctgcagcatattcaccatgcctgtcaggaccgccaagtccctggtgacagtgctaggcattcctcagaaacccatcattacaggatacaagagctccctacgggagaaagacactgcaacactgaactgccagtcctcaggaagcaagcctgctgccagactcacctggaggaaaggagatcaagagctgcatggggagccgaccagaattcaagaagatccgaatgacacccctaccgcgatgatcaggccagacccacctcatcctagagagggacagaaactactgttacattgtgaaggcaggggtaatcccgttccacagcagtacctgtgggagaaagaaggatcagttccaccactcaaaatgacacagtag

SEQ ID NO: 48861 - DNA, 2130 bp, Artificial Sequence
  Description of Artificial Sequence: Synthetic coding sequence
atgccttcggccacctctcatagcggatcaggctcaaagagttcagggccaccaccacccagcggctctagcggctccgaagctgccgcaggagctggcgcagccgctcccgcatctcaacaccctgccaccggtaccggagccgtgcaaaccgaagcgatgaaacagattctgggagtgatcgacaagaagctgcggaatttggagaaaaagaagggtaaactcgatgactaccaggagaggatgaacaaaggagaacgactaaaccaggaccagttagatgctgtatctaagtaccaggaggtgacgaataatcttgagttcgctaaggagctgcaacggtccttcatggcactgtcgcaagacattcagaagacaatcaaaaagactgcgagaagggaacagctgatgagggaggaggcagaacagaagcggctcaaaactgtcttggagttacaatacgtcctggacaagctgggcgacgatgaggtgcgaaccgacctgaagcagggactaaacggtgtccccattctgtccgaagaggagttgagtttgctcgacgaattttacaagctggtcgatccggagcgggatatgtctctcaggctgaacgagcaatatgagcacgcctctatccacctgtgggatctgttagagggaaaggaaaaacctgtgtgcggcaccacctacaaagttctgaaggagatcgtggagagagtgttccaaagcaactatttcgacagcacgcacaaccatcaaaacggcctgtgtgaagaggaggaggccgcaagcgcacccgctgtagaggatcaagtgcccgaggccgagccagagcctgcagaggagtacactgagcaaagtgaagttgaatccaccgagtatgtgaatcggcagttcatggccgagactcagtttacttcgggggaaaaagagcaggttgacgaatggactgtggaaactgtggaggtggtcaatagtctgcagcagcagccacaagctgcctctccctccgtcccagagcctcatagcctgacccctgtggcccaagccgaccctcttgtgcgcaggcagcgggttcaggacttaatggctcagatgcaggggccttacaacttcattcaggacagcatgctagacttcgaaaatcagaccttggatccagctatcgttagcgcccagccaatgaatcccactcagaacatggatatgcctcagctcgtttgtcctcctgtccattcagaatctagactcgctcagccaaaccaagtccctgtacagcctgaagcaactcaggtgcccctggtatcttcaacttctgaggggtatactgcatcacagccgctgtaccagccctctcatgcgaccgaacagaggccccagaaagagcctattgaccagatccaggctaccatctctctgaacaccgatcaaactacagcttcatcttcacttcccgctgcctcccagccccaggtcttccaggctggtacttccaagcctctccactcatccggaataaatgtgaacgcagccccattccagtcgatgcaaaccgtatttaatatgaatgcgccagtgccacccgtgaacgagccagagaccctgaaacagcagaatcaataccaggctagttataaccagagcttcagttcacagccacaccaggttgaacagacagagctccaacaagaacagctccaaaccgttgttggcacttatcatgggtctccggaccaaagtcatcaggttactggaaatcaccaacaaccccctcagcagaataccggatttccgagatctaaccagccttattataatagccgaggggtgtcccggggaggatctaggggagcacgaggcttgatgaatggataccgaggacctgccaacgggtttagggggggatacgatgggtatagacccagctttagtaacaccccaaactcaggctacacccagagccagttttccgcacctagagactactctggttatcagagggatggctatcagcaaaacttcaagagaggttccggccaatcagggcctcgcggtgcaccacgaggacgcggaggtccccctagacccaaccggggaatgccccagatgaatacacagcaggtgaactag

SEQ ID NO: 48862 - DNA, 2130 bp, Artificial Sequence
  Description of Artificial Sequence: Synthetic coding sequence
atgcctagcgcaacttctcacagtggctccgggtctaagagttccgggcctccacccccatcaggcagtagtgggtctgaggctgctgccggtgccggagctgctgctccagcatcccagcatcccgctacagggaccggcgctgtgcagactgaggctatgaaacagatcctcggcgtcattgataagaaactgcgcaacctagagaaaaagaaaggaaagctggatgactaccaagaacgtatgaacaaaggtgaaagactcaaccaggaccagctggacgctgtctccaagtaccaagaagtgaccaataacctggaatttgccaaggagctgcagcggtcatttatggcactatctcaggatattcagaagacgatcaagaaaactgctcgcagggagcagttgatgagggaggaggcagagcagaagcggctcaagaccgtgctcgaattgcagtacgttctggataaactgggagacgatgaagtaaggacagacctcaagcaggggctgaacggcgtgccgatccttagcgaggaagaactgtccctcctggatgagttttacaaacttgtggatcccgaacgagatatgtccctaagacttaacgaacaatacgagcacgcaagcatacacttatgggatttactggaggggaaagaaaagccagtgtgtgggaccacatacaaggtactaaaagagatcgtggagagagtgtttcaatctaactattttgacagcacccacaaccatcaaaatggactgtgtgaagaagaagaggctgcctcagcccctgcagtggaagatcaggtaccagaggctgaacctgaacctgcggaagagtacacggagcagtcggaagtggaaagcaccgaatatgtcaataggcagttcatggccgaaactcaatttaccagtggcgagaaggagcaggtggacgagtggaccgtcgaaacagttgaggtggtaaacagcctccaacaacagcctcaggccgcttcgcctagtgtcccagagccacattcactcacaccggtggcccaggccgaccccctggtgaggcgacagcgcgtgcaggacctgatggcacagatgcagggaccatataactttatccaggatagcatgttggatttcgagaatcagaccctggatcctgcgattgtgagcgctcagccgatgaatccgacccagaatatggatatgccccagctggtgtgtcccccagtgcactccgagtcaagactggcccaaccaaatcaggtgcccgtacaacctgaggccacccaagtgccactggtaagctctacatcagaaggatacaccgcgagccagccgctctaccaaccctctcacgcaacagaacagagaccccagaaagagcctatcgaccaaatccaagccacaattagcctgaacacagaccagacaaccgcttcttcttctctgccagctgctagtcagccccaagttttccaggctggcacaagtaagccccttcacagctctggaatcaacgtaaacgcagctccctttcagagtatgcaaacggtcttcaatatgaacgcccctgtcccacctgtgaacgaacctgagactttaaaacagcagaaccagtatcaggctagctataatcagagcttcagcagccagccacatcaggttgaacagacagagcttcagcaggaacagttgcagacagtggtgggcacctaccacgggtctcccgaccagagtcaccaggtcaccggaaaccaccagcaaccccctcagcagaatactggctttccccgtagcaatcaaccttactataatagccgcggagtcagtaggggtgggtctagaggcgctagaggactcatgaatggctaccgcggtcctgccaatggatttcgcggtggttatgacggctaccggccatccttctctaatacgcctaatagcgggtatacccagagtcagttttccgcacctagagattacagcggctaccagagagacggctaccaacaaaattttaaaaggggctccgggcagagtggcccacgcggagcgccacggggtcggggtggccctcccaggcctaaccgtggaatgcctcagatgaatacacaacaagttaactag

SEQ ID NO: 48863 - DNA, 2085 bp, Artificial Sequence
  Description of Artificial Sequence: Synthetic coding sequence
atgccctcggctacctcgcactcaggttcaggaagtaagtccagtgggcctcctccacccagcgggagctccggctccgaggccgcagcaggcgctggcgcagccgctcctgcctctcagcatccagcaaccggaaccggggcagtacagaccgaggcgatgaagcagatcctcggggtgatcgacaaaaagctgaggaatctggagaaaaaaaaaggcaaactggatgattatcaggaacgcatgaataagggcgagcggttaaatcaggatcaactggatgcagtctccaaatatcaggaggttacaaacaatctcgagtttgctaaagaactccagcggagtttcatggccctttcacaggacatccagaagaccattaaaaagacagctcggagggagcaactcatgagggaggaggcagagcagaagagattgaagaccgttctggaactgcagtacgtgctcgataagctgggtgatgatgaggtgcgcactgatctgaagcaaggccttaacggggtgcccatcctgtccgaggaagagttaagcctgctcgatgagttttacaagttggtggacccggaaagagatatgtctctgcggctgaacgaacaatacgagcacgcttctatccatctctgggacctgctggaaggcaaagaaaagcctgtttgcgggaccacttacaaggtgctgaaggaaatcgtcgaacgggttttccagtccaactatttcgacagtactcataaccatcaaaacggcctttgcgaggaggaggaggccgcatcagcaccagcagttgaggaccaggtcccggaggccgagccggaacctgccgaagaatatacagaacaatcagaagtggagagtactgaatatgtcaatagacagtttatggctgagacccagtttactagtggcgagaaagaacaagtcgacgagtggacagtggagaccgtggaagtagtcaatagcctgcaacagcagcctcaggcagcatcacctagcgtcccggaaccccatagcctgacaccagttgcccaagccgatcccctggtcagacgacagagggtgcaagatctgatggcccagatgcagggcccatataatttcatccaggactcgatgttagattttgaaaatcaaaccttggacccagccatagtgagcgcccagcctatgaatcctacccagaacatggacatgccacaactggtgtgcccacccgtacactccgaatcccgtttggcacagccaaatcaggttccggtgcagcccgaggccacacaggtgccgctggtctctagtaccagcgaaggctacacagcttcccagccgctctatcagccctcccacgccactgagcagcgaccccagaaagagccaattgatcagatccaggcgaccatctctcttaatactgaccagaccacagcctcttcttcattacccgctgcgtcccagcctcaagtttttcaggccggaacttcgaaacctctccacagctctgggattaatgttaacgccgcacctttccagagtatgcagactgtatttaatatgaatgcgccagttccacccgtgaacgagcccgaaactctcaaacaacagaaccaataccaggcctcatataaccaaagcttctccagccagccccaccaggtggagcagaccgagctgcagcaggagcagctccaaacagtggttggcacctaccacgggagtcccgaccagagccaccaggttaccgggaatcaccaacaacccccacagcagaatacaggctttcctcgctctaaccaaccttattacaattcgcggggagtctcgagagggggaagccgcggtgccagagggttgatgaatggctacagggggccagcaaatggcttcaggggtggctacgacgggtaccggccttcatttagtaatacaccaaattctggctacacgcagagccagttcagcgcccctagagactactcaggctaccagcgtgatggttatcagcagaactttaagcgcggaagtgggcagtcgggcccaaggggtgcgccacggggaaacatcctctggtggtag

SEQ ID NO: 48864 - DNA, 2274 bp, Artificial Sequence
  Description of Artificial Sequence: Synthetic coding sequence
atgtccgagaactcatctgactctgattcaagctgcggctggacagttataagccacgagggatctgacattgagatgctcaacagcgtgaccccaactgattcctgtgaaccagctcccgaatgcagttcattggagcaggaggaactgcaggcactccagatcgaacaaggtgaaagcagccaaaatgggactgtgttaatggaagaaacagcttaccctgccctagaagaaactagcagcactatagaggccgaggagcaaaaaattcctgaggattcaatatacatcggaaccgcctcagacgatagtgacatagtgacactggaaccgcctaagttagaagagatcggcaatcaggaagtggtaatcgtggaggaagctcagtcctcagaggactttaacatgggaagcagttcttctagccaatataccttttgtcagcctgagacagtgtttagcagccagccttcagatgacgaatcttcttctgacgaaacatctaaccagccgagtccagcctttcggcgaagaagggcaaggaagaagaccgtcagtgcctccgagtcggaggatagattggttgcagagcaagaaaccgaacccagcaaggaactttctaaaagacaattctctagtggacttaacaagtgcgtgattttggccctggtaatagctattagcatggggttcggacatttttacggaacgattcagatccagaaacggcaacaactggtacgaaagattcatgaagatgagctgaacgacatgaaggattatcttagccagtgtcagcaagagcaggaatcctttatcgattacaagtctttaaaggaaaacttggccaggtgctggacgcttacggaagcggagaagatgagcttcgagactcagaaaactaacttggctaccgaaaatcagtatctcagggtgtctctggagaaagaggagaaagctttgagtagtctgcaggaggagctgaataagctgagggagcaaattaggatcctggaagacaaaggcacttctaccgaattggtgaaagaaaatcagaaactgaagcaacatttggaagaggagaaacagaagaagcactccttcctcagccagagagaaaccctactaacggaggccaagatgcttaagcgcgaattggaacgagagagattagtcacgacagccctgaggggcgagctgcagcagctgtctggaagccaattacacggtaagagcgactctcccaatgtatacaccgaaaagaaagagatcgctattctgcgggagcgattgactgaactcgaaagaaagctcacattcgaacagcaaagatcagatctgtgggagcgcctctacgttgaggccaaagaccagaatggcaagcagggtacagacggtaagaagaaggggggaaggggcagtcatcgtgcgaaaaataaatccaaggagaccttcttgggaagtgtgaaggagacatttgacgcaatgaagaactccactaaagagttcgtaaggcaccataaagagaagattaagcaggcgaaggaggctgtcaaggaaaacttaaagaagttttcagactccgttaagtccacatttcgccatttcaaagatacaacgaaaaatatctttgatgagaaggggaacaaacggtttggagctactaaggaggctgcagaaaagcccagaacagttttttccgactatctgcacccacagtataaggcccctacagagaaccatcacaacagaggtccaactatgcagaacgacggacggaaagagaagccagtccactttaaggaatttagaaagaacaccaacagtaaaaagtgtagccctggtcacgattgtcgcgagaactcacacagctttaggaaggcttgctcaggggttttcgattgcgcacagcaagagtccatgagcttgtttaataccgtggtgaatccgatcaggatggacgaatttcggcagattattcagcggtatatgttgaaggagttagacaccttctgtcattggaatgagcttgatcagttcataaataaattctttctcaacggagtctttattcacgatcaaaagctgttcaccgactttgtcaatgatgtaaaggattatctcagaaatatgaaggaatatgaagtggacaacgatggggtctttgaaaagctcgatgagtacatataccgacattttttcgggcacacattctccccaccctacgggcctcggtcagtctatatcaagccatgccattacagcagcctctag

SEQ ID NO: 48865 - DNA, 1275 bp, Artificial Sequence
  Description of Artificial Sequence: Synthetic coding sequence
atgagcgaaaactcatccgatagcgatagttcctgcgggtggactgtgatcagccatgagggatcagacatcgagatgctcaattcagtgacccctaccgattcctgcgaacctgctccagagtgtagttctctggagcaggaggaactgcaggccctccagatcgaacagggagaatccagccagaacggcaccgttcttatggaggaaactgcctatcccgctctggaagagacaagcagcacgatagaggcagaggaacagaagattcccgaggacagcatctacattgggaccgcaagtgacgattctgatatcgtgacattggaacctcctaaattggaagagattggtaaccaggaggtagtaatagtcgaggaggcccagtcatctgaggacttcaacatgggctcttcatcaagtagtcagtacaccttctgccagcctgaaacggtgttcagcagtcagccctcagatgatgagtcgagcagtgatgagactagcaatcagccttcaccggcttttagacggaggcgagccagaaagaaaactgtgtcagcgagcgagtccgaggaccggcttgtggcagagcaagagactgaacccagcaaggagctgagcaaaaggcaattcagttccggcttgaataagtgcgtaatcctagccctggtcatcgcaatttcaatgggattcgggcatttttacggtaccatccagatccagaagcgacagcagctggtacgtaagatccatgaggatgaactaaacgacatgaaagactacctgtcccagtgtcaacaagagcaagagtccttcatcgattacaaaagcctcaaagagaatctggctcgctgttggacgctgaccgaagccgagaagatgtctttcgagacacagaaaaccaacctcgcaacagagaatcagtatctgaggaaactgttcaccgactttgtgaatgacgtcaaagactacttacgaaacatgaaggaatacgaggtggacaatgacggagtgttcgaaaagcttgatgaatatatttacagacacttttttggccatacattctcccccccatatggcccaagccgcccagataagaagcaacgaatggtcaacatcgagaactccagacatcgcaaacaggagcaaaagcacctgcaaccacagccttacaaaagagagggtaagtggcacaaatatggacgtacgaacggcaggcagatggccaatcttgaaatagaattgggacagctcccgtttgatccacagtactag

SEQ ID NO: 48866 - DNA, 2424 bp, Artificial Sequence
  Description of Artificial Sequence: Synthetic coding sequence
atgtcagaaaactcttccgatagtgacagtagctgcggctggactgttattagtcatgaaggctccgatattgaaatgctgaattcagtgactccaactgattcatgcgaacccgctcctgagtgctcttcactggagcaagaagaactgcaggcactgcagattgaacagggggagtccagccagaatgggactgtgctgatggaagagacagcctatccagccctcgaagagactagctcgactattgaagcagaagaacagaagatccctgaggatagcatttatatagggacagctagtgatgattcagatatcgtaacactggagccacccaagttagaggagattggtaatcaggaggtggttattgtcgaggaggcccaatcatcggaggattttaacatggggtcttcttcctcttcacagtatacattctgccagccggaaacggtattcagcagccagccatcagacgatgagtcttccagcgacgaaacttccaatcagcctagccctgctttccgacgaagacgggcaaggaagaagaccgtttccgcctctgagtcagaggatcgcctggtcgctgagcaggaaacagagccctccaaagagctgtcaaaaaggcagttttcttctggcctgaacaagtgcgttatcttggctctcgtcatcgctatatccatgggctttggacacttctacggcactatccagatccagaaacgacagcagctcgtccgcaagatccacgaggacgagttaaacgacatgaaagactatttatcacagtgccagcaggaacaggagtcctttatagactataagagtctgaaagagaatctggccaggtgttggacccttacggaagccgagaagatgagttttgaaacacaaaaaacaaacctcgcgaccgaaaatcagtatctgagggtgtctctcgagaaggaggaaaaagcgctgtcctccctgcaggaggaactcaacaagttaagagaacaaatcagaattctggaggataaggggacttcaactgagttggtgaaagagaatcagaaactgaaacagcatctcgaagaagagaaacagaagaagcacagcttcctctctcaacgtgagaccctgctcacggaagctaagatgctcaaaagggaactggaaagagagaggttagtgactactgcgttacgtggcgagctgcagcagctctccggttcccagctccacggcaagtcagacagtcccaacgtatatacagagaaaaaagagattgccatcctaagggagaggttgacagaacttgaacggaaacttacattcgagcagcagaggtccgacctttgggagcgactgtatgttgaggctaaggatcaaaatggcaaacagggcactgatggcaagaaaaagggaggcagggggagtcacagagctaaaaataagagcaaggagaccttcctcggtagtgtaaaggagacatttgacgctatgaaaaactccaccaaggagtttgttcggcatcacaaggagaagatcaaacaggccaaggaggccgtgaaggagaatctgaagaaattctcagattcagtaaagagcacctttagacactttaaggacacgactaaaaatatcttcgacgaaaagggcaacaagcggttcggtgccaccaaagaagccgctgaaaaaccccgtactgtgttctcggattacctgcatccccagtacaaagcccctacggagaatcaccataacaggggacctaccatgcagaatgacggaaggaaggagaaacccgtgcattttaaagagttcaggaagaataccaattcaaagaaatgctctccaggccatgactgtcgcgaaaatagccattcgttccgcaaggcctgtagcggcgttttcgactgcgcccagcaggagtctatgtctctgttcaatactgtggttaatccaatccgcatggacgaatttcgacagatcatccagcggtacatgctgaaagagctcgatacattctgccactggaacgaactggaccagtttatcaacaaattcttcctaaatggtgtttttatccatgatcaaaaactttttactgacttcgttaacgatgtgaaagactatcttagaaacatgaaggaatacgaggtggacaacgacggagtgtttgagaaactggatgaatatatctacagacatttttttggacataccttttcacccccatatgggccttcccgtccagataagaaacaaaggatggtgaatatcgagaactctcgccaccgtaaacaggaacagaagcatttacagccgcagccgtataaacgggaagggaagtggcacaaatacggccgtaccaatggcaggcaaatggctaacttagagattgagctaggccagctgccgttcgatcctcagtactag

SEQ ID NO: 48867 - DNA, 717 bp, Artificial Sequence
  Description of Artificial Sequence: Synthetic coding sequence
atggaatatgcaatgaagtccctgtcattgctttatccaaagagccttagtaggcatgtgagcgtccgtaccagcgtcgtgactcaacagctcctgtcagagccctcacccaaggcaccaagagctcgtccatgtagggtaagcacggcggaccggtcagtaaggaaagggattatggcctacagtctggaggatctcctcctgaaagtgcgggataccctcatgctggcagacaaaccatttttcctggtgctcgaggaggatgggacaacggtcgagaccgaagagtatttccaggccctggcgggtgacactgtttttatggtgcttcagaagggccagaagtggcaaccgccatccgaacaagggacaagacatccattaagcctctcccacaagccggcaaagaaaatcgacgtggctagggtaactttcgacctgtataaactgaacccccaggattttattggttgtctgaatgtgaaggctactttttacgacacatattccctaagttacgatctccactgctgcggggcaaagcgaatcatgaaggaagctttcagatgggcattgttctcaatgcaggcaacaggacatgttttgctcggcacctcatgctatctacagcagttgctcgatgcaaccgaggagggacagcctccaaaggggaaggcctccagcttgatacctacttgtctaaagatactgcaatag

SEQ ID NO: 48868 - DNA, 402 bp, Artificial Sequence
  Description of Artificial Sequence: Synthetic coding sequence
atggagtatgcaatgaaatctcttagccttttgtacccaaaatccctgagccgtcacgtgagtgtgcggaccagtgtcgtcacccagcagctgctgagtgagccatcacccaaagcaccacgagcacggccttgccgcgtctcaacagcggacagaagcgttcggaaagggattatggcctattcactggaggatttgttgttaaaggggagttttccactgggaccactgcaacacgccggtcaccgcccaaggacggcgtggcacctcctcttgcccgctgccgcacctaggtgttatgggggtcgcgctgcaccacagggccaaggactgattccatatcccgacctgagcgaggacaccgctgtgaaagcccaggtactcggaagttttcctcagtag

SEQ ID NO: 48869 - DNA, 495 bp, Artificial Sequence
  Description of Artificial Sequence: Synthetic coding sequence
atgttagccgacaaaccctttttcctggtactagaggaggacggtactaccgtcgaaactgaagagtattttcaggccctggcaggcgacacagtcttcatggtgcttcagaaaggccaaaagtggcagcctcctagcgaacaagggacacggcatcctctgagcctgagccataagccggctaagaaaatagacgtggctcgtgtgacctttgacctttacaaactcaacccacaggacttcataggttgcctcaatgtgaaggcaactttctatgatacctattcactgagttatgacctgcactgttgcggcgcaaagcgtataatgaaggaagcctttcgatgggcactgttcagcatgcaggccacaggacacgtgctgctcggtacgtcatgctacctgcagcagctgcttgacgcaactgaggaagggcagcctccaaagggcaaagcctcaagcctcattcccacttgcctaaagattctacagtag

SEQ ID NO: 48870 - DNA, 495 bp, Artificial Sequence
  Description of Artificial Sequence: Synthetic coding sequence
atgctggctgataaacccttttttcttgtgctggaggaagacggtacaaccgtggaaacagaggagtacttccaggctctggcaggcgacacagtcttcatggtgctgcagaagggtcaaaagtggcagcctccttctgaacaggggactagacaccctctgagtttgagccacaaaccagcaaaaaagatcgacgtggcaagagtgacattcgatctgtataaacttaatccgcaggattttatagggtgcttgaatgtgaaagcgactttctatgacacttacagtcttagctacgaccttcactgttgcggtgccaagaggatcatgaaagaagctttccgctgggcactctttagcatgcaggccactggtcacgtgctgctcggcacttcttgctacctgcaacaactgctagatgccaccgaggagggacagccacctaaaggcaaggcctcttccctgatccctacttgtctcaaaatactccagtag

SEQ ID NO: 48871 - DNA, 747 bp, Artificial Sequence
  Description of Artificial Sequence: Synthetic coding sequence
atggaatacgccatgaagtccctctccctgctctatcctaaatccctgagtcgccacgttagtgtgcgcacttcagttgtgacacagcaactgctttccgaacctagccccaaggcccctcgagctagaccctgcagagttagtaccgctgatcgatcagtgaggaagggcataatggcatacagcctggaagatctgctgctgaaaactagaaaccctgaagctcgatctcaggaggtcagagatacattgatgctcgcagacaaaccttttttcctggtcctcgaggaagacggcacgaccgtggaaactgaagagtacttccaggcgctggcaggagatacagtctttatggtgctccagaagggccaaaagtggcagcctcccagtgagcagggaacccgacaccctctctcactctctcataagccagccaaaaagattgatgtggccagggtaacttttgacctttataaattaaatcctcaggatttcataggttgtctgaatgtgaaggccaccttttacgatacatacagtttgtcatacgatctacattgttgtggggctaaacgcataatgaaggaggccttccgctgggcactgttcagtatgcaggccaccggccatgtgctgttaggaacaagctgctacctacagcagctcctcgacgctacggaggaaggacaacccccaaaagggaaagcgtccagcttaatcccaacctgcctcaaaatcctgcagtag

SEQ ID NO: 48872 - DNA, 987 bp, Artificial Sequence
  Description of Artificial Sequence: Synthetic coding sequence
atggctaacagcgccagccccgagcaaaatcagaaccactgctcggccatcaataacagcattccccttatgcaggggaacttgcctactttgactctttcaggcaagatacgggtgacagtgacatttttcctattccttctctcagcgaccttcaacgcatcattcctactcaagctccagaagtggactcagaagaaggaaaaagggaagaagttgtcacgcatgaagcttctactgaagcacctgacgctcgccaatctgttggaaacactgattgtgatgccactggatggtatgtggaatattacagtgcagtggtacgccggagagctcttatgcaaagtgttgagctacctcaaattgttctccatgtatgcccctgcttttatgatggttgtcatctctctggacaggtcgctggctattaccaggcctcttgcccttaaaagcaacagtaaagtggggcagtccatggtgggtctggcttggattctatcttccgtgttcgcgggacctcagctctacatttttcggatgatccacctggcggattcaagtggccagacaaaggtgttctctcagtgcgtcactcactgcagttttagccagtggtggcaccaggccttttataactttttcacattcagctgcctgtttatcataccactttttataatgttgatctgcaatgcaaagatcatctttacactcaccagggttttacaccaggatccacacgagttgcagctcaaccagagtaagaataatatcccgcgagctaggctgaagactctgaagatgaccgtcgcctttgctacctcttttacagtgtgctggaccccatactacgtgctgggtatctggtattggttcgatccggagatgttgaataggctttctgaccccgtcaaccatttcttcttcctgtttgcattcctgaacccatgcttcgacccgctgatttacgggtatttctctctctag

SEQ ID NO: 48873 - DNA, 504 bp, Artificial Sequence
  Description of Artificial Sequence: Synthetic coding sequence
atgagcctagcccttcgcagtgagttagtagttgacaagaccaagagaaaaaaacggagagagctgtctgaggagcagaagcaggagatcaaagacgccttcgaactgttcgacacggacaaagacgaggccattgactatcacgagctgaaggtggcgatgcgagccctcggcttcgatgttaagaaggcggacgtcttaaagattctcaaagattatgacagagaagccactgggaaaatcacttttgaagacttcaacgaagtggtcaccgattggattttagaacgcgacccgcatgaagaaatactcaaggcattcaaattattcgacgacgatgatagcggcaaaatcagtctacgaaaccttagacgagtggccagggagttgggtgaaaatatgtcagacgaggaactcagagccatgattgaagagttcgacaaggacggcgatggggagatcaatcaagaagaatttatcgccataatgaccggagacatttag

SEQ ID NO: 48874 - DNA, 789 bp, Artificial Sequence
  Description of Artificial Sequence: Synthetic coding sequence
atggccgtaacagctcaggctgcacgtcgaaaagagcgtgtgctgtgcctgtttgacgtggatggaacactcactcccgctcggcaaaaaattgatcctgaggtggccgctttcctgcaaaagttgcggagcagagtacagatcggggtagtcggcggaagcgactactgtaaaatcgcagaacagttaggcgacggagatgaggtcattgagaagtttgactacgtttttgctgagaacggcaccgtccagtataaacatggacgcctgttatcaaaacagaccatacagaatcatctgggtgaagagctcctgcaggatctgattaatttttgtctgagctacatggcattgctcaggcttccgaagaaaagaggcacctttatcgagttccgaaacggcatgcttaatatatcacctataggaagatcctgtactctcgaggagaggatcgagttcagcgaactggataagaaggagaaaatcagagagaaatttgttgaagccttgaagactgagtttgctggaaagggactgcggttttctagaggcggtatgatttcctttgacgttttccctgaagggtgggataagcgctactgtcttgacagtctcgaccaagacagtttcgacacaatccacttcttcggcaatgaaacctcaccaggcggtaatgatttcgagatcttcgcagatccacgaaccgtggggcactctgtagtctccccgcaggacaccgtgcagaggtgtcgagagatcttcttcccagaaacagcccatgaggcgtag

SEQ ID NO: 48875 - DNA, 1020 bp, Artificial Sequence
  Description of Artificial Sequence: Synthetic coding sequence
atgtttagtgaggtcctgcacggcctcattggaagaacgcagagatccgccggagttgatcagaatcacccaagggcagttctggtcccatcctccttacgaatcggcatcatcccagccggaagcaccgactgcgtgtgttattcaacagtgggaacaagtgatgccgagacgtcggctttgcacatcgtggtgggtgactcactggcgatggatgtcagcagcgtgcaccacaactccaccctgcttaggtacagcgtgagcttgcttggctacgggttctacggcgatatcatcaaagactcagagaagaagagatggctcggactggccaggtatgacttctctggtctcaagacatttttatcgcaccattgctatgaggggactgtcagcttcttgcctgcacaacatacggtgggatctcccagggacaggaaaccttgtagggcaggctgttttgtgtgccggcagagtaaacaacaattagaggaagagcagaagaaagcactttatgggctggaggccgctgaggacgtggaagagtggcaggtcgtttgcggaaagtttttagcaattaatgctacaaatatgtcctgtgcctgtagacggtcccctcggggtctcagtcccgcagcacacttgggagatggatcaagcgatctcatcctgatccgtaagtgcagtaggtttaacttcttgcgctttctcattaggcataccaaccagcaggaccaatttgattttacctttgtggaggtgtaccgggtcaaaaagtttcagttcacctctaaacatatggaagacgaagactcagatctgaaagagggtggtaagaagagatttggccatatctgtagtagtcatccaagctgctgttgtactgtgtcaaattcctcctggaactgtgatggcgaagtgctgcacagccctgcaatagaggtgcgagtccactgtcagctggttcggctgttcgcacgaggtatcgaagagaatcctaaaccagactctcacagctag

SEQ ID NO: 48876 - DNA, 1053 bp, Artificial Sequence
  Description of Artificial Sequence: Synthetic coding sequence
atggccgctgcgggtccagcagctggcccaaccggtccagagcctatgccctcctatgcccagttagtgcaacgcggatggggctccgccttagccgctgccagggggtgtaccgattgtggctggggtctggctaggcggggactcgcggagcatgctcacttagccccacccgagctgctcctcctcgctctcggcgcactgggttggacagctctgcgcagcgccgcaactgctaggttgttccggccactcgctaagcgctgttgcctgcagccccgtgatgccgcaaaaatgccggagtccgcgtggaagttccttttctatctgggatcttggtcttattcagcctacctcctgttcggaactgattatccattttttcacgacccaccttctgtgttctatgactggacacctggaatggcagtccccagagacatagctgccgcatacctgttgcaaggctcattttacggacacagcatctacgcaaccttgtacatggatacatggagaaaagattcagtggtgatgctgctgcatcatgtggtcacactgatactgattgtgtccagttatgcctttagataccacaatgtcggaatcctagtgctattcctccatgatatctctgacgtacagttagaatttacaaagttaaacatttacttcaagagcagaggcggtagttatcaccgcctgcatgccctggctgcagacctgggctgtctatcatttgggttcagctggttctggtttaggctgtactggttccccctgaaggtgctctatgcaacatcccactgttctcttcggaccgttccagatatacccttctactttttttttaatgcactgctgctgctgctgacgctgatgaatttatactggtttctgtacatcgtcgcctttgccgcaaaggtcctgacaggtcaagttcacgagctgaaagacttaagggagtatgatacggccgaagcccagtccctcaagccttcaaaggccgagaaacctctcaggaacggattggtcaaggacaaacgattctag

SEQ ID NO: 48877 - DNA, 1014 bp, Artificial Sequence
  Description of Artificial Sequence: Synthetic coding sequence
atggccgctgcagggcctgctgcaggcccaacaggaccagaacctatgccaagctacgctcaactggtacaacggggatggggctctgctcttgctgccgctaggggttgtaccgactgtggctgggggctggctcggcgtgggctggcggagcacgcccacctcgcccctcccgagctgctgttacttgccctcggggcacttggctggactgcgctgcggtcagcagccaccgcgagactgttcagacccctcgccaagcgctgctgtttgcaacccagggatgccgcaaagatgcctgagagcgcttggaaattcttattttatctggggtcctggtcgtactctgcgtatctactgtttggtacagactatcccttctttcacgaccccccatcagtattttatgactggacacctggcatggcagtcccccgagacatcgctgcagcttacctgctgcagggatccttctatggtcatagcatatatgcaaccttatatatggacacatggcgcaaggattccgtggtcatgctgctacaccacgtcgttacgttgatcctcatcgtcagtagctatgcttttagataccataatgtgggcatcctggtcctgttcctacacgatattagcgatgttcagctggagtttacaaagctgaacatctatttcaagtctcggggaggatcctaccacagacttcatgcactagccgcagaccttggctgcctctcttttggttttagttggttctggttccggctgtattggtttccactgaaggtgttatacgccacatctcactgttccctgagaacggtgcctgatattcccttttactttttctttaacgcgctattactgctcctgactctgatgaacctgtattggtttctgtatatcgtcgcctttgctgctaaggtgcttactgggcaggtccacgaattgaaagacttaagggagtacgatacggctgaagcccaaagcttgaagccatcaaaagccgaatag

SEQ ID NO: 48878 - DNA, 720 bp, Artificial Sequence
  Description of Artificial Sequence: Synthetic coding sequence
atgccagagtctgcttggaagttcctattctacctgggaagctggagttactcggcctaccttctcttcggcaccgattacccattttttcacgatccgccttctgtcttttatgattggacccctggaatggcagtgcctcgcgacattgccgctgcttatctcctgcaaggatctttttatggacactctatttatgcaactttgtatatggacacctggagaaaagactcagttgttatgttactccaccacgtcgtcacactgatccttatcgtcagtagctatgctttccgttaccataatgttggcattctggttttgttcctgcacgatatctctgacgtgcagctcgagtttacaaagctgaacatctatttcaagtcccgcggaggaagctatcacaggctgcacgcattggccgcagatttaggatgtctgtccttcggcttctcatggttctggtttaggctgtattggttccctctgaaagtactgtatgctacgagccactgctctctgagaacagtgcccgatattcccttttactttttttttaatgccctgttactgctgttgacgctgatgaatctttactggtttctttatatcgttgcatttgctgccaaagttctgaccggtcaggtacatgagttaaaggacctgagggagtacgacaccgccgaagcccagagcctcaagccttctaaagcagaatag

SEQ ID NO: 48879 - DNA, 1143 bp, Artificial Sequence
  Description of Artificial Sequence: Synthetic coding sequence
atgctgcagaccctgtacgactatttctggtgggagcggctgtggttgcccgtgaatcttacctgggctgacctggaagatagggacggacgggtgtatgccaaagcaagtgatctgtatataacccttcccctagctctgctgtttctcattgtccggtattttttcgagctttatgtggcaacacccctggctgccttgttaaatatcaaggagaaaactcggcttagagcaccaccgaacgccaccctggaacacttctacttgacttcaggaaagcaacctaagcaggtggaagtagagctgctgagccggcaatccggtctatctggcaggcaagttgagcgctggttcagacggaggcgtaaccaagatagaccgagtctgctcaaaaagtttcgcgaggcttcttggcgctttacgttctatctgatagcatttattgcgggaatggccgtcattgtggataaaccatggttctacgatatgaaaaaggtgtgggaaggttacccgatacagagtactatcccttcgcagtactggtattatatgatcgaactgagcttctactggagcttgctcttcagcatcgccagtgatgtgaaacgcaaggacttcaaggagcaaatcattcaccatgtagctaccatcatcctcattagtttttcctggtttgctaactacattcgtgctgggaccctcatcatggcactgcatgacagctcagattacctgcttgagtccgctaagatgtttaattacgcaggatggaaaaatacatgcaacaatatctttattgtattcgctatcgttttcatcattactcggctcgtgatcctccctttttggattctacattgtacactcgtgtaccccctggagttatatccagccttcttcggctactatttttttaactccatgatgggggtgctgcagctgctgcatatcttttgggcttatctgattctgcggatggcccacaagttcatcacaggaaaattagtcgaagacgaacgatcagatcgagaagagactgagagcagcgaaggtgaagaggcggcagcaggcggaggcgcaaagagtcgacccctggcaaacggacaccccatactgaacaacaaccacaggaagaacgattag

SEQ ID NO: 48880 - DNA, 693 bp, Artificial Sequence
  Description of Artificial Sequence: Synthetic coding sequence
atggccgttatcgttgacaaaccttggttttacgatatgaagaaagtatgggagggataccccattcagtcaaccatcccatcacagtactggtactacatgatagagctgtctttttactggagcctgcttttctccatcgccagtgacgttaagagaaaggacttcaaggagcagattatccaccatgtggctaccatcatcctcattagctttagctggtttgccaactatatcagggctggcactctgattatggcgctgcatgatagcagcgactatttattggagtcagccaaaatgttcaactacgctggatggaagaatacctgcaataatattttcatcgtcttcgcaatcgtctttatcatcacacgcctggtgattcttccattctggatcttacattgcactttggtatatcccctggaactctaccccgctttcttcggatattactttttcaattctatgatgggggtgctgcagctgctgcatatcttttgggcctacctgatactgcgcatggcacacaaattcataacagggaagctggtagaggacgaacgaagtgacagggaagagactgaaagcagtgagggggaggaggctgctgcagggggaggagcaaagagtaggccgctggcaaatggtcacccaatccttaataataatcaccggaaaaacgactag

SEQ ID NO: 48881 - DNA, 750 bp, Artificial Sequence
  Description of Artificial Sequence: Synthetic coding sequence
atgctccagaccctgtacgattatttttggtgggaacggctttggttaccggttaacctaacgtgggctgacctggaagacagagacggcagagtgtatgccaaagccagcgacctttacatcactctccctttggccttactgttcttaatcgtccggtattttttcgagctgtatgtcgcaaccccactcgccgctcttctgaatattaaggagaaaactcggctgagagcaccccctaatgccacccttgaacacttctatctgacaagcggcaagcaaccaaaacaggtcgaagtggaactgttgagtcggcagagcggtttaagcggaaggcaggtcgaacggtggttccggaggagacgcaatcaagacaggccctcactgctcaaaaagtttagagaggcttcctggagattcaccttctacctgatcgcgttcatcgccggaatggccgttatagtcgataaaccatggttttatgacatgaagaaagtctgggaaggttacccaatccaatctacaattcctagtcagtattggtattacatgattgagttgtccttttactggtcactgctgttctctatcgcctccgatgtgaagagaaaagactttaaggaacagatcatacaccacgtagccaccatcattctcatctccttcagttggtttgccaattatatacgggctggcacgcttattatggcattacatgactcgagcgactacctgctcgaagtcagatag

SEQ ID NO: 48882 - DNA, 975 bp, Artificial Sequence
  Description of Artificial Sequence: Synthetic coding sequence
atggtaccgctggctctgcatttcccaggtgaagtcggcctccaagagaccgcagtgagaatgctgcaaacactgtacgattatttttggtgggaaagactgtggctccccgttaacctgacctgggccgacctcgaggatagagacggacgcgtgtatgcaaaggcgtcagatctgtacataactctcccactggcattgttattccttatagtgaggtatttctttgaactgtatgtcgcaacccctttggccgcactgctgaacatcaaagaaaaaacaaggttgagggcacctccgaacgcgactctagaacatttctacctgactagtggcaagcagccgaaacaggttgaagtcgagttgctgagcagacagtctgggctgtcggggcgacaggtcgaacgctggtttcgccgaagaaggaatcaagataggccttcccttctgaagaaattccgggaggctagttggcgatttaccttttatcttatcgccttcatcgccggtatggctgtcatcgtcgataagccctggttttatgacatgaaaaaggtgtgggaagggtaccccattcagagcacgatcccgagtcagtactggtattatatgatcgagctaagtttctattggtccctgcttttctctatcgccagtgacgttaaacgcaaggactttaaggaacagattatccaccatgtggcaactattatacttatttcattctcctggttcgctaattacattcgggcaggcactctaattatggctcttcatgatagcagtgattacctcctggagtctgctaaaatgttcaattacgctggatggaagaacacatgtaacaatatcttcatagtgtttgccattgtgttcataatcacccgcctggtgattctacctttttggatcctgcattgtacactcgtgtatccattggaactctacccagccttcttcggatattacttctag

SEQ ID NO: 48883 - DNA, 1143 bp, Artificial Sequence
  Description of Artificial Sequence: Synthetic coding sequence
atgcttcagaccctgtacgactatttttggtgggaaaggctgtggctcccagtgaacttgacctgggctgatctggaagacagggatggaagggtctatgcaaaagccagtgacctgtacatcaccttacccctggccttgttatttctcatagtgaggtactttttcgaactttatgtcgccacaccactcgccgctctacttaacataaaagagaagacgaggctcagggctcccccaaatgctactctggaacacttttaccttacaagcggaaaacagccaaagcaggtggaggtcgaactcctctcccgccagagtgggttatcaggacgtcaggtagagcgatggttcaggcgcaggagaaaccaagatagaccaagccttctgaaaaagtttcgcgaagcctcttggaggttcactttctatttaatagccttcattgcaggaatggccgtgatcgtagataagccctggttctacgacatgaagaaggtctgggaagggtatcctatccagtccactatcccttcccagtattggtattatatgattgagctttcattctactggagtttgctgtttagcattgcttctgatgtgaagcgtaaagacttcaaagaacagatcattcaccatgtggccacaattatcctgatttccttctcatggtttgctaactatatcagagccggaaccctaataatggcgctccatgactctagtgactacctgctggagagcgctaagatgtttaactacgccggatggaaaaatacatgtaataacattttcatcgtttttgccatagtgttcattatcacccggctggtgattctgcctttctggatactgcattgcaccctcgtctaccctctcgaattatatcctgctttcttcgggtattatttcttcaatagcatgatgggtgtgttgcagttgctgcacatattttgggcttatctgatcctgcgaatggctcacaagtttatcaccggcaaactagtggaggacgaacgctctgaccgggaagaaacagagagcagcgagggagaggaggcggctgccggaggtggagctaagtctagaccgcttgctaacggtcaccccatcctgaacaataaccaccgcaaaaatgactag

SEQ ID NO: 48884 - DNA, 579 bp, Artificial Sequence
  Description of Artificial Sequence: Synthetic coding sequence
atgctccagactctgtacgactatttttggtgggaaagactgtggctcccagtcaacttgacttgggctgacttagaggacagggacgggagggtctacgccaaagctagcgatctctacataaccttgcccctggccctgcttttcctaatcgttcgctacttcttcgagctatatgttgcgactcctctggccgcactgctgaacattaaggagaagactcgattgcgggcaccacccaacgctacattggaacacttctaccttacatccggcaagcagcccaaacaggtggaggtggagctgctctcccggcagtcagggctatctggtcggcaggtggagagatggtttcggaggcgtagaaatcaggacaggcccagtctcttgaagaagttcagggaggcttcttggagatttacattctatttgatagcgtttattgcgggtatggccgtgatcgtggacaagccttggttctatgacatgaaaaaggtctgggaggggtaccctattcagagcacaattcctagtcaatactggtattacatgatcgagctgtccttttattggagttag

SEQ ID NO: 48885 - DNA, 390 bp, Artificial Sequence
  Description of Artificial Sequence: Synthetic coding sequence
atgttgcagacactgtacgattacttctggtgggagagattgtggctgcctgtgaatctcacttgggccgacctcgaagacagagacggacgggtatacgctaaggcaagcgacctctacatcacactgcccctggctctcctttttttaatcgtccggtactttttcgaattgtacgtggccacgcctttggctgccctgctcaacatcaaggagaaaacaaggctccgggctccaccgaatgctacactggaacatttttatttaacgtcgggaaagcaacccaagcaggtagaagtcgagttactgtccaggcagtccgggctgtccggtcgacaggtggagcgatggttcagaaggcggcgtaaccaggaccggccttctctgtag

SEQ ID NO: 48886 - DNA, 672 bp, Artificial Sequence
  Description of Artificial Sequence: Synthetic coding sequence
atgttacagaccctctacgattacttttggtgggagagattgtggctgcctgtcaatctgacctgggcagacctggaggaccgcgatggccgagtatacgccaaagccagtgatctctatatcacacttccattagcattgctttttttaatagtgaggtatttttttgagctatacgttgctacccctctggccgcacttttaaatattaaggagaagacccgcctcagggctccccctaacgctacgttggaacatttttacctgacatctgggaagcagcctaaacaagtggaagtggaactgctttctcgacagtctggactgtctgggaggcaggtggagcgttggtttcggagacgacggaaccaagatcgcccttccctcctgaaaaagtttagggaggccagttggagatttaccttctacttaatcgcgttcattgctgggatggcggtgatcgtcgataaaccatggttctacgacatgaaaaaggtgtgggagggctaccctatccagtccacaatcccatcccaatattggtattatatgattgagctgtctttctactggagtctgctcttctccatcgcatctgatgtcaaacgcaaggattttaaggagcagatcattcaccatgttgcaaccattatcctaatctcattcagctag

SEQ ID NO: 48887 - DNA, 1152 bp, Artificial Sequence
  Description of Artificial Sequence: Synthetic coding sequence
atgttttggaccttcaaggagtggttctggttagagcgattctggcttccacctacaattaaatggagcgatctggaggatcatgacgggttagtcttcgtgaagcctagccatctatacgtgactattccctatgcctttctgctgttaatcatacggagggtcttcgagaaatttgtggcaagccctctggccaaaagctttgggatcaaagagaccgttagaaaagttactccaaataccgtgctggaaaatttttttaagcatagtacgcgacaaccactccagaccgatatttacggcttggcgaaaaagtgcaatctgacagagcggcaggtggagaggtggttccgcagtaggagaaatcaggaacggccttcacggctgaaaaagttccaggaagcctgctggaggttcgctttctatctgatgattacagtagcaggaattgcgtttctttacgacaagccttggctttacgacctctgggaggtctggaatgggtatcccaagcagcctttgctcccatcccagtactggtactatatcctcgaaatgtctttttattggtcattgctttttcgcctaggcttcgatgtgaagcgtaaggatttcctagcccatatcatccaccacctagcggctatttccctgatgagcttcagttggtgtgccaattatattaggtcaggtactctagtcatgattgtacacgatgtggcagacatctggctggagtcagccaagatgtttagctatgccggatggacacagacttgcaataccctgttttttatcttctcaacaatcttctttattagtcgcttgatagtgttccccttttggattctgtactgcacccttattctgccaatgtaccatctggagccgtttttctcctatatctttctgaatctccagttgatgatattgcaggttctccatctttattggggttattacattcttaaaatgctgaacaggtgtatttttatgaaatcaatccaagacgtacgcagcgatgatgaggactacgaggaggaagaagaagaggaggaggaagaggccacgaaaggaaaagagatggattgcctcaagaatggactgagagcagaacgacatctgattcccaacggacaacacgggcattag

SEQ ID NO: 48888 - DNA, 1152 bp, Artificial Sequence
  Description of Artificial Sequence: Synthetic coding sequence
atgttttggacattcaaggagtggttttggttagagcggttctggttgccaccgaccatcaagtggagtgacctcgaagatcatgacgggttagtctttgtgaagccaagtcacctgtatgttacaatcccgtacgccttcctcctcctgattattcggcgagtattcgaaaagttcgtcgcttccccccttgcaaaatcgtttgggatcaaggagacagtccgaaaggttaccccaaataccgtccttgaaaacttctttaagcactccacccgccaacccctccaaacagacatatacggtttggccaaaaaatgcaacctgaccgaacggcaggtggaacgctggttcagatcccgcaggaatcaagagcgaccatctcgcctgaagaagttccaagaagcctgctggaggttcgccttttacctcatgataacggtggcaggtatcgcatttctctatgataagccatggctttatgatctgtgggaggtatggaacggatatccaaagcagcccctgctgccatcccagtattggtactatatcctcgagatgtctttctactggtcactcctctttcggcttgggttcgacgtgaagagaaaagactttctcgcgcatataattcaccatctggctgccataagtctgatgtcatttagctggtgtgccaattatatacgttctggcacccttgtgatgatcgtgcacgacgtcgcagacatttggctggaatctgcaaaaatgtttagctatgccggatggacccagacgtgtaacactctttttttcattttcagtactatcttcttcatcagccgcctcatcgtgttcccattttggattctctactgcaccctcatccttccgatgtatcatctggaacccttcttctcatacatcttcttaaatctccagctaatgatactccaggtgcttcacctctactggggctattatattctgaagatgctcaatcgttgcatatttatgaagtcaattcaggacgtcagaagcgatgatgaagactatgaggaggaggaagaggaagaggaggaagaagccaccaagggtaaagaaatggactgtctcaaaaatggcttgcgcgcagagcgccacctcattccaaacggccagcacggccattag

SEQ ID NO: 48889 - DNA, 1152 bp, Artificial Sequence
  Description of Artificial Sequence: Synthetic coding sequence
atgttctggacttttaaagaatggttttggcttgagaggttctggctgcctccaacaatcaaatggtcagacttagaggaccatgacggactcgtttttgttaagccttcgcacctctatgtgaccataccctacgcatttctgcttctcattataaggagagtgtttgaaaagtttgtcgccagtcctctggccaagtcattcggtatcaaagagacagtccgaaaagtgactccgaatactgtactcgaaaatttcttcaagcacagtacaaggcagccactgcagacagacatatacggtcttgctaagaaatgtaatctgacggagagacaagtagaaagatggttcaggtctcggagaaaccaggagcgcccatcacgcctgaaaaagtttcaggaagcatgctggagatttgcgttctatcttatgattacagtcgcagggatagccttcttatatgataaaccatggttatacgatctctgggaagtgtggaacggatatcctaaacagcccctgctgccttcccagtattggtactacattctagaaatgagtttctactggagcctgctcttccgcttgggctttgatgtgaaacgcaaagatttcctggctcatattatacatcatcttgctgcgattagtctgatgtccttctcctggtgtgctaactacattcgttctggcactctggtgatgatagtgcacgatgtggctgacatttggctggaaagtgctaagatgttctcctacgccggatggacacagacctgcaatacactgttctttattttctcaaccatctttttcatttctagactgatcgtgtttcccttctggatcctgtattgcactcttattctgccaatgtatcatcttgagcctttcttctcctacatttttctcaacttacagctcatgattttacaggtgctgcacctgtattggggctattatatcttgaaaatgctcaacagatgtatatttatgaagagtatccaggatgtgcggtcggatgatgaggactacgaggaagaggaggaagaggaggaagaagaggccactaagggcaaggaaatggattgcttgaagaatggtctgcgcgctgaacgtcacctcattcctaatggccagcatggccattag

SEQ ID NO: 48890 - DNA, 468 bp, Artificial Sequence
  Description of Artificial Sequence: Synthetic coding sequence
atgttttggacctttaaggaatggttctggcttgaaaggttttggctcccccctactattaaatggtcagatttggaggaccacgatggactggtcttcgtgaaacccagccatctctacgtgacaattccctacgctttcctactcttgatcatcagaagagtgtttgaaaaattcgtcgcatcccccttagcgaaatcgtttgggataaaagaaactgtgaggaaggtgacccctaacactgttctggagaactttttcaagcactccacccggcagcccttacagaccgacatctacgggctcgctaagaaatgtaatctcacagaacgccaggttgaacgctggttcagaagtcgcaggaaccaagagcgccctagccggctgaagaaatttcaggaggcctgctggcgcttcgctttctatctgatgattaccgttgccggtattgcattcctgtacgattag

SEQ ID NO: 48891 - DNA, 48 bp, Artificial Sequence
  Description of Artificial Sequence: Synthetic coding sequence
atgttttggaccttcaaagagtggttttggctcgagaggttctggtag

SEQ ID NO: 48892 - DNA, 174 bp, Artificial Sequence
  Description of Artificial Sequence: Synthetic coding sequence
atgttttggacctttaaagagtggttctggctggagagattttggctgccacctacaatcaaatggtccgacctggaggaccacgacggccttgtgtttgtgaaaccatcccatctgtatgtgacaataccgtacgctttcctgttactgattattagaagagtctttgaatag

SEQ ID NO: 48893 - DNA, 1185 bp, Artificial Sequence
  Description of Artificial Sequence: Synthetic coding sequence
atgttgtcaagttttaatgaatggttctggcaggaccgcttctggttaccacccaatgtaacttggactgaacttgaggaccgcgacggtagggtgtacccgcatccccaggacctactcgctgcattaccacttgcgctcgttctgttggcaatgcggctggcctttgaaagatttatcgggctgcctctgtcccgttggctcggagtcagggatcaaacgcggcgacaggtaaaaccaaacgccactctggaaaagcatttcctgaccgaggggcataggccaaaggagccacaacttagccttctggcagcccagtgcggactgaccctccagcaaacacaaaggtggttcagacggcgacggaatcaggacaggcctcaactaaccaaaaaattctgtgaggccagctggcgatttcttttctatctaagtagcttcgttggcggtctgtccgtgctgtaccacgagtcttggctgtgggcacccgtcatgtgctgggatagatacccaaatcagaccctgaaacccagtctctattggtggtatcttctagaactgggcttctatctatcattgctgattagactccccttcgatgtgaagcgtaaagatttcaaggagcaggtcatccaccactttgtggcggtgattctcatgacatttagttacagtgcaaatctgcttcgcataggttctctggttctgctgctgcatgacagctccgactaccttctcgaagcatgtaaaatggtcaactacatgcagtaccagcaagtttgtgatgcgttgtttcttatcttctcttttgtattcttttatacgagactcgtcttgtttcctactcagatactttatactacttactacgaatcgatttccaatagaggaccgttcttcggatactactttttcaacgggttgttgatgcttctgcagcttctgcatgtgttttggtcttgtttgattttgcgcatgttgtattcctttatgaaaaaggggcagatggagaaagacatccgatctgacgtcgaggaatccgactcttccgaagaggctgccgcagcccaagagccactacagttgaagaacggcgcagcaggcggaccgagacccgcacccacagatggacccagatctagagtggctggtcggctgacaaatcgacacacaacagccacatag

SEQ ID NO: 48894 - DNA, 342 bp, Artificial Sequence
  Description of Artificial Sequence: Synthetic coding sequence
atgttgtcatccttcaacgagtggttctggcaggacagattttggctaccgccaaacgtgacatggacagaactggaggatcgggacggcagagtgtatccacatccgcaggatctgctggccgctctcccattggctttagtgcttctggccatgagattagcttttgagagattcattggattacccctctctcgctggcttggagtcagagaccagacacggagacaagtgaaacctaacgcgactttggagaagcactttctgacagaggggcacaggcccaaggaacctcagctgtcgctgcttgccgcacagtgtgggttaacccttcagcagtag

SEQ ID NO: 48895 - DNA, 579 bp, Artificial Sequence
  Description of Artificial Sequence: Synthetic coding sequence
atgttgtccagcttcaatgaatggttctggcaagacagattttggctgccaccaaatgtgacttggacagaattagaggaccgagacggaagagtctatccgcatcctcaggacctgctggccgctcttccccttgcattggtgctactggccatgagactagcattcgagcgattcatcggactgcctttaagcagatggctaggagtgcgggaccagactcggaggcaggtgaaacctaatgcgaccttggagaagcatttccttactgaggggcatcggccaaaagaaccccaactaagcctactggctgcgcaatgcggactgaccctgcaacaaacacagaggtggttccgaagaagacgcaatcaggaccggcctcagctgacaaagaagttctgcgaagcttcttggcgatttctgttttacttaagcagctttgtgggtgggctgtcggtcctttaccacgaatcctggttgtgggccccagtcatgtgctgggataggtacccaaaccagaccctgaaacctagcctgtattggtggtacttgttggagctggggttctacctgtcctag

SEQ ID NO: 48896 - DNA, 1185 bp, Artificial Sequence
  Description of Artificial Sequence: Synthetic coding sequence
atgctctcaagcttcaacgagtggttttggcaagatcggttctggcttcctcccaacgtgacatggaccgagctggaagacagggacggcagagtatatccgcatccacaggacctgttggcagcccttccactggccctggtactgctggcgatgcgcttagcatttgagcgattcattggactaccattatcgagatggctcggcgtcagagaccagacgaggcgccaggtcaaacccaacgctaccttggaaaagcactttctgacagaggggcataggcctaaagagccacagttgtccttgctggcggctcagtgcggcttgacgttgcagcagacacagcggtggtttaggagaaggcgtaaccaagaccggcctcagctgacaaaaaaattctgtgaggccagctggagattcctcttttacctgtctagtttcgttggcggactgtccgtgctgtaccacgaatcctggctgtgggcgccagtcatgtgttgggataggtaccccaatcagacccttaaaccgtctctgtactggtggtacctcctggaactggggttttatctctctctgctcattagactcccttttgacgttaagcgtaaagattttaaggagcaggtgattcaccatttcgtcgcagtcatccttatgaccttcagttacagtgcgaatctgctccggatcggcagcctcgtccttctccttcatgattctagtgattacctcctcgaggcatgcaagatggtgaattatatgcagtatcagcaggtgtgcgatgcactgtttctgatctttagtttcgtgttcttctacaccagattagtcttattcccaacccagattctctataccacatattatgagtccattagtaacaggggtccgtttttcggatattattttttcaacggtctgctgatgctgttacagctcctccacgttttctggtcatgtcttatcttacgcatgctctactcgtttatgaagaagggtcagatggagaaagatattcggtcggatgttgaagagagcgactcctccgaagaggcagcagctgcacaggaacctttgcagctgaagaatggagctgcaggaggcccacgcccagccccaacagacgggcctcgatctcgtgtagctggcaggctgacaaatcgacacacaactgcaacctag

SEQ ID NO: 48897 - DNA, 99 bp, Artificial Sequence
  Description of Artificial Sequence: Synthetic coding sequence
atgctaagttcctttaacgagtggttctggcaggaccgtttctggttgccccctaacgtgacctggacagaactggaggacagggacgggcgagtatag

SEQ ID NO: 48898 - DNA, 279 bp, Artificial Sequence
  Description of Artificial Sequence: Synthetic coding sequence
atgcttagctcatttaacgagtggttttggcaagataggttctggctacctccaaacgtgacgtggaccgagctcgaggatagagacggcagagtttacccacatcctcaggaccttcttgcagccttacccctcgccctggttctgctagctatgcggcttgcgtttgaacgtttcatcgggctcccactgtcacggtggcttggtgtacgggaccaaacccggagacaggtgaagccgaacgccaccctcgaaaagcatttcctaacagagggatag

SEQ ID NO: 48899 - DNA, 1179 bp, Artificial Sequence
  Description of Artificial Sequence: Synthetic coding sequence
atggcaaccgccgcacaaggacctcttagtttactgtggggatggctctggtccgagcgattctggttgcctgaaaacgtttcttgggccgatctcgaggggccagccgatgggtacgggtacccgagaggtcgacacatactgagcgtgttcccactcgccgctggtattttttttgtcagacttcttttcgagcgcttcatagccaaaccttgtgcactgtgtattggtattgaggacagcggcccataccaggcccagccgaacgccatcctggagaaggttttcatctcaatcaccaagtacccggacaagaagcgcctcgagggtctgtcaaagcagctggactggaacgtgcggaagatacagtgctggttccgccaccgcaggaatcaggataagcctcccactctgacaaagttctgcgagtccatgtggcgattcaccttctatctctgcatcttctgctacggaataagatttctctggtcctcaccatggttttgggacattcgccagtgttggcacaactacccatttcaaccactcagctcaggcctctaccactattatatcatggagctcgctttttactggagtctaatgttctcacaattcaccgatattaaaagaaaagactttcttatcatgtttgtccaccatctcgtaacaatcggtctcatctcgttcagttatattaataacatggtacgagtggggaccctcattatgtgcctgcacgatgtgtcagatttcctgttggaggccgcaaaacttgccaattacgctaagtaccagcggctctgcgacaccctgttcgttatcttcagcgccgtctttatggtgacccggctggggatctatcccttctggatactcaatactactctattcgaaagctgggaaattattggcccttatgcaagttggtggctcttaaacggcctgctgcttaccctgcagctactccacgtgatctggtcatacctgatcgctcgcatagctctaaaagctctgatcaggggcaaggtgtctaaggatgatcggtctgacgttgagtctagttccgaggaggaggacgtgacaacctgtaccaagtccccatgcgatagtagctcctctaacggcgcaaatcgagtaaacggacacatgggagggagctactgggctgaggaatag

SEQ ID NO: 48900 - DNA, 588 bp, Artificial Sequence
  Description of Artificial Sequence: Synthetic coding sequence
atggctacggcggcacagggcccattgtctctcctctgggggtggttgtggtccgaaagattttggcttcccgaaaacgtgtcatgggctgacctagagggccctgccgatgggtacggatacccccgtggtaggcatattctgtcagtgtttcccctcgctgctggtatcttcttcgttcggttactgttcgagcgcttcatagctaaaccttgtgctctgtgcatagggatcgaagattctgggccttaccaagcccagcctaatgcaatcctcgaaaaggtgtttatcagcatcaccaagtacccagataaaaagcggttggaggggctgtctaagcagcttgattggaatgtgcggaaaatacaatgttggtttcgccaccgacgcaatcaggacaaaccacccacacttacaaagttctgtgaatccattcatctcgggagtgggacttccgactcagcgggaataactattcactttagcttgttccaagtgggctttatcacaattatttcctggaactggccctccattggcccattatgcttcttgtccctgcagacgctgaaggaaagaacaagttag

SEQ ID NO: 48901 - DNA, 1005 bp, Artificial Sequence
  Description of Artificial Sequence: Synthetic coding sequence
atgatgaagccgcgtcccaagaggttcatcgccaagccttgtgctctgtgcatcggaatagaagattccggcccttaccaggctcagccgaatgctattctcgagaaggttttcatatccatcaccaaatatcccgacaagaaacgcctcgaaggtctgtccaagcagctcgattggaatgtacgaaaaatccaatgctggtttagacacagaaggaaccaagataagccgcctaccctgacgaaattttgcgaatctatgtggagatttactttctatctgtgcatcttttgttatgggattcggtttttgtggagttccccatggttctgggatatccgccaatgctggcataactacccttttcagcccctttccagcggtttataccattactatattatggagctggcgttctactggtcactgatgttcagccagtttacagacattaaacggaaggacttcctcatcatgtttgtccatcacttggtgaccatcgggctgattagcttttcgtatataaacaatatggtcagagtgggcacgctgattatgtgcctgcacgatgtctcagatttccttctcgaagctgccaagttagcgaactatgctaagtaccaacgcctttgtgatacactgttcgtgattttctctgctgtgttcatggttacgcggctcgggatataccccttttggatcctgaacactactctgttcgagtcttgggagatcattggcccatacgctagctggtggctcctgaatggacttcttctcacactgcaactactccatgtgatctggtcttacctgatagcacgtatcgcccttaaagcactgatcagaggcaaggtctctaaagacgataggtccgatgtcgaatcaagttcagaggaggaagacgttacgacgtgtacaaaaagtccctgcgacagtagtagctcaaatggtgctaaccgggtcaatggccacatgggaggatcctactgggccgaggagtag

SEQ ID NO: 48902 - DNA, 588 bp, Artificial Sequence
  Description of Artificial Sequence: Synthetic coding sequence
atggctacagctgctcagggtccgctgtcactactttggggctggctctggagcgagagattttggcttccagagaatgtgtcctgggccgatctcgaaggcccagccgacggttatggataccccagggggagacacatcttgtccgtctttccactcgctgctggtatctttttcgtgcgtcttctctttgaacgttttatcgccaagccttgcgccctgtgcataggtattgaggattccggaccatatcaggcccagccaaacgccattctcgagaaggtcttcatatccataactaagtatcctgacaagaagaggctagaaggactgagtaagcaattggactggaatgttcgtaaaattcagtgttggttccggcacagacgcaaccaggataagcccccaaccttaactaagttctgcgagagcatccatctcggctctgggacctccgactcagccggaatcaccatccacttttcactctttcaggtggggtttattactatcatctcatggaattggccaagcatcggcccactgtgtttcctgagccttcagacactcaaggaaagaacatcctag

SEQ ID NO: 48903 - DNA, 1155 bp, Artificial Sequence
  Description of Artificial Sequence: Synthetic coding sequence
atggccggaatcctagcctggttttggaatgagcggttctggttgccccataatgtgacctgggccgacctgaagaacactgaggaggctacttttccacaggccgaagacttgtacctggcttttccactggccttttgcatcttcatggtgcggctaatatttgaaagatttgtggccaaaccatgtgcaattgcactaaacatacaggcgaatggaccgcagatcgctcctccaaacgctatactggagaaggttttcaccgcgattactaagcatcctgacgaaaagcgactcgagggtttgtctaaacagttggattgggacgttagatcaattcagaggtggtttcgccagcggagaaaccaagaaaagccctctactctgacccggttctgtgagtcaatgtggcggttctccttctacctctacgtgtttacctacggggtaaggtttctgaaaaagacaccatggctgtggaatacccgccactgctggtacaattacccttatcagcccctaaccacagatttacactattactacattctggagctgagcttttattggtcgctgatgttctctcaattcaccgacatcaagagaaaggactttggaatcatgtttttacaccatcttgtcagtatctttctgataacctttagttatgttaataacatggctagggtggggaccttagtgttgtgcctgcatgattcagcggacgccttacttgaggctgccaaaatggctaactacgccaagttccagaaaatgtgcgatctgctgtttgtgatgttcgccgtcgtatttatcacgaccaggctaggcatctttcccctgtgggtgctgaatacaacactgttcgagtcttgggaaatcgtcgggccttacccatcctggtgggttttcaacctgctgctgctgctagttcagggactgaactgcttttggtcttatctgatcgtaaagattgcatgtaaagctgtctctcggggtaaggtctccaaggacgatcgtagtgacattgagtcctcttccgatgaggaggactccgaaccgccagggaaaaatccacatactgctacaaccaccaatggaaccagtggaactaatggctacctcctgaccggttcttgttccatggatgactag

SEQ ID NO: 48904 - DNA, 1179 bp, Artificial Sequence
  Description of Artificial Sequence: Synthetic coding sequence
atggccggaattctcgcctggttctggaatgagaggttttggctgcctcataacgtcacttgggccgatctcaagaataccgaagaagcaacattcccacaggccgaggacctgtaccttgcgtttcctctcgctttctgcattttcatggtaaggttgatctttgagaggtttgtggcaaaaccctgcgcgattgccctgaatatccaggcgaacggaccacagatcgccccacctaatgccatcctagaaaaagtctttaccgccattactaaacaccccgacgaaaagaggctggagggtcttagcaaacaacttgactgggacgtgagatccatccagaggtggtttaggcagcggagaaatcaggaaaaaccctcaacgctcactagattctgcgaatctatgtggcgcttctcgttttatctgtacgtcttcacttatggggtgcgctttctgaaaaaaaccccgtggttgtggaatacaagacactgctggtataactacccctaccagcccctcactactgacctccactattattacattctagaactttcgttttactggtcacttatgttcagccaatttactgacattaagagaaaggatttcggcattatgtttttgcaccacttggttagcatctttctcatcactttttcctatgtgaacaacatggctcgggtcggtactttggtgctgtgtctgcatgactccgcggacgcccttctcgaagccgctaaaatggcaaactatgcgaaatttcagaagatgtgtgatcttctgttcgtgatgttcgccgttgtgtttatcactactaggctggggatattccccttatgggtgctaaatacaactctatttgagagctgggaaatcgtagggccatacccctcctggtgggtcttcaatctgctattgctgctcgtgcagggcctgaattgcttttggagctacctcatagtgaaaatcgcctgtaaggctgtgtcacggggtaaagccggaaagtggaaccctttgcacgtttcaaaggacgataggtcagacatcgagtcttcgtccgacgaggaggacagcgagccccctgggaagaatccccacaccgcaaccactaccaacggaacaagtgggactaatggatatctcctgacaggttcctgtagcatggatgattag

SEQ ID NO: 48905 - DNA, 675 bp, Artificial Sequence
  Description of Artificial Sequence: Synthetic coding sequence
atgcaggcccctggcagaggcccacttggcctccgcctaatgatgcctggccgtagaggcgctttacgggaacccggagggtgcggctcgtgcctcggtgtcgccctggccctgctgcttctgctgctgccggcttgctgtcccgtgagagcacaaaacgacactgagccaatagtgctggagggaaagtgtctcgtggtctgtgattcctctccatccgctgacggcgctgtcacaagctccttagggatcagtgtgagaagtggatcagctaaggtagccttttctgccaccaggagtaccaatcatgaaccaagcgagatgagcaaccgtacgatgactatctacttcgaccaggtcctggttaatattggcaatcattttgatctggcaagctccatcttcgtagcacccagaaagggcatctactcattctctttccatgtggtcaaagtgtacaatcggcagacaatccaggtctctctgatgcagaacggttatcccgtcatcagtgcattcgccggtgaccaggatgtaacaagagaagccgcaagtaacggcgtcctgttgttaatggagcgtgaagacaaggtacatcttaaattggagcgcggaaatttgatgggcggatggaagtatagtacatttagcggattcttggttttccccctgtag

SEQ ID NO: 48906 - DNA, 1788 bp, Artificial Sequence
  Description of Artificial Sequence: Synthetic coding sequence
atgagagcagcgagagccgcacccctgctgcagctgctgctgctcctggggccttggttagaagcagctggggtggctgagagccctcttcctgccgtcgtgttggccatacttgcacggaatgctgagcacagtctaccgcattatttgggagccctggagcgcctcgactaccctcgggcacgcatggcactgtggtgcgcaactgatcacaatgtcgacaacacgacagagatgcttcaagaatggctggctgcagtgggagacgattacgccgcagttgtctggcggccagagggagaaccgaggttttatcctgacgaggaagggcctaagcactggaccaaggaacgtcatcaattcttgatggagctgaagcaggaagccctgacgtttgcccgaaattggggggcagactatatccttttcgcagacaccgacaatatactgaccaataatcagacactgcggttactgatggggcagggcctgccagtggtggccccaatgttggattctcagacatattactcaaacttttggtgtggaatcaccccccaaggctattatagacggacagccgaatactttccgaccaaaaaccggcagaggagaggttgtttccgggtgcccatggttcattcaacctttttggctagcctacgggcagagggtgctgatcagttggcattttaccctccccacccaaattacacctggccattcgatgatatcatcgttttcgcttatgcttgtcaggctgccggtgtctccgtgcatgtgtgtaatgagcacagatacggctacatgaacgtgcctgttaaaagtcatcagggactcgaagacgagcgcgtgaattttattcacctaattctcgaagctcttgtggacggccctcggatgcaagcctcggcacatgtgacaagaccatctaagcgcccttctaaaattggtttcgacgaggtgtttgttatctccttggcacgcagaccggatagaagagaacgaatgctggcatcgctttgggaaatggagatcagcggtagagtcgttgatgctgtcgacggatggatgctcaatagttccgctatcaggaacctgggcgttgaccttctgcccggttaccaggacccgtactccggacgaaccctgactaagggcgaagtgggctgcttcctgagtcactatagtatctgggaagaagtggttgcacggggtctggctcgtgtgctggtgtttgaagatgacgtgagatttgagtccaatttccgcggtcggttagagcgcctgatggaggatgtagaagcagagaaactgagctgggacctgatttatctgggtaggaaacaagttaatccagaaaaggaaaccgctgttgagggtctgccgggtttggtcgtcgcagggtacagctattggaccctggcctacgcactccgcttggccggagccagaaaactgctggcctctcaaccgttaagacggatgctgcctgtagacgaatttctccctatcatgtttgatcagcaccctaatgaacagtacaaggcacacttctggccgagggacctagtggcctttagcgcacagcctctgcttgccgcaccaacgcactacgctggcgacgccgaatggctgagcgatacggaaacctccagcccatgggacgatgattctggcagattaatcagctggtccggatcccagaagacactacgctctccgagattagatcttacaggatcgtccggccactctctgcagccgcagccccgagacgagctgtag

SEQ ID NO: 48907 - DNA, 1554 bp, Artificial Sequence
  Description of Artificial Sequence: Synthetic coding sequence
atgctgcaggagtggctggcagcggtgggcgacgactacgccgctgtggtctggagaccagaaggcgaaccccgattctacccggatgaggaaggcccaaagcactggactaaagagcgccaccagttcctgatggagctgaagcaagaggcactcacttttgcaagaaactggggagctgattacattctgtttgccgacacagataacatcttgaccaataaccagacgctgcgtttactgatgggccagggactccctgtcgtggccccaatgctggactctcagacgtattactccaacttttggtgtggaatcacaccccaagggtactatcgccgtaccgccgagtacttcccaaccaagaatcgacagcgaaggggatgttttagggtccctatggtgcactcaacatttttggcatctttgagggccgaaggggcagaccagctggcattttaccctccgcacccaaattacacttggcccttcgacgatatcatcgtcttcgcttatgcgtgccaggccgctggagtttcagtgcacgtttgcaatgagcatcggtatggttacatgaacgtgccagtgaagtcgcaccagggactagaggatgagagggtgaacttcatccaccttatcctcgaagcactggtagacggaccacggatgcaggcgtccgctcacgtcacccggccatccaaaagaccatccaaaatcggatttgacgaggtctttgttatctctcttgcacgtcggcctgaccggcgagaaagaatgctggcgagtttatgggaaatggaaatcagtggcagagtagtggacgccgtagatggctggatgctgaactcgagcgccatacgcaacctcggagtggacttactgccaggataccaggacccctattctggtagaacgctcactaagggtgaagtgggttgtttcttatcccactattcaatatgggaggaggtggttgcacgcggactggcacgggtgttggtattcgaggacgacgtgaggttcgagtcaaacttcagaggacgattggagagactgatggaagatgttgaagccgagaagctatcctgggatctgatctatctgggcaggaagcaggtgaatccggagaaggagactgcagtggagggtctccctggtctcgtggtggcaggttattcatactggaccctggcctatgctctccgcctggcgggagccagaaaattgctggcatcccaacctctcaggcggatgctgcccgtggatgaattcctccccatcatgttcgaccaacatcctaatgaacaatacaaggcgcatttttggccccgtgatctggtggctttctccgcacaaccattgcttgccgcacccacccactacgccggagatgcggaatggctctccgacacggagacgagctccccctgggacgatgatagcgggagattaatttcttggtctggttcccagaaaaccttgcgcagccctagactcgacctgacagggagctcaggacactcactacagcctcagccccgagacgagctatag

SEQ ID NO: 48908 - DNA, 240 bp, Artificial Sequence
  Description of Artificial Sequence: Synthetic coding sequence
atgctgcaagagtggctggcagctgtgggcgacgactacgcagctgttgtttggcgcccagagggtgaaccgaggttttatcccgacgaggagggaccgaagcattggacgaaagagcggcaccagttcctgatggaactaaagcaggaggctctcacctttgctagaaattggggggctgattatatcctgtttgccgacaccgataacatcttgaccaataaccaaactctcaggtag

SEQ ID NO: 48909 - DNA, 1647 bp, Artificial Sequence
  Description of Artificial Sequence: Synthetic coding sequence
atgcgggctgctcgggctgcacccctgctccaattattgctgctgcttggtccctggctcgaagccgcaggcgtggccgagtctccccttcctgcagttgtcctggccatcctggccagaaacgctgagcacagcctgcctcattacctcggagccctcgaacggcttgactatcctcacgaggagggccctaagcattggactaaggagagacaccaatttcttatggaattaaaacaggaggccctgacctttgctaggaattggggcgcagactatattctgttcgccgacactgacaatatcctaacaaacaaccaaacactccgtttgcttatgggacaaggactacccgtggttgcacccatgcttgatagccagacgtactacagcaacttttggtgtggcattaccccgcagggctattatcggcgaacagccgagtacttccccacgaagaatagacagcgcagagggtgctttcgagtgcccatggtgcactctactttcctggcctccttgcgcgctgaaggggcagatcaactagccttctacccacctcatccaaattacacatggccatttgatgatattatcgtgttcgcgtacgcgtgccaggccgcaggagtctccgtacacgtgtgcaatgagcatcgatacgggtacatgaatgttcctgtgaagagccaccagggactggaggacgaacgagtgaacttcatccatttgattctcgaggctctggttgacggtccccgaatgcaggcttctgcccatgtgacgagaccatcaaagcgaccttctaagatcggctttgacgaagtgttcgtcatctcgttggccagacggcctgatagacgggagcgcatgttagccagcctgtgggagatggagatttccggacgggtggtcgatgccgtcgacgggtggatgcttaactcttccgcaattcggaatcttggagtagacctcctgccagggtatcaggatccttattccgggaggacactaacaaagggagaagtgggctgctttctcagccattactccatatgggaagaagtcgtggcacggggactggcgagggtcctggtgtttgaagatgacgtacgcttcgagagcaattttcggggaagactggaacggttaatggaagatgttgaggcagaaaagctatcttgggacctgatttacttaggcaggaagcaggtgaatccagaaaaggagactgccgtggaagggctgccaggccttgtggtcgccggttattcttattggaccctggcctacgccctgcgcctggcgggtgccagaaaattgcttgcatcccaacccttgcgccgaatgcttcccgttgatgagtttctgccaatcatgtttgatcagcatccaaacgagcaatataaggctcacttctggccgagagatctcgttgcctttagcgcgcagcctttgctggccgcaccaacgcattacgctggcgatgccgagtggttgtccgacacagaaacatcttctccatgggatgatgatagtggtagactgatatcttggtccggatcacagaaaacactccggtctccccgtcttgacctgactggaagctccgggcactctctgcagccacagcctcgtgacgagctctag

SEQ ID NO: 48910 - DNA, 195 bp, Artificial Sequence
  Description of Artificial Sequence: Synthetic coding sequence
atgttacaggagtggctcgcagccgtgggggatgactatgccgctgttgtatggcgccctgagggcgaaccacgattttatccggacgaggagggtccaaagcactggactaaagaacgtcaccagttcctgatggagctgaaacaagaggccttgaccttcgccagaaattggggagctgattacatactgtag

SEQ ID NO: 48911 - DNA, 657 bp, Artificial Sequence
  Description of Artificial Sequence: Synthetic coding sequence
atgcttcaagaatggctggctgcggtgggagatgactatgctgcagtggtgtggagaccagaaggggagcctcggttttatcctgacgaggaggggcctaaacactggaccaaggaacgtcatcagtttctgatggagctgaagcaggaagctctgacattcgcgaggaactggggggcagattacattctgtttgctgatacagacaacatattgaccaacaatcagaccctccgattgctgatggggcagggtctgcctgttgtggcacctatgctggatagccagacctattatagcaacttttggtgcggaatcacaccacaaggctactataggagaactgcggaatacttcccaactaaaaataggcaacgccgtggctgttttagggtcccaatggtgcactcgacctttctggcctctctgagggctgaaggagccgaccaactggcattttacccgcctcaccccaactatacatggcctttcgatgatattatcgtgtttgcctatgcatgtcaggccgctggggtcagtgttcacgtttgtaatgagcaccgctacggctacatgaatgtgcctgtcaagtcgcaccagggtcttgaggatgagagggtgaactttatccacctgatcctggaagcattgggatag

SEQ ID NO: 48912 - DNA, 330 bp, Artificial Sequence
  Description of Artificial Sequence: Synthetic coding sequence
atgctccaagaatggctagccgctgttggcgacgactacgcagctgtagtgtggcgccctgagggggagcctagattctaccctgatgaggaaggtcctaagcattggactaaggagaggcaccagttcttaatggagttgaagcaggaagcacttacatttgcgagaaattggggtgcggattacatcttatttgcagatactgataacatactcactaacaaccagaccctgagactgcttatggggcaaggcctgcccgttgtagcaccaatgctggacagccagacctactactccaatttttggtgcggaatcacccctcagtag

SEQ ID NO: 48913 - DNA, 348 bp, Artificial Sequence
  Description of Artificial Sequence: Synthetic coding sequence
atggaagtgaaagacgctaattcagctttgctgagtaattatgaaaccctgaaatacatctctaagactccttgcagacatcagagccctgagattgtaagagagttcttgaccgccttgaagtcgcataaactaactaaggccgagaaactgcagctgttgaaccatagaccagtcactgccgttgaaattcaactgatggtcgaggagtctgaagagcgcttgacagaggaacaaattgaggccctcctccacaccgtgacttcaatactccccgcagagccggaagcggagcagaagaagaatacgaattccaacgtagctatggacgaggaggaccccgcttag

SEQ ID NO: 48914 - DNA, 447 bp, Artificial Sequence
  Description of Artificial Sequence: Synthetic coding sequence
atggaagtaaaggatgccaattccgccctactaagtaactatgaggtctttcagttactcaccgacttaaaagagcagaggaaagaatcaggcaagaataaacattcctcgggacaacaaaacctcaacacgatcacctatgagaccctgaagtacattagtaagacaccttgcaggcaccagtctcctgaaatcgttcgggaatttctcactgcgctcaagtcacataaattgaccaaagcagagaaacttcaactgctgaatcacaggcccgtcacagccgtcgagatacagcttatggtggaggagtcggaggagagactaactgaagagcaaatcgaagcgctgttgcatacggtgacaagcatcctgccagcggaacctgaggccgaacaaaaaaaaaataccaacagcaatgtggccatggatgaggaagatcccgcatag

SEQ ID NO: 48915 - DNA, 216 bp, Artificial Sequence
  Description of Artificial Sequence: Synthetic coding sequence
atggaggtagccgaaaaacttcagttgctgaatcatagacccgtcacagccgtggagatccagctgatggtagaggagagcgaagagagacttaccgaagaacagatcgaggcactgctgcacacagtcacatccattctaccagctgagcccgaggcggagcaaaagaaaaacacaaattcaaatgtggccatggacgaggaggaccccgcttag

SEQ ID NO: 48916 - DNA, 348 bp, Artificial Sequence
  Description of Artificial Sequence: Synthetic coding sequence
atggagatgaaagacgcgaattccgctctgttaagcaactacgaaaccttaaaatacatatctaaaactccctgccggcaccaatccccagagatagttcgcgagtttctgaccgccctgaaatcccataaactaaccaaggccgagaagctgcagctgctcaatcatagacccgtgacagccgtcgagatccagctgatggtcgaggaaagtgaagagagattaacagaagagcagattgaggctcttctacacacagtcaccagcattttgcccgctgaaccggaggctgagcaaaagaaaaacaccaacagtaacgttgctatggacgaggaggacccagcctag

SEQ ID NO: 48917 - DNA, 426 bp, Artificial Sequence
  Description of Artificial Sequence: Synthetic coding sequence
atgcagagaggtgatcctggcgaacatttgggggctcgaagctggcatctgggcgcagtgggtggaggcggagactcctgcgaggtaaaagatgctaatagtgcactgttatcaaattatgagacattgaagtacatatccaaaactccgtgcaggcaccagagcccagaaattgtccgggagtttctaacagcactcaaatcacataagttgaccaaggcagagaagcttcagctattgaaccaccgccctgtcaccgccgttgaaatccagctgatggttgaagagagtgaagagagacttacagaagaacagatcgaagcactgctccacaccgtcacttctattcttccagctgaaccggaagctgagcagaaaaagaataccaattctaatgttgctatggacgaggaggatcctgcctag

SEQ ID NO: 48918 - DNA, 702 bp, Artificial Sequence
  Description of Artificial Sequence: Synthetic coding sequence
atgtccaagctgggcaaattcttcaaaggtgggggaagctccaagtccagggctgctccgagcccccaggaagccctcgttcggcttcgcgagaccgaggaaatgttggggaagaaacaggagtacctggagaatcggatccagcgcgagattgccctggctaagaagcacggtacacagaacaagagagcagccctccaggcactgaagcgcaagaaaaggttcgagaaacagcttactcagattgatgggaccctgagcactattgagtttcagcgggaagccttggaaaattcccataccaacaccgaggtcctccgtaacatgggttttgcagctaaggcaatgaagtcagtgcatgaaaacatggacctgaacaagatcgacgatttaatgcaggaaattaccgaacagcaggacattgcgcaggagatctccgaagccttctctcagagagtcggttttggggacgactttgatgaagatgagttaatggcagagttggaggagctagagcaggaagaactcaacaagaagatgactaatatccggctgcccaatgtgcccagtagctctcttccagcccaaccgaataggaaacccggaatgtccagcacagcacgaaggagcagggccgcaagttcccagcgggctgaggaggaagacgacgacattaagcagttggctgcttgggcaacatag

SEQ ID NO: 48919 - DNA, 1293 bp, Artificial Sequence
  Description of Artificial Sequence: Synthetic coding sequence
atgctttgttctctcctgttgtgcgagtgcctccttctagttgctggatacgctcatgatgatgattggatagaccccacagacatgctaaactatgacgctgcatccggaaccatgcgcaagagccaagccaaatacggcatttccggggaaaaggacgtctctcccgacctcagctgcgctgatgagatcagtgagtgctaccataagctggatagtctgacctacaagattgacgagtgtgagaagaaaaagcgggaggactatgaaagccaaagcaatccagttttccggagatatctcaataagatcttgattgaggctggcaagctgggcctcttagcctttgcacagcatcaggcagaggtcgccaagatggaacctctcaacaacgtgtgcgctaagaagatggactggacaggtagcatctgggaatggttccgctcttcttggacctacaaggacgatccctgccagaagtactacgagctgctcctcgtaaaccctatttggctggtgcctccaaccaaggccttagctgtaaccttcaccacatttgttaccgagccactaaaacacatcggcaaaggcaccggagagtttattaaggcactaatgaaagaaatcccagcattgcttcatctcccagtcttaatcatcatggcactcgctatcctgagtttttgctatggcgctggtaaatcggtgcatgtcctccgccacattggcggaccggagtctgaaccccctcaagccctacgaccaagggatcgcaggcgccaggaagaaatagattatcgccctgatggaggtgctggcgatgctgactttcattaccgtgggcagatgggaccaacagagcagggcccttatgcgaaaacttacgagggcagaagggaaattttgagggagcgtgacgttgacctgcggtttcagaccggcaataagtcgcccgaggtgctgcgagcattcgatgtgcctgacgctgaagcacgagagcaccccaccgtggtgccctcacataaaagtccagtgcttgatactaagcctaaggaaacaggagggattctgggtgaaggtacccccaaggaatctagcacagaaagttcccaatctgctaaacccgtgtctggacaggatacttcaggcaatactgagggaagcccggcagcagagaaagcccaactgaagagcgaagccgctggcagcccagaccaggggagtacctatagtcccgcacgcggagtagccggtccgaggggacaagatcccgtatccagcccttgcggttag

SEQ ID NO: 48920 - DNA, 1101 bp, Artificial Sequence
  Description of Artificial Sequence: Synthetic coding sequence
atgttgtgttcactgctcctgtgtgagtgtctgcttctggtggccggttatgcgcacgatgatgattggattgatcctaccgatatgttgaactacgatgcagcctcggggaccatgcggaagtctcaagcaaaatacgggatatctggggagaaagatgtgtccccggacctgtcttgtgccgacgagataagcgaatgttaccacaagctggacagcctgacctacaaaatcgatgagtgcgagaagaagaagagagaagactacgaatctcagtctaatccagtgtttcgccgatatttgaacaaaatccttatcgaagcgggtaaactgggcctggcactcgctgtgacattcaccacctttgttacagaacctcttaagcatatcgggaagggaactggagagttcatcaaggccctgatgaaagagatacccgcactcctccacttgccagtcctgatcataatggccctggctattctgagcttttgctacggcgcaggaaagagcgtgcacgtgttgcgacacataggcggacctgaaagcgagccccctcaggctctgcgccctagggatcgcagacggcaagaagagatcgattatcggccagatggcggtgctggtgatgcagactttcactatagagggcagatggggccaacagagcaagggccttatgccaaaacctacgaaggccgacgcgaaatcctgagggagagggacgtggaccttagatttcaaaccgggaataagagtccggaggtcctaagagcctttgatgttcctgacgcagaagcaagggagcacccaacggtcgtcccctctcacaagtcgcccgtgctagacacaaagccgaaagagacggggggtatcttgggcgagggaactcctaaggagtcctctaccgagagcagccagtcagctaaacccgtctcagggcaggataccagtgggaacactgaggggagtcccgctgctgagaaggcccaattgaagtctgaggctgccggttcccccgatcaaggtagcacctactcaccagctagaggcgtcgctgggccacggggacaggaccccgtttcctcaccttgtggatag

SEQ ID NO: 48921 - DNA, 1656 bp, Artificial Sequence
  Description of Artificial Sequence: Synthetic coding sequence
atgttgtgttcactccttctctgcgagtgtctgcttttagtggcgggttatgcacacgatgacgattggattgatcccactgatatgctaaattacgacgccgcaagcgggactatgcggaaaagtcaggccaaatacggcatttcaggcgaaaaggacgtgagccccgacctctcctgtgcagatgaaatttcagagtgctaccacaagttggactcactgacatataagattgatgaatgcgaaaagaagaagcgtgaagactatgagagccaaagcaacccagttttccgcaggtatcttaataaaattctgatcgaggctggaaaattgggcctgccagatgagaataagggcgatatgcactacgatgcggagataatactcaagagagaaaccttacttgagatacaaaaatttctgaatggagaggattggaaacccggagcgctggatgatgcgcttagcgacattcttattaacttcaagtttcacgatttcgagacctggaagtggagattcgaggatagtttcggtgtagatccctataatgtccttatggtattactgtgtctactttgcatcgtcgttctcgtggctaccgagctttggacctacgtccggtggtatacacagcttaggcgggtgctgataatctctttcctatttagcctcggttggaattggatgtatctatacaagctggcctttgcccagcaccaggccgaggttgcgaagatggaacccctgaataatgtctgtgcgaagaaaatggactggacaggcagtatttgggagtggttcagaagcagctggacatacaaagacgacccttgccagaaatattatgaactattgttggtgaaccccatctggttggtgccacccactaaggccttggctgttacctttacaacttttgtgaccgaaccattaaagcatataggaaaaggcaccggagaattcatcaaggccctgatgaaagaaatacctgccctgctgcaccttcctgtgctgatcatcatggctctcgctatcctcagcttttgttacggcgctggaaagtctgttcatgttctccgacatatcggtggaccggagtccgaaccccctcaagctctccgcccacgagatagaaggagacaggaggaaattgactacagaccagacgggggagctggggacgccgatttccattacagagggcagatggggccaacagagcagggaccgtatgcgaagacatacgagggcagaagagagattttgcgggaaagagacgtagatctgcgatttcagaccgggaacaagagccccgaagttcttcgggctttcgacgtacctgatgcagaggcgagagagcatccgaccgtggtcccttcgcataagtcgcctgtgcttgatactaaacccaaggaaacgggcggtattctgggcgaaggtactccaaaggaatcaagcactgagtcatctcagtcggcgaagccagtaagcggccaggacacctcaggaaatacggaaggttcccccgcagcggagaaagcacagttaaagtccgaggccgctggatcccctgatcagggatctacctattctccagccaggggagtggccggaccgaggggacaggaccctgtgtcttccccttgcggatag

SEQ ID NO: 48922 - DNA, 1101 bp, Artificial Sequence
  Description of Artificial Sequence: Synthetic coding sequence
atgttatgttcattactgctctgtgaatgcctgctcctggtggcgggttacgcacatgacgacgattggatcgaccctactgatatgctgaattacgatgctgcaagtggtaccatgcgaaagtctcaggctaaatatgggatcagcggcgaaaaagacgtttctccagatctgagctgtgctgatgaaatttcggagtgttatcataagttggactcccttacatacaagatagatgagtgtgagaaaaaaaaacgggaggactacgaatcccaatctaaccctgtatttcgcagatatctcaacaagatcctgatcgaggcgggtaagctgggccttgctctcgcggtgacattcaccacttttgtcactgagccactgaaacacattggcaagggaactggggagtttattaaggcactaatgaaagaaattcctgcccttctgcatctacccgtactgatcattatggctttagcaatcctcagcttctgttacggcgctggcaagagcgttcatgtgctccgacacattgggggtcctgagtccgaacctccacaggcccttcggccaagggatcgacgtcgccaggaggagatagattatcgcccagatggcggagccggagacgcggatttccactatcggggacagatggggccaacggaacaagggccttatgctaaaacctacgaaggtaggcgcgaaatcctccgcgagcgggacgtggatctgcgcttccagactggaaataaatctcccgaggtgctcagggcatttgatgtgccagacgctgaagctagggaacaccccacggttgttccaagccataagtctcctgttcttgacacgaagcctaaggagaccggtggaatcttaggcgaaggcacacctaaggagagcagcaccgagagttctcagagtgccaaacccgtatccggccaggacaccagcggcaataccgaaggcagcccagccgcagagaaagctcagctgaagtctgaagccgctgggtcccctgaccaggggtcaacatacagcccagccagaggcgtagccggaccacgtggccaggatccagtcagcagcccatgcggctag

SEQ ID NO: 48923 - DNA, 1293 bp, Artificial Sequence
  Description of Artificial Sequence: Synthetic coding sequence
atgctgtgctcgctgctcctttgcgagtgtctgctcctcgtggctggctatgcacacgacgacgactggatagaccccaccgatatgctcaactatgacgccgcaagtggcacaatgcgcaaatcacaggcaaagtatgggatcagtggagagaaggatgtgtctcctgacctgtcgtgtgccgacgagattagcgagtgttaccacaagttggacagtctgacgtacaagattgacgagtgcgagaaaaagaaaagagaggattacgagtcccagtccaatcctgtattccgtcgctatttaaacaaaattctgattgaggccggtaaactgggactgctggctttcgctcagcatcaggcagaagtggccaagatggagccgttgaacaatgtttgtgcaaagaaaatggactggaccggctcaatctgggagtggtttcgtagcagttggacctacaaggatgatccgtgccagaaatattacgaattgctcttagtgaacccgatttggctggtgccccctacgaaggcactggcggttacatttactacattcgtaacggagcccctaaagcacatcgggaaggggacaggggaatttatcaaggccctaatgaaagagattccagctctattgcatctccccgtgctcatcatcatggccctggccattctcagtttttgctacggcgcaggaaaatctgtgcacgtgttaaggcatataggcggacccgagagcgagccaccacaggcccttaggcctcgcgatcgcagacgccaagaggaaatagactacaggccggatggcggagccggtgatgccgatttccactataggggacagatggggcctacagaacaaggaccatatgcgaagacctacgaagggcgacgggagattctgcgtgagagggatgtggacctgaggtttcagactggcaataaatcaccggaagtcctcagagcctttgacgtacccgatgctgaggcacgcgagcacccgaccgtggtccccagccacaaatctccggttctggatacaaagcctaaggaaacgggcggtatcttaggagaaggcacccccaaagagtcgtccactgaatctagccagagcgcaaaacccgtgagtggccaggacaccagcggaaatacagagggctcccctgcagcagagaaagcccagctgaaaagtgaggcggctggttctcctgaccagggatccacctatagccccgctaggggtgtggctggtccccgtggtcaggacccggtgtcctccccctgtgggtag

SEQ ID NO: 48924 - DNA, 1506 bp, Artificial Sequence
  Description of Artificial Sequence: Synthetic coding sequence
atgctctgctcactgctgctttgcgaatgtttgcttttggtggccggttacgcacacgatgacgattggattgaccccactgatatgttgaactatgacgcagcgtccgggactatgcgcaagagccaggctaagtacggaatttcaggtgagaaggacgtgtcccccgacctttcctgcgcagacgaaatcagtgagtgctaccacaagctggatagcctgacctataaaatcgacgagtgtgagaagaagaaacgagaagattatgagtcgcagagcaatcctgtgttcagacggtatctgaataaaatcctgattgaggctggtaagcttggattatttcacgatttcgaaacatggaagtggcgatttgaggacagttttggtgtggatccctataacgtgttaatggtgctcttatgcctgctttgcattgtggttctggtagcaacggagctgtggacatatgtgcggtggtacacccagctccgcagagtcttaataatctcctttctgttctctctgggctggaactggatgtacctctacaagctggcattcgctcagcatcaggccgaagtggcgaaaatggagcctctgaataatgtgtgtgccaagaagatggattggactggatctatttgggaatggttccgcagctcgtggacttataaggacgacccctgccaaaagtactacgaactccttctcgttaaccccatttggcttgtgccaccaacaaaggctttggccgtgacctttactactttcgtgacggaaccacttaagcatattgggaaggggactggcgagttcattaaagccctgatgaaagagatcccggcattgttgcatcttcctgtgttgataatcatggcgcttgctattttaagtttctgttacggcgctggtaaatctgtgcacgttctgcggcacattggaggtccggaatccgagcccccacaagctctgcgaccaagagataggaggcgtcaggaggaaattgattatagacccgacggaggagctggggacgccgacttccactaccgcggtcagatggggccaacggaacaggggccttatgccaagacctacgaggggagaagggagattctgagagagagagacgtcgaccttagatttcaaactgggaacaaatcccccgaagtgcttagggcattcgacgtgcccgatgccgaagctcgagagcacccgaccgtggttccctctcacaagtcacctgtcttagacaccaagcccaaggagaccggtgggattctcggggagggaacaccaaaggaaagctcgacagaatccagccagtccgctaaacccgtttccggccaggacacttcagggaacaccgaggggagtcctgcggctgagaaggcccaacttaaatccgaggctgcaggatcaccggatcagggctctacctacagtcccgctaggggtgtcgctggtcctcgtggacaggatcccgtatctagcccatgtggatag

SEQ ID NO: 48925 - DNA, 1656 bp, Artificial Sequence
  Description of Artificial Sequence: Synthetic coding sequence
atgttgtgcagcctcctcctgtgtgagtgcttgttgctggtggccggttatgcccatgatgacgactggatcgatccgaccgatatgctgaactacgacgctgcctcgggtaccatgagaaagagccaggccaagtatggaatcagcggtgagaaggacgtcagccctgacttgtcttgtgccgacgaaatctctgagtgctaccacaaactcgactccctgacctacaagatcgacgaatgtgaaaaaaaaaaaagggaggactatgagtcccagtccaatcccgttttccgcaggtacctgaacaaaattctaattgaagcgggaaagctgggcctccccgatgaaaacaaaggcgatatgcactatgacgctgagattatcctgaaaagggagactctgctcgagatccagaagttccttaacggagaagattggaaacccggagccttggatgatgctctctctgacattctcatcaacttcaagtttcacgattttgaaacttggaagtggcgattcgaggatagcttcggtgtcgatccatacaatgtcctgatggtgctgctctgtcttctctgcattgtcgtccttgtggccacggagctgtggacctacgtgaggtggtatacgcagctacggagagttctcataatcagtttcctgttttcacttggatggaattggatgtacctctacaaactggctttcgcacagcatcaggcggaggtcgcaaagatggagcctttgaacaacgtgtgtgcaaaaaaaatggactggaccggttccatttgggaatggttcaggtcaagttggacctacaaagatgatccatgtcagaagtactatgagctactgctggtcaaccccatctggttggtacccccaaccaaggcgctagccgtgactttcaccacgttcgttacggagcccctgaagcacatcggcaaaggaaccggggaatttatcaaagccctcatgaaagaaattcctgccctgctacatctgccagtcctgatcatcatggccctggcgattctgtctttttgttacggggctggtaaaagcgtacatgtgctgcgccacataggaggcccagagtcagaaccgcctcaggcactaaggccacgagaccggaggcggcaagaggagatcgattatcgcccagacggcggagccggagacgctgatttccattatcgcggtcaaatgggtccaacagaacagggaccatacgctaaaacctatgaaggtcgccgagagatcctgagagaaagagatgtcgatctacgatttcagaccggtaataagtctccagaagtgctgagagccttcgatgtgcctgatgctgaggcccgtgagcaccccaccgttgtcccctcccacaagagcccagttctcgacacaaaacccaaagaaactgggggtatactgggagaagggactccaaaagaaagcagtaccgagtcaagccagagcgcaaaaccggtgtccggtcaggatactagtggaaatacagagggaagccccgctgctgagaaagcgcagcttaaaagcgaggctgctgggagccctgaccagggttccacgtattctcctgccaggggagtggccggtccacgaggccaggatccggtctcttcaccgtgtggctag

SEQ ID NO: 48926 - DNA, 789 bp, Artificial Sequence
  Description of Artificial Sequence: Synthetic coding sequence
atgctgtgctcactcctcctgtgtgaatgcctgctactggtggccggatatgcccatgacgatgactggattgacccaactgatatgctgaattacgacgcagcatccgggaccatgcggaagagccaagccaaatatggtatctccggcgaaaaagacgtgtcgccagacttaagctgcgcagatgagatctccgagtgctatcacaaacttgatagcctgacttataagatcgatgaatgcgagaaaaagaagcgcgaagattacgagtcccagagcaatcccgtattccgccgataccttaataagattctgattgaagcaggcaaattaggattgcccgatgaaaacaaaggcgacatgcactacgatgccgaaattatcctcaaacgggaaacactgctcgagatacagaaattcctcaacggcgaagattggaaaccaggggcactcgatgacgccttgagcgatatactgattaatttcaaattccatgattttgaaacttggaaatggaggtttgaggattcattcggcgttgacccctataacgtgcttatggtcttactgtgccttttgtgcattgttgtattggtggctacagagctttggacctacgtgcggtggtacacccaactccgaagagtgctaattatcagctgtgctcagtctgaggcatcaagagtaaagcaggtggggaacctctttcaggcctgggcattcgcagtgtgcgaccctgtgctcctccaggtccccgtgtgtcctattctggtgttctgctattcgtag

SEQ ID NO: 48927 - DNA, 1506 bp, Artificial Sequence
  Description of Artificial Sequence: Synthetic coding sequence
atgctatgttccttgctcctctgcgagtgcctgctgcttgtcgcaggctatgctcacgacgacgactggattgatcctactgatatgctgaattacgacgctgcctctgggactatgagaaaatctcaagctaagtatggcatctctggggaaaaagatgtttctccagacttgtcctgtgccgacgaaatcagcgagtgttaccataagctcgattcgcttacctataagattgatgagtgtgaaaaaaagaaacgagaagattatgagtcacagagcaatccagtatttagacgctacctgaacaaaattctgatcgaagccggaaagctggggctgttccatgacttcgaaacttggaagtggaggtttgaggactcctttggagtagatccctataatgtactgatggtgctgctatgcctgctgtgtatcgtagtcctcgtggcgacggagttatggacctatgtgcgctggtacacgcaactccgccgtgtgctgattatctcgttcttattctccctcgggtggaattggatgtacttgtataaactggcatttgcccagcaccaggccgaggtggccaagatggaacctctgaacaacgtctgtgccaaaaagatggactggactgggtctatctgggagtggttcagatcttcctggacctataaagatgacccctgccaaaagtactacgaactgctcttggtgaatccaatatggctggttccgccaacaaaggccctggcagtgacttttacaacctttgtgacagaacccctgaagcacattggtaagggcactggggaatttatcaaagctctgatgaaagaaattccagctctcctgcacctgccagtactgatcatcatggccctggccatcctgagtttttgttacggcgctggtaaaagcgtgcatgtgttacggcacattgggggtcctgaaagtgagcctccccaagcccttcgtcctcgcgatcgtaggagacaggaggagatcgactacagaccggatggcggtgccggagacgcagatttccactaccgtgggcagatggggccaacggagcaggggccatacgctaagacatacgagggacggagagagattctccgcgaacgggacgttgatctgcggttccagaccggcaacaagagcccggaggtgctccgggcatttgacgtccccgacgctgaagctcgggagcacccgactgtcgtgccgtcccacaagagccctgtcttggatactaagcccaaagagaccgggggaatcttgggcgaggggacacccaaggaatcaagcactgagagtagtcaatccgctaagcctgtaagtggccaggatacatccggcaacaccgaaggctctccagcggctgaaaaagcccagttgaaaagcgaagcggcaggctccccggatcagggctctacctattcgccggcacggggagtcgcgggaccgagggggcaggatccggtgagctccccttgcggctag

SEQ ID NO: 48928 - DNA, 726 bp, Artificial Sequence
  Description of Artificial Sequence: Synthetic coding sequence
atggcagaagaacaaccccaggttgagctttttgtcaaggctggatccgacggtgcaaaaatcgggaactgtccatttagtcagcgactcttcatggtcctgtggctgaagggcgtcaccttcaacgtcactacagtcgatacaaaacggaggaccgaaactgtacaaaaactctgcccagggggtcagctgccattcctactatacgggacagaggtacataccgatacaaacaagattgaggaatttctcgaagcagtgctatgcccaccaaggtaccccaagttggccgctttgaacccagagagcaacaccgccggtctggatatattcgcaaaattttcagcttacattaagaacagtaacccagccctcaatgacaacctggaaaaggggctcctgaaggcacttaaagtgctggacaactatctgacttctccactgcccgaggaggtagatgagaccagcgctgaggatgaaggggtgtctcaaagaaaattcctggatggcaacgagctcacactggcagactgtaacctcttgccaaaactccatatcgtccaggtggtgtgcaaaaagtatagaggcttcactatccctgaagcctttcggggagtgcaccggtacttaagtaacgcctacgcacgtgaagaattcgccagtacctgccctgatgatgaggaaatcgaacttgcctatgagcaggtggccaaggcattgaagtag

SEQ ID NO: 48929 - DNA, 726 bp, Artificial Sequence
  Description of Artificial Sequence: Synthetic coding sequence
atggctgaggagcagccccaagttgagctgtttgtgaaagcaggatcggatggggcaaaaattggaaattgcccattctctcagagattgtttatggtactctggctcaaaggcgtcacatttaacgtgaccaccgtggacactaaaaggcgaacggaaaccgttcagaagctctgcccagggggacagctgcctttcttgctctatggaacagaagtgcacacagacacgaataaaatcgaagagtttctggaggctgtgttgtgccctccaaggtaccctaaacttgctgccctgaatcccgaaagtaacaccgccggactggacatttttgccaagttctccgcatacatcaagaactcaaatcctgccttaaacgacaatttggaaaaaggcctcctgaaggcactgaaggtcctcgacaattacctgactagcccgctgcctgaggaagtggacgaaacctcagccgaggacgagggcgtttcccagaggaagttcctggacggaaatgagctgacgctagcggactgtaacctgctgccaaagctccacatcgtgcaagttgtttgtaagaagtatcgtggtttcacaatacccgaggccttcaggggcgtccatcgttacctgtctaatgcatacgccagggaagaattcgcatccacatgcccagacgatgaagagatcgagctggcatatgaacaggtggccaaagcactgaaatag

SEQ ID NO: 48930 - DNA, 726 bp, Artificial Sequence
  Description of Artificial Sequence: Synthetic coding sequence
atggcagaggagcagccgcaagtagaactgttcgtcaaggcagggtccgatggagccaaaattggcaactgtccgttcagtcagcggctgttcatggtgctctggctcaaaggtgtaacttttaatgtgacaacagtcgatactaagcgcaggaccgagacagtgcagaagttgtgcccagggggacagctccccttcctgctgtacggtaccgaagtgcacacagataccaacaaaattgaagagttcttggaagcagtgctttgtccgccacggtaccctaagttggccgcactgaaccccgaaagcaacacagctggcctggacatatttgctaaattctccgcttacatcaagaatagcaatcccgcactgaacgataacctggaaaaaggtctcctgaaagcactaaaggttctcgacaactatctgacttcccctttgccagaggaggtcgatgagacatcagcggaagatgagggagtctcccagcgcaaatttttggacggaaatgagctgactctggccgactgcaacctgctccccaaattgcacatcgttcaggtcgtgtgcaaaaagtatcgcggattcacaattcctgaggcatttagaggggtgcatcgatatctgtctaacgcatatgccagggaagaattcgcttcaacctgccccgatgatgaagagatcgaactggcgtatgagcaggtggccaaggcactgaagtag

SEQ ID NO: 48931 - DNA, 726 bp, Artificial Sequence
  Description of Artificial Sequence: Synthetic coding sequence
atggcagaagagcaacctcaggtcgaactgttcgtaaaagcaggatcggacggagctaagatcggcaattgtcctttctcacagagactctttatggtcctctggctcaaaggcgtcacctttaacgttactacagtggacaccaagaggaggactgagacagtgcagaagctgtgtccaggaggccagttgccttttctcctgtatggtactgaggtgcacactgacactaacaagatcgaagaattcttagaggcagtgctctgccctccacggtacccaaaactggctgctcttaatcctgaaagcaatactgcaggactggatatttttgctaaattttccgcctacatcaaaaacagtaatcccgcactcaacgataaccttgagaaaggtctccttaaagccctgaaggtgctggataactatctgacaagccccctcccagaggaggtggacgagacaagtgcagaagacgaaggtgtttcacagagaaaatttctagatggcaatgaactcaccctcgccgattgcaatctgctgccaaagctccacatcgtgcaagtggtgtgtaaaaaatatcggggattcaccatccctgaagccttcagaggcgtgcatcggtacctgtccaacgcgtacgcaagagaagagtttgcatccacttgcccagacgacgaggaaatcgagctcgcctacgaacaggtagccaaagccttgaagtag

SEQ ID NO: 48932 - DNA, 726 bp, Artificial Sequence
  Description of Artificial Sequence: Synthetic coding sequence
atggctgaggaacagcctcaggtggaactgttcgtaaaggccggatcagacggcgcaaagatcggcaattgcccttttagccaaaggctcttcatggtactctggctcaagggggtgaccttcaacgtcacaactgtggacaccaagaggcgcaccgagaccgtgcaaaaactctgccctggaggacaattgcccttcctgctgtacggcacggaggtgcataccgataccaacaaaatagaagaatttcttgaggctgtactctgcccccctcgttatccgaaattggcagccttgaaccctgagtccaatacggcaggactggatatcttcgcgaagttctccgcttatatcaagaattctaacccagccctaaacgacaatttagaaaaggggctgttaaaggctttaaaggtcctggacaattatctgacttccccccttcctgaggaggtggacgagacctctgcagaagacgagggtgtcagtcagcgaaaattcctggatggtaatgagttgacgctggccgattgcaaccttcttcccaaactacacatcgtgcaggttgtgtgtaagaagtatagagggttcactattcccgaggccttcaggggagtgcaccgctatctgtccaatgcgtacgcaagggaagagttcgcttcaacctgccccgatgatgaggagatcgaactggcttatgagcaggttgccaaggctcttaagtag

SEQ ID NO: 48933 - DNA, 726 bp, Artificial Sequence
  Description of Artificial Sequence: Synthetic coding sequence
atggcagaagagcagccccaggtggagttgttcgtaaaggctggttcagacggcgcaaagatcgggaattgtccctttagtcaacgtctatttatggttctctggctgaaaggggtcactttcaatgtgacaacagtggatactaagcggaggacagagacagtccaaaagctgtgccctggagggcagctgcccttcctcctctatgggacagaggtgcacacagatacgaacaagatagaggagttcttggaagcagtactttgccctcctcgttacccaaagttggccgctttgaaccccgaatccaacactgccggactcgatatctttgccaagttttctgcctacatcaagaattcgaatcctgccttaaacgataatttggagaaaggtctccttaaagcgttgaaggtgcttgacaactacctgacgagccccctgccagaagaagtggacgaaacctctgccgaggatgagggcgtgtcccagcgcaaattcctggatggaaatgaactcactcttgcagattgtaacctgctccccaaactgcatatagtgcaggtggtgtgtaagaagtatagaggctttacaatccccgaagcctttcgcggtgtgcaccggtatctttcgaatgcttatgctcgagaagaattcgcctccacgtgccctgacgatgaagaaattgaactcgcctacgagcaggttgctaaggccctcaaatag

SEQ ID NO: 48934 - DNA, 726 bp, Artificial Sequence
  Description of Artificial Sequence: Synthetic coding sequence
atggctgaagagcagccccaagtcgagctcttcgtcaaggctggctcagatggtgcaaagataggaaactgcccattctcacagcgcttgtttatggtgctctggctgaaaggtgtgacgttcaacgtgactaccgtggatactaagcgcagaacagagacagtgcagaaactctgtccagggggtcagctacctttcctgctgtacggtactgaggtgcatactgataccaacaagatcgaagagttcctggaggccgtactgtgtccccctcgctacccaaagttggccgctctaaacccagaatccaacacagctgggctggatatcttcgccaaattctctgcctatattaagaatagcaaccctgcgctcaatgacaatttggagaagggtctccttaaggctctgaaggtgctggataactacctgacttctcctttgccggaagaagtggatgaaacaagcgctgaagacgagggggtctctcagaggaaattcctggatggcaacgaactgacattggccgattgcaatctcttgcccaagctacatatcgtgcaggtagtgtgtaaaaaatatagaggtttcacaattccagaagctttcaggggcgtgcaccgctacctgtcgaacgcatacgccagggaagagttcgcctccacctgcccagatgacgaagagattgagcttgcatacgagcaggtggcaaaagccctcaagtag

SEQ ID NO: 48935 - DNA, 726 bp, Artificial Sequence
  Description of Artificial Sequence: Synthetic coding sequence
atggcagaagagcagccacaggtcgagctgttcgtgaaggccggaagtgacggagcgaaaatcggaaattgcccattcagccaaagactgtttatggtgctgtggctgaagggggttactttcaatgtcacaacagtggacaccaaaagacgaacggagacagtccagaaactgtgccccggaggacagctaccttttctgttatatgggaccgaggtgcacacagatacgaacaagatcgaggaatttcttgaggctgtattgtgcccaccacgttatcctaagctggccgctctcaatcctgagtcgaacaccgctgggctcgacattttcgctaaattctccgcctatattaagaactcaaatcccgctcttaatgacaacttggagaagggattgttaaaagccttaaaagtcctcgataactatctgacctcccccctgcccgaagaggtggacgagacctccgccgaggacgagggggtgtcacagagaaaatttctggacgggaacgagctgacattagctgattgcaacctgttgccaaagcttcacattgttcaggtcgtgtgcaaaaaataccgaggtttcactatccccgaagcattccgcggagtacaccgatatctgtccaatgcttatgcccgtgaggagttcgccagcacctgccccgatgacgaggagattgaattggcatacgagcaagtcgcaaaggccctcaaatag

SEQ ID NO: 48936 - DNA, 726 bp, Artificial Sequence
  Description of Artificial Sequence: Synthetic coding sequence
atggccgaggaacagccgcaagtggaattatttgttaaggcaggttcagatggcgcaaagataggaaactgcccattcagtcagcgactattcatggtgctatggctgaagggcgtgacctttaacgtcacaacagttgatacgaagagaagaacggaaactgtgcagaagttatgccccggagggcagctcccttttctgctgtacggtaccgaagtgcacactgataccaataaaatcgaagaattcctggaggcagtgctgtgtccgcctcgctaccccaagctcgcagccttaaatccagaatcaaatacagctgggctcgatatcttcgccaagttctccgcctacatcaagaatagcaatcctgccctgaacgataacctggagaaagggctgctaaaagccctaaaagtgttagataactacctcacatcccctctgccagaggaggtggacgaaacctctgccgaagacgagggagtttctcagcgcaaattcctggatggcaatgaactgaccctggctgactgcaatctgttgccgaagctgcatattgtgcaggtcgtctgtaaaaaatacagaggattcacaatccccgaagcattcaggggcgtccaccgttacctgtctaacgcctacgcaagagaagagttcgccagcacatgtcctgatgatgaggaaatcgagttggcctacgagcaggtggccaaggctctgaaatag

SEQ ID NO: 48937 - DNA, 726 bp, Artificial Sequence
  Description of Artificial Sequence: Synthetic coding sequence
atggccgaagagcagccgcaggtggaactgttcgtcaaggctggatccgacggcgcaaaaatcggaaactgtcccttctcccagcgcctattcatggtcctctggctgaagggggttacatttaatgtcactacagtcgatacaaaaagaaggaccgagaccgtccagaagctgtgcccgggaggacagcttccttttctgctttatggtacagaagtgcacacggatacaaacaagatcgaggaattccttgaggcggtgctgtgcccaccgcgataccccaagctcgccgcactcaacccagaaagcaacaccgcaggcctcgatatctttgccaagttcagcgcctatatcaaaaatagtaatccagctcttaacgacaatctggaaaagggactgttgaaggcgcttaaggttctcgacaattacttaacatcccctctcccagaggaagtcgatgaaacatcagctgaagatgagggcgtgtcgcagcggaaattcctggatgggaatgagctcacgctggccgactgcaacctgctgccgaagctgcatatcgtgcaggtagtgtgtaaaaagtacagaggattcactatacctgaggcatttcgcggtgttcacagatacctgagtaacgcatacgctagagaggaattcgcttccacatgccctgatgatgaagaaattgagctcgcatatgagcaggtggcaaaggctctaaagtag

SEQ ID NO: 48938 - DNA, 726 bp, Artificial Sequence
  Description of Artificial Sequence: Synthetic coding sequence
atggccgaggagcagcctcaggtggagctgtttgtgaaagccggaagcgacggagcaaagattggcaactgcccattcagtcagcgcctgttcatggtattatggctgaagggcgtgacttttaatgttacaaccgttgataccaagcggagaacggaaacagtgcagaagctatgccctggcggtcagctcccttttctgctgtacggcacggaggtgcacaccgataccaacaagattgaagagttcctggaggccgtcctgtgccctccccgatatcctaagttagctgcgctgaatcccgagagtaatactgccggactggacatcttcgccaagttttcagcttacataaagaatagcaatcccgcactcaatgacaatctggagaagggcctgctcaaagctcttaaagtactggacaactatttgacgtcccctctgccagaggaggttgatgaaactagtgctgaagacgagggcgtctcccagcgaaagtttcttgacgggaacgaacttaccctggcggattgtaacttactgcctaagcttcacatcgtgcaggttgtctgcaagaagtacagaggatttactattcctgaggccttccggggagtgcatcggtacctgtccaatgcatacgcacgggaagaattcgcaagcacctgtcctgatgatgaggagatagagctggcatacgaacaagtggcaaaggccctcaagtag

SEQ ID NO: 48939 - DNA, 726 bp, Artificial Sequence
  Description of Artificial Sequence: Synthetic coding sequence
atggccgaggagcagccacaggttgaactttttgtgaaggcagggagcgacggcgcaaaaatcggcaactgtccattttcccaacgtctttttatggtgctgtggttgaagggagtgacttttaacgtgaccactgtggataccaaaaggcgaactgagaccgttcagaaactctgtccaggcggtcagcttccctttttgctatacggcacagaggtgcataccgacactaacaagatcgaggaattcctggaggcggtgctgtgtccgcctaggtacccaaagctggctgccttaaatcctgaatccaatacagccggactcgacatctttgctaagttcagtgcatacataaaaaactctaatccggctctcaatgacaacctggagaaaggcctgctgaaagcactgaaagtgctcgacaattacctcacctcacctcttcctgaagaagtggatgagacttccgcggaggatgaaggcgtctcccaacggaaatttctggacgggaatgagttgaccctggccgactgtaatctgcttcctaaactccacatcgtacaggtggtttgcaagaaatacaggggttttaccatccctgaggcttttagaggagtacaccggtatctctccaatgcttatgccagagaggagtttgcctccacttgtcccgacgatgaggagatcgagctggcctacgaacaggtggccaaggccctaaaatag

SEQ ID NO: 48940 - DNA, 726 bp, Artificial Sequence
  Description of Artificial Sequence: Synthetic coding sequence
atggcggaggagcagccacaagttgagcttttcgtcaaagccggatccgacggagctaagataggcaactgccctttcagccagagattgttcatggtgctgtggttaaagggtgtgacctttaatgtcactaccgtagacacaaagagacggacagaaactgtccagaagttatgtccaggagggcagctgccattcctgctgtatgggacagaggtccacactgataccaacaaaattgaggaattccttgaggccgttctgtgtccccctcggtaccccaagctggccgctctgaacccagaatctaatacagccggtttggatatcttcgcaaaattcagcgcatacataaaaaacagcaatcctgctctgaacgataacctcgaaaaaggtttgctgaaggccctgaaggtgttggataactatctcaccagtccactcccagaagaggtcgatgaaacctctgccgaggacgaaggcgtcagtcaacgcaaattcctggatgggaacgaactgacactagcagattgtaatctactcccgaaattgcacattgtgcaagtggtgtgtaaaaaatacaggggatttacaattcctgaagcatttcgcggtgttcatcggtatctctccaatgcctacgcacgggaggaattcgcttccacctgtcctgacgacgaagaaatagaactggcttatgaacaggtagcgaaggccctcaaatag

SEQ ID NO: 48941 - DNA, 726 bp, Artificial Sequence
  Description of Artificial Sequence: Synthetic coding sequence
atggccgaagaacagccccaagttgagctgttcgtgaaagccggatccgacggggctaagattggaaattgtccgtttagtcagaggctgtttatggttttgtggctgaaaggcgttactttcaacgtcaccaccgttgacaccaagagacgtacagaaacagtccagaaactttgcccaggcggacagttgccattcctcttgtacggcactgaggttcacaccgataccaacaagattgaagaattcctggaggccgtgctatgccctcccagataccccaagttggctgcactgaatccagagtccaacaccgcaggtctggacatatttgccaagtttagtgcctatattaagaattccaatcccgctcttaatgataacctggagaagggcttactgaaggcccttaaagtcctagacaattatctaacgtccccccttcccgaagaagtggatgaaacttctgccgaagatgagggggttagccaaaggaaattcttggacggaaatgagctgactctcgctgattgcaacctgctgcccaagctgcacattgtgcaggtcgtgtgtaagaaatatcggggtttcacgattccggaggcgttccggggtgtacatagatacctttccaatgcatatgctagggaggagtttgcctccacatgtcccgatgacgaagagattgagctggcctatgagcaggtagcaaaggcccttaagtag

SEQ ID NO: 48942 - DNA, 726 bp, Artificial Sequence
  Description of Artificial Sequence: Synthetic coding sequence
atggcggaagagcagcctcaagtcgaattattcgtgaaagctggcagtgacggtgccaagatcggaaactgccccttctctcagcgacttttcatggttttatggttgaagggcgtgaccttcaatgtcacgactgtggataccaagcgacggacggagactgtccaaaagctctgtccaggcggtcagcttccctttctgttgtacggaaccgaggtgcataccgacactaacaagattgaggaattcctggaagcggtactctgtcctcccagatatcctaagttggccgctctgaaccccgagtcaaatacagcaggactagatatattcgccaaattctctgcctatattaaaaactctaaccccgctctgaatgacaatttagagaaaggtcttcttaaagctctaaaggtgttggacaactacttgaccagcccactcccagaggaagtggacgaaacttcggccgaagatgagggcgtgagccaacgtaaattcctcgatggcaatgagcttaccctagccgattgtaacttgttgcccaagcttcacatagtacaagtggtttgcaagaagtatcgcggatttacaataccggaggcttttcgcggtgttcatagatatctcagcaatgcttatgcacgcgaggaatttgccagtacctgcccagacgacgaggagatagagctcgcctacgaacaggtggccaaagctctaaagtag

SEQ ID NO: 48943 - DNA, 726 bp, Artificial Sequence
  Description of Artificial Sequence: Synthetic coding sequence
atggctgaagagcagccgcaagtcgaattatttgtcaaagccggaagtgatggtgctaagatcgggaattgtccattttctcagcgcttattcatggtcctctggcttaaaggtgtgactttcaacgttactactgtggacacaaagcgaagaaccgagacagttcagaaattgtgtcctggtggacaattacccttcctgctgtatggcactgaagtgcatacagataccaataaaatagaggagttccttgaggccgtgctgtgccctccacgctatccaaaactggccgcactaaatcccgaatctaacacagccggactcgatatttttgccaaattctcggcctatattaagaactctaatcccgctctgaacgataacctggagaagggcctcttgaaagctctgaaagtgttagataactacctgacctcccccctgccagaggaggtggacgagaccagcgcggaggacgagggggtgagtcagaggaagttcttggatgggaacgaattgaccctcgccgattgtaaccttttacctaaactgcacatcgtacaagtcgtctgtaagaaataccggggattcacgattcccgaggcctttcggggagtacaccggtatctgtcaaatgcttacgctagggaggaatttgcctctacgtgccctgatgacgaagagatcgaactcgcatacgaacaggtggccaaggccttaaagtag

SEQ ID NO: 48944 - DNA, 726 bp, Artificial Sequence
  Description of Artificial Sequence: Synthetic coding sequence
atggccgaggagcagccacaagtggagctcttcgtgaaggcagggagtgacggggcaaagattggaaattgtccctttagccagagactcttcatggtgctgtggctcaagggagtaacttttaacgttaccaccgtggacacaaagagacggaccgaaaccgtccagaaattatgtccaggcggtcagctccccttcctcctatacgggaccgaggtccatactgataccaacaagattgaggaattcctcgaggctgtgctttgtccgcctaggtatccaaagttagccgctcttaaccccgagagcaataccgcaggactggatatcttcgcaaaattctccgcttatatcaaaaattccaaccctgcattgaacgacaacctggagaaggggctgctgaaggcccttaaagtgctggacaattacctgacctcgcccctaccggaggaggttgacgagacctcagcagaagacgaaggcgtgtcacagaggaaattcttagacgggaatgaactgacgctcgccgactgtaatctgctccccaaattgcacatcgttcaggtggtttgcaaaaaatatcggggttttactattcccgaggccttcagaggagttcatcggtacctgagtaacgcgtacgctcgggaggagttcgcttctacctgccccgatgatgaggagatagaacttgcctatgagcaggtggctaaggccctgaagtag

SEQ ID NO: 48945 - DNA, 726 bp, Artificial Sequence
  Description of Artificial Sequence: Synthetic coding sequence
atggccgaggaacaacctcaggtagagctattcgtgaaggctggcagtgacggggctaaaatagggaattgtccctttagccaaagattattcatggttctgtggctgaagggtgtgaccttcaacgtgactactgttgacacaaagcgaaggaccgagactgtacagaagctttgccctggcggacaattgcctttcctcctgtacggaaccgaagtccacaccgatacaaacaagattgaagagttccttgaggcggttctatgtccccctaggtatccaaaacttgctgcccttaacccggagagcaataccgccggactggacatctttgcgaagttctccgcgtacatcaagaactccaacccagctctgaatgataacctggagaaaggcctcctgaaagccctcaaggtcctcgacaattatctgactagtccgttgcccgaggaggttgatgagacctcggccgaggacgaaggcgtgtcccagagaaaattcctggatggcaatgaactcaccttagcagactgcaaccttctccccaagcttcatattgtacaggtggtctgtaaaaaatatagaggatttaccatacctgaggcatttcgcggtgtgcaccgatacctgagcaacgcatatgctcgcgaagagttcgcaagtacttgtcctgacgacgaggaaatcgaactggcgtacgaacaagtggctaaagcactgaaatag

SEQ ID NO: 48946 - DNA, 726 bp, Artificial Sequence
  Description of Artificial Sequence: Synthetic coding sequence
atggcagaggagcagccacaagttgagcttttcgtgaaggccggatccgacggagcaaagattggcaattgtccgttttcccaaagactcttcatggtcctctggctgaagggagtgaccttcaacgtgacaacggtcgacactaaacgaaggaccgagacagttcagaagctttgcccaggtgggcaactgcccttcctgttgtatggaacagaagtccataccgatactaacaaaatcgaagagttccttgaggcagtgctgtgtcctccccgttaccccaaacttgcagcactcaacccggagtccaacactgctgggctggatatatttgcaaaattcagcgcttacattaagaattcaaaccccgctctgaacgataatctggaaaaggggctcttaaaggcccttaaggtgttagacaactaccttacgagccctctccccgaggaagtggatgagacttcagccgaggacgaaggcgtgagccaacgcaaattcctggatggaaatgagctcaccctggcggattgtaatctgcttccaaagcttcacatcgtgcaggttgtgtgcaagaagtaccgtggtttcacaataccagaggcctttagaggcgtacaccggtacctgagtaacgcctacgccagagaagagttcgcttccacatgtccggatgacgaagagatagaacttgcgtacgaacaggtcgctaaagcactaaagtag

SEQ ID NO: 48947 - DNA, 726 bp, Artificial Sequence
  Description of Artificial Sequence: Synthetic coding sequence
atggcggaagagcagccccaggtggagctgttcgtgaaggctgggagtgacggcgctaaaataggcaattgtcccttttcgcagcgtctgttcatggtgctgtggctcaaaggcgtgacgttcaatgtgaccactgtggacaccaagcgacggaccgagacagtccagaaactttgtccaggaggccaactcccctttctcctgtacggcacagaggtgcacactgacacaaataaaatcgaagagttccttgaagcggttctgtgtcctccccgttatcctaaactggcagcgctgaatcccgaaagtaacaccgcgggtctggatatatttgcaaaatttagcgcttatattaaaaacagtaatcctgccctgaatgacaatttggaaaaggggctccttaaagctctaaaagttctggataactacctgacttcccccttacctgaggaggtggatgagacaagcgcagaggacgagggcgtatcgcagcgtaaatttctggatggcaatgagctgactctggctgactgtaacctccttccaaagttgcatattgtgcaggtcgtctgcaaaaaataccggggttttactatacctgaagccttcaggggcgtgcatcggtacctgagcaatgcctacgctcgggaagagttcgcatccacctgtccagacgatgaggagattgaactggcctacgagcaggtcgctaaagcgctcaagtag

SEQ ID NO: 48948 - DNA, 726 bp, Artificial Sequence
  Description of Artificial Sequence: Synthetic coding sequence
atggccgaagagcagccccaggtagaactgtttgtcaaagcaggctctgatggagccaagatcgggaactgcccatttagtcagaggctcttcatggtgctctggctcaaaggtgttactttcaatgttaccaccgtggacacaaagcggcgaaccgaaaccgtgcagaagctgtgccccggtgggcagcttccatttctgttgtatggcacggaagtccacactgacaccaataagattgaggagttcctggaagctgtcttgtgtccgccacgttaccccaagctggcagccctgaatcctgagtctaatacagccggattggacatttttgccaagttctccgcttatatcaaaaactctaatcccgctctgaacgataaccttgaaaaaggcctgctcaaggctctgaaggtgctcgataattatttaacctccccattgcctgaagaagtggacgaaacaagtgcagaagacgagggggttagccagaggaaatttctcgacggaaatgaactgactctcgctgattgtaacctgttgccaaagctccacattgtgcaagttgtatgtaagaagtatcgtgggtttaccatcccggaagcctttcgcggtgtacaccgttacttaagcaatgcctacgccagagaggagtttgccagtacttgtcctgacgacgaggagatcgagctcgcatatgagcaagtggccaaagcactgaagtag

SEQ ID NO: 48949 - DNA, 726 bp, Artificial Sequence
  Description of Artificial Sequence: Synthetic coding sequence
atggcggaggaacagccacaagtcgagcttttcgttaaggccggtagcgacggagcgaaaataggtaactgtcctttcagccagcgattattcatggtattatggctaaagggggttacattcaatgttacaaccgttgacactaaaagacgcactgaaacagtgcagaagctgtgccctggcggtcaactgccttttctcttgtacggaaccgaggtgcataccgacacaaataaaatcgaggagttcctagaagccgtattgtgccctccccgataccccaagcttgcggcactgaatcccgagtctaataccgccggtctggacattttcgccaagttcagcgcctatattaaaaacagcaaccccgctctgaatgataatcttgagaaaggtctcttaaaagctcttaaagtgctcgacaattaccttacttcaccgctccccgaagaggtggacgagacaagcgccgaagacgagggggtgtcccagcgtaagttcctagacggtaatgaactgacgctggcagactgcaacctactcccaaagcttcatattgtccaggtggtttgtaagaaatatcgcggatttaccatccccgaagcattccggggagtgcaccgctatcttagcaatgcctatgccagagaggaattcgcgagcacatgtcccgatgacgaagagatcgagctagcctacgagcaagtagctaaagcactgaagtag

SEQ ID NO: 48950 - DNA, 726 bp, Artificial Sequence
  Description of Artificial Sequence: Synthetic coding sequence
atggccgaggaacagcctcaggttgaactgtttgtgaaggcaggtagtgatggcgcaaagattggtaattgtccattcagccaaagactgtttatggtcctctggttgaagggcgtgaccttcaacgttacaacagtggacacaaagaggaggacagaaactgtgcaaaagctctgccccggaggacaattgccattcctgctctacggaaccgaggtacacacagatactaataagatcgaggaattcctcgaggccgtgctgtgcccccctaggtaccctaagctggctgccctcaatcctgaaagtaataccgctggtctggacatctttgcaaagttcagcgcgtacatcaagaattctaaccccgctctaaacgacaacttggagaaaggactgctgaaggccctgaaagttctggacaattacttgaccagtcctctgccagaggaggtcgatgagactagcgccgaagatgagggcgtgagccagaggaagttcctggacggtaatgagctaacactggcggactgtaatctgctgcccaaactgcacatcgtccaagtggtgtgcaaaaagtaccgaggatttactattcctgaagcattcaggggggtgcataggtacctgagtaacgcgtatgctagagaggagttcgctagcacatgtcctgacgatgaagaaattgagctcgcctacgaacaggtggctaaggcccttaagtag

SEQ ID NO: 48951 - DNA, 726 bp, Artificial Sequence
  Description of Artificial Sequence: Synthetic coding sequence
atggccgaggaacaacctcaggttgagctgttcgtcaaagccggatcggatggtgctaagatcgggaactgtccatttagccagaggctgtttatggtgctgtggctgaaaggtgtgactttcaacgtcactacagtggatacaaagcggaggaccgagacagtgcagaaactttgccccggtggtcagctgcctttcctgctctacggtacagaagtgcatacagacaccaacaagatcgaagagttcctcgaggctgtactgtgccctcctcgttatccaaagcttgccgctcttaaccccgagtccaatactgcagggttggacatattcgcgaagtttagcgcttacatcaagaatagcaaccctgccctcaacgacaatttagagaagggactcctgaaggctctgaaagttcttgacaactacctcaccagccccctgcctgaagaagtggatgagactagcgcagaggatgagggagtgagtcagcggaagtttttagacggaaatgagctgactctcgccgattgtaatctacttccaaagcttcatatcgtgcaggtcgtctgtaaaaaatacaggggatttacaatccccgaagcttttagaggcgtccatcgatacctctccaacgcatacgctcgagaagagttcgccagcacctgtcccgatgacgaagagatcgaattggcctatgagcaggtggcgaaagccctgaaatag

SEQ ID NO: 48952 - DNA, 726 bp, Artificial Sequence
  Description of Artificial Sequence: Synthetic coding sequence
atggccgaggaacaaccgcaagtggagctcttcgtgaaagccggatccgacggtgcgaaaatcgggaattgtcccttcagccaaagactgttcatggtgctatggctgaaaggtgtgacattcaatgtgactactgtggatacaaaaaggcggactgagacagtccaaaaactatgcccaggcggacagctcccattcctgttgtacggaacggaggtgcacactgatacaaataagatcgaggagttccttgaagccgtgttgtgccccccacgttatcccaaattagccgcactgaaccccgaaagtaacaccgccggtctcgacatttttgccaaatttagtgcttacattaagaactctaatccagccctgaacgacaacctggagaagggactgctgaaggctttgaaagtgctggataattacctgacctcaccactgccagaggaagttgacgaaactagcgcagaagacgagggggttagtcagcggaagtttctggatggcaacgaactcacactggccgactgcaacttgcttcctaagttacatatcgtccaggttgtgtgcaaaaagtacaggggatttacgatcccggaagccttcagaggcgttcataggtacctctctaatgcctatgctagggaggaatttgcgtcaacttgtcctgatgacgaagagatcgagctggcctacgaacaagtagcgaaggctttgaagtag

SEQ ID NO: 48953 - DNA, 726 bp, Artificial Sequence
  Description of Artificial Sequence: Synthetic coding sequence
atggctgaggaacagccacaggttgagctcttcgtgaaagccggtagtgacggggcaaaaataggaaactgccctttctcccagcgtttattcatggtgctctggctaaaaggtgtaacatttaacgtgacaaccgtcgacacaaaacgtcgtactgagacagtccagaagctgtgcccaggcggacagctgcccttcctgctttacggaaccgaagttcacacggatactaataagattgaagagtttctggaggccgtgctgtgccctccgagatacccaaagctggcagcactcaaccccgagtctaacaccgcaggtctcgacatttttgcgaaattctccgcttacatcaagaattctaatcctgccctgaatgacaatcttgagaagggcctgctcaaggcgttaaaagtcttggataattacctcacttctcctctacccgaagaggtagatgagacttcggcagaggatgagggtgtgagtcaacgcaaatttctagatggcaatgaactgaccctggctgattgtaacctgctgccaaagctgcatatcgtccaagttgtatgcaagaagtatagggggttcaccatccccgaggctttccgtggcgtgcaccggtacctatctaacgcgtatgctagagaggaatttgcctctacgtgtcccgatgatgaggagatcgaactggcatacgaacaagtcgccaaggcactaaaatag

SEQ ID NO: 48954 - DNA, 726 bp, Artificial Sequence
  Description of Artificial Sequence: Synthetic coding sequence
atggccgaagaacagccccaggttgagctattcgttaaagcgggttctgacggagccaagataggaaattgtcctttttctcagagactgtttatggtgctatggcttaaaggggtgacatttaatgtgactacagttgacacaaagcggcgtacagaaacagtgcagaaactttgtccaggcggtcagctgcctttcctactctatggcaccgaggtccacactgacactaacaagatcgaggagttcttagaggccgttctgtgccctccccgataccccaaactcgctgcactgaatcccgaaagtaacacagctggcctggatatctttgcaaaattcagcgcttacatcaagaacagtaacccggctcttaacgacaacctcgagaaaggattgctgaaagccttgaaagtcctggacaactacctcaccagcccactaccagaggaggtggacgaaacttcagcagaggatgagggcgtatcgcagcggaagtttctggatggaaacgagctaaccctggccgattgtaacctgcttcccaaactgcatattgtgcaggttgtgtgcaaaaaatatcgcggattcaccataccggaggcatttagaggtgtgcaccgatatctctctaacgcatacgcaagggaggaatttgcaagtacatgtccagacgacgaagagatcgagctggcttacgaacaggtggctaaggcgctgaaatag

SEQ ID NO: 48955 - DNA, 744 bp, Artificial Sequence
  Description of Artificial Sequence: Synthetic coding sequence
atgtcaggactacgacctggaacccaagtggatcctgagattgagctgtttgtaaaggcaggttcagatggagagtctataggtaactgtcccttttgccagcgactgtttatgatcctttggcttaaaggtgtcaaatttaacgtgactaccgttgacatgacacgaaagccggaggagttgaaggacctcgcacccggtaccaatccaccattcttggtgtacaataaggagctgaaaacagacttcattaagattgaagagttcctggagcagacattggccccacccaggtacccgcatctctcccctaagtacaaagaaagctttgacgttggctgcaatttattcgccaaattcagtgcatatatcaagaatacccagaaagaggccaataaaaattttgaaaagagcctgctaaaagagttcaagcgtcttgatgactacctgaacacacctctgcttgacgaaatagatcccgattcagccgaggaaccgcctgtgtccaggagactgttcctggatggggatcagctcaccctggctgactgcagcctgttgccgaaactcaacatcatcaaggtggccgcaaaaaagtacagggacttcgatatccccgcagaattcagtggcgtgtggagatacctgcacaatgcttatgcccgagaagagtttacacacacctgtcctgaggacaaagagatcgagaacacctacgcaaacgttgctaagcagaagtcatag

SEQ ID NO: 48956 - DNA, 762 bp, Artificial Sequence
  Description of Artificial Sequence: Synthetic coding sequence
atggccttgtcaatgccactgaatgggctaaaggaggaggacaaggagcccctgatcgagctgtttgtaaaagccggttcagatggagagagtattgggaattgccctttctcacagagattgtttatgattttgtggttgaagggcgttgtgttctcagtgaccacagtggaccttaagaggaagcccgcagacctgcagaatcttgccccaggcacccaccccccattcattacttttaacagtgaggtcaagactgacgtaaacaaaattgaggagtttctcgaggaagtgttgtgtccccctaaatatctcaagttgtctcccaagcatccagaaagcaacactgcgggtatggacatcttcgccaagttttccgcatacattaaaaatagtcggcctgaggctaacgaagctcttgagcgtggcctgctcaagacactgcaaaaactggacgaatacctgaactcgccactgccagatgagattgacgaaaattccatggaagatatcaaatttagcaccaggaaattcctggatggcaacgaaatgacactagccgattgtaatttgcttccaaagctccacatagtgaaggtggtcgccaaaaagtacaggaacttcgatattccaaaggagatgactgggatttggcgctatctgacaaacgcatactccagagatgagtttacaaacacctgcccctccgacaaggaggtcgagatcgcctattccgatgtggcaaagagactaacgaaatag

SEQ ID NO: 48957 - DNA, 624 bp, Artificial Sequence
  Description of Artificial Sequence: Synthetic coding sequence
atggcactctccatgcccctgaatggtctcaaggaagaagataaagaacccctgatcgagctgtttgtaaaagcgggttccgatggtgagtcaattggtaattgtccattcagccagcggctgtttatgatcctgtggcttaagggggtggtgttttccgttactactgttgacctaaaaagaaagcccgcagatcttcagaacttggctcccggtactcacccgccattcattactttcaatagcgaagtcaaaacagatgtgaataaaatcgaagaatttctggaggaggtgctgtgtcctcctaaatatctaaagctcagccctaaacaccccgagtcaaacaccgccggtatggatatatttgccaaattttctgcgtacattaaaaactcacgcccagaagcaaacgaagcacttgagcggggacttttgaaaacccttcagaagctggacgaatacctgaatagcccgctgcctgacgagatcgatgagaacagcatggaagatattaagttcagcacccggaaattcctcgacggaaacgagatgactctcgccgactgtaatctgcttcctaagctgcacatcgtcaaagtcgtggctaaaatctcccagctctag

SEQ ID NO: 48958 - DNA, 762 bp, Artificial Sequence
  Description of Artificial Sequence: Synthetic coding sequence
atggcactttccatgcctctgaacgggctgaaggaggaggataaggaacctctcatcgaattatttgttaaggcagggtctgacggggagagtatagggaactgtccgtttagtcagcgactctttatgattctgtggctcaagggcgtggtcttttccgtgacaaccgtggacttgaagcgcaagcctgcagacctgcagaatctggcacccggtacccacccccctttcattacattcaactccgaggtgaaaaccgatgtaaataaaatagaagagttcctcgaggaggttttgtgtcctcctaaatatcttaagttatcccctaaacatccagaaagcaacactgctggcatggatatctttgcaaagttctccgcttatatcaagaattccaggcctgaggctaatgaggcgttggagcggggactcctgaagaccttacaaaagctggacgagtatctgaactctcccctcccagacgaaatcgacgagaattccatggaagacattaagtttagcaccagaaagtttttggatggtaacgagatgacactcgccgattgcaacttactgccaaagctgcacatcgtgaaggtcgtggctaaaaaataccggaatttcgatattccaaaagagatgactggaatttggcggtacttgactaacgcttattctagggatgagttcacaaatacctgcccctccgataaggaggtggaaatagcttactccgacgtggccaagaggctgaccaagtag

SEQ ID NO: 48959 - DNA, 2061 bp, Artificial Sequence
  Description of Artificial Sequence: Synthetic coding sequence
atggccgaggctgcggaaccagagggtgtggccccaggacctcagggccctcctgaggtgcccgcaccgctggcggaacgacctggagagcccggagctgcgggtggagaggccgaggggccagagggtagcgaaggggctgaagaagctccccgaggggctgcagccgtgaaggaggctggtgggggaggacctgatcggggtccagaggctgaagccagaggcactcgcggtgcacacggcgagacagaagccgaggaaggtgcccctgaaggggctgaagtaccccaggggggagaagagacatctggcgcacaacaagtcgagggagcatcacctggcaggggagctcagggtgagccacgcggtgaagcccagagggagccagaagactctgctgcacccgaaaggcaggaagaggctgagcagagacctgaggtgcctgagggtagtgcgagcggcgaagctggcgatagtgtggatgcggaaggccctctgggcgacaacatagaggccgaaggacctgcaggggactccgtagaggcagagggacgggtaggtgattctgtggatgccgagggacccgcaggcgactctgtagatgctgagggacccctgggcgacaatatccaggccgagggccctgccggagacagcgtggacgcagaggggagagtcggtgattcagtggacgccgaaggacctgctggagactctgtcgatgcagagggtagagtgggtgattctgttgaggcaggcgaccctgctggcgacggagtagaggccggtgttccggctggagattcagtggaggcagagggccctgctggcgatagcatggacgcagaagggcctgctggacgggctcgcagagtgagcggggaaccccagcaaagcggtgacggctcactgagcccacaggccgaagctatcgaggttgcagcaggagagagcgccggaagatctcctggagaattggcctgggacgcggctgaagaggcggaggtgcctggtgtgaaaggttccgaagaggccgctccaggggatgccagagctgacgctggagaagaccgagtgggcgacgggccacaacaggagcctggagaagacgaggagagaagggagcggagtccggagggccctcgcgaggaggaagccgcaggaggggaggaagagtcccccgattcatctccccatggcgaggcctccaggggggctgctgagcctgaagcacagctgtctaatcatctggcggaggaggggcctgcagaaggttccggcgaagcagcacgcgtcaacgggcgacgcgaggacggcgaggccagcgaacctagggctctcggtcaagagcacgatataactctgttcgtgaaagcgggttatgatggagagtctattggaaattgcccgtttagtcaacgactcttcatgatcctctggcttaaaggagtgatcttcaatgttaccacagtggacctgaagcggaaacccgcagatctccagaacctagcacccggaacaaaccccccattcatgacgttcgatggtgaggttaaaacagatgttaacaaaattgaagaatttctggaagaaaaactcgcccctcctcggtaccctaagcttggcacccagcaccccgagtctaattcggccggaaatgacgtgttcgccaaattctctgcttttataaaaaacaccaagaaggacgccaacgaaatccacgagaaaaacctgctgaaagccctgaggaaactggacaattatctaaactctcccctacccgatgagattgacgcttacagcacagaagatgttacagtgagcggacgtaagtttttggacggagacgaactgacactggcagattgtaatctgctcccaaaactgcatataattaagattgtggccaaaaagtaccgtgactttgagtttccttctgagatgacaggtatttggagatatttgaacaacgcttatgcgagagatgagttcactaacacatgtcccgctgaccaggagatcgagcacgcctactctgatgtggccaaacggatgaaatag

SEQ ID NO: 48960 - DNA, 2115 bp, Artificial Sequence
  Description of Artificial Sequence: Synthetic coding sequence
atggctgaggctgcagaacctgagggcgtcgctcccggaccccaaggccctcccgaagtacccgctcccctcgccgagcgccctggtgaacctggcgcagccggtggcgaggctgaagggcctgagggcagcgagggcgctgaggaagctcctcgcggagcagccgcagtgaaggaagccggaggagggggaccagatcggggtccagaagctgaggcaagaggaacgaggggcgctcatggggaaacggaggccgaagaaggagctccagagggggctgaggtgccacaggggggagaggagacaagcggtgcccagcaggtggaaggagcgtcacccggacggggagcccagggggagccacgcggagaagcacagcgagagcctgaggattccgctgccccagaacgacaggaggaggctgagcagcggcctgaagtcccggaggggtccgcttccggcgaggcaggggattctgttgacgccgagggacccctcggcgacaatattgaggctgaaggcccagctggtgactcagtagaggccgaggggagggttggagactcagtggatgccgaggggccagccggagatagtgtggatgctgaaggaccactgggtgataacattcaagccgagggccctgcgggagatagcgtcgacgcagaaggcagagtaggagatagcgtcgatgctgaaggacctgcgggagattctgtggacgctgagggtagagttggggattcggtcgaggcaggtgatcccgctggagatggggttgaggcgggagtccctgccggagactcagttgaggccgaaggaccggctggagactctatggatgctgagggacccgctgggcgtgccagacgggtgtccggggagccccagcagagcggagacgggtccctgagccctcaagctgaggctatcgaggtggccgcaggcgagagcgcagggagaagtccaggagaattagcctgggatgctgcagaagaagcagaggtgccaggtgtcaaagggtcagaagaagcagcccctggtgatgcccgagccgatgctggtgaagatcgtgtcggcgatggcccacaacaggagcctggcgaggacgaggaacgacgggagaggagccccgagggtccacgggaggaagaagcagcgggtggagaggaagaatcccccgattcttcacctcatggagaagcaagcagaggggctgccgagcctgaggcacaactaagcaatcatctggcagaagaggggccagcggaaggctcaggcgaggccgcaagagtgaacggacgccgagaagatggagaggcctcggaacccagggccctgggccaagagcacgacatcaccttattcgtgaaggtcaaactaactgcactcggctgcagcagaatcgccattaaaaaataccttagggccggttacgacggggaaagcattggaaactgtcccttcagccaacggcttttcatgattctgtggttaaaaggcgtgatttttaacgtcactacggtagatctaaaacggaaacccgcagatcttcaaaatctggctcccggaaccaatccccctttcatgacattcgatggagaggtcaagacagacgttaacaagatcgaagaattcctggaggaaaagctagcaccgccacgatacccaaagctgggtacccagcaccccgaatctaacagtgccggaaatgacgtttttgctaagttctctgccttcattaagaataccaagaaggatgcgaatgaaattcatgagaaaaatctgctcaaagcactcaggaagctggataactacctgaattcccctctgccagatgagatcgatgcatattcaaccgaagatgttactgtgagcggcaggaaatttctcgacggagacgaactcacactggcagactgcaatctgctcccaaagttgcatatcataaaaattgtcgccaaaaagtacagggattttgaatttccctccgaaatgacggggatttggaggtaccttaataacgcttatgccagggacgaattcacaaatacttgcccagccgaccaggaaatcgaacacgcctatagcgatgtggctaaacgcatgaaatag

SEQ ID NO: 48961 - DNA, 1785 bp, Artificial Sequence
  Description of Artificial Sequence: Synthetic coding sequence
atgtggtgtctgctccgcggtctaggtcgccctggagccttggcaagaggggcacttggacaacaacaatccctgggggctcgagccctggctagtgcagggtcagagtccagagatgagtactcctacgtcgtggtaggtgcagggtccgctggctgcgtgcttgccggacgacttactgaggaccccgctgaacgggtgctgttacttgaggcgggaccaaaggacgtgctggcaggctccaaaagattgagctggaagatccacatgcccgctgccctggtcgcaaatctgtgcgacgatcgctataactggtgctaccatacggaggtgcagcgcggtctggatggtcgtgtgctgtactggccacggggacgcgtctggggaggttcaagcagcttgaacgccatggtatacgtccggggacacgccgaggattatgagagatggcaaagacagggggcacgaggatgggattacgcccattgcctgccttactttagaaaagcacaaggccatgaactgggggcatccagataccgcggtgcagatgggcctctcagggtaagtcgcggaaagacgaatcaccccttgcactgcgcgtttctcgaggctacgcagcaggccggataccccctgaccgaggacatgaatggtttccagcaagaagggttcggctggatggatatgacaatccatgagggcaaacgctggagcgccgcttgcgcatatctgcaccccgctctttcacgtacaaacctcaaggcagaggcagagacgctcgtatcccgagtcctgttcgaggggacgagggcggtaggagtcgaatatgttaagaacggtcagtctcaccgcgcttatgctagtaaagaagtcatcctgtcaggtggggctataaatagccctcagttgctaatgctctccgggatcggcaatgcagatgaccttaaaaagctcggtatcccagtcgtgtgccaccttcccggagtaggacagaacctccaggaccaccttgagatctacatacaacaggcatgcacaaggccgattaccctgcactcagcccagaaacccctgaggaaggtctgtatcgggttagagtggctgtggaagtttacgggggagggcgctaccgcccacctcgagaccggaggattcatccgctcccagccaggagtaccccatcctgacatacaattccacttccttccatctcaggtgatcgaccacggccgagtgcctacacagcaagaggcataccaagtgcacgtggggccaatgaggggaacctcagttggctggctcaaactccgttcggccaacccacaagaccaccctgttatccagcccaactaccttagcaccgagaccgacatcgaagacttccggctctgtgtgaaactcaccagggagatcttcgcacaggaggccctggcgcctttcagaggcaaagagctgcaacccggtagtcacatccagagcgacaaggaaatcgacgctttcgtgagggctaaagcggactccgcataccatccatcgtgtacctgcaagatgggacagccctccgatccgaccgccgtcgttgatcctcagaccagagtcctaggcgtggagaacctacgggtcgtggatgctagcatcatgccctccatggtgagtggaaatctcaatgctcctaccattatgattgctgaaaaggccgcagacattataaagggccaacccgctctctgggacaaagatgtgcccgtatacaagccacgaacattggcaacccagaggtag

SEQ ID NO: 48962 - DNA, 381 bp, Artificial Sequence
  Description of Artificial Sequence: Synthetic coding sequence
atgtggtgtcttctgcgtggactgggcagaccaggggcacttgcacggggtgccctcggacagcagcagagtttgggggctcgagccctcgcctctgccggttctgagagtcgggatgagtatagctatgtggtggtgggtgctggatctgcgggttgcgtgctcgcgggaaggctgaccgaggaccccgctgagcgcgtactgttactggaagccggacccaaagacgtgttagctgggagtaagcggttgagctggaagatacatatgcccgcagcgctggtggctaatctgtgtgatgatcggtacaactggtgttatcacaccgaagtgcagcgaggcctggacggacgcgtcctgtattggccgagagggcgttag

SEQ ID NO: 48963 - DNA, 468 bp, Artificial Sequence
  Description of Artificial Sequence: Synthetic coding sequence
atgtggtgtctcctcaggggcctgggaagaccgggtgccttagctaggggagctctgggacaacagcaaagcctgggggcacgggcactagcctcagctgggagcgagtcccgcgatgagtacagctatgtcgtggtcggcgcaggttccgccggatgcgtgctggcaggaaggttaacagaagacccagctgaacgcgtgctgctgctcgaggctggtcccaaggacgtgctggcaggcagcaaacgcctttcgtggaagattcatatgccagctgctttagtcgcgaacctgtgcgatgacaggtacaattggtgctaccacaccgaagtacagcgcggactggacggcagagtgctgtactggcctcggggtagggtatggggtggatcttcatctcttaatgccatggtctacgtgagaggtcacgcggaggactacgaaagatggcaaagacaaggtgcttag

SEQ ID NO: 48964 - DNA, 1023 bp, Artificial Sequence
  Description of Artificial Sequence: Synthetic coding sequence
atgggtgagatggagcagctgcggcaggaggcagagcagctgaaaaaacaaattgccgatgctcggaaggcttgcgccgatgtcacgctcgcagagctggtaagcggtttggaggtggtgggccgtgtgcagatgcgcacacgacgtacgctgcggggacatttagcaaagatctacgccatgcactgggcgaccgatagtaagctgctcgtgtctgcgagccaggatgggaaattgattgtgtgggactcatacacaacaaacaaggttcacgctattccgctgagatcatcctgggttatgacctgtgcctatgcaccaagcggcaatttcgtggcttgcgggggtctggacaacatgtgttctatttacaatctgaagtctagagagggcaatgtcaaggtgagtagggagctaagcgcacataccgggtacctttcatgctgcaggtttctcgacgacaacaatatcgtcacttcaagtggagacaccacatgcgctctgtgggacatcgagaccggccagcagaagacagtgttcgtgggacacacgggcgattgcatgtcactggcggtttctcccgattttaatctttttatttccggggcatgcgacgcctctgccaagctgtgggatgtaagggagggcacgtgtcgccaaaccttcacaggacatgagagcgacatcaatgcaatctgcttctttcccaatggggaggctatatgtaccggcagcgatgacgcgagctgccgcctgtttgatttgcgagccgaccaggagctgatctgtttctctcacgagtccatcatctgtggaatcactagtgttgcgttttctctcagcgggagactgctcttcgctggctacgatgatttcaattgtaacgtttgggatagcatgaaatcagaacgtgtcgggatcctgtccgggcatgataacagagtgtcttgtttaggtgtaactgctgacggcatggccgtggcgactggatcttgggattccttcctgaagatttggaattag

SEQ ID NO: 48965 - DNA, 696 bp, Artificial Sequence
  Description of Artificial Sequence: Synthetic coding sequence
atgttcgttttttactgcgcccattggcagacttacgtgagcgggatgttaaggttcggcaaggtggatgtcactgagatccagattgccctcgtgatagtcttcgttctaagtgcttttggcggagcaacgatgtgggactacaccattccaatactggagattaagctaaaaatcctgcccgtactcggtttcctaggaggggtcatattctcatgctccaactacttccatgtcattctccatggcggagttggcaaaaacggtagtacaattgccggtacgtccgtactgtcacccggattgcatataggcttgatcatcattctggccattatgatttataagaaaagtgcaacggatgtttttgaaaagcacccttgcctgtacatcttgatgtttggttgtgtgtttgcaaaagtttctcagaagctggtggttgcccatatgaccaagagcgagctatacctccaggatacagtgtttttagggcctggcctgctgttcctggatcaatacttcaataacttcattgacgaatacgtcgttctttggatggcaatggtcatcagttcttttgatatggtaatttacttctctgctctgtgcttgcagatcagtcgccacctgcacttgaatatctttaagaccgcatgccatcaggctccagagcaggtgcacaaacacatagactag

SEQ ID NO: 48966 - DNA, 1251 bp, Artificial Sequence
  Description of Artificial Sequence: Synthetic coding sequence
atgtcaggccacagatctacccggaaacgctgtggtgactcacatcctgagagtcccgtggggttcggacacatgtctactaccggatgtgtcctcaacaagttgttccagttacccactcctcccctctcgcgccaccaactaaagagactcgaggagcaccgttatcagtccgcaggccgatccctgctggagcctctcatgcaaggttattgggagtggctggtgcggagggtcccttcatggattgcgccaaatctgatcaccattatcggtctatcaattaacatttgtacgaccattctcctggttttttactgcccaactgccacggagcaggctcctttgtgggcctatatcgcgtgcgcatgtgggcttttcatttatcagagtctggatgccatagacggaaaacaggccagaaggacaaactccagtagtccgctcggtgaactgtttgaccacggttgcgacagtctcagcactgtatttgtggttctgggaacatgcattgcagtccagcttggaacaaacccggactggatgtttttctgctgttttgccggaacatttatgttctactgcgcacactggcagacatacgtgtcgggcacccttcgctttgggatcatagatgtcactgaggttcagatcttcatcatcattatgcacttactggccgttatcggcggtcccccattctggcagtcaatgattcccgtccttaatattcagatgaagatttttcctgctttgtgcacagtcgccggtactatcttcagctgcactaattacttcagggttatcttcacaggcggagtcgggaaaaatgggagtacaatcgctgggactagcgtgttaagtcctttcctgcacatagggtccgtgatcactctagctgctatgatttacaagaaatccgccgtacagctgttcgagaagcatccatgcctgtatatccttaccttcggctttgtttctgccaagatcaccaacaaactggtggttgcgcacatgaccaagagcgaaatgcatcttcacgatactgcctttatcgggccagctttactcttcttagatcagtacttcaatagctttattgacgagtatatcgtgttgtggattgcgcttgtcttttcttttttcgacctgataagatattgtgttagtgtttgtaatcagattgcatcccatctgcacattcatgtttttcgaataaaggtgtccaccgcacattccaatcatcattag

SEQ ID NO: 48967 - DNA, 1251 bp, Artificial Sequence
  Description of Artificial Sequence: Synthetic coding sequence
atgtctggtcataggagcacccgcaagagatgcggggatagtcacccagagtcaccggtgggctttgggcatatgtcaaccacagggtgcgtgctcaacaagctatttcaactgcccacgccacccctgtcacgccaccaactgaaacgcctcgaggaacaccgatatcagagcgctggcaggtctctcctggaaccgctgatgcaaggttattgggagtggctcgtgcgccgtgtcccttcatggattgcacccaatcttataaccattattggactgtccatcaacatatgcaccacgatcctcttggtcttttattgcccgactgccacagagcaggcaccgctctgggcctatattgcctgcgcctgtggcctgtttatctatcagtctctggatgccattgacggcaagcaggctcgtagaacaaattcctcgagtcccctgggcgagttgtttgatcacggatgcgatagtctctcaaccgtgttcgtcgtcttaggaacctgcatcgctgtgcagcttggtactaaccccgattggatgtttttttgttgttttgctggcacctttatgttctactgcgcccactggcagacttatgtatccggaaccctccggtttggcatcatcgatgtgacagaggtgcagatctttatcattattatgcatctcctggctgttatcgggggtccccctttctggcagtctatgattcctgtgttgaacattcaaatgaaaattttcccagctctgtgcactgttgcgggaactattttttcctgcacaaattattttagagttatctttactggaggtgttggcaaaaatggaagcactatcgccggtacgtcagtcctctctccattccttcatatcggctcggtcataacccttgcggcaatgatatataagaaatcggcagttcaactttttgagaaacatccttgtctgtatatcctcaccttcgggtttgtgagcgcaaagattacgaacaaacttgtagtcgcacacatgactaagtctgaaatgcacctgcacgatacggcatttataggtcccgctctgttgttcttagaccagtactttaattcattcatcgacgaatatatagttttgtggatagccctcgtgttttccttcttcgacttaatccgttactgtgtcagcgtgtgtaaccaaatagcaagccatctgcacatacacgtgtttcggatcaaggtgagcacggcacactctaaccaccactag

SEQ ID NO: 48968 - DNA, 1599 bp, Artificial Sequence
  Description of Artificial Sequence: Synthetic coding sequence
atgatgatggtgcggcgtgggctgctcgcttggattagtcgggtagttgtgttgctagtcctcctatgttgcgcaatctctgttttgtacatgctagcctgtacccctaaaggagatgaggaacaactggctctacctagggcaaatagtcctacaggcaaggaaggctaccaggctgtgttgcaagagtgggaagaacagcaccgcaactacgtttccagtctaaagcgacaaatcgctcaattgaaagaagagctccaagagcgtagcgaacagctccggaatggacagtaccaggccagcgacgcggcaggcctgggtctggatcgctcacccccagagaaaacacaggctgacctgctggcctttctgcattcacaggttgacaaggctgaagtgaatgctggcgtgaaattagctacagaatacgctgccgtgccatttgactccttcactctgcagaaggtgtaccaacttgagaccggcctcacgagacacccagaagaaaaaccggtgcggaaggataagcgggatgagctggtggaagccattgaaagcgctttggaaaccctgaactccccagcagagaactccccgaaccacagaccttatactgcaagtgacttcatcgagggcatatatcgcactgaaagagacaaaggtaccctttatgagctcacctttaaaggcgaccataagcatgaatttaagaggctcatcctgtttaggcccttcggccctataatgaaggtgaaaaatgagaaactgaatatggccaataccttgattaacgtgattgtgccactggctaaacgggtcgataaattcagacaattcatgcagaattttcgggaaatgtgtatcgagcaggatggacgggtgcacctgacggtggtctattttggaaaagaagaaatcaacgaagtcaaaggtatcctagagaatacttctaaggcagctaacttcaggaacttcacttttatccaattgaacggtgagttctcacgcggaaaggggctcgacgtcggggctcgattttggaaaggaagcaacgtgcttctttttttttgtgatgtcgatatctattttacctccgaatttctaaacacctgtcgccttaacactcagcccggtaaaaaggttttctacccagtgctctttagccaatacaacccaggtattatttatggccaccacgacgccgtccctcctctcgagcaacagctggtgatcaaaaaggaaactggattttggagggattttgggtttggaatgacttgccaatatcgtagcgatttcatcaatattggaggctttgacctggatattaaaggctggggcggagaggatgtccatctatacaggaagtaccttcattccaatctgattgtggtgcgcacacctgtcaggggactatttcatctttggcacgagaagaggtgcatggacgaactcacacccgagcagtataagatgtgcatgcagtctaaagctatgaatgaagcctcccacggacagctggggatgctggtgtttcggcacgaaatcgaggcccaccttagaaagcagaagcagaaaacctcgtccaaaaagacctag

SEQ ID NO: 48969 - DNA, 1599 bp, Artificial Sequence
  Description of Artificial Sequence: Synthetic coding sequence
atgatgatggtgcggagggggttgctcgcgtggatttctcgcgtagtggtacttcttgttctactgtgctgcgccatctcggtgctctacatgctcgcctgcacccccaagggcgacgaagaacagcttgcactgccccgtgccaattcgcctactggtaaggagggttaccaggcagtcctgcaggaatgggaggagcagcaccggaactatgtgtccagccttaagcgccaaatcgcacagcttaaagaagagctgcaagaaaggagtgagcagctacgaaatggccagtatcaggcttctgacgccgctggcctgggtcttgaccgttcaccaccagagaagactcaagcagacctcttggccttcctccacagccaggtagataaagccgaagtgaatgccggagtgaagctcgctactgagtatgccgcagtgccttttgatagttttaccctccagaaagtgtaccaacttgaaaccggtctcactcgtcaccccgaggaaaaacccgtgaggaaggataaaagggacgagctggttgaagccatagagagcgccctggaaactctcaactcccccgctgaaaacagtcctaatcacagaccttacactgcctcagattttatagagggtatttatagaacagagagggacaagggcacactttacgagttgaccttcaaaggtgaccataaacacgagtttaaacgtttgattttatttagaccttttggtcctatcatgaaggtaaaaaacgaaaagctgaacatggcaaataccctaattaatgtgattgtacctctggcaaagcgcgtggataagttccggcagttcatgcagaactttagagaaatgtgcatagaacaggatggaagggtgcacttaaccgtggtgtattttgggaaggaggagatcaatgaggtgaaaggcattttggagaacactagtaaagcagccaattttcggaactttacctttattcaactaaacggcgagttcagcaggggcaaggggctcgacgtgggagctaggttctggaagggttctaacgtgctgctttttttttgtgacgtagatatatacttcacttccgaattcctcaacacttgcaggctgaacacacagcctggaaagaaagttttctatccagtgctgttcagtcagtacaatcctggtataatttatgggcatcacgacgcagtcccgcctttggagcaacagttggtgatcaaaaaggaaaccggattttggcgggacttcggctttggcatgacttgccagtacagatccgatttcattaatatcggcggtttcgatctggacataaaggggtggggaggcgaagatgtgcatctatatcggaagtatctccacagcaatcttatagtggtgcgtacccccgtcaggggccttttccacctctggcacgagaaaaggtgtatggatgagttaaccccggagcaatataagatgtgtatgcagagtaaagccatgaacgaagcgtcccacggccagctggggatgctggtctttcgccatgagattgaagcacatctgagaaagcagaagcagaaaacatccagtaagaaaacatag

SEQ ID NO: 48970 - DNA, 1599 bp, Artificial Sequence
  Description of Artificial Sequence: Synthetic coding sequence
atgatgatggtgaggagaggactcctcgcctggattagccgagtcgtggttttattggtgttgctttgttgtgctatcagcgtgttatacatgcttgcctgtacacccaagggcgacgaggaacaactggccctaccaagggccaattcaccgaccggtaaggaaggctaccaggctgtacttcaagaatgggaagagcagcatcggaactacgtgagcagcttgaaaagacaaatcgcccagttgaaggaggagcttcaagagagatccgagcagttacggaatgggcaatatcaagcttcggacgcagccggtcttggactagaccgctccccacctgagaagacgcaagctgatttgctggcgtttttacattcacaggtagacaaggctgaggtcaatgccggtgtcaagttggctaccgaatacgccgctgtgcctttcgattccttcacgctgcagaaagtttaccagctggagaccggactcactcgccatcccgaagaaaaacccgttaggaaagacaagagggatgagttggtcgaagccatcgagtctgccctcgaaacactgaattccccggctgagaactctccaaatcaccgtccctacaccgcttctgactttatagaaggcatctatcggactgagcgggacaaagggactctgtatgagctgactttcaagggggaccacaaacacgagttcaagagactcatcctgtttaggccctttggtccgatcatgaaagtaaagaacgaaaagctcaatatggccaacacccttatcaacgtaatagtgccactggccaaacgagtagataaattccgtcagtttatgcaaaattttagagaaatgtgtattgaacaggacgggagagtgcatcttaccgtggtttacttcgggaaagaggagatcaacgaggtgaaaggcattttagaaaacacttctaaagccgcaaattttcgtaatttcacatttattcaactcaacggcgagttcagcagaggaaaagggctggacgtcggcgcacgcttctggaaaggatctaatgtcttgttgtttttctgcgacgtggatatctatttcacctcagaattcctgaacacatgtagactgaatacgcagcccggaaagaaagtcttttatcctgtgctgttctcccagtataacccaggcatcatatatggccaccacgacgcagtgcctccactggaacagcagctggtgattaagaaagagactggcttttggagggatttcggcttcggcatgacctgtcagtatcggagcgacttcatcaatattggcggattcgacctggacatcaaggggtggggaggggaagatgtccatctttaccggaagtatttacacagcaacttaatcgtagtgaggacacccgtaagagggctctttcacctgtggcacgagaaacgttgcatggacgagctcacgccggagcagtataaaatgtgcatgcagagcaaggctatgaatgaagcctcccatggacagctcggcatgttggtctttcgacacgagatagaagcccacctcagaaagcagaagcaaaaaactagttcaaaaaagacgtag

SEQ ID NO: 48971 - DNA, 291 bp, Artificial Sequence
  Description of Artificial Sequence: Synthetic coding sequence
atgatgatggtcagaagagggctcctcgcctggatttccagggtggtggtcctcctggtcctcctgtgctgtgcaatatccgtgctgtatatgctggcatgcaccccgaagggcgatgaagaacagctggccttacccagggctaatagcccaacggggaaggaggggtatcaagcggtcctgcaggagtgggaggagcaacaccggaattatgtttcttctcttaaacgacagattgcacagctgaaagaggagctccaggaaaggagtgaacaactgcgtaacgggtag

SEQ ID NO: 48972 - DNA, 162 bp, Artificial Sequence
  Description of Artificial Sequence: Synthetic coding sequence
atgatgatggtaagaagggggcttctggcttggatcagcagagtggtcgtgctgcttgtcctgctttgctgtgccatctctgtgttatatatgctggcttgtaccccaaagggcgacgaagaacaattagctctgcctagagcaaacagccctacgggttag

SEQ ID NO: 48973 - DNA, 1599 bp, Artificial Sequence
  Description of Artificial Sequence: Synthetic coding sequence
atgatgatggtgagacgcggtctgctggcctggattagcagggtggtggtgctgctggtgctgctgtgctgtgctattagtgtgctgtacatgttggcttgcactccaaagggagatgaagagcagctggctttaccccgagctaacagtcctaccggtaaagaggggtaccaggctgttttacaagagtgggaagagcagcaccgcaattatgtttcatccctaaagaggcaaatcgctcagcttaaagaggaactgcaagagagaagcgagcaactgcggaatggacaataccaggcgagtgacgccgcaggattgggcttagatagatcaccccctgagaaaactcaggccgacttgttagcctttctccattcacaagtggacaaggccgaggtcaacgcgggagtgaaattggccaccgaatacgcagcagtccccttcgactcgttcacccttcagaaagtataccaacttgagacagggctcacaagacatccagaagagaagccagtgcggaaagacaaaagagacgagttggttgaagccatcgagagtgccctcgagacactgaactctcctgccgaaaattcgccaaaccatcgaccatataccgcgagtgattttatcgagggcatatatcggactgagcgagacaagggcacactgtacgaactaacttttaagggcgaccacaagcacgagttcaaacggttaatcctttttcgcccatttggcccaatcatgaaggtaaagaacgagaagttaaatatggctaatacactgatcaacgtgatcgtgccgctggctaagcgagttgacaaattccgacaatttatgcagaatttccgggagatgtgcatcgaacaggatggacgtgttcacctgactgttgtgtacttcggcaaggaagagattaacgaagtgaagggtatattagagaatacaagcaaagccgctaactttcggaacttcacttttatccagctgaacggcgagttttcccgcggaaaggggctcgatgtcggtgccaggttctggaagggttccaacgttcttctattcttctgtgacgtcgatatctacttcacctctgaattcttaaacacatgcagactgaacacacaacctggcaaaaaggtgttctaccctgtgctgttttcacaatataacccagggatcatatatggccatcatgacgcagtgccccctctagagcagcagctggtaatcaagaaagagactggattttggcgagatttcgggtttggaatgacatgccagtatcggagcgactttataaatattggcggatttgacctagacatcaaaggatgggggggtgaggacgtccatctgtacagaaagtatcttcactccaatctcattgttgtgcggactcctgtgagaggattgttccacctctggcacgagaagcgctgtatggatgaactgaccccagagcagtacaagatgtgtatgcagtctaaggcgatgaacgaagcctcacatggccaattaggcatgctggtttttcgacatgagatcgaggcccacttgagaaagcagaaacagaagaccagtagtaagaaaacgtag

SEQ ID NO: 48974 - DNA, 315 bp, Artificial Sequence
  Description of Artificial Sequence: Synthetic coding sequence
atgatgatggtgaggcggggattgctcgcatggatttcaagagtcgtcgttctcctcgttctgctgtgctgtgccatcagcgttttgtatatgctggcttgtacacccaagggagatgaggagcagctcgctctcccgcgagctaatagccccacaggcaaagagggttaccaggccgtgctgcaggagtgggaggagcaacatcgtaactacgtgtctagcctcaaacgtcagatcgcccagctgaaagaggaactgcaggagcggtcagaacagctgcgaaatggacagtaccaggcttccgacgccgcatag

SEQ ID NO: 48975 - DNA, 45 bp, Artificial Sequence
  Description of Artificial Sequence: Synthetic coding sequence
atgatgatggtgaggagggggctgctcgcgtggatttctcgatag

SEQ ID NO: 48976 - DNA, 1599 bp, Artificial Sequence
  Description of Artificial Sequence: Synthetic coding sequence
atgatgatggtccggagaggcttgctagcttggatcagcagagttgtagtgctcttggtccttttgtgttgtgccatctcagttctgtacatgttagcctgcactcctaaaggagatgaagaacagttggcactccccagagccaattcaccaaccgggaaagagggttatcaggccgtccttcaagaatgggaggaacagcaccggaattatgtgtcgagccttaagcgacaaatcgctcagctgaaagaggagctccaggagcggtctgaacagcttaggaacgggcagtaccaggccagtgacgccgcaggcctaggactcgatcgaagtccccctgagaaaactcaggccgacctgctggcatttctgcattcacaggtcgacaaagcagaagttaatgccggagtaaagctcgcaacggaatacgctgctgtgccatttgattcttttaccctccagaaggtctatcaactggaaaccgggttaacgcggcacccagaagaaaaacctgtgcggaaggacaagcgtgacgagctagttgaggctatcgagagtgccctcgagactctcaactcacccgctgaaaactcccctaatcaccggccttacactgcctctgattttatagaaggcatctaccgtaccgaaagagacaagggaactctgtacgaacttacgtttaaaggcgaccacaaacatgagtttaagagacttatactttttcgccctttcggtcccatcatgaaggtcaaaaacgagaagctgaatatggctaatacactcataaacgtgatcgtccccctggctaagcgagtcgacaaattccggcagttcatgcagaactttcgcgagatgtgtattgaacaggacggaagagtgcacttgaccgtcgtgtactttggcaaagaggagatcaacgaggtgaagggaatccttgagaacacctccaaggctgccaatttccggaactttaccttcatccagctcaatggtgagtttagcagaggaaagggcctggacgtgggtgccaggttttggaaggggtctaatgtgctcttgtttttttgcgatgtggacatttacttcacctccgaattcttgaatacatgccggctgaatacgcagcctggcaagaaggtgttttatcctgtgctgttttctcagtacaatccaggaattatctacgggcatcacgacgctgtgcccccattggaacagcagctagtcataaaaaaggaaacaggcttttggcgcgacttcggatttggaatgacatgccaatataggtcagacttcattaacatcggaggattcgatttagacatcaagggctggggcggtgaagacgtgcacctgtacagaaagtacctgcattccaacctcattgtagttcgaacaccagtgaggggcctattccacctctggcacgagaagaggtgtatggacgagcttaccccggaacagtataagatgtgcatgcaatcaaaggccatgaacgaggccagtcacggtcagctaggtatgcttgtgtttaggcacgagattgaggctcatttgaggaaacagaagcagaagacctcttcgaagaagacatag

SEQ ID NO: 48977 - DNA, 1002 bp, Artificial Sequence
  Description of Artificial Sequence: Synthetic coding sequence
atgcctcggagaggactgattctgcatactcgcacccactggcttcttctgggcctggctctgctgtgctccctcgtcctttttatgtatctgctggagtgtgcgccacagaccgatggtaatgctagtctcccgggtgtcgtcggcgaaaactacggtaaagaatactatcaagcactactccaagagcaggaggagcactaccaaaccagagcgacttccctgaagcgccagatcgcccagctcaaacaggagctccaagagatgtctgagaagatgcggagcctccaagagaggcggaacgtgggggcaaatggaattggctatcagtcaaataaggagcaggccccaagtgacctgcttgaattcctgcatagtcaaatagataaagccgaggtgagcatcggagcaaagctcccctccgagtacggtgtgatcccttttgagtctttcacgttgatgaaagtgttccagctggaaatgggccttactcgccatccagaagagaaaccggtaagaaaagataagcgggacgagctggtcgaagttatagaggctggcttggaggtcattaataaccctgatgaggatgatgaacaggaagatgaggaggggcctctcggggagaaactaatatttaacgagaacgattttgtggagggatactatcgaacggagagggataaaggcactcagtatgaactgttttttaagaaggccgatctcactgagtacaggcacgtcacacttttcagaccttttggacctcttatgaaagtgaaatctgagatgatcgatattaccaggtctatcatcaacatcatcgtccccctggctgaaaggaccgaggccttcgtccagtttatgcagaattttcgtgacgtttgcatccaccaggacaagaagattcatctcacagttgtgtatttcggcaaggaaggtctcagcaaagtgaaatctatactggaatctgtcaccagactggctagctcaacttggtag

SEQ ID NO: 48978 - DNA, 1629 bp, Artificial Sequence
  Description of Artificial Sequence: Synthetic coding sequence
atgcctcggagggggttaatcttgcacactcgcactcattggctgcttctgggtctagcactgctttgctcgctggtattgtttatgtatctgttggagtgcgcaccccagacagacggaaatgctagtttgcccggtgtcgtgggcgaaaattacggcaaggaatattaccaggcactgctgcaagagcaggaggaacattaccagacgcgagccacatccctcaaaagacagatcgcgcaactgaagcaggaattacaagagatgagtgagaagatgaggagcttacaggaaagacgcaatgttggtgctaatggtattggatatcagtcaaataaggaacaggccccttctgacctgcttgagttcctccactcgcagattgacaaggccgaggtgtcgatcggcgcaaaactaccatctgaatatggcgttatacccttcgaatcatttactctgatgaaggtgttccagcttgagatgggactgacaaggcatcctgaggagaagccagtcagaaaagataagcgagatgagctggtcgaagtaatcgaggcgggactcgaagttatcaacaatccagacgaggacgacgagcaggaagatgaagaaggtccgttgggcgagaagctaatattcaacgagaatgacttcgtggaaggatattatcggacagagagggacaagggaacgcagtacgagcttttcttcaaaaaggctgacctgactgagtatcggcatgtcacgctgtttagaccttttggacctctgatgaaggtgaaaagtgaaatgattgatatcactagatcaatcatcaatatcattgtgcccctggccgaacggactgaagcatttgtgcagttcatgcagaattttagagatgtgtgcatacaccaagataaaaagatccacctgactgttgtatacttcggaaaggagggactgagcaaggttaaaagcatcctggaatctgtgacaagcgagagcaattttcataactacaccctggtgagcctgaatgaggagtttaacagaggcagaggcctgaatgttggggctcgagcctgggacaagggggaggtgctcatgttcttttgtgacgttgatatctacttcagcgcggaatttctaaacagttgtcggcttaacgccgagcccggaaaaaaagtgttctaccccgtagtttttagcctctataatcccgctatcgtgtatgcaaatcaggaggtgccgcctcctgtagaacagcagctggtgcataagaaggatagcgggttttggagggatttcggcttcggaatgacgtgtcagtacaggagtgacttcctaacaattggcggtttcgacatggaagttaaaggctggggcggagaagacgttcatctatatcgcaagtatctccacggcgatctgattgtgatccgcacaccggtgcccggactgttccacttgtggcatgagaaacgatgcgctgatgagctgacacccgagcagtatcggatgtgcattcagagcaaagcaatgaatgaggcctctcattcccatctgggcatgttagttttcagggaagaaatcgaaactcatctacacaagcaggcctacagaacgaacagcgaagccgttgggtag

SEQ ID NO: 48979 - DNA, 1620 bp, Artificial Sequence
  Description of Artificial Sequence: Synthetic coding sequence
atggggcgagcgggaggaggtggccctggacggggaccccctccactcctgttgtttctgggggctgccctagtgctagcctcaggtgccgtgccggctagggaggcaggttctgccgtcgaagcagaagagcttgtgaaggggtcccccgcttgggagcccccagctaatgatacacgggaagaagcgggtcccccagctgctggagaggacgaggcatcctggactgccccaggtggagagttggctgggccagaagaagtgctgcaagagtctgccgctgtaacggggactgcctggttggaagctgactcccccggtcttggaggcgttacagcggaagccggttccggggatgctcaggctcttcctgctacgctgcaggctcctcacgaagtattgggccaaagcataatgcctcccgctattcccgaagcgactgaagccagcgggcctccttcccctacccctggtgacaagctaagtcccgcttctgaactccccaaagagtccccattggaggtatggctgaacctgggcggatctactccagacccacagggtcccgaactcacctatcccttccagggcaccctggagccacagcctgctagcgatataatcgatattgattattttgagggattggatggggaaggacgcggagcagacttaggatcattcccaggatcgcctgggacgagcgagaaccaccccgacactgaaggcgaaactcccagctggtcactgctagacttatacgatgatttcacccccttcgacgagagtgatttttatccgaccacctccttctatgacgatctggatgaggaggaggaggaggaggaagatgataaagatgcagtcggaggcggtgatcttgaggacgagaatgaactgctggtgcctacgggaaaacccggattgggcccaggaaccggccagccgacttcacgatggcatgctgttcccccacaacacacgttgggctcagtgcccggatcgagcattgctcttcggcctaggcccggtgaacctggacgtgatctggcctcctcagagaatgggaccgaatgtaggtctggttttgtccggcacaatggctcttgtcgctcagtgtgcgacttgttcccaagttactgtcacaatggaggacagtgctatcttgtggaaaacataggagctttttgtcgatgcaacacacaggactacatctggcacaagggtatgcgctgtgaaagcatcatcaccgattttcaggtgatgtgtgtcgcagtagggtcagcagccctggtcctgctgctcctcttcatgatgacagtgttttttgctaagaagttgtacttgctgaaaactgaaaacacaaaactgcgaaggacaaacaagtttagaaccccttcagagctccacaacgacaatttctccctgtccaccatcgccgagggcagccacccaaatgatgacccatctgccccacataagattcaggaagtcttaaaaagttgtctcaaagaagaagagagcttcaatattcagaattctatgagtcctaagttggaaggaggcaagggggaccaggcagatctggatgtgaattgtctacagaataacctgacttag

SEQ ID NO: 48980 - DNA, 1701 bp, Artificial Sequence
  Description of Artificial Sequence: Synthetic coding sequence
atgggtcgtgcagggggtgggggtccaggccgaggccctcccccactcttgcttttcttaggggcagccttggtgctcgccagcggcgcagtgcctgctcgggaggccggatccgcagtggaagccgaggaattggttaaaggatcacccgcttgggagccacccgctaacgatacacgggaagaggccggacccccagccgctggcgaagatgaggcctcatggactgcacctggaggtgagctggcaggacctgaagaggtcctccaggagtcagcagcggtgactggcaccgcctggctggaagccgactctcctggtctcggaggagtcacagccgaggccggatccggggacgctcaggcccttccagccactcttcaggcccctcatgaggtacttggtcagagcattatgccacctgctatcccggaagctaccgaggcctccggccctccctctccgacacccggagataagttaagtccagcatctgagctgccaaaagaatcacctctggaggtatggttgaatctcgggggatccacccctgatccacagggtcctgagcttacctacccgtttcaagggactctggaaccccagccggctagcgatattattgacattgactattttgaaggcttagatggcgaaggcaggggagcagacctgggctcttttccgggtagtcccggaacatctgagaatcaccccgacaccgaaggggaaaccccaagctggagcctgctggatctgtatgatgacttcaccccttttgatgagagtgatttctacccaaccaccagtttctatgatgacctagatgaagaagaggaagaggaagaggacgataaagacgccgtcggcggtggcgatctcgaggatgaaaatgagcttctggtcccaaccggtaagccaggactaggacccggtaccggacagcctacaagccgttggcatgctgtccccccacagcatacactgggatcggtgcctgggagcagcatagccttacgccctcgacccggtgagcctggacgggacctcgccagcagcgaaaatggaacagaatgccggtccggctttgtgcggcataacggttcttgcagaagcgtatgcgatctctttccgtcctactgccataacgggggacagtgctacctcgtggagaacatcggagccttttgccgttgcaatacccaggactacatttggcacaagggcatgcggtgcgagtccataattaccgatttccaggtaatgtgtgtggccgtggggtccgcggcacttgttctgctactgttattcatgatgacggttttcttcgccaagaagttatacctgctgaaaacagagaataccaagctgagaagaactaacaagttcagaacgccgtccgaactgcataatgacaattttagtctcagtaccatagccgagggatcgcatcccaatgtgaggaagttatgtaatactcccagaacatccagcccacacgccagagccctggctcattatgacaacgtgatctgtcaggatgatcctagcgcccctcacaagatacaggaagtgcttaaatcttgtcttaaagaagaggaaagttttaatatccagaacagtatgtctccaaagctggaaggcggtaagggagaccaggccgatctggacgtgaattgtttacagaacaacctgacttag

SEQ ID NO: 48981 - DNA, 1206 bp, Artificial Sequence
  Description of Artificial Sequence: Synthetic coding sequence
atgcctcccgctattcccgaagcgacagaggcttccgggccacccagtccaacacctggtgataagctgagccctgcgtctgagttgcctaaggagtctcctctcgaggtctggctcaatctgggtggaagtactccagatcctcagggccctgaactgacctatcccttccagggaactctggagccccagcctgcctctgatattattgatatcgactatttcgaaggactggacggcgagggccgaggggcagacctcgggtccttccctggttcacccggaaccagtgaaaatcatccagatactgagggcgaaaccccatcatggtccctgttggacctgtacgacgactttaccccattcgatgaatcagacttttaccctacgacctcgttctatgatgacttggacgaggaggaggaggaggaagaagatgacaaggacgccgtgggtggtggagatctcgaagatgagaatgaactcttagtgcccacaggaaagcctggactcggccctggtaccggccaacctacatcaagatggcatgcggtgcctccacagcacacccttggaagcgtccccggttcctcaatcgctctgcgcccaagacctggagaacccggtagggacctcgcgtccagcgagaacggaacggaatgccgctctgggttcgtgaggcacaatggctcttgccgcagcgtctgtgatctgtttccttcatattgccacaatggtgggcagtgctatttggtggagaacattggggctttctgtcggtgtaacacccaagactacatctggcacaaaggcatgagatgcgaaagtatcatcactgacttccaggttatgtgtgtggctgtggggtcggccgctctggtcctcctgttgttatttatgatgacagtgtttttcgccaaaaagctctatctgctgaagacagagaatacaaaattgcgacggactaacaaattcaggacaccctctgaactgcataacgacaatttttctttatctacgattgctgagggaagtcaccccaacgatgatccttctgccccacacaagatccaagaggtcctcaagtcatgcttaaaagaggaggagagtttcaacatccagaactccatgtcgcctaagctggagggaggcaaaggcgatcaggcagatttggatgttaactgcctccagaacaatttgacctag

SEQ ID NO: 48982 - DNA, 822 bp, Artificial Sequence
  Description of Artificial Sequence: Synthetic coding sequence
atgtccagagtcgtgagtctgctcctgggggctgcccttctctgtggccacggagctttctgcagacgcgtcgtatctggccaaaaggtttgtttcgcagactttaaacacccctgctacaaaatggcttattttcacgagttatccagtcgggtatcctttcaggaggctcgcctggcgtgcgaatctgagggaggggtgcttttgtcattagagaacgaagcagaacagaagctgatcgaaagcatgctgcagaacttgacaaagcccggaacggggattagcgacggagatttttggattgggctgtggcgaaatggagatgggcaaacgagcggagcatgtcctgacttgtaccagtggtccgacggttccaacagccaatatagaaactggtatactgacgagccatcatgcgggtccgagaagtgcgttgtcatgtaccaccagcctacagctaaccctggccttgggggtccttacctgtaccagtggaatgatgaccgttgcaacatgaagcacaactacatttgcaagtacgagccagagattaacccaactgcccctgttgagaagccctacttgaccaatcagccaggggacactcaccagaatgtggttgtgactgaggccggtattatccctaacctcatctatgtcgtgatcccaaccatccctctccttctgctgattctggtggctttcggaacatgttgtttccagatgttacataaaagtaagggccgtactaagacttctcccaaccagagcacactctggatatccaaaagcaccagaaaagagagcggaatggaggtatag

SEQ ID NO: 48983 - DNA, 711 bp, Artificial Sequence
  Description of Artificial Sequence: Synthetic coding sequence
atggcctactttcatgaattaagctctcgcgtgtcattccaggaggcaagattggcgtgcgaaagcgagggtggggtgctcctgtccctagaaaatgaagctgaacagaaacttattgaatccatgctgcagaatctgaccaagcccggaaccggcattagcgacggcgatttctggatcgggctgtggcggaatggggacgggcaaacatccggagcgtgtccagatttgtaccagtggtccgatggcagtaacagccaatatcggaactggtatactgatgagcctagttgtggaagcgagaagtgcgtggtgatgtaccatcagcccaccgcaaaccccggtctgggtggtccttatctgtaccagtggaacgatgaccggtgtaacatgaagcataattatatttgcaagtacgagccggagattaatcccaccgcgccagtagagaagccctacctgaccaaccaacctggagatacccatcaaaacgtggttgttacagaggccgtgaaggaagaacagaagctagtgcagaccagtctgcactgcgggttccaacgggtgccggagaagaaagttgcttggaaatataataactcactcacgtggttccagaatttcgtaatccttgacctgtataaagaatggcaccaaaataactcactcgagtggttagagatcactaaggacttgcaggacgagttgtag

SEQ ID NO: 48984 - DNA, 699 bp, Artificial Sequence
  Description of Artificial Sequence: Synthetic coding sequence
atggcttacttccacgaactgagctcgagagtgtcctttcaagaagcacggctcgcctgtgaatcagaagggggagtcctgctgagtcttgagaacgaggctgagcagaagctcatcgaatcaatgttgcagaatttgaccaagcccggtacaggcatttctgatggtgacttctggatcgggctatggcgcaacggagatggtcaaacttccggggcatgtcccgatttgtatcagtggagcgatggctctaactctcagtacagaaactggtacacggacgaaccttcctgcgggagcgagaagtgtgtggtcatgtaccatcagcctactgccaatcccggacttggtggaccttacctgtatcagtggaatgacgatagatgtaacatgaagcacaattatatatgtaagtatgaaccagagataaatcccactgcacctgtggagaagccttatctcactaaccaaccgggtgacacccatcagaatgttgtggtcaccgaggcaggtataatccctaaccttatatatgtggtgatacctactattcccttactgcttcttatcctcgttgccttcggcacttgttgcttccagatgctccataagtccaagggcagaacaaagacctctcccaatcaaagtacactgtggatctcaaagagcacgagaaaggagagtggaatggaagtgtag

SEQ ID NO: 48985 - DNA, 699 bp, Artificial Sequence
  Description of Artificial Sequence: Synthetic coding sequence
atggcttattttcatgaattgtcttctcgggtgagcttccaggaggcacggctggcttgcgaatcagagggtggtgtgcttttgtctcttgagaatgaagccgagcagaagctcattgaaagcatgttgcagaatttaaccaaaccaggcacaggcatttcagatggtgacttttggattggcctgtggcgaaacggagatggccagaccagcggtgcttgcccagatctgtaccagtggtctgatggcagcaattcacaatacaggaactggtatactgatgagccctcctgcggctctgaaaagtgtgttgtaatgtaccaccagcctacagccaatccagggctgggcggaccgtacctgtaccaatggaacgacgatagatgcaacatgaagcataattatatatgtaagtatgaacctgaaattaatcccacagcccctgtcgagaaaccctatttaacaaaccaacccggtgacactcatcagaacgttgtcgttactgaggctggcattattcctaatttaatttacgtggtgattccgacaattcccctgctcctcctgattctggtcgcctttggaacctgttgcttccagatgctgcacaagagtaagggacgcacaaagacatcaccaaaccagagcacattgtggatctctaagagtaccagaaaggaatcgggaatggaagtgtag

SEQ ID NO: 48986 - DNA, 711 bp, Artificial Sequence
  Description of Artificial Sequence: Synthetic coding sequence
atggcttatttccatgaacttagcagcagagtcagttttcaagaggctcgcttagcttgtgagagtgaaggaggcgtgctcctgtccctggagaatgaggcggagcagaagttgatagagtctatgctccagaatctcaccaagcccggaaccggcatctctgatggtgatttctggattggtttatggaggaatggagatggccaaacttccggcgcatgtcccgacttgtaccagtggtcagatggctctaattcccagtatcgcaactggtatactgacgagccgtcctgtggaagcgaaaagtgcgtagtcatgtaccaccagcctacagcgaaccctggactaggtgggccatatctgtatcagtggaatgatgatcgctgtaacatgaagcacaattacatttgcaagtacgagcccgagataaatcctacggccccagttgagaagccctacctcactaaccagcccggtgatactcaccagaacgtcgtggtaaccgaggctgtcaaagaggagcaaaaacttgtccagacctccctccactgtgggtttcagcgcgtccccgaaaaaaaagtggcctggaagtataacaacagccttacttggtttcaaaatttcgttatacttgacctgtacaaagaatggcatcagaataactccctggaatggcttgagatcactaaggatctccaagacgagctatag

SEQ ID NO: 48987 - DNA, 711 bp, Artificial Sequence
  Description of Artificial Sequence: Synthetic coding sequence
atggcctattttcatgagctttcttccagggtgagcttccaagaagcccgactggcatgtgagtccgaagggggagtcctcttaagcctcgagaacgaggcagaacaaaagctgatcgagtccatgttgcagaacttaaccaagccaggtactggaattagcgacggagatttctggataggcctgtggagaaatggagacggccagactagtggtgcttgccccgacctgtatcagtggagcgatggtagcaactcccagtataggaactggtacacggatgagccgtcctgtggcagtgagaaatgtgtcgttatgtaccatcaacccacagcaaacccgggactgggcggtccttacctgtaccagtggaatgatgacagatgcaacatgaagcacaactacatctgtaaatacgagcctgagatcaatcctacagcgccagtcgagaagccatacctcaccaatcaacctggcgacacccaccaaaacgtggttgttaccgaggcagtgaaagaagaacagaaactggtacagacatccttgcattgtgggttccaaagggtacccgagaaaaaagtggcatggaagtataacaactctctcacctggtttcagaatttcgttatcctggacctctacaaagagtggcaccagaataactctcttgaatggttggaaattaccaaggatcttcaggatgagctgtag

SEQ ID NO: 48988 - DNA, 141 bp, Artificial Sequence
  Description of Artificial Sequence: Synthetic coding sequence
atggcctacttccatgagctgtcttctcgggtgtcctttcaggaggctagactggcttgcgagagcgaggggggagtactgttgtctttagagaacgaagcagaacagaagctgatcgagtccatgctgcaaaacctctag

SEQ ID NO: 48989 - DNA, 141 bp, Artificial Sequence
  Description of Artificial Sequence: Synthetic coding sequence
atggcctactttcatgaactctccagtcgggttagcttccaagaggcccgactggcctgcgagtcagaaggtggagtactgctgtcactggaaaacgaggcagagcaaaaactgatagagtcaatgttgcaaaatctgtag

SEQ ID NO: 48990 - DNA, 141 bp, Artificial Sequence
  Description of Artificial Sequence: Synthetic coding sequence
atggcttacttccatgagttatcttcccgggtgtcctttcaggaagcgagactcgcttgcgaatccgaggggggagtgctcctctcccttgaaaatgaagcagagcagaagctgatagagagtatgctgcagaacttgtag

SEQ ID NO: 48991 - DNA, 765 bp, Artificial Sequence
  Description of Artificial Sequence: Synthetic coding sequence
atgacagcaggctccgcacattcccagaaggtctgttttgccgattttaagcatccgtgctataaaatggcttactttcatgaactttcaagcagggtgagcttccaggaggctcgcttggcttgtgaaagcgagggcggagttctgctatcactcgagaatgaggctgagcagaagctgatcgaaagcatgctgcagaatctgactaagcccggaaccggcatctctgatggggatttttggatcggcctctggaggaatggagatggccagactagcggagcttgtcccgacctgtatcaatggagcgacggctctaactcccagtatcgtaattggtacactgatgagccaagctgtggttccgaaaagtgtgtagtgatgtatcatcagcctactgccaacccgggactgggaggaccctatctgtatcagtggaacgatgacagatgcaatatgaagcacaactacatctgcaagtacgaacctgagattaaccctactgctccagttgagaaaccatatttgactaatcaacccggtgacacacatcaaaacgtggtcgtaacggaggcaggaatcattcccaatctgatttatgtggtgattccaaccattccacttttactgctcatccttgtcgcatttggcacctgttgttttcagatgttgcataagagtaagggcaggactaagacaagcccgaatcagagtacactttggatctccaaatcaacacgcaaggagagtgggatggaggtctag

SEQ ID NO: 48992 - DNA, 1239 bp, Artificial Sequence
  Description of Artificial Sequence: Synthetic coding sequence
atgcagaagtactgcatttatcagcattttcaattccagcttctgattcagcacctgtggattgccgcaaactgcgacatagctgatgaacggttcgacgctacatttcatactaatgtgttagtaaacagcagcgggcattgccaatacctcccgccaggaatttttaagtcatcctgctatattgacgtgagatggttccccttcgacgtgcagcactgcaaactgaagtttggctcctggtcgtacggaggctggtctctggatctgcagatgcaggaagcagatatcagtggttacatccccaacggcgagtgggatctggttggcatccccggaaagcgctctgagcgcttttacgaatgctgtaaggaaccatacccagacgtaaccttcactgtcacaatgaggcggaggaccctctactatggtctgaacttgctgatcccttgtgttctgatcagcgcccttgccctgctggtctttctgctccctgccgactccggagagaaaatctctctcggcattaccgtcttattaagcctgaccgtgtttatgctcctggtagcagagatcatgccagcaacgtccgactcagtccctctgattgcccagtattttgcatccaccatgattatagtgggccttagtgtggtggtcacagtcatcgttctgcagtaccaccaccacgatcctgatggcggtaaaatgcccaagtggacaagggtcatcctcctaaactggtgcgcctggttccttagaatgaaacgacctggggaagataaagtcagaccggcatgtcagcacaagcagaggcggtgctccctcgcatccgtcgaaatgagcgccgtagcccctccacctgcgtccaatgggaatctcctgtacattggattcagagggcttgacggtgttcactgcgttcctacgcccgattccggtgtggtgtgcggccgaatggcctgttcccccacccatgacgaacacctcctccatggtgggcagcctcctgaaggcgacccggacctcgctaagattcttgaagaagttcgctacattgccaacaggttccgctgccaagacgaaagtgaggcagtgtgctccgaatggaaattcgcggcatgcgtagtggacagactttgcttaatggctttcagcgtgttcaccatcatttgcactatcggaatcctcatgtccgcccctaattttgtcgaggcagtatctaaggattttgcctag

SEQ ID NO: 48993 - DNA, 966 bp, Artificial Sequence
  Description of Artificial Sequence: Synthetic coding sequence
atgcaggaagctgatatcagtggatatattcccaatggcgaatgggatctggttggaatcccgggaaagcggtctgaacgtttttatgagtgttgcaaggaaccctaccctgacgtgacgttcaccgtcacaatgcgccgaagaaccctctactatggtctgaatttgttaataccatgtgtgctcatctctgccctcgcactgctcgtctttctcctcccagcagacagcggggaaaagatcagcttagggattacagtactgctttcacttaccgtcttcatgttactcgtagctgagataatgcccgctacctctgacagcgtcccactaattgcacagtatttcgcttcaaccatgatcattgtggggttatctgtcgtggtgaccgtcatcgtgcttcaataccatcatcacgaccctgacgggggtaaaatgcctaagtggacaagagtgatcttattaaattggtgcgcctggtttttacgaatgaaacgacctggcgaggataaggtgagacctgcttgccagcacaagcagcggagatgctctctcgcttccgtggaaatgtcagctgtcgcaccccctccagccagcaacggcaaccttctctacatcggctttaggggcctggatggagtgcactgtgttcccacgccagattctggagttgtgtgcggcagaatggcttgcagtccaacgcatgacgaacacttgctccatggtggacagccacctgagggcgaccccgatcttgctaagatattagaagaggtgcggtacatcgccaaccggttccggtgtcaggacgagtccgaggctgtgtgtagcgagtggaagttcgccgcttgtgttgtggaccggctgtgcctgatggctttctctgtgttcacgattatatgcacaattgggatcctaatgtcagccccaaattttgtcgaggctgtttcaaaggattttgcgtag

SEQ ID NO: 48994 - DNA, 966 bp, Artificial Sequence
  Description of Artificial Sequence: Synthetic coding sequence
atgcaagaagccgacatttcaggatatatccctaatggggagtgggatctggtggggatcccaggcaagaggagtgagaggttctatgaatgttgtaaggagccctaccccgacgttacatttactgtcacaatgcgcaggagaactctgtactacggtctgaacctcctcattccgtgtgtactaatctcagccttggccctgttagtcttcttactccctgcggatagtggcgaaaagatcagtctggggattaccgtcttactgtcactcaccgtgtttatgctgctggtcgccgagatcatgcccgcaacctccgacagcgttcctcttatcgcccaatacttcgcctctaccatgattatcgtgggattatccgtcgtggtgactgtcatcgtgcttcaatatcatcaccacgaccccgatggaggcaaaatgcccaaatggaccagggtgatcctgcttaactggtgcgcgtggttcctgaggatgaaaaggccaggggaagataaggtgcgtcctgcgtgtcaacacaagcagcggcgatgtagtttagcgtcagtggagatgagtgctgttgcccctccccctgcatctaacggaaaccttctgtacattggctttcggggactcgacggtgtccactgtgttcccaccccagattctggcgtcgtttgtggcaggatggcgtgttcgcctactcatgacgagcaccttctgcacggcggacagccacccgagggagaccccgatctcgcgaagattctagaggaggtgcggtatatcgccaatcgcttccgctgtcaggacgaaagcgaggccgtatgttccgaatggaaattcgcagcctgcgtcgtggataggttatgtttaatggctttctcggtcttcaccataatatgtacaattgggatattgatgtctgcccctaatttcgtggaggcagtcagcaaggactttgcttag

SEQ ID NO: 48995 - DNA, 1626 bp, Artificial Sequence
  Description of Artificial Sequence: Synthetic coding sequence
atggcctcacaagagttcgaggtggaagccatcgtggacaagcgccaggataaaaacggcaacacgcagtacctggtccggtggaaaggctacgataaacaagacgacacgtgggaacctgagcagcacctcatgaattgcgaaaaatgtgttcacgatttcaacaggcggcaaaccgaaaagcagaagaaactgacttggactactacttctcgcatcttcagcaataatgcacgacgcagaacatcccggtccactaaagctaactacagcaaaaatagccccaagacacctgtgaccgacaaacaccacaggtcgaaaaattgcaagctgtttgccgcaagcaaaaatgttcggcgaaaggctgccagtaccctgagcgacaccaaaaacatggagatcatcaattcaaccatagaaacacttgccccagacagtcccttcgatcataagaaaacagtgtctggattccagaagttggagaagctggacccgattgctgcagaccagcaggacaccgttgtcttcaaggttactgagggcaaattgctgcgtgatccattgtcgcatcccggagccgaacaaacaggaattcagaacaagactcaaatgcacccgctgatgtcgcagatgtccggaagcgtcaccgcatctatggccaccggcagcgcgacccgcaagggaattgtcgtactcatcgaccccttggccgcaaacggcactacagatatgcataccagtgtgccgagggttaagggtgggcagcgaaatattaccgacgactcgagagggcagcccttcattaagaaaatgcacttcacaattaggctgacagaaagcgcaatcacatacagagacattgtagtcaaaaaagaggatggatttactcagattgttctgagcacccgctctacggagaagaacgccctgaacacagaagtgatcaaagagatggtaaacgctttaaactccgccgctgccgatgactctaaactggtgcttttttccgccgctgggtccgttttctgctgtggcctggattttggctatttcgtaagacacctgcgaaacgataggaatacagcgtctctcgagatggtcgacaccattaagaatttcgtgaatacattcatacagtttaagaaaccaattgttgtatccgtcaatggacccgctatagggctgggagcaagcatactcccactgtgtgatctcgtctgggccaacgagaaggcctggttccagacaccatatactacatttggccaatcacctgatggctgttcttccataacatttcccaaaatgatgggaaaagcctcagccaatgaaatgcttattgctggcaggaagctaacggcacgagaggcctgcgccaagggcttagtgtcccaagtgttcttaactggcacatttacccaggaagtgatgattcaaatcaaggaactcgctagctataacgccattgttctggaggagtgtaaggcccttgtccgctgcaacattaaactcgaactggaacaggctaacgaacgcgagtgtgaagtgttaagaaaaatttggtcgtctgcacaaggcattgagtccatgttgaagtacgtcgagaataagatcgatgagttctag

SEQ ID NO: 48996 - DNA, 1668 bp, Artificial Sequence
  Description of Artificial Sequence: Synthetic coding sequence
atggcctcccaggagttcgaggtggaagcgatcgtggacaagcggcaggacaaaaatggaaatacgcagtatttggtgcggtggaaggggtacgataagcaggacgacacatgggaaccagaacagcacctaatgaactgtgagaagtgtgtgcatgactttaatagaaggcagactgagaagcagaagaaactgacatggaccaccacttcacgtatcttcagcaataatgctcggagacgcacctcaaggtccaccaaagccaattacagcaagaactctcctaagactccggtgacagacaaacaccatcgcagcaaaaattgtaaattgtttgccgcaagcaagaatgttcggaggaaagcagcttcaacactgagcgacaccaaaaacatggaaattatcaatagcacgatcgaaactttggcacctgactcacctttcgatcacaagaagaccgttagcggctttcagaagctggagaagttggatccaattgccgcagatcagcaggataccgtggtatttaaggtgaccgagggtaaacttttacgggaccctctgtcccatcctggtgcggaacagactggcatccagaataagacccaaatgcatccattgatgagtcagatgagcggatccgtaacggcttctatggccactggatcggccacccgcaagggcatcgtggttctaatagatcctctcgcagccaatgggactacagatatgcatactagcgtccctcgtgtgaagggaggccagcgaaatatcacggatgattcacgcggtcaaccctttatcaagaaaatgcacttcaccatccgtctgacggagagcgcgattacttacagagatattgtcgtgaaaaaagaagatgggttcacgcagatcgtgctctccacgcgcagcactgagaagaacgcactcaacactgaggtcattaaagaaatggtgaacgccctgaacagtgctgctgccgatgactccaagcttgtgctgttctctgccgcaggctcagtcttttgctgtgggttggactttggatactttgtacggcatctcaggaacgaccggaacactgcctccctggaaatggttgatactattaaaaactttgtcaatactttcatacagtttaaaaagcctatcgttgtctctgtaaatggtccagcgatcggacttggcgcatccattttgcccttatgtgatcttgtgtgggcgaacgagaaagcctggttccaaacaccttataccacctttggacagagccctgacgggtgcagttctattaccttccctaagatgatgggaaaggctagcgcgaatgaaatgctgatcgcaggcagaaagctgacagctcgggaggcttgcgccaaagggttggtgtcacaggtgtttctgaccggtacttttacacaggaagtcatgattcaaattaaagagctggcatcatacaatgccatagtgttagaggaatgtaaggccctcgtgaggtgcaatattaaattggagctagagcaggcaaatgaacgcgagtgcgaggtgctccggaaaatttggtcttccgcccaggggatcgagtcaatgcttaaaatcccccttcttgggtacaaggccgcttttcctcccagaaagacacagaacgaccagcgctggtgtccgtag

SEQ ID NO: 48997 - DNA, 2403 bp, Artificial Sequence
  Description of Artificial Sequence: Synthetic coding sequence
atggcgaccctgggccaaaaacctgtgattcacaccgttctcaagcgcaaggtttacagctccaacgaaaagatgaggcgtggcacctggcgaattgtggtacctatgactaaggacgatgcactcaaagagatcagaggaaaccaagtgaccttccaagattgtttcattgctgactttcttattttgctgaccttccctctgttgaccattcctgagattccagggtatctcccgatctcatctcccagaggctcccagttgatggctagttgggacgcctgtgtggtagcgtctgcagtcctcgtcaccgacatggaaacgttccatactacagactcattcaaatcgtggacgcgcattagagttccacctgatatcctgtcagatgacgagcggaggtcggtggcccatgtcatactctcacgagacgggatagtgttcttgattaacggcgttctttatattaagtcctttcggggtttcattcggctgggtggcatcgtcaatttgcctgatgggggaattacaggcatctccagtcggaaatggtgctgggtgaactacctgcttaaagcaaagggaagaagatctaccttcgcagtttggacagaaaatgagatttatttgggaagcatcctgcttaagtttgctcggctggtcactaccacagagctgaagaacatccttagtctgtctgtgaccgctaccctgacgatcgaccgggttgagtacacaggtcacccgttagagatcgccgtctttcttaattactgcacggtgtgtaacgtcactaagaagatattcctggtcatctacaatgaagatacaaagcagtgggtgagtcaggacttcaccctggacgcccctattgactctgtcactatgcctcatttcacgtttagcgccctgccaggcctcctcttatggaacaagcatagtatttattactgttaccataactttacgttcacggggatcctgcaaacgcccgcaggccacggcaatctgtctatgttgagtaatgacagcatcatccacgaggtcttcatcgattactacggtgatattttggtgaagatggagaataatgttatcttttatagcaagattaatactcgggacgctgtcaaactccacctgtggacgaactatactacacgtgctttcatcttcttgagcacctctggccagacatatttcctgtacgctctggacgatggaacaatacaaatacaagattatcccctccaccttgaagcccagtccatcgcatttacaacaaaagataaatgtccctacatggccttccacaacaacgtcgcccatgtgttttattttctggataaaggcgaagcacttacggtgtggacgcagatcgtgtatcccgaaaacacagggctgtatgtcattgtggagtcctatggtcctaagatccttcaggagagccatgagataagttttgaggccgctttcggttattgcacaaaaaccctgacactgactttctatcagaacgtggactatgaacgtatcagcgattatttcgaaactcaagacaagcacacgggtctcgtcttggtgcagttccggccaagtgagtactcgaaggcttgcccaattgcacagaaggtatttcagatcgctgtcggctgcgatgataaaaagttcatagcaattaaaggcttctccaaaaaaggctgtcatcatcacgatttcagttacgtgatcgagaagtcttacctcagacaccagcctagcaaaaatttgagagtgagatatatttggggcgagtatggctgtcccttaaggctggattttacagaaaagttccagccagtggtgcagctgttcgacgataatgggtatgtcaaagacgtagaagccaatttcattgtttgggaaatccacggcagagacgactacagtttcaataatactatggcccagtcaggttgcctccacgaagctcagacctggaagagcatgatcgagctcaataagcacctgccgctggaggaggtgtggggacctgagaattataaacactgtttctcctatgcgatcggtaagcccggagacctgaatcaaccctatgagatcataaatagctcaaatggaaaccatattttctggccaatgggccactccgggatgtacgtgtttcgcgtgaaaatcttggacccaaattacagtttctgcaatttaacagctatgttcgccatcgagacgtttggtcttatacctagcccttccgtgtatcttgtcgcgtcgttcctgtttgtgttgatgcttctgttcttcaccatccttgtgttgtcctacttccgctacatgaggatctatcggaggtacatatacgagcctctccataagccacagaggaagagaaagaaaaactag

SEQ ID NO: 48998 - DNA, 2499 bp, Artificial Sequence
  Description of Artificial Sequence: Synthetic coding sequence
atgagcgccagagaagtggcagtgctgctgctgtggctgtcttgttatggatcagccttatggcgatacagtactaactctcccaactataggattttcagtacccggtcgactattaagctcgagtatgaaggaacgctgttcacagagtggagtgtgccggagacctgtttcgtcttaaataagtcctctcccactacagagctgaggtgctcctcccccggtgttcacgcaattaaacccatcgtcactggtccggacgaagaggaaaggtacctatttgtagagagtagccacacatgtttcctgtggtattacagagtccgccacttttttaataacttcacccagttaatcactgtttgggcttacgatcctgagtccgccgatccagacgaactcctgggaaatgccgaggagcctagtatcaattcaatagtgcttagcacccagatggctaccctcggccaaaagccagtgatccataccgttctgaagcgcaaggtatatagtagcaatgagaagatgcgcaggggtacttggaggattgtggttcctatgacaaaagacgatgctctgaaagagatccgcggaaaccaggtcacatttcaggactgtttcattgctgactttctgatactcttaacattcccccttttgacgattcccgaaattcctgggtatctgcccatttcaagccctcggggttcgcagctgatggccagctgggacgcctgcgtggtagcttcagccgttctcgtgacggacatggagacctttcacactactgacagttttaagtcatggactcggattagagttccccctgatatcttgtcggacgacgagcggaggagcgtcgcacatgtcatcctcagtcgcgatggcattgtgttcctcattaatggcgtgttatacataaagtcctttagagggtttataaggcttgggggaatcgttaacctcccagatggtgggatcacaggcatctcgagccgcaagtggtgctgggtaaattacctcctcaaagccaagggaaggaggagcacgtttgctgtgtggactgagaacgaaatttacctgggaagcatcctgctcaagttcgctagattggtgactacaacagaactgaagaatatcctatcactgtccgtcaccgccacactgacaattgatcgtgttgagtacacgggccatcccctggagattgcagtcttcctgaattactgtactgtctgcaacgtgaccaaaaagatcttcctagtgatctataatgaggacacaaagcagtgggtgtctcaggacttcacgttagatgctccaatcgattccgtaacaatgccgcactttactttctcggctctgcccggtcttcttctttggaataagcactctatttactactgctaccacaatttcactttcacggggatcctgcaaacaccagcagggcacggcaatctttctatgctgagcaacgactccatcatacacgaagtgttcattgattactacggcgatatactggtcaagatggagaataatgtaattttctactctaagattaataccagagatgctgttaaactgcacctctggacaaactacacaacgcgagcgtttattttcctgtcaacgagcggtcaaacgtactttctgtatgcactagacgacgggacgatacaaattcaggattatcccctgcacctcgaagcccaaagtatagccttcacgaccaaggataagtgtccctacatggcgtttcataataacgtcgcccacgtattttatttcttggataagggggaagcgcttacggtttggacacagatcgtctatccagagaataccggattgtatgtgattgtggagtcgtatggtccaaagatactccaggaaagtcacgagatcagcttcgaagctgccttcggatattgcacaaaaacacttaccctgacattttaccagaatgtggattacgagcgcatcagtgactactttgaaacacaggacaagcatacagggctcgtgcttgtgcagttccgtccatctgagtattccaaagcttgccccattgctcagaaggtatttcagatcgctgttgggtgcgacgacaagaaattcatcgccatcaaggggttctccaaaaagggatgccaccaccatgatttttcatatgtaattgaaaagtcttaccttcgccaccagcccagcaagaacctgagagtgaggtatatctggggcgagtacgggtgtcccctgcgattggattttaccgagaagtttcagccagtggtgcagttgttcgatgacaatggatacgttaaggatgttgaggccaatttcatcgtgtgggaaatccacggaagggacgattattctttcaacaacactatggcccaatcgggctgcttgcacgaagcccagacttggaagtccatgattgaactgaacaagcaccttccccttgaggaagtatggggtcctgagtttctctag

SEQ ID NO: 48999 - DNA, 2856 bp, Artificial Sequence
  Description of Artificial Sequence: Synthetic coding sequence
atgagcgctagagaggtggctgtgctgctcctatggctgagctgctatgggagcgcactgtggcggtacagcaccaacagcccgaattaccgcattttttccacaaggagtacaatcaagctcgagtacgagggcaccttgtttaccgagtggtcggtgccagaaacgtgtttcgtgttaaacaagtcttcaccgaccacagagcttcgctgctcctctccaggtgtgcatgcaatcaagcctattgtaacgggtccagacgaagaggagagatatctctttgtggaaagctcgcatacatgttttctgtggtactatagggtgagacatttctttaataatttcacacagcttatcaccgtgtgggcctatgacccggagtccgcggacccggatgagttgttagggaatgccgaggaaccatcaatcaacagtattgtgttgtcaacccagatggctaccttgggacaaaagccagtcattcatacagttctcaaacgcaaggtatattctagcaatgagaagatgcggagggggacatggaggattgtggtgccaatgactaaagacgatgcactgaaagaaatccgtggaaaccaggtaacctttcaagactgcttcattgccgatttcttgattctgttgacatttccgctcctcaccattcctgagattcctgggtatctccccatttcaagtccccgaggttctcagctcatggctagttgggatgcttgcgtagtcgccagcgcagttctcgttaccgatatggaaacatttcataccacagacagcttcaaaagctggacaagaattcgggtaccacctgacattctgtctgatgacgagcgcagatctgtggcccatgtcatactttccagggacggaattgtttttctaatcaacggcgtgctgtatataaagagcttccgcggattcatcagactggggggaattgtcaatttgcctgatggaggtattactggaatcagctcaagaaaatggtgttgggttaactatttattaaaagccaagggacggaggagcacattcgctgtttggacagagaatgagatctatctggggagtattttgttgaaatttgctcgcttggtgaccaccactgaattgaaaaacattctctccctcagtgttacagccactctgacaattgacagagtggaatacacggggcaccccctggagattgcggtttttttgaactattgtaccgtgtgcaatgtgacaaagaagatcttccttgtgatttacaatgaagacactaagcagtgggtgagccaggacttcaccctcgatgcaccaatagacagcgttacaatgccacatttcacctttagcgcacttcctggcctactgctatggaataagcactctatctattattgctatcataatttcacattcacaggcattctccaaactccagcgggtcatgggaatctgtccatgctcagtaatgacagcataattcacgaggtgttcattgattattacggagatattctggtgaagatggaaaataacgtgatcttctatagcaagatcaacaccagagatgcagttaagctccacctgtggacaaactatacaacacgcgctttcatttttctttctacttcaggccaaacctactttctgtacgccctcgatgatggcaccattcagatccaggactatccactgcacttagaggcacagagcattgcctttactaccaaagacaagtgcccctacatggcgtttcataacaacgtagcccatgttttctatttcctagataaaggggaagcactcactgtgtggacacaaattgtttaccccgagaacaccggactttacgtgatcgtggaaagttacggaccaaaaatcctccaagaatcacacgagataagtttcgaggctgcctttggttattgtacgaaaacccttacactcactttctaccagaacgtggattacgagcgcatctcggattattttgaaacacaggacaagcacactggtctggtgctggtacagtttagaccctccgagtatagtaaggcttgtccaatagctcagaaggtgttccaaatcgccgtcggctgtgatgataaaaaatttattgctatcaaagggttttctaaaaaaggctgccatcatcatgacttttcctatgtaatagagaagtcttacctccgtcatcagcccagtaagaacttgcgggtacggtacatttggggcgagtatggctgccctctccgtttggattttaccgagaaatttcaacctgttgtgcagctcttcgacgacaacgggtacgtaaaagacgtcgaagcaaacttcattgtttgggagatacacgggagagatgactattctttcaacaacaccatggcccaatccggatgccttcatgaagcacagacctggaagtctatgattgagttaaataaacacctcccactggaggaagtttggggtccggaaaattacaaacactgcttcagttatgccattggtaaacctggtgacttgaaccagccctatgagatcatcaattcttccaatggtaaccacattttctggcctatgggccacagcggcatgtacgtctttcgtgtgaaaatactggacccaaactacagtttctgcaaccttacggccatgttcgccatagagacgtttggcctgatccccagtccaagtgtatatctcgttgccagcttcttgtttgtccttatgctccttttcttcaccattctcgtgctttcctatttccgctacatgcgaatctaccgccgatacatctacgaacctctccacaagccccagcggaagcggaaaaagaactag

SEQ ID NO: 49000 - DNA, 2499 bp, Artificial Sequence
  Description of Artificial Sequence: Synthetic coding sequence
atgagtgcgagagaggtcgccgtgctactgttatggcttagctgctatgggtctgctctgtggcggtactctacgaactctcccaactaccgtattttttccacccggtctaccattaagctagaatatgagggcaccctgtttacagagtggtcagtgcccgaaacctgtttcgttctgaacaagagcagccccaccacggagctccgatgtagctctcccggagtgcacgcaatcaagcctattgtgaccgggcctgacgaagaggagcgttaccttttcgtcgagagcagccatacgtgcttcttgtggtattaccgtgtgaggcatttctttaataatttcacccagctgatcacagtgtgggcatatgatccagagagcgccgaccccgatgagttactgggcaatgctgaggagccgtccattaactcaatcgtgctcagcactcagatggctaccctcggacaaaagccggtgatccacacagtcctgaaaaggaaggtctactctagcaatgagaagatgaggcggggaacctggcggattgtagtgccgatgacaaaggacgatgccctgaaggagatccggggaaatcaagtcacattccaggactgtttcatcgcagacttcctgatcttgttgacttttccactactgacgatcccggaaattcccggatatctgcccataagctcacctcgcggttcccagctgatggcttcctgggatgcgtgcgtcgtggcatccgcagtgctggtgactgatatggagactttccacacgactgattcctttaagtcatggacaaggatccgcgtgccacccgatatcctgagcgacgatgaaagaagatctgttgcccacgtcattctgagcagagacggcattgtgttcctgattaacggtgtgttatatatcaaaagtttccgcggattcattcgcctcggaggtattgtcaacctgccagacggcggtatcactggaatctcctctcgtaaatggtgctgggtcaactacttactcaaggccaaagggcgacgaagcacctttgctgtctggaccgaaaatgaaatttatctgggaagcattctgcttaaatttgccaggctggtaacaaccacagagctgaagaacatcctcagtctatcagtgaccgccacattaaccattgatagggtggaatacactgggcaccccttagagattgcagtattcttaaactactgcaccgtgtgtaatgtgacaaagaagatcttcctggttatctataacgaagacaccaagcagtgggtcagccaggatttcactctcgacgcacctatcgattctgtgaccatgccccattttaccttctcagctctacctgggctactcttatggaacaagcattcaatttactactgctatcataactttacattcactggcatactgcaaacccccgctgggcacggcaacctctccatgttgtccaacgattccatcattcacgaggtgtttatagactattatggagatatcctggtgaagatggagaataacgtgatcttctacagcaagattaatacacgcgacgcagtgaagttgcacttgtggaccaactatactacccgcgcattcattttcttgagcacaagcgggcagacctattttctctacgcattggatgacggaacaatacagattcaggactaccccctgcacttggaggcacagagtatcgctttcacaacaaaagacaaatgcccctatatggcgttccataacaacgtggcccacgtgttctacttcttggataaaggggaggctttgactgtttggacccagatcgtgtaccctgaaaacaccggtctgtatgtgatcgtggagagttacgggcctaagatcctacaggagtcccacgaaatttcgttcgaggccgcatttggttactgcaccaaaactttaactctgaccttctatcagaatgtggattacgagcgcatttctgattatttcgaaacccaagataaacatactggccttgtgctcgtgcagtttcgcccttctgagtacagtaaagcctgtcctatagcccagaaagttttccagatcgctgtagggtgtgatgataagaagtttatcgctatcaagggttttagcaaaaaaggctgccaccaccatgatttttcatacgtcatagagaagtcatatctgcgccatcagccgtccaaaaatctcagagtgaggtatatctggggcgaatatggatgcccgttgagactggatttcaccgaaaagttccagcctgtagtgcagctattcgacgataatggctatgtgaaggatgtcgaggcaaacttcatcgtttgggagattcatggtcgcgacgattactccttcaacaacacaatggcccaatccggttgtcttcacgaggctcagacatggaagtccatgatagaattgaacaaacacttacccctagaagaagtgtggggacccgaatttctgtag

SEQ ID NO: 49001 - DNA, 2616 bp, Artificial Sequence
  Description of Artificial Sequence: Synthetic coding sequence
cgcaggagatctaggcgacatgtaagccctggaagcggaagggccgctgccgtggccgagcttttatggctaaggccccttgagattaaattggagtacgaaggaactttgttcaccgaatggtctgtgcctgaaacatgttttgtgttaaacaagtcttcccctacgacagagctcaggtgcagcagtcccggtgtacatgcaattaaacctatcgttaccggacctgacgaggaagaacgctacctgttcgtcgagtccagccacacctgttttctgtggtactacagagtgcgcacgtggcgaatcgttgtgcccatgacaaaggacgacgctttgaaagaaatacggggtaatcaggtgacctttcaagattgtttcatcgcagactttttaattctgcttacattcccactgcttaccatcccagaaattccgggatacctgcctatttcaagtccacgcggaagccagctcatggcaagttgggacgcttgtgtagttgcttcagctgtcctcgtgaccgacatggagaccttccataccaccgactccttcaagtcctggacaagaataagggtccctccagatattctatctgatgatgagcgtagatccgtcgctcacgtgatcttgtccagagacggtattgtgttcctgattaatggcgtcctctatatcaagtcttttaggggcttcatcagactgggtggcatcgtgaacctgccagacggcggaatcacgggaatcagtagccgtaagtggtgttgggtaaactacctgctgaaggcgaaaggcaggaggtctacctttgctgtctggaccgagaatgaaatctacctgggcagcatcctcctgaaattcgcaaggctggtcactacaacggagctaaagaacatcctctcactgtctgtaactgccacgttgactatcgatcgggtggaatacaccggccacccattggaaatcgcggtgtttctgaactactgtacagtgtgcaacgtgacaaaaaaaatcttccttgtcatctacaacgaggacacaaaacagtgggtgagccaggattttaccctggatgcgcctatcgatagtgtgactatgcctcacttcaccttttctgcgctcccaggactactcctttggaacaagcattccatctattactgctaccacaatttcacctttactggtattctccagacccctgctggacatggaaacctgtcgatgcttagcaacgactccatcatacacgaggtgttcatagactattacggggacattctcgtgaaaatggagaacaatgtgatcttttattctaagattaatacacgggacgccgttaaactgcacctttggacaaattacactactagggccttcatattcttaagtacatccgggcagacatatttcttgtatgcactggatgatggaacgattcagattcaggactaccccctgcacctggaagcccagagcatagccttcacaactaaggacaagtgtccctacatggcattccacaacaacgttgcccatgttttttattttttggacaaaggagaggccctgacagtatggactcagatagtgtacccagaaaataccggcctatacgtcatcgtcgagtcctacggtccgaaaatcctgcaggagtcccatgagatcagtttcgaggccgcttttggctactgtacaaaaaccttaaccctgacattctaccaaaatgtggactacgagcgaatttccgattactttgaaacgcaagataaacatactggtctcgtactggtgcaattcaggccatccgagtactctaaggcctgccctatcgcacagaaagtattccaaatcgctgtgggctgcgacgataaaaaattcatagcaattaaggggttttcaaagaagggatgccatcaccacgacttcagctacgtgattgaaaagagttatctgaggcatcaaccatccaaaaacctcagggtgaggtatatttggggagagtatggctgtcctctcagactcgactttacagaaaaattccaaccagttgtgcagctgtttgacgataacgggtatgtcaaggacgtggaagctaatttcatagtgtgggagattcacgggagagacgactatagttttaataatactatggctcagagcggctgtcttcatgaagcccagacctggaagtccatgatcgagttgaacaagcacctcccactggaggaggtgtggggtccagagaattacaagcactgcttctcttatgccattgggaagccgggagatctgaaccagccctatgaaatcatcaactcgtccaacggaaaccatatattctggcctatgggacatagtggcatgtatgtattcagggtcaagatcttggaccctaactattcattctgcaatctcactgcgatgtttgctatcgaaaccttcggcctcatcccatcacctagtgtctatctggtggcgagtttcctgttcgttctgatgttgctttttttcacaatcctggtcttgagctactttaggtacatgagaatctaccgccgttatatctacgaacccctgcacaagccacagcggaagcggaagaagaattag

SEQ ID NO: 49002 - DNA, 309 bp, Artificial Sequence
  Description of Artificial Sequence: Synthetic coding sequence
atgaccacagcgactcccttaggagataccacctttttctcactgaacatgacaacccggggtgaggacttcctgtataagagctctggagctatcgtggctgctgtggtagttgtggttattattatcttcaccgtcgtgcttattcttctgaagatgtacaataggaagatgcggaccaggcgagaactggagcctaagggtcccaagcctacggccccttctgctgtgggtccaaatagcaacggtagccaacacccagcaacagtaacctttagtcccgtggatgtgcaggtcgaaacaaggtag

SEQ ID NO: 49003 - DNA, 1035 bp, Artificial Sequence
  Description of Artificial Sequence: Synthetic coding sequence
atggccctgcgtcacttggctctcctggccggactcctggtcggagtggcctccaagagcatggagaacacagcccagctgcctgaatgttgtgtcgatgtggtcggtgtgaatgcctcatgtccaggtgccagtctttgcggcccaggatgctatcggaggtggaacgctgacggttctgcatcctgtgtgaggtgcggtaatggcacattaccagcttacaacgggagtgaatgtcgctcattcgccggtccgggtgccccatttccgatgaaccggtcaagcggtacgcctggaaggccacatcccggagccccaagggtggccgcaagcctctttctgggaactttttttatcagttcaggactgatcctgtccgtagcagggttcttttacctgaagagaagcagtaaattacccagggcctgctaccgcaggaataaagccccagcattgcagccgggagaggccgctgccatgatccctccgcctcagtcatcagggaattcgtcctgccggattcccctctgggggttcccgtcactcggacagtcacagggcgctctatgggtgtgccctcagacaggccttcccggaagcggcagtaggccgcctctgcctggctcccccggtgatccccctacacgacagggtcaggggaggatttggctcgtaccccctgcgctggatttgagctggatttggcctgctccccctgcccgacccccactgatcccagtcacttccatgctctttcccgttccggaaacctggggcctccaggaacgacggactcaccatgacagggctgacccccagtatctcctgctgctggaagttcagcttcaccccagaacggatgctgccggattaagacaggcattgctgtcttctcatcggttttcaggcgctgggagcgggggtccaaagtcacagcctgtgaggaagcctcgatatgttcgaagagagagacccttggacagggccaccgacccggctgcctttcctggagaagccaggatctcgaacgtctag

SEQ ID NO: 49004 - DNA, 597 bp, Artificial Sequence
  Description of Artificial Sequence: Synthetic coding sequence
atggcactgaggcatctggcccttctcgccggattgctagtcggcgttgcctcaaagtcaatggaaaacaccgctcaacttccagaatgttgcgtggacgtggttggcgtgaatgccagctgccctggagcttctctgtgcggcccagggtgttatcgacggtggaatgcggatggcagtgcttcttgcgtcaggtgtggtaacgggactttaccggcatacaacgggagcgaatgtcgcagtttcgccggacctggcgcaccgttccccatgaacaggtcttccggcacccctgggcgtccccatcctggtgcaccacgggtggcagcgtccctgttcctcgggaccttttttatttcctcgggactgattctgtccgtagcaggctttttctacctcaagcgcagcagcaagctccctagggcctgttatagaaggaataaagcccctgcattgcaaccgggagaggcggctgctatgatcccacctccgcaatctagtgttcgaaagcctcgatatgttcggcgtgagcgcccactagacagagccacagacccagctgcttttcccggtgaagcgcgaataagcaacgtgtag

SEQ ID NO: 49005 - DNA, 1143 bp, Artificial Sequence
  Description of Artificial Sequence: Synthetic coding sequence
atggccctcagacatctggcccttctggccggattactagtgggcgtggcgtccaagtcaatggagaataccgtcacacggaatagcacagcagttattaatactcaggctgaaggcaccctgtccccacctggcctctcctccttgcctgttgttagagaatgggctcttacacatacagcccagctccccgagtgctgtgtggacgttgtcggtgtcaacgcatcatgtccaggagcgagcctgtgtggacctggatgctacagacgatggaatgctgacggtagtgcttcttgcgtgagatgcggtaacgggaccctgcccgcatacaacggttctgagtgtagaagcttcgctggtcccggtgccccttttcccatgaatcggtcaagtggaacccccggacggccacatcctggtgctcctagggtggccgcttcactgttcctcggaacattttttatttcgagcggactcatactgtcagtggctgggttcttctacttgaagcgaagtagcaagcttcctagagcttgctataggagaaacaaggctcccgcactccagcctggcgaggctgccgcaatgattccgcctccccagtcttctggcaacagctcgtgccgtattcccttatggggcttccctagcctgggtcagagccagggcgcactctgggtgtgtcctcagactggtttgcctggcagcggaagtagacctcccctgccagggagccccggagatccgcctaccaggcagggtcaggggcgtatctggctcgtgcctcctgcactcgatctgtcctggatctggcccgctccaccagcacgaccgccattgattcctgtgaccagtatgttgttccctgtccctgagacatgggggctccaggaacggcgaactcaccacgaccgcgctgatccccagtacctgctgcttttggaggtgcaactgcacccaagaaccgatgccgctggtctgcgacaggcacttctgtcaagccatcgtttctccggtgctggctccgggggtccaaagtcgcagcccgtacgtaagcccaggtacgtgcgtcgggaaagaccactagatcgcgctactgaccctgcagcattccccggagaggccaggatctctaatgtgtag

SEQ ID NO: 49006 - DNA, 597 bp, Artificial Sequence
  Description of Artificial Sequence: Synthetic coding sequence
atggcactccgtcaccttgccttgctggccggtctactggtcggtgtggccagcaagtccatggagaataccgcccaactgccggaatgctgtgtggacgtggttggcgtgaacgccagctgccctggggcttctctttgcggtcccggatgttaccgacgttggaatgctgatggaagcgcgtcctgtgtcagatgtggcaacggaacattgcctgcttacaatgggagcgagtgtcgcagtttcgctggcccaggtgcaccattccccatgaaccgttctagcgggaccccaggaagacctcatcccggagctcccagagtggccgcttccctctttctcggtacgttcttcatatcttctggcctcatcttaagcgtggcaggattcttttatctgaaaagatcttctaaactgccacgtgcatgttataggagaaacaaagcgccagcactgcagccgggagaggcagctgccatgattcctccgccacagtcttcagtgcgtaaacctagatacgtacggcgagaacgtccgctggacagggctacagaccctgccgcattcccgggagaggcgagaatttccaacgtatag

SEQ ID NO: 49007 - DNA, 558 bp, Artificial Sequence
  Description of Artificial Sequence: Synthetic coding sequence
atggctctgcggcatttggccctgctggccggactccttgttggagtagctagcaagtcaatggagaatactgcccaattgccagaatgttgtgtggatgtcgtgggagtgaacgctagttgtcccggtgcgagtctctgcgggcctggctgttacaggaggtggaacgcagacgggtccgcatcatgcgttaggtgcggcaatgggacactcccagcctacaatggcagtgagtgtcggagctttgcagggccaggtgccccttttccaatgaaccggagttccggcacacctggtcgccctcatccgggtgctccacgggtggcggctagcctgttcctgggaacgttttttatatcaagcggcttgattttatctgtggccggatttttttatctgaaaagaagctccaagttacccagggcctgctacaggcgcaataaaggaccggctcccgcaggcagcctccctggccgatggagctctcagcaatttggtccgcaggcacctgccctgcaaccgggtgaagccgtgtctaaccctcatcacccagggtag

SEQ ID NO: 49008 - DNA, 174 bp, Artificial Sequence
  Description of Artificial Sequence: Synthetic coding sequence
atggcattgagacacctggccctgctcgctggactactcgtgggggtggcgtctaagtcgatggaaaataccgctcaactcccagaatgctgtgtcgacgtggtgggcgtgaacgcgtcctgcccgggagcctccctgtgtggacccggttgttatcggaggtggaacgcctag

SEQ ID NO: 49009 - DNA, 1143 bp, Artificial Sequence
  Description of Artificial Sequence: Synthetic coding sequence
atggcattgcggcacctggctttgctcgcaggcctgctggtcggtgtggcgtctaagagcatggaaaataccgtgacaaggaactctacggcagtcatcaacacacaggccgagggcacattgagcccaccaggcctgtcctccctgcctgttgtgagagaatgggccctcacccacacagcacagcttccggaatgttgcgtcgacgtggtgggagttaatgcatcgtgccctggcgcttccttatgtgggcctggctgttatcgacggtggaacgcagacggatcagccagttgcgtccgctgtggaaacggaaccctgccagcttacaacggctctgaatgccgtagcttcgccggtcctggtgccccttttccaatgaacagatcctcaggcacgcccggtcgccctcaccctggcgcaccccgagtagcagcgtcactcttccttgggaccttttttatcagttccggcctgattctgagtgtcgcaggcttcttctacctcaagcgctcatcaaaactgccaagggcgtgctatcgcagaaataaagccccagctctgcagcccggtgaggctgctgcaatgatcccccctccacagtccagcggcaattcaagttgcagaatacctctttggggcttcccttcgttgggccagagccaaggagccctctgggtttgccctcaaacaggcttacccggttcaggttctcgaccacctctgcccggtagtcctggggatcccccaaccaggcagggccaaggtaggatctggctcgtaccgccagcactcgatctgtcctggatctggcccgctcctccagcacggcctcctctgatccccgtgacctccatgctgtttcccgtgcctgagacatgggggctgcaggaacgaagaacccaccatgaccgcgctgacccgcaataccttctgctcttggaggtgcagctgcatccacgaaccgatgccgctggcctgcgtcaggcactgctgtcctcgcacagattctctggtgctggaagcggtggacccaagagccagcccgttcgtaagccccgatatgtgcggagggagcggcctctggacagggcgacagatccagccgcttttcccggtgaggcgagaatcagcaacgtgtag

SEQ ID NO: 49010 - DNA, 603 bp, Artificial Sequence
  Description of Artificial Sequence: Synthetic coding sequence
atgagcgttgtgcctatactggaagggcaagcattgcggatttgttcttgtagttggctcgctttttcgtgggagagcccagcatctccttggcgcaccaggcctagctgcccgtctgctgtttggatgtggtgggccagtacaccagccgctcaggcccaggtgtgtgtggtgcaggcagttaccggagccggtaccagaaccggcgcacccgctgcgtccgccgtggggacagaacccagccagccaactaccgcccctagtgttgaggcagtcgtagccggaccgggagccccattccccatgaaccgttccagtggcaccccaggcaggcctcacccaggagcgccacgcgtcgctgcctctctgttcctgggaacattttttatcagctctgggctcatcctgagtgtcgctggtttcttctacctgaagaggtcatctaaactgccacgggcttgctataggagaaataaagctccagccctgcaacccggtgaggcagctgctatgatcccaccccctcagtctagcgacgttggcagcgcgggaaaagaagatccaccccgtcagggtagaccccctattcctgcccctccatag

SEQ ID NO: 49011 - DNA, 468 bp, Artificial Sequence
  Description of Artificial Sequence: Synthetic coding sequence
atggggggtaacggttctacgtgcaagcctgatacggagcgccagggaacattatctactgctgcgccaaccacttcgccagccccttgcctatcaaatcaccacaataaaaagcacctgattctcgcattctgtgccggagtgttgttgaccctgctgttaatcgcgtttatttttctgatcatcaaatcgtatcgcaaatataggcgcgagagacttcccattagccctggtccgctcttacgctgggtgcccctactaagtgggactatggccgaccattcaaagccccaggccccagatccccattccgacccgccagccaagctatctagtataccaggcgagtcgctcacatacgcctctaccacattcaaactgagcgaggaaaagtccaaccacctggccgaaaaccactcagcggatttcgatcccatagtctatgcccagatcaaggttacaaactag

SEQ ID NO: 49012 - DNA, 393 bp, Artificial Sequence
  Description of Artificial Sequence: Synthetic coding sequence
atggggggtaatggctccacgtgtaagcctgatactgagcgccaaggaactctatcaactgccgctcccacaacttcacctgcgccatgtctctcaaatcaccacaataaaaagcacctgatcctcgcgttctgtgccggagttttgctgaccctgctgttgatagcttttatctttctgattatcaaaagctataggaaatatcattcgaagcctcaagcaccagatccgcattccgaccctccagccaagttgtcatcaataccaggtgagagtctgacatatgcttccaccaccttcaaactgtcagaagagaaatcaaatcacttggctgagaatcactctgctgacttcgaccccatcgtgtatgcccagattaaggtgacaaactag

SEQ ID NO: 49013 - DNA, 600 bp, Artificial Sequence
  Description of Artificial Sequence: Synthetic coding sequence
atggcttcacccaaaggatttttcaactacctcacttactttcttgccgctggggcagtgacattaggcataggcttttttgctcttgcaagcgcattatggtttctcatctgcaagcgcagggagatttttcagaattccaagtttaaggctatcgatgaaaggtgccgacagaggccttccatggccaagatcaaatcacactcccaatgcgtttttatctctcggaattttcatacaggacgtttccagttgcaggaagaacagaggaaaaaagaggcagctcacataaaggctataaaagaccactctaaagatgagccgcagttggcaacgaaaaatataatctgcgacccgtccgaaacctcaagcacaactaatcgtagtagtgtgaccctgagtctgtctacactcccatcagatagctattacagccaatctatcgaagctgccgatgactggttttctgacgacagtcttgtgaagcggaatagccccatgccctccctgggggagcctctcatggagaaggtgttttcctaccttagtacgatttcactggaggaagggacggaatcagtactgaatgataccctctag

SEQ ID NO: 49014 - DNA, 519 bp, Artificial Sequence
  Description of Artificial Sequence: Synthetic coding sequence
atgctaaccgaggttatggaggtatggcatggtctggtcatcgccgtggtgagtctgttcttgcaggcttgcttccttactgcaataaattatcttctcagcaggcacatggcgcacaaatccgagcagatccttaaagccgcatcactccaggtgcctaggcctagccccggtcaccatcatccacccgctgtcaaagagatgaaagagacccagaccgagagggacattcccatgtcagacagcctgtaccggcatgattcagacaccccaagcgattccctggatagcagctgtagcagtccacccgcttgtcaggcaaccgaggacgtggactacacccaagtggtcttttccgaccctggcgaattgaagaacgactcccccctggattacgaaaatattaaggaaattaccgactacgtaaacgtcaaccctgaacgccacaaaccatccttctggtattttgttaatccagctctctccgagcctgccgagtacgaccaagtggctatgtag

SEQ ID NO: 49015 - DNA, 342 bp, Artificial Sequence
  Description of Artificial Sequence: Synthetic coding sequence
atgaatgaaacaaataaaactctggtggggccttctgaattgcccactgcgtcagcggtggcccctggacccggaaccggggctcgtgcctggccagtgctggttggctttgtcctgggagccgttgtcctttccctcctgattgccctggccgctaaatgtcacttgtgcagaaggtaccatgcgagttacaggcaccggccactgcccgagacagggaggggcggaagaccccaggtcgccgaagatgaagacgatgacggctttattgaggataattatatacaacctggcaccggcgagctagggacagagggcagtagagaccatttttcactctag

SEQ ID NO: 49016 - DNA, 342 bp, Artificial Sequence
  Description of Artificial Sequence: Synthetic coding sequence
atgaatgaaacgaacaaaacgctggtgggtccttcagagttacctacagcaagcgcagttgctcccggaccagggaccggcgcaagagcctggcctgtactcgtcggtttcgttcttggcgctgtcgttctctctttgttaatcgcattggcggcaaagtgtcatttgtgtaggcgttatcacgcctcataccgccaccgccctctgcctgagactggcaggggcggacgccctcaagtggcagaggatgaggacgacgacggctttatcgaagacaactacattcaacctggcacaggggagcttggaaccgaaggatcacgagatcatttctcgttgtag

SEQ ID NO: 49017 - DNA, 1365 bp, Artificial Sequence
  Description of Artificial Sequence: Synthetic coding sequence
atgggcaggacctacattgtagaggaaaccgttggccaatacttaagcaacatcaacctacaaggcaaagctttcgtgagtgggctcctcatcggacaatgcagttcgcaaaaggactatgtgatccttgccacacgcacaccccctaaagaggaacagtccgagaacctcaagcatcccaaagcaaaactcgataacctggatgaagagtgggctacggagcacgcctgtcaggtgtccaggatgcttccaggtggcctgctggtcctgggtgtattcattattacaacccttgagctggccaacgatttccagaatgcactgaggcgtctaatgtttgcagtcgagaaaagtattaatagaaaacggctgtggaactttaccgaagaagaagtatctgagcgagtcaccctccatatttgcgcttccacgaagaaaatcttttgtagaacatacgacattcatgatcctaagtcatctgctcgtccagctgactggaagtatcagtccgggctatcctcttcttggctaagtctggagtgcacagtccacattaatattcacatcccactgtccgcgacaagtgtgagctacaccctagagaagaacacgaagaatggcctaacacgctgggccaaagagatagagaatggcgtttacctcatcaacggccaggttaaggatgaggattgcgacctgctggagggacaaaagaagtcttccagaggtaacacccaggcgacaagccacagctttgacgttagagtgctgacgcagcttctgctaaacagtgaccacagatctaccgctacggtccagatatgttcagggagcgtaaaccttaagggcgctgtaaaatgcagagcctacatacactcaagcaaacctaaggtgaaagacgccgtacaggccgtcaagcgcgatatactgaatacggttgcagaccgttgcgaaatgctgttcgaagatcttctgctgaacgaaattccggaaaagaaagattcagaaaaagaattccacgtgctcccctacagagtgttcgtgcccctccctggcagcaccgtgatgctgtgcgactataaattcgacgatgagtcagccgaagagatccgggatcattttatggaaatgttggaccatactatccagatagaggatctggagatcgcagaagagacgaatacagcttgcatgtcgtcctctatgaattcacaggccagcctggacaacaccgatgatgagcagcccaagcagcccattaagacaaccatgttactgaagatacaacagaatatcggcgtaattgcagcattcactgtcgctgtgctggccgctggtatctcttttcattacttttctgattag

SEQ ID NO: 49018 - DNA, 1296 bp, Artificial Sequence
  Description of Artificial Sequence: Synthetic coding sequence
atgggcaggacctacattgtcgaggagacggtgggccagtacctgagtaacattaatctccagggaaaagcttttgttagcggtttgctgatcggacagtgcagttcacagaaagattatgtgatcctagccactcggacaccgccaaaggaggaacagtcagaaaatctgaagcatcccaaggccaagttggataacctggatgaggagtgggcaaccgaacacgcttgtcaagtttcccgtatgcttccaggtggcctgcttgtccttggcgtgtttattatcactactttggaattggccaacgactttcagaacgccttgcgtcggttgatgtttgctgtagagaagtccattaatcgtaagcgcctgtggaatttcaccgaggaggaagtaagcgagagagtcaccctgcacatttgcgctagcacaaaaaagatattctgcagaacctacgatatccatgatcctaaaagtagcgccaggccagccgattggaaataccagagtgggctctcttcttcatggctctcccttgaatgtacagtgcacatcaatattcacataccgctgtcagcgacttccgtctcgtacacattagaaaagaataccaagaacggcctgacccgatgggcaaaggagatcgagaacggtgtgtatctaattaatggccaggtaaaagacgaggactgcgaccttctcgagggccagctgttgaactcagaccacagatccaccgctacggtacagatatgttctgggagtgttaatctgaaaggggcagtgaaatgcagggcctatatccacagctcgaagcccaaagtcaaggacgccgtgcaggccgtcaagagggacattctgaataccgtggccgatcgatgtgagatgctcttcgaggacctgcttctgaatgagattccggaaaagaaggattccgaaaaggaattccacgtgctgccttacagagtgttcgttccccttccgggatctactgtcatgctttgcgattataagttcgacgatgaatccgcagaagagatccgtgatcactttatggagatgctggatcacacaatccaaattgaggacctggaaatcgctgaggagactaacactgcttgcatgtcaagctcaatgaattcacaagcatccctggacaatacggacgatgagcagcccaaacagcccatcaagacgactatgctccttaaaatccagcagaacataggtgtgatcgccgcttttacagtcgcagtgttagccgctggcatatcctttcactatttttcagactag

SEQ ID NO: 49019 - DNA, 1269 bp, Artificial Sequence
  Description of Artificial Sequence: Synthetic coding sequence
atgggtcggacatacattgtggaagagacagtaggccagtacctttctaacataaatctgcagggcaaagcctttgtgagcggcctgctgattggtcagtgtagctcccagaaggattacgtgattctagcgacaaggacacctcccaaagaggagcagtctgagaacttgaagcatcccaaagccaagctggacaatctggatgaggaatgggccactgaacacgcatgtcaactgatgttcgctgtggagaagtctataaatcggaagagactctggaacttcacagaggaggaagtgtcagaacgggtgacgcttcacatttgcgcttctaccaaaaaaatcttttgccgcacttacgacattcacgatccgaagagctcagccaggccagccgattggaaatatcagtcgggccttagctcttcttggttatccttagaatgtaccgtccacataaatattcacattcccctgtctgctacttctgtttcctacacgttggaaaagaacacaaaaaacggccttaccaggtgggcaaaggagatcgagaatggggtatacctgatcaatggacaggttaaagatgaggattgtgacctgctggaagggcagaagaagtcatctcgcggaaacacccaggctacatcacatagtttcgacgtgagggttttgacacagttgcttttaaattccgaccacagatctaccgcaactgttcagatctgttctgggtccgttaatctcaaaggtgctgttaaatgcagagcctacatacactctagtaaaccgaaggtgaaagatgccgtccaggcggttaaacgcgacattctgaatactgtagctgatagatgtgagatgctcttcgaggacctgctacttaacgagattccggagaaaaaggactctgagaaggaattccatgtcttgccatatcgagtgtttgtcccacttccaggctcaacggtcatgctgtgtgattacaagttcgacgatgagtccgcggaggagatcagagaccattttatggaaatgcttgatcacaccatccaaatcgaggatctggagattgcggaggagactaataccgcctgcatgagtagcagtatgaactcccaggccagtctggacaatactgacgacgagcagccaaagcaaccgattaaaactacaatgctcctgaagatccagcagaacatcggagttatcgccgctttcacagtcgcggtgttggccgctggcataagcttccattatttcagtgactag

SEQ ID NO: 49020 - DNA, 1008 bp, Artificial Sequence
  Description of Artificial Sequence: Synthetic coding sequence
atggggcgtacctacattgtggaggaaaccgtcggccagtacctctctaatatcaacctgcagggcaaggcctttgtctcagggctcttaattgggcaatgtagctcacagaaagactacgtgatcctcgctacgaggacccccccaaaggaggagcagtcagagaatctgaaacatccaaaagccaagctcgataatctggacgaggaatgggccaccgaacacgcctgtcaggtgagtagaatgcttccagggggactgctcgtgctgggagtattcataatcacaaccctcgagcttgcgaacgatttccaaaacgcactccgcaggttgatgtttgctgtggagaagtcaatcaaccgaaagcgcctctggaactttacagaagaagaggttagcgaacgagtaaccctgcatatatgtgcctccaccaaaaagattttttgtagaacatacgacatccacgatccaaaatcctccgccagaccggctgactggaaatatcagagcgggcttagctcctcatggttgtctctggagtgtacggttcatatcaacatccatatccccttaagtgcaactagcgtgagttacacactggaaaagaacaccaaaaatggactcacacggtgggcaaaagaaattgagaatggcgtttatttgatcaacggacaagtgaaggatgaggactgtgatcttctggaaggccagaaaaagagctcccgcggaaatactcaggcaacatcacactcctttgacgtgagagttcttacccagttacttttgaactcagaccatcgcagcacagctacagtgcagatctgcagcgggtcagttaacctgaagggagccgtcaaatgccgtgcctatattcactccagcaagccgaaagtgaaagatgcagtgcaggccgtgaaaagagatattctgaataccgtggccgatcggtgtgagatgctttttgaagaccttctcttaaacgaaatacctgaaaaaaaggatttctag

SEQ ID NO: 49021 - DNA, 240 bp, Artificial Sequence
  Description of Artificial Sequence: Synthetic coding sequence
atggccgctcccagtatgaaagagagacaggtgtgctggggcgcacgagatgaatactggaagtgccttgatgagaacctggaggatgccagccagtgcaagaaactcagaagcagttttgaatcatcgtgcccacagcagtggatcaaatactttgataaacggagggactacctgaaattcaaagaaaaattcgaggccggtcagttcgaaccaagcgagacaacagccaagtcgtag

SEQ ID NO: 49022 - DNA, 378 bp, Artificial Sequence
  Description of Artificial Sequence: Synthetic coding sequence
atgggccctggaggccctctcctcagcccttcccgtgggttcctgttgtgtaagacaggttggcatagcaatcggctgctcggagactgcggcccacacacacccgtcagtacagcattgtccttcatcgctgtgggtatggccgctccttctatgaaagaaaggcaggtttgttggggcgctagagacgagtattggaaatgcctagacgagaacctggaggatgcctcccaatgcaaaaagctccggtcaagcttcgagtcctcttgtccacagcagtggatcaaatatttcgacaaacgcagagactatctgaagtttaaagagaagttcgaggcgggtcagttcgaacctagcgagactaccgccaaatcatag

SEQ ID NO: 49023 - DNA, 468 bp, Artificial Sequence
  Description of Artificial Sequence: Synthetic coding sequence
atggttgctcgcaaggggcagaagtcacctagatttcgtagggtgagctgcttcctacggttgggcagatcaaccctacttgagctggagccggcaggacgaccgtgtagtggccgaactcgtcaccgggctttacaccggcgtctggtggcctgcgtgactgtctcctctaggaggcaccgcaaggaggcaggccgtggccgagcagaaagcttcatcgccgtggggatggccgctcctagtatgaaggaaagacaggtttgctggggggctcgcgacgaatattggaagtgtcttgacgagaaccttgaggacgcatctcaatgcaaaaagctccgatcaagctttgaatctagctgtccacagcaatggattaaatattttgacaagcgccgagactaccttaagttcaaggaaaaattcgaggctggccaatttgagccctcggaaaccaccgccaaatcctag

SEQ ID NO: 49024 - DNA, 471 bp, Artificial Sequence
  Description of Artificial Sequence: Synthetic coding sequence
atggtggctcggaaagggcagaagagcccgagatttcgcagagttagttgttttctacgactcggccgatccaccctgctggagttagagcccgctggcaggccctgtagcggcagaactcgccacagagctctgcacagacgattggtggcttgtgtcaccgttagttcccgccgtcaccggaaagaggcgggaagagggagagccgagtcctcctttattgctgtaggaatggcagcaccttcgatgaaggagaggcaggtttgttggggggctcgggacgagtactggaagtgtttggacgagaatctcgaagatgcaagtcagtgtaagaagctgcggagctcttttgaatcaagctgtccacaacagtggatcaaatacttcgataagcgccgagactacttgaagtttaaagaaaagttcgaggctggccagttcgagccctcggaaacaaccgctaagtcatag

SEQ ID NO: 49025 - DNA, 660 bp, Artificial Sequence
  Description of Artificial Sequence: Synthetic coding sequence
atggcctcagggtccaattggctcagcggcgtcaatgtcgtgctcgtgatggcctatgggtctctggacctgaaggaagaaatcgacattcgactgtcccgggtgcaggacatcaaatacgagcctcagttgcttgccgacgatgacgcacgccttctgcaactcgaaacacagggcaaccagagctgctataattatctgtaccggatgaaagcgcttgacgccattcgcacatctgaaatcccatttcactctgagggacgtcatccccgaagcctgatgggaaaaaacttcagaagttaccttctcgacctgcggaatacaagcaccccgttcaaaggagtacgcaaggccctcatcgacacgctgttggatgggtatgagacagccagatacgggaccggcgtctttggtcagaacgaatacctgcggtaccaggaggcactgagcgaactggccactgcagtcaaggccaggattggctccagccagcgccaccaccagagcgcagctaaagatcttacacagtccccagaagtgtcacccactaccattcaggtcacttaccttcccagctctcagaaatcaaagcgggctaaacactttctcgagctgaaatcgttcaaagacaactacaacactctggagagcaccctgtag

SEQ ID NO: 49026 - DNA, 606 bp, Artificial Sequence
  Description of Artificial Sequence: Synthetic coding sequence
atggcctccgggagcaattggttatccggggttaacgtagttttggtgatggcatatggctccctcgatctgaaggaggaaattgacattagactttcccgtgttcaggatatcaagtacgagccacagctgctcgcggacgatgacgccagactgctccagctggaaacacagggcaatcagaaaattcctttccatagtgagggcagacacccgcgaagcttaatgggcaaaaacttccgcagctatctgctggaccttcgcaatacttccactcctttcaagggagtgcgcaaagccctcatagacaccctcctcgacggatacgagaccgctaggtacgggaccggtgtcttcgggcagaacgagtacttgaggtatcaggaagcgcttagtgaactggcgacagcagtgaaggccaggataggcagtagccagaggcatcaccagagtgccgcaaaggatttgacacagtcaccagaggtgtctcctaccaccatccaggtgacatatctgccatcttcccaaaaaagtaagcgtgcaaagcacttcctggagctcaagtccttcaaagataattacaacacattggagtcgacattgtag

SEQ ID NO: 49027 - DNA, 468 bp, Artificial Sequence
  Description of Artificial Sequence: Synthetic coding sequence
atggccagcgggagcaattggctgtctggcgttaatgtggtgctagtgatggcttatggttctttggacctgaaggaagagatcgatatacggctgtcccgcgttcaggatataaagtatgaacctcaactgttggccgatgatgacgcaaggttgctgcaattggagacacagggaaaccagtcatgttataactatttataccgcatgaaagctctcgacgccattaggacaagcgagatcccattccactcagaaggccgtcatcctaggagccttatggggaaaaactttaggtcatacctcctagaccttcggaatacatccacgccatttaaaggtgtgagaaaggctttgatcgacacgctgctcgacgggtatgagactgctcgctatggaacgggcgtgttcggtcagaacgaatacctgcgctaccaggaggccctgtccgagttggccacagcatag

SEQ ID NO: 49028 - DNA, 570 bp, Artificial Sequence
  Description of Artificial Sequence: Synthetic coding sequence
atggcatctggttccaactggctgagcggtgtgaacgtcgttcttgtcatggcttatggctcgctcgtgtttgtgttgctctttatattcgttaagaggcagatcatgagatttgccatgaaatctcggagaggtccacatgtaccggtgggccataatgcccctaaagacctgaaagaggagattgacatccgactgagccgtgttcaagatataaaatatgaaccacaactcctggctgatgatgatgccagactgcttcagctcgagacccagggtaatcaatcctgttacaattacttgtataggatgaaggccctggacgccattagaacttctgagatcccgtttcattctgaggggcgacatcccagatcgctaatgggcaagaatttccggagttacctacttgaccttcggaacaccagcacccctttcaagggggtgcggaaggcactgatcgatacactgctagacggctatgagaccgcgcgatatgggactggtgtgtttggccagaacgaatacttacggtaccaagaagcgctgtctgagctcgcgaccgcttag

SEQ ID NO: 49029 - DNA, 708 bp, Artificial Sequence
  Description of Artificial Sequence: Synthetic coding sequence
atggccagcggatccaactggctttcgggagttaacgttgttctggtgatggcctacggctccctggtgtttgtgcttctgttcatcttcgtcaagaggcagatcatgagattcgccatgaagtctaggcgcggtcctcacgtgcccgtcggtcataatgcaccaaaagacttgaaggaagaaattgatattcgcctttcaagggtccaggatattaaatatgagcctcaactactcgctgacgacgacgcacggctgctgcagctggagactcagggaaatcagaaaattccttttcactctgaggggagacacccaagatctttgatggggaagaattttcggtcatacctgttggacctgagaaacacctccacccctttcaagggcgtcaggaaggccctgattgacaccctattggacggttacgaaacagccaggtatgggactggcgtgtttggacagaacgagtatttgcggtaccaggaagcgctgtccgagcttgctacagcggtgaaagcccgaattggttcctctcagcggcatcatcagagtgcagctaaagacttaacacagagcccggaagtgagtccgaccaccattcaggttacgtaccttcctagttcccagaagtctaagcgtgcgaagcacttcctggagcttaaatcttttaaagacaactataacaccctcgagagtaccctttag

SEQ ID NO: 49030 - DNA, 762 bp, Artificial Sequence
  Description of Artificial Sequence: Synthetic coding sequence
atggcttccggttctaattggctgtctggggtcaacgttgtgctcgtaatggcttacggctctctggtcttcgttttactgttcatcttcgtaaagcgccaaataatgaggttcgccatgaaaagtcggcgtggtccacacgttccagtgggccacaacgcaccaaaagatctcaaagaggagatcgatatcagattaagcagagttcaagatattaaatacgaaccccagctgctggcggacgacgacgcgcgattgttgcagctagagacacagggcaaccagagttgctataactacctataccggatgaaagctttagatgctattcggacctccgagattccattccacagcgaagggagacaccccagaagtttgatgggcaagaacttcaggtcctacctcctggacctccgaaataccagtacccccttcaaaggggtgcgcaaagccctaattgatacccttttagacgggtatgagaccgcccgatacggaaccggcgtcttcggccaaaatgaatacctgcggtatcaagaagccctgagcgagcttgctactgccgtgaaagctcgtatcggaagcagtcagagacatcaccagtctgccgctaaggacttgacccagtctccagaggttagcccgactacaatacaggtgacatacctcccctcatcccagaagagcaagcgggctaagcacttcctggagctgaagtcattcaaagacaattacaataccctcgaatctactctgtag

SEQ ID NO: 49031 - DNA, 1221 bp, Artificial Sequence
  Description of Artificial Sequence: Synthetic coding sequence
atgagggggtccgtcgaatgtacatggggttggggtcactgtgctccttcccctctgctgctgtggactctgctactgttcgcagcaccatttgggctgctcggggagaaaacccgccaagtctctctggaggtcatccccaactggctgggacctttacaaaacctccttcacattcgagcggttggaaccaactccaccctgcattatgtgtggtcctcgctcgggccacttgcagtcgtgatggtggctacgaacacgccacatagtactctgtccgtgaactggtcgcttttactctctcccgagccggacggcggtctcatggtgctacctaaggactcaatacagttctcatccgcgctggtgttcacccggctcctcgagttcgatagtactaacgtgagcgacacggccgctaagccgctgggccgtccttatccaccttattctttggccgacttcagctggaataacatcaccgactccttagatcccgcaaccctgtctgcgacattccaagggcaccccatgaacgacccgacaagaacattcgccaacgggtcacttgcatttcgggtccaggccttctctcgatcttcccgaccggcacagccacccagacttcttcatacggcggacacttgtcagctcgaggtggcactgatcggcgcttctcctcgagggaatagaagcctgtttgggcttgaagttgccacacttgggcagggaccggactgcccatccatgcaggaacagcactctatcgacgatgaatacgcaccggcagtgtttcaacttgatcagctgttgtggggatctctcccttcaggtttcgcccaatggcggccagtcgcgtattcccagaagcctggcggtcgggagtccgcccttccatgccaggcttctccactgcacccggcactggcttattccctacctcagtcaccaattgtgagggctttctttggctcacagaacaatttctgtgcttttaatctcacctttggagcatccaccgggcctggttactgggatcaacattacctgagctggtcaatgctccttggcgttggcttcccgccagtggacggcctctcccccctagttctgggtatcatggcagttgctctgggcgctcctgggttgatgctgctcggaggcggtttagtgctgctgctgcaccataagaaatacagcgaatatcagtctattaactag

SEQ ID NO: 49032 - DNA, 3765 bp, Artificial Sequence
  Description of Artificial Sequence: Synthetic coding sequence
atgaaaaaacatagaagagcgcttgcgctggtttcttgcttatttctgtgttcactcgtgtggctgccctcttggcgcgtttgctgtaaagagtcctcctccgcaagcgcctcgtcctactattctcaggacgacaattgcgccttggagaatgaggacgtccagttccagaaaaaggacgagagagaaggacctattaacgctgagtctctgggaaagtcagggtccaatctacctatctcccccaaggaacacaagttgaaagatgactccatcgttgatgtgcagaacacagagagcaagaaactgtccccccctgttgtggaaaccttgcctactgtggacctgcacgaagagtcatcaaatgcagtagtggattcagagactgtggagaatattagcagctcttctacctctgaaattacacctatttctaagttggacgagatcgaaaagtcaggcactattcccatcgcaaaaccatctgaaaccgagcagtcagaaactgattgtgacgtgggggaagccctggatgcgtcagctccgatcgagcagccctcttttgtgagtcctcccgattctctcgtgggccaacacatcgaaaacgtctcatcttcccacggcaagggaaaaattaccaaaagcgagttcgagagtaaggtctcagcctcagagcagggagggggagacccgaaatccgccctgaatgccagcgataatctcaagaacgagtcatctgactacactaagccaggcgacatcgatcccacatccgtggcaagtcccaaggatcccgaagatatccccacattcgacgagtggaagaaaaaagttatggaagtagaaaaggaaaagagtcagagtatgcacgcctcctctaacgggggaagtcatgcaactaagaaagtgcagaagaatcgaaacaattacgccagcgttgagtgtggagcaaagatactggccgctaatccggaagccaagtctacaagcgccatattaatagagaacatggacctctacatgcttaacccctgttcgaccaaaatttggttcgtaattgagctttgtgagccaatccaagttaagcagttggacattgcaaattatgagctcttcagctctacccctaaagacttcctggtttcgatttctgacaggtatccaacaaacaagtggatcaaactgggaacttttcatggcagggacgagcgcaatgtgcaaagcttcccacttgacgaacagatgtatgccaagtatgtgaaaatgttcataaaatacattaaagtggagttgctgagccacttcggcagcgagcacttttgcccgctgtctctgatccgcgtgttcgggacctccatggtcgaagaatatgaagagatcgccgatagccagtatcacagcgagcgccaggaactcttcgacgaggactatgattaccccctggactacaacaccggtgaagataagtcttctaaaaatctcctaggaagcgccacaaacgcaatcctgaacatggtgaacatcgcagctaacatattgggagcaaagactgaagatcttaccgaaggtaataagtcgatctccgaaaacgccaccgccaccgcagccccaaagatgcccgaatccactcccgtatccacaccagtgccgtcacccgagtacgtcactacagaagtgcatactcacgacatggagccgtctacacccgatactccgaaggagtcaccaatcgtccagctggttcaggaagaggaagaggaggcgagcccgagcaccgtgaccctgctgggttccggagagcaagaggatgagtcaagcccatggttcgagtccgaaacacaaattttctgcagcgaactgaccacaatctgctgtatctcgagcttctctgaatatatttacaagtggtgcagcgttcgcgttgcactctatagacagaggagtcgtactgcactgagcaaaggaaaagactacctcgtcctcgcacagcctcctctcctgttgcctgccgaatcagtagatgtgagtgttctgcaacccctgtcaggcgagctcgaaaataccaacatcgagcgcgaggccgaaactgtcgtcctgggggatttgtcgtcatccatgcatcaggacgacctggtgaatcacacggtggacgccgtggaactcgagccaagccacagccagaccctttctcaatctctcttgctcgatataacacccgagattaaccccttacctaagatagaagtgagcgagagtgtagagtacgaagctggacatattccttctcctgtcattcctcaggagagtagtgtagaaatcgataacgaaaccgagcagaagagcgaatctttttcttccatagagaagcctagcatcacatatgagacaaataaggtgaatgaactcatggacaatatcattaaagaggacgtcaactctatgcaaatcttcactaaacttagtgagaccatagtcccccctataaatactgcaactgttcctgacaatgaggacggtgaagcgaaaatgaatattgctgatacagcaaaacagacgttgataagcgttgtggactcctcaagcttgccagaggtgaaagaggaagagcagagtccagaggatgccctgctccggggtcttcagaggacggccaccgatttctacgcggagctccagaattccacagacttaggttatgcaaatggaaacctggttcacggttccaaccaaaaggaaagcgtatttatgaggctgaacaatcgtattaaggcattggaggtgaatatgtcattaagtggcaggtatcttgaagaactgagccaaaggtatcgtaaacagatggaagaaatgcaaaaagcgtttaataagactattgttaaactgcagaacacctcaagaattgccgaagagcaggatcagcgccagaccgaagccatccaactgctacaggcccagcttacaaatatgacccagttggtttcaaacctttccgccaccgttgccgaactgaagagagaggtctccgatcggcagtcgtacttggttatcagcctcgtcttgtgcgttgtcttaggcctcatgctctgtatgcagcgatgccggaataccagccagttcgatggtgactatataagcaagctccccaagtcgaatcaataccccagcccgaagcggtgcttttcttcctacgacgacatgaatctcaagcgaagaacttctttccccctcatgcggtctaagtccttgcagttgacaggtaaggaggtagatccaaacgacctttacatcgtcgagcctctgaagtttagtcccgagaaaaaaaagaaacgctgcaagtacaaaatcgagaagattgaaactattaagcctgaggaaccacttcaccccattgcaaatggggacattaaagggaggaagccattcacaaaccagagggacttctctaacatgggggaggtttaccactcgtcctacaagggtcctccctctgaaggatcttctgaaacaagcagccagagcgaggaatcctacttctgtggcatcagtgcatgcacgtcactgtgtaatgggcagtcgcagaaaaccaaaactgagaagcgcgctctgaagcggagaagatcgaaagttcaagaccagggcaagctaattaaaaccctgatccagacgaaatcaggatctctgccctcacttcatgatatcatcaagggtaataaggagatcactgtgggtacctttggcgtaaccgcagtgagcggacatatctag

SEQ ID NO: 49033 - DNA, 4221 bp, Artificial Sequence
  Description of Artificial Sequence: Synthetic coding sequence
atgcggggttttctcgccagaccctttttgtccactaatcagcatttggcacagtgggggtcacccctgcctcaggggaagggcttggtgcagctgccaagtcagcacactcgccatagccgcccattccacgaattgtgcagtaaagaagaaaacagcgctaccgtgccgaagctcattagtctggtggtatcttctgagacaattgatttctctaacaagactatggatagcagaagagactgggagcgagagaagcgtatcctggaggggaagctacagttgccgaaggctctggcgcgaacccagcgagccagagatgagggacggagagcttggacgtctaggtggcttcaacgccgtaggtctccagagagctgcgaggctccactgagcgcccctctgtggggccctcagaggggactcccagggagagagcctctgcgaagccgatctgcctcggctatagctctgcgtacaatcgggcacatcctggctttgctactacgtcttcttcacctggggctgggatccggcggatgtcgtgaggacgttccacccagcggaagaggtaaaaaagaggaaaaaatgaagaaacaccgcagggcccttgcgctggtatcatgcctgttcctctgctctctggtgtggctgccatcatggcgtgtgtgttgcaaagaatctagcagcgcttctgcctcctcttattacagccaggacgataactgcgcactggaaaacgaagatgtacaatttcaaaagaagaacacggaatcaaagaagctttctcctcccgtggtggaaactctacccactgttgacctacatgaggagtcgtctaacgcagtggtggactctgagacagtagaaaatatcagctctagcagtacctccgaaatcacgccgatcagtaaacttgacgaaatagaaaaaagcggaactatcccaatcgccaaaccgtcggagacggaacagagcgaaactgattgcgatgtgggggaagcattagacgcctctgcgccaatagagcagccatcatttgtgtcgccacctgactctctggttgggcagcacattgagaacgtgagctcctcccatggaaaaggcaagattacaaaatccgagtttgaaagtaaagtgtccgcgagtgagcaggggggtggcgaccccaagtccgctctgaacgcatcggataatctcaaaaacgagtcctccgattatacaaaacccggagacattgatccgacatccgtagctagtcccaaggatcctgaagatattcccacctttgatgagtggaaaaagaaggttatggaagtggaaaaagagaagagccagtcaatgcacgcctccagcaacggaggatcacacgcgactaagaaggttcagaagaatagaaataactacgcttctgttgaatgtggggctaaaatcttggccgctaatcctgaggcaaagtccacttcggctatattgattgagaacatggatctgtacatgctgaacccgtgcagtacgaaaatttggtttgtcattgaactctgtgaacctatccaggtgaaacaactggacatcgcaaactacgaactgttcagttctaccccaaaggattttctcgttagtatcagtgaccgatatcccaccaacaagtggatcaagctcggcacctttcacggccgagacgaacgcaacgttcagtcctttcccctcgacgaacagatgtacgccaagtatgtcaaagtcgaattgctcagccatttcggtagtgagcacttctgccctttgtctctcatcagagtattcggaacctctatggtggaggagtatgaagagatagccgactcacagtaccactcggagaggcaagagctttttgatgaagattacgattacccgctcgactacaacacaggtgaggataaatccagcaaaaacctgctgggttcggctaccaacgcgatccttaacatggtgaacatcgcggctaatattctcggggctaaaacggaagacttaacagaagggaacaaaagcatcagtgaaaatgcgacagccacggcagctcccaagatgccagaaagcacccccgtcagtacacccgtaccttcaccagaatatgtcactacagaggtgcacacccatgacatggaaccttcgacgccggatacccctaaggagtcccctatcgtccagctggtgcaggaggaggaggaagaggcatccccatccacagtgaccttacttgggtctggggagcaggaggatgagagcagtccatggttcgaaagcgagactcagatcttttgcagcgaactcactaccatctgctgcatcagcagcttttcggaatatatctacaagtggtgcagcgtgagggtagccctgtaccgccagagatctcgaacagcgttgtccaagggtaaagattatcttgttctggctcaaccacctttgctcttgcctgcggagtctgtggacgtctctgtgctccagcctctaagcggagagctggaaaacacgaacatcgaacgtgaggctgaaacggtggttctgggggatctgagcagcagtatgcatcaggatgacttagtgaaccatacagtcgatgctgtagaactggagccatcacactctcagaccctctcccagtccctgctactggatatcacccctgagatcaatcctttgccaaagatagaagtctccgagagcgttgagtatgaagctggtcatattcctagtccagtgattccgcaggagagctcagttgagatcgacaatgagaccgaacagaagtcagagagcttttccagcatagagaagccatcaatcacctacgaaacaaataaggtcaacgaactgatggacaacatcatcaaagaggatgttaattccatgcaaatttttactaagctgagcgaaactatcgtccctccaatcaatacagcgacagtgcctgataacgaggatggcgaggctaaaatgaacattgcggacaccgccaaacaaactctgatttccgtcgtagacagttcatcactgcctgaggttaaggaagaggagcagagccctgaggacgcccttctgagggggttgcagcggactgccaccgacttttatgcagagctgcagaactctaccgacctcggctacgcaaacggaaatctggtgcacgggtctaaccagaaggagagcgtctttatgagactgaacaatcggatcaaggcgctcgaggtgaacatgtcactctcaggtcgctatctggaggaactctcacaacgatataggaagcagatggaagaaatgcaaaaggcctttaacaagactattgtgaaacttcagaatacatctagaatcgccgaggaacaggatcagagacagacggaagctattcagttgctccaagcccagctgaccaacatgactcagctggtgagcaacttgagcgcaactgttgctgaactgaaacgcgaagtctccgaccgacagtcctaccttgtaatctccttagtcctctgtgtcgtgttgggcttgatgttatgtatgcagcgctgtaggaacacttcccagttcgatggtgattacatttctaaacttcccaaatctaatcagtatccgtcacccaaacgatgtttcagctcctacgacgacatgaacctcaagcggaggactagctttcccctaatgaggagcaagtctctccagctgaccgggaaagaggtggaccccaatgatctgtacattgtggaacctctgaagtttagtcccgaaaaaaaaaagaaacgatgcaaatataagatcgagaagattgaaaccatcaagcctgaggagccactgcaccctatcgccaatggcgacattaaaggtagaaagccctttactaaccaacgggacttcagtaacatgggcgaagtgtatcattcaagctacaaaggcccaccatcagaaggatcttccgaaacgtcatctcaaagtgaagaatcatatttctgtgggatttcagcatgcacttccctttgcaacggacagagtcagaagacaaagacagagaaaagagcactgaagagacgcaggtctaaggtgcaggaccaaggaaagctgataaagactctcattcagacaaagagtggatctctgccaagcttacacgacattatcaagggaaataaggagatcactgtaggcacattcggagtcactgctgtctcggggcacatttag

SEQ ID NO: 49034 - DNA, 1227 bp, Artificial Sequence
  Description of Artificial Sequence: Synthetic coding sequence
atgcccgtaattagtagtagacaggactgcgatagcgccacctctacagtgacggatattctgtgcgcggctgaggtgaaaagctctaagggaactgaggatcgcggtaggatcttgggagattcaaaccttcaggtcagcaagctcctgtctcagttccctctgaaaagcactgagacctccaaggtgccagacaacaagaacgtgctggacaagacccgcgtgaccaaagacttcctgcaggataatctcttttccggccctgggccaaaagagcccactggcctttcccccttcctcctactgccacctcggccacctccagctcggccagacaaactacccgaactacccgctcagaagcgccagttacctgttttcgcaaagatctgcagcaaaccaaaggccgatccagcagtcgaaagacatcacctgatggagtggtctcccggaacaaaggagcctaagaagggccagggaagcttattcctttcccagtggccacagtcacagaaagatgcctgcggagaagagggctgctgtgacgccgttggaacagccagcttgacgctgccaccaaaaaaacctacttgtcccgctgagaaaaatttgttgtatgagtttctgggggcaactaagaaccctagcggccagccacgcctccgaaacaaggtcgaagttgatggaccagagctgaaattcaatgctccagtgaccgtcgcggacaaaaataaccctaagtacactgggaatgtgtttactccacactttcctactgcaatgacctccgcaactctgaaccaacccttgtggctgaatctgaactatccgccacctcccgtcttcaccaaccattccacgttcctgcagtatcagggtctgtacccacagcaggcagccaggatgccctaccagcaggcacttcatccccaactgggctgttacagccagcaggtaatgccctacaacccccaacaaatggggcagcagatatttcgcagttcttacacaccgcttctgagctacatcccgttcgtacagcccaattacccctacccccagcgcaccccgccaaaaatgagtgcaaaccccagagacccgccactgatggcgggtgatggcccacagtacctgttcccccaagggtatggcttcggctcaaccagcggtgggccactaatgcacagcccctacttctcctcctctggcaacggtatcaatttttag

SEQ ID NO: 49035 - DNA, 1797 bp, Artificial Sequence
  Description of Artificial Sequence: Synthetic coding sequence
atgaggggcggtggtggctgtgttctggccctaggcggtcaacggggatttcagaaggagcgcagacggatggctagcggaaatggcttgccttcgagttcagccctggtagccaagggaccatgcgccctggggcctttccccaggtatatatggatccaccaggatactcctcaagactccttggacaagacttgccacgaaatttggaaacgtgttcagggtctcccagaagcttcgcaaccttggacttctatggagcagctgtctgtccctgtggtcggcactctgcggggaaatgagcttagctttcaagaggaggctttagaactgtcttcaggaaaggatgaaattagtctattggttgaacaggaatttctgtcccttacgaaagaacactctatcctggtcgaagaatcgagcggcgaactggaggttcccggttcgtcacccgagggaacacgagaactcgccccatgcatactggccccacctctcgtggccggttcaaacgagcggccacgcgctagcataattgtgggggataagctgttaaaacaaaaggtggccatgcccgtgattagctccaggcaggactgcgactccgccaccagtaccgtgactgatattctttgcgccgcagaagtaaagtcttcgaagggtactgaggaccgaggcaggatcctcggagattctaacctgcaggtaagcaagttacttagccagttcccattgaagtctacggagacgtccaaggtgcccgacaacaagaacgtcctcgacaaaacaagagtgactaaggacttccttcaggataacttgtttagcggcccaggtccgaaggaaccaacgggcttgagcccattcctgctccttcctcccaggccaccaccggcacggcctgacaagctacctgagctgcccgcacagaagcgccaacttcctgtgtttgccaaaatttgctcaaagcccaaagccgaccccgcagttgagcgtcaccatctgatggaatggtcaccaggaaccaaggagcccaagaaggggcaaggctctctttttcttagccagtggccacaatcacagaaggatgcctgcggagaagaggggtgttgcgatgcagttggcacagcgtctttaacactgccgccaaagaagcctacatgtccagccgaaaagaacctgctctatgaattcttaggtgccaccaagaatccctccggtcagccccgactccgcaacaaggtggaagttgacgggccagaattgaagttcaatgcacccgtcaccgtcgcagacaaaaacaatcctaagtacaccggcaatgttttcactccccacttcccaaccgcgatgacgagtgcaaccctgaaccagcctttatggctgaacctgaactacccacctcccccagtgttcactaatcactccacattcttgcagtaccagggactgtatccccagcaggccgcaagaatgccataccaacaggccctgcacccacaacttggatgctattcacaacaagtgatgccatacaaccctcagcaaatgggccagcagatttttagaagctcttacacacctttactcagttacattccctttgtccaacccaactatccatacccccagcggacgcctcccaagatgtcagctaacccaagagacccgccattaatggcgggtgacggcccacaatacctctttccacaggggtatggatttggctccaccagtggcggacctttaatgcactctccttattttagctcttctggaaacggaatcaatttttag

SEQ ID NO: 49036 - DNA, 426 bp, Artificial Sequence
  Description of Artificial Sequence: Synthetic coding sequence
atggagcccagccacaaagatgccgagaccgcggctgcggcagccgctgtggcagctgctgatccccgaggcgcatcttcatcctccggcgtagtcgttcaggtgcgagaaaagaaaggcccactgagggcggcaattccctacatgccctttcccgttgccgtgatctgtcttttcctcaatacctttgttcctgggttgggaactttcgtaagtgcattcaccgtcctgtgcggggcaagaacggatctccctgacaggcatgtgtgttgcgttttttggttgaacatcgctgccgctcttattcagattctgacagcaatagtgatggtgggatggatcatgagcatattctgggggatggacatggtgatcttggccatcagccaaggatacaaagagcagggtatacctcagcagctctag

SEQ ID NO: 49037 - DNA, 426 bp, Artificial Sequence
  Description of Artificial Sequence: Synthetic coding sequence
atggagccctctcataaagatgcagaaactgccgctgccgctgccgcagtcgcggctgctgacccaagaggggcatcttctagctccggggtcgtggttcaagtacgagaaaagaagggtcccctacgggcagcgatcccatacatgcccttccccgttgctgtgatttgtctttttctaaatacgttcgttccagggctgggaacttttgtgtccgcctttacggtgctttgcggagccaggactgacctgccagatagacacgtgtgttgcgtcttctggctgaatatcgccgcagcacttatccagatcttgaccgctatcgtgatggtgggatggatcatgtctatcttctggggcatggacatggtgatcttagcaacttcgacagggtataaggagcagggtattcctcagcaattgtag

SEQ ID NO: 49038 - DNA, 639 bp, Artificial Sequence
  Description of Artificial Sequence: Synthetic coding sequence
atgaggtcgagactgctcctcagcgtcgcccatcttcctactatcagagagacgaccgaggagatgcttctcggtggacccggacaggagcctcctccatccccgtccttggatgattacgtgaggtcaatttctagacttgctcagcccacaagcgtgctagacaaggccactgcccaaggtcagccaagaccccctcaccgacccgctcaggcctgccggaaaggacgccctgctgtcagcctccgggacattaccgcacgcttttctggacagcaacccaccctgcctatggccgatactgtggaccctctggattggctgtttggcgaaagtcaggaaaagcaaccatcacagagagacctgcctagacgcactggacccagcgccggtctgtggggaccccaccgccagatggattcctctaagccgatgggagcgcctcgtggaagattgtgcgaggctcggatgcctggtcattcacttgccaggcctcctcaggatgggcagcaaagttcagacctgaggagctggacctttggccagagtgcgcaagctatggcgtcgcgccacaggcctcgcccatcaagtgtactgcgaactctttatagtcacctccccgtcattcacgaactctag

SEQ ID NO: 49039 - DNA, 384 bp, Artificial Sequence
  Description of Artificial Sequence: Synthetic coding sequence
atgcggtcgcgactgttattgtctgtagctcacctcccaactataagggaaactaccgaggagatgctgctggggggacccggtcaggagcccccacccagcccgtccctggacgactacgtgagatccataagtcgtctggcccaacccacgtctgtgttggataaggcgacggcccagggtcaaccacggcctcctcaccgcccagcccaagcttgtaggaagggccgacccgctgtgagtttgctggcttcgggcgtacatatcgatcgctggaccgctgccagtccatggggtccgcctgagggcggttcagtgaaacctgggtgcttgggcattccctggcaagaccacagacgcatgggtagtagggccctgacctag

SEQ ID NO: 49040 - DNA, 255 bp, Artificial Sequence
  Description of Artificial Sequence: Synthetic coding sequence
atgagaagccggctgctcctgtctgtcgcccacctccctaccattcgagagaccacagaagagatgctgcttggaggcccaggtcaagagcctccaccatcaccctccctggacgattatgtacgaagcatttctcgtttagcacagcccacaagcgtgctcgacaaggccacagcgcaaggccaacccaggcccccacaccgcccagcccaggcctgccggaaaggtcgacctgcagtgtccttacgcgactag

SEQ ID NO: 49041 - DNA, 504 bp, Artificial Sequence
  Description of Artificial Sequence: Synthetic coding sequence
ttaggcctgctggtggagaggcaggaatcagaaggactcccaagggtgcggcctcccgtgcatggacgaccccaagctacagcagccggaattactggcgctatgtccactgagggcccttctctggcgagctctcccgcaatttcgccacttgcgtttttatcggctccagttactcctggcactctggccgaagccaccgacccactgccgatgctgatagctttagcatgcattttcctgttgttggccacctgcctactctttatgaccctctgcaaacccgctgccttggacccttctcgtcggagagctcacgagtgcatgcctcaccatccaggtagcccctcggaacctcagctgcgactctggaaacgactcggctcattgcggctgtcgctccactcttttcgtcacggcagaccaacagtccccagacagccgctgcctgggccagaggacaatagaagccactgtgattacatggagtcaaccaagatgtag

SEQ ID NO: 49042 - DNA, 402 bp, Artificial Sequence
  Description of Artificial Sequence: Synthetic coding sequence
atgagcacggaaggtccttccctggcaagctctccagccatttctccgttggcgttcttgtccgcacccgtcacaccaggtactctcgcagaagccacagatccattgcccatgctcattgctcttgcctgcatctttctgttactcgccacgtgccttttattcatgaccctttgcaaaccagcggcattagatcctagtcgccgaagagcacatgaatgcatgccacatcatcctgggtctcctagtgaaccacagcttcgactatggaagaggcttgggtctctgaggctcagtctgcactcgtttaggcacggtcgccctactgttccgaggcagccattgcccggacccgaagacaatagatcacattgtgactacatggaatcaaccaagatgtag

SEQ ID NO: 49043 - DNA, 402 bp, Artificial Sequence
  Description of Artificial Sequence: Synthetic coding sequence
atgtctacagagggtccctctctggcatccagtcctgccatcagcccgctggcttttctctctgctcccgtgactccaggaacactggccgaagccaccgaccccctccctatgcttattgcccttgcgtgcatctttctgctgctcgcaacctgcctcttgtttatgacactgtgtaaaccagccgctctggatccctctagaaggcgagcccacgagtgtatgccccatcaccccggttcgcccagcgagccgcaactgcgtttatggaaaagactcggcagtttaagattaagtctgcattcctttagacatggccgacccacggtgcctagacagcctctgcctggccctgaagacaatcgctctcattgcgactacatggaatccactaagatgtag

SEQ ID NO: 49044 - DNA, 468 bp, Artificial Sequence
  Description of Artificial Sequence: Synthetic coding sequence
atggagtcattacagaccccgcaacatcgagagaatcaagataagcgcgagaaggagtatggtgttaagcacatgccaatggggaataacgccggaaacctggagccagaaaagcggaaggctgtgagagtggccttgtccagcgctacagcagcacagaatattccaagctcagtccattgtggttgctcaaagcagtggcgcctcaggctgccttcagagtcactccagagccggggacaggtgatgaaacgccctaataacattctgaagctcagaaatcttgacttgctgatttatccatggccagaactgagacggagacaagtggcctctgacctgatgtccctgctgttgttgccggcttttagcgggctgacatgggctccgtttctcttcctgttcacgtatctgcctccattcttaaatctgctgactgttggtttcgtttcctacttcttagtctag

SEQ ID NO: 49045 - DNA, 1524 bp, Artificial Sequence
  Description of Artificial Sequence: Synthetic coding sequence
taggaatgtccacgaggtcggagcgcacttcttaaggggcctccgcaggagaagcccaaccgtcgaagtgcactgctgagcgtcggtgagattagcgaactctgcccagaaattacagatttcctgtgtagagataagaaatgtattgcttctcatctgctgtgtgattataaacctgattgctctgaccggtcagacgaggcacactgtgcccactacacctccaccactggctcctgcaactttgagacttcctccggcaactggacaactgcctgcagtttgacccaggattcagaggacgacctcgactgggcaattggctcccgtatccctgccaaagctttgattcctgattctgaccacacacccggttctggccagcactttctctacgtaaattctagcggtagtaaggagggttctgtggcgaggatcacaacaagcaaaagtttcccagcttctctgggcatgtgcactgtgcggttctggttctacatgatcgatcccagatccatggggatcctaaaggtgtataccatcgaagagagcggactaaatattctggtctggtctgtcatcggcaacaagaggactggctggacgtacggatccgttccactgagctctaactcccctttcaaagttgccttcgaagccgatctggacggaaatgaggacatctttattgcactcgacgatatttcttttacacccgagtgcgttactggcggtccagtcccagtccagcctagtccttgtgaagctgaccagttctcctgcatttacaccctgcaatgcgtgcctctttccggcaagtgtgacgggcacgaggattgcatagatggctccgatgaaatggattgtccattgtcgcctacacctccactttgttcaaacatggaattcccctgttcgactgatgaatgcattccaagccttctcctgtgtgatggtgtccctgactgccacttcaatgaagatgagcttatttgctccaataagagctgcagtaatggggcattagtgtgtgcctcctccaattcctgtatcccggcacaccagcgctgtgatggctttgccgactgcatggactttcaactggacgagtcaagttgttctgaatgtccgttgaattattgccggaacggtgggacatgcgtggtcgaaaagaacggcccaatgtgccgatgtaggcagggatggaaagggaacaggtgccatattaaatttaacccccctgctaccgattttacctacgcccagaacaatacatggacactgctaggtattgggttggcattcctgatgactcacataactgtagctgtgctctgcttccttgcgaatagaaaggtgccaattcgaaaaactgaaggctctgggaactgcgcttttgtgaacccagtgtacggcaattggtctaatcccgaaaaaacggaatccagcgtgtattctttttcaaaccctttatacggtaccacttctggttctctagaaaccctgtctcatcacctaaagtag

SEQ ID NO: 49046 - DNA, 4461 bp, Artificial Sequence
  Description of Artificial Sequence: Synthetic coding sequence
ccacgggatcactcattaaacgccagccaggggcactttatgtttatcctgaagaaatcatcctctctctggcaggtggcaaagttgcagtccccaacttttagccagacgggacccggatgtatactgtcattttggttctataattatggcctttccgtgggcgctgccgaattgcagctgcacatggagaactcacatgattccaccgtcatctggcgcgtgctatacaaccaggggaagcagtggcttgaggcaaccattcagctgggccgactgtctcagccctttcatctctccctggacaaggtgagcctgggaatttatgatggcgtgtctgccatcgacgacataagatttgaaaattgtactctgcctcttccagccgaatcatgcgaaggcctcgaccacttttggtgccggcatacccgcgcatgtattgaaaaactgaggctgtgtgatctggtggacgattgcggcgatcgaaccgacgaggtgaattgcgcaccggaattacagtgtaattttgaaacaggaatctgcaactgggagcaggatgcgaaggacgatttcgactggacacggtctcagggcccaacccccacacttaacacaggacccatgaaggacaacacgctagggacagcgaaaggccactacctctatatcgaaagctcagagcctcaagcgtttcaggactcagccgctttattgagccccatcctgaatgctaccgatacaaaaggatgcacgttcaggttctactatcatatgtttgggaagagaatttaccggttagccatctaccaacggatttggagcgattctagaggccagcttctttggcagatctttggcaatcagggtaacaggtggatccggaagcaccttaacatttcaagccgacagcctttccagatccttgttgaagcatcggtgggggacggctttactggagacatcgcaattgatgacctatccttcatggactgcaccctgtatccaggcaacctgcctgccgatctaccaacaccacccgaaacatccgtgcctgttactctgccccctcacaactgcaccgataatgaatttatttgtaggtccgacggacattgtatcgagaaaatgcagaagtgtgacttcaagtatgattgtcccgataagagcgatgaggcgtcctgtgtcatggaagtgtgctcgttcgaaaagcgatccctatgcaagtggtatcaacccatccctgttcatcttcttcaggatagtaacacatttcggtggggactcggcaatgggataagcattcatcacggggaggaaaaccaccggccatctgtcgaccatacccagaacactactgatggttggtacctgtacgctgacagctcaaacggaaagtttggagacaccgcagatatcctcactccaatcattagtctgacgggcccaaagtgtaccttagtgttttggacgcacatgaatggcgcaacagttggtagcctccaggtcctgatcaaaaaagataacgtgacgtctaagctgtgggcccaaacggggcagcaaggagctcagtggaagcgggcagaagtgtttttggggattcgcagtcatacacaaattgtgttcagagcaaagagagggattagttacatcggagacgtcgctgtggatgatatatcctttcaagactgcagccccttgctgagtcctgagagaaagtgcacagaccatgaattcatgtgcgctaacaagcactgtatcgccaaggataaactgtgcgacttcgtcaatgattgcgcagacaattccgacgagaccacattcatctgtcggacgagcagcggacggtgcgacttcgaatttgatttgtgtagctggaaacaggagaaagacgaagacttcgattggaatttaaaggcttcaagtatccctgcagcgggaacggaaccagccgctgatcacactctcgggaattcgtctggccattacatcttcattaagtctctgttcccccagcagccgatgagagccgctcgaatttcatcccctgtcatctctaaaaggtcaaagaactgtaaaattatctttcactaccacatgtacggtaacgggattggggcacttaccctgatgcaggtttcagtgacaaatcagactaaggtgttgctgaaccttactgtggaacaaggcaacttctggcgacgcgaggagctcagtctcttcggcgatgaggacttccagctgaagtttgaaggtcgtgtaggaaaagggcagagaggagacatcgcactcgatgacatcgtactgacagaaaattgtctgagcctgcacgacagtgtccaagaggaacttgcggtaccgctgccaactggcttttgtcctctggggtatcgagaatgtcacaacggcaagtgctatcgcttagaacagtcctgcaacttcgtcgacaactgtggtgacaacacagatgaaaatgaatgcggtagttcctgcacgtttgaaaagggctggtgtggttggcaaaacagtcaggccgataacttcgattgggttctgggagtcgggagccaccagagcctgaggccacccaaggatcacaccctcggaaatgagaatgcaatcttactgatgcgtaggcacaaataccccattcggagtgtaaacttgcacacagtgaagcacgtgcttaaggcccagaccgtgggcaattgttctgtgtcgaagctcgaggcgaggctgcttgatttcttatcagtccccaatgagaacaccttcggctcctccgatcataccaactggcactttatgtatctggaggccactgcagttggattgcggggtgataaagcccacttccggtccaccatgtggcgggagagttccgccgcttgtacgatgagcttctggtattttgtaagcgctaaggcaacaggaagcattcagattttgatcaagcgcggtaggcggaggcgcagagccccaaatcctgttttgtccggaagtccaactatccccagacagggaagccaacagctggggggatggcgcggtggcagcgcccgacatcgagccagggcttttccagagccggaatgtcccagaggcagatccgcacttctgaagggccctccgcaagaaaagccaaacagacgctccgcattgctttctgtgggcgagattagcgagttgtgtcccgagattaccgactttctgtgtcgcgataagaaatgtattgcctcccacctcctgtgtgattacaagccggactgttctgatcggagtgatgaggcccactgcgcgcactacacatccacgactggttcttgcaatttcgagacctctagtggcaattggaccacagcttgctcactgactcaggactctgaggacgaccttgattgggccatcggttcccggattccagccaaggccttgatacccgactcggatcacactccaggcagcggacagcactttctgtatgtaaatagcagtggaagcaaggaaggatccgtggccagaattaccactagcaaatcatttccagcttcacttggaatgtgtacagtgcggttctggttttacatgatcgatcccaggtctatgggtattcttaaggtgtatactattgaggaatccggtctgaacattctcgtctggtcagtaattggtaataaacgaaccggatggacctatggttccgttccattgtcctctaattcaccattcaaagtggcgtttgaggcggacctggatggaaacgaggatatctttatcgctcttgatgatatttctttcaccccggagtgcgttacgggcggaccagtgcccgtccagcccagtccctgcgaagcggaccagtttagctgtatttataccttacagtgtgtccccttgtctggcaaatgcgacggtcatgaagattgcatcgacgggagcgatgaaatggattgcccactgtcccccactcctccactgtgctctaacatggaattcccctgctcaactgatgagtgcattccttccttgctgttatgcgatggggttcctgattgccacttcaacgaggacgagctgatctgcagcaataagtcctgtagtaacggcgcacttgtctgtgcatcctccaattcatgcattccggcacatcagagatgtgacggcttcgccgattgtatggattttcaactggacgaatccagttgctcagatacatggaccctcctgggaataggcctggcatttctgatgacacatattacggtggcagtcttatgtttcctagcaaaccgtaaggtacccatcagaaagactgagggctcaggtaactgcgctttcgtcaacccggtgtacggcaactggagtaacccagaaaaaacagagagcagtgtgtactcattctccaaccccctttatggcaccaccagcggatccctggagacgctgtcccatcatctcaagtag

SEQ ID NO: 49047 - DNA, 777 bp, Artificial Sequence
  Description of Artificial Sequence: Synthetic coding sequence
ctgaagttcgaggggagagttggtaagggacagaggggcgatatagcattagatgacatcgtgctcaccgagaactgtctgtcccttcatgattcggtgcaggaggaactcgccgttcctctccccacaggattttgtccactcggctacagggagtgccacaatggaaaatgctaccgcctggaacagagctgcaactttgttgataactgcggggacaacaccgacgagaacgaatgtgggtcttcctgcacatttgaaaagggctggtgtggatggcagaactcacaggccgacaacttcgattgggtgctgggtgtcgggtctcatcaatctctgaggcctccgaaggaccatacacttgggaacgagaacggacacttcatgtatctcgaggccacagccgtaggtctccgaggagataaggctcactttcgctcaactatgtggagggagtcttctgccgcatgtactatgtcattctggtactttgtgtccgccaaagccaccgggtctatacaaatcttgatcaaaacagagaaaggcctctccaaggtgtggcaggagtccaaacagaatccaggcaatcactggcaaaaggccgacatactccttggaaagttgcgcaacttcgaggtcatattccagggtattcggacccgagacctaggcggaggagccgcaatcgacgacattgaattcaaaaactgtacaaccgttggcgaaatcagcgaattgtgccccgagatcacagattttctgtgcagggataaatag

SEQ ID NO: 49048 - DNA, 4422 bp, Artificial Sequence
  Description of Artificial Sequence: Synthetic coding sequence
atgttcattctcaagaaaagctcttcattgtggcaggtcgcaaaactccagagcccaacctttagccagaccggcccaggttgtatcctcagcttctggttctataactacgggctcagcgtcggagccgcagagcttcagctgcacatggagaactcccatgatagcacagtgatttggcgggtgctgtataatcaaggaaagcagtggctggaggcgaccatccagctgggtaggctttctcaaccgtttcatctgtcactcgataaggtatccctcgggatatatgatggtgtctccgcaattgatgatataagatttgagaattgtacgcttcccctgcccgcagagtcatgcgagggccttgatcatttctggtgcagacacacacgggcatgcatcgaaaaactgaggctgtgcgatctcgtggatgactgcggcgaccggacagacgaggtgaattgcgcccctgagttgcaatgtaatttcgagacgggtatctgcaattgggaacaggacgctaaagatgactttgactggacccggagccaaggccctacccctacactgaacacaggaccaatgaaagacaacacgctgggcaccgcaaaaggccactacctgtacattgagagtagcgagccccaggccttccaggattccgccgctttgctgagcccgattctgaatgcaacagatacaaaaggttgcacgtttcggttctactaccacatgtttggaaagagaatctaccggctggccatctaccagcggatctggagcgatagcagaggacagcttctatggcagatttttggcaaccaggggaatcgctggatccgcaaacaccttaatatctccagtcgccaaccctttcagatacttgttgaggcctccgttggtgacggcttcacaggcgatatcgccatcgacgacctgtcgttcatggattgcaccttgtacccaggtaatttgcctgccgacttacctacccctcccgaaacctctgtccctgtgaccttgccccctcataactgcactgacaacgagttcatttgtaggagcgatggacactgcattgaaaagatgcagaaatgtgatttcaaatacgactgccccgataagtctgacgaagccagctgtgtcatggaagtgtgtagtttcgagaaacggtcactgtgtaaatggtatcagccgatcccggtgcatctgctgcaggattcgaataccttccggtggggactggggaatggaattagtatccaccatggggaagaaaatcatcgcccatcggtggaccacactcagaatacaactgacggctggtatttatacgccgactcctccaatggaaagtttggagacaccgccgacattctcaccccgatcatctctttaacaggcccaaaatgcactctggtgttctggacccatatgaacggagccaccgttggttcgctccaggtcctcataaagaaggacaacgttaccagtaagctttgggctcagactggacagcagggcgctcagtggaaacgcgcagaggtattcctgggaataaggagtcatacccagatcgtgttccgggcaaaacggggaattagttatattggggatgtggccgtcgatgatatcagcttccaggactgcagcccgctcttgtctcccgaacgtaagtgcactgatcacgaattcatgtgtgcgaacaaacactgtattgccaaggacaagttgtgcgatttcgttaatgattgtgccgacaacagtgacgagactactttcatctgccggacttctagcggacgctgtgactttgaattcgacctgtgcagttggaagcaggagaaagacgaggattttgattggaacttgaaggcatcatcgatccccgctgctggaacagagcctgcggcagaccacaccctgggaaactcttcaggtcattacatttttatcaaatctctgttcccccagcagcctatgagggccgctcgcatatcctcgcctgtgatttcaaagagatccaaaaactgtaagatcatattccattatcacatgtacggtaacgggatcggtgccttgacactgatgcaggtctcagtgactaatcagaccaaggtgctactgaatctgaccgttgaacagggcaacttctggcgaagagaggaactgagcctgtttggagacgaagactttcaactgaaattcgaagggagggttgggaagggacaaaggggggacatcgcgttagatgatattgtcttgacagagaattgtctctctctccacgattctgtacaggaagagctggccgtgccactgccaacaggattttgtcccctcggataccgggagtgtcataacgggaagtgttatcggctggagcagagctgtaacttcgtagataactgtggagacaacaccgacgagaatgagtgtggctcctcatgtacatttgagaagggctggtgtggttggcagaattcccaagctgacaattttgactgggtcctgggtgttggaagccaccagtccctgcggccacctaaagatcacacacttggcaacgagaacgccatcctgctgatgcgtcggcataagtaccctatccggtcggttaatttgcacacagtcaagcacgtactgaaagctcagactgtgggtaactgttctgtgtctaaacttgaggctagactgctcgactttctgagcgtgcccaacgaaaacacttttgggtctagcgaccatactaattggcatttcatgtatcttgaagcaacagctgtcggtcttcggggagacaaggcgcacttcaggagcaccatgtggcgggaatcctcagccgcatgcaccatgagtttctggtactttgtttccgctaaagccaccggaagcatccaaattctcattaagaggggtcggaggcgacggagggctccgaaccctgtgctgagcggtagccctaccattccccgtcagggctcgcagcaactcgggggatggcgtggaggaagcgcccgacatcgcgctcgcgcttttccagagcctgagtgccctaggggtcggtctgctctgctcaaaggtccacctcaagagaaaccaaaccgacgcagcgctcttctatcagttggtgagattagcgaactgtgtcccgaaattaccgacttcttatgtcgtgataagaagtgcatcgcctcccatttgctgtgtgactataagcctgactgctctgaccggagcgatgaggctcactgtgcccattacacatcaaccactggaagttgcaatttcgagacgagctcaggtaactggacaacagcatgtagtcttactcaggactctgaggacgatctggactgggctataggatccaggatcccggctaaagctctgatccctgacagtgaccacacaccaggcagtggccagcactttctgtacgtcaactcctcagggagcaaggaagggagcgtggccagaatcactactagcaagagctttccagcttcgttgggcatgtgcacagttcgcttctggttctatatgattgatccaagatccatggggattcttaaggtgtataccattgaagagtctgggcttaacatcttggtatggagcgtgatcggaaataaacggacaggatggacttatggatccgtacccctttcttcgaactccccttttaaggttgcttttgaggccgacctcgatggcaacgaggatatattcattgctttagatgatatttcattcacacccgaatgtgtaacaggtggtccggtacccgtccagccttccccctgcgaggcagatcaatttagttgtatttacaccctccagtgcgtaccactctcggggaaatgcgatggtcacgaggattgcatagatggaagtgacgagatggattgtccactctccccaacaccacccctttgctcaaacatggagttcccatgcagcaccgatgaatgtattccaagtttgttgctctgcgatggtgtgccagattgtcactttaatgaagatgaactcatctgttccaacaagtcctgctctaacggagctctggtttgtgcatcctctaattcctgcattccagcgcatcaacgctgcgatggtttcgccgattgcatggattttcagctcgatgaatcttcgtgcagcgacacttggaccctgcttggaattgggctagcattcctgatgacacacattaccgtcgcagtgctgtgtttcctcgctaaccggaaggtcccgatccggaaaacggaaggaagtggaaactgcgccttcgtcaatcctgtttatgggaactggtccaaccccgagaagacagagagcagcgtttattcattctctaaccctctttacggtaccacatcaggctccctggagactctaagccaccacttgaagtag

SEQ ID NO: 49049 - DNA, 1053 bp, Artificial Sequence
  Description of Artificial Sequence: Synthetic coding sequence
atgtgtacagtacgtttttggttctacatgatcgatccaaggtctatgggcatcctgaaagtgtacacaatcgaggaaagcggcctgaacatcctcgtatggagcgtgatcgggaataaacggaccggctggacctatggcagtgtgcctctcagcagcaattctccttttaaggtggccttcgaggcggaccttgatgggaacgaagatatttttattgccctggacgacatatcctttacacccgaatgcgtgactggcggtcccgttccagtgcagcccagcccctgcgaagcggaccaatttagctgtatttacacattacagtgtgtcccactctcaggcaagtgtgacgggcatgaggactgcatagatggaagtgacgagatggattgtcctctaagcccgactccccctctgtgtagtaatatggagtttccctgcagcacagacgagtgtattcccagcttgttgctgtgcgatggcgttccagattgtcatttcaatgaagacgaactcatatgctctaacaagtcttgctcaaatggtgcgctcgtgtgcgcgtcatcaaatagttgcatcccagcccaccagagatgtgatggctttgcagactgtatggattttcagttggacgagtcatcttgttcggagtgtccgctgaactactgtcgcaatgggggaacttgcgtcgtggagaaaaacggcccaatgtgcaggtgccgtcaaggatggaaggggaatcggtgtcacataaaatttaatccacccgctaccgatttcacctacgcacagaacaacacctggacattattgggaataggtctcgccttcctcatgacccacataacagtagcggtcctttgctttctggcaaataggaaagtgccaatcaggaaaaccgaagggagcggaaactgcgcattcgtgaatcccgtctacggcaattggtctaacccagaaaaaaccgagagttcggtgtacagtttttcgaaccctttgtatggaacaacttcgggatcactggaaactcttagtcaccatcttaaatag

SEQ ID NO: 49050 - DNA, 318 bp, Artificial Sequence
  Description of Artificial Sequence: Synthetic coding sequence
atgaacctgggcgtcagtatgctgcgcattctatttcttctggatgtaggtggggcacaagtgctggctactggtaaaacgcccggtgctgaaatagactttaagtatgcactcatcgggactgctgtgggcgtagccattagcgctggcttccttgctctgaagatttgtatgataaggcggcacctgtttgatgatgacagctccgacctgaaaagcacgcccggagggctgagtgacacaattcccctcaagaaacgagccccaaggaggaaccacaacttttctaaacgagacgcccaggttatcgagctgtag

SEQ ID NO: 49051 - DNA, 1443 bp, Artificial Sequence
  Description of Artificial Sequence: Synthetic coding sequence
atgctaggccgtttccagccttttagcctcgtaaggtcttttcgactaggattcgaggcctgttgttatcctaaccagaaatgcgctactcagacaatccgcccaccagattctcggtgtctcgtgcaggctgtttcgcagaatttcaattttgcaaaggacgttctcgatcagtggtcacagctggagaaagacggattacgtggaccataccccgctctatggaaggtgtcagcaaaaggcgaggaggataagtggtcctttgagaggatgacgcagctcagcaaaaaagccgcttctattttgtccgacacatgtgcactctcacacggggataggctgatgattatactgcccccaacccctgaagcctattggatttgcttggcctgcgtaaggttggggataaccttcgtgcctggcagccctcagctgactgccaagaagatcagatatcagctccggatgtcgaaagcacagtgtatcgtggctaatgaggcaatggctcccgtcgtgaattcagccgtgagtgattgcccaaccctcaaaacaaagctgctcgtgtctgataaatcatacgatggatggcttgacttcaaaaaattaatccaggtggcccctccaaagcagacttacatgagaaccaagagccaagatcctatggcgattttttttacaaagggcacaaccggtgcaccgaagatggtggagtatagccaatatggactggggatggggttcagccaagccagcagacggtggatggaccttcagccaacggacgtgttgtggtcattgggcgatgcctttgggggttctctctcactgtcagccgtgctgggaacatggtttcagggagcttgtgtttttctctgtcacatgccgaccttctgcccggagacggttctcaatgtgctgtcccggtttcctatcaccacactgtcggctaaccctgagatgtaccaggaattgctacagcataaatgctttacttcatatagatttaagtcgctcaagcagtgtgtggcggctggaggcccaattagcccaggggtcatcgaggactggaagaggataaccaaattagacatctatgaggggtacggtcagactgagacaggtttgctttgcgctacctccaagaccattaaactcaagccgtccagccttggaaaaccactccccccttatattgttcaaattgtcgacgaaaactccaacctgcttccccctggggaggagggtaatattgccatcaggatcaagctgaaccagccagcctcactgtactgtcctcacatggtgagctgggaagaatacgcaagcgccaggggccacatgctgtatctcacgggcgaccgcggtattatggacgaagacggctatttctggtggagtggtcgcgtggacgatgtcgcaaatgcactcgggcagcggttgtag

SEQ ID NO: 49052 - DNA, 1443 bp, Artificial Sequence
  Description of Artificial Sequence: Synthetic coding sequence
atgcttggccgtttccaacctttttccctggtccggagctttcggctcgggtttgaggcctgctgctacccaaatcaaaaatgtgctacccagacaatcagaccaccagattcacggtgtctcgtgcaggccgtatcccagaatttcaattttgccaaagatgtactcgaccagtggtctcagcttgaaaaagacggacttcggggaccctatcctgccctctggaaggtgagtgcaaaaggggaagaagacaaatggagttttgaaaggatgacccagctaagcaaaaaggccgctagcattctcagtgatacatgtgcactgagccatggcgatcggttaatgattatcctgccacctacccccgaggcatattggatttgcctcgcatgcgttagactgggcatcacatttgtgcctgggtcaccccagctcactgccaaaaagatacgataccaattgaggatgtccaaggcccagtgcatcgtggccaacgaggcaatggctccagttgtgaacagcgccgtgagcgattgtcccacactaaagaccaaattgttagtatcggataaaagctacgacggctggctggattttaagaaactgattcaggtagcccctccaaaacagacctacatgcggaccaaatcccaggacccaatggctatcttcttcacgaaagggactaccggggcacccaaaatggtcgaatacagtcagtacggactgggaatgggcttttcgcaggccagccggaggtggatggacctgcagcccactgatgtgctgtggtcactgggtgatgcttttggaggttccttgtcattgtctgccgtactcggaacttggttccagggggcttgtgtcttcctgtgccacatgcctacattctgtcctgagacagtgctaaacgtgctctcgaggtttcctatcaccaccctttcagccaaccctgagatgtatcaagagctgttgcagcataaatgttttaccagttacagatttaaatccctgaagcagtgcgtggccgctgggggtcctatttctcctggtgtcatcgaggactggaagagaataaccaagctggacatctacgaaggctatggccagacagaaactggactgttgtgcgccacttctaagaccatcaagctgaagccatcttcattggggaaacccctcccgccttacatcgtgcaaatcgtggacgagaactctaacctgctgccgcctggcgaagagggaaacatagctatacggataaaactcaaccagcctgccagtctatactgcccacatatggtaagctgggaggaatatgcgtccgcaagaggccacatgctctatcttaccggagacagagggattatggatgaggatgggtatttctggtggtccggacgtgtcgatgatgtcgccaacgccttgggtcagcgactgtag

SEQ ID NO: 49053 - DNA, 561 bp, Artificial Sequence
  Description of Artificial Sequence: Synthetic coding sequence
atgtccaaggcccaatgcatagtcgccaatgaagccatggcccctgtagtaaatagcgctgtttctgactgtccaaccctgaaaaccaagctgttggtcagtgataagagttatgatggctggttggattttaagaaactaatccaggtagcaccaccaaaacagacttacatgagaacgaaatcccaagatcccatggctatttttttcacgaagggaactaccggcgcacctaaaatggtggagtacagccaatatggtttgggcatggggttctcacaagcctcacgtaggtggatggatctgcagcctaccgacgtcctctggtcactaggtgacgccttcgggggttcactcagcctcagtgccgtgctgggaacatggtttcagggcgcttgcgtgttcctctgccacatgcctaccttctgccctgaaaccgtgcttaatgtactgtccaggttccccattaccactctgtcggctaatccagaaatgtaccaggagttgctgcaacataaatgctttacacgagtgtatagtgtacccctgcccaagcagtag

SEQ ID NO: 49054 - DNA, 1521 bp, Artificial Sequence
  Description of Artificial Sequence: Synthetic coding sequence
atgcttgggagatttcagcctttctcattagtgcgaagtttccgattgggatttgaggcttgctgttatcctaatcagaaatgtgcaactcagaccattcggccaccagactccagatgtctggtgcaggctgtgtctcagaatttcaatttcgctaaggacgtcttagatcagtggtcccagctggaaaaagataatggactccaactgcatccatgctgttgtaagcggcaggattttatcctgttccacggctgtctcttctatatcgacggtctgagggggccataccccgcactttggaaggttagtgcaaaaggagaggaagacaagtggagtttcgagaggatgacacagttaagtaagaaggccgctagcattctgagcgacacctgtgcgctgagtcacggcgatcgactgatgatcatcctgccacccacacccgaggcctattggatatgcctggcatgcgtgcggctgggtatcaccttcgtgcctggttctccccagttaacagcaaagaagattaggtatcaattgcggatgtcgaaagcacagtgcatagtggccaacgaggccatggcccctgtggtaaactctgcagtgtcagactgcccaaccctgaagacgaaactccttgtctctgacaagagctacgatggctggttggacttcaagaagctcatccaggttgctcctcccaagcagacatacatgcgaactaaatcacaagaccctatggccattttttttactaaagggacaaccggcgcaccaaagatggtagagtatagccagtacgggctcggtatggggttcagccaggcaagcagaaggtggatggaccttcaacctactgacgttctctggtctttgggagacgcttttggcggtagtttgtccctttccgcagttctgggtacatggttccagggagcttgtgttttcctgtgtcatatgccgacattctgcccggaaacggtgttgaacgtcctgtcacggttccccattaccacactctccgcaaatcccgaaatgtaccaggagctgctacagcacaagtgtttcacttcttaccgattcaagagtttgaagcagtgcgttgccgctggaggacccatttcacccggtgtgatcgaggactggaagaggatcaccaagcttgacatttatgaggggtatgggcagaccgagaccggattgctttgtgctaccagcaagacgatcaaattaaaaccttcctcactcggtaaacccctccccccatacattgtgcagatagtcgatgagaactcaaacctcttgcctcccggagaggaaggaaacatcgccatcagaattaagctgaatcagcctgcatctctttactgtcctcacatggtgtcttgggaagaatatgcatccgcacgaggccatatgctgtacctaacgggcgatagaggtatcatggacgaggacgggtacttttggtggagcggaagagtggacgacgtggctaacgcgctagggcaacgactctag

SEQ ID NO: 49055 - DNA, 366 bp, Artificial Sequence
  Description of Artificial Sequence: Synthetic coding sequence
atggtgcgtatccttgccaacggcgaaatcgtgcaggatgacgatcctcgagtgcgcacgacaactcaacctcctcgagggagtatccccagacagtcattcttcaatcgtggccatggagctcctccaggcggacctgggcctcggcagcagcaagctggcgctcggttgggtgctgctcagtccccttttaacgatcttaaccgccagttggtgaacatgggcttcccacagtggcatctgggtaatcacgccgtggagcccgttactagcatactcctgttgtttctccttatgatgttaggcgttcggggtttactgcttgtgggcctggtctacctggtgtcgcatctgtcccagcggtag

SEQ ID NO: 49056 - DNA, 312 bp, Artificial Sequence
  Description of Artificial Sequence: Synthetic coding sequence
atgagtcctgtgttgtctgggatccactctatctattccgcatgggtgaccagcgtgaacatcaccgattgtaagcctccaagcataagcggagccgcacaccaaggcccaaccgcgcctggacggatggttcgcatcctggcaaatggtgaaattgtccaggacgacgacccccgagtgaggacaaccacccaacctccccgaggctccatcccacgtcaatccttcttcaatcggggacatggggcaccaccaggagggcctggccctcgtcagcagcaagcgggagcaagattgggcgctgctcagtag

SEQ ID NO: 49057 - DNA, 924 bp, Artificial Sequence
  Description of Artificial Sequence: Synthetic coding sequence
gcctcaccgcgacggccacgtccagcccgtagccccgctccggaggtgccccttagggtacgtaggaggcacggaaggccacatggtcctggaggccgtcagttggccctaggtatccctgcccttcggtcactgcccggttgcgtacccaggctcttaggccctgttgataaaggacatgacgtgaccttttataaaacatggtataggtccagccgaggagaggtgcaaacctgctcagagcgcaggcccatcaggaatctcaccttccaagatctgcatctccaccacggcggtcaccaggcagcaaacaccagccacgacctcgctcagcgccatggcctagagtctgcgtcggatcaccatgggaatttcagcattaccatgagaaatctcaccctgttggattcaggtctctactgttgcctcgttgttgagattcgccaccatcattccgagcatagggtccatggagccatggagctccaggtgcagacaggaaaggacgctcccagcaattgtgtcgtctatcccagttctagtcaggatagcgagaacatcactgccgctgcactggcaaccggtgcctgcatagtgggcatcctctgcctgcccctgatcctgttgctcgtgtataagcagcggcaggctgcctccaacaggctggcccaggagcttctggctcaggacagcaacatccagggtatcgagaatcctgggtttgaagctagccctcctgcacagggcattcccgaagccaaagtgcggcatcctctcagttacgtagcccagcgccagcctagcgaatccgggagacacctcctatcagagcctagcacacctctttctccgcctgggcctggtgatgtgttcttcccttccctggaccccgtgcccgactcccccaactttgaggtgatttag

SEQ ID NO: 49058 - DNA, 936 bp, Artificial Sequence
  Description of Artificial Sequence: Synthetic coding sequence
atgggcgttcctaccgcactagaagctggatcgtggagatgggggagtctgctcttcgcactgtttcttgcagcaagtcttggcccagtcgccgcatttaaagtagccacaccctactccctgtatgtgtgtccagaggggcagaacgttacactgacatgcagactcctcgggccagttgataagggccacgacgtgacattctataagacgtggtatagaagttcacggggtgaagtgcaaacttgctcagagaggagacccattcgtaacctcactttccaggacctgcacttgcaccacggaggacatcaagccgcaaatacgtcgcacgatctggctcagcggcacggactggagagcgcctcggaccaccacgggaatttctccatcaccatgagaaatttgactcttctggattccggtctctattgttgccttgtggttgaaatcagacatcaccactccgaacaccgtgtccatggggctatggagcttcaagtgcagacaggaaaagacgcgccttccaattgcgtcgtgtaccctagctccagccaggatagcgaaaacatcaccgctgctgccctcgccaccggcgcttgtatcgtaggcatactgtgtctgcctctgatcctgctgcttgtgtacaagcaaaggcaagcagcatccaacaggcgcgctcaagagttggtcagaatggacagtaatatacaaggaatagagaacccagggttcgaggcgagcccccctgcccaaggcataccagaagcaaaagttaggcatccactgtcttacgtcgcccagaggcagccctcagagtccgggagacatctgctgagcgagccttcgacccctttgagccctcctggccctggcgacgtgtttttcccctcactggacccggtcccagattctcccaatttcgaggtcatatag

SEQ ID NO: 49059 - DNA, 435 bp, Artificial Sequence
  Description of Artificial Sequence: Synthetic coding sequence
tgaactgccggagaactccccgcaaatagtgtgtctggatttttcaaacgaatggtcaaaagtgaggccagcaacgccgctacggcgtactttcgtcctgccaggcccctgccgtctctggtaacagtgttggggctgggatacttcgcttgggtcgtattctggcctcagtccatcccctatcagaaccttgggccactgggcccttttacgcaatatctggtggaccatcaccacacactgttatgcaatggatattggctggcctggctgatccatgtgggggaatcattgtatgcaattgtactctgtaaacacaaagggataacttctggcagggcccagttactctggttcttgcaaacctttttctttgggatagcctctctcacaattctgattgcttacaagagaaagcgccagaagcagacatag

SEQ ID NO: 49060 - DNA, 312 bp, Artificial Sequence
  Description of Artificial Sequence: Synthetic coding sequence
atggcaacagcagcaggggctacctatttccagaggggcagcttgttttggtttacagtgatcacacttagtttcggctactacacctgggtggtgttttggccacagtcaatcccctaccagaaccttggtccactggggcctttcactcagtacttggtggatcaccaccacacactgctgtgtaacggctattggctcgcatggctcatccacgtcggtgagagcttgtacgccatcgtgttgtgcaagcagaatgagcttagaattcggatcaaaatgcggaagcttatccttagggattctgaatag

SEQ ID NO: 49061 - DNA, 255 bp, Artificial Sequence
  Description of Artificial Sequence: Synthetic coding sequence
atggcgacagctgccggtgccacgtatttccagcgcggtagtctgttttggttcaccgttatcaccctttcattcggttactacacatgggtcgtcttttggcctcagtccatcccatatcagaatctgggccctctgggacctttcacccagtacctggtcgatcaccaccacacgctcttatgtaacgggtactggctagcctggctgatacatgtgggcgagtctctgtatgcaattgttctctgcaaatag

SEQ ID NO: 49062 - DNA, 312 bp, Artificial Sequence
  Description of Artificial Sequence: Synthetic coding sequence
atggccaccgccgcaggggctacatacttccagaggggcagcctgttttggtttaccgtgatcacgttgagctttggctactatacatgggtcgtcttctggcctcagtctattccataccaaaatctaggacctctggggccattcacacagtatctggtggatcaccaccatacccttctctgtaacggctactggttagcctggctgatacatgtcggggagtccctctatgccatcgtgctgtgcaagcaaaatgaattgcggatccgaatcaagatgaggaaacttattctgagagacagtgagtag

SEQ ID NO: 49063 - DNA, 372 bp, Artificial Sequence
  Description of Artificial Sequence: Synthetic coding sequence
atggccactgccgcaggtgccacttatttccagcggggatcccttttctggtttactgtaattacactatcttttgggtactacacgtgggttgtcttctggccacaaagtattccctaccaaaacctcggacctctcggacccttcacacaatacctggtagatcaccaccacactcttctgtgcaacgggtattggctggcctggctcatccacgtcggagaatccctgtacgctattgtgctctgtaagcacaagggcatcacgtccggacgcgcacaattactttggttcctgcagaccttcttctttggtatcgctagcctcaccatcttgatcgcttacaaacgaaagcgccaaaagcagacctag

SEQ ID NO: 49064 - DNA, 306 bp, Artificial Sequence
  Description of Artificial Sequence: Synthetic coding sequence
tgagagtttctgcggtctgtttgggtggtattttggccccagtcaatcccgtaccaaaacctggggccactcggaccgttcacccagtacctggttgatcatcaccataccctactttgtaatggatactggctggcttggctgattcatgtcggtgagtccctctatgccatcgtgctctgtaagcacaagggcattacaagtgggagagcccagctactgtggttcctgcagactttcttttttggcattgcctcccttaccattctgatcgcttacaagagaaagagacagaagcagacttag

SEQ ID NO: 49065 - DNA, 285 bp, Artificial Sequence
  Description of Artificial Sequence: Synthetic coding sequence
agcgttgagctgccgctggatgccgatgtgcagacatccaatttattaatcacattcctcaagtattcctcaatagtaatgcaagacaccaaagacgaacatcgcctccatagtggcaagctctgtcttataattctgacctgcattgctgagccgatgaggcatcgtaaaaaggcggctgataaaaatttgccgtgtcggcctctcgtctgcgccgttttagacctcatggtagaatttattgtcacccatatgatgaaggagtttcctatggatctgtactag

SEQ ID NO: 49066 - DNA, 597 bp, Artificial Sequence
  Description of Artificial Sequence: Synthetic coding sequence
atggcccaggtggaaaaacggggaggactcctgcgcaagagttccgctagcaagaaacctctcaaggagaaagtcgtgctcatgtatgacgagattttcatgactgaggatccctctaaatgttcaccgcgtttttgggaggaactttttcttatgaaagtgaatctcgagtacctagaaggcaagcttgaaagtttggacggggaggaactgatgaagatcaaagataatatcaactgtctgttccaacactgtattcaagcactgggcgaagagcatccaattcgagtggtgaatgccctgcaaactctctgcgcattgatcaggggcgttcatcaaaaaaataagagcacttcaggcttcgatataataaacatgctgatggggttcgacaaggctgagctgtgtatgaaagttcgccacaagctgcaaatgtgcctgtggatggccgcaagtgattcctgtagctggacactcagcgctgataagtgtacccagaggttcggcctgcgaaagattcagatgattgaatttggattggctttccggtgcttctactttactgacctcctctacctgaacaagggtaaattttag

SEQ ID NO: 49067 - DNA, 2070 bp, Artificial Sequence
  Description of Artificial Sequence: Synthetic coding sequence
atggctcaggtcgagaagaggggaggcctgctcaggaagtctagcgcctcaaagaaacctctgaaagagaaagtggtactcatgtatgacgagatttttatgacagaagacccctctaaatgcagccccagattctgggaagaactctttctcatgaaggtgaacctcgaatatttggaagggaaactcgaatcactggacggtgaagagctgatgaagattaaagacaatattaactgtctctttcagcattgcatccaggcacttggtgaggaacatcccatacgtgtcgtcaacgctctgcaaaccctgtgcgctctcatccggggtgttcaccaaaagaacaagagtactagcggcttcgacattataaatatgcttatggggttcgataaggccgagttgtgcatgaaaaatctcatggaatcattggactcactactttgcgccgagggtagtgagtctttgaagtcactatgtctcaagctgttgctttgcctagtcactgtaaccgacaacatctctcagaacacaatcttagaatacgtaatgataaactcaattttcgaggcaatcctgcagattttgtcacaccctccatcacggagggagcatggctacgacgccgtggtgctgctcgccctgctggtaaactaccgaaagtatgaatctgtcaatccatatattgtgaagcttagtatcgttgatgacgaggccaccctgaatgggatgggattagtaatcgctcaggcgctcagtgagtacaatcgccagtacaaagacaaggaagaagagcaccagtccggcttcttcagtgccctaaccaatatggtcggcagcatgtttattgcggacgcgcacgagaaaatctcggttcagaccaacgaggccatcctgctggctctgtatgaggccgtgcacctgaatcgtaactttataaccgtcttggctcagtctcaccctgaaatgggtcttgtgacaacccctgtgtcccccgcacccactacacccgtgactccactcgggacaaccccaccaagcagtgacgtgatctcctccgttgagctcccactggacgccgatgtccagacttcaaacctattgattactttcttaaagtactcatccatagttatgcaggataccaaggacgagcatcgtttacactctggaaaactgtgcctgatcatcttaacatgcatcgccgaggaccaatacgcgaatgcctttctgcacgatgataacatgaattttagggtcaatctccaccgcatgcccatgagacacagaaagaaagccgctgacaagaacctgccctgtaggccgctcgtctgcgccgtcctggacttgatggttgagtttatcgtaacgcatatgatgaaagagttcccaatggacctgtatattaggtgtattcaggtcgtgcataagctcctgtgttaccaaaaaaagtgcagggtaaggctccactatacttggcgcgagttgtggagtgcattgattaatctgctgaagtttctcatgtccaacgagactgtactgttagctaagcataatatctttacattagctctcatgatagtcaacttgtttaacatgttcattacctatggggatacatttttacccactccctcatcctatgacgagctgtactacgaaattatacggatgcatcaatccttcgataatctttactctatggttctgagactgtccactaatgctggacagtggaaggaggcagcaagtaaagtcactcacgccctagtaaatatccgcgctattataaatcacttcaaccctaaaatagagagctatgccgctgtgaatcacatttctcagctctctgaggagcaagtgctcgaggtcgtgagagcgaattacgataccctgactttgaaactccaggacggcctggatcagtacgaacgctattcagagcagcacaaggaggcagcatttttcaaagaactcgtgcgaagtatatcaaccaatgtgaggaggaacctcgcatttcatactctttctcaggaggtcctcctcaaggagttctctaccatttcctag

SEQ ID NO: 49068 - DNA, 285 bp, Artificial Sequence
  Description of Artificial Sequence: Synthetic coding sequence
agcgtcgagctcccactggacgcggacgttcagacgagcaatctccttattacgttcctgaagtatagtagcatcgtgatgcaggacactaaagacgagcaccggcttcatagcgggaagctctgccttataatactaacctgcattgcagagcccatgcggcaccggaaaaaggcggctgataaaaatctcccatgccgcccacttgtgtgcgctgtgctagatctcatggtggaatttattgttacccacatgatgaaggagttcccaatggacttgtactag

SEQ ID NO: 49069 - DNA, 240 bp, Artificial Sequence
  Description of Artificial Sequence: Synthetic coding sequence
atggaactcgaggcaatgagcaggtacacgagtcctgtcaacccagcggtatttccgcatctcacagtcgtacttctggctatcggcatgttctttaccgcctggttttttgtgtacgaggttacctccaccaaatacactcgagatatctataaggaattgctcatctccctggtcgccagcttattcatggggttcggagtgctgtttctccttctgtgggtcggcatctacgtatag

SEQ ID NO: 49070 - DNA, 240 bp, Artificial Sequence
  Description of Artificial Sequence: Synthetic coding sequence
atggagcttgaagccatgtccagatacaccagcccggtgaatcccgctgtgttccctcacttgactgttgtgcttctggcaatcgggatgtttttcaccgcctggttctttgtttatgaggtgacaagtactaagtacacccgggatatttataaggagttgctcatttccttggtcgctagcctgtttatgggatttggagtcctgttcctgctgctgtgggttggaatctatgtgtag

SEQ ID NO: 49071 - DNA, 2349 bp, Artificial Sequence
  Description of Artificial Sequence: Synthetic coding sequence
atggcagcagcagctgctgcgggtccttcaccaggttccggccctggcgattcccctgaggggcctgaaggggaggctcccgagcggaggcgcaaggcacatggaatgctgaagttatactatggtctgtccgagggggaggcagccggacggccagccggaccagaccccttggaccctacagatctgaacggggctcactttgaccctgaggtgtatctcgataaactgaggagggagtgcccacttgcccaattaatggattccgagacagacatggtccgtcagatcagagcactagattctgacatgcaaacactcgtgtatgagaactacaacaagttcataagcgctacggatacgatcagaaagatgaagaacgacttccgaaagatggaggacgagatggaccgcctggctaccaatatggcagttattactgatttctctgccagaatctctgccacattacaggaccgccacgaacgaattacgaagctcgcaggagtccatgcactgcttcgtaaactccaattcttgtttgaactgccctctcgacttacaaagtgcgttgagctgggggcatatggacaggccgtccgctaccagggacgggctcaggcagttctccagcaataccagcacctgccgtcctttcgggctattcaggatgactgtcaggtgataacagctcgtctcgcacaacagttaagacagcgattcagagagggaggctccggggctccagagcaggctgaatgcgtcgagctgctgcttgccttaggggaaccagcggaggaattgtgtgaagaatttctcgcacacgccagagggaggctcgagaaagaactgcggaatcttgaagcggagctggggccttcaccacccgcaccagacgttctggagttcacagatcacggcggatccgggttcgttggcggactgtgccaggttgccgcagcatatcaggagctatttgccgctcagggccctgcaggtgctgagaagttagcagcgtttgccagacaactgggaagccgctactttgccctcgtcgaacgtcgactggcccaggaacagggaggcggagataacagtctgctggtgcgggcactggatcgctttcaccgacgactgagggccccaggggctttgcttgctgctgccggattggcagatgctgctaccgagatcgtggagcgtgtagccagagagaggcttggacatcatctgcagggccttagagccgcttttctcggatgtctgactgacgtgaggcaggctctggccgctccccgagtagccggaaaggaggggccaggccttgctgagctgttggctaacgttgcaagctcaattctgtcacacatcaaggcatctctcgcggcagtgcatctttttaccgcaaaagaggtgtcattttcaaacaaaccttacttccgcggagagttttgtagccagggcgtgagggagggtctcatcgtggggttcgtccacagtatgtgccaaaccgctcagtccttttgtgactcccctggcgagaagggtggggcaacaccccctgccttactcctcttactcagcaggctctgcctcgactacgaaacagccaccatctcgtatatcctgacattgacagacgagcagttcctagtccaggaccaatttccagtaacccccgtcagcactctttgtgccgaggcccgtgagaccgcacggagactgctgacacattatgtgaaggtacagggactagttatttcgcagatgttaaggaaaagcgtggagaccagggactggttgagcactctggagccgagaaacgtgagagctgtgatgaagagggttgtggaggatacaacagctatcgatgtgcaagtcgggctcttgtatgaagaaggagtgcgtaaagctcagagctccgatagcagcaagcgcacattctccgtatactcctcctctcgccagcagggtcgatacgccccatcatacacacctagcgcgcctatggatactaaccttctgtccaatatccaaaagttgttcagtgaacgtattgacgtgttctcccctgtcgaatttaataaagtctcggtgctaaccgggattattaaaatcagcctcaaaactctcttggaatgcgtgcgacttcgcactttcgggagattcgggttacagcaggtgcaagtcgactgtcactttttgcagttatacctgtggcggttcgtagccgacgaagagttagtgcacctcttactggacgaagtggtggcaagcgccgcattacgttgcccggaccctgtccctatggaaccctccgtcgtcgaggttatatgtgagagagggtag

SEQ ID NO: 49072 - DNA, 594 bp, Artificial Sequence
  Description of Artificial Sequence: Synthetic coding sequence
atgagcgcccgagccccaaaagagttgcggttagccctgcctccctgcctgcttaatcgcaccttcgcctcccccaatgcctcgggttctggtaataccggggctcgagggccaggtgcggtcggcagcggcacatgtatcacccaagttgggcagcagcttttccaatcgttctcctccactttggttctgatcgtactggttaccttgatcttttgcttgattgtgttaagcttgtcaactttccatatccataagcgcagaatgaaaaaacgcaaaatgcagcgggcacaggaagagtacgagagggatcactgtagtggttcacgcggaggaggaggactgccacgcccaggccgtcaagcccctacccacgcaaaggagaccagactcgagaggcagcctagagacagtcccttctgtgctccgtccaatgcttcgtctttatcgtcatcaagccctgggcttccttgccaggggccttgcgctccaccccctccgcctcccgcatcctccccgcagggggctcacgccgcttcctcctgtcttgacactgcgggtgaaggcctcctgcagactgttgtgttgagctag

SEQ ID NO: 49073 - DNA, 1131 bp, Artificial Sequence
  Description of Artificial Sequence: Synthetic coding sequence
atgggccaccagtttctgcgtggcttgttgactctgttgctgccccctccaccattgtacactaggcaccgtatgcttgggccagaatccgtcccccctccgaagcgaagcagaagcaaattaatggccccaccacggattgggactcacaatgggacatttcattgtgacgaggcactagcctgcgccctccttcgtctgctccccgagtaccgggatgccgaaatagtgaggacccgcgaccctgaaaagttggctagttgcgacattgtagtcgacgttgggggtgagtatgatcccagacgtcacaggtacgaccaccaccaacgctccttcacagaaacaatgtcctccctgtcgcctggaaaaccgtggcagactaaactcagctccgctggactgatttacctccacttcggtcataaactgctggcccagctcctcggtacaagcgaagaggattccatggtggggacactttacgacaaaatgtacgagaatttcgtagaggaggtagacgcggtggataatggcatttcccaatgggctgaaggcgaacctcgctatgctttgaccacaactctgtctgcgagagtggctagactaaaccctacgtggaaccaccccgatcaagacacggaggcaggattcaaacgcgctatggatcttgtgcaggaagaatttcttcagagactcgatttctaccaacatagttggctgcctgcacgcgctcttgttgaagaggcactcgctcagcgtttccaagtggatccttccggagaaattgtggaacttgcaaaaggagcgtgtccatggaaagagcacttataccatttagagagtggtttgtcaccacccgtcgctattttttttgtgatatacaccgaccaggcaggacaatggcgcatccagtgtgtgccaaaagagccacatagttttcagagccgactgcctctcccagagccctggcgcggtctgagggatgaggctttggaccaggtttcagggattccaggttgtatcttcgtgcacgcaagtggctttactggagggcatcatactagagagggcgctttatctatggcacgagccaccctcgcgcagagaagctacctgccccagattagttag

SEQ ID NO: 49074 - DNA, 978 bp, Artificial Sequence
  Description of Artificial Sequence: Synthetic coding sequence
atgggtcaccagttccttaggggcctgctgacactgcttctacctccccctccgctgtatacacggcataggatgcttggccctgagtccgtgcctccaccaaaacggagccgctctaaactgatggcacctccacgcataggaacacacaacggcaccttccactgcgatgaggctttagcttgcgcgctgctgaggttactgccggagtaccgagacgccgagattgtgcggacccgcgaccccgagaagctggctagctgcgatatcgtggtggatgtagggggagagtacgatcctagacggcaccgatacgaccaccatcagagatcctttacagaaacaatgagttcactcagccccggaaaaccttggcaaaccaagttaagcagcgcagggcttatttatctccacttcggccataagctcctcgctcaactgcttggcacatctgaggaggattcaatggtaggcacactctacgataaagctgggttcaaacgtgcaatggatctggtccaggaagaattcctgcagagactggatttttatcagcactcatggctgccagccagggcactggtcgaggaggccctcgcacagcggttccaggtagatccatcaggcgaaatcgtggagcttgcgaagggcgcatgtccctggaaggagcacctgtatcaccttgaatctggactttccccgccagtggccatattcttcgtcatctatacagaccaggctggccagtggcgcatccagtgcgtgcccaaagagccacacagctttcagtctcgactgcccttacccgagccctggcgcggtctcagagatgaggccctcgatcaagtcagcggaattcctggctgtattttcgtccatgctagcggattcaccgggggacatcacaccagagagggcgcactgtcaatggccagggccaccctcgcccagcgttcgtatttgccccagatctcttag

SEQ ID NO: 49075 - DNA, 351 bp, Artificial Sequence
  Description of Artificial Sequence: Synthetic coding sequence
atgaatcagactgataagaaccagcaagaaattcccagctacctgaacgacgagcctcccgagggatcaatgaaagaccaccctcaacagcagcctgggatgcttagtagagtgacaggcggtatattctctgtcactaagggagccgtgggggctaccattggaggagtggcttggatcggcggaaaatcgctggaggttaccaaaactgctgtcacaacggtcccctctatgggtattgggctggtcaaagggggtgtgtcagcagtcgctggtggagtcacggctgtcgggtccgcagtcgtcaacaaggtgccactgactggcaaaaaaaaagacaagagcgactag

SEQ ID NO: 49076 - DNA, 351 bp, Artificial Sequence
  Description of Artificial Sequence: Synthetic coding sequence
atgaatcaaacagacaaaaaccaacaggaaatccccagctatctcaacgacgaaccccctgaaggctctatgaaagatcacccccagcagcagccaggtatgctgagcagggtgactggcggtatcttttctgtcaccaaaggcgctgtaggtgctaccataggcggtgtagcatggattggtggtaaatcattggaggtcacaaagaccgctgttaccaccgtgccttcgatgggcatcggcctagttaaaggaggcgtgagcgcggtggcaggcggagtgactgccgtggggagcgcagtagtgaacaaagtccccctcacgggtaagaaaaaggataaaagtgactag

SEQ ID NO: 49077 - DNA, 351 bp, Artificial Sequence
  Description of Artificial Sequence: Synthetic coding sequence
atgaaccagacagacaagaatcagcaagagataccttcttacttgaacgacgagccgccagagggctctatgaaagaccacccacagcaacagccaggaatgctttccagagtcaccgggggtattttctcagtgactaagggggctgtgggagccaccatcggaggtgtggcttggattggtggcaaatccctggaggtgacaaaaaccgccgtgacaaccgtgccaagtatgggaatcggacttgtaaaggggggagtttcagcagtggccggaggggtaaccgctgtgggcagcgcggtggtgaacaaggtcccactgacagggaagaagaaagacaaatctgattag

SEQ ID NO: 49078 - DNA, 351 bp, Artificial Sequence
  Description of Artificial Sequence: Synthetic coding sequence
atgaaccaaaccgacaaaaaccaacaggagatcccttcttatctcaatgatgagccccctgaagggtctatgaaggaccatccacagcagcaacccggtatgcttagcagggttaccggtggaattttctccgttacgaaaggagccgtgggggcaacaataggtggggtcgcctggatcggcggtaagtcattggaggtgaccaagacagccgtcacgaccgttccctcgatgggcatcgggctcgtgaaaggtggtgtctctgcagtggccggtggcgttactgctgtgggcagcgccgttgtgaataaagtgccacttaccgggaaaaagaaggataagtccgactag

SEQ ID NO: 49079 - DNA, 351 bp, Artificial Sequence
  Description of Artificial Sequence: Synthetic coding sequence
atgaaccagactgacaagaatcagcaagaaataccaagctaccttaacgatgaacctcccgaaggatccatgaaggaccacccccaacagcagccgggtatgctcagcagggtcacagggggaatcttttcggtgaccaaaggcgctgtgggggctacaatcgggggagtagcctggatcgggggaaaatccttagaagtcactaagacggctgtgactacagtgcccagcatgggaatcgggctcgttaaaggcggagtcagtgcagtggccggtggcgtgactgccgtggggtccgccgttgtaaacaaagtccctttaacaggaaagaaaaaagacaaatcagactag

SEQ ID NO: 49080 - DNA, 351 bp, Artificial Sequence
  Description of Artificial Sequence: Synthetic coding sequence
atgaaccagaccgataaaaaccagcaggagatcccctcctatttgaatgatgaacccccagaagggtcaatgaaggatcatcctcagcagcaaccaggcatgctttccagagtgaccggcggtatattcagcgttacaaagggggctgtgggagcaaccatcggcggagtggcctggataggcggaaagtctttggaagtgacaaagacagctgtgaccacggtcccatctatggggatcggactcgttaagggtggagtgtccgctgtggcagggggtgtgactgcagtgggctcagctgtcgtgaacaaagtgcccctcactggaaaaaaaaaggacaagtcagactag

SEQ ID NO: 49081 - DNA, 12741 bp, Artificial Sequence
  Description of Artificial Sequence: Synthetic coding sequence
atgggacttctcctcgtctttcctctcattcaatcccagtccaggacagatccctctctctgcaatatcaccgctgaggtcttgctgaattgcttgcgagactgtcagcccttatcactgacgaaagagccagccgattgcctgaatggaatcgagacactgctgtgttcctggttagaggagaccagcgacaccggacgacacatcccccataaacagaaggagaatgccgctgctgcacttgtcgccttggcctgcgctcgaggtagcctaaagactttcgtccacaccgttcatctgttacaaaagcagacagaccttggtagtttaccagttgcggatgtactgtataggctgcttttgctggagggcggacctggctctccttcttgtctgctggggggaaaacatatcgtgagctggggatatgaagatatgctgccagcacccgactcaaacacaggatccagcagcgagaataaggatgcagaccttggacgctgcctaacagcagacggactgtacctgtataccacaaattctgtaggccgaggagtaagcaagctgggcagcggactacatgggactcttaggggttttgtctactgtcggaatgaagagctcgaacccggatgggtggcatttggtagtggctccctgctgcaccgacctgtttcttttgataacaaacctcactcactattccaagtcatagaccaaaacaccttgcaggtgtgccaggtggtgccaatgcccgcaaaccaccttcctattgggagcacaatgtcaaccgtgcatttgagttccgacgggacctatttttattggatctggtcaccagcatcactgaatgagaagacaccgaagggccactccgtgttcatggatatctttgaattggtggtcgagaatggtgtcttcgtggcaaacccactccaagagcgcaccattctcatgagaaaggagggggagagcgccaaaagtatcaacgagatgctcctcagccgcttatctagatatagggcctcaccgagtgccacactggccgcactgacagggtccactatcagcaacacactgaaggaggaccaggccgcaaacacaagctgtgggctgcctctaaagatgttgaggaagacgcccatttacacgtgtgggacctacctagtgatgctggtccctccaccaggcggatctggctcaagcgcgacacgttcactcttcggagggacgtcgggcttgagctccttgaagagagcttgctacgataccgttaataatatgctgtggacttgctcaaacgactacatagatcagtggtgcaacccaggaaaccaggctttccattatgtctgccagagactgggggtgtctcatatcattacagaacctaaggaggaggccatcacaacaaacgaagtgataaatcagcttcttcaccacgttggcgctatgtgcatccaccagctgaacctcctcgcaacaaatcccaaccttccaatcacttctgtgcttgggaaacagcatcctattgaagcccatcacctaagcagtatttgtgacattatggaaaaagccatggttaacggggacacatgcatcatccggtgtattctagtggtcttccaagtagtcttcaagttctttttttcccctcagacagagagaaacagggacatcatccggagatctggccttctcctctggcaattgctgatggcacccaaggatcagatttgtccagaaattcaaaaagaagtgtgcctggccatttcctcaggactgaacatactttaccctggtgaaacagaaataaacaacttactgaaactggtgctgactgagggcgaacggaactccggtctcagtcagctcagagacgtgatcctgacgaatctggcggagcagcttcagaataatagattcggatcagatgaagatgatcactatcgcctcaacgacgaactgctgcactacattcttaaaatcgttgtgagagaatcctgtatccttattactaagtgccagaccgtatctaaggacgattttcaaaagctcctaagtaccgttcccgcagcttcaagttgcctcaggtatctcatggctgtccagaaccatcttctatccaacactatccttatcaaaccagacgagaacgatgactcagatagctctctacaaggagagaccctcaaggtgcaggaacttaaggtcagtatcctggctctcgcaactcagatcctgacaggctgtgacgaggtgctggaaatgttacaacaagtgacaaccgcgctgatcaactctgatatcgccgaccgtgagcagcgcctgaagggattagagcaggtcaccaaagcaactatgcttggccatttactgcctgtgctgcttaccagtctcatgcaccctaatctccagactcttatcatggccgacgctctgatgccacaacttgtgcagttggtgctgtacaccagccagactgccctgctcctcaagactcaatgtcccgtttttgccgaagtcggttgctccccttgcggcgcaccagaccagaagtgcaggctgttccccgatgagaggatgctggaagaaaaagaagagcccggatttctgacaggactgaaaattcctgccccttgggccgctggcaaaacagttgaaaccgttcaccctgtaagggacaactacaaattcaaggaaaccgtgcacatccctggcgctcggtgtctatacctccgctttgattctaggtgttcaagccagtacgactatgacaagctggtcatttatgccggtccaaatactaactccaggaaagttgccgagtatggaggaaacaccctcggctatggatcccgatcagtgctgggtaccgggtggccaaaggatcttgtgaaatgcatcagccctccatctttaaatttcaaggtggagggagacacagtcaccttttcgttcgagatgcgttccggaagagagcacaatacgcccgacaaggctatgtggggcttcgcctgtacagtgcgcgcacaagaatcttctgaagacgtcagcggagggttgccattcctggtggatctcgcccttgggttaagtgtactggcctgttccatgctgaggatactctacaacggaccggaaattactaaagaggaggaagcctgtcaggaactgcttcgatcaaaactcctgcagcgatgccagtggcaggtagaggctaacggggttatcagccccgcactgacccctagtcctagcccactccctttaactatcgaggaggatagagaattcacctacccctcagatgtgctggtacctcccgtgggaaactacttcgacctgcctagaattaggctccctccgggaattatgataaagctgcgcgaaatctccggacgagcccgtccacagttccgcccttctatcaaagaggtgattcaacccgacgtgatggaggagatggtagtgtcctgcgtgatcaagcatctgaacctcgtggacgcacttcagtcgcttatcaatttccagtaccaggaagagcacgccgaggaatacgacttgctgtgcaagataatgggcgaaaccttcaagaaacttaacgccatggagcggcagctgcagtcagtggcggagctggagcagaaatggcaatctgaggtggacgatgccatgcaggggaaactagagaataacatgcccttcttttacgactatcattttaacgaaaataagatgaaggaactagaattactttgttctatgaaggaggtaagtttcgacggcaatgatctggagaatatggtgctgagcctgcgggaaaaatttctccaagaggtgaactccctgattcagaagccaagtcatcccttggcgaagacaaaaaccttagtcaagagcctgatgaacagagccgaactgctcctccatgttactattgccgcacagtctgggctgacgcgatcaatctctgggacgcctgcagaaacaccggcttgtaagtctgcctccgaaacgaaggtgatttcccatgctgtccgccagcctgtgttcttaagaagcatgtcggccccatccgatctcgagatgataggcaatgaagatctagaatttacacgtgctaatcagagacggcgacacgtaacttctcacagatccagttcatttaccctgcttcaaagcctggcaattgaagacagcagggacaaaccaacttattcggtgctcctgggtcaactgttcgcgtttattggtacgaaccccgatcaggctgtgtcgtcatcctcatttctgttagccgctcagacgagatggagacgcggaaatacacggaagcaggcattggtgcacatgcgggaactgctaaccgccgctgtgagggtcggcggagtcacacacctggtgggccctgtcaccatggtgctgcagggcggtccaaggatcgaggagttgacatgtggagggatggtagaacaggttcaagaggcctttggcgagacaatgacatccgtggtttccctgtgcgctcgatacccaatcgcctgtgcgaactcaattggactgctttgtacaattccttacacgcgtagtgaagagaaatgcttggtgaggtccggtctagtccagttaatggacagactgtgtagcctcagtaaccagactgaaagctcatcctccgaaaagcagaccaagaaacagaaggtagccacaatggcttgggcagcattccaagtgctcgccaaccggtgcgtcgagtgggagaaagaggagggaggcagtacagaagccgtgcatagtggtcttgccagacaggtgagctctctactgaccaatcatctggctcgcgctacggagtgctgtgggaaccaagccgcagggaacgacgctctccaagacgttttgagtctgttaaatgacctgtctaggtcccacatcggaaaagcaatcctgtcgcaacctgcatgcgtgtccaaacttctgtctttgctcttagaccagagaccatccccaaagcttgtcctgattatcctgcagctctgccgggctgcgctccctctgatgtctgtggaagactgcggaaacgtggaattgcccccttggagctactcagtaccatcactcaattctgagcaagaggacccgtctgatcccgcatccaagatcgcaagcttactgttggccaagctggccgactatgtcgtgcccggatgtcagacggtgctgtccccgactgcaagtgaaccagatactacactcacaaagacatcacccaagaattctctcaaaggagataaggatccgggagaggaaagtgaggcagttgacggtaagctgtccatatttattcataagagagaggaccaatcctcacacgaggtcctacagcccctactctcgagcagcgagggaagaccattccgcctgggcactggagccaacatggagaaggtcgtaaagatggatcgggatatgactaaaggcggatgctgtgaagtaatcaccgaagaagcagcggcagccctccggaaagccacgaagtgggcacagtctgggctgattgtgtcaattggccctcccgttgaatccattaatccagaaacagtcagcggcctgtccactggagacaagaaaaagacagcgcagacttcaatctgcagagagagaaattctgaattggccagaaccgacccagtccgaccattcatatccgggcacgtggcaaactccatggccgcagaggtgatcgcgctcctgcactccctactgatggctccggaatccaacgccgctcaaatctggacaacaacggctgaaaaggtgctctcccgggctctgatgtacatcccacagctcgggaaatatgccgagagcattctcgaaaatgggagctcttctggtcgaaaattagccaaactgcagcgtatcgcaagacaagccgtcgccgcactgtgtgccttagggggtttcaaggagaccatcaaaatcgggtccgaggtacaggtactcgggcgaggaatttctggttccatcggtgtcgtggcgtctatcaacgaacaggaaggaattgccaccgtccgatttccacccatagactgtcgtaagacatcacaggctagtgacactctgacaatcccgctgtcgcgcctgtgcgtgcctcggtcggaagcactgccgctacataaactgtctatcactgaaaaagtggtccaggccgtgcagagcatgttattgccacaggaaggttctttgtccatccataccagcttaccagctaccggagacggctcagcacctgtgatggcggttgtgcgcttgctggccgaaatcaggacacgagcttgcctagtgatggctcagctgctggaggattcattgttctgtgaggaatttattcagcagtgtcctgcagcggtagaagtgctgaacctggttgcgcaggaatgcagcgccggagagagactggccgtggtcgaagtccagtgcgagagattaagaatgctctaccgcgactgtgccagaccccctccccctcccctgcaggcagacaggcgtcagcccaaggaaatcacctggtcccccagccgcgtcttcccacccgtgcgagcatgcatgttttcctcccaccttacctcagtgacattcctggcggacccgagcgccggaggaggcctgcccagaggtacctttatttacgcaacctcacctctgccagtccaggctcctagcttttattgggagattgaaatagtcagctacggtgacacagacgacgatacaggccctattgtctctttcgggttcactacagaagccgaaaagcgcgacggtgcgtggactaacccggtcggtacctgtctgtttcacaacaacggtcgggcagtacactacaacggttcttcactgctgcagtggaagtcggttcgtctggatgtcactctgtctcccggagacgtggcaggtatcgggtgggagcgcaccgaaggcacacctcctccccctggccagccagccaagggtcgagtatatttcacctactgcggacagagacttagcccctatctggaagacgtctccgggggaatgtggcctgtggtacacattcagaaaaagaacacaaagactcgcgctaactttggaagccgaccttttgcttatgcagagggccaggcccatcgcaacgccgctgacctctgtactgatctagccgaggagatcagcgccaacttcgaggcactcccctttgccatggcgtcagactccgacaacgatgctgggacctccatcgcctctgatccaggcacacacggcccaccctgcaggatcgccgctgttgcaactgcccaacagcagtatgattccgacaccagctgtcactataaagtggaactcagctacgagaattttattaccagtggacccgaccctcacccccctcccattgccgacgacgaaagtgacgatgacgatgacgacgacattccacaggaggatcattacgctcttctggttaaagcatgggaaaccaaagtttttccaaccattagaagacgctttcggaatgaggcagaacgtaagtccgggctcgaccagattaaaggggctcttcaactaggtatggtggatattgccaggcagaccgtcgaattcctatacgaggagaatgggggaatcccgagggatctgtatttaccaaccatcgaggacatcaaagatgaagccaacaagtttaccatagacaaggtgcggaaggggcttaccgtggtaaccaggagcccagactcaaacaatgtggcgagctccgctgtgggtaccgcactacccaagtttgcaatcagagggatgctgaagacatttgggctgcacggggtggtcttagacgtggactctgtgaacgagttggttcaggtggaaacctacctcagatcggaaggggtgcttgtccgatattggtaccccattgacatgcttgagaggccaccagccggatacaggagaaccgccacaaacggattggtgactttagacaacaccaacctgcagatccacagggagctgttgcgttgcgaagccgcactcgcgaggctgtattgccgcatggccctactcaatattttcgcgccaaagctcccccacttgttcacgagattgtttcatattcctgcgatccgagatatcaccctcgagcatctccaattgctttcaaatcaactcctagcacctccgctgccagatggcaccataagttcctcctctatcctactggctcagtctcttcagcattgtatacatagtcaaaactgcagcgcaaccgatttattttatcaggggaattcacagacagtgagagagtggcttaacgtggcgatcactaggactctgcaccaaggagaagaatccctcctggaactgactaagcagatttgttccttcctacagacagcacctgaacagtttccctctgaggaattcccgatctcagagtcgaaggtaaacatggacgtgaatttcccaggtgcggcattcgtggtggtgtcttgtaaggaatcgcagagtggttttcggaaggatagctctctttacaaggcaccttgggcacgcgtgctcgtgtatggcctggggcataaagtgaagaggaacggccaactaaaccttattgaggctgcttgctatcctagagacgcctctcccgctaatacgggtctggctccccctccaacagctgatcaatacccctcagttgtcctatcaaccgacagagtccacataaagttgggtgtaagcccgcctccaggcgcagtgctggttctgcattcactccccctggaattcccactggcaatggcttttgccgaacagttactgagctggaagtcagaggatagcgaggggaaaagcgaggacgagccagacactatcccaacctccgtgttactgcaggtggtagagttattagggaatttcctgtggactactgatatggcggcttgcgtgaaagaactggtgttccatctactggcagagctgctccgcaccgtccatactttagagcagcggagacatcctgcaggattgtccagctccattgccctgcaacttaatccatgtctggcaatgcttatggccctccagagcgaactccacaagttgtacgatgaggagacgcaaaattgggtatctggcggagcctgtgggggatctggcggagcagcagccggagaccaggggagattttcaacatacttccacgccttgatggaagggtgtttggccgtagctgaggtgactctcccaacgaacatgtctgtgacagcgagtggtgtgacatcagctaccgcaccaaacctctctgatagttctagctcctccagctcttcacccggacagacgcctcagtctccgtcacttcttagtaagcgcaaaaaggtcaaaatgaagcgggagaaggcctcttccagcggaaagcgccaaagctcccggacggtagacagtgatccaaccgttctgagcatcgggggatcgaaacctgaggacatgctctggttccatcgggcactaactctattgatcatcctcaggcacctgaccaggaaggatccccaagggttaggagtaacgtctgatgctattgctgatgcttgccaggcactggtgggcccaacagcccacagccggctgctcgtgatctcagggatacctactcatttggatgaaggggtcgtgaggggtgctattaggaaggcatgtaacgcccatggcggagtcttcaaagacgagatatatatccccctgcaagaagaggataccaagaagcctaaagacaaggcagagggcggagacggcaaagtcgagcccgaaaaaaccttagcctttcccggaactgatagcatggaggtatccacctcttccagtttaactcctgcaatgtctattagcgcctccgcttccacgagtcaagcctctatatgttccagccagggcatctcccaaactgtgtcggacctgtccgtggacccactgccagctggtttggagctgcccattcctcccggactgctggaaccccacgcagtcagctctcaggagtcattggacatctctctgtgctccactggcagtctgggctccctgggctctctgggcgagcccttggataacgctgagacagcctccgtctcagatatgggctccatgtatactgtcactagtttggacaatcaaccacttgccgcacgcccaataaaggggttcgccgtggttgagattaggtctagagcaaagatagaaaagatccgtgccagccttttcaacaacaatgacttaatagggctaagctctctcgacggggaggacgaactgatggagatgtccacagaagagattcttacagtatccgtggttaatcagtccctttttgatactcaaggatcccccggtcttgaggactatttcaatgataagagcatcaagggtgagaagttggtacccggagctagagaagtcctgaccgaaatcttcaaatcctgcgcccactccgagcaaaccctgtctctgacacccgcaaaaccaatcagagttagcgatatttatttaagcaaagaacagatcaacagtcagactccgggaaaccttttgcatctgttttttacaaatgtgcggccaccgaagaaagtcctggaagatcagctaactcagatcctgcgtaaatacggtgtgcccaagcccaagtttgacaaatccaaatacagcaaagctggaaaggagcaacatccggtgaaagtggtgtcaaccaaacgccctatcactaaacctcctgctaaagacaaggctgtgctaaactctgtgtctcggaccgctctgagcgagaagaagcctactgtgaaacctaaaagcccagagaagtccaaaccagatgagaaggaccccgagaagagtccaacaaagaaacaggaagtgccggaagagaagtatctgacgttagagggttttcacaaattcgtgatcgatcgagctcgccaggatatccgcagtgtctggagagccattctctcgtgcggctatgacctacacttcgaacgttgcgcttgcatcgatgtccggcacgcgcagaaagcctctcgcaaatggacattggagatggacgtggctctggtgcagtatatcaaccaactatgccgacacttagctatcacccccgctcgactgcacccacacgaggtctacctggacccagccgacgccgctgatccccgagtcgcatgcctcctcaacgtgcccatcgagtctctgcgcttgcgcttcgccctgcttcagtccctcaacactaccttggagacattctttttgccactggtcgagctgagacagactcctatgtatacacactccattgccgctctcttgaaggaggctaaggggctcatattctacgatactaaagtgaccgtgatgaacagggttttgaatgccactgtccagaggacggccgaccacgccgctcccgagatcactcttgatccgctggagattgtgggcggtgagatacgggcatccgaaaacagctatttttgccaggcggcacgccaactcgccagtgtgcccagtagtcagctttgtgtaaaattggcttccgggggagaccctacttacgcctttaatattcggtttaccggcgaagaggtgcacggcacctccggcagcttccggcactttctgtggcaggtttgtaaagagctccagtcctcatcattgtcactgttgctcctctgcccgagcagcgccgtgaataagaacaagggcaaatacattctgacaccatccccgatcacgtacggggaagagcagctcctccacttcctcggccagctcttgggtatcgctatacgggcagatgtgccattacctctggatctcttgccttcattttggaaaactctggtgggcgaacccctcgaccctgagcaggacctgcaggaggccgacatcctgacatacaactacgtaaaaaaattcgaatccatcaatgacgagactgaactggaagctctgtgtgccgagatcgcttctcaacatcttgctactgaaagccctgatagtcccaataaaccttgctgtaggtttacctacttgaccatgaccggcgaggaggtcgaactttgtagcagagggcgtcacattctagttgcttgggagaataaagacatatacgctgctgccataagatctctcagactgagggaacttcagaacgtggaatgcgtgaccgcggttagagcaggcttgggatcaatcatcccgctgcagctgctaacaatgttgtcccctctagaaatggaattgaggacttgcgggctgccctatataaatctggaattcctgaaagcacatacaatgtaccaggtggggctgatggagacggatcaacacatcgagtttttctggggagctcttgagatgtttactcaagaggagttgtgtaaattcatcaagttcgcatgcaaccaggaaagaataccattcacgtgcccctgtaaggacggaggacccgatacagcccatgtgcccccatatcccatgaagattgcccctcccgacgggactgcgggaagtccagactcccgctatattagagtggaaacctgtatgtttatgataaaacttccacagtattcctcactcgagattatgttagagaagctcagatgcgcaattcactatagggaagaccccctgtccggctac

SEQ ID NO: 49082 - DNA, 11990 bp, Artificial Sequence
  Description of Artificial Sequence: Synthetic coding sequence
atgcctgccaatcacttgcctataggaagcactatgtctactgtccacctctcgtccgatggaacctatttctattggatatggagccccgctagcctgaatgagaagacgccgaagggccatagcgtgtttatggacattttcgaactggtcgttgaaaatggtgtcttcgttgccaaccccttacaggaaaggactattttaatgaggaaagaaggcgaaagcgccaaaagcatcaacgagatgctgctgtcacgtctgagtcggtatagggcatcacccagtgcaacattggcagccttgaccggcagtaccatcagcaacaccctgaaagaggatcaggcagctaatacttcttgcggcctgccactcaaaatgctacgaaaaacaccgatctacacttgcggcacctacctggtgatgcttgtgccaccaccaggtggatccggaagttctgccacaagatcactatttgggggtacaagcgggctgagctccctcaagagagcttgttatgatactgtcaacaatatgctgtggacttgctctaacgattacattgaccaatggtgcaacccgggaaaccaggctttccactatgtgtgtcaacgcctgggcgttagccatattattacagagccgaaagaggaagccattaccactaacgaagtcatcaatcagctgctgcaccacgttggtgcaatgtgtatccaccagctgaatctgctcgcaactaatccaaacctcccgatcacgagcgttctggggaagcaacaccctatagaggctcaccatctctccagtatatgtgacatcatggaaaaagctatggtgaatggcgatacatgtattattaggtgcatcctggtggtgtttcaagtcgtgtttaagttcttcttcagcccacagaccgaaaggaacagggatatcatccgcagatccgggttactgctgtggcaacttcttatggcaccaaaggaccaaatatgccccgaaatacagaaagaggtgtgtctggccatttctagcggactgaatatcttgtatcctggtgagaccgagatcaacaaccttctcaaattggtgctgacggaaggtgaacggaactctggactctcccagctgcgcgatgtgattctcaccaacttggccgaacaactccagaacaatcgctttgggagcgacgaggatgaccattatcggctgaacgacgaactgttgcactacattttgaaaattgtggtgcgtgagtcctgtatactgataaccaagtgccagactgtgtccaaagacgactttcaaaagctgttgagtacagtgccagctgccagtagctgcctgcgctacttgatggccgtgcagaaccacctgctatctaatacaattctgattaaacccgatgaaaacgacgacagcgattcaagtctgcaaggggagactctgaaagtgcaggagctaaaagtgagcatcctggctctggctacccaaattctcaccgggtgcgacgaggtcctagagatgctgcagcaggttacaactgccttgatcaatagcgacatagcggatcgagaacaaagactcaaaggcttggaacaggtgacaaaggctaccatgttaggtcacctgctaccagtcttgctgaccagcctcatgcaccccaacctccagaccttgattatggcagatgctctcatgccccagctggtgcagctggttctgtatacttcacagactgccctgctgctgaagactcagtgcccggtgtttgccgaggtagggtgtagcccttgtggcgcacctgaccagaagtgcaggctgttcccagatgaaaggatgctggaagaaaaggaggaaccaggatttttaaccggtctgaaaatacccgctccatgggccgcaggtaagacagttgaaacagttcatccggtgcgcgacaactataaattcaaagagacggtgcacattccaggcgctaggtgcctgtacttgaggttcgacagccgatgttccagtcaatatgattatgacaaactggttatttacgcaggcccaaatactaacagtagaaaggtggctgagtatgggggaaacacattaggttacggctcgcgaagcgttctgggaactggctggccaaaagacctagtgaagtgcatttcgcctccaagcctgaattttaaggttgagggcgatactgtcaccttttcattcgagatgcggtcaggcagggaacataacaccccagataaggctatgtggggatttgcatgcacagtcagggctcaggagtcaagcgaagatgtctccgggggattgccatttcttgtggacctggctttggggctgtccgtgcttgcttgctctatgcttaggatcctatataacggcccagaaatcaccaaggaggaagaggcatgccaggaattgttgcgaagcaaacttctccagagatgtcaatggcaagttgaggcgaatggagttatcagccccgctctgaccccctctccaagtcccctgcctctgaccatcgaagaggaccgggagtttacttaccctagcgatgtcctggtcccccctgtgggtaactacttcgacctgccgaggatccggctgcccccagggatcatgataaaactgagagaaatttccgggagggcccgtccacagttcagaccctctatcaaggaagtcatccagccagacgtgatggaggagatggtcgttagctgtgtgatcaagcacctgaacctcgtggatgccttgcagagcctaataaacttccagtaccaggaagaacacgccgaggagtacgacctcctgtgtaaaatcatgggggagacctttaaaaaactgaatgcgatggagagacagttgcaatccgtggctgagttggagcaaaagtggcagagcgaagtcgatgacgccatgcagggaaagcttgaaaacaatatgcctttcttttacgactatcatttcaatgagaacaaaatgaaggaactcgagctgctgtgctccatgaaagaggtatccttcgacgggaacgatctggagaatatggtgctgtcactgagggagaaatttcttcaggaggttaacagtctcatccagaaacccagccatccacttgccaagacaaaaacactcgtgaagtctcttatgaaccgagcggagctccttctgcatgttactattgcggctcagtcagggctgacaagatccatctcaggtactccagctgaaacacctgcctgcaaatctgctagcgagacaaaagtgatttcccacgcggttaggcagcctgtgttcctccgtagtatgtcagcgccttccgacctcgagatgatcggcaacgaagatctagaatttacaagagctaatcagaggagacgccacgtaacatcacatcggtcatcttcattcacactgttacagtccctggcaattgaagattctcgagacaaacccacatattcagttttgcttgggcagctgtttgcctttattggtactaacccagaccaggctgtgtcttcctcatctttcctcctcgcagcccaaaccaggtggaggcgcggtaacacccgaaaacaggccctggtgcatatgcgggagcttctgactgccgctgtgcgcgtgggaggcgttacacaccttgtaggccctgtgaccatggtgctgcagggtggcccacggatcgaagagctaacctgtggcggtatggtagagcaggttcaggaggctttcggtgaaacaatgacaagcgtcgttagtctgtgtgccagataccccatcgcctgcgctaattcaataggcctgctttgtactattccctatacgagatcagaagaaaagtgtctagtgagaagcggtttggtgcagctgatggatcggctgtgttctcttagtaatcagaccgagtcatcctctagtgaaaagcaaacaaaaaagcaaaaagtggcgaccatggcctgggctgccttccaggtgctcgccaataggtgcgtcgaatgggaaaaggaggagggtggaagtacagaagcggttcacagcggactggcacgccaggtctcttccctgttaactaaccatctcgccagggcgacagaatgttgtggcaatcaagcagccggaaatgacgcacttcaagacgtcctctccctcctcaatgatctgtcacgttcacacatcggcaaggcaattctgagtcagcctgcctgtgtgtccaaactcctgagcctgctactcgaccagaggccttcacccaagcttgtgctcatcatcctccagctgtgtcgcgcagcactgcctctgatgtcagtcgaagactgcggaaatgtggagctgcccccatggtcatattcagtgcctagcctcaatagcgaacaggaggatcccagtgaccctgcctccaagattgcatctctgcttctcgccaaactcgctgactacgtggtgcctgggtgccagactgtcctgtcccccacagcgtctgagcccgataccaccctcacgaaaacatctccgaagaattctctgaaaggggacaaggatccgggtgaagagtctgaggccgtggatgggaaactcagcatctttatccacaagcgcgaggaccaaagtagtcacgaagtattgcagccactactctctagcagtgaagggaggccctttcgactggggacaggggctaatatggagaaggtcgtgaaaatggaccgagacatgactaagggaggctgctgcgaagtgatcacagaggaggcagcagccgcactgcgaaaagccactaaatgggcccagtccggcctgatcgtgtctattgggcctcctgtggaatcaataaaccccgaaacagtgagcggcttatcaacaggggacaagaagaagactgcccagacttccatctgtcgggaacgaaattccgaactggctcggaccgatcctgtccgtccttttatttccggacacgtggcaaacagcatggcagccgaggtgattgcactgctgcattcactcctcatggccccagagtccaatgctgcccagatctggacgactaccgcagagaaagtgctgtcgcgcgcattaatgtatatcccacaactgggcaagtacgctgagtccattctggagaacggctccagcagcgggaggaaactggccaaactacagcgcattgctagacaggcagtcgccgcactttgtgctctggggggtttcaaggagaccattaagatcggctcagaggtccaggtcctgggaaggggcatctcagggagcatcggggttgtggcatccattaacgagcaggagggcattgccacagttaggttccctccaattgactgtcgcaaaacatctcaggcctctgacacactcaccatccccctcagcagactttgcgtcccaaggtctgaggcgctccccctgcacaagctttcaatcactgagaaggtcgtccaggcagtgcagtccatgctgctgccccaagaaggctcactgagtatccacacgtcacttccggctaccggagatggaagcgcccctgtgatggcagtggtgaggctcctggccgagatccgaacccgagcctgtctcgtcatggcccagctattggaggacagtcttttctgtgaagaattcattcagcaatgtcctgccgcagtggaggtgctgaatctcgtagcacaggaatgcagcgccggagaacggctcgcggtggtcgaagtccagtgtgagaggctgagaatgttatacagggattgcgctaggccccctccccctccccttcaggccgaccgacgccagcccaaggagatcacttggtcccccagccgcgtattccctcctgtgcgcgcttgtatgttctcgagccatctgacaagcgtaacattcctggccgacccatcggcgggtggaggcctcccccgaggcactttcatttatgctacaagccctctgcccgtgcaggccccttcgttctattgggagattgaaattgtcagttacggagatactgatgacgacaccggccctattgtttcattcggatttaccaccgaggcagaaaaacgcgatggcgcatggaccaaccctgttggcacctgcctgttccacaacaacggccgtgctgtacactataacggatcttccttactccagtggaagtctgtcagactagacgtcacactgagtcctggggacgtagcagggataggctgggagcggacggagggtacaccccctccccctggtcagcccgctaaaggtagagtatacttcacatactgcggacagcgcctctctccttaccttgaggatgtgagcggcggtatgtggccagtcgtgcacatccagaagaagaatactaaaacaagggccaactttggctctaggcctttcgcctacgcggagggtcaagcacaccgcaacgcggcagacctttgcacagacctcgcggaggagattagcgccaatttcgaagcacttccgtttgcaatggcttccgactctgacaatgatgccggaacttcgatcgctagcgacccaggtacccatggccctccatgccggatcgctgccgtggctacagcccaacagcaatatgattcagatacatcgtgtcattacaaggtggaactgtcatatgaaaattttatcaccagcggtccagacccgcatcccccacctatcgcagatgatgaaagcgacgatgacgatgatgatgatatcccccaggaagatcattacgctctgctggtgaaggcatgggaaacaaaagtttttcccaccatccgcagaaggtttcggaacgaggccgaacggaaatcagggctggaccagataaaaggggcattacagcttggcatggtggatattgccaggcagacagtggagttcctgtacgaggagaatgggggaattccccgagacttgtatctgccgacaatagaagatattaaggacgaggccaataagtttaccattgataaggtgaggaagggactgacagtagttacgagaagccccgactccaataacgtggcctccagcgccgttggcaccgcactgccgaagttcgctattcgtggcatgttgaaaacattcgggctccacggcgttgtgctcgacgtggattcagtcaacgagctcgtgcaagtagaaacttacctaagatcagagggggtcctggtacgctactggtaccctattgatatgctggagcgacctccagccggataccggagaactgccactaatgggcttgtaacattggacaacaccaacctacagattcatcgggagctgttgcgatgtgaggccgcattagcacggctctattgtaggatggctcttctgaatattttcgcacctaagcttccacacctgtttacacgcctgttccatatacctgccatccgtgacatcaccttagagcacctccagctcctgagcaaccagttactagccccacccctcccagatggtaccattagcagcagctccatacttctcgcccaaagtctgcagcactgtattcacagccagaactgttccgcaacagacctgttctaccaggggaattctcaaacggtgagggaatggctcaacgtagcaatcacccggacgctgcatcaaggcgaggagagccttctggagttgaccaaacagatttgctcattcctgcagacagcgccagaacaattcccgtccgaggaatttcccatttccgagagtaaggtcaatatggatgtgaacttcccaggtgcagcttttgtagtggtcagctgtaaagaatctcagagcgggtttcgaaaagattcctccttgtacaaagccccatgggcgagggttctggtgtatggccttggacacaaggtaaaacgcaacggacagctcaacctcatagaggctgcatgctacccccgtgacgcgagcccggctaatactgggctcgctccaccgccaactgccgatcaatatccttcagtggtcctctccaccgaccgggtccatatcaaactcggggtttcacccccacccggagcagtgctggtcctgcacagtctcccactagagttccctctcgccatggctttcgcggaacagttgctgagttggaagagcgaagactcggagggaaaatctgaggacgaacccgacactatacccacaagcgtgcttcttcaggttgtcgagttactggggaatttcctctggactactgacatggccgcttgtgtcaaggaactggtgttccatttgcttgctgaactgctgaggaccgttcacaccctggagcaaagaaggcatcccgcaggactctccagttccattgccctgcagctgaacccctgcctcgccatgctaatggccctccagtcagagttgcacaaactatacgatgaggagacacagaattgggtttcagggggagcctgcggcggatcagggggagcggctgccggagatcagggcagattctcgacatattttcacgccctgatggaagggtgtctcgcggttgctgaggtgactctccctactaatatgtccgtcacagccagcggagtcacttccgctactgctcctaacctgtccgattctagttcaagctccagcagtagcccaggtcagaccccccaatcgccttccttgctatcaaagcggaagaaggtaaaaatgaagcgggagaaggccagttcctccgggaaaagacagtcctcacgtacggtggactctgatccaaccgtactgtccattggcggatctaaacccgaagatatgctctggttccaccgggctttgaccctcttgatcatcctccggcatcttacacgaaaagatccccaaggcctcggcgtgacttctgacgccatcgccgacgcatgtcaagccctggttggccctactgcccattctcggcttttggtcataagcggcatcccaacacacctcgacgagggtgtggtgcgcggtgccattcgcaaggcctgtaatgcccatgggggagtgttcaaggatgagatttatatccccttgcaggaagaagacacaaaaaaacctaaggacaaggccgaaggaggagatggcaaggttgagccggagaagactttagcttttccagggactgactccatggaagtctctacatcaagctcacttactcccgcaatgagcatcagcgcaagcgccagtacatcccaggcgagtatatgctccagccaaggaatttcccagacggtgtccgacctctccgtggatccactgccagcgggactcgagctgccaattccaccaggtctgctcgaaccacacgcggtcagcagtcaggaatccttagacattagcctctgctccacagggagtctggggtcgcttggttcgctgggcgagccactagataatgccgagactgcctcggttagcgacatgggtagcatgtacacagtcacctctttggacaatcagccactcgccgctagacccatcaaagggttcgccgtggtggagataaggagcagagcaaagattgaaaagatcagggcctccctctttaataataatgacctcattggacttagcagcctcgatggagaagacgaactgatggaaatgtccaccgaggaaatcctcactgtatctgtagtgaatcaaagccttttcgatacccagggcagccccggattggaggactatttcaatgacaagtctatcaagggggaaaagttagtgcctggagctcgcgaagtgctgaccgagatatttaaaagctgcgctcactctgagcagaccctaagtctcacccccgcaaagccaatacgggtgtcagatatttatctcagcaaggaacaaattaacagccagacacccggaaatctactgcacctgtttttcactaacgtgcgaccccctaaaaaggtgctcgaagaccagttaacacaaattctccggaaatatggcgtccctaaacccaaattcgacaagagtaagtactcaaaagccggaaaggaacaacaccctgtgaaggtagtgagcactaagcgacctatcactaagccgccagccaaggataaagccgtgctgaatagcgttagtcgtacggcactgagcgaaaaaaagcctactgtcaaaccaaagtctccagaaaaatccaagcccgatgagaaggatcctgagaagtctcctacaaagaagcaagaggttcccgaagagaaatacctgactctcgagggattccataagtttgtgattgaccgagccaggcaggacatccgtagcgtctggcgagccattttgtcatgtggttacgacttgcactttgaaaggtgtgcctgcatcgacgttcgccatgctcaaaaggcgtcgagaaagtggacactggaaatggacgtagcgcttgtccagtacatcaatcagctgtgccgacacttggccatcaccccagctagacttcatccccacgaggtctacctggacccagccgacgcagccgacccaagggtggcttgtcttttgaacgttcctatcgagtctttgcgtctccggtttgccttgctccagtcgcttaataccaccttagaaaccttcttcctgcctctggtagagctgaggcaaacacccatgtatactcactccatagccgcattactcaaagaagccaaagggctgatcttctatgacacgaaggtgacggtaatgaatcgcgttctgaatgcgaccgttcagaggacagcagatcacgccgcacccgagataacactggatcctctggaaattgtcggcggtgagatcagagcatcagagaactcctatttctgtcaggccgctcgccagctggcctcggtgccgtcctcccagctttgcgtcaagctggccagcgggggagatcccacatatgccttcaatatacgcttcacaggtgaggaagtccatggcacatcaggttcttttagacacttcctttggcaggtgtgcaaagagctgcagtcatcttcacttagcctgctgttgctgtgtccatctagcgcagtcaacaaaaataaaggtaagtacatcttgactcccagccctatcacatacggggaagaacagcttctgcatttcctgggccagctcctcgggatcgctatacgagcggacgtcccactgcccctggaccttctgccttcgttttggaaaacgttagtgggcgaacctttagatccggagcaggacctacaggaagcggacatcctcacttacaactacgtcaagaagtttgaatcgattaatgacgagaccgagcttgaggccctctgcgcggaaattgcttcacagcacttggcgacggagtctcccgattcaccaaataaaccgtgttgtcgttttacatatcttacaatgaccggcgaggaggtggagctctgttcccgtggccgacatattctagtggcctgggagaataaagacatatatgcggctgcaattcgtagcctccggctccgagagctgcagaacgtggaatgcgtgacagctgtgagagctgggctaggtagcattatacccctgcagcttctcacaatgctatcaccactggagatggagcttagaacctgtggcctgccctatatcaatctggaattcctcaaggcacacaccatgtatcaagtggggttaatggaaaccgatcagcatattgagttcttctggggcgcactggaaatgtttacgcaggaggaactctgcaagttcataaaattcgcatgcaatcaggaacggattccatttacctgcccatgtaaggacggcggacctgacacagcgcacgttcccccataccctatgaagatcgcccctccagatggtacagctgggagccctgactctcgctatatccgggtcgagacctgtatgtttatgatcaaactgccccagtactcgtccctggaaatcatgttggaaaagctgaggtgtgccattcattacagagaagatccattgagtggtta

SEQ ID NO: 49083 - DNA, 849 bp, Artificial Sequence
  Description of Artificial Sequence: Synthetic coding sequence
atggagtctcgaatgtggcccgcactgctgttgagtcacctgttgcctctctggccactacttctgctaccattacccccacctgcacagggatcgtcatccagccccagaacaccccctgcacctgcccgacccccatgcgcaagaggaggcccaagtgctcccaggcatgtctgtgtatgggagcgggcaccacccccatcgagaagccccagggtgcccaggtctaggcgccaagtactgccgggaaccgcgcctcccgctacccccagtggattcgaagaaggaccgccttcctcccagtatccttgggcaatcgtttggggtcccacagtgtctcgagaagacgggggtgatcctaactcagctaatccaggctttcttgactacggcttcgccgctcctcatggtctagctacccctcatcctaattctgactccatgaggggtgacggggatggcctgattcttggggaggctcctgcaacactccgccctttcctgttcggagggaggggcgaaggggtcgatccccaattgtatgtcacaatcacaataagcattatcatagttctcgtggcgaccggtatcatcttcaaattctgttgggaccgttcccagaaacggcgtaggccgagcggtcagcagggagcgctgaggcaggaagaaagtcaacagccccttacagatctgtcacccgcaggggtgacagtgctgggagccttcggagacagccccaccccgacgcctgaccacgaggaaccaaggggcggaccgagacccggaatgccccaccctaaaggggcacccgcatttcagttgaatcggatccctctggtcaacctgtag

SEQ ID NO: 49084 - DNA, 771 bp, Artificial Sequence
  Description of Artificial Sequence: Synthetic coding sequence
atggagtcacggatgtggcctgcactccttctttcccatttactgccgctgtggcccctgcttctcctgccactgcctccagcgcctcggcacgtctgtgtgtgggaacgcgcaccacccccaagtagatctccacgggtcccccgtagcaggcggcaggttctgccagggacagcgcctcccgctacccctagcggctttgaggagggccctcctagtagccagtacccctgggcgatcgtgtggggaccaacagtgtcgcgcgaagatgggggtgaccctaactctgcaaaccctgggttcctcgattacggattcgctgcacctcacgggctggccaccccccatccaaactcggatagcatgcgcggtgacggggatggcctgattctgggtgaagccccagccacgcttaggccttttctgttcgggggaagaggggaaggagtggacccccaactctatgtcaccattaccatctcaattataatcgtgctggtagccacaggcattatctttaagttctgttgggacaggtcccagaaacgacgcagaccttccgggcaacagggggcactgcgtcaggaggaaagccagcaacccctgacagacctttcccctgctggggtgactgtgctgggcgcattcggtgattcaccgacccctactcccgatcatgaagaaccaagaggcggacctcggcctggtatgccacaccccaagggcgctcccgcatttcagttgaacagaatcccgctggtaaacttgtag

SEQ ID NO: 49085 - DNA, 831 bp, Artificial Sequence
  Description of Artificial Sequence: Synthetic coding sequence
atggaaagccggatgtggcctgctcttctcctgtcccatctgcttccgctgtggcctctcctgcttctgcccctccctccccctgcccagggatcctcgtcatctcctcgcaccccccctgccccagccagaccaccctgtgctcgtggaggccctagcgctccacgccatgtttgtgtctgggaacgggctccgccacccagtagatcgcctcgagtgccaaggtctcgcaggcaagtgctgccaggcactgctcctcccgctactcccagtggcttcgaggaagggccaccgagttcgcagtatccgtgggccattgtgtggggccctactgtgagcagggaggacggcggagacccaaattctgcaaatcccggatttttagattacggcttcgcagcccctcacgggttggctacccctcaccccaattccgactcgatgaggggcgatggcgacgggttgattttgggcgaagccccagcaactctgcgccctttcttgtttgggggtcggggagaaggggttgaccctcagctatatgtgacaataaccatttctattataattgtgctggtggcaacaggaataatctttaagttttgttgggaccgctcccagaagagacgcagaccctctggccagcaaggggctcttaggcaagaagaatcccagcaacccctgacggatctcagtcccgctggggtgacggtgctcggtgcctttggggatagccccactcccactcctgaccacgaagaaccgaggggtggccctaggccagggatgcctcaccctaaaggggctcccgcttttcaactgaatagatag

SEQ ID NO: 49086 - DNA, 849 bp, Artificial Sequence
  Description of Artificial Sequence: Synthetic coding sequence
atggagtcgcgcatgtggcccgctttgttattatcccatctacttccactttggcctctacttctgcttccactcccccctcctgcccaggggtccagttcttcccccaggacgccacctgcccctgcaagaccaccatgcgccaggggcggaccctccgcgcctaggcatgtgtgtgtttgggagagagcccctcccccatcccgctcccctagagtgccccgttcccggcgtcaggtgctcccaggcactgccccaccagccacaccatccggctttgaggagggcccaccctcaagccagtacccttgggcgatcgtatggggccctaccgtctcgcgtgaagacggaggagacccgaatagcgcaaaccctggattcttggactacgggtttgccgcaccacatggcctggccacaccccaccctaattcagacagcatgcgaggggacggtgacggacttatcctgggtgaggctcccgctacactgcgcccttttctgtttgggggtaggggagagggtgtcgacccccaactgtatgtgaccataaccattagcataattatagttctcgtggccacgggcatcattttcaaattttgctgggacagaagccaaaagaggcggcgtccaagcgggcaacagggggcactgcggcaggaagagagccaacaaccactgacagatttatctccagctggggtgacagtgctaggggcattcggcgactctcccactccaactccagatcacgaggagcccagaggagggccacgccctggcatgccccatccaaagggagcaccagcttttcaactcaatcggatcccccttgtaaacctctag

SEQ ID NO: 49087 - DNA, 492 bp, Artificial Sequence
  Description of Artificial Sequence: Synthetic coding sequence
atgtcatggaggccacaaccttgttgtatctcttcgtgctgcctgaccaccgactgggtacatctttggtacatttggctcctggtggtgatcggtgccctgctcttactatgtgggcttacaagcctctgcttcaggtgctgttgtctgtccagacaacagaacggcgaggatgggggacccccaccctgtgaggtgaccgtgattgccttcgaccacgattccactctgcaaagcacaattacgtctctccagtctgtctttggaccagccgcacgcagaattctagccgtggcccattctcacagctcattgggacagctccctagctctctagacacattacccggatatgaggaagccctacacatgtctcggttcacagtggccatgtgtgggcaaaaggcccctgacctcccgccagttcccgaggagaagcaactgcctcctaccgaaaaagagtccactagaattgtcgatagttggaactag

SEQ ID NO: 49088 - DNA, 552 bp, Artificial Sequence
  Description of Artificial Sequence: Synthetic coding sequence
atgggcgtgagagtacatgttgtcgccgcatcagcgctgctttacttcatcctgttgagtggcactagatgtgaggagaactgtggcaaccccgagcactgtcttaccactgactgggtccatctatggtacatctggttactggtggttattggggcactcttgctcctctgcgggctcactagcttatgcttcagatgctgttgtctgagcagacaacagaatggggaagatggagggccacccccttgcgaggttactgtgatcgcctttgaccatgattccactctgcagagcaccattacatcattgcaaagtgtttttggcccagctgcaaggaggattctggcggttgcacacagccatagttccctgggccagctgccttcttctcttgacaccctccccggttatgaggaggcactgcacatgtcacggttcactgttgccatgtgtgggcagaaagcacccgatctccccccagtccctgaagaaaaacaacttccgccaactgagaaggagagtacacggatcgtcgattcttggaattag

SEQ ID NO: 49089 - DNA, 552 bp, Artificial Sequence
  Description of Artificial Sequence: Synthetic coding sequence
atgggtgtaagggttcatgtggtggccgcttctgccctgctttatttcatactcttaagcggcacaagatgtgaggagaattgcggcaacccagagcactgcctgacaaccgactgggtccacctatggtacatatggctgctggtcgttattggggcacttctgctgctatgcgggttgactagtttgtgctttaggtgctgctgtttatctcgtcagcagaatggcgaagacggtggccctcccccttgcgaggtcaccgtgattgctttcgatcacgattctacgctccagtctaccattacttcactgcaatcagtttttggccctgccgcacggagaatcctcgctgtggcacattcccacagctctctggggcagctaccttccagtctggacacactgccaggttacgaagaagctcttcatatgtcacggttcactgtggctatgtgcggccaaaaggcaccggaccttccccctgtgcccgaagagaagcagctccctcctacagagaaggagagcacacggattgtcgacagttggaattag

SEQ ID NO: 49090 - DNA, 273 bp, Artificial Sequence
  Description of Artificial Sequence: Synthetic coding sequence
atgggggtgcgcgtacacgtggtggcagcgtccgcgctgctgtacttcattcttctctcagggacccggtgcgaggaaaactgcggcaaccctgaacactgcttgacaacagattgggtgcatttatggtacatctggctccttgtcgtgatcggagctctcttactgttatgcggtttgaccagcctgtgttttcggtgttgctgcttgagtaggcagcagaacggagaagatgggggtcctccaccttgtgaggtaactgtgatagcttag

SEQ ID NO: 49091 - DNA, 174 bp, Artificial Sequence
  Description of Artificial Sequence: Synthetic coding sequence
atgccgactggcaaacagctggccgatatcggatataaaaccttctccacctccatgatgttgttgacagtatacggcggatacctttgctcggtcagggtctaccattactttcagtggcgccgagcccaaaggcaggctgcagaggaacagaagacctcaggcattatgtag

SEQ ID NO: 49092 - DNA, 174 bp, Artificial Sequence
  Description of Artificial Sequence: Synthetic coding sequence
atgcctactggtaagcagctggctgacatcggttataaaaccttcagcacatccatgatgcttctgacagtttacggcggatatctctgttcagtgcgcgtgtaccactacttccagtggcgcagagcccagaggcaggctgccgaagaacagaagacatctggcatcatgtag

SEQ ID NO: 49093 - DNA, 174 bp, Artificial Sequence
  Description of Artificial Sequence: Synthetic coding sequence
atgccaacaggcaagcagctggccgacatcggatataagacattcagtacatctatgatgctcctaaccgtttatggtggttatctttgctcagtgcgggtgtaccattattttcagtggcggcgtgctcagaggcaagccgcagaggagcaaaagacatccggaatcatgtag

SEQ ID NO: 49094 - DNA, 174 bp, Artificial Sequence
  Description of Artificial Sequence: Synthetic coding sequence
atgcctactggcaaacagttagcagatataggttacaaaacattcagcacatcaatgatgttacttacagtttacggaggctacctttgctcggtccgcgtgtaccactacttccaatggcggagagcacagcgtcaggctgccgaggaacaaaagacctctggcatcatgtag

SEQ ID NO: 49095 - DNA, 678 bp, Artificial Sequence
  Description of Artificial Sequence: Synthetic coding sequence
atggcgcagtccgatttcctatatcccgaaaacccaaagcgtagggaagaagtgaaccgactgcaccaacagctgctggactgcttatccgactcttttgacgttacgaataaactgacagaggtcttgaatatgcacctgggctgtcggctggcctccattgagatgaagagagacggcactataaaagagaactgcgatttgattatccaggctatcatgaaaatccagaaagaactgcagaaggtggacgaggccctgaaggacaaactggagcctaccttatatagaaagctgcaggacattaaggaaaaggagacggataagattgccatcgtccagaaggtcatctccgtcatcctcggggaggctacaagtgctgcgagcgccgttgccgttaagctggttgggagcaacgtgaccacgggaattattaataaactcgtcacggtgctggcacagatcggagccagcctgttaggctccatcggggttgccgtgttgggcctaggtattgatatgatcgttcgtgctatcttaggcgcagtggagaagacacagctacaggcagccattaaaagttacgagaaacatttggtggagtttaagtcggcttccgaaaagtacaatcacgccatcactgaagtcattaacacagttaaacaccagatgaaatag

SEQ ID NO: 49096 - DNA, 456 bp, Artificial Sequence
  Description of Artificial Sequence: Synthetic coding sequence
atggaatacgtgctggaagtgaagaatagccccagacatcttctgaaacagtttaccgtctgcgacgtacccctgtacgatatttgtgactacaatgtctccagagataggtgtcaggagctggggtgttgtttctatgagggagtatgttacaaaaaggccgtgcctatctatatccacgttttttctgcattaatcgtcattatcgccggagctttcgtaataaccattatctacagagttatacaggaatctaggaaggaaaaggcgattcccgttgacgtggccctcccacagaagtcctctgagaaggccgagttggcctcctcttcctccaagctgggccttaagccggcatccccaggaccaccctcggccggaccatctatgaaaagcgacgaggataaagacgatgttacaggtaccattacagaagcagaggagacagaggattag

SEQ ID NO: 49097 - DNA, 258 bp, Artificial Sequence
  Description of Artificial Sequence: Synthetic coding sequence
atggaggctggcgaacgaattgacgccagccagctcccacatcgggtgctggaaaccagagggcatgccatttctatactgtttggcttctggacctcattcatttgtgacacctacattgtactagcttggatcagcaagattaaagggagcccagacgtatcggcaagctccgatgaaccctatgcccgtattcagcagtcaaggagacaatgccatgcagaggaggaccagagccaggtgcctgaggcagggtag

SEQ ID NO: 49098 - DNA, 2124 bp, Artificial Sequence
  Description of Artificial Sequence: Synthetic coding sequence
atgagcccccacggtgacggacgtggccaagcccagggcagagccgtgagagttgggctaaggcgatcaggcggaatcaggggtggggtggccgtgttcgctgcagttgccgctgtgtttacattcacccttccaccctctgtgccaggaggtgacagcggtgagctcatcaccgctgcccacgagctaggagtggcccacccgccagggtatccattgttcaccctcgttgctaaactggccattaccctgttcccattcgggtccattgcctacagggtcaacctgctgtgtggcctgttcggcgcagtcgccgcaagccttctgttctttaccgttttccgcctgtccgggagtagtgcaggtggtatccttgcagccggtgtgttctctttttcccggctcacttggcagtggagcatcgccgcagaggtgttcagcttgaacaatttatttgttgggctgttgatggcactgaccgttcacttcgaggaggccgctacagctaaggagcgatctaaggtcgctaaaattggagccttctgctgcggcctcagcctgtgtaaccagcacacaatcattctgtacgtactttgcatcataccttggatcttgttccaattgctcaaaaagaaggaactgtccttaggcagtctcttgaagctgtccctgtatttcagcgcaggcctgctcccctacgtgcatctgcctatctcgagctatctgaaccatgccaggtggacctggggagatcaaaccaccctgcagggcttccttacacacttcttgagagaggaatatggcacattctcacttgccaagtccgagatcggctcttctatgtctgaaattctgctgtcccaggtgactaatatgagaacagagctgagttttaatattcaggctcttgccgtgtgcgcaaacatctgccttgctaccaaagaccggcagaacccatctctggtatggttatttaccgggatgttttgcatttatagcttattcttcgcatggcgcgcaaatctggacatcagtaaacctctcttcatgggtgtggtggagcggttctggatgcagagcaatgccgtggtggccgttctcgcgggtatcggtctggctgctgtggtttccgagacgaaccgggtcctgaactctaatggcctgcaatgtttggagtggctgagtgcaactcttttcgtggtgtaccagatttattcaaattacagtgtgtgcgaccagagaactaactatgtgattgacaaattcgcaaagaacctgcttacatctatgcctcatgacgccatcatactgctcaggggtgatttacccggaaattctctgcgttatatgcactactgtgagggcttacggcctgatatctccctggtggaccaggaaatgatgacatacgagtggtacctcccaaagatggcaaagcacctcccaggagtcaacttcccgggaaaccgctggaatccagtggaggggattctgccttctgggatggttacctttaatctctaccacttcttagaggtcaacaagcagaaggagacatttgtctgtatcggaatacatgaaggcgacccaacctggaaaaagaactactctctgtggccatggggttcatgcgacaaactggtgcctcttgagattgtttttaatccagaggagtggattaagctcactaagagtatttacaactggactgaagaatacggcagatttgatccctctagctgggaaagcgtcgccaacgaggagatgtggcaagcacgaatgaaaactccattctttattttcaacttagcagagacagcccatatgccctccaaagtcaaagcacagttgtatgcccaagcttacgacctatataaggagatcgtgtaccttcagaaagaacacccggtaaactggcacaagaactatgctattgcctgcgaacgcatgttgaggctgcaagcaagagatgccgaccctgaagtcctcctttctgagaccatacgacactttcggttatactctcagaaagctcctaatgacccgcagcaggcggacatactgggagccttaaaacacctgagaaaggaactgcagagcttgcgaaatcgaaagaatgtgtag

SEQ ID NO: 49099 - DNA, 726 bp, Artificial Sequence
  Description of Artificial Sequence: Synthetic coding sequence
atgatgacttatgaatggtatttgcccaagatggccaaacatctgcctggcgtaaatttcccgggaaatcggtggaatcccgtggaggggatcctccctagcggaatggtgaccttcaatctgtatcacttcctggaggtgaacaagcaaaaggagacattcgtgtgtattggcatccatgagggagatcctacctggaagaagaactattccctgtggccttggggcagttgtgacaagctcgttcctctggagatcgtgttcaatcccgaagagtggatcaagctcacaaaaagcatttacaactggaccgaagagtatgggagattcgacccgtctagctgggagtctgtcgccaacgaggaaatgtggcaagccagaatgaaaaccccgtttttcatatttaacctcgcagagactgctcacatgcccagtaaggtgaaagcccaactatatgcccaggcatatgatttgtataaggaaatagtgtatcttcagaaggagcatccagtcaactggcacaagaactacgcaattgcttgtgagcgtatgctcagactgcaggcgcgagacgctgatcccgaggtgctgctgagcgagacaatcaggcacttccggctctactctcagaaggcccctaacgatccgcagcaagcagacatcctgggtgctctaaaacacctacggaaggagttgcagagtctgcggaatagaaaaaacgtgtag

SEQ ID NO: 49100 - DNA, 1230 bp, Artificial Sequence
  Description of Artificial Sequence: Synthetic coding sequence
atgtccccgcacggcgatggtaggggtcaggcccagggaagggcggtgcgcgtgggccttagaagatcaggcggtatacgcggaggagttgcggtgttcgctgctgtggccgcagtattcaccttcaccctgcctccttctgttcccggaggcgattcgggagagctgatcaccgccgctcacgaacttggcgtcgcccatccacccggttatcctttatttacgctggtggccaaactcgctatcacactcttcccctttggatcgatcgcatatcgtgttaacttgttgtgcggcctgtttggcgctgtggctgccagtttactgttcttcacagtattccgcctgtccggatcatctgcgggtggaatattggccgctggcgtcttttcctttagcaggctgacgtggcaatggagcattgctgccgaggtcttctctctcaacaatctctttgttggcctgctcatggccctgaccgttcactttgaggaggctgccactgctaaagagcgctccaaagttgcaaaaattggtgccttttgctgcggtctctctttatgcaatcaacacacaatcattctgtatgttctgtgtattatcccctggatcttattccagcttctgaaaaagaaagagctttcactggggtctctgttgaaactttcactctactttagcgccggtctcctgccctacgtgcacctgccgattagcagctaccttaatcacgctcgttggacttggggggaccagacaacattacagggtttcctgactcacttcctaagggaagagtatgggactttctctctcgctaaaagtgagatcggctctagcatgtcagagatcctcctctcgcaggtaacgaacatgcgcacagaactctcatttaacatacaggcactagctgtttgtgcaaatatctgtcttgcaacgaaagacagacagaatcccagtctggtatggttattcaccggtatgttttgcatctactctctctttttcgcttggcgggctaatctcgatatcagcaagcccctctttatgggtgtcgtggagcgtttctggatgcagtctaacgcagtcgtggccgtgctcgcaggaatcggattagccgctgtggttagtgagactaatcgagttctgaactctaacggcctgcagtgcttagaatggctctcagcaacactcttcgtcgtctatcagatttacagcaattacaggtag

SEQ ID NO: 49101 - DNA, 396 bp, Artificial Sequence
  Description of Artificial Sequence: Synthetic coding sequence
atgatgaactttcgacaacggatgggatggatcggggtaggactgtacctactcgcctccgcagccgcattctactacgtgtttgagatcagtgaaacctacaatcggcttgctctggaacacattcaacaacatcccgaggaacctctggaggggactacctggacccactctctgaaggctcagctgctttcactccctttttgggtctggaccgttatcttcctggtaccgtaccttcagatgttcttgtttttgtattcctgtaccagggccgacccaaagaccgtcggctactgtatcattcctatttgcctggccgtgatttgtaacaggcaccaggcattcgtgaaagcctcaaatcagatttcgaggttgcagctgattgatacatag

SEQ ID NO: 49102 - DNA, 510 bp, Artificial Sequence
  Description of Artificial Sequence: Synthetic coding sequence
atgctggcctttagtgaaatgccaaagcctcccgactactcagagctgagtgactctttgacactggctgtgggaaccggacgcttctctggtccgttgcacagagcctggagaatgatgaacttccggcagcgaatgggctggatcggcgtgggtctgtacctcctggcatccgcagcggcattttactacgtctttgagatatcagaaacatacaataggctcgccctggaacatatccagcaacaccccgaggagcccttggagggcaccacctggactcacagtctaaaggcccaactactctccctgcctttttgggtttggactgtcatcttccttgtcccctatctgcagatgttcctatttttgtattcttgtacacgagctgatcccaaaactgtaggatactgtatcatccccatttgcctggcagttatctgtaatcggcaccaggcctttgttaaggcgagcaaccagatcagccgcctgcagttaatcgatacctag

SEQ ID NO: 49103 - DNA, 522 bp, Artificial Sequence
  Description of Artificial Sequence: Synthetic coding sequence
atgatggcacaattattccttctgcaggcaaacgccgttcttccgctaagtcacgaaataaaggtgaaacgccagattcggttgccagctccactgtacccaccagagcggaatgattccaggagttttcagatcccacaggacctgagagagaagggctgggaggaaggacaacagcacttcgctgggaaggccgctgatgcctttcccgcaccagtgcaattagaagggctggaggccggacagacaaccctggcttcccccgaggtcggtccgtggcgccctaagcgcctgtcaggagtgtgtctgctttcagccctgctcccggatccgtgcaagactaatggcaccttcttactgcagaagcaccatctcccatcactcttagccgtgatcttgtttcccgtgatcattcttaccggagcgtcttttgcacatttgttcgtcgccctgttcgtttctcaccttctgttgaaactgcccctgggggctggtatgaggatgcagcgtgatgccagatag

SEQ ID NO: 49104 - DNA, 522 bp, Artificial Sequence
  Description of Artificial Sequence: Synthetic coding sequence
atgatggcccagttatttctgttgcaagcaaatgccgtgctacctctcagccacgagataaaggtgaagcgtcaaatacgccttcccgctcctctttaccctcccgagaggaatgactcgaggagcttccagatccctcaggatctgagagaaaaggggtgggaggagggccagcagcatttcgcaggaaaggccgcagacgccttccctgccccagtccagttagaagggctagaagcgggacagactaccctggcttcccctgaagtcggtccatggaggccaaagcggttatctggggtatgcctattgtctgctttgcttccagacccatgcaagacaaatggaacgttcctcctgcagaaacaccaccttccttccctcttagccgtcatcctgttccctgtgattatcctaacaggggcatcttttgcacatctcttcgtggctcttttcgtgagccacctattgcttaagctcccccttggagctggaatgcgcatgcagcgcgacgccaggtag

SEQ ID NO: 49105 - DNA, 2817 bp, Artificial Sequence
  Description of Artificial Sequence: Synthetic coding sequence
atgcctgcactggaacatatgaatcaaattctgcatatcctgttcgtctttcttccatttctgtgggctcttgggaccctccctcctcccgacgctctcctgctgtgggccatggaacaagtcctggaattcgggctcggtggatcctctatgagcactcaccttaggctcctggtgatgttcattatgagtgctggcaccgcgatcgcaagttattttatacccagtaccgtgggggtggtgctgttcatgactggattcggcttccttctcagcctgaatctgagcgacatggggcataagataggcaccaaatctaaggacctgccatctggtcctgaaaaacacttctcttggaaggaatgcctgttctacattattatcttagttctagcacttttggagacatctctcctccatcactttgctgggttttcccagatcagcaaatccaactcccaagctatagtgggatatggactcatgattctcctaatcatcctatggatactgcgggagatacagtcagtctacatcatcggtatctttaggaatcccttttaccctaaagatgttcaaactgtgacagtcttcttcgaaaagcaaacccgacttatgaagatcggcattgtgagaagaatccttcttacactcgtgtctccctttgcaatgatcgcattcttgagcctagattcttctctgcagggattgcactctgtgagcgtgtgtattggctttactagggccttccgaatggtgtggcagaacaccgagaatgccctcctggagacagttatcgtttccacagtacacttgatttcctccacagatatttggtggaatcgaagtctcgatacaggactcagactcctgttagtgggtattattagagataggctcattcaatttatcagcaaactccagttcgcagtgacggttctgctgacatcatggacagaaaaaaaacagcgtagaaagactaccgccacgctgtgtattttgaatattgtcttctcaccattcgtgctcgtaatcattgtctttagcaccctgctgagttctccgctactacctctatttacgctgcccgtttttcttgtcggctttcccagacccattcagtcctggcccggtgccgcaggcacgactgcatgcgtgtgtgccgataccgtctactattatcagatggtaccgcgtttaactgccgtgctgcagacagcgatggcagcaggttctctcggcctacttctgcctgggtcccactatctgggcagatttcaggaccggctaatgtggatcatgattctagaatgcggatacacatactgctctatcaacatcaaaggtctggaactgcaagagactagctgtcacaccgctgaggcaagaagagtcgatgaggtgtttgaagacgcattcgagcaggaatacacgcgcgtttgcagtctgaatgagcatttcggaaacgtgctcactccttgtaccgtgttgcctgtcaaactgtatagcgacgcaagaaacgttctcagtggaataattgacagtcacgaaaatctcaaggaattcaagggcgacctgatcaaagtcctcgtgtggatcttagtccagtactgctcaaagcgccctggcatgaaagagaatgttcacaatactgagaataaaggtaaggcccctttaatgctccctgccctgaacactttgccacctcccaaaagcccagaagatattgatagcctgaacagcgagaccttcaatgattggagcgatgataacatctttgatgacgagccaactattaagaaagtcattgaagagaaacatcagcttaaagatttacccggaaccaaccttttcattcccggatcagtggaaagtcaaagagtaggcgaccattcaactgggaccgtgcccgagaacgatctctacaaggcagtgctgctaggatacccggctgtcgacaaagggaaacaggaagacatgccttatattcccctgatggaattctcttgtagtcatagtcacttggtctgcctgccggctgaatggcggacgtcctgcatgccctcgtcgaaaatgaaagagatgtctagtctctttcccgaggactggtaccagtttgtgctcagacagctagaatgctaccactccgaggaaaaagcttcgaatgtcctggaggagatcgccaaagataaagtgctcaaagatttttacgtccacactgtcatgacgtgttatttttccctcttcggtatcgataacatggcgccaagccctgggcacatcctcagggtatacgggggtgtgttgccatggtcggtggctctagactggctgacagagaagcccgagctgttccagttagccctgaaggctttccgctacacactcaaattaatgattgataaggcaagcttgggtccgatcgaagactttagagagctgatcaaatatctggaggaatatgagagggactggtatattgggctggtgagcgacgaaaaatggaaggaagccatcctccaggagaagccatacctcttctcgctgggatatgactccaacatgggtatttacactgggagagtcttgagcctgcaggaacttctcattcaagtgggaaaactcaacccggaagccgtgagaggccagtgggcaaacctgagctgggagctgctctacgctactaacgatgatgaggagaggtactcaattcaagcccaccccctgctgcttcgcaacttaacagttcaggctgccgagccccctcttggttacccaatttactcttctaaacccctccacattcacttatactag

SEQ ID NO: 49106 - DNA, 3519 bp, Artificial Sequence
  Description of Artificial Sequence: Synthetic coding sequence
atgtctccagacgtgccattactcaacgactacaaacaagatttcttcctcaagcggttccctcagacagtgctggggggacctagatttaagctggggtattgtgccccaccttacatttacgttaaccagattatcttattcttgatgccatgggtatgggggggtgtaggaactctgctctaccagctcgggatcctgaaagattactatactgccgctctgtcaggcggactcatgcttttcaccgccttcgttattcagttcacaagtttgtatgccaagaataagtctactacagtggaaagaattcttacgaccgacatactagccgaggaggacgaacacgaattcacttcttgtactggcgctgagactgttaaatttctgatacccggaaagaaatacgtggcgaacaccgtgttccattctattctagcgggtctcgcatgcggtttaggcacgtggtacttgctgcctaatcgcatcacgctgctgtacggttccactggaggtacagccctgctgttcttcttcgggtggatgaccctgtgtatcgcagagtactctttgattgtaaacactgcaacagagacagccacctttcagactcaggacacctacgaaatcatcccattaatgcgtccactgtacatcttttttttcgtgtcagtagacctggcacacagattcgtcgtaaacatgcctgcattagaacacatgaatcagatcctgcacattttgttcgtctttctgccattcttatgggcccttggtacacttccgccaccggatgcgctgctgctatgggccatggaacaggtgttggagtttgggctgggtggttcttcaatgtctacccacctgaggctcttggtgatgttcattatgtccgctggaaccgcaatcgcgtcttatttcatcccctccactgtgggggtggtcctctttatgacagggttcgggtttctcctgtcacttaatcttagcgatatgggccacaaaattggtactaagtcaaaagatcttccaagcggccctgagaaacatttttcatggaaggagtgtctcttctacataataatcctggtgctggccctactggagacatcactgctacaccacttcgcaggcttctcacaaatcagcaaaagcaactctcaagcaattgtgggctacggcttgatgatcctgctcataattctctggattctgagggagattcagtcggtgtacatcatcgggatctttcggaaccctttttacccaaaggatgtgcagacggtgacagtctttttcgaaaagcaaactcgcctgatgaagatcgggatcgtacgcagaatcttgctgacactggtgtcgccattcgctatgatcgctttcctgagcctggactcctcacttcagggattacattcagtgtcagtttgtattggtttcacccgagcctttcggatggtctggcagaacaccgaaaatgccctgcttgagacagtgattgtcagtacggtgcacctgattagcagcacagacatctggtggaatcgcagtctggataccggactgcgtctgcttcttgtgggtattattagggaccggctcatccagtttataagcaaacttcaatttgctgtgacggtgttgttgacaagttggaccgaaaaaaagcagcgccgaaaaacgaccgccactctgtgcattttgaatatcgtgttctccccatttgtgctggtgataatcgtgttttccactttgctctccagcccattgctgccccttttcacccttcctgtgtttttggtcggattccctcgaccaatccagagctggcctggcgctgcaggaaccacggcttgtgtatgcgccgacaccgtatactattaccaaatggtgccccgtctgactgctgttctccaaacagccatggcagccggtagcctaggactgctgttgccgggaagccactatctcgggagattccaggacagactgatgtggattatgatcttggagtgtgggtatacatactgcagcattaacatcaaaggtctagagctgcaggagaccagctgccacactgctgaagcccgaagggtcgatgaggtctttgaagacgcctttgagcaggagtacacacgggtctgctccctgaatgagcactttggaaacgtactcaccccttgcacagtactccccgtgaagctctacagtgacgctcgaaatgtgctgagcggaatcatcgatagtcacgaaaacctcaaagagttcaagggtgatctgattaaagttctggtctggatactcgttcagtattgttctaaaagacccggtatgaaggaaaacgtgcacaacactgagaataagggaaaagctcccttgatgctccccgcattgaacacgctccctccccctaaatcacccgaggacattgactcactgaactctgagaccttcaacgattggtcagatgataacattttcgacgacgaacccacaatcaagaaggtgatagaagagaagcatcagctcaaggacttgcccggaacaaatttatttattcccggatctgtcgaatcccaaagggttggggaccactcaacgggcactgtgcctgaaaatgacctctataaagctgtgctgctgggatacccggctgtagacaagggcaagcaggaggatatgccatacataccactgatggagtttagttgtagtcactctcacttagtgtgcctcccggcagaatggcgaacatcgtgcatgccgagttcaaaaatgaaggagatgtcgtctctcttcccagaggattggtaccagttcgtgctgaggcagctggaatgctaccacagcgaagagaaggcatctaacgttcttgaagagattgctaaagacaaggtccttaaggatttctacgttcacactgtcatgacctgttacttttccctgtttggtattgacaatatggccccttcacctggccacatactgagggtatacggtggcgtactgccctggtcagtggcattggattggctcaccgaaaagcccgagttatttcagctggcccttaaggctttccgttacacccttaagctaatgatagacaaagcgtccttgggcccaattgaagattttcgtgagctgatcaagtatttggaagagtacgaaagagactggtacatcggtctggtgtccgacgagaaatggaaggaggctatactacaggagaaaccctaccttttctccctcggttacgattcgaatatgggcatatatacgggcagagtgctgtctctgcaagaactgctcatacaggtcggcaagctgaatccagaggccgtgcgtggacagtgggcgaatctcagctgggaactgctctacgcaactaatgacgacgaagagaggtattccattcaagcccatcctctgctactgcgaaaccttaccgtgcaggcagcagagcccccactgggatatcctatctacagctccaaaccactgcatatacacctgtattag

SEQ ID NO: 49107 - DNA, 3519 bp, Artificial Sequence
  Description of Artificial Sequence: Synthetic coding sequence
atgagcccggacgttcctctgctcaacgactataagcaggacttcttcctgaaacggttcccccagacggtccttgggggacccaggtttaaattagggtactgcgccccaccttatatttacgtgaaccagatcattctattcctcatgccatgggtttggggcggagtcggcactctcctctaccagctaggcatcctgaaggactattatacagcagctctatccggagggttgatgctctttacggcatttgtcatccagtttacgtcgctttatgccaagaacaagagtacaacagtagagcggattctcacgaccgacattctggccgaggaggatgagcatgagttcacatcttgcacgggcgcagaaacagtcaaattccttattccaggtaagaagtacgttgccaacaccgtcttccattctatcttagctggactcgcatgtggattgggtacatggtacctgttacctaacaggataacattactgtatggatctacaggcggaacagctctcctcttctttttcggctggatgaccctgtgcattgccgaatactcgttaatagtgaatacagctacagagaccgccactttccagacacaggacacctatgagatcattccactcatgagaccactctacatctttttctttgtgagcgtggatttagcacacagattcgtggtaaatatgccggcactcgagcacatgaaccagattctgcatattctgttcgtattccttccattcctctgggctctgggtaccctccccccaccggatgctctgcttctttgggccatggaacaggtgctcgaattcggcctgggaggaagttccatgtctacccatctgcggttgttggtgatgttcatcatgagcgcaggtactgcaatcgcgtcatactttatcccatccacagttggtgtggtgctttttatgacgggattcggcttcctcctctcactcaatttatccgatatgggccacaaaataggtactaagtccaaggatttgccgtccggaccagaaaagcatttctcttggaaggaatgtctattttatattatcatcctagtcctggccctgttggaaacctctttgctccatcactttgcagggttctcccagatatctaaaagtaattcgcaggcgattgtgggttatgggctgatgattctcttaatcatcttgtggatcttgagggagatccagtctgtctacatcatcggaatctttcgaaatcctttttaccccaaagacgtgcagacggttactgtgttcttcgagaagcaaaccagacttatgaagattggtatcgtcaggagaatactgttgactttggtctcccctttcgccatgatcgcattcctgagtctggacagctccctccaggggcttcattcggtctctgtttgtattggatttacacgcgcttttcgtatggtatggcagaatacagaaaacgctctgctggaaactgtgatcgtcagtaccgtccatctcatttcaagcacggacatctggtggaatcggagcctggataccggactgaggctgctgcttgtgggtatcatccgggatagactcattcagtttatcagcaagctgcaatttgccgtgactgtactcctgaccagctggacagaaaaaaagcagagacggaaaacgacggcgacgctgtgtatcttaaatattgtcttttcacccttcgtcctagtgattatcgtgttctctacactgttgagtagccctctgttgcccctgtttaccctgcccgtgttccttgtgggcttcccccgaccaattcagtcatggcccggagccgctggtaccactgcttgtgtgtgcgccgataccgtctattattaccaaatggtaccacggctaacggccgtgttacagacagcaatggctgccggaagcttaggattgctccttccgggttcccactacctggggaggtttcaggaccgactgatgtggattatgatcctagaatgtggctatacttactgcagcatcaatataaagggccttgagctccaggaaacgagttgccatacggctgaggccagaagagtcgacgaagtgtttgaggacgcgtttgaacaggagtacacgcgtgtctgtagcctaaacgagcacttcggcaacgtcctcactccctgtactgtgctcccagtcaaattgtactctgacgcacgcaatgttctctcaggcatcatcgacagccacgagaaccttaaagagtttaagggcgacctgatcaaggtgctcgtgtggattctggtgcagtattgtagcaaaaggcccggtatgaaggaaaatgttcataataccgaaaacaagggaaaagcccctctgatgctcccggcattaaacaccctgcctccgcctaagagcccggaagatattgactcactgaactcagagacatttaatgactggtccgacgataacatctttgacgacgaacccacaatcaaaaaagtcatcgaagagaaacaccagctgaaagacttaccaggaaccaatctcttcatccctggtagcgttgaaagccagagggtgggcgatcattccactggcacagtaccagaaaatgacctgtacaaagctgtgctcttgggctaccctgcagtggacaaaggaaagcaagaggatatgccttacataccgttgatggagttctcatgctcacattcacacctggtttgcctccccgctgagtggaggacctcctgtatgccgtcaagcaaaatgaaagagatgtcttccctgttccccgaggattggtaccaattcgtgctgcgccagctggaatgctatcattctgaggagaaggcttctaatgtgctagaagaaatcgctaaggataaagtcctgaaggatttctatgttcataccgtgatgacgtgctacttttcactgttcggtattgataacatggctccatcacctggacacattctccgggtctacgggggagttctcccgtggagcgtggccctcgattggctgaccgagaaacccgaactcttccagctggccctcaaggcatttcgttacaccttaaagctgatgattgataaggcctctctcgggccaattgaggactttagggagctgataaaatacttggaggaatatgaacgtgattggtatatcggcctcgttagcgacgaaaagtggaaagaagctattctgcaggagaaaccgtaccttttctcgctcggatacgattcaaatatgggaatttacactggcagggtcttaagcctacaggagctgttaattcaagtcggtaagctgaatccagaagctgtaagagggcagtgggctaacctgagttgggagctactctatgcgactaacgacgacgaagagcgctactcaattcaagctcacccactgctgctgcgtaatttaaccgttcaggccgcagagccccctcttggctaccccatttattcgtcgaagcccctgcacatacacctatactag

SEQ ID NO: 49108 - DNA, 897 bp, Artificial Sequence
  Description of Artificial Sequence: Synthetic coding sequence
atgctccccgcattgaatacactgccgccaccaaaaagtcctgaggatatcgacagtttgaacagcgagactttcaatgattggtctgacgacaatatctttgacgacgagccaaccataaagaaggttattgaagaaaagcaccagctgaaggacctgccgggaactaatctgttcattcccggatccgtcgagtcccagcgagtgggtgaccatagtacaggtactgtgcccgagaatgacctctacaaagcagtccttctgggttaccctgccgttgataaaggaaaacaggaggacatgccttacatcccactaatggaattttcctgttctcactctcatcttgtatgcctgcccgcagagtggaggacctcttgcatgccatcctctaaaatgaaggaaatgtctagtctgtttcctgaagactggtaccaatttgtgcttaggcaacttgagtgttaccactccgaagaaaaggcatccaatgtgcttgaggagattgcaaaggacaaggtgttaaaagacttctacgtgcataccgtaatgacctgctacttttcgttgttcggaatcgacaatatggcccctagtccaggccacatcctgagggtttatggcggtgtgctaccatggagcgtggcgctggattggctgaccgaaaagcccgaactttttcaactagcacttaaagccttccggtatactttgaaacttatgattgacaaggcctcactggggccaatagaggactttcgcgaactcattaagtacctggaagagtacgagagggactggtatataggcctcgtctctgacgagaaatggaaggaggccatcctccaagaaaagccctacctgtttagcttgggatacgatagtaacatgtatctgtag

SEQ ID NO: 49109 - DNA, 1584 bp, Artificial Sequence
  Description of Artificial Sequence: Synthetic coding sequence
ctctgtattcttaacattgtcttctcaccatttgtcctggttatcatcgtctttagcacactgctatcttccccactgctccccctgttcaccttgcctgtgtttctcgtgggctttccgaggccgatccagtcctggcccggagccgcagggaccaccgcatgcgtatgcgccgatacagtctattactaccaaatggtgccccgtcttaccgctgtgcttcagacagcaatggccgcaggaagcttgggattactgctgcctggttcacactatctgggacggttccaagatagactgatgtggattatgatcctggagtgtgggtatacttactgctccattaacataaaaggcctcgaactacaagaaacctcttgtcacactgcagaggcacgtagagtggacgaggtcttcgaggacgcgtttgagcaggagtacacgagggtgtgctcccttaacgaacattttggcaatgtattgactccctgtacagtccttcccgtgaagttgtacagtgacgcacgtaatgtgctgtccgggatcattgactctcacgagaacctgaaggagttcaaaggcgatctgattaaagtgttagtgtggattctcgtgcagtactgcagcaagagaccaggcatgaaggaaaacgtacacaataccgagaataaaggtaaggctcccctcatgctaccagcactgaatacattgcctcctcctaaatctcctgaggacattgactcactgaattctgagacgtttaacgattggagcgacgacaacatttttgacgatgaaccgaccattaaaaaggtgatcgaggaaaaacaccagctgaaggatctgcccggaactaatctcttcattcccggaagcgtagaatctcagagggtgggtgatcactccacgggtacagtgccagaaaatgatctgtataaagccgtgctgctcgggtaccccgctgttgataagggaaagcaagaggatatgccttatatcccactaatggagttctcgtgcagccacagtcatctagtgtgccttccagccgagtggcgcacatcgtgtatgcctagttcaaagatgaaagagatgagcagtctctttcctgaagattggtaccagtttgttctccgacagctggagtgctatcattccgaagagaaagcttccaacgtattagaagagatcgctaaagataaggtgctgaaggacttctatgtccatacagtgatgacctgctattttagcctctttggaatcgacaatatggccccaagtcctggtcatattctgcgcgtctatggcggtgtactcccatggtccgtggctctagattggctcactgagaaacccgaactgtttcagcttgcactgaaagcctttcgttacaccctaaaactaatgatcgacaaagctagcctcggacctatcgaagactttagagaactaataaagtacctggaagaatatgaaagggattggtacatcggcctagtgtcagacgagaaatggaaagaagccattctgcaagagaagccgtacctgtttagcctcggctatgactctaacatgtatctgtag

SEQ ID NO: 49110 - DNA, 1866 bp, Artificial Sequence
  Description of Artificial Sequence: Synthetic coding sequence
atgccttttaccctgcatttgaggtccaggcttccatccgctatcagatcactcatattacaaaaaaagcctaatattaggaatacatcaagtatggccggagagttaaggcctgccagtttggtggtactccctcgatcactcgcaccagctttcgagagattttgccaggtgaatacaggacccttgcccctactgggccaaagcgagccagaaaaatggatgctgcctccgcagggcgctatcagcgagactcggatgggacatccacagttctggaaatacgaatttggtgcctgtacagggtcccttgccagcctcgagcagtacagtgagcaattaaaggatatggtcgcattcttcctgggatgctccttttccctcgaagaagctctcgagaaagcgggtttgccgagacgagatccagctggccactcccaggccggtgcctacaagaccactgtaccctgcgtgactcatgccggattttgttgccccctggtcgtgaccatgcgaccaatccccaaagataagctggagggactcgtgcgcgcatgctgttccttgggtggggagcaggggcagccggtgcatatgggtgatcccgagctgctgggtataaaggagctgtccaaacctgcctatggggacgctatggtgtgcccgccaggagaagttccggtgttttggcctagccctttaacctccctcggagctgtgagctcttgcgagaccccgttggcattcgcctccattcccggttgcacggtgatgaccgatttaaaagacgccaaggctccccctggctgcctcactcccgaaagaataccggaagtacatcacatatcccaggacccattgcattattctatcgcgtccgtgagtgctagccaaaagatccgagaactggaatccatgatagggatcgaccccggaaaccgtggcataggccaccttctgtgtaaagatgagctgctgaaagcgtcactgagtctgtcgcatgctcgcagcgttctgatcacaaccggtttccccactcacttcaatcacgaacctcctgaggagactgatgggcctccgggagctgtggctctcgtcgcattcctgcaggctcttgagaaagaggttgccatcatcgtggatcaacgggcttggaaccttcaccaaaagattgttgaagacgctgttgagcagggggtgttaaagactcagatacctattctcacataccaggggggatccgttgaggctgcccaagctttcctgtgcaaaaatggcgatcctcagacgccacgcttcgaccacctggtcgctattgaacgggctgggagagccgctgacgggaattattacaacgcacgaaaaatgaacattaagcatctggtggatcccatagacgatctctttcttgcagcaaaaaaaattccaggaatctccagcaccggcgtcggtgatggcggtaacgagctggggatgggaaaagtaaaagaggctgtgagacgacacattagacatggagacgtcattgcttgcgatgtggaggctgacttcgcagtgattgccggtgttagcaactggggtggctatgcactggcgtgtgcactctatattctgtacagctgcgcggtgcattcgcaatatctgcgtaaggccgttggcccttcgagagctccaggcgaccaagcatggacgcaagccttaccatcagtgatcaaggaagaaaagatgcttgggattctggtgcaacacaaggtacggtccggagtgtctggtatagtcggaatggaggtggatggcttgccttttcataatacccacgcagagatgatccagaaactggtggacgtgaccacagcccaggtctag

SEQ ID NO: 49111 - DNA, 480 bp, Artificial Sequence
  Description of Artificial Sequence: Synthetic coding sequence
atgccgttcacccttcacctgagaagccgcctgccatctgcgattagatctctgatcctacaaaagaagcctaacatcaggaacacaagctccatggctggtgaactgcgtcctgcctccctggttgttttacctaggtcactggctcctgcattcgaaagattctgtcaagttaacactgggccactgcctctgctgggacaaagcgagccagagaaatggatgctgcccccacaaggtgccatttcagagacctctttgcgtgacctgcattccgcctggcataggacttcccttatgactgtggcccaagagagagccgctctccctacagtcctcacaccaagtccgataacgtggcgcttgtcttggctgcggtccctgagatcctggagaaagtctagccccggtgagatccccctcgcactccctagcgttcatagcatcgcacaggcacgcaacccacccgtgcaggattag

SEQ ID NO: 49112 - DNA, 1866 bp, Artificial Sequence
  Description of Artificial Sequence: Synthetic coding sequence
atgcccttcaccctgcatctgcggtcaagactgccgtccgctatacgctctttgatattgcagaaaaagcccaatatccggaacactagctccatggccggagaactgcgtccagctagcctggtggtgcttccaagaagccttgcaccggcttttgaacgcttctgccaggtgaatacaggccctttgccgctgctcggccagagtgagccggaaaaatggatgttgcctccccagggagcgatctcagagactaggatggggcatccccagttctggaaatatgagttcggtgcgtgtacaggcagcctggcatcactggaacagtacagcgagcagctgaaagacatggtcgctttttttcttgggtgcagcttttccctagaagaagcactggagaaagcagggctgccaaggcgagaccccgctgggcatagccaggccggagcttacaaaacaacggtcccctgtgtcacacacgcaggtttctgctgtcctttggttgttaccatgcgccctatacccaaggataaactggaaggcctggtaagggcctgctgttcacttgggggagagcaaggacagcccgtgcatatgggcgaccccgagttgctagggatcaaagagctgagcaagcctgcctatggagacgccatggtgtgcccgccaggtgaggtgccagtgttctggccaagtcccctgacatctctgggagctgtgtcgagttgcgagactcctctggcgtttgcctccatacccggatgtaccgtaatgacggacctgaaggacgcgaaagcccctccgggatgcctgacccccgaaaggattccagaggtgcatcacatttcccaggaccctctccactattcaatcgcgtccgtgtccgcttcgcagaaaatcagagagctggagagcatgattggcatcgaccctgggaacagggggatcggccatctgctctgtaaagatgaactgcttaaggcctctctgagtttatctcacgccaggagcgtgctgatcacgactggcttcccgactcacttcaatcacgaaccacccgaagagacagatggacccccaggtgctgtggcattggttgcttttctgcaggcccttgagaaagaggttgccatcatagtcgatcaacgtgcatggaacctgcaccagaagatcgtggaggatgctgttgagcagggagtcctgaaaacccagatcccgattctgacctaccagggcggaagtgtggaggcagcccaggcatttttgtgtaaaaacggcgatccgcagacaccaagatttgaccacttagttgccattgaacgggcaggcagggctgccgacggcaactattataacgcaaggaaaatgaatataaaacacttagtggacccaatagatgatctttttctcgctgctaaaaaaatccccggaattagcagcaccggcgtaggcgatggcggaaacgagctggggatggggaaagtgaaggaggcagtgcggaggcacataagacatggggacgtgattgcctgtgacgtagaggcagatttcgccgtgattgccggagtttccaattggggtggctacgcactggcctgtgcattatacattctctactcctgcgccgttcacagccaatacttgagaaaagctgttggcccttctcgcgctccgggagatcaagcgtggacacaggcactgccttcagtgataaaagaagaaaagatgctgggcattctggtgcagcacaaggtgagatcaggagtgtcaggaatcgtgggcatggaggtcgatggcttgccatttcataatacccacgccgagatgatccagaaattggtggatgttacaaccgcccaggtatag

SEQ ID NO: 49113 - DNA, 1851 bp, Artificial Sequence
  Description of Artificial Sequence: Synthetic coding sequence
atgccgttcaccctgcacctaagaagcagactgccatcagctattaggagcttgattttacaaaaaaaacctaatataagaaatacaagtagcatggccggtgaacttcggcctgcaagtttggttgttctgccaaggtcattggctccagcatttgaacgcttctgccaggttaacacggggccactccctctgctcgggcagtctgaaccagaaaaatggatgctgccaccgcagggagccatctccgaaactcgtatgggccacccccagttctggaaatacgaatttggcgcatgtaccgggagcctggcctcacttgaacaatacagtgagcagctcaaagatatggtcgccttttttctcggatgctccttttcccttgaagaagccctcgagaaggccggactgccaaggcgcgatcccgcaggacatagccagacaacagtgccttgtgtcactcacgccggattctgttgccctctggtggtcaccatgaggcccatccctaaggataagctggaagggctggtccgtgcttgctgctctctcggcggtgaacagggccagccagtgcacatgggggaccccgaactgctcggaattaaagagctttctaaacccgcatacggggatgccatggtgtgcccacccggtgaggtaccagtgttctggccctctcccctgacatcgttaggtgccgtatcatcctgcgaaaccccactcgccttcgccagtatccctggctgtactgtcatgactgacctaaaggacgccaaggccccaccaggctgtctcactcccgagagaatcccggaggttcaccacatatcgcaggatccgttgcactatagtattgcatctgtctctgcatcacagaaaatccgggaattagaaagcatgattggtattgaccctggaaatagagggattggccatctgctttgtaaggacgaactcctaaaggcatccctctctctgtctcatgcgcgtagcgtactgatcactaccgggtttccaactcattttaaccatgagccgccagaggagacagacgggcctccaggcgctgtcgccctggttgccttcttgcaggctctcgagaaggaggttgccatcatcgtcgaccagcgggcttggaacctgcatcagaaaattgtggaggacgctgtcgaacaaggtgtcttgaaaacacagataccgatcctcacgtaccagggcggtagcgtggaggcagctcaagccttcctatgtaagaacggtgacccacagacaccacgcttcgatcacctggttgcaattgagcgcgctggaagagcggctgatggaaactattataatgcaagaaagatgaacatcaagcacctagttgatccaatagatgatctgttccttgcggcaaaaaaaatccctggtatctcgtctacaggggttggtgacggcggaaacgaactcgggatgggaaaggtgaaggaagcagtgaggagacacattcgtcacggcgacgtcatagcatgtgacgttgaggccgattttgcagtaatagctggtgtctccaactgggggggatacgcactggcttgcgcattgtacatactgtacagttgtgcagtgcattcacagtacttgcgcaaggccgtcgggccttcccgggcaccaggcgatcaagcatggacgcaggccttaccgtctgtcatcaaggaggaaaaaatgttggggatcttagtgcagcataaagttaggagcggagtttctggcattgtgggaatggaggttgatggcctcccattccataacacacatgccgaaatgatacaaaagcttgtggacgtgacaactgcccaggtgtag

SEQ ID NO: 49114 - DNA, 198 bp, Artificial Sequence
  Description of Artificial Sequence: Synthetic coding sequence
atgccatttaccttacacttaagatcacgccttccttcagccatcaggtctcttatactgcaaaaaaagcccaacattcggaacacttcaagcatggccggtgaacttaggcctgcgagtctggtcgtcctgccccgatcacttgcaccggcttttgaacggttctgtcaggtgaacaccggccctctacctctgtag

SEQ ID NO: 49115 - DNA, 1296 bp, Artificial Sequence
  Description of Artificial Sequence: Synthetic coding sequence
atgcctttcaccctgcatctgcggtctaggctgcctagcgcgatacggtctctgatcctgcagaagaaaccaaacatacggaacaccagcagcatggccggtgagcttcgccctgcctccctggtggtgctccctagatccctggcacctgcctttgagcggttttgtcaagtcaacactggaccgttgcccttactagggcagtccgaacccgaaaaatggatgcttccgcctcagggtgctatctccgaaactaggatgggacatccccagttctggaagtatgagttcggggcttgtactgggtcactcgcgagtttggagcagtactccgaacagctaaaagacatggtggctttcttcctggggtgctcattctcccttgaagaggctcttgagaaagctgggcttcctagaagagatccagctgggcactctcaagctggagcctataagaccaccgtgccatgtgtaacacacgccggattctgctgtcctctggtcgttacaatgagaccaatcccaaaggacaaactcgagggattagtgagagcatgctgttctttaggtggagagcagggccaacctgtccatatgggcgaccccgaactcctcggaatcaaggaattgagcaagcccgcatatggagatgccatggtttgtccacccggagaagtacccgttttttggcctagcccgctgacgagcctcggtgccgtgtcttcatgcgagactcctttagcttttgcctctattccaggttgtacagttatgacggacctgaaagatgccaaggctccccctgggtgcttgacccctgagcgcatccccgaagtgcaccatattagccaggatcctctgcactacagtatcgcatccgtgagcgcttctcagaaaatcagggaactggaatccatgattgggattgatcccggtaacagagggattggacacctactttgtaaagacgaactccttaaggcctccctttccctgagtcacgctcgctcagtgctgataacaaccggcttccccacgcactttaaccacgaaccaccagaggaaacagacggcccacccggagcggtcgcattagtcgcctttctgcaggcactcgaaaaagaggttgccatcatcgtggatcagagagcctggaacctgcatcaaaagatcgtggaagacgctgtggaacagggcgtccttaagacgcagattcccatcctgacttatcaagggggatctgtggaggccgctcaagcttttctctgtaaaaacggcgaccctcagacgccatag

SEQ ID NO: 49116 - DNA, 480 bp, Artificial Sequence
  Description of Artificial Sequence: Synthetic coding sequence
atgccattcactttacatctcaggtctaggctgccctctgcaattcgcagtctaattttgcagaagaaaccaaatatcaggaacacgtcatccatggccggtgagctgagaccagcctctctggttgtgcttcctaggagcctagctcctgcctttgagcggttctgccaggtgaacacggggccattgcctctgctgggacagtccgaacctgaaaaatggatgctgcctccacaaggagctatatcagagacttccctgcgagaccttcacagcgcctggcaccgaacgagtctaatgacagttgcccaggaacgtgccgctctgccaactgtattaactccctcccccattacatggcgtctatcctggcttaggtcccttcgatcttggagaaaatcgagtcccggtgaaatcccgctagccctcccatccgttcactcaatcgcccaggcacggaacccaccggtccaagactag

SEQ ID NO: 49117 - DNA, 1866 bp, Artificial Sequence
  Description of Artificial Sequence: Synthetic coding sequence
atgcccttcaccctccacttacgctctcgccttccctcagccatcagatctctcattctgcaaaaaaaacccaatatccgaaatacctcctcaatggccggagaactccggcctgcaagcctggtcgtgttgcctcgctctttggcccctgccttcgagaggttttgtcaggtcaacactggccctctacccctcctgggtcagtctgaacctgaaaagtggatgctgccgcctcagggggcaatctccgaaacgaggatgggacatcctcagttttggaagtacgaatttggagcatgtacggggagtctggcctccttggaacagtactccgaacagctcaaggatatggtggcgtttttcctcggatgctcttttagcttggaggaggccctcgaaaaggccggtctcccaagacgagacccggctgggcattctcaggctggggcttacaaaacaaccgttccctgcgttacccacgcaggtttttgctgtcccctggtcgtgaccatgcgaccaatacctaaagacaagctggagggccttgttcgggcatgttgctctctcggcggagagcagggacagccagttcacatgggcgacccagagcttctcggcatcaaagaattgagtaagccagcttacggggacgctatggtgtgccctcccggagaagtgcctgtcttctggccctcaccattgacgtcactgggagctgtgtctagttgtgaaacacctctggcgtttgcatctataccaggatgcacggtgatgactgacctgaaggacgcaaaggccccaccaggctgtttgacccctgaaaggatacccgaggttcaccacatctcccaggatcccctgcattacagcatcgccagtgtttccgcctcccagaaaatcagagaactcgagtccatgataggcattgatcctgggaacagaggcatcggccatctgctgtgcaaagacgagctgcttaaagcatcactgtccctgagtcacgcccgatctgtcctcatcaccactggtttccctacacactttaatcatgaaccaccagaggaaaccgacgggccaccaggcgctgtggcccttgtcgcttttttacaggctcttgagaaagaggtcgcaattatcgtagaccaaagagcctggaacctgcatcagaaaatcgtagaggacgctgtcgaacaaggcgttctgaagacacagatccctatcctcacatatcagggcggatcagtcgaggctgcacaagcattcctgtgcaaaaacggggatccccagactcccagatttgatcatctggtggcgatcgagcgcgcaggcagagccgcagacggtaactactacaatgcaagaaaaatgaatattaagcatctggtagatcctattgacgatctattcctggccgctaagaaaattcccggaatctcatccaccggagtcggcgacgggggtaacgagttgggcatgggcaaagtaaaagaagctgtgagacggcacataaggcatggcgacgtaatagcatgcgatgttgaggctgatttcgcagtgattgccggagtctcaaactggggcggttacgccctcgcctgcgcgctatatatcctctattcttgtgccgtgcactcgcaatatctgagaaaagcggtgggcccttcaagggccccaggtgatcaggcttggacccaagctcttccctctgttataaaagaggaaaagatgcttggcatcctggtgcagcacaaagtgcgtagtggcgtcagtggcattgtgggtatggaagttgatggactacctttccacaatacacatgccgagatgatccaaaaacttgtcgatgtgactaccgcccaggtttag

SEQ ID NO: 49118 - DNA, 330 bp, Artificial Sequence
  Description of Artificial Sequence: Synthetic coding sequence
atgccctttactttgcatctgagaagtaggctacccagtgcgattagaagcctcatcctgcaaaagaaacccaatatccgtaatacttcaagcatggctggggaactcagacccgcaagtcttgttgtcctgccacgtagcctcgcccctgcctttgagaggttctgccaagtcaacacgggcccactcccattgctgggacagagcgagcctgaaaaatggatgctgccacctcaaggagcaatctcggaaacgcggatggggcacccacaattctggaagtacgagttcggagcatgtacagggtccctggcaagcctggagcagtag

SEQ ID NO: 49119 - DNA, 606 bp, Artificial Sequence
  Description of Artificial Sequence: Synthetic coding sequence
atgcccttcactctccatcttcggagtcgcctacccagcgccatccgatcgctcatactgcagaagaagcccaacatacggaacacaagttcgatggcgggtgagttgcgacctgcctctctggtggtactacctaggtcgctggcccctgccttcgaacgattttgccaagttaatacaggtccattaccactcctcgggcagagcgagcccgagaaatggatgctgccaccccaaggcgctatcagtgagactcgcatgggccatccgcagttttggaagtacgaatttggagcctgtaccggcagccttgccagtctggagcaatactccgagcagctcaaggatatggttgccttctttctgggttgcagcttctcactcgaggaggcgttggagaaggctggtctgccccgtagggacccagcaggacactcgcaagcaggcgcatataaaactacggtgccctgcgtgactcatgcgggattttgctgtccgttggttgtgactatgcggcctattccaaaggataaactcgagggactcgtgcgtgcatgttgctcattaggaggagagcagggccagcctgtacacatgggcgactag

SEQ ID NO: 49120 - DNA, 1695 bp, Artificial Sequence
  Description of Artificial Sequence: Synthetic coding sequence
atgccgttcacactgcatctgaggagccgccttccatccgcaatcagaagcctaatactgcagaaaaagcctaacattcgcaacacatcatcgatggccggagagttgcgtcccgcttcacttgtagtgctccctcggagcctggcgcctgctttcgagcgcttctgtcaggtgaacaccggcccattgccgctcttgggccagtctgagccagagaagtggatgctgcctcctcagggcgcaattagcgagaccaggatggggcacccccagttttggaagtatgaatttggagcgtgtaccgggtcccttgcctccctggaacagtattcggaacagctgaaggacatggtcgctttctttctgggatgcagtttctctttggaagaagctcttgagaaggccggtctgcctagaagggacccagctggacattctcagacaacagtgccctgtgtcacacatgctggtttctgctgccccctggtggtcacgatgagacctatccccaaggataagctggaggggctcgttcgcgcttgttgtagtttgggggaactccttgggattaaggagctgagtaaacctgcttatggagatgcaatggtgtgtccgcctggagaagtgccagttttctggccatcccccctgacctctctgggtgcagtgtcctcttgcgagacacctctggcttttgcttcaatccccggttgtaccgtcatgacagacttgaaggacgctaaagcaccacctggatgtctgacaccagaacgcatcccagaggtacatcatatctcacaggatccgctgcactatagcatagcttctgtgtcggccagccaaaaaatcagggaattagaaagtatgattggcattgatcccggtaaccgcggtatcggccacctgctctgcaaggatgagctactgaaagctagtctgtcattaagtcatgccaggagcgtcctcatcaccacgggttttcccacgcatttcaatcacgagccccctgaagagacagatggccctccaggcgcagtggcactcgtcgcattcctgcaggcactcgagaaagaggttgcaatcatagtagatcaaagagcatggaacttacaccagaagattgtagaggatgccgtcgaacagggcgttctcaagacacagattcccattctgacatatcagggcggatctgtggaggctgctcaggcgttcttgtgcaaaaacggggaccctcagacacctcgctttgatcaccttgtggccattgagagggcaggtcgggctgcagatggcaattactacaacgccaggaagatgaacattaaacatttagtggacccgattgacgacttgtttctggccgcaaaaaagatccccggaatttcttccacaggcgtgtccaactggggaggctatgctctggcctgcgctctctacatactgtattcatgcgccgttcactcccagtacctccggaaagccgtaggcccttccagggccccaggagaccaagcttggacacaggctctgccctccgtgatcaaggaagagaaaatgctgggtatcctagtgcagcacaaagtccggtctggcgtgagcggtattgtcgggatggaggttgatggcctgccctttcataatacacacgcggaaatgatacaaaaactagtggatgtgacgaccgctcaggtctag

SEQ ID NO: 49121 - DNA, 378 bp, Artificial Sequence
  Description of Artificial Sequence: Synthetic coding sequence
atgccattcaccctgcacctccgcagccgcctcccgtctgcgatccggagcctcattttgcagaaaaaacccaatatccggaacacctcgtcaatggcgggagaactaaggcccgcttcattggtcgtcctgcctaggagtctggctcccgcatttgagagattttgccaggtgaacactggtccgctcccactcctgggtcagagcgagcccgagaagtggatgttacctccccagggagcaatcagtgaaacccgtatgggacacccgcagttctggaaatacgagtttggtgcctgcaccgggtccctcgccagcctcgaacaatactccgaacagttgaaagacatggtcgcattctttctcggctgttcttag

SEQ ID NO: 49122 - DNA, 1746 bp, Artificial Sequence
  Description of Artificial Sequence: Synthetic coding sequence
atgcctttcaccctccacctgagaagccgtcttccgtctgccattcgatctctgattttgcagaaaaagcctaacatacggaacacgagctcaatggcaggggaactcagaccagcctccctggtggtcctgccccgaagtttagctcccgcattcgagagattctgccaggtcaacaccggtcctttacctctgctgggtcaatctgagccagagaagtggatgttacctcctcaaggtgccatctctgaaacgcggatgggccacccgcagttttggaaatatgagttcggcgcttgtaccgggtctctcgccagtctggagcaatactccgagcagctcaaagatatggtcgcattcttcctgggctgttctttcagtctggaggaagcccttgagaaagcgggactgcccaggagagaccccgcagggcactcacaggcgggagcctacaaaactaccgtgccatgcgtgacccacgccggattttgctgcccactcgtggttaccatgaggcccattccaaaagataagttagaaggcttggtgagagcttgttgcagcctggggggagagcaaggacaaccagtgcatatgggggatcccgaactgctgggtatcaaggaactgtctaagccggcttacggggacgccatggtgtgtccaccgggtgaagttcccgtcttctggcccagcccccttacctccttaggggctgtctcaagctgcgagacccctctcgctttcgcgagcatacctggatgcaccgttatgaccgatttgaaggacgccaaagcccctcccggatgcctcaccccagagcgaatccccgaggtacaccatatttctcaggatcctctgcactacagtatagcttctgtgtctgcctctcagaagattagggaactggagtccatgattggaatcgatcccggtaacagaggcattgggcacctcttatgtaaggacgaactgctgaaggcctctctgagcctgagccatgcacgtagtgtgcttatcactaccggctttccaacccacttcaatcatgagcctcctgaggagaccgacggtcccccaggagcggttgcactagtggcattcttacaggctctggagaaagaggtggcaatcattgtggatcagagggcatggaatctccaccagaagattgtagaggatgctgttgaacagggggttctgaagactcagattcccatccttacctaccagggtggctccgtagaggccgctcaagcattcttgtgtaagaacggcgatcctcagaccccaaggtttgaccatttggtcgctattgaacgtgcgggtagggcggctgatgggaattactacaatgcaagaaaaatgaatatcaaacatctcgtggatccaattgacgacttatttctggctgccaaaaagatcccaggcatcagtagcacgggagtgagcaattggggtggctatgccctcgcttgtgccctttatatcctgtactcttgcgccgtccacagccagtatctgcgtaaagcagtgggaccctcacgggctccgggtgaccaggcatggacacaggctctgcctagcgtaattaaagaggaaaagatgctgggcatcctcgtgcaacacaaggtgagatcaggtgtcagtgggatcgtgggcatggaggtggatggcctgccatttcacaacacacacgctgagatgattcagaaactagtcgatgttacgacagctcaagtctag

SEQ ID NO: 49123 - DNA, 78 bp, Artificial Sequence
  Description of Artificial Sequence: Synthetic coding sequence
atgcccttcacccttcatcttcggtcccgactgccgagcgctattaggagcttaatcttgcagaagaagccaaactag

SEQ ID NO: 49124 - DNA, 459 bp, Artificial Sequence
  Description of Artificial Sequence: Synthetic coding sequence
atgccatttaccttgcacctcaggtcccgtctaccctctgctatccggagcctgatcctacaaaagaaaccaaatatcaggaatacgtcatcaatggccggagaactgcgtccagcctccctagttgtgctgcctaggtccctggcaccggcttttgagcgcttctgtcaggtgaacactggccctctgccattactgggacagtccgaacccgagaaatggatgctacccccacagggagctatttccgagaccagaatgggtcatccccaattttggaaatacgagtttggggcatgtaccggtagcctggcatcactcgagcagtattctgagcaattaaaggacatggtggcttttttcttaggatgttccttttctctcgaagaagctctagaaaaagcaggtctgcctagacgcgatccagcaggtcatagtcaggcaggtgcatataagtag

SEQ ID NO: 49125 - DNA, 609 bp, Artificial Sequence
  Description of Artificial Sequence: Synthetic coding sequence
atgcccttcactctgcatttgcgttcccgactgccgtcggccatcaggagccttatattgcagaaaaaacctaatatcagaaacacctctagtatggccggagaactcagacccgcatctctagtggttctcccgaggagtctcgctcctgctttcgagaggttttgtcaggtgaacacaggcccacttcctctcctggggcagtcggaaccagaaaaatggatgctgcccccacagggcgcaatttccgagaccagaatgggtcatccgcagttctggaagtacgagtttggagcatgcaccggcagtctggctagtctcgagcagtattcagaacagctaaaggacatggtggcctttttcctggggtgctctttttctctggaggaggctttggaaaaggcgggactgccgcgacgtgaccctgctggacactcccaagccggtgcatacaagactaccgtaccatgcgtgacccatgcaggtttctgctgtccgctagtggtcacgatgagaccgattcctaaagacaaactagaaggcctggtcagggcctgttgctccttaggaggggaacagggacagcccgtgcatatgggcgatccctag

SEQ ID NO: 49126 - DNA, 1851 bp, Artificial Sequence
  Description of Artificial Sequence: Synthetic coding sequence
atgccattcacactgcacctgcggtccagacttccaagcgccattcggagtctaatactgcagaagaaacctaatattcgtaatacctctagtatggcaggggaactcagacccgcatctctcgtcgtgctgccaagaagtctcgctcccgcttttgagcggttctgtcaggtgaacaccggacctctgccattgctgggacagtcagaacccgaaaagtggatgctcccacctcagggtgcaatcagcgagaccaggatgggacacccccagttctggaaatacgagttcggcgcttgtacagggtccctagctagcctggagcagtattccgaacagctcaaagacatggtagcgttcttccttggttgtagcttttcccttgaggaagcactggagaaagccggtctgccaaggcgagatcctgcaggccatagtcagacgacggttccctgcgtaacccatgcgggtttttgttgcccacttgttgtgactatgcggcctatccccaaagataagttggaaggtcttgtgcgtgcttgctgctccctcggcggagaacaaggacagcctgtgcacatgggagaccccgagctgctgggcatcaaggagttgtccaagccggcttatggggacgccatggtttgccctccaggtgaggtgcccgtcttctggccatccccactaacatcactgggtgctgtcagttcttgcgaaacacccctcgcatttgcgtctataccaggttgtacagtgatgactgacctgaaagatgctaaagctccgccaggatgtctgacccccgagcggatacccgaagttcatcatataagccaagatcctctgcattattctatcgcctcagtgtccgctagtcaaaaaatccgcgagctcgaaagcatgatcgggattgatcctggcaaccgcggaatcggccacttgctctgtaaggatgagctgctcaaggctagtctttctttaagccatgctcgatccgtcttaataactactgggtttcccacccatttcaatcatgagccaccagaggaaaccgacggcccacctggggctgtggcattggtggcttttctccaggccctggaaaaggaggtagctatcattgtggaccaacgcgcttggaatttgcatcagaagattgtggaagacgcagtggaacaaggggtactcaagacgcagattccaatcctcacataccagggcggatccgtagaggcggctcaagcatttctctgcaaaaacggtgatccacagacacctaggtttgaccacctcgtcgccattgaacgagccggtcgagccgcagatggaaattattataacgcacgcaaaatgaatatcaagcacctcgtggatccaatagacgatttatttcttgccgctaaaaagatccctggtatttcctcaacgggcgtgggagatgggggaaacgagctgggcatgggcaaagttaaggaagccgttcgacggcacatccgacacggagacgtgattgcttgcgatgttgaagccgactttgctgtgattgccggagtttcgaactgggggggatacgcactggcctgtgctctgtacatcctgtactcatgcgctgtgcactctcagtatttaagaaaggctgtgggcccttcccgagcccctggcgatcaggcctggacacaggcactcccgagtgttatcaaggaagagaagatgctcggcatcctggtgcagcataaggttaggtcaggtgtaagcggaattgtgggaatggaggtggacggcttgccctttcataatactcatgcagagatgatccagaaactggtcgatgttaccacagcacaagtgtag

SEQ ID NO: 49127 - DNA, 258 bp, Artificial Sequence
  Description of Artificial Sequence: Synthetic coding sequence
atgccattcacgcttcatctccggtctcgtcttccatctgccatccggagcctgatattacagaagaaacccaacattaggaacactagttcgatggccggagagctaaggccggcatcattggtggttctccccagatcacttgcaccagcttttgagcgcttctgtcaggtgaacaccggcccactgcctcttttaggacagtctgaaccagaaaagtggatgcttcccccacagggggctatctccgagacatag

SEQ ID NO: 49128 - DNA, 1851 bp, Artificial Sequence
  Description of Artificial Sequence: Synthetic coding sequence
atgccattcaccctgcacctccgcagtcggcttccatccgcaattaggtccctcatcctgcagaagaagcctaacattagaaatacctcttccatggctggagagctgcgacctgcctctctggtggttctgcccaggagtctggctcctgccttcgaacggttctgtcaggtgaatacaggaccattacccctccttggccagagcgagcctgagaagtggatgctgccccctcagggggcaataagtgaaacaaggatgggacatccacagttctggaagtacgagttcggagcgtgcactgggagcttggccagcctagaacaatactcagagcagttgaaagatatggtagccttttttttagggtgctccttctctctcgaagaagccctcgagaaggcgggacttcccaggcgcgatccagccggtcatagtcaaactaccgttccttgtgtcacacacgccggattctgctgtcctctcgtggttaccatgcgcccaatacccaaggataagctcgaagggctggtgcgcgcatgctgcagccttggtggcgagcagggacagccggtgcacatgggagatccagaattgctgggcatcaaagaactgagtaaaccggcatatggtgatgccatggtttgcccccctggggaggtcccggtcttctggccaagcccgctcacttccttaggggctgtctccagctgcgagacccctctcgctttcgccagtatccccggttgcacagtgatgacagatttaaaggatgctaaggcccctccaggctgcctaaccccagagaggataccagaggtccatcatatatcacaggacccactgcattattccatcgcttccgtttccgccagccagaagattagggagctcgagagcatgatcggcatcgacccaggaaaccgcggaattggccatttgctctgtaaagatgagctgttaaaggccagcctttcattatcgcacgcccgatctgtgcttattaccaccggattcccaactcacttcaatcacgagccacccgaggagaccgacggccctcctggagctgttgccttggtcgcctttctgcaggccttagagaaagaggtggctatcatagtcgatcagagggcctggaatctccatcagaaaatcgtcgaggacgctgttgaacagggggtgctgaaaacacagattcctatactgacatatcagggcggaagcgttgaagcggctcaagccttcttgtgcaagaatggtgacccgcagacccctcgctttgatcacctggtggctatcgaaagggccggacgcgctgcggacgggaactattataacgcgagaaaaatgaacataaagcatctggtcgatccaatcgatgatctgtttcttgcggcaaagaagatccccggaatctcctcgaccggagtgggtgatggcggtaacgagctgggtatgggcaaagtcaaagaagctgtcaggcggcacattcggcacggagatgtgatcgcctgcgatgtggaggccgactttgctgttatcgccggagtctcgaactggggtggttacgccctggcttgcgccctctatattctctatagctgcgcggtccactcccagtatttgcgcaaggctgtgggtccaagcagagcgccaggagatcaagcttggacccaggcgttaccttcagtgatcaaagaggaaaagatgctgggcatcctcgtgcagcataaggttcgcagcggcgttagcggaattgtgggaatggaggtggatgggcttccttttcacaacacacacgcagaaatgatccaaaaactggtggacgttacaacagctcaagtgtag

SEQ ID NO: 49129 - DNA, 1851 bp, Artificial Sequence
  Description of Artificial Sequence: Synthetic coding sequence
atgccgttcacccttcatctgaggagtcgtctccctagcgcaatcaggagcctgattcttcagaaaaagccaaatatcagaaatactagttcaatggccggtgaactgcgaccggcaagcctggtcgtattaccgagaagtctcgctcctgctttcgagagattttgtcaagtgaacaccggacctctcccactcctcggccagtccgaacctgaaaagtggatgctgcccccacagggggctatctctgagacaaggatgggtcaccctcaattttggaagtacgaatttggagcttgtacaggatctctggcctccttggagcagtactcagagcaactgaaagacatggtagcatttttcttgggctgctcattttcacttgaagaagccttggagaaggcagggttgcctagacgggacccagctgggcactcccagacaaccgttccatgcgtaactcacgccggtttctgttgtcctctggtggtgaccatgcgcccaattccaaaggataagcttgaagggcttgtgcgcgcatgttgctccctgggaggagagcaaggacagcctgtacatatgggggatccagaactgctggggattaaagaacttagtaagccagcttacggggatgccatggtatgcccccctggggaggtgcccgtgttctggcccagcccactgacctctctgggggctgtttcttcctgcgagacacctctggcattcgcttcgatcccagggtgtaccgttatgactgatcttaaagatgccaaggctccacccggatgcttgacacctgagcgaattcctgaggttcaccatatttcccaggatcccctgcactattccattgcctctgtgagcgcttcgcagaagatccgggagcttgagtcaatgatagggattgatcccggtaatcgcggaatcgggcatttgctatgcaaggatgaattgctgaaggcttccctcagcctatcccatgccagatccgtcctgataaccactggattccccacacattttaatcacgaaccaccagaggagacagacggccctcccggagcggtggctctcgttgcttttctgcaggctttagagaaggaagtggctatcattgttgaccagcgggcttggaatctccaccagaaaatcgtggaagatgctgtggaacaaggcgttctcaaaacccagatacccatcctcacctaccagggaggcagcgttgaggccgctcaggcatttctgtgtaagaatggcgatcctcagacacccaggttcgatcatctggttgccatcgagagagcagggcgagctgccgacggaaactactataacgccagaaagatgaatatcaaacaccttgtagatcctatcgatgacttattcttggccgctaaaaaaatacccggtatttcttccaccggagtgggagacggaggcaatgaacttgggatgggaaaggtaaaagaggctgtgcgacgacacattagacatggcgatgtaattgcgtgtgatgtggaagccgatttcgctgtcatcgcaggcgtgtccaactgggggggatatgcgttggcctgcgccctctacattctatacagctgcgccgtgcattcccaatacttgcgcaaagctgtgggaccttccagggcgcctggcgaccaggcctggactcaagccttaccttcggtaattaaggaagagaaaatgctgggaattttggtgcagcacaaggttcgctccggagtcagcgggattgtgggcatggaagtggacgggctcccattccacaatacccacgccgagatgattcaaaagctggtggacgtaacaacagcccaggtgtag

SEQ ID NO: 49130 - DNA, 252 bp, Artificial Sequence
  Description of Artificial Sequence: Synthetic coding sequence
atgccctttacactgcacctgaggagcaggcttccttccgccatacggagcctcattctacaaaaaaagcccaatattcgcaacacctcctccatggcaggtgaactgaggccagctagcctagtggtcctacctaggtccctggctcctgccttcgagcgcttttgtcaggtgaataccggaccgttgcccctcttgggacagtccgagcctgagaaatggatgctcccaccccaaggcgctatttcctag

SEQ ID NO: 49131 - DNA, 459 bp, Artificial Sequence
  Description of Artificial Sequence: Synthetic coding sequence
atgccgtttaccctccatttacgctccagactgccaagcgctatccgcagtcttatcctccagaaaaagcctaacattcgaaacacatcaagtatggcaggcgaattgagacccgcttcgttggtcgtcctgcccaggtctctggcaccagcattcgagcggttctgtcaagttaacaccggtcccttacccttgctggggcagtccgagcctgagaagtggatgttgcctccccaaggggctataagcgagacacgcatgggacatccgcaattctggaagtatgaattcggtgcctgcactggcagtctggcttccttggaacaatacagcgaacaactcaaggacatggttgcattctttctggggtgctcattttcactcgaagaggcactggagaaagccggactccccagaagggaccccgctgggcacagccaggctggtgcgtacaagtag

SEQ ID NO: 49132 - DNA, 159 bp, Artificial Sequence
  Description of Artificial Sequence: Synthetic coding sequence
atgcctttcactcttcacctgcgttcgaggctaccctctgccataagatctctcattctgcagaaaaaaccaaatattcgaaacacgagttccatggctggagaactccgtccagcctccttggtggtgctgccgcgttcgctggcgcctgcgttctag

SEQ ID NO: 49133 - DNA, 1479 bp, Artificial Sequence
  Description of Artificial Sequence: Synthetic coding sequence
atggtggcttttttccttggctgctcctttagcctagaagaggccctggaaaaagctggggcatacaagaccaccgtgccctgcgtgacccatgccggattttgctgcccccttgtcgttacaatgcgccctattccgaaagacaagctcgaggggctcgtgcgagcttgttgtagccttgggggagaacagggacagcctgtgcacatgggcgatccggaacttctaggaatcaaggaactgtccaagccagcatatggcgacgctatggtatgtcctccaggggaggtccccgtcttttggcctagtccactgacatccctcggagccgtgtcctcttgtgagacccctttggctttcgcatctatcccagggtgtacagtgatgaccgacctgaaggacgctaaagcgcctcccggatgcctgactcctgagcggatccccgaagtgcaccacatttcacaagatccattgcattactccatagcatcggtctctgcttcccaaaaaatacgagaactggaaagtatgattggaatcgatccagggaataggggcatcgggcatctgttatgtaaggacgaattattgaaggccagcttatctttatctcatgctcgatcagttttaattaccaccggttttcccacacattttaaccatgagcctcctgaggaaacagacgggcctcccggagctgtcgccttggtcgcctttctccaggccctggagaaggaggtagccatcatcgtggatcagagagcttggaacttgcatcagaagatcgttgaggatgctgttgagcaaggtgtcttgaaaacccagattccaattctgacataccagggcggttcagtggaagctgctcaagcattcctctgtaagaacggcgacccacagactccacgatttgatcatctggtggcgatcgagcgtgccggacgcgctgccgatggcaattattacaatgccagaaaaatgaatataaaacacctggttgatcccattgatgacctgtttctggccgctaaaaaaatccctggcatcagcagcaccggagtcggagatgggggtaacgagcttggaatgggtaaggtgaaggaagctgtgaggagacatattagacacggcgatgtcatcgcttgcgatgttgaagctgattttgccgtcattgcaggagtctcaaattggggcggttatgcactggcctgtgctctatacatactctatagttgtgctgtgcattcccagtatctgcgaaaagccgttggtccctcccgcgctccaggcgaccaggcctggactcaagccctgcctagcgtgatcaaagaggaaaagatgttgggaattctggtacaacacaaggttcgttctggcgtttctggtatcgttggaatggaggtcgatggtcttccgttccataacacacatgcggagatgattcaaaagcttgtagacgtgaccaccgctcaagtatag

SEQ ID NO: 49134 - DNA, 483 bp, Artificial Sequence
  Description of Artificial Sequence: Synthetic coding sequence
atgcgcacagctgccggagccgtatcccctgatagcagaccagaaactcgaaggcaaacccgcaaaaacgaagaggcagcctggggcccacgcgtgtgccgggctgagagagaagacaaccgcaaatgtcctccttccattctgaagcgcagccgcccagaacaccacaggccggaagctaagccccagcggacaagccgacgagtttggtttcgagagcctcccgcagtcaccgtccactatattgccgacaagaatgctacagccaccgtgcgagtgcccggacggccacggcctcacggtgggtctctgctgctgcagctgtgtgtctgcgtgctgctcgtactggccctgggactctattgtggacgagccaaacctgtggctacggctctcgaggacctgcgagctaggctcctggggttagtcctccacctaagacatgtggcactgacctgttggcgcggactgctgagactgtag

SEQ ID NO: 49135 - DNA, 483 bp, Artificial Sequence
  Description of Artificial Sequence: Synthetic coding sequence
atgcggacagcagcaggcgctgtcagccctgacagtaggccagaaacccgccgtcagactcgcaaaaacgaggaggccgcatggggcccacgcgtttgcagagccgaacgggaggacaacagaaagtgccctccatctatattgaaacggtccaggcctgagcatcataggccagaggcaaaaccacagcgcacctccaggcgcgtgtggttcagggaaccccctgctgttacagttcactacatagccgacaagaatgctacagccacggtgagggtgcccggtaggcctagaccacacggaggcagcctactccttcaattgtgcgtctgcgtgctcctggtgctggcgctgggcctgtattgtggcagggcgaaacccgtggcaacagctttagaagatctgagggcccgactgctaggtctagtgcttcacctgcgccatgtggcactcacttgctggaggggcttactgaggctttag

SEQ ID NO: 49136 - DNA, 2325 bp, Artificial Sequence
  Description of Artificial Sequence: Synthetic coding sequence
atgcgcggtcccatagtgctccacatttgtctggcattctgttcgctgctgttgttcagcgtcgctacccagtgtctggccttccccaagattgagcggagaagagagatcgctcacgtccacgccgaaaaaggccagagcgacaagatgaacaccgatgacctggagaactcgtctgtcaccagtaaacagacccctcaactggtcgtctcagaggaccccatgatgatgtctgccgtgccaagcgctacttctttaaataaagcattcagcataaacaaggagactcagcctggacaagctggcctcatgcaaaccgaacggccaggtgtttccacccccacagaaagcggagttccctctgctgaggaagtgtttgggtcttcacagcccgagcgtattagccccgagagcggcctcgcaaaagccatgctcacaatcgcgattaccgccacccccagtctgactgtcgatgagaaagaggagttgctgacatccaccaacttccagcctatcgtcgaggaaattacagagacgactaagggcttcctcaagtatatggacaatcagtcttttgccacagagtcccaggagggcgtgggtcttgggcacagcccttcatcctacgtcaatacgaaagagatgttaactacaaacccaaagacagagaagtttgaagccgacaccgatcaccggacaacatcttttcccggagccgagtctactgcaggttctgaacccggatcgttgacaccggataaggaaaaaccaagtcagatgactgctgacaacacccaggcagccgctactaagcaaccacttgagacatctgaatacactctgagcgttgaacccgagacagactctctgctgggggctcccgaggttacagtgtccgtgtcaactgctgtcccagccgcttccgcgttgtcggacgagtgggatgacacaaagcttgaaagcgtcagtagaattaggacgccaaaactgggcgataatgaagagacacaagtccggacggaaatgtctcagactgcccaggtgtctcatgaagggatggaaggcggacagccttggacggaggcagctcaagtcgccctgggactccccgagggtgaaacacacacaggcaccgctctcctaattgcccacggcaacgagcgcagtcccgcttttactgatcagagctccttcacaccaacatctctcatggaggacatgaaggtatccattgttaaccttctgcagagtacgggcgactttacggaatccaccaaagagaacgatgcactgtttttcctagagacgaccgtgtccgtgtcggtttatgagtcggaggctgaccagttgctcgggaacacaatgaaagatataatcactcaggagatgactactgcggtgcaggaacccgacgccaccctcagtatggttacacaggaacaggtcgcaacattggaacttatcagggattccggtaaaactgaggaggagaaagaggacccatcaccggtctctgacgtgccaggagtaacacaactctcacggcgatgggagcctctggcaaccaccatttccaccactgtcgttcccctctctttcgaagtcaccccgaccgtggaagagcagatggatacagtgacgggcccaaatgaggaattcacccctgtgctgggttctcccgtaacacccccaggaataatggtgggcgagccttcaattagtccagcactcccagccctggaggcgagctcagagcggaggacagttgttccctctattacaagggtgaacacggctgcgagttacggtctggatcagctcgagtctgaggaaggacaagaagatgaggacgaagaagatgaagaggatgaggacgaagaagaggaggatgaggaagaggatgaagaggacaaagatgcagattccctggacgaaggtttggatggggataccgagctaccaggttttacactgcccggtattacaagccaggagcccggactggaggagggcaacatggaccttctcgagggagcaacatatcaggtgcctgacgccttagaatgggaacagcagaaccaaggcctagtaaggtcttggatggagaagctgaaagataaggccggatacatgagtggaatgttggtgccggtgggtgttggtatcgctggagctctctttatactcggggcactctatagtatcaaggtgatgaaccgccgacgaagaaatggttttaaaaggcacaaacggaaacagcgggagttcaacagtatgcaagacagggtgatgctcttggcagacagttccgaggacgaattctag

SEQ ID NO: 49137 - DNA, 729 bp, Artificial Sequence
  Description of Artificial Sequence: Synthetic coding sequence
atggctgctgccctttggggcttttttccggttcttctactgctgttactaagtggtgatgtgcagtcttctgaggttcctggagctgccgcagagggctcaggtgggtcaggcgtgggtatcggcgacaggttcaagatagaggggagggctgtcgtaccaggcgttaaaccacaggactggatctccgccgctcgcgtcctggtggacggcgaagaacacgtcggattcctgaagacagacgggtctttcgtggtgcatgacattccatccggaagctacgtggtggaagttgtgagtcccgcatataggtttgatcccgtgagagtggacattacctctaaaggcaagatgcgagctcgctatgtcaattatattaaaaccagcgaggtggtgcgtcttccttaccctctgcagatgaaatcctctggaccaccatcatatttcattaaaagggagagctggggatggacagacttcttgatgaaccctatggttatgatgatggttctcccccttcttatattcgttttgctccccaaggttgtgaataccagcgatcccgacatgcgccgagagatggaacaaagtatgaacatgctgaactctaatcatgagctgcctgatgttagcgagtttatgacaagactcttcagttctaagagttccggcaagagttcaagcggatcctccaagaccggcaaatccggtgcaggtaagcggaggtag

SEQ ID NO: 49138 - DNA, 1596 bp, Artificial Sequence
  Description of Artificial Sequence: Synthetic coding sequence
atggccgtggcccctagtttcaacatgaccaaccctcaaccagcaattgagggtggaatttcagaagtggaaataatctctcagcaggtggacgaggaaacaaaaagcattgcacccgtccaattggttaactttgcttatagggatctccctctggccgctgttgatctgagtaccgcaggctcgcaactgctgagcaacctcgacgaagactatcagcgggaaggctcaaattggcttaagccatgttgtggaaagagagcggctgtctggcaggtgtttctcctttcagcgagtctcaacagcttcctcgtggcttgtgtcatactggttgtcattctgttgactctcgagctgctgatcgatatcaaactcctgcagttttcttcagcatttcaatttgcgggagtgattcactggatctctctggtgatcttgtctgtcttcttctcggaaactgtgctgagaattgtggtcttagggatctgggattatatcgaaaacaagatagaagtgtttgatggcgctgtaatcattttgagcctggcccctatggttgcgtccactgtagcaaatggccctcgtagtccttgggatgccatttctcttattattatgcttcgaatctggcgtgtgaaacgtgtaattgatgcctacgtcttgcctgtcaagctcgaaatggaaatggtaatacagcagtacgagaaagctaaagttatccaggacgagcagctggaaagattgacacagatttgtcaggaacagggctttgagatccgccagctgagagctcacctggcccagcaggatcttgacctggcagcagaacgtgaggccgcacttcaggcgcctcacgtcctgtctcagcccagatctagattcaaagtgttggaggcaggaacctgggacgaagagaccgccgctgaaagcgtagtggaggagttacagccctctcaggaggcaacgatgaaggacgacatgaatagttatatctctcagtattacaacgggccttcaagcgactcaggtgtcccagagcccgcagtgtgtatggtcacgaccgctgccatcgacatccaccaacccaacatcagcagtgatttgttttctctggacatgcccctgaagcttgggggtaatggcacctctgccacctcagaatccgcctccaggtcctccgtcaccagagctcagtcagattcatctcagacactcggaagctccatggattgttcaacagcacgagaggaaccatctagcgaacctgggccttcccctccgccactgccttcacagcagcaggtggaagaagcaacagtgcaagatcttctgtccagcctttctgaggacccctgcccttcccagaaggccttggacccagcccctctggcgaggcccagcccggcaggttctgcacagacatcaccagagcttgagcatagagtcagtctctttaaccagaagaaccaggaaggattcacagtgtttcagattaggcctgtgatccacttccagccaacagtccctatgctagaagacaaatttcgcagcctggagagtaaagaacagaaactgcacagagtacctgaagcctag

SEQ ID NO: 49139 - DNA, 252 bp, Artificial Sequence
  Description of Artificial Sequence: Synthetic coding sequence
atgtcattctttcagttgctgatgaagagaaaggaattgattcccttggtggttttcatgaccgttgcagctggaggggcatcctccttcgcggtgtacagtctatggaaaacagacgtcatcttggaccgaaaaaagaatcctgagccttgggaaactgtggatccaacggtcccccaaaaactcattacgatcaaccagcagtggaaacccatcgaggaactgcaaaacgttcaaagagtgaccaaatag

SEQ ID NO: 49140 - DNA, 252 bp, Artificial Sequence
  Description of Artificial Sequence: Synthetic coding sequence
atgagttttttccagctgctgatgaaaaggaaggaactcatccccctcgtggtatttatgaccgtggccgcagggggagcaagcagtttcgccgtgtattccctctggaagacggacgtcatcctggatcggaaaaaaaaccccgagccttgggaaacagtagatcctacggttccacagaaactgatcactattaaccaacagtggaagcccatcgaggagctgcaaaatgtgcaaagagtcactaaatag

SEQ ID NO: 49141 - DNA, 528 bp, Artificial Sequence
  Description of Artificial Sequence: Synthetic coding sequence
atggaaacatggagaaaagggtcatttaggaatgcctcattctttaagcagctcagtctgggacgcccaagacggctgcggcgacaatcctccgtgttatcccaagcatccacagctgggggagaccacgaggagtatagtaatagagaagtgatccgggaacttcaaggtcgtccagacggtcggagattgcccctttggggggacgaacagccaagagcaactttgctggcaccaccaaagcctcccaggctttaccgagagtcaagctcatgccccaacattttggagcccccaccagcctacaccgccgcttattcagcaacacttccgtccgccctcagcctatcctcagccctccaccagcattctgaaaagggcctagtcgatacaccatgcttccagcgaacaccaacacctgacctgtcagatccctttctttcattcaaggtcgatcttgggattagcctcctcgaggaggttctgcagatgttgcgcgaacagtttccttccgagcctagtttttag

SEQ ID NO: 49142 - DNA, 528 bp, Artificial Sequence
  Description of Artificial Sequence: Synthetic coding sequence
atggagacgtggcgtaagggtagtttcaggaatgctagtttctttaagcaactttccctgggacgaccaaggcggctcaggcggcagtcgtctgtcctgagtcaggcaagcacagcaggaggggaccacgaggagtactcaaatcgggaggtaattcgggagctacagggaagacccgatgggcgtaggctccctctttggggagatgaacagcctcgggcaacacttctagcccctcccaagcctcccaggctgtaccgggaaagttcttcatgtcccaacatcctagagccccctcctgcatatacagccgcttacagcgcaactctcccctctgcattaagcctttcctctgccctccaccaacacagcgagaaggggctggtggatacaccttgcttccagcgtactcctacccccgacttgagtgacccatttctctcctttaaagtggacctggggatctcactgctggaagaagtgctgcagatgctgagagaacagttcccctctgaaccatccttttag

SEQ ID NO: 49143 - DNA, 675 bp, Artificial Sequence
  Description of Artificial Sequence: Synthetic coding sequence
atgccattgactccagagcccccttcaggtcgagtggaaggaccccctgcatgggaagctgccccatggccttcactgccctgtgggccatgcatacctataatgctcgtgttggctacactggctgccctgttcattctgacgactgccgtgctggcagaacgtttgtttcgacgagcacttaggccagacccatcacatagagcccctacacttgtgtggcgcccaggtggagaactgtggattgagcccatgggcaccgcacgggagcggtcggaagattggtacggctctgccgtcccacttttgaccgacagagccccagaacctcctacccaagtgggaacgctggaggcaagagccaccgcgcctccggcaccttctgcgcctaacagtgcccctagcaacctcggccctcagactgttctggaggtaccagccaggtcgaccttttggggaccacagccctgggagggcagaccaccagccactgggcttgtgagttgggcggagccagaacagcggcctgaagcctccgtccagttcggctctccccaggccagaagacaacggcctggtagccccgatcccgagtggggacttcaacctcgtgtgactctggagcagatctccgctttctggaagagggagggacgtacaagcgtgggattctag

SEQ ID NO: 49144 - DNA, 1407 bp, Artificial Sequence
  Description of Artificial Sequence: Synthetic coding sequence
atggctgatgatgccggactggagactcctctctgttctgagcagttcggctccggagaagcacgcggttgtcgagcagctgcagatggcagcctccagtgggaggtcggcggatggaggtggtggggattgtctagagccttcactgtgaagcccgagggtagggatgccggtgaggtgggcgctagcggggctccttcccctcccttgtccggactgcaggcagtctttttacctcaggggttcccagacagtgtgagcccagactatctgccctaccaattatgggatagcgtccaggcctttgccagctctctgtcaggctccctcgctacccaggctgtgttactcggaatcggtgtcggaaatgccaaagcaacggtgagcgcagcaacagccacatggcttgtgaaggacagcaccggaatgcttggcaggattgtgtttgcttggtggaaggggtcgaaactcgattgcaatgcaaagcaatggaggctgttcgccgatattcttaacgacgttgccatgtttctggaaatcatggcccctgtgtatccgatttgtttcacaatgaccgtgagcacatctaaccttgccaagtgcatcgtgagcgtggccggtggagcaaccagagctgccctcactgtacaccaggccaggcgtaacaacatggccgatgtgtcagctaaagactcatctcaagagacattagtgaatctggcaggacttttagtctccttgctgatgttgcctttagtttccggctgtcccggtttcagcctcgggtgtttcttttttctgacagctttacatatttacgccaactacagagctgtccgggcactcgtgatggagactctgaatgagggcagactgcggctggttctgaagcactacctccagcgaggggaggtgctggatccgaccgccgcaaatcggatggaaccattatggaccggattctggccagctcccagtctctcactcggggtgcctctgcatagactcgtgtctagtgttttcgagttgcagcagctcgtggaaggacaccaagaatcttacctcttgtgctgggatcagtctcagaatcaagtccaggtcgtgttgaaccagaaagcaggaccgaagaccattctacgcgcagcaacccatggattgatgctgggagccctccagggagacgggcctctcccagcagagctggaggaactgaggaatcgtgttagagcgggacccaaaaaagaatcatgggttgtagttaaggaaacccacgaggttttggacatgctattccctaagttcctgaaaggcctgcaagacgccggatggaaaaccgaaaagcatcagctagaggttgatgagtggcgtgctacctggttgctctcccccgagaagaaggtgctttag

SEQ ID NO: 49145 - DNA, 585 bp, Artificial Sequence
  Description of Artificial Sequence: Synthetic coding sequence
atgcttgggagaatcgtgttcgcttggtggaaagggtctaaactggattgcaacgccaagcagtggaggctgttcgcggatattctgaatgatgttgccatgttcctcgaaatcatggcccctgtgtacccgatttgttttaccatgacagtgtccacctctaatctggccaagtgtattgtcagcgtggcaggtggcgcaacacgtgctgccctaaccgtgcatcaggctcgccgaaataacatggcagatgtgtcggccaaagactcgagccaggaaactctggtcaacctagccggattgctggttagtctcctgatgctgccactggtgagcggctgtcctggattctctctaggctgcttcttttttcttacagctctgcacatctacgcaaattaccgggctgtccgcgctctcgtgatggagaccttaaacgagggccgacttcggctggtcctcaaacattatcttcagcgaggagaggtgcttgacccaaccgccgctaacaggatggagcctctctggaccggtgaccccgctccaggcctcggctcctgcgtcagcacctcacccacagcctag

SEQ ID NO: 49146 - DNA, 1269 bp, Artificial Sequence
  Description of Artificial Sequence: Synthetic coding sequence
atggccgatgacgccggactggagacgccattgtgctcggaacagtttggaagcggcgaggctagaggctgccgggcagcggcagatggcagcctgccacagggatttccagacagcgtaagcccagactatcttccttaccagctgtgggattccgttcaggccttcgcttctagccttagcggcagtctggccactcaggctgtactgctggggataggcgtgggtaacgcaaaggccactgtcagtgccgctacggccacctggttagtcaaggattcaacgggcatgcttggacgcatcgtgtttgcatggtggaaaggttcaaagctcgattgtaacgccaaacagtggcgcctatttgccgacatccttaatgatgtggcaatgtttctggagattatggcacccgtctaccctatctgctttactatgacagtaagcacctccaacctggcaaagtgtatcgtctcagtggccggaggagccacccgggcagccctgactgttcatcaggcacgcagaaataatatggcggacgtgagcgctaaggattccagtcaggaaaccctcgttaatctggcaggcctgctggtcagcttgctcatgttaccgctcgtgagtggatgccccggtttctccctgggctgtttcttcttcctgacagcactgcatatttacgctaactacagagctgttcgagctctggtgatggagacgcttaacgaaggacgccttaggctagtccttaaacactatctgcagagaggtgaggttctggatcctacagccgcaaacagaatggaacccctctggacaggtttttggccggcaccctccctctccctgggtgtgccccttcacaggctggttagttcagtctttgagctccaacagctggtggagggacaccaggagtcctacctactctgctgggaccagagccagaaccaggtacaggtggtgttaaaccagaaagcagggcctaagaccattttgagagccgcaacgcacggccttatgctcggagcattgcagggggacggtccattaccagctgaacttgaggagctgcgcaatcgcgttagagccggacccaaaaaagaatcttgggttgtggtgaaagaaacccacgaggtgctcgacatgctgttccctaagtttctgaagggcctccaggatgctgggtggaagaccgagaaacaccagctggaggtagatgaatggcgcgctacatggcttctgtctcccgagaaaaaggtgttgtag

SEQ ID NO: 49147 - DNA, 471 bp, Artificial Sequence
  Description of Artificial Sequence: Synthetic coding sequence
atggcggatgatgctgggctggaaacaccactgtgttcagagcaatttggttccggagaggccagagggtgtcgtgccgcagccgacgggtcactccagtgggaagttgggggttggcggtggtggggcctaagccgggctttcaccgtgaaaccagaaggccgtgacgctggggaagtgggggcttcaggggctccttcccccccactgtctggattgcaggccgttttcctgcctcaggggttcccagactctgtcagtcccgactatctgccctaccagctctgggacagcgtgcaggcttttgcatcaagcctctctggttcactggctacgcaggccgttctcctggggataggagtcgggaacgcaaaggctaccgtttccgctgcgacggccacttggttggtcaaagattcgacggggatgctaggaaggatcgtgttcgcctggtggaagggggctagttag

SEQ ID NO: 49148 - DNA, 2892 bp, Artificial Sequence
  Description of Artificial Sequence: Synthetic coding sequence
atggcagtgtttccgtggcactcccgcaatcggaactacaaggctgagttcgcctcatgtcggcttgaagcagtcccactcgagtttggcgactatcatccgcttaaacctataacagttacagaaagcaagacaaagaaggtgaatcgaaagggctccacttctagtacctcgtctagttcttccagcagcgtggtcgatccgttgagctccgtactcgacgggaccgatcctctcagcatgttcgctgccactgcagaccctgccgcacttgccgctgctatggatagctcccgacgcaagcgggaccgcgatgacaattccgtcgtgggctcggattttgaaccgtggacgaacaaaagaggagagatcctggccagatacacaaccaccgagaagctgtctatcaacctcttcatggggagcgagaagggaaaagccggtacggcaaccctggccatgtcggagaaggtcagaactaggctggaggagctggatgatttcgaggagggatcccagaaagagctgctaaatctgactcagcaggactacgtaaataggatagaggagctgaatcagagccttaaagatgcgtgggccagcgatcagaaggtcaaagccctgaagatcgtcattcagtgtagcaagctcctgtcggataccagtgtgatacaattttacccgtccaagttcgtgctgataacggacatcctcgatacctttggcaaactcgtgtatgaacgcattttctcaatgtgtgtcgacagcagatctgtcctgccagaccatttctctcccgagaatgccaacgacacagcaaaagaaacatgcttgaattggttcttcaaaatagcctccattcgagagttgatacccaggttctatgtggaagcttccatcctgaagtgtaacaagtttttgtctaagaccggtatttcggagtgtcttcccagactaacatgtatgatacgcggtatcggtgacccccttgtcagtgtgtacgctagagcatatctgtgcagagtgggcatggaggtggcgcctcacctgaaggaaaccttaaacaagaactttttcgactttctactgacattcaaacagatacacggagacacggttcagaaccagctagtcgtgcaaggagtcgagctgccatcgtatctgcctctctaccctccagcaatggactggatcttccagtgcatctcataccatgccccagaagctctgctgacggaaatgatggaacgatgcaaaaaactgggaaacaacgccctgcttctgaactcagttatgtccgcatttcgcgcagagttcatcgccaccagaagcatggatttcattggcatgatcaaagagtgcgatgagtccggctttccaaagcacctactctttaggtccctgggccttaatctggccctggccgacccaccagagagtgatcgcctgcagatcctgaatgaggcgtggaaagtcataactaaacttaagaacccacaggattacatcaactgcgccgaggtgtgggtggaatacacctgtaagcactttaccaaaagagaggtcaataccgtgctcgctgatgtgatcaaacacatgacgcctgaccgggcttttgaagacagttacccacaactccagctgattataaagaaagttattgcccatttccacgatttctccgtgctattcagtgtggaaaagttcctgccttttctggatatgtttcaaaaggagagtgtgcgggtagaagtttgcaagtgcattatggatgcattcatcaagcatcaacaggaacccacaaaagaccccgtaatactcaatgcgctactacatgtttgtaagacgatgcatgacagtgtaaacgcccttacactggaagatgagaagcgcatgctgagctatttgattaatggattcataaagatggtcagttttggcagggacttcgagcaacagctgtcattctacgtggagtctagatccatgttctgcaatttggaacccgtgctggtgcagctgatccatagtgtgaaccgtctggctatggaaactcggaaagtaatgaagggaaaccacagccgcaaaactgccgcttttgtcagagcgtgtgtggcctactgcttcattactattccatccctggcagggattttcacccgtctgaatctgtatttacattctgggcaggtggccctggcaaaccagtgtctctcccaggccgatgccttctttaaagccgctattagcttggtgccagaagtgcccaagatgattaacattgatggcaagatgcggccatccgagtcctttcttttagagttcctgtgtaatttcttcagcacactgctgattgttcccgatcaccccgaacatggcgttttgttcctggtgcgcgaattactcaatgttatacaggattacacatgggaggataatagcgacgagaaaatccggatctacacatgtgtattgcatttactctctgcaatgagccaggagacctatctctatcacatcgataaagtggacagcaacgattccctgtacggcggagacagtaagtttttggccgagaacaacaagctgtgcgagaccgtcatggcccaaatactggagcatttgaaaacattagcgaaggacgaggccctgaaaaggcagtctagtttgggcctatccttttttaactcaatattagctcacggtgacctcaggaataataagcttaatcagctcagcgtcaatctctggcaccttgcacaaagacatgggtgtgcggatacacggacaatggtaaagacactcgaatacattaagaagcagagcaagcagcccgacatgactcatctcaccgagctggctttgcggctcccactgcaaacacgaacttag

SEQ ID NO: 49149 - DNA, 2613 bp, Artificial Sequence
  Description of Artificial Sequence: Synthetic coding sequence
atggctgtattcccctggcactctcgtaacagaaactataaggccgagttcgcttcctgcagactagaggcggtacccctagaattcggggactatcacccattaaagccaatcacagtgaccgagtcaaaaactaagaaggtgaacagaaagggctccacgagttctaccagtagctccagctcatctagcgtggtcgatccgctaagtagcgtgctggacggcaccgaccctctctcgatgtttgcagcgacagccgacccggctgccctcgccgctgccatggactcatcacgtaggaagagagaccgggatgataactccgtggttggctccgattttgagccatggacaaacaaaaggggggagatactggctcggtacacaaccactgagaaactgtccattaacttgttcatggggagtgagaaaggtaaggcaggaactgctacactggcaatgtcagaaaaagtccgaacccgacttgaggaactagatgactttgaagagggaagccaaaaggaactgctgaacctaacacagcaggattacgtgaatcgcattgaagagctaaatcagtctttgaaagacgcctgggcttctgaccaaaaggtgaaagcactgaaaattgtcatacagtgcagcaagctactctccgacacttcagttatccaattctatccatctaaatttgtgctcattacggatatcctagacactttcggcaaactggtttacgagcgtattttctctatgtgcgtcgacagccggagcgttctgcctgaccatttcagccccgaaaacgcaaacgacacagccaaagagacatgccttaactggtttttcaagatagccagcatacgcgagcttatcccccgattttacgtggaagcctccatactgaaatgtaacaaattcttgtccaaaaccggaattagcgagtgccttcctcgtctcacgtgcatgatcagaggaattggagatcctctcgtatccgtgtacgccagggcgtacttgtgtcgcgctctgctcacagagatgatggagcgttgcaaaaaacttggtaacaatgctctgctgctaaattccgtgatgtccgctttccgagctgaatttatagccaccagatcaatggacttcatcggtatgatcaaagagtgcgatgaaagcggattccctaagcatttgctttttcgaagcctcggcctgaatctggctctggcagatcccccagaatcagaccgattacagatccttaacgaagcttggaaggttattaccaaactgaagaatccccaagattatatcaactgtgctgaggtgtgggtggaatacacctgtaagcactttactaaacgcgaagtgaatacagtgctagctgacgtgatcaagcacatgactccagatcgcgctttcgaagactcgtatccacagctgcagctgataattaagaaggttatcgctcatttccacgatttctccgtgctgtttagcgtggagaagtttctgcccttcctggacatgtttcaaaaagagagcgttcgggttgaggtctgtaagtgtataatggacgcattcatcaagcaccaacaggaacccaccaaagaccccgtgattctgaatgcccttctgcacgtgtgcaaaactatgcacgactccgttaatgccctgacactcgaggatgagaaacgaatgctttcgtatctcatcaatgggtttattaagatggtaagcttcggacgcgactttgaacaacaactgtctttctacgtggagtcccggtcaatgttctgtaatctggaacccgtcctggtgcagctaatccatgcttgtgttgcatattgttttattactattccctcccttgctggaatcttcacgcgactgaatttgtacctacattcaggacaagtcgctctggctaaccagtgtctatctcaagccgacgctttcttcaaagcagccattagtcttgttccagaagtgcccaagatgatcaacatcgatggaaaaatgcggccatcagagtccttcctgttggaatttctgtgcaatttcttcagcaccctcctcatcgtgcccgatcatcccgagcacggggttctgtttctcgttcgggagctgctgaatgttatccaagactacacctgggaagacaactccgatgaaaagatcagaatttatacgtgtgtactgcacctgctgagcgctatgtctcaagagacatatttataccacattgacaaggtggactctaatgattcattgtacgggggagatagcaagttcctggctgaaaacaataagctctgcgagaccgtcatggcgcagatcctggagcacctgaagactctggctaaggacgaggccctgaaacgtcagtccagcctaggcctaagcttcttcaactctattctggcccatggagacctccgcaataacaaactaaatcagctgagtgtgaatctttggcacttagcccagagacacggatgtgccgataccagaacaatggtgaagactctcgagtacattaagaaacagtcaaaacaacccgatatgacacacctgactgaactcgctctccgcctaccccttcagactcgcacctag

SEQ ID NO: 49150 - DNA, 3159 bp, Artificial Sequence
  Description of Artificial Sequence: Synthetic coding sequence
atggcaccagctggcgtggtcacccgggctgtgagaagtggagagctgccgctaacttcgatggccagcgccgaaaatgaggcttgcgctgtgagaagtgttgcctgcccgagtcaagcttggcgccttcagaaagtcctgtgtggcaggtgcggagcagcttcgtgtccctcccaaacctggcggccacggggagccggaagcgggggtgtccgaatgggcagtagggctgatggacccagaacttctggacatgtgactggcaagatggcggtgtttccatggcattctcggaaccggaactataaggctgagtttgcaagctgccgccttgaagccgtacctttggagttcggggactatcaccccctgaagcccattactgtgacagaatctaaaactaagaaggttaaccgcaagggaagtaccagttccacgtcttcttcgtcgtcttcctcagtggtggaccctctaagcagcgtccttgatggcacagacccgctgagtatgttcgccgctactgccgatcccgcagctctggcggcagccatggattcttcacgcagaaagagagaccgcgacgacaactcagtggtggggtctgatttcgaaccctggaccaataaaaggggcgagattctcgcccgatacactaccaccgagaaactctctataaatctgttcatgggtagcgagaagggaaaggctggcaccgccactctggccatgagtgaaaaagtgagaacccgtttggaggaactggacgatttcgaggaagggtctcagaaagagttgctcaacttaacacagcaagactatgtgaaccgcatcgaggagcttaaccagtcactaaaggatgcgtgggcaagtgaccaaaaagtgaaggcgctgaagatcgtcatccagtgttccaaacttctcagtgacacatcggtgattcaattttacccaagcaagttcgtgctgatcaccgatatcttggatacattcgggaagttagtttacgaaagaattttctctatgtgtgtcgatagcaggagtgtgctaccagaccacttcagccccgaaaatgcaaacgacacagccaaggaaacatgcctgaattggttcttcaagattgcctcaatccgagaactcatcccccgattttatgtggaggctagtattctgaaatgcaataaattcctgtcaaaaacagggatttcagagtgcctgccgaggttaacttgcatgatccgcggtatcggcgatccattggtgtcagtctacgccagagcatatttgtgccgagtaggcatggaggtggcccctcacctgaaagaaaccctgaacaagaatttcttcgattttttgctcacgtttaaacaaattcacggtgacacagtccagaaccagcttgtggtgcagggggtggaactcccttcctacctgcccctctatccccctgcaatggactggatttttcagtgtatctcatatcacgccccagaagccctccttaccgaaatgatggaacggtgcaagaaactcggcaataacgccctcctgctgaactctgtgatgtcagcgtttcgcgctgaatttatagcaacgcggagcatggactttattggaatgattaaagagtgtgacgagtccgggttcccgaagcacctgctttttaggtccctcgggctgaacctggcactggccgacccacccgagagtgatcgactgcagattttaaatgaggcatggaaggtgattacaaagcttaagaacccacaagactacataaactgtgccgaggtatgggttgagtacacatgcaagcactttaccaaacgggaagtgaacacagtcttggccgacgtgataaagcacatgaccccagaccgtgcctttgaggattcgtatccacagctgcagctgattattaaaaaggtcattgctcacttccatgatttcagcgtgctcttttctgtcgagaaattcttaccttttctggatatgttccaaaaagaaagcgtgagggtggaggtttgcaagtgtatcatggatgctttcattaagcatcaacaggagccaactaaagacccagttatcttgaacgcacttttgcatgtttgcaagacaatgcatgactccgtgaacgccttgacccttgaggacgagaagcggatgctctcctacttgattaacgggttcataaagatggtctctttcggaagagacttcgaacaacagctaagtttctatgtggagagccggagtatgttttgcaaccttgagcctgtcttggttcagttaatacacagtgttaaccggctggctatggaaacacggaaggtgatgaaaggcaatcactcccgaaaaaccgcagctttcgtaagagcctgtgttgcgtattgttttatcaccataccctcgctggctggaatcttcactcgtctcaatctgtatctacactctggccaggtggcgcttgccaaccagtgtctttctcaggcagatgcatttttcaaagccgcaattagcctggtgccagaagtgcctaaaatgattaatattgatggcaagatgcggccatctgaaagtttcctgctcgagtttctgtgcaattttttcagcacgctgttaatcgtcccggatcaccccgaacacggagtgttgttcctggtgagggagctactgaatgtcatccaagactacacatgggaagacaactctgacgagaagatccgcatttatacatgcgtgttgcaccttttgtccgccatgagccaagaaacttacctgtaccatattgataaagtggactccaacgattctctttacgggggagattccaaattcctcgccgagaataacaagctctgtgagacagtgatggcccagatcctcgaacatctcaaaaccctcgctaaagacgaagcactgaaaaggcagagttccctcggcctatccttctttaacagcattctggcccatggggatctccgaaacaataagcttaaccagctgtccgtcaatctctggcacctggcacagcgacacggatgcgctgacacaagaactatggtcaaaaccctcgaatatattaagaaacagtcaaagcaacccgatatgacccacctgaccgagctcgccctccgactgccattacagaccaggacatag

SEQ ID NO: 49151 - DNA, 2442 bp, Artificial Sequence
  Description of Artificial Sequence: Synthetic coding sequence
atgcctccccttggagtcctcgttcacgaaaaaagccatctgtgcgacgtaaattcattctgcctcggtaaggccggaactgcaacgctggcgatgagcgaaaaggtgaggaccaggctcgaggagttagacgactttgaagaggggagtcagaaggagctgctcaacctcacacagcaggattatgttaaccggatcgaggagctcaatcagagcctcaaagatgcatgggcgtcagatcagaaggtcaaggcgcttaaaatagtgattcaggcggagctggtctatgagagaatcttttctatgtgcgttgactccagaagtgttttacccgaccatttttcgccagaaaacgccaacgacaccgcaaaagagacttgcttgaactggtttttcaaaatagctagtattcgtgagctcatccccagattttacgtggaagcctcaatccttaaatgtaataaattcttaagcaagactgggatttcagagtgcctgcccagactgacctgtatgatccgcggtataggcgatcccctagtgagcgtgtatgctagagcctacctgtgccgcgtgggcatggaagttgcacctcacttgaaagaaactttaaataagaattttttcgacttcctcctgactttcaaacagatccatggtgataccgtgcagaatcagttggtagtccagggggttgagctcccaagttacttgcctctctatccccctgcgatggattggatcttccagtgcatctcatatcatgccccagaagccttattgacggaaatgatggaaagatgtaaaaagctggggaataatgccctgttgctgaactcagtcatgtctgccttcagagctgaatttatcgccacaaggtccatggacttcatcgggatgattaaggagtgcgacgagtccggttttccgaaacacctgctattccgctctctcggactgaacctggcactggctgatccgccagagagcgaccggttgcaaattctgaatgaagcatggaaggtaattacgaagctgaagaatcctcaggattacataaactgtgcagaggtgtgggttgagtatacttgtaagcactttactaagcgcgaggtgaacactgtcctcgcggacgtcataaagcacatgactcccgatcgggctttcgaagacagttaccctcagcttcagctcataatcaagaaagtgattgcccactttcatgacttctctgtgctgttcagcgtcgagaagtttctgcccttcctagacatgttccagaaggaatctgtgcgggttgaggtttgtaagtgcatcatggatgctttcattaagcaccaacaggaacctaccaaagatccagttattctgaacgctcttcttcatgtgtgcaaaacaatgcatgactctgtgaacgcactaaccttagaggatgaaaagcgcatgctttcctacctgataaatgggtttattaaaatggtctctttcggcagagacttcgaacagcagctatcattttatgtcgagtcaaggagcatgttttgcaacctggaacccgtgctggtgcagctcatacacagcgtcaaccgcctcgcgatggagacacggaaagtgatgaaagggaaccattccaggaaaacagcagcttttgtcagagcatgcgttgcttattgcttcatcacaatcccctcccttgcaggtatcttcacaagactgaatttatacctccattcaggccaagtggctctggctaaccagtgcctcagtcaggcggatgcattctttaaggccgctatttccctagttcccgaggtgccaaagatgattaatatcgatgggaagatgcgcccttctgaaagttttctccttgaatttttgtgtaattttttctccacactgctaatcgttcccgatcacccagagcatggtgttctgttcctggtccgagagcttctcaatgtgattcaggactatacttgggaagataattccgatgaaaagatacggatctacacctgcgtcctgcacctgttgtctgccatgtctcaggaaacctatctttatcatatagataaggtggacagtaatgacagtctgtacggtggcgattccaaattcctcgccgaaaacaataagttgtgtgagaccgtcatggctcagatccttgaacatctcaaaactctggccaaggacgaagctctgaaaagacagtccagtttgggcttatccttctttaactctattctggcacatggagacttacggaataacaagctaaatcaactaagcgtgaacctgtggcatctggcacaacggcatggctgcgccgatactcgcaccatggtgaaaacacttgagtacatcaaaaaacagagcaaacaacctgatatgacgcatctcacagagttggcattgcgcctacctctccagactcggacatag

SEQ ID NO: 49152 - DNA, 822 bp, Artificial Sequence
  Description of Artificial Sequence: Synthetic coding sequence
atggcccctgccggagtcgtcaccagagctgtgcgttctggcgaattgcccttaacctcaatggcctctgccgagaacgaggcatgcgcagtgaggtcagtggcgtgtcctagccaggcttggagattgcagaaggtgctttgcggtaggtgcggcgctgcctcttgtccatcccaaacttggcgtccgagaggagctggctccgggggagtaagaatgggctcacgtgcagacgggccacgcacatctggacatgttaccggtaagatggctgtgtttccatggcacagtcgaaatagaaattataaagcagaattcgcgagttgccgcttggaagcagtgcctcttgaatttggcgactatcatccgctaaaaccaataacagtaacggagagcaagacaaagaaggttaatcgaaaaggctccacaagttctacgagttcctctagttcatcatctgtggtggatcccctgtccagcgttctggatggcacagatcccctgagcatgttcgcagcaaccgctgacccggcagctctggcagctgcaatggattccagtcggagaaaacgggatagagacgacaatagcgtggtgggctccgactttgagccatggacaaacaaaagaggcgagatcctagcccgatacacaactacagaaaagctgtctatcaatttgttcatgggcagcgagaaggatggcggatatagcgaacccaggtcccggcaccgtacccccgcttggacaactgagcaaagctgggactgccacatcggcaacgtgcgtgaaggagccgatcctgccggtggagcaggctag

SEQ ID NO: 49153 - DNA, 2880 bp, Artificial Sequence
  Description of Artificial Sequence: Synthetic coding sequence
atggcaccggcaggagtggtgactcgagctgtaagatccggggagctgcccctgacatcaatggcgtcagctgaaaatgaggcgtgcgcagtcagaagcgtggcatgcccaagtcaggcttggagactgcagaaggtcctctgcggacgttgtggcgctgctagttgcccttcccagacgtggcgcccaagaggagccggttcgggaggagtcagaatggggagcagagccgatggcccacgaacctctgggcacgtgaccgggaaaatggctgttttcccatggcattccaggaaccgaaactataaggctgagtttgcaagctgtaggctggaggcagtgccactggagtttggcgattatcatcctctgaaaccaattaccgtaacagagtctaagaccaagaaggtcaacagaaagggatccacgagcagcacctctagctcaagcagctccagcgtcgttgacccattaagcagcgtgctcgatggaactgatccgctttccatgttcgctgccacagctgatcctgctgccctcgccgcagccatggattccagtagaagaaagcgggaccgcgacgataactccgtggtgggcagtgactttgaaccctggacaaataagcgcggagagatacttgcaaggtacaccaccactgaaaagttatccataaacctgttcatgggctcagagaaagggaaggcaggaaccgcgactctggccatgtccgagaaggtccgaacacgtctggaggaattggacgactttgaagaagggtcgcagaaagaactgcttaatctaacccagcaggattacgtgaaccggattgaagaactgaaccagagtctgaaagatgcgtgggctagcgaccagaaggtgaaggcactgaagattgtgattcagtgctccaagctcctgagcgatacgtctgtcatacagttttatcctagcaagttcgtcctgatcactgacatacttgatacctttggtaagctggtatacgagcgtatctttagcatgtgtgtcgacagtcgctctgttctgcccgatcatttctcacccgagaatgccaatgacactgccaaggagacatgcctaaattggttctttaaaatcgcatcaatcagagaactgattccaaggttctatgtcgaagcgtcaatcctgaaatgcaataagtttttgtcaaaaacgggtatatccgaatgccttccaagactgacgtgcatgattaggggtatcggagacccactagtgtcagtatatgcccgagcctatctgtgcagggcactgttaacagagatgatggagcgctgtaagaaactcggtaataatgcacttctgttaaatagcgtcatgtccgccttcagggccgagtttattgccacgcggagtatggatttcatcggtatgattaaagaatgtgacgagtctgggttcccgaaacacctgttatttcgctctttaggattaaatctggcattggccgaccccccagaatcagatcgtctgcagattttaaatgaggcatggaaagtcatcacgaagttgaagaaccctcaggactatattaattgtgccgaggtgtgggtggagtacacctgcaagcacttcactaaaagggaggtcaatacagtactcgccgatgttattaaacatatgactccggatagagcattcgaagactcatacccccaactgcagctgatcataaagaaagtgattgcccattttcatgacttctccgttctgtttagcgtggaaaagtttttgccattcttagacatgtttcaaaaggagagcgtgcgtgtcgaggtgtgcaagtgtataatggacgcatttatcaaacatcagcaggagcctaccaaggatcctgtgattctaaatgctctcctgcacgtatgtaagaccatgcacgatagcgtgaacgccttgactctcgaggatgaaaaaagaatgcttagttacttaattaatggattcattaaaatggtttcttttggtagggactttgagcagcaactgagcttttatgtggaaagcaggtcgatgttttgcaatctggaaccagtgctcgtacagctcatacacgcctgcgtagcatattgctttattacaataccttcgctggctggaattttcacaagattaaatttgtatctgcattctgggcaggttgctttggccaatcagtgcctgtcccaagcagacgcgtttttcaaagcggcaatcagtctggtgcctgaagtccccaagatgatcaacatcgatgggaagatgaggccttcagaaagcttcctcttggagttcctttgtaatttcttttcgactttgctgatcgtgcctgatcaccctgagcatggtgtcctgtttctagtgcgagagctattgaatgtgatccaggactacacatgggaagataactcggacgagaaaatacgtatttacacttgtgtgctccaccttctgtccgctatgtcacaggaaacatacctctatcacatcgacaaggtagactctaatgactccctttatggtggggacagtaaatttctggccgagaacaataagctctgcgagacagtgatggcccagattctggagcacttgaaaaccctggcaaaagacgaggctctgaaacgccaatcctctctgggcctctccttttttaattccatactggcgcatggagacctgagaaataataagctgaatcagctctccgtgaatttgtggcacctggctcagagacacggatgtgctgataccaggaccatggttaagaccctagaatatattaaaaagcagtctaagcagcccgacatgacacatcttactgagctcgcacttagacttccgcttcagactcgaacctag

SEQ ID NO: 49154 - DNA, 759 bp, Artificial Sequence
  Description of Artificial Sequence: Synthetic coding sequence
atggggagcgagctcatcgggagacttgcacctcgcttgggcctggctgagccggacatgctgagaaaagctgaagaatatctcaggctttctcgcgtcaaatgtgtcgggctttcggctcggactaccgaaactagctctgccgtcatgtgcctcgacctggctgcctcctggatgaagtgcccgctggacagggcctacctgattaagctttccggcctgaacaaggagacctatcagagttgcctcaagagtttcgaatgcctcctgggattgaattcgaacataggcattagagacctggctgtgcagtttagctgcattgaagccgtcaacatggcctccaaaatactgaaatcctatgagtcctctctcccacaaacccagcaggtcgatctggacctgtctcgacctctgttcacaagtgcggctttgctctcggcctgtaagattctcaagttgaaggtggataagaacaagatggtagcgacctctggtgtcaaaaaagctatttttgaccgactatgcaaacagctggaaaagattggtcagcaagtggatcgagaaccaggtgacgtggccaccccgcctagaaaaaggaagaagatcgtagttgaggctccagccaaagaaatggaaaaagtagaagagatgccacacaagccacagaaggacgaagatcttacacaggactacgaggaatggaagcggaagattctggagaacgcagccagtgcccaaaaggctaccgcggaatag

SEQ ID NO: 49155 - DNA, 1071 bp, Artificial Sequence
  Description of Artificial Sequence: Synthetic coding sequence
atgggtcttatggtgcggggaggagtaacttgcaggagccaggagcggctcttgggcgtgggaacggggacagcatctgcacaaccacctgtaactgcaagtccatactgttccttcacaggtcgatcgcgggctgatgccccagcccgtgctgcagggaacgggcagcccaggctccgggctcaggtagacctgtcgagcgcctcttcagtgctcgtgaccgtgttagacgccaaagccctgccccttacgctattatcttggggaagcctgtgcgctacggcccagaaccacaacaaccaggagggtgccccagctcagccgaagggatccatggccaatcagcgggctctgagattcccgcctccctctggctctcctcctggcctccacactagaatgaggctaaccagtcctccacagccacattttgaacctcccccacccaccaccgtgggggctcctaggtctctgcagggtgattggttcggttcggattcacgcgcagtgcgggctctaagactcattggatgggctagcaggtcactgcacccattgcctggttcccgcgatcgagcccacccagccgctgaagaagaagatgaccctgatcggccaatcgagttctctagtagcaaagcaaacccacacaggtggtctgtgggtcataccatgggtaagggccaccaacgcccatggtggaaggtgttgcctctgagctgcttcctggtcgccttaataatctggtgctacctgcgggaagagtcagaggcggaccagtggctgcgccaggaaggctccagacaacctccatttggctttgatgtcacattcgccagagattgtccaggctacgcttgcgttttgagcacggaggggctgggatggtggatggggcatctggcgatgctgatccgggtcaaggctgagcaaaatctgagccgctcagagacagcccctaggctggccttagatgtccagggctttcatcggcaggacttctcagatccatggggccgtttccaactgcattgtatgttgctcgatcttcccagcctctgtatcacatag

SEQ ID NO: 49156 - DNA, 399 bp, Artificial Sequence
  Description of Artificial Sequence: Synthetic coding sequence
atgaacagggtgctctgtgcccctgccgctggagccgtgagagcgttgcgactgatcggatgggcatcgcgcagcttgcatcctctgcctggctctcgcgacagagcccatcccgcagccgaagaagaggatgatccggaccgacctattgaattttcctccagcaaggctaacccccataggtggagcgtgggtcatacaatggggaagggccaccaaaggccgtggtggaaagtgcttccattgtcttgctttcttgtggccctgattatctggtgctaccttcgagaagagtccgaagccgatcaatggttacggcaggtgtggggcgaagtgcctgagcccagcgatcgtagcgaggagcccgaaacccctgctgcctaccgagcccgaacatag

SEQ ID NO: 49157 - DNA, 399 bp, Artificial Sequence
  Description of Artificial Sequence: Synthetic coding sequence
atgggcgctggagtgggcgtggccggttgcacgaggggccatcggaattgggtcccttcacagctcccaccccgagaaatcaaggccggtgtatcattggcagtggtgactgaattcgcttgggtgcttgctccgaggcctaagcgcgctacagcttcagccctcgggactgaatcaccgagattcctagacaggcccgacttctttgactatcctgacagtgatcaggcacgcctgctggccgtggcgcagtttattggggaaaaacctatcgtcttcattaattcaggttcctcaccaggcctgttccaccacatactagtcggtctcctagtggtggcattcttttttctgctgtttcaattttgtacgcacatcaatttccaaaagggagcatag

SEQ ID NO: 49158 - DNA, 960 bp, Artificial Sequence
  Description of Artificial Sequence: Synthetic coding sequence
atggcccctcagcgtagggccgcaacaaaagcccctgaaggcaacggggctgccgaacgaaggaatcgtagttctacgaaaaaagatagagcacccagagaggtacagcggctttggcagaggccctggttgagaactgctgggttgggcgctgggttcgtattgacagccctgctcctgtggtctagtctgggcgctgacgacggagtggcagaagtcctcgccagacgaggtgaggtggtcgctgggcgttttattgaggttccatgcagcgaggattacgactctcaccgtcggttcgaaggctgcacaccacggaagtgtggacgcggagttaccgacgttgtcattacgagggaagaagccgaaagaattcggtctgtggctgaaaaagggcttagtttaggcggatccgatgggggtgccagcatcctggatctgcattctggggctctctcagtcggcaagcatttcgtgaacctctacagatacttcggagataaaattcaaaatattttcagtgaagaagattttagactgtatagagaggttaggcaaaaggtgcagctgacgatcgcggaggcatttgggatttccgcatctagcttacacctcaccaagcccactttcttctcacgaattaatagcaccgaggcacgcaccgcacacgacgagtactggcacgcccacgtggacaaggttacttacgggagttttgattacacttcactcctttatctgtccaactatctggaagattttggtggaggtcgctttatgttcatggaggaaggggcaaacaaaaccgttgaacctcgggctggccgagtcagctttttcacctctggctctgagaatctgcaccgggtggagaaggtccattgggggacaaggtacgctataacaattgctttctcatgcaacccggaccatggaattgaggatcccgctttcccctag

SEQ ID NO: 49159 - DNA, 996 bp, Artificial Sequence
  Description of Artificial Sequence: Synthetic coding sequence
atggccccacagcgacgtgccgctacaaaggcgccagaaggcaacggcgctgcagaacggagaaatcggtcctctactaagaaggacagagcaccccgtgaggtgcagcgattgtggcagcggccatggcttcggacagcaggcttaggagcaggctttgtgctaacagccttgctcctgtggtcatcgcttggcgctgatgatggggtggccgaagtcctggcaagaaggggagaagtcgtggctgggcgatttatcgaggtgccctgctcagaggattacgactctcacagaaggttcgaggggtgcacgcctcggaagtgtggacggggagttacggatgtagtgatcaccagggaagaggccgagcgaattcggtccgtcgccgaaaagggcctctccttagggggaagcgacggaggcgcttcaattctggatctacatagcggcgcacttagcgttgggaagcatttcgtaaacctctatagatactttggggacaagatccagaatattttttccgaagaggactttcggctgtacagggaggtcagacagaaggtgcaacttacaatcgccgaggcattcgggatttctgctagcagcctgcacctcacaaagcccacctttttctcacgaatcaacagcaccgaggctcgcaccgctcacgatgagtactggcacgctcacgttgacaaggtcacatatgggtccttcgactatacttctttactttatctgtcaaactatctggaagacttcggtggagggaggtttatgtttatggaagaaggggcaaacaagacagtggagcctagagcaggttgcttctgcttcaggatgatgagctgtggctttcaggaagttaatggtcccagagcatccgaagcagcaggagccaaagctggagtgcgttgccccccaggaacccaccacccaccggaacgcggagaaactcacgcaatcctcgaagctgagtcaatcgcctactgttag

SEQ ID NO: 49160 - DNA, 234 bp, Artificial Sequence
  Description of Artificial Sequence: Synthetic coding sequence
atggccgcaacggacttcgtacaggagatgcgcgctgtgggcgaacggttgctcctgaagcttcaaaggctgccacaggccgaacccgtggaaattgtagcttttagtgtcattattctgtttaccgctacggtgcttcttctgctgcttatcgcttgtagctgttgctgcacccattgttgctgccccgagcggcgaggcagaaaagtgcaggtgcagcccacacctccctag

SEQ ID NO: 49161 - DNA, 1578 bp, Artificial Sequence
  Description of Artificial Sequence: Synthetic coding sequence
atggccgcagcccctccactgcgcgaccgcttgagcttcttacatcggctgcctatactgttgaaagggactagcgacgatgatgtaccatgcccaggttacctgttcgaggagatcgcgaaaattagccacgagtctcccggtagcagtcaatgcttattggagtacctgctctctaggctccacagttcgagcgggcatggtaaactcaaggtgctcaaaatccttctgtatctatgcagtcatggcagctcattttttcttctcattctgaaaagaaacagcgcatttatccaggaggctgccgctttcgccggacctcccgacccactgcacggtaacagcctataccagaaggtgcgtgccgcagcccaagatcttggatctacactgttcagcgacaccgtcttgcctctggcccctagccagccacttggcaccccacctgccaccggaatggggagtcaagccagaccccactcgacactgcaaggatttggctatagcaaagagcatggacgcaccgccgtcagacatcagcccggtcaggcaggcggagggtgggacgaattagacagcggaccctctagtcagaactcatcacagaattcagatctgtcaagggtgagtgacagcggttcccattctgggagcgactcccacagcggagcttccagggaaccaggggacctggctgaaagggtggaggtggtagcactctcagactgccaacaggagctgtcgctggtgcgaaccgtcacaagaggcccacgcgcttttctgagccgtgaagaggcccagcactttattaaggcttgcggcctgctgaattgtgaggccgtgctccagttgctgacatgccacttgagaggaacgagcgagtgcacccagctgcgggcactgtgtgctatagcttcactaggcagctcagacctgctccctcaggaacatatccttctccgaacccgaccctggttacaggaactcagcatggggtccccagggcctgtcacaaacaaggccaccaaaatcctgagacactttgaggcatcgtgtggccagctcagccctgccaggggtacctcagcagaaccgggacccactgccgctctcccgggaccctcagacctacttacagacgcagttcctctgcccggttcccaggttttcctgcagccattgagctcaacccccgtttcatcccggagcccagcccctagttccgggatgccatcgagcccggtccccacccctcccccagacgccagtcccattcctgcaccaggagaccctagtgaggcagaagccaggttagcggagagcaggcgatggcgtccagaacggatacccggtgggactgatagccctaaaagggggccatccagttgtgcctggagtcgagattctttgttcgccggaatggagctggtcgcctgcccacgattggtaggggcaggcgctgcagccggtgagtcctgcccagatgccccaagggccccacagacatcatcacagcggacagccgcaaaagagccaccaggttccgaaccaagtgcttttgcttttttaaatgcgtag

SEQ ID NO: 49162 - DNA, 1326 bp, Artificial Sequence
  Description of Artificial Sequence: Synthetic coding sequence
atgggctcacaggctcggcctcattccactctgcagggcttcggatacagcaaggagcatggtcgcaccgggtctgctggtgaggcatttttatcgacgattcagaaagcggcagaagtcgtcgcctccgcaatgcgcccagggccagaaagcccttccactcgaaggctgctgccgaggggagacacataccaacctgctatgatgccttccgcctcccatggccctcctacgcttggcaacttattacctggagcgatccctggtcccagagcagtgcgacaccaacccggacaagcaggaggcggttgggatgaactcgactccggccctagctcccagaacagttcccaaaatagtgacctgtccagagtctctgattcaggatctcattcagggtccgactcccactcgggggcaagcagagagcctggagaccttgccgaaagggtagaagtagtggctcttagcgattgccagcaagaactttccctcgtccggaccgtgacccgaggcccaagagcatttttatcgcgagaagaagcccagcattttattaaggcgtgtggattgctgaactgcgaagcagtcctgcagctgctgacatgccacctcagaggcacaagcgagtgcactcaactacgagcattatgcgccattgctagcctgggctcttccgacctcctcccacaggaacatatacttttgaggacccgcccatggttgcaggagttatctatgggaagcccgggacccgtgactaataaagctacaaagattttgcggcactttgaggccagctgtggccagcttagccccgctcgaggcacctctgctgaaccaggaccaactgccgcactgcctgggccttccgacctcctcactgatgctgtgcctctccctggtagtcaggtcttcctacagccacttagctccacccccgttagctcgagatctcccgctccaagctccggaatgcctagttcaccagtcccaaccccccctcctgatgcttcccctatccctgccccaggagatccatccgaggccgaggccaggcttgcagaatcccgcaggtggaggcccgagcgcatacccggtggcactgactctcccaaacggggaccctcaagctgcgcctggtcacgagactccctgtttgccggaatggaactggtggcgtgtccacgcctggtgggcgctggcgcagccgctggagagagttgtccagatgccccaagggcccctcagacttcatctcaaagaacggccgctaaggagccccctggaagcgagccgtctgccttcgcattcctaaacgcctag

SEQ ID NO: 49163 - DNA, 1074 bp, Artificial Sequence
  Description of Artificial Sequence: Synthetic coding sequence
atggaatcctcacggggacgacccggacccgagactgatctactggccgttgccgagcaccaagccctggtctttgggggtggccctggtcggacctccagcgagccccctgccggtttgcgtgtatccggcgaggaagagacggaaaatgtcggcggtgccaatcggcaccctcgcacaagcccaaagacctccagttgtggcgtggtccacaggccagaacgagaagccctggaaaatgagcctggcccacagggcaccttaagtggggctgggagcaggcgcggtgccccaggcgcagagcacgagcccagcctctccagtaggcacaaaaaccctgcaccacctgagggcaagccgagtagcggcagggactgtaggaggggaggcccagggggaggcatggacgttgagcagcaagaggaggaagacaacgacgaggaagctgccgcaggctccagggctggacgatccttctcaagtaggttgcaggattctcgctctctggacggactgagcgaagcctgtgggggagcaggaagctcaggaagtgcggaatccggcgcaggtggtgggaggcgggcaaccatatccagccccctggagctcgaggggaccgtcagtcggcacggagatctgacccacttcgtggccaacaacttacagctcaaaataagactctctggagcgcctccaccgcctcctagcgcacctgcgagaccgtgccccgcaccggctcccacccccacccccgctattccaccgattgaccctgaggtgttgcgcgatctggaacgtttgtcaagagagttgggcggacgcgtcgatcggctgctgagggggttggggggagctgtacaagaactgactgcactgagcgtgggttgcatccagacctaccgcgatgcagtggattccctgggcgaggccgttgacatgtcaatcaaaggcatgtacaccctgctagcccgatgcgaggagttggagcgtgctcttcagcctgtgcagggacttgcacgacaagtgcgagatatcagacgaaccctcgaggtactggaggccttgtgcaaatag

SEQ ID NO: 49164 - DNA, 342 bp, Artificial Sequence
  Description of Artificial Sequence: Synthetic coding sequence
atggcgggaccagccgcagccttcaggagattaggtgcgctgtctggcgcagcagcgctcggtttcgcctcctacggcgcacatggagctcaatttccggatgcttatggaaaggagctgtttgacaaggcaaacaagcaccattttctccacagtctggcactgctgggggtgccacactgccgcaagcccttgtgggccggactcctcctcgccagcggcaccacgttgttctgcacaagcttttactatcaagccctcagcggagacccctctattcagactttagctcctgctggcggaaccttgctgctgctcgggtggctggctctggctctgtag

SEQ ID NO: 49165 - DNA, 564 bp, Artificial Sequence
  Description of Artificial Sequence: Synthetic coding sequence
atgtatctgcaggtagagacgcgcaccagcagtagattgcacctcaaaagggctcccggtatccgttcatggtctctgcttgtgggcatcctctctattggcctcgcagccgcatactactccggcgattcactcggctggaagctgttctacgtgaccggctgcctcttcgtggcagtccagaacttagaagactgggaggaggccatatttgacaagtccacaggcaaagttgtcctcaaaacattctcattgtacaaaaaattgctcacccttttccgggctggccacgatcaggtcgtggtgctgctgcatgacgtgcgggacgtgagcgtggaggaagagaaagtcaggtactttgggaaaggctatatggtagtgctgcggttggcaaccggattttcgcatcccctaactcagagcgcagtcatgggacacaggtcagatgttgaggctatcgctaagcttatcacttcctttttggaactgcattgtctggaaagtcccacagaactgagccaatcttccgactccgaagccggtgatcctgcatcccaatcctag

SEQ ID NO: 49166 - DNA, 672 bp, Artificial Sequence
  Description of Artificial Sequence: Synthetic coding sequence
atgtggaagccctccccatctagttctccggcttcttggtcctgtactgcccttcgagcaccccagtcttgcttaagagccgctacagtgcgtccagttacattacaggccagggccgattcccctaccgtgcccgagcctgtgcatcggccacaggatccctggcacattcctggcgtgccagagcctgtccatcggccacaagacccttggcatattcctggagttccagagcctgtccatagaccacaggatccatggcacatcccaggggttccagaacccgtgcaccggcctcaagatccttggcatatacccggtgtgcctgaaccggtgcaccgtccacaagacccatggccctggttgcaactagtccctcccgcagagttggcttactgcctattgatgctcctcctggcccattgcatgaaacaacaggctcgacccggtcacccggactttctccacagagaagcttgggcttgtctcagcgccgctggaggcctggccagtcctggtctgctcctgtgggctacagcacgtcccagggcttctggggaagctggaccaggccgagccctagtgggagccgacgccgcatgctgcccaagacattcagttctgagcttggtggacatcccgagcggccaggtcctgccccaaggccagtag

SEQ ID NO: 49167 - DNA, 786 bp, Artificial Sequence
  Description of Artificial Sequence: Synthetic coding sequence
gcctggaggcgccgacgctccggtacctctggcaaggccacctggtggtgtagtggactgaggagggcctccccaacaccatctcggcgagtccaaagctgggccacagcagttatgtggaagccaagcccaagtagcagccctgcctcatggagctgcaccgccttgcgggctccccagtcctgcctcagagccgcaaccgtccgccctgtgactttgcaggcaagagcggatagtcccaccgtgccggagcctgtgcataggccgcaagacccatggcatatcccaggggtaccagagcccgttcaccgaccgcaggacccctggcatatccccggagtgccggaacctgtgcatagaccacaggacccttggcacatacctggggtgccagagcccgtgcaccgaccccaggatccttggcatatcccaggggtcccagaaccggtgcaccgcccacaggatccctggccctggctgcagctcgtcccccctgcagagctggcatactgcctgcttatgcttctcctggcgcactgtatgaagcagcaggctcgccctgggcatccagatttcctacaccgcgaagcgtgggcctgcctgtctgccgcaggcggtcttgcttcccccggactgcttctttgggccaccgctcgccctcgggctagtggtgaggcgggtcctggcagagcactcgtaggcgctgatgcagcatgctgtcctagacatagcgttctgtctctggtcgatatacccagtggtcaagtgctgccccagggtcagtag

SEQ ID NO: 49168 - DNA, 522 bp, Artificial Sequence
  Description of Artificial Sequence: Synthetic coding sequence
atgtatctgcaggtcgaaaccaggaccagttccaggttgcacctgaaacgagctccaggcattcgcagctggagccttctggtggatagcctgggctggaaactcttttacgtgaccgggtgcctgttcgtggcagtgcagaacttggaagattgggaggaggctatctttgacaagagtaccggaaaggtggtgttgaaaacattctccttgtacaagaaattgctgacactatttagggccggacacgaccaggtagtagtgctgctccacgacgtacgggacgtctctgtggaagaggagaaggtgaggtacttcgggaaggggtacatggtggtgctcagactggccacaggattctcccacccgctgacccagagtgcggttatggggcaccggtcagacgtggaagccatagctaagctgatcacctcatttctagagctgcactgtctggagagccccactgagctgtcgcaatcatcagactccgaggccggagatcccgctagccagtcctag

SEQ ID NO: 49169 - DNA, 564 bp, Artificial Sequence
  Description of Artificial Sequence: Synthetic coding sequence
atgtacctccaggttgagactcggacctccagtcgcttgcacctgaaaagagccccaggtatcagatcttggtcactattggtgggtatattgagtatcggcctcgccgcagcatactatagcggagattcattggggtggaagctgttctacgttaccgggtgcctgtttgtcgcggtgcagaacttagaagattgggaggaggctatcttcgataaaagcaccggtaaggtggtcttgaaaaccttcagtctttacaagaagctgttaactctcttcagagcgggacatgaccaggttgtcgttctactgcacgatgtcagagacgtttctgttgaagaggaaaaggtgcggtattttggaaaaggctatatggtggtgttgagactcgctaccggattcagccatccattgacgcaaagcgctgttatgggccatcgtagtgacgtcgaggcaatagcgaagctcataacctcctttctggaactccactgtctggaatctcccactgagctgagccaatcgtctgactctgaagcaggcgacccggcttctcagtcatag

SEQ ID NO: 49170 - DNA, 684 bp, Artificial Sequence
  Description of Artificial Sequence: Synthetic coding sequence
atgggtcataggtcagatgttgaggccatcgcttcttcttctcccgcttcttggagttgtacagccctccgggctcctcagtcatgcctgcgcgcagctaccgtgcgtcctgtcacacttcaggccagagcggacagtcctactgtgcccgagcctgtccaccgaccccaggatccctggcacatccccggagtcccggaacccgttcataggccacaagatccatggcatattcctggcgtgcccgagcctgtgcatcggcctcaggacccatggcacatcccaggcgtccccgaacctgtacaccggcctcaggatccctggcacatacccggagttcctgagccagtccaccggcctcaggatccatggccttggctgcaattagtgccacccgctgagctggcttattgtctcctgatgctgctgctcgcacactgtatgaagcagcaggccagacctgggcaccctgatttcctgcatcgcgaagcatgggcctgcctcagcgcagccggtgtgagcccagccctggacagttgtttcggtcctcagcaggacctaggcagagtggagaggcgagcaaggcccgctctggtaggagccgacgccgcatgttgccccaggcacagcgtcctgagtctggtcgatataccctccggacaggtattgccccaggggcagtag

SEQ ID NO: 49171 - DNA, 828 bp, Artificial Sequence
  Description of Artificial Sequence: Synthetic coding sequence
atggatacaatcctggtgttttctctgatcattgcctcttacgatgctaacaaaaaggacctgagggattcttcatgtcgactcgagcagcttcctggaattttcccaaaggacgtgcgctccatacgggaactacaaatgcaggagactcatacagagacaaagcgcacaacttttatccagaatcgtaccattgccaccctccaatgcctgggctctgattcaaaggtgaaagtcaaccttgtatacctcgaaaggagacccaaagtgaagcacattctgaaaaacttgcgaatcattgctgcccctcgaagaaacagcagcgcttcatcatcttgccacttgattcccacctccaaattccagacaggcagcctgctcaaaggcaaagcttttttacccggtatatctcaatgtaaggtgttgggtgcttcctccgagacatttcccacaaccgccccttcaatcactccgggtaataaggagggcgaaaagacgacaagtacagataccgacgagaatctagagaaaagacagaagtggtccatagtggtgaagattctgatcgccgtgacgctactcttgtcaggcgttgctataatcgtctttgtcatattcgaagtcccatgtccatatcagtgcctgggcgctagaaagttgtgccaatgtcagtggctgtggagatggcagaaaaaggggggacagccaccgggtacagccgagagcaaaccagactcccagcctcagaaggtaggccaggatgctgccaattcctccaatcccaagaaagccgcagagataaccgttatccatcagacatacttttag

SEQ ID NO: 49172 - DNA, 480 bp, Artificial Sequence
  Description of Artificial Sequence: Synthetic coding sequence
atggacacaatccttgtgttctctctgatcatcgcctcctacgatgccaataaaaaggaccttagggactccagctgcagactggagcagctgccaggaatttttcccaaggacgtccggtctatcagggagctccagatgcaggagacccacactgaaaccaaaagaacgacctttatccagaatagaactattgcaactctgcagtgcctagggagcgattccaaggtaaaagtgaatctggtttacctggagcgcagaccaaaagttaagcacatccttaagaatttgcgcatcatcgctgcccctcggaggaatagctctgccagcagtagttgccacctcattccgacaagtaagtttcagacaggctccctcctgaaggggaaggtaagtatgccgaggagtcaagaggcggtgccgatgcctgtcgtcgtcgagatggcaaaggagggccgtcccgcaacctgggacagctag

SEQ ID NO: 49173 - DNA, 1644 bp, Artificial Sequence
  Description of Artificial Sequence: Synthetic coding sequence
atgagtgataacccacctcgtatggaagtgtgcccgtactgcaagaaaccttttaaacgcttgaaaagccacctgccatactgtaagatgataggacccacaattcccacagatcagaaagtgtatcaaagtaagcccgctacgcttcctagagccaaaaagatgaagggtcctatcaaggacctcattaaagctaaaggaaaggagctagaaacagagaatgaggagcgcaactctaagttagtcgtggacaagcccgaacaaactgtaaagacctttccactgcccgctgtgggtctggaacgagctgctacaactaaagcagataaggatattaagaacccaattcagccaagcttcaagatgttaaagaatacaaagccaatgacaacctttcaagaggagactaaggcgcagttctatgcttccgaaaagaccagcccaaagcgagaattagctaaagatcttcccaagtctggggagtccagatgtaatcccagtgaagccggagccagcttattagtcgggagcatcgagccttccctgagtaatcaggacagaaagtactcttccactctgcctaacgatgtgcagaccacttcaggagaccttaaactggacaagatcgacccacagcggcaagaattactcgtgaaattactcgatgtgcctacaggggattgccatatttcacccaaaaacgtctccgatggggtcaagcgcgtgcgtacccttctgtctaatgagcgcgactctaagggcagagaccacctctctggagtccctacagatgtgacagttacagagacaccggaaaagaacacagaatctctgatcctctcccttaaaatgtcttcactgggcaaaatccaagttatggaaaagcaagagaagggtctcactctgggagtggagacttgtgggagcaagggaaatgctgaaaaaagtatgagcgcaactgagaagcaggaacgtacagtgatgtcgcacggctgtgaaaacttcaacaccagagactcagttacgggaaaggagtcacagggagagcgtccacatctctccctgttcatcccacgggagacgacatatcagttccactctgtcagtcagtcgtcaagccagtcactagcctctctggcaactaccttcctgcaagaaaaaaaggcagaggcccaaaatcatcactgcgtgccggatgtcaaggcgttgatggagtcccctgagggccagctgtcacttgagccaaaatctgatagtcagttccaggcttcccatactgggtgtcagtcaccactttgctcagcccagcgacatacacctcaatctcctttcacaaatcacgctgctgcggctggacgcaagactctgcgatcatgcatggggcttgagtggttccctgagctttaccccggatacttgggactgggtgttctgcccggaaagcctcaatgctggaacgcaatgacacaaaagcctcaattaattagcccccagggagagcggctgtcccagggatggatccgatgcaatactacaatccgcaaatccggatttggcggtatcaccatgcttttcactggttatttcgtcctgtgctgctcctggagtttccgtaggttgaagctgcagagatggcggaagtag

SEQ ID NO: 49174 - DNA, 1722 bp, Artificial Sequence
  Description of Artificial Sequence: Synthetic coding sequence
atgagcgataatccaccacggatggaggtgtgtccttactgtaagaaaccatttaagcgcctgaagtctcacctgccttactgcaagatgattggacctactattccaaccgatcagaaggtctaccaaagcaagcccgcaacacttcctagggccaagaagatgaaggggccaattaaggacctcattaaggccaaagggaaggaactggaaactgagaatgaggagcgtaattcaaaactcgtggtggacaaacccgaacagaccgtcaagaccttccccctgcctgctgtgggcctcgaacgcgcagccactacaaaggccgacaaagacatcaagaacccgatccagccttcctttaagatgctgaagaataccaagccaatgacaacatttcaggaggagaccaaagctcagttctacgcgagtgaaaagacaagtcccaaaagggaactggctaaagatttgcccaaatccggtgagagccgatgcaaccccagtgaggccggtgcctctctgctggtgggctcgattgagccttccttatcaaaccaggaccgaaagtacagttctaccttgccgaacgatgtgcaaaccacctctggcgacctaaaacttgataaaattgatccccaacgacaggagctgttagttaagctgttggatgtgcccaccggtgattgtcatataagccctaagaatgtcagcgacggagttaagagggtgcgaactcttctcagtaatgaacgtgactccaaaggaagagatcacctttctggggtgccaaccgacgtcactgtcacagaaacgcctgaaaaaaatacagagtccctcatcctttcactgaaaatgagcagtctaggcaagatccaggtgatggaaaaacaagaaaagggattaacgctgggagtggagacctgtgggagcaagggtaacgcagaaaaaagtatgagcgccactgagaagcaggaaaggactgtgatgagtcatggttgcgagaatttcaataccagagattcggtgacaggtaaggaaagccagggcgagaggccacacctgtctttgtttattcctcgggaaaccacgtaccagtttcattccgtgagtcagtctagcagtcaatctttggcctctcttgcaaccaccttccttcaggagaaaaaagcggaggcgcagaatcaccactgcgtgcctgacgtgaaggctcttatggaatcacccgaaggtcagttatctctggaacctaaatctgactcgcagttccaggcgtcccacaccgggtgtcagtcacccctctgctccgctcagcgccatacccctcagagtccattcaccaaccacgcagccgcagctgggcgaaaaacattacggtcttgcatgggtctcgagtggttccctgagctgtaccccggatacctgggtctgggggtactccctggtaaaccacagtgctggaatgcaatgacccagaagccccagcttatctccccacagggcgagcgacttagtcagggctggatccgatgtaacacaacaatcaggaagtccggttttggaggtattacgatgcttttcaccggatattttgtgctttgctgttcctggtctttcaggaggctgaaaaaactgtgcaggcctttgccatggaagtccacggttcctccatgtatcggcgtcgctaagacaactggtgactgtagatctaagacatgcctggactag

SEQ ID NO: 49175 - DNA, 1830 bp, Artificial Sequence
  Description of Artificial Sequence: Synthetic coding sequence
atgtcagacaacccgccaaggatggaggtgtgcccctattgtaaaaaaccctttaagcgccttaagtcacacctaccttattgcaaaatgatagggccaacgattcccactgaccaaaaagtgtatcagtcaaagccagccaccctgcctcgagccaagaaaatgaaaggacctattaaggaccttatcaaggctaaaggaaaggagctggaaacagagaatgaggagcggaacagtaagttagttgtggataagccggagcagacagtaaaaacattccccctgcccgctgtaggtctggaaagagccgctactaccaaggctgacaaggatattaagaacccaatccaaccttccttcaaaatgctgaagaacactaaaccaatgacaaccttccaagaagaaaccaaagcccagttctacgcatcagaaaagacatcccctaagcgtgagctcgccaaggacctacctaaatcgggggagagcagatgtaatccttctgaagccggtgcttcactcctggtggggtccattgagccctcactctctaaccaggaccgcaaatatagctcgacgttgcccaatgacgtccaaaccacttcgggcgacctgaaattggacaaaatcgatcctcagcgccaggagctgctggtaaagttgctggacgtcccgactggtgattgccacatatcgcctaaaaacgtaagcgacggcgtcaagcgggtcaggacgctcctgtccaatgagagagatagcaagggtagagaccacctatccggagtcccaacagatgtgacagtgaccgagacgccagagaaaaacacagagagcctcattttgtcgctcaagatgtctagtctaggtaaaatacaggtgatggagaagcaggagaaagggctgactctgggggtggagacatgcggttcgaaaggcaatgcagaaaagagcatgtccgccaccgaaaaacaggaacgcacagttatgtcacacggatgcgaaaacttcaacacgcgggatagcgtcaccgggaaagaaagccaaggcgaaagacctcacctgagcctcttcattcctcgtgagaccacctaccagttccactctgtctcacagagcagtagccagtcgttggcgtctctcgccactacgtttctacaggagaagaaggcagaggcacagaaccatcactgtgtccccgacgtgaaagccttgatggaatctcctgagggccagctaagtctggaaccgaaatcagactcccagtttcaggcctcccatacaggttgtcagtcccccctgtgcagtgctcagcggcacacaccgcagagtcctttcacaaatcatgctgccgcagcgggacgaaaaacgctccggagttgtatgggactagaatggtttccagagttgtaccctggctacctcggcctaggggtgctgcctggcaagccacaatgttggaacgcgatgactcagaaaccgcagctcatttccccccaaggcgaacgtctaagccaagtgagtttgctggagcggagctcgacccatattaggagccttgagcccccagccggtctgactacatcgaactttagcctgatgaggctactaggtgccgtccaaaaggggtggatccggtgtaataccactatccgcaaatccggcttcggcggaataacaatgctgttcacaggatacttcgttttatgctgcagttggtcttttcgaaggctgaagaagctgtgtcggccattgccctggaagtcaactgttcctccctgtatcggcgtcgcaaagacgacaggggactgccgctctaagacgtgtctagattag

SEQ ID NO: 49176 - DNA, 1752 bp, Artificial Sequence
  Description of Artificial Sequence: Synthetic coding sequence
atgagtgataaccctccaaggatggaggtatgtccctactgcaaaaagccatttaaacgcctgaaatctcacttaccatactgtaaaatgatcggacccacaatcccaaccgaccagaaggtctaccagtccaagccagcaacactgccccgagcaaagaagatgaagggcccaattaaggatctgatcaaagccaagggtaaagagctcgagaccgagaacgaggagcgcaactcgaagctcgtagtcgataagccggagcagacggtgaaaaccttccccctcccagcagtgggcctggaaagagcagcaaccaccaaggccgacaaggatataaagaaccctattcagccctcatttaaaatgttgaaaaacacaaagcctatgacaaccttccaggaggagaccaaggctcaattttacgcctcggaaaaaaccagccctaagcgtgaattggcgaaagacctgcctaaaagcggagaaagccggtgcaatccttccgaagccggagcctcactgttagtgggttccatagagccaagcttgtccaaccaggatagaaaatacagcagcactctgcccaatgacgtccaaaccacatccggagatctgaagctagataagatcgacccacagagacaggagctccttgtgaagcttctggatgtgcctaccggagactgccacattagcccgaaaaatgtgagcgatggagtgaaaagggtgcggacacttctcagtaacgagcgtgattctaagggccgtgaccacctttccggggtccccactgacgtcaccgtgaccgaaacgcccgagaaaaatacagaatccctcattctgtcgttgaagatgagcagtctgggcaagatccaggtgatggagaagcaggagaagggcctgacgctgggggtagaaacctgcggatcgaaagggaacgccgaaaagtctatgagtgccacggaaaaacaggagcgcactgtcatgtcccacgggtgcgaaaacttcaacacccgcgatagcgtgactgggaaagagtcccagggagaaaggccacatctctcactgttcatccctcgcgagaccacatatcagttccactctgtctcacagtccagttcccagtcactcgctagtctggctacaacgtttctgcaggaaaaaaaggcagaggctcagaatcatcactgcgtgcctgacgtcaaggccctgatggagtcacctgagggacagctgagtctagagcccaaaagcgatagccagttccaggcgtctcacacagggtgccagtctccattatgcagcgcccagaggcatacgccccagagcccatttacaaatcacgcagccgctgctggtcgcaaaaccttgcggagctgtatgggccttgaatggtttcccgagttgtatcccggatacctcggattgggggttctgccagggaagccccagtgttggaacgccatgactcagaaaccacagctcatatccccacaaggggaaaggttatcgcaggtctccttgctcgagagatccagtacccacatacggtctctcgagccaccagcaggactcacgacctcaaatttcagtctcatgaggttactgggagccgtccagaaggggtggatcaggtgcaataccacaatcaggaagtcaggatttggtggcattacaatgttgtttacgggctacttcgttctgtgctgctcctggtctttccgccgactcaaactgcagaggtggcgtaaatag

SEQ ID NO: 49177 - DNA, 1740 bp, Artificial Sequence
  Description of Artificial Sequence: Synthetic coding sequence
atgtctgacaaccctccccgtatggaggtctgcccgtattgcaaaaagcccttcaaaaggctcaaatcacacctgccctactgcaagatgatcggtcccacgatcccaacagatcaaaaggtgtaccagagtaaacctgccaccctcccgcgagccaaaaaaatgaagggccctataaaggatctgattaaagcgaagggaaaggagctggagacagagaacgaagagaggaactcaaagctggttgtcgataagccagagcagaccgtcaaaacatttccgcttcccgcagtggggctcgaaagggccgctaccaccaaggcagataaagacatcaagaatcctattcagccatcattcaaaatgctcaagaacacaaagccaatgactacatttcaggaggagacgaaggcgcaattttacgcaagtgagaagacctcaccaaagcgggagctggcgaaggaccttccaaagtctggtgaaagtaggtgcaatccgtccgaggcaggagcaagcctgctcgtgggaagtattgagccatccctgtcaaaccaggaccgcaagtacagctcgaccctgcctaacgacgtccagaccacctctggggaccttaaacttgataaaatcgatcctcaacggcaggagctactggtcaaactcctggacgttccaaccggcgactgccatatcagtcctaagaatgtgtccgacggggtcaaacgcgtgcggactctgctaagtaatgaaagggatagcaaggggagagatcacctttcgggggtgccgacggatgtgactgtcaccgaaactcccgaaaaaaacactgagagcctcattctgagcctgaaaatgtcttcattgggaaagattcaagtgatggagaaacaagagaaaggcctgactctcggagttgagacttgcggaagcaagggtaatgccgaaaaaagcatgtctgctactgaaaaacaggagcgaactgtgatgtctcatggctgcgagaactttaacacaagggactcagtgaccggtaaagaatcacagggcgagcggccacatctgtctctgtttattcctcgtgaaacgacctatcagttccattctgtcagtcagagtagcagtcagagcctggcttccctggctacgacctttcttcaagagaagaaagccgaggctcaaaatcaccattgcgtaccagatgtcaaggcactcatggagagtccagaaggacagctgtcattggagcctaagagcgactcacaattccaggccagtcacacaggatgccagtcacccctctgcagcgcccagcggcacactccccagtcacccttcacaaatcacgccgcagcggctggacggaaaacactgcggtcatgcatgggcttagagtggttcccggaactgtacccagggtatctgggactgggagttttgcctggcaagccccagtgttggaatgcaatgacccagaagccacaactaatctctccccagggcgaacgattgtctcaggttagcctgctggaacgttcttctactcacattaggagtctggaaccacctgcaggtctgactactagcaacttttcacttatgaggctgctcggggctgtgcagaaaggctggattcgatgtaatacaacaatcagaaagagtggcttcggtggcattaccatgctgtttacgggatatttcgttctgtgttgcagttggtcatttcggaggttaaccctccagtag

SEQ ID NO: 49178 - DNA, 225 bp, Artificial Sequence
  Description of Artificial Sequence: Synthetic coding sequence
atgagtgccaacggggctgtgtggggcagggtgcgaagtaggcttagggcctttccagagcggctcgctgcctgtggggctgaagcagccgcttacgggaggtgcgtgcaggcctccaccgctcccggaggaaggctgtcaaaggacttctgcgctcgagaatttgaagctctccgcagttgcttcgccgctgccgcaaagaaaactctagagggtggttgttag

SEQ ID NO: 49179 - DNA, 444 bp, Artificial Sequence
  Description of Artificial Sequence: Synthetic coding sequence
atgcttctgcgacgagtggtggagggagggagagcggtggccgctgctgttcggggttcaggcgctagacgattttcttcacccgattgctgccagagactgcctggcggaggctccttcctgcaacgtcatcaccccggagctcaggccccagatggccgaaggaagtttggtacagatcacgtggaggtgggttcccaagctggggctgacggcactcgcccacctaaagcttccctgccccctgagctccagccacctacaaactgttgtatgagcggctgtccaaactgcgtttgggtagaatatgctgaccgactccttcagcacttccaggatggaggcgagcgggctttggccgcactagaggagcacgtcgcagatgagaatctgaaagccttcctgcgcatggaaatccgcctgcatactcgttgtggcggatag

SEQ ID NO: 49180 - DNA, 633 bp, Artificial Sequence
  Description of Artificial Sequence: Synthetic coding sequence
atggtcgccgacatcaagggcaatgaacagattgagaaatattcctggagagaagcctgtgacactgggtctagtcgtatggaccgcaagcacggaaagtatattcttaacgtggaacatagtgaaaaccagccacccatcactcaccctaatgaccaagaagcccacagtagtatctgttggtgtctcccaagtaatgacattacaagtgacgtgtcacctaatctcaccggggtgtgtgtaaaccctggcattctggcccattcgaggtgtctgcaaagtgagtcgtgcaacacgcaggttaaggaatattgcaggaacgattggtccatgtggaaagtgttcctggcgtgtcttctggcgtgcgtgattatgacagccatcggagttctgatcatttgccttgtcaacaataagggctcagcaaactcgtcaatcgtgatccaactgtccaccaatgacggcgaatgtgtcacggttaagcctggtacaccctctcccgcatgtcctccgaccatgaccaccaccagtactgttcccgcttcaacagccactgagtctacaacatccaccgccaccgccgctacaacttctaccgagcccattacggtggcaccgacagaccatctgtag

SEQ ID NO: 49181 - DNA, 306 bp, Artificial Sequence
  Description of Artificial Sequence: Synthetic coding sequence
atggatcagtatgtctcgaccgcaccccctcgattccccattgctcagctggggacttttaagcaggatagcgctgggatgggacggatattcaagggcaacctgctgcagaaaaaggcccttaccacatttgaaaatgagcatcacatccggttctttactcttcttgttttatttcacgtgatggtgctgctaagaaatcatagccgaattcagggcgtgagcgaggactggaagagagccaacagcatcttcaggaactttctgaggctcaagtcctcacggaacacagcagaggccgagtag

SEQ ID NO: 49182 - DNA, 306 bp, Artificial Sequence
  Description of Artificial Sequence: Synthetic coding sequence
atggatcagtacgtgtccactgccccaccgagattccccattgctcaactggggaccttcaaacaggactcggcagggatggggaggatctttaagggcaacctattgcagaaaaaggcactgacaactttcgaaaatgaacaccatatccgcttcttcactctccttgtcctgttccacgtgatggttcttctgcgtaatcacagcagaattcagggggtgtctgaggactggaaacgagcaaactcaatatttcgtaatttccttaggctgaagtccagccgtaatacagccgaggccgagtag

SEQ ID NO: 49183 - DNA, 648 bp, Artificial Sequence
  Description of Artificial Sequence: Synthetic coding sequence
atggataaagttcagagcggctttttgatcttattcctgttcctaatggaatgtcagctgcatttatgccttccgtatgcagacggtttgcatcctactggaaacattacgggtctgcctggttcaaagaggtcccaaccacccagaaacataaccaaagaacccaaggtttttttccacaaaacacagctaccaggcattcagggagctgcttcgagaagtaccgccgcatccccaacaaacccaatgaaatttcttaggaataaagcgattatccgccacagacccgcactggttaaagtcattctcatcagcagcgttgccttcagcattgctctgatttgtggcatggccatctcatacatgatatatcggctcgcacaggctgaagagagacagcagctggagagcctctataaaaatctcagaatccctctccttggcgatgaggaggaaggctcggaggacgagggtgagagcacacacttgctccctgagaacgagaatgaattggagaaattcatccattctgtaattatcagcaagcgttccaaaaatattaagaagaaactgaaagaggagcagaactccgtgaccgagaataagaccaagaacgcaagtcacaacggcaagatggaggatctatag

SEQ ID NO: 49184 - DNA, 2178 bp, Artificial Sequence
  Description of Artificial Sequence: Synthetic coding sequence
atggcaactgctgcaacaaccaccaccacaactacagcaacggtagctctgacaacctcgtgggataatgcaacaggtcggcctaccgccgagcccgatccaattcttgacaattatgtcctgctggtcgtagtaatgagcctgtttgtgggagggactcttgtggttctttcaggagttttgctactctgtaaacggtgctgggacgtgcatcaaagactcaaccgagccatggaggaggccgagaaaactacaacaacatacctggataacggtacacatccagcccaggatcccgactttcggggagaggaccctgaatgccaggacgcggaaaccgaacggttcttgtctacctccagcaccggccgtagggtttccttcaacgaggctgcattgttcgagcagtcacgaaagacccaggataagggtagacagggaggatggcaatcaaccgccgcaggagctagcggcatgggagggggacgtgccctgatggctcgttgctgtcgtcggtatacgctgacagagggtgatttccatcatctgaagaatgccagactgacccatctacacctcccaccactcaagattgttacaatccatgaatgtgactccggtgaagctagctcggccacaacgccacacccagctacttctccaaaagccacactggcgatttttcagccccctggtaaagcgttaaccggcagaagtgttggcccaagctcggcccttccaggcgacccatacaactcggctgctggcgcaactgactttgctgagatatcccctagtgcgtctagtgatagcggtgagggcaccagcctggacgccggtaccaggagcacaaaggctgggggacccggagccgctgccggaccaggggaggctggccctggcagcggagcaggtacagtgctgcagttcctgacacggctcagacggcacgcgagcctggatggggcttcaccctacttcaaagtcaagaagtggaaactggaaccatcacagagagccgctagcctggatacaagaggttccccaaaacggcaccacttccagcgacagcgggcagcttccgagtccaccgaacaggaggagggagacgctcctcaggaggactttattcagtacatcgctcgcgcaggcgacgccgtagccttcccccacccgaggcccttcctggcctcacccccacctgccttgggtcgacttgaggctgctgaggccgcaggaggcgcttccccggacagcccacctgagaggggggctggcagcgctgggcctgagcagcagcagcctccgttggaacctgacgcggaaagagatgcagggccagaacaagcccaaacgagctacagggacttgtggtctttgagagcttccctggagcttcacgctgctgcttccgaccactccagctccggcaatgatcgggatagtgtgcggtctggtgattcctccggcagcgggtctggaggcgctgcaccagcctttcctccaccttcccctccagcccctcggccaaaggatggggaggctagaagactgctgcaaatggattctgggtacgccagtatcgagggcaggggggcaggcgacgatacagagcctcctgctgcacccgcacgccctcgttccccaagagcttggcccaggcgccctaggcgcgactacagtatcgatgaaaaaactgacgccctattccacgaattcctgcgacacgacccacattttgatgatacgccagctgctgcccgtcatagggccagggctcacccccacgccagaaagcagtggcagcgcggaagacagcattcggaccccggagcacgtgccgctcctgcccttgcgggtaccccagcaccccctgctggtgcagctaggcctgccagagcacccctgcggagaggggactctgtggatggtccgcctgatggtcgaacgctgggaggggctggtgacgaccctgcaattcctgtgattgaggaagagccaggcggaggaggatgccccggttcgggcctgtgcgtgctcccaagtggtagtgtgcttgacaagctggccgcagggctcgatgaacggcttttccccccaaggctggctgagcccgtagtggccactcccgctctggtcgcggcagcacctacatcacccgatcatagtccggcttag

SEQ ID NO: 49185 - DNA, 693 bp, Artificial Sequence
  Description of Artificial Sequence: Synthetic coding sequence
atgccgtggacaatactgctgtttgctgctggctcacttgcaatcccagccccatcgattcgccttgtgcccccttatccgagttctcaagaagaccctatccatatcgcctgcatggcccctggaaactttcctggcgcaaactttactctgtatcgcggaggccaggtggtacagctcctccaggcacctaccgatcagaggggcgtcacttttaatctgtcaggaggctccagcaaagcccctggtgggccattccactgccagtacggtgtgctgggtgaattaaatcagtctcagttgagtgacctctcagagcccgttaatgtgagctttcccgtacctacatggatcctggtgctgtccctgtcgttggcaggtgccttgttccttcttgctggactggtcgcagtggcactcgtagtgagaaaagttaagctccggaacttgcagaaaaagcgggaccgcgaaagctgctgggctcagataaactttgactcgaccgatatgtctttcgataatagcctgttcacggtcagcgccaagacgatgcctgaggaggaccccgcaacactggacgaccatagcggcactaccgccacccccagtaattctcgcacccggaaaaggcccacgtcaacctcctcttccccggaaaccccagagtttagtacctttcgagcttgccagtag

SEQ ID NO: 49186 - DNA, 1215 bp, Artificial Sequence
  Description of Artificial Sequence: Synthetic coding sequence
atggcattatccctccccctgggtcctagactagggtctgagccgctcaatcacccccctggcgctccaagggaagcggatattgtaggctgcactgtatgtcccgcaagcggcgaggagtcaacatccccagaacaggcgcagactctgggacaagactcgctcggtcccccagagcactttcagggcggacctcggggaaatgaacccgcagcacacccgccacggtggtccaccccttcaagctacgaggaccccgctggtgggaagcattgcgaacatcctatcagtggcctagaggtgctcgaggcagaacagaactctcttcacctctgcctcctgggactggggaggagactccaagatctcgagcaagggctgggtcactgggctctggctcagtctggcatggtgcagctgcaggccctgcaggttgatctgagaggcgcagctgagagagtggaggccctcctggcgtttggggagggccttgctcagcggagtgaacccagggcatgggccgctcttgaacaaattcttagggcgctaggtgcctatcgtgacagtatctttagaagactatggcagctccaagcacagctggtgtcttacagcttggtatttgaagaagccaatactttagatcaggacttggaggtagaaggcgactctgactggcctggccctggtggggtctgggggccttgggccccaagcagtctgccaaccagtaccgagctggagtgggaccccgctggcgatatcggaggactgggaccgctgggccagaaaacagccagaaccttgggagtgccatgtgagttatgcggccagcggggtccgcaggggagaggccagggcctggaggaagctgatacctcccacagccgtcaagatatgctagaaagcggtctggggcatcagaaacgcctggcccgtcatcagcgccacagcctgctcaggaagccgcaggataaaaagaggcaagccagtccacacctgcaggacgtccgactggaaggtaatcctggtgcccctgatcctgcctcccgtcagcccctgacgtttcttctcatcctgttcctcctgtttcttctcttggtgggagcgatgtttctactcccggcttcaggcggaccctgctgctcccatgctagaatcccgaggaccccctacctcgtccttagctacgtaaacggattgccccctgtatag

SEQ ID NO: 49187 - DNA, 876 bp, Artificial Sequence
  Description of Artificial Sequence: Synthetic coding sequence
atggctctgagtctgcccctgggacccaggttaggttccgaacctctgaaccaccctcctggcgctccacgggaggccgatattgtcggctgcactgtatgcccggcaagcggagaggaaagtactagccccgagcaggcccagaccttaggccaggactctctgggtcctcctgagcacttccaggggggaccacgcggaaatgaacctgccgcacatccacccaggtggtcaactccctcttcgtatgaggaccctgccggtggaaagcactgcgaggtgtttgaggaggcaaatacacttgatcaagatcttgaagtggagggagatagcgactggcccggacctggaggtgtctggggaccgtgggcaccctcttctctgcctacctccaccgagctggaatgggaccctgccggtgacattggaggcctggggcctctgggacagaagacagccaggacactcggtgtgccttgcgaactgtgcggccagagagggccacaggggagagggcaaggcctggaggaggctgacactagtcactcaagacaggatatgctagagtcgggactagggcatcagaagcgtttggccaggcaccagaggcattcgctgctgcgcaaaccacaagataaaaaacgccaagcttcgccccatctgcaggacgttaggctggaaggtaatcctggcgctcccgatcccgcatctcgtcaacctctgacattcctgttgatcctttttttattattccttttgttggttggggctatgtttttgctgcccgcaagcggaggcccatgttgcagtcacgcacgaatacctaggaccccttatctcgtgctgagttatgttaacggactgcctcctgtgtag

SEQ ID NO: 49188 - DNA, 564 bp, Artificial Sequence
  Description of Artificial Sequence: Synthetic coding sequence
atggaggtggaggagatttacaagcaccaagaagtgaagatgcaggctccagcttttcgggacaaaaagcaaggtgtttcagccaaaaatcagggagcccacgatcctgattacgagaatattacattggcatttaagaaccaagaccatgcgaagggcggacacagtaggcctacgtcccaggtgcccgctcaatgccgccctccctcagatagtacacaggtcccatgttggctctaccgtgccatcttgtccctttatatcctgttagccctggcttttgtactttgcataatcctgtctgccttcataatggtcaaaaatgcagaaatgagcaaagaattgctgggcttcaagcgagagctctggaatgtcagcaatagtgtgcaggcatgtgaggaacgccaaaagcgtggatgggatagcgtgcagcagtccatcaccatggtgaggtcgaaaatcgatcggcttgaaacgacattggcagggatcaagaatatagacaccaaagttcagaagatcctggaagtgctgcaaaagatgcctcagtcctccccccagtag

SEQ ID NO: 49189 - DNA, 357 bp, Artificial Sequence
  Description of Artificial Sequence: Synthetic coding sequence
atggtcgctagagtatggtctctgatgagattcctcattaaaggctcagttgcaggcggagccgtgtatctcgtttatgaccaagagcttctgggaccgagcgacaaaagccaggctgccctccagaaggctggagaggtggtaccacccgctatgtaccagttcagccagtatgtgtgccagcagaccggcttgcagattccccagttaccggctcctcccaagatctactttcccatccgcgatagttggaacgccggaattatgacggtgatgtcagcactgtctgtcgctcccagcaaggcacgcgagtacagtaaggagggatgggagtacgtgaaagctcgcacaaaatag

SEQ ID NO: 49190 - DNA, 594 bp, Artificial Sequence
  Description of Artificial Sequence: Synthetic coding sequence
atgctgccattgctccagctagtgcccgcaaagttgctgaattcctcgtgctccttggagaagaccttgcaatgcagctgcagttttcatggaatccctacccctagcgtacagtggtggatggggggagtgcccgtcggcgtcgatggaatggatggatcactgcaggttaccagcaccatgctaggcccttgggcgaatagtaccatcagtcttacagaggagcctgagatggggatgaggttgctgtgcgaaggcaaaaatcagaacggaactcacgccctctctattctccttatgtctcgcaaatccagcctggcagcccaggctttcgtcaagggactgatccagggggctatctacgccggaatcgtaatcgccctcctttttctgtgtctgttacctctgatagtaaaacatatacggaaaaagcaggcaaagaaagcagctgctattcgggctaagaaaagtagcaaagtgagggcatcgcaagagttggagatgtcccttaagccagaggagcccggtaagcccgtggttgctactttttctgaatcaagaatcctggagaaacaagacaagagagcatcatag

SEQ ID NO: 49191 - DNA, 513 bp, Artificial Sequence
  Description of Artificial Sequence: Synthetic coding sequence
atgaggcggaggctgtggttgggattggcctggctcctcctagctagagccccagacgctgctggaacaccttccgcctccaggggtcccagaagctatcctcacttggagggtgacgtgagatggagacgcctcttttcatctactcacttcttcctgcgcgtggatccagggggaagagtacaaggcacacgctggcggcacggacaggattccatactcgagatccgtagtgtgcatgtgggcgtggttgttattaaagccgtgtcctccggattctatgtagccatgaatcgcagagggagattgtatgggtctcgactctatacagtggactgtagatttcgggaaaggatcgaggagaatggccacaacacttatgcctctcaacggtggcgcaggaggggtcagccaatgtttctggcactggaccggcgtggaggaccacgacccggtggacgcacgagaaggtatcatctgtctgctcacttcctcccagtattagtctcctag

SEQ ID NO: 49192 - DNA, 1116 bp, Artificial Sequence
  Description of Artificial Sequence: Synthetic coding sequence
atggcgtggactaaataccagctctttctggccggactcatgctggttaccggatcgatcaacacactctccgctaaatgggcggataatttcatggccgagggctgtggtgggagcaaggagcatagtttccagcacccgttcctgcaggccgtgggaatgttcttaggtgaattctcatgtctggccgcattttacctgttgcgctgccgcgcagcaggccagtctgactcttctgtcgacccacaacagccctttaacccgttactctttttacctccagccctgtgcgatatgactggaactagcttaatgtacgtggctttaaatatgaccagcgcttcttctttccagatgttgcggggagcagtgatcatcttcacaggactgttcagcgtcgcttttttagggagaaggctggtgctgtcccagtggttagggatcttagctacgattgcgggtctggttgttgtgggccttgccgacctcctgagtaagcatgacagccagcacaaattgtctgaagtcataacaggagacctgctgatcataatggcccaaattattgtggccatacagatggtcctggaagagaaattcgtgtacaaacataatgtgcatccactccgcgcagtcggcactgagggcctcttcggcttcgtcatactgtcactgttgctcgtccctatgtattatattccagctgggagcttcagtgggaaccctcgcggaacacttgaagacgccctcgatgctttctgccaagtggggcagcaaccccttatcgcggttgccctgctggggaacatcagttccatagctttcttcaacttcgccggtataagtgtcacgaaagaactctccgcgacgacccgcatggttctcgacagcttgcgaacagtcgtcatttgggccctcagcctagccctggggtgggaggcctttcacgcattacaaatcttgggttttctgattctgctgatcggcactgccctgtacaatggcctccaccgaccactactgggccgactgtcgcggggtcgaccacttgctgaggagtccgaacaagagcgtcttctgggcggtaccagaacacctataaatgatgccagctag

SEQ ID NO: 49193 - DNA, 867 bp, Artificial Sequence
  Description of Artificial Sequence: Synthetic coding sequence
atgggcggacagtttcacggaaggggtctatggcgagagcagggcgctcagctgccagcttctctgcctcccgctcttaatatgacgagcgcgtcgtcttttcagatgctccggggtgccgtcattatatttaccggtcttttttcggtcgcctttcttggaagaaggctcgtgctctcacagtggcttggcatccttgctaccatcgccggtttggttgtggtcggcctagccgacctgttgtccaaacacgattcacaacataagctgagtgaagtcattaccggcgacctgctgatcattatggcccagattatagtcgccattcagatggtgctcgaggaaaaattcgtgtacaagcataatgtgcaccccctgcgcgctgtcggaactgaaggattgtttggatttgtaatcctgagcttactgctggttcccatgtactatatccctgctggatctttctcgggcaatccacgaggaacactcgaggacgcactggatgccttttgccaagtggggcagcaaccgcttattgctgtcgccctgctggggaacataagcagcatcgccttctttaactttgccggaatcagtgtcaccaaggaactgagcgcaactaccaggatggtactggattctctgagaactgtagtgatttgggccctcagcttggccctgggctgggaagcttttcatgccctgcagatcttaggcttcctgatcttgctcatcggaaccgctctatataatggcctccatagaccactcctcgggaggctgtcgcgcggacgccctctggcagaagaatccgagcaggaacgcctgttgggcggaactagaacgcccatcaacgacgccagttag

SEQ ID NO: 49194 - DNA, 855 bp, Artificial Sequence
  Description of Artificial Sequence: Synthetic coding sequence
atgaaaacatcagctgagttgcacgaacaggaaaagcctccctcatctcctcgtgccactggccctggccgactggggcacgccagggggcgagggccagacgctctgcgagggggagccgcaggccctggcagagcttcatcaggggctccacgcgagaggaaaatggctccccacgatccgggaagcctaacaacactggtgccctgggccgctgctttactcctggccctcggtgtggaaagggccctcgcccttcccgagatatgtacacaatgcccagggtcggtccagaacctgagcaaggtcgccttttactgtaagacaaccagggagctcatgctccacgccaggtgctgtctaaatcagaaggggacaatccttggattggatcttcaaaactgctcgcttgaggatcccggaccaaacttccaccaggcccacaccacagttattattgacctgcaggctaatcctttgaagggtgacttagctaacacatttcgtgggtttactcagctgcagactctgattctgccgcagcacgtaaattgccccggaggcattaatgcctggaacacgattacttcctacatcgataaccaaatttgccaaggtcagaagaacttatgcaataacaccggagaccccgaaatgtgcccggagaacggctcatgcgtgcccgatggtcccggactacttcagtgtgtttgcgccgacgggttccatgggtataaatgcatgcgtcagggcagtttctccttattgatgttttttggaatcctcggcgcaaccacactttcagtatccatcctgctctgggctactcagcggcgaaaagctaaaacttcttag

SEQ ID NO: 49195 - DNA, 516 bp, Artificial Sequence
  Description of Artificial Sequence: Synthetic coding sequence
atgttacatgctcgctgctgccttaatcagaaagggactattttggggctggacctgcagaactgctccttagaggaccccggaccaaatttccaccaagcccacaccacagtcatcattgacctacaggcaaatccactgaaaggggacttagccaatacatttcgcggatttactcaattgcagaccttgatactcccacagcacgttaattgtccagggggaattaatgcctggaacacgattactagttacatcgacaaccagatttgccaggggcagaagaatctttgtaataacactggagatcccgagatgtgtcccgagaatggatcatgcgtccctgatggtcctggtctattacagtgtgtgtgtgcagatgggttccatggctacaagtgtatgaggcaggggagtttttccctcctgatgtttttcggcatcctcggcgctaccactctatcagtgagcattctgttgtgggctacacaaagacgtaaggctaagacaagctag

SEQ ID NO: 49196 - DNA, 228 bp, Artificial Sequence
  Description of Artificial Sequence: Synthetic coding sequence
atgcttcacgctcggtgctgtctgaaccagaagggtacaatactcgggctcgacctgcagaattgttcactggaggacccaggtccgaatttccaccaggcacacaccacggtcattatcgatctgcaagcgaatccgctgaaaggagacttggcaaatactttccggggtttcacccagctgcagacccttatcctgccccagcacgtcaattgccccggtggatag

SEQ ID NO: 49197 - DNA, 876 bp, Artificial Sequence
  Description of Artificial Sequence: Synthetic coding sequence
atggcattagctgctaggttactgccacagttcctgcatagtcggtcgctaccctgtggagccgtccgattaagaacacctgctgtagcggaggtcaggcttccaagcgccactttgtgttacttctgccgatgtcgactcggcttgggcgctgctctttttccaaggagcgcaagggcgctcgccgcaagtgccttacccgcacaaggaagccgatggccagttttatcatctcctggcctcccggctgcgttcgccagttttcctgcatgccctcagcgcagttacagcacagaagaaaagcctcagcaacatcagaaaacaaagatgatcgtgctggggttctctaaccctatcaattgggtaaggacaaggataaaagcatttctgatctgggcatactttgataaggagttcagtatcaccgaattttccgagggggcaaaacaggcgttcgctcatgtgagcaagcttcttagtcaatgcaagtttgatttactggaggaattggtagcgaaagaggtgctgcacgctctgaaggaaaaagtgacatcccttccagataatcataagaacgcccttgcagcaaacattgacgaaattgtatttacgtcaaccggcgatattagcatatattacgatgagaaaggcaggaagtttgtcaatattctgatgtgcttttggtatcttacatcggctaatatccctagcgagacactccggggagcctcagtcttccaggtgaaactgggaaaccagaatgtggagacaaaacagctcttgtcagcatcctatgagtttcagcgcgaatttactcagggggttaagcccgattggactatcgccaggattgagcacagcaagctgctcgaatag

SEQ ID NO: 49198 - DNA, 876 bp, Artificial Sequence
  Description of Artificial Sequence: Synthetic coding sequence
atggctctggcagcccgactgctcccccagtttttacattcacgctcgttaccatgtggcgcagtgcgcttaagaacacccgcagttgccgaggtgaggctgcccagcgctacgctgtgttacttttgccgatgccgcctgggcctgggcgcagccctgtttccacgttctgctcgggctcttgccgcatccgccctgccggcacagggcagccgatggccagtgttgagctcacctggcctgcccgctgcgtttgccagctttcctgcttgtccccaacgcagctactcaactgaggagaagcctcaacaacaccagaaaactaaaatgatcgtgcttggtttctcgaacccaataaactgggtgcgcacacgcattaaagcattcctcatctgggcctacttcgataaagagtttagtatcacggagtttagcgagggcgcaaagcaagcttttgctcatgtgagcaagctgctcagtcagtgtaagttcgacctgctggaagagttggtggcgaaagaagtactccacgcgttaaaggagaaagtgacttctttgccagacaaccacaaaaacgcgctggccgctaatatagacgagattgtctttacctctactggtgacatttccatatactacgatgaaaaaggacgcaagttcgtgaacatcctcatgtgcttctggtatctgacctccgccaacatcccttccgaaacactgcgcggtgcctcagtgtttcaggtgaaattgggcaaccagaatgtagaaacgaagcagctgctgagcgcatcctatgaatttcaacgggagtttacgcagggcgtgaagccggattggaccatcgcgagaatcgagcacagcaaattactggagtag

SEQ ID NO: 49199 - DNA, 1326 bp, Artificial Sequence
  Description of Artificial Sequence: Synthetic coding sequence
atgtcagtgcttctgcgctctggcctagggcctttgtgtgcggtggctagggcggcaatccccttcatctggcggggaaaatacttttccagcgggaacgaaccagctgagaatcccgtcacacctatgctccgtcacctgatgtacaaaattaaatctaccggccctatcacggttgccgagtacatgaaagaggtgctgacgaatcccgcaaaaggatactacgtgtatcgggacatgctcggggagaagggggacttcatcacttcacctgagatctctcagatcttcggcgagctactgggcatatggtttatctccgagtggatggccaccggtaagtccactgcctttcagctcgtagaactgggacctggtcggggaaccttagtcggggacatcctccgggtcttcacccagctgggatcagtccttaagaattgcgatatttcagtccatctcgtggaagtctctcagaagctgtccgagattcaggcgctgacactcaccaaagagaaggtgccgttagagcggaacgcgggaagtcccgtgtatatgaagggcgtgacgaagagcggaatccctatttcctggtatcgggacttgcatgatgtgccgaagggttactctttttacctggctcatgagttctttgatgtcctgcccgtgcacaagttccagaaaacaccacaaggatggagggaagtgttcgtggacatcgacccacaggtctctgataagttacgtttcgtgctcgcaccctctgccacccccgcagaggccttcattcagcacgatgagactcgggaccatgtggaagtgtgccctgacgcaggggtcattattgaggagctctcccagagaattgccctcacaggaggcgcagctctcgtagctgattacggacatgatgggaccaaaacggacaccttccggggtttttgcgatcacaagcttcacgatgtcttgatcgctcctggaaccgctgatttgacagccgatgtagatttctcctacctcaggcggatggctcaggggaaggtcgcctctttaggtcccattaaacagcataccttcctcaagaatatgggtatcgatgtacggctcaaggtgctactggacaaaagcaacgagccctccgttagacagcaactgctgcagggttacgacatgctcatgaacccaaagaagatgggggaaaggttcaattttttcgctctactgcctcaccagagactgcagggcggacgctatcaaaggaacgcgaggcagagcaagccattcgccagcgttgtcgccggtttcagcgagctggcctggcagtag

SEQ ID NO: 49200 - DNA, 1593 bp, Artificial Sequence
  Description of Artificial Sequence: Synthetic coding sequence
atgcaccctggcagaaccacaggtaaggggccttcgacacatacgcagattgaccagcagcccccaaggcttcttatcgtgcacatagccctgccatcttgggccgacatttgtacgaacctctgtgaggccctgcagaacttcttttctctggcgtgtagtctcatgggcccttcacgaatgtcactgttctctttatacatggtgcaggaccagcatgaatgcatactccccttcgtgcaggtcaaggggaacttcgctagactgcagacatgcatcagtgagctcagaatgctccagcgggaaggatgcttcagaagtcaaggcgcttctttgagactggccgtcgaggatgggctccaacaatttaagcaatattctaggcatgtgactacacgcgctgccctgacttatacttctctggagattacgattctcactagtcaacccggaaaggaagtggtgaagcaactcgaggagggcttgaaggacaccgatctggctcgtgtgagaaggttccaggttgtggaggtgacaaagggtatcttagagcatgtggactctgccagtcctgtggaagatacatcaaatgacgaatcttcgatcctgggcacggatattgacctgcagacgattgataacgatattgtcagtatggagatctttttcaaagcctggcttcataattcagggactgaccaggagcagatccatctgctattgtcctcccaatgtttctcaaacatctctcggccaagagacaacccgatgtgcctgaagtgcgaccttcaagaaagacttctgtgcccatccctgcttgcaggcaccgccgatggctctttgaggatggacgatcctaagggtgactttattaccctgtaccagatggcctcacagtcttctgcctcacactacaagcttcaggtgattaaggcactaaaaagcagtggactgtgtgagagtctgacttacggtcttccctttatcctgcgcccaactagttgctggcagctcgactgggatgaactggagaccaaccaacagcatttccacgctctgtgccatagcctactgaaacgagaatggctattgcttgctaagggcgagccacccggacccggacattcgcagagaatacctgcctcaaccttctacgtcattatgccaagccatagcttgactttgttggtcaaggcagtcgctactcgggaattaatgctcccatcaactttcccgcttctgcccgaggacccacatgatgattcactgaagaatgtggaatccatgctcgattcactagagctggaacctacgtacaatcctctgcacgtgcagtctcatttatattcacacctctcgtctatttacgctaagcctcaaggcaggctccaccctcattgggagtcaagagcccctagaaagcatccttgcaagacaggccaactgcagactaatcgggctagggctacagtcgcccctttacccatgacgccagtcccgggaagagccagcaagatgcctgcggcttcgaaatcttccagcgacgccttttttttaccatctgaatgggaaaaagaccctagcagaccctag

SEQ ID NO: 49201 - DNA, 540 bp, Artificial Sequence
  Description of Artificial Sequence: Synthetic coding sequence
atggacgacccgaaaggcgattttattacactgtaccaaatggcctcacaaagctccgcaagtcactataagctgcaggtcatcaaggcgctcaagtcctctggtctgtgcgagagtcttacctatgggttaccgtttatacttaggcccacaagttgctggcaactggactgggacgaactggagactaatcagcagcacttccacgcattgtgccattctttgctgagtatgctggactccctagagctggaacccacgtacaaccctctgcacgtgcagagccatctgtattctcacttgagctccatctatgcgaaaccacagggaaggcttcaccctcactgggaatctcgcgcaccacgcaaacacccttgtaaaactggacagctccagaccaatcgggctcgcgcaactgtcgctcctctgcctatgacccctgtacctggaagggccagcaaaatgccagccgcttcaaaatctagttccgacgccttttttcttccctcggagtgggagaaggatccaagtcggccatag

SEQ ID NO: 49202 - DNA, 429 bp, Artificial Sequence
  Description of Artificial Sequence: Synthetic coding sequence
atgcatcccggtagaacaactggtaaagggcctagtacacacacccaaatcgaccaacagcctcccagactgctgattgtccatatcgctctcccaagttgggcagatatctgcacaaacttatgcgaagcccttcaaaactttttttccctggcttgcagcctgatgggccctagccgtatgtcattattcagtctgtacatggtccaagaccagcacgaatgcatactgcctttcgtccaagtgaaagggaattttgcacgtcttcagacttgtatctcagaactgaggatgttacagagagagggctgcttcaggtcccagggcgcttcgttacgcctggcagtcgaggacggacttcagcagttcaagcaatattctcgacatgttaccactagagccgcactcacctacacaagcctcgagtag

SEQ ID NO: 49203 - DNA, 1581 bp, Artificial Sequence
  Description of Artificial Sequence: Synthetic coding sequence
atgcacccgggaaggactaccggcaaaggaccgtcaacacacacacagatcgaccaacagccccctcgcttgctaatcgtccacatcgcactcccttcttgggcagatatctgtactaacctctgtgaggccctgcagaacttcttctccctggcctgttctctgatgggtccctctcgcatgtctctcttttcactgtacatggtccaggatcagcatgaatgcattctgcctttcgtgcaagtgaagggaaattttgccaggctgcagacgtgcatctctgagctaaggatgctgcagcgtgagggctgctttcgctctcaaggagcttcactccgacttgccgtggaggacggactgcagcagttcaagcagtattctcgtcacgtgaccacccgggcagcccttacatacactagtctcgagatcactatccttaccagccaacctggtaaggaggtggtgaaacaactggaggaaggattaaaagataccgacctcgcccgtgtgagacggttccaggtggttgaggtgactaaaggaatcctggagcatgtcgactcagccagtccagtggaagacacgtcaaatgatgagtctagcattttggggacagatatcgacttacagacaatcgataacgatatcgtcagcatggagatctttttcaaggcatggttgcacaactctgggaccgatcaagaacagatccatctgttgttgagttctcagtgtttctctaatatcagccggccaagggataatccgatgtgcctgaaatgcgatcttcaggagaggctgctgtgcccatcactgctcgctggcacagccgatgggagccttaggatggatgatcctaagggggattttatcacactctatcaaatggcaagtcagagctccgcgtcacactataaactacaggttatcaaagctctgaagtctagtggactctgcgagagcctgacttatggactcccctttatactcaggcctacctcctgttggcagttagattgggatgagttggagacaaatcagcaacattttcacgccctttgccattccctgttgaagcgagagtggctgctgctggccaagggagagcctcccggtcccggacactcccagaggattcctgcctccaccttttatgtcataatgccatcccactccctcacactgctggtgaaagccgtggccactagagagctaatgctgccctcgacttttcctttgttgcccgaggaccctcatgacgacagcttgaaaaacgtggagtcgatgttagattcactcgaactcgagcctacttacaatcccctccacgtgcagtctcatttatactcccacttatcatccatctatgccaagccacaggggaggctgcaccctcattgggaaagtagagcccctagaaagaccgggcagctgcaaacaaacagggctcgggctaccgtggcaccacttccaatgacacccgtacctggcagggcttccaaaatgccagcggcaagcaagagctccagcgacgcgtttttcctccctagcgagtgggagaaagatccgtctagaccatag

SEQ ID NO: 49204 - DNA, 864 bp, Artificial Sequence
  Description of Artificial Sequence: Synthetic coding sequence
atggaagagaaagaggataaacaccagcaacacaagattgaagacgctgcgatcacctatgtatccgagaacgaggagataaagcacgaggaaaaacccggtaagagtattcatcactccaagtctcacgtgggcaggggcaggatatactatgcaaagttcatcaataccaacgctcggacctataacgagccattcccctacattgaccctaagaaaggaccagagatccagggcgactggtggagtcatggcaaggcacttgagcctgtgtttctgccaccttacgattctaagagtacacaacgctccgattttcaaaaacctagttgtccattagtcctacccgtcaagcatagtaagatgcagaagccgagttgcggcatagttcccctcgcctctccaggaacgtctgctgagcttcagaataactttatagagtacattagcttcatccaccagtatgatgcacggaagacaccaaatgaacctcttcaaggtaagcgccatggtgcttttgtccagagagagataaaacctggaagtcgcccaacggtccccaagggggctgaagtgctattaaacacgcccggtagtcgttccagtgaacagagtaaaaagaccgagaagggcaattcggcagagagcaggatgatttcccccggactgtgccagcagaatagccaagagctgctcgaacccaaaacgcatttgtccgagaccgatgtgcggcaggcagctaaggcgtgtcctagcacacctgaatctcgggagaagacgtctggtgctactcagaccacagtgggagatgcgttattcactaggcataagcccctgaaccctcccatcaagaaatctgaatag

SEQ ID NO: 49205 - DNA, 366 bp, Artificial Sequence
  Description of Artificial Sequence: Synthetic coding sequence
atggcctcctgtctggcactgagaatggcgctactgttagtaagcggcgtgctggctcccgctgtcctgactgacgacgtgccccaggaaccagtacctaccttgtggaacgagcctgctgagctgccctcaggagagggaccagttgagagtacttcaccaggacgcgagccagtagacacgggccctcctgctcccacggtcgctccgggaccagaggactcaacagcccaggaaagactggatcagggcggaggctctcttggaccgggagccatcgccgctatagtcatcgccgctctcttggccacgtgcgtcgttctcgctctggtcgtagttgccttacgtaaattttccgcctcttag

SEQ ID NO: 49206 - DNA, 366 bp, Artificial Sequence
  Description of Artificial Sequence: Synthetic coding sequence
atggctagctgcctcgcactgcgaatggctctgttgctggtctccggggtccttgccccagctgtgctaacagatgacgtcccacaagagcccgtacctacactttggaatgaacccgcagagctgccttcaggcgaaggtcccgtggagtccactagccccggtagggaaccagtggataccggacctcccgcaccaaccgtggcccctggacctgaagactccacagcccaggagcggctcgatcaagggggaggcagtctaggccctggcgctattgccgctattgtgatagctgctctcctcgccacctgcgtggtgctggccctggttgtggtggccttgaggaaatttagtgcttcgtag

SEQ ID NO: 49207 - DNA, 366 bp, Artificial Sequence
  Description of Artificial Sequence: Synthetic coding sequence
atggccagttgccttgccctccgaatggctctcttgctggtttccggagttctagcgccagcggtgttgaccgatgatgtaccccaggagcccgtgcccactctgtggaacgagcctgctgaactaccttccggagagggccctgtcgagtccacttctcctgggagggagcctgtagacaccggtcccccagcccctacagtggccccagggcctgaggacagtacagctcaagagcgcctcgatcaggggggaggatcactcggtcccggagcaatagcagccatagtgatcgccgctctgctagcaacttgtgtggtgttagctctggtcgtagtagctctgcggaagttctccgcgagttag

SEQ ID NO: 49208 - DNA, 1371 bp, Artificial Sequence
  Description of Artificial Sequence: Synthetic coding sequence
atgtcaccatggtcttggttcttgctccagactttgtgcctgctccccacgggagcggcttcacgaaggggcgcacccggtacggctaactgcgagctgaagccacagcagtcagagctcaacagcttcctatggacaataaagcgggatcctcctagttacttcttcggcacaattcacgttccgtacacacgggtctgggactttattccagataactccaaagaagcttttctgcagtcaagcattgtttatttcgagctggaccttaccgacccgtacaccataagtgccttgaccagctgtcagatgctgccccagggagaaaacctgcaagacgttttgcctcgggacatctattgccggctgaagagacaccttgaatacgtcaagctgatgatgcctctgtggatgacccctgatcagagaggtaagggcctatatgccgattatctattcaatgccatagccggaaattgggaacggaaaagaccagtgtgggtgatgctgatggtcaactccctgaccgaggtggatattaagagccgtggcgtcccagttcttgacctgtttttggcccaggaagcagagagactgcgcaagcaaactggtgctgtggagaaggtggaagaacagtgccatccacttaacggactgaacttctctcaggtacccaatttcatcaatgccacgcttcctccccaggagaggatcactgcccaggagatcgacagctatctgagaagggagttaatctacaaacggaatgagaggatcggtaaacgtgtgaaggcactgctggaggaatttccggacaagggattcttcttcgcgttcggcgcaggccattttatgggcaataacactgtgctggatgtccttcgccgagagggttacgaagtcgagcacgcaccagcgggacggcctatccacaagggcaaatcaaaaaagaccagcacccgcccaacgctctccactatctttgctcccaaagtcccaacactcgaagttcccgcacccgaggcagtgtcgtccggacatagcacattaccacctctggttagtaggccaggctccgcggacactcccagcgaggccgagcagcgtttccgcaagaagaggcggcgatcacagcgacgaccgagactccgccagttctccgacctctgggtgaggctcgaggaaagtgacatagttccacaactccaggtgccagtattagaccggcatatcagtaccgagttacgcctcccccgtcgcggtcatagtcatcacagccagatggtggcatcaagtgcttgcttgtcattgtggactcctgtgttttgggtcctggtactcgcattccagaccgagactcctctactgtag

SEQ ID NO: 49209 - DNA, 1518 bp, Artificial Sequence
  Description of Artificial Sequence: Synthetic coding sequence
atgtctccctggagttggttcctgctccagaccctgtgtctcttgcctacgggcgcagcaagccggcgaggggctcccggaaccgccaattgtgagctcaaaccccagcagtccgaactgaactcatttctttggaccatcaaacgtgaccctccatcctacttcttcggcaccatccatgtcccatatacccgagtctgggatttcatccctgacaattctaaagaggcattcctgcagtcctcaatagtctacttcgaattggatctgacggatccctacacgatcagcgccctgacctcttgccaaatgctccctcagggcgaaaacctccaggacgtattgcctagagacatttactgtcgcctgaaaaggcatctggagtacgtgaaactgatgatgcccctgtggatgacccccgatcagcgtggtaagggattgtatgcagactacctgttcaacgccattgcaggaaattgggagagaaaacgccctgtgtgggtcatgctgatggtgaactctctcacagaagttgatattaagtctaggggtgtcccagtcctggatctttttttagcccaggaggcagagcgactccgcaagcagacaggagcggtcgagaaagtcgaggaacagtgtcacccccttaacggtctaaacttctcacaggtcatcttcgcgctgaaccagaccctactacaacaggagtctctgagggcaggctcccttcagatcccatacacgacagaggatctgatcaagcactataactgcggggaccttagcagcgttatcctcagccacgactcaagtcaagtgcccaacttcattaatgccacactgccaccacaggaacgcatcacagcgcaagagatcgactcgtacctccgacgcgagctcatatacaagaggaatgagcgcatcggtaagcgcgtcaaggctttactggaggagttccctgataaagggtttttcttcgcttttggcgcagggcacttcatgggtaataatactgtccttgatgtcctccgccgagaaggctacgaggtcgagcatgccccagctggacgcccaattcacaaaggaaaatctaagaagactagtacaagacctacactaagcactattttcgcaccaaaggtgcccactctggaggtgcccgctcctgaggccgtaagtagcgggcactccactcttccaccacttgtttcgcggccaggctcggcagacaccccaagcgaggcagaacaacggtttagaaagaagcggaggagatctcagaggagaccgagattaaggcagttttcagatctgtgggtaagattggaggagagtgacattgttccgcagctccaagttccagtgctggaccggcacattagtaccgagctgcgtctccccaggcgcggtcatagtcaccacagtcaaatggtggcatcttcggcttgtctgagcctctggaccccagtattttgggtgctggttctagcatttcagacggaaacaccactgctgtag

SEQ ID NO: 49210 - DNA, 1878 bp, Artificial Sequence
  Description of Artificial Sequence: Synthetic coding sequence
atgtgtgagaccagtgcattttacgtcccgggagtcgccccaattaacttccatcagaatgatcctgtggagattaaagctgtaaagctgaccagctctaggacccaactgccgtacgagtattattccttacccttttgtcagccaagtaagatcacatacaaggcagagaacttaggcgaggtcctcaggggtgatcgaattgtgaataccccttttcaggtcctgatgaattccgagaaaaagtgcgaggtgttgtgtagccagagcaataagcccgtcacactgactgtggagcaaagccgtctggtggccgaaaggattactgaggactactacgtgcatctgattgccgataatttgcctgtggctacgcggctggaactgtactctaaccgagacagcgacgacaaaaaaaaagaaaaggatgttcagttcgagcatgggtatcgactgggctttaccgacgtgaacaaaatatatctgcacaatcacctgtcttttatattgtactaccatagggaagacatggaggaagatcaggagcacacgtatcgtgttgttcggtttgaggtgatacctcaatccatcaggctggaagacctgaaggccgacgagaagtcctcctgtaccctcccagaaggaaccaatagctctccccaggagatcgaccccacaaaggaaaatcagctgtactttacctatagtgtccattgggaggagtccgacataaaatgggctagtcgctgggatacttacctcaccatgagtgacgtccagattcactggttctcaatcataaacagtgtcgtggtcgttttctttttgtccggaatacttagtatgattatcatcaggactttacgaaaggatattgccaactataacaaagaggacgacattgaggacacgatggaggagtccggatggaaattggtgcatggagacgtgttcaggcccccacagtaccctatgatcctgtcctcactcctaggtagcggcatacagttattctgtatgatcctgatcgttatctttgtcgccatgcttggtatgctgtcaccgtcaagcagaggggctctgatgacaacagcctgcttcctcttcatgttcatgggggtcttcggcggatttagcgccggacgtctttatcggacgctgaagggtcacaggtggaagaaaggcgcattctgtaccgctacactctaccccggagtcgtgttcggaatttgttttgttctgaattgttttatttggggcaagcattcaagcggggcagtcccttttcccaccatggttgcgctcctctgcatgtggtttgggataagcctgcccctagtctacctggggtattattttggcttccgcaaacagccgtacgataatcctgtacgaacaaaccagataccgcgacagatcccagagcaacgatggtacatgaacagattcgtaggcatcctaatggctggcatcttgcccttcggtgccatgttcatcgagcttttctttattttcagtgccatttgggaaaatcagttctactaccttttcgggttcctgttcttagtctttattatcctagtggtgagctgctcacaaatctccattgtgatggtgtactttcagctgtgcgcagaggattatcggtggtggtggcgcaatttcctggtctctggcggttcggcattttacgtgctagtgtatgctattttctacttcgtaaacaagctcgacatcgtggagttcatccccagcctgctttactttgggtatacggcactgatggtccttagcttttggctcttaaccgggaccatcggcttctacgctgcttacatgttcgtccgcaaaatatacgcagcggtgaagattgattag

SEQ ID NO: 49211 - DNA, 1701 bp, Artificial Sequence
  Description of Artificial Sequence: Synthetic coding sequence
atgcccggacaccctggcgcagcagagcagctggtgaagaccggctggcggtcttggcaccttggcttttggaaggctctcgcacctcttcaggccgcttgggatgcctttagccagcctgtacctgccagctgtgggcagctactaacccagttgctgctctgcgcctccttggcagcggcagccgctgggctagtttatcactggctggccagcctgctattgtacccgccaggtcccagtgccatggttgctactgtctgtgggctgttggtctttctctccctaggtctggtgcctccggtgaggtgcctgtttgctctctccgtcccgactctcggcatggagcaggggagaagactgttgctcagctacagcacagctactttagccatcgctgtggtaccaaatgtgttggctaacgttggtgcggcagggcaagtgctgagatgtgtgaccgagggctctctggaatcacttctcaacactacacaccagctgcacgcagcctcaagagccctcggacccactgggcaggctgggtcccggggtctgacctttgaggcccaagataacggctctgccttctacctgcacatgttaagggtgacacagcaggtcttagaagacttttctggactcgagagtttggctcgcgcagcggcactgggcacacagcgcgtggtcacggggctctttatgctcggactgcttgtggagagcgcctggtacctgcactgctatctgactgacctcaggtttgataacatatacgccacacagcagttgacacagaggctcgcccaggcccaggctacccacctgcttgctccaccgccaacatggctgctccaggctgcacagctgcgcctatcccaggaggagctgctcagttgccttttgagactgggcctgctggcacttttacttgtggctaccgccgtcgccgtagctactgatcacgtagcttttcttctggcccaggccacagtggattgggctcagaagctaccgacagtgccaatcacccttacagtgaaatatgacgttgcctacaccgtcctggggtttatcccttttctgtttaaccagctcgctcccgagagcccgtttcttagtgtgcactcaagctatcagtgggagttgcggctgacatccgccaggtgtcctcttttgcctgcccgtcggcctcgagcggcagcaccactcgcggcaggtgcccttcagctgctcgccggttctaccgtcctcttggaggcctatgcccgtcggctcagacacgccattgctgcctcgttcttcacagcacaggaagcacgtcgagtgagacatctccacgccagactacagagaagacacgaccgtcatcaggggcaacagctgcccttaggagatcccagctgcgtacccactcctagacctgcctgcaagccacccgcatggattgactaccggctcgacgccctccgtacagagtcttccgaaggtgaggggaaggagctctggagctgccgggatctgtcatgtaacttgggccctgtaccccctccttgtgtgactctgggcaagtctttacacttgtccgaacctcggttccttcatctgcacaatgacagcattttcaccattgatgtgacatacttccctaggcgggatgtcgtacgcatggaaggaaataccggtcacgacagaccaggctag

SEQ ID NO: 49212 - DNA, 432 bp, Artificial Sequence
  Description of Artificial Sequence: Synthetic coding sequence
atgtctggaggacggcgaaaggaagagccccctcaaccacagctcgccaacggggcattgaaggtatctgtgtggtctaaagttctgcgctcagatgctgcctgggaagataaagacgagttccttgacgtgatctactggtttagacagatcatcgcagtggtcctaggcgtcatttggggcgtgctgcccttacgcggtttcctaggcatagcaggcagcttcgggagttcttttactctaccatcaattatgactgatggggtccaactgccgtctgccccatatccggtgcagcgcacattgttaataaccgcccaggagctcgatagatggggaacaccagctccttggaaccttgaagacccgtgcttcttagaccgcgaatcggtctgttgggcaagcgtattcagcgcacgcgttgtgacctag

SEQ ID NO: 49213 - DNA, 390 bp, Artificial Sequence
  Description of Artificial Sequence: Synthetic coding sequence
atgagtgggggtcgaaggaaggaggagccgccacagccacaattggcaaacggtgctctgaaagtctccgtgtggtcaaaggtcctgcgatctgatgcagcttgggaagataaggatgagtttctggatgtcatctactggttccgacagataatcgccgtggtcttgggtgtgatttggggggtactgccgctacgaggtttcctggggatcgctggattttgcttgatcaacgccggtgtactgtacttgtacttctccaactacttacagatcgacgaggaagaatatggtggcacgtgggagctgacaaaggaaggattcatgactagctttgccttattcatggttatatggatcatcttttataccgctattcactatgactag

SEQ ID NO: 49214 - DNA, 414 bp, Artificial Sequence
  Description of Artificial Sequence: Synthetic coding sequence
atgtcaggtggccgtagaaaagaagaaccgcctcagccccagttggctaatggagcactgaaggtctccgtctggtccaaggtgcttcgctccgacgctgcctgggaggacaaggatgagttcctcgacgtgatctattggtttaggcaaattattgcagtggtgctgggagtcatctggggcgtgctgcccttaaggggattcctggggatagcgggattttgtctgatcaacgctggcgtgctgtacctgtatttttctaactatcttcagattgatgaggaagagtacggcggaacttgggaactcaccaaggaaggctttatgactagtttcgctctgtttatggtctgtgttgcggacagtttcactaccggccacttggaccatctactgcactgccatcctctgtag

SEQ ID NO: 49215 - DNA, 960 bp, Artificial Sequence
  Description of Artificial Sequence: Synthetic coding sequence
atgtccagccctcaggcacctgaggatggacagggctgtggagatagaggggatccacctggcgatctgcgctcagtgttggtgaccaccgtcttaaatctggagcctctggacgaggacctgtttcgtgggaggcattactgggtccctgcgaagcgcctctttgggggtcagatagtcggacaggcgctggtggctgctgctaaatctgtgagtgaggacgtgcacgtccattcactgcactgctattttgtccgcgctggggaccctaagcttcctgtcctctatcaggtcgagcgcactcggacaggctcaagtttctcagtccgctctgtcaaggctgtgcagcatggtaagccaatttttatctgtcaggcaagctttcaacaggcacagccgtcaccgatgcagcaccaattctctatgcctaccgtgcctcctccagaggagttacttgactgtgagaccctcatcgaccagtacctgagagatcctaacctgcagaagaggtaccccttagccctgaacaggatagccgctcaggaagtgcccatcgagatcaagcctgtgaacccatctccccttagtcagctccaaaggatggagccaaagcagatgttctgggtgcgcgctcgcggttatatcggggagggagacatgaagatgcactgttgcgtcgcagcctacataagcgactatgcatttctggggactgccttactgccccaccagtggcagcacaaggtgcacttcatggtgtctctagaccacagcatgtggttccatgcaccttttcgcgctgatcattggatgctctacgaatgcgaatcaccttgggccggtgggagtaggggactggtgcacggccgactgtggcgccaggacggggtcctcgctgtgacctgcgcccaagagggggtgatccgggtcaagccccaggttagcgagtccaagctatag

SEQ ID NO: 49216 - DNA, 870 bp, Artificial Sequence
  Description of Artificial Sequence: Synthetic coding sequence
atgagtgaggcagacggtttgcgtcaaaggagacccctgcgcccacaggttgtgactgacgacgacgggcaagcacccgaagctaaggacggctccagtttctccggaagggtatttcgggtgacctttctgatgctagcagttagcctgactgtcccgttgttgggtgccatgatgttgctagagtcccctattgacccccagcccctgtcattcaaggaacctcctctgttgctaggtgtgttgcaccccaacaccaagcttagacaggcagagaggctctttgaaaatcagctcgtagggcctgaaagcattgcacacattggagatgtcatgtttaccggaacggccgatggtcgggtggtgaagttagagaatggagagattgagaccatcgcccgatttggctcaggcccatgtaagaccagagatgacgagcccgtgtgcggccgacccctgggaattcgcgctggcccaaatggcaccctatttgtagccgacgcttataaaggcctctttgaagtaaacccttggaaacgcgaagtaaagttgttactttccagcgagacacctatcgagggaaagaacatgtcgtttgtgaacgaccttacggtaacacaggacggccgaaaaatttactttactgatagctctagcaagtggcagaggagggattacctcctccttgttatggaaggaaccgacgacggaaggctcctggaatacgatactgtaacacgcgaagtgaaagtgctgcttgaccagttgagattcccaaacggagtgcagctgagtcctgcagaggatttcgtgctggtcgcagaaacaactatggcccgaatccgaagctccctagtgaaacgcaggtag

SEQ ID NO: 49217 - DNA, 1230 bp, Artificial Sequence
  Description of Artificial Sequence: Synthetic coding sequence
taagtggtcacggacgacgacggccaggcacccgaggctaaggatggtagttcgttctctggtagagtgtttagagtcacattcctgatgctggccgtgtcgttgacagttccactcctgggagcgatgatgctgctagaaagtccaattgacccccagcctctgagctttaaggaacctccgttactcctcggagtgctccatcccaatacaaagctgcgccaggctgaaagactgttcgagaaccagcttgtaggaccagagtccatcgcgcacattggtgacgtcatgttcacaggaacagctgatggcagggtggtgaagctcgagaacggcgaaatcgagacaatcgctcggttcggcagcggtccttgtaagacccgggatgacgaacctgtgtgtggcaggccactggggatccgggctggacctaatggtactttatttgtggccgacgcctataaaggcctgtttgaagttaacccttggaagcgcgaggtgaagctgctgctgtcttcagagacgcctatcgagggcaagaacatgagttttgttaatgacctgactgtgacccaggatgggaggaagatatatttcacagactccagctccaagtggcagagaagggattatctgctgttggtaatggagggcaccgacgacggaagactgctggagtacgataccgtgactcgagaagtaaaggtgcttttagaccagttgagattccctaacggggtgcaactaagccccgcagaagactttgttctggtcgccgaaaccactatggctcggatacgcagagtatacgtctcgggtcttatgaaagggggagccgatctgtttgtggaaaacatgcctggctttccagacaatatccggccatccagtagcggcggatattgggtgggtatgtcgacaatacgtccgaatccgggattctctatgctagacttccttagtgagaggccttggatcaagcggatgatttttaagggatcgtgtgcaggttgtgatttactgttctcgcaggagacagtaatgaaattcgtccctcggtattctctggtgctggagctctcggactccggcgcattccggcgatctcttcatgaccccgacggcctcgtggctacatatatcagtgaggtgcatgaacatgatggccacctttatttgggcagcttccgctcgcctttcctatgccgcctctcccttcaggccgtgtag

SEQ ID NO: 49218 - DNA, 363 bp, Artificial Sequence
  Description of Artificial Sequence: Synthetic coding sequence
atgatgccttccaggacaaaccttgcgactgggatccctagctccaaggtaaaatatagtaggctttcatcaaccgacgatgggtacatagatttgcaatttaagaaaacccctcctaaaataccatacaaggccatagccttagccacagtcttgtttctgataggtgcgttcttaatcatcattggcagcttacttctgtcagggtacattagcaaggggggtgccgacagagcggtcccagtgttgattataggcattctagttttcctgcctggattctaccacctgagaattgcatactacgcctccaaggggtatcggggatactcgtacgacgatattccagacttcgatgactag

SEQ ID NO: 49219 - DNA, 552 bp, Artificial Sequence
  Description of Artificial Sequence: Synthetic coding sequence
atgcagccctgggccctccccacggttggggaattatgggtctgcggaagacccggagccgctcttagatggtccctggtgctgtccccgaggctggaacctagcggagtcatctctgcccattgtaatctgcatctactggccagttcagactcgtccgcctccgcttccagactgtgccagagggtcatgatgccatctcggacgaacctggctactggaattccttccagcaaggtaaagtatagccggctgtccagcaccgatgacggttacatcgatctgcagttcaagaagactccgccaaagattccttacaaggctatcgccctggctacagtgcttttcctcataggcgctttcctgataatcatcggctctttactgctctcaggctacattagcaaggggggagctgaccgcgctgtccccgtgctgattattgggatcttggtattcctgcctggattctatcacctcaggattgcctactacgcctccaaaggttatcggggatactcctacgatgatatacctgattttgatgactag

SEQ ID NO: 49220 - DNA, 225 bp, Artificial Sequence
  Description of Artificial Sequence: Synthetic coding sequence
atgatgccctctcgcacaaacttggcaacaggcatcccttcaagcaaggttaaatattctcggctgtcatccactgacgacggatatattgatttgcagttcaagaaaaccccccctaagattccttataaagccattgctctggcgacagtgctgtttcttataggagcttttttaattatcatcggatcgctactgctgtcgggttacatcagcaaaggctag

SEQ ID NO: 49221 - DNA, 363 bp, Artificial Sequence
  Description of Artificial Sequence: Synthetic coding sequence
atgatgccttctcgcacaaatttggctaccggtattccaagcagcaaggtgaaatactcaaggctcagctcaacggacgatggctacattgacctccagtttaagaagactccgcctaagataccctacaaagccatcgctctcgcaaccgtgttgtttctgataggagcatttcttattattatagggtcactcctgctgtctggctatatctctaagggtggcgcagaccgggctgtccccgtgttgattatcggcatcctggtttttctcccaggcttctaccacctcagaatcgcttattatgccagcaaaggatatcgcggttattcgtatgatgatattcctgactttgacgattag

SEQ ID NO: 49222 - DNA, 363 bp, Artificial Sequence
  Description of Artificial Sequence: Synthetic coding sequence
atgatgccaagcaggaccaacctggctaccggcataccaagttccaaggtaaagtatagtcgactttcatctacagacgacggatatatcgacctgcagtttaagaaaaccccccctaaaatcccgtacaaagcgattgccttggccactgtgctgttccttattggggcattcctaattattatcggcagtctgctgttgtccggctatatctctaagggtggagccgatagggccgtcccagtgctgataatcggcatactcgtgttccttcctggattttaccatctgagaatcgcctactatgcctctaagggctaccggggttatagctacgatgatatacccgatttcgacgattag

SEQ ID NO: 49223 - DNA, 363 bp, Artificial Sequence
  Description of Artificial Sequence: Synthetic coding sequence
atgatgccctcaaggaccaacctggcaacaggaatacccagctcaaaagtgaagtatagccgattatctagcaccgatgacggatatatcgatctgcagttcaagaaaacaccaccaaaaatcccgtacaaggcaattgcattagcaacagtgttattcttgatcggggcattcctgattatcattggaagcttgctgctgtccggctatatctccaagggaggagcggaccgagccgtgccggtcctgattattggaattctcgtgttcttgcccggattttaccacctgagaattgcctactatgccagcaagggttacagaggctattcgtatgatgacatccctgatttcgacgactag

SEQ ID NO: 49224 - DNA, 363 bp, Artificial Sequence
  Description of Artificial Sequence: Synthetic coding sequence
atgatgccctcacgcactaatctcgcaactggaatcccctcatccaaagtcaagtatagtcgcctgagtagtacggatgatggctacatcgacctacagtttaagaaaacacccccaaaaataccatacaaggccattgctctggccacagtactgttcctgattggcgctttcttgattattataggcagcctgcttctgtccgggtatatctcaaaaggaggggcagatagggccgtgcccgtgcttattattggcattctggttttcttacctggcttttaccatctcagaatagcctattacgccagcaaaggatatagaggctattcatatgacgacattccggacttcgatgactag

SEQ ID NO: 49225 - DNA, 363 bp, Artificial Sequence
  Description of Artificial Sequence: Synthetic coding sequence
atgatgccttctcgtactaacttggccacagggatcccctcttctaaagtcaaatattcaagattgagcagcaccgacgatgggtatatagacctgcagttcaaaaagaccccgcctaagatcccgtacaaggcaatcgcacttgccactgtgctgtttttaattggcgcatttctgatcattataggcagcctccttctttccggctacatttcaaaagggggtgcagatcgcgctgtacccgtgctgatcattggcattcttgtgtttctccccggtttttaccacctcagaatcgcatactacgcttccaagggctatagaggttatagttatgatgacattccagattttgacgactag

SEQ ID NO: 49226 - DNA, 759 bp, Artificial Sequence
  Description of Artificial Sequence: Synthetic coding sequence
atgaagatgaagctgtttcagaccatttgtcgtcagttgagatcttccaagtttagtgttgaatccgccgcactcgtggcgttctccactagctcctacagttgtggacggaagaagaaagttaatccttatgaagaggtggaccaagaaaaatactctaatctggtacaatccgtgctcagctctaggggcgtagcacagacaccaggttccgtagaagaagatgcactcttatgtgggccagtctctaagcataaactccccaatcagggagaagatcggagggtaccacagaactggttccccatattcaatcctgagcgatcagacaagccaaatgccagcgatccttcggtgcccttgaagattcccctacagaggaatgtgatccctagcgtaacccgggtcctccagcaaactatgaccaagcagcaagtttttctgctagaaaggtggaagcagcgcatgattcttgagttgggggaggatgggttcaaagaatatacttcctcttctatgtggctgaactgcggcggacttcagaggtggattacctgcccacctacctttcacggctgtcgggcactgtttccagttctggatcaggtggcgtctagtactagacgcatctatggcaaagagaaggagccagagtactctgaaacaaggattttcaggatcggatctaagctcctcttcggcaacatccagcacctgctgaccgtgtgggagcacatccttctcttcacaccggtgtag

SEQ ID NO: 49227 - DNA, 795 bp, Artificial Sequence
  Description of Artificial Sequence: Synthetic coding sequence
atgaaaatgaagctgtttcagacaatttgccggcagttacgctcatcaaaattctctgtggagtctgctgccttagtagcattctcaacttcaagctactcttgcggcagaaagaaaaaggtgaatccttacgaagaagtcgaccaggaaaaatattcaaatcttgtgcagagtgtacttagttcacgcggtgtggcccaaacacctggtagcgtcgaggaagacgctctcctgtgtgggccagtcagcaagcacaaactacctaaccaagacgtgttccttcaaggaaaaagattccacgaggcactcgagtccatcctgtctcctcaggagacattgaaggaaagggacgaaaacctgttgaaaagtgggtatattgagagcgtccagcacattctgaaggatgtctccggagtgcgtgctctggaatcagctgtacagcatgagactttgaattacattggcctgctagattgtgtggccgagtaccagggaaaattatgtgtcatcgactggaagacaagcgaaaaacctaagcccttcatacaatccacatttgacaacccgctgcaagttgtcgcttacatgggcgcaatgaaccacgacacaaattactccttccaggtgcagtgcggcttgattgtggtggcctacaaggatggctcaccagcacatccccactttatggatgcagaactctgctcacagtactggacgaagtggcttctccggctggaagagtacactgagaagaagaaaaaccaaaatatccagaagcctgagtatagcgagtag

SEQ ID NO: 49228 - DNA, 1035 bp, Artificial Sequence
  Description of Artificial Sequence: Synthetic coding sequence
atgaaaatgaagctgtttcagaccatttgccgccaactacggtcatcaaagttctctgtagagagtgcggctctggtggccttctctacttctagctactcctgcggcagaaaaaagaaagtgaatccgtatgaggaggtggaccaagaaaagtacagtaatctggtgcagtctgtcctgtcctctcggggagtggcccagaccccaggctcggtggaagaagatgctcttttatgtggcccagtgtcaaagcataagctgcccaaccaaggagaagaccggcgtgtgccacagaattggttccccattttcaaccccgagcgaagtgacaagcccaacgcttcagatccatcagtgccattgaaaattcccctgcagcgcaacgtgatccctagcgtgacccgggtactccagcagactatgaccaagcagcaagtattcctgttagagagatggaaacagaggatgatccttgagctcggcgaggatggattcaaggagtacacatccaacgttttcctgcaaggaaaaagatttcatgaggccctggagtctattctgtcaccccaggagacactgaaggagcgggatgagaacctgctgaagtccgggtacattgaaagcgtgcaacacattttaaaggatgtgagcggcgttcgcgctcttgagtctgctgtgcagcatgaaacactcaactacatcgggcttctggattgcgtggctgagtaccaaggcaagctgtgcgtaatagattggaaaactagcgagaaaccaaagccattcatacagtctacattcgacaatcccctgcaggttgtggcttatatgggtgccatgaatcacgacacgaactatagttttcaggttcagtgcggcctgattgttgtggcctataaggacgggtctccagctcacccgcattttatggacgccgagctgtgttctcagtactggactaagtggctattgaggctagaggagtacactgagaaaaagaaaaatcaaaatatccaaaaacccgagtactccgaatag

SEQ ID NO: 49229 - DNA, 1326 bp, Artificial Sequence
  Description of Artificial Sequence: Synthetic coding sequence
atgctgctgccaggccgagctcgacagccgccaactccccagcccgtacagcacccaggattgcgtcgtcaggtggagccaccaggccagttactaaggctattctactgcacagtgcttgtttgctcaaaggaaatctcggccctcacggatttttccggttacctcactaagctgctccaaaaccatacgacctatgcctgcgacggcgactatctgaatttgcagtgccctcgacatagcactatcagtgtacagtcagcgttttacgggcaggactaccaaatgtgcagctcccaaaaacctgcctcgcagagggaagactccttgacttgtgttgccgcaaccaccttccaaaaggtcctcgatgagtgccagaaccagcgcgcttgccacctacttgtaaacagtagggtttttggacccgatctctgcccagggagcagtaagtatttactcgtaagctttaagtgtcagccaaatgagctcaagaataagacggtgtgtgaggaccaggaactgaagttgcactgccacgaatctaaattcttgaatatttattctgctacctacggcaggcggacccaggagcgtgatatttgttctagtaaggcagaaaggctgcctcccttcgactgtctctcctactctgcgctccaggtcctatcaaggcgatgctacggcaagcagagatgtaaaattattgtaaataaccaccactttggctcaccctgcttgccaggagtaaaaaaatacttaaccgtcacctacgcctgtgttccaaagaacattctgactgctatagaccctgccatcgccaatctcaaaccgagtttaaagcagaaggatggagagtacggcatcaacttcgatcccagcggcagcaaagtactgcgtaaggacggcatcttagtttctaattctttggcagcttttgcgtatattcgcgctcacccggaacgtgcagcattgctctttgtctcttccgtgtgtattggtctggcactaactctgtgcgccctggtcatcagagaatcttgcgccaaagattttcgggacctgcaacttggcagggagcagttagtgccgggatccgataaagtggaagaggattccgaggatgaggaggaagaagaggatcccagcgagagcgatttcccgggagagttatccggcttctgtagaacgtcataccccatatactcgtctatcgaagccgcagaactggcagagcgaattgaacggagggagcagattatacaggagatctggatgaattctggactggacacctccttgcccagaaacatggggcagttctactag

SEQ ID NO: 49230 - DNA, 615 bp, Artificial Sequence
  Description of Artificial Sequence: Synthetic coding sequence
atgggctgggactgccgacgcaccacagtcgaaaacccaagtccaattcgaaattgcgtaaaccaggagtggcccgaaggctcctccccgggactgacggaagggaatacaggcctggttagagatcttcgccctgcgcaccaggatagatctgggacccgcgaggatcccgcaggacaggagacaacagcaataaccaacccttctccgtccttggcagccgacctggcaggggacgcgttaccgggttgcctgggtgccgcagcccaccaaggtcctctgcttgaccggtccagcgaatctacccttggccctcaggcccttgaactcgaacattgtcatgagaggggttgttgcagggggtgcgcgtcctttagcccttttcctgccccaaggtgtcccagcgagcggcttggtgcccacagcagcaggtgggcgattcggggtcgaagcaagatcaatccaccgccttgggccccagcctgcttaccaggtggatttcctgcatgcttgcccgctcccaagagtagtacagactcagcttcgagttgctttaaaggtgggagagagttttcggacccgttggatatccctggcgctggggctatggggtag

SEQ ID NO: 49231 - DNA, 249 bp, Artificial Sequence
  Description of Artificial Sequence: Synthetic coding sequence
atgggatgggactgcagaaggaccactgtcgagaacccatctcctattcggaattgcgtgaatcaagagtggcctgaagggtcgagccctggcctgaccgaaggaaatactgggcttgttagagatcttcggcctgcccatcaagataggagcggtacacgggaagacccagcaggacaggaaactactgcgataacaaacccttcacctagctgtacttctggcgcaagcgctggacaaaaactgtag

SEQ ID NO: 49232 - DNA, 483 bp, Artificial Sequence
  Description of Artificial Sequence: Synthetic coding sequence
atgaccacacaggaagatacaacagggttacaccaaaagacaagcctttggactatgagtcgaccaggggctaagaaggtcatgaactcttactttatcgctggttgtggtccggcagtctgctattacgccgtttcttggctccgccagggtttttcgatcaatttgacaagtttcgggagaatcccatggccacacgcaggagttggcacgtgcccttcaccgcagtcctggatttccccatttctgcaatcacacagggagcatcactacgctaagacttcttcgcacagccaaccaagcccccaatctttggcactgtgcctcgcctacagcaggtgcagcatcaacatatgtcagatgactgagtgtatcagtctggcaagcggttgccatcaggcattgcgggagcccggtcgctctgaggagtcattctggatccccgctactccctacatcagcaatatctttagtgaaagttag

SEQ ID NO: 49233 - DNA, 684 bp, Artificial Sequence
  Description of Artificial Sequence: Synthetic coding sequence
atggtgccaacgggctgggctgggcttggaggcgcagtcgtccatggccctggtaaactcgaaaaggctgtaccatctccccgagccctggactttctctctgttaagtgggaggcagctatgatgaacggaaaagtcccgtttttcttcagctccgagtcgttaggctacttcgcgaccggcagacctgcggataacgttatgacaactcaagaggacactacaggtctgcaccagaaaactagtttgtggaccatgtccaggcctggcgctaagaaagtcatgaactcttactttatcgcaggctgcggcccagcagtatgctattacgcagtgtcctggcttcggcagggattctctattaacttgacttcctttggaaggataccctggccgcatgccggagtgggaacttgtccctcccctcagtcctggataagcccctttttgcagtctcatcgcgagcaccattatgcaaagaccagtagtcactctcagccatctccacagtccctggccctgtgcctagcctacagtagatgttcaataaacatctgccagatgaccgagtgtatatccctggccagcggctgtcaccaggctctgagagagccaggaagatccgaggaatcattttggatccctgcgaccccatatatttcaaacatattctcagaaagctag

SEQ ID NO: 49234 - DNA, 831 bp, Artificial Sequence
  Description of Artificial Sequence: Synthetic coding sequence
atgtgcataatttttttcaaattcgacccacggccagtgagtaaaaatgcttacaggctgatcctggccgcaaacagggacgagttttactcacgaccctccaagctggctgacttttggggaaataataacgaaatcctgtccggcctggacatggaggaaggtaaagagggcggaacttggttaggcatttcaactcgtggtaaactggcggcactgaccaactatctccagccacagcttgactggcaggcgcgaggcagaggagaattagtgacccattttttgaccaccgacgtcgacagcctttcctacctgaagaaagtgagcatggagggccatctctacaacggttttaatcttattgccgctgatttaagcactgccaagggagatgttatttgctactatggaaatcgcggtgaaccagacccaatcgtgctcacccctgggacttatggcttgtcaaatgcgctgctagagactccttggaggaagttatgcttcggaaaacaactgttcctggaggccgtggagcggagccaggctctgcccaaagacgttttgattgctagtctgttggatgtactcaacaatgaggaagcacaactcccagatccggctatcgaggaccaggggggtgaatacgtgcagccaatgctctctaagtacgccgcagtatgcgtccgatgtcctggatatggaacacgtactaatactatcatcctggttgacgctgatggccacgttactttcaccgaaagatccatgatggacaaggatttgagccattgggagacccgtacctacgaattcacactgcagagctag

SEQ ID NO: 49235 - DNA, 645 bp, Artificial Sequence
  Description of Artificial Sequence: Synthetic coding sequence
atgtgtattatattctttaagtttgaccctagaccggtaagcaagaacgcatacaggctcatcctggcagccaacagagacgaattctactccagaccatccaagttggcagacttctggggtaacaacaatgagatcttaagcggtctggacatggaggaaggaaaagaggggggaacttggttggggatcagcacccgcggaaaactggccgcattgaccaattatctacaaccccagctggattggcaggccaggggccgtggtacctatggcctctccaacgccctcctcgagacaccctggaggaaactttgtttcgggaagcagctgttcctggaggcagttgagaggtcccaggcactaccgaaggacgtgttaatcgccagcctgttggacgttctgaataatgaggaggcacaactgcccgatccggctatcgaagaccagggtggtgaatacgtgcaaccgatgctgagtaagtacgccgcagtgtgtgtccgttgcccagggtacgggactcgaaccaacaccataatcttggttgatgctgacgggcatgttacatttaccgagcgcagcatgatggataaggatttaagtcactgggagacacgcacttacgaattcaccttgcagtcgtag

SEQ ID NO: 49236 - DNA, 645 bp, Artificial Sequence
  Description of Artificial Sequence: Synthetic coding sequence
atgtgcataatctttttcaagtttgatccacgacctgtgagcaaaaatgcttacagacttattctcgccgcaaatcgcgacgaattctacagcaggccatccaagctcgctgacttctgggggaataataacgagatcctgtcaggcttggacatggaagaaggaaaggaggggggtacctggctgggcatttcaacaagaggtaaactggctgcccttacgaactacttacaaccccagctggactggcaagcaagaggccgtggaacatacgggctatcgaatgccctactggagacgccctggaggaaactctgcttcggcaagcaactctttctggaggcggttgagcgcagtcaggccctgcccaaggacgtcttgatcgcatccctgctggatgttttaaataacgaagaggctcagctccctgatccggctattgaagaccagggcggagaatacgtgcagcccatgctctctaaatatgccgcagtatgtgtcagatgtcctggctatggtacgcgcaccaatacaattatcctggtagatgccgacggccacgttacattcaccgagcgttcaatgatggacaaggacctttctcattgggagacccgaacttatgaattcaccctgcagtcctag

SEQ ID NO: 49237 - DNA, 537 bp, Artificial Sequence
  Description of Artificial Sequence: Synthetic coding sequence
atggcaggccaccagcatacatggcaggcaggatccacgcaccagctccctgccgcagccgctggacttgccggtccaagggcgtctacggctaaaggcgacgtgatttgctactatggaaatagaggtgagccagatccgatcgttctgacccccggaacatatggactatccaatgctctcctggaaacaccctggcggaaactatgtttcggcaagcagctttttttggaggcggtagaaagaagccaagccctcccaaaggatgtgctcattgcatctttgctagacgtgctgaataatgaagaagcccagctgcccgaccccgcaatcgaggaccagggaggagaatatgttcaacctatgctgtccaaatacgcggctgtgtgtgttcggtgtccaggttatgggacaaggacaaacactattattctcgtcgacgctgatggccatgtgaccttcacagagaggtctatgatggataaggacctgagtcattgggagacccgcacttacgagttcacactgcagagctag

SEQ ID NO: 49238 - DNA, 267 bp, Artificial Sequence
  Description of Artificial Sequence: Synthetic coding sequence
atgtgcattatttttttcaagttcgatcccagaccagtgagcaagaatgcctatcgactgatcttggctgcgaacagagatgagttctacagtagaccctcaaaactcgcagatttctggggaaacaacaacgagatattgtctggactggatatggaggaggggaaagaaggtggtacctggctgggcatctcaacacggggtaagctggcagctctgaccaattaccttcagccacagctcgattggcaagcaaggggcagatag

SEQ ID NO: 49239 - DNA, 645 bp, Artificial Sequence
  Description of Artificial Sequence: Synthetic coding sequence
atgtgtattattttctttaagtttgaccccagacctgtgagtaagaatgcctaccggttgattttagccgcaaatcgcgatgaattctattctaggccttctaagctcgctgatttttggggaaacaacaatgaaatcttgtccggccttgatatggaagaagggaaggaaggaggcacctggctcggaatctctactcgagggaaactggctgcgctcacgaactacctgcagccacagctggactggcaagcgaggggaagaggaacatacggactaagtaacgctctgctggaaacaccatggcggaaactatgttttggtaagcagctgtttctggaagctgtggagcgatcacaggccctgcctaaggacgtgctgatcgcttctttgctggatgtcttgaacaacgaagaggctcaacttcctgaccccgctatcgaggatcagggcggagagtacgttcagcccatgctgagcaaatacgccgcagtgtgcgtaaggtgccccggttacggaacacgcacaaataccattattttggtcgacgctgatggccacgttacttttacggaaaggagcatgatggacaaggacctgagtcactgggagacgaggacttatgaatttacgcttcagtcctag

SEQ ID NO: 49240 - DNA, 681 bp, Artificial Sequence
  Description of Artificial Sequence: Synthetic coding sequence
atgtgtattatattcttcaagtttgatcccagacccgtttcaaagaacgcgtacaggctaatccttgccgctaaccgcgacgagttctattcacggccttcaaagctggcggatttctggggtaacaataatgagatcctgtctgggctggacatggaggaaggtaaggagggaggcacatggcttgggatttccaccagaggcaaactggctgccctcaccaactatctgcagccccaactcgactggcaggcaaggggtcggggtgagctggtcacccacttcctcactaccgacgtcgattccctctcatatctgaaaaaggttagcatggagggccacttatataacgggttcaacctgatcgcagccgatctctccacggccaaaggcgacgtgatatgctactacggaaacagaggggaacctgatcctatagtgctgactccgggaacatacggtctcagcaatgctctcctagagacgccttggcgcaagctgtgctttggcaagcagcttttccttgaagcagtggaaagatcccaggctctgccgaaagacgtcctgatcgcctctctgctggacgtcctgaataatgaggaggcacagctacccgacccagccattgaggaccagggaggagagtatgtacagccaatgctgtccaagtacgccgcttag

SEQ ID NO: 49241 - DNA, 597 bp, Artificial Sequence
  Description of Artificial Sequence: Synthetic coding sequence
atgcctccaaagctcctgtgtgctgggcgatgcgtgggacaggatggagccgcacaggcctggcactgtccgcctggacagggccactctgtctgggacgccgttagaatgccgctgggcgctggcactcccgtcaatgtccagcgcagagaagattcagctaccgaaggctcacatcgtttaatccttgcggcaaatcgtgacgaattctactctaggccctccaaactagcagatttctggggaaataacaacgagattctttctggactggatatggaggagggcaaggaaggcggaacttggttaggcatcagtactcggggtaagcttgctgcattgaccaattacctgcagcctcagctggactggcaggctaggggaaggggggagcttgtaacccattttttaaccactgatgtcgatagtttgtcttacctgaaaaaggtctccatggaggggcatctctataacggcttcaacttaattgccgcagacctgtctacagcaaagggggacgtgatctgctactatggcaatagaggagaacctgacccaattgttttgacgcccgagccgacactcagctcatggtag

SEQ ID NO: 49242 - DNA, 831 bp, Artificial Sequence
  Description of Artificial Sequence: Synthetic coding sequence
atgtgcatcatcttctttaagtttgaccccagacccgtctctaagaacgcctacaggcttatcctggccgctaaccgagacgaattttattctagaccttccaaattagcagatttttggggcaataacaacgagatcctctcaggactggacatggaggaggggaaggaagggggtacgtggctcggaataagtacaaggggaaaactcgccgctttgactaactaccttcagcctcaactcgactggcaggcacgtggacgcggagagttggtgacccacttcttaactacagatgttgattcactgtcttacctgaagaaagtgtcaatggaagggcatctgtataatgggtttaatctcattgccgcagacctttcaacagccaaaggagatgtgatctgttactacggaaatcgtggggagccagatcctatcgtgctgacacccggaacttatgggctgagtaacgccctcctcgagaccccttggcgcaaactctgttttggaaagcaacttttcctggaggccgtcgagcgctcccaagcccttccgaaggacgtacttatagccagcttgctcgacgtgttgaacaatgaggaagcccagctcccggaccctgctattgaagatcagggtggggaatacgtgcagcctatgttgagcaaatacgccgcagtgtgcgtgagatgccccggttacggcaccagaactaacacaatcattcttgtggacgccgatgggcacgttaccttcacagaaaggtctatgatggacaaggatttatcccattgggagacccggacatatgagttcaccctgcaatcctag

SEQ ID NO: 49243 - DNA, 498 bp, Artificial Sequence
  Description of Artificial Sequence: Synthetic coding sequence
atgtgcatcatcttcttcaaattcgatccgagacccgtctctaagaacgcctacagactgattctcgcagcaaatcgtgatgagttttactctcgacccagtaaactagcagacttctggggaaataataatgagatactgtcaggacttgacatggaagaggggaaggaaggaggcacctggctgggaatatctacccgaggcaaactggctgcattgaccaactacttgcagccccaactggactggcaggctaggggcagaggggagctggtcacccactttctgacgactgacgtggatagtttgtcatacctgaagaaagtttccatggagggccacctatataacggttttaacctgattgccgctgatttgtcaacagccaagggcgacgtaatatgttactacggaaatcgaggggaacccgacccaatagttctgacacctggtacatacggattgtccaatgccctgcttgaaacaccctggcgctag

SEQ ID NO: 49244 - DNA, 846 bp, Artificial Sequence
  Description of Artificial Sequence: Synthetic coding sequence
atgccccttggagccggaacacctgtgaatgttcagagacgagaggatagtgctacagagggcagtcaccggctgattctcgctgcaaaccgcgacgaattctacagtcgcccttccaaactcgccgacttttggggtaacaacaatgagatcctttctggacttgatatggaggagggaaaggaggggggaacgtggctcggaatctccaccaggggtaaactcgccgctttaacaaattacctgcagcctcaactggattggcaggccagggggagaggtgagctagtcactcacttccttaccacagatgtcgactctctgtcctatctgaaaaaagtctctatggagggtcacctctacaatggtttcaatctgatcgccgctgatctgtccaccgccaagggcgatgttatctgttattatggaaaccggggagagcctgatccaatcgtgcttacgcccggaacatatgggctgtcaaatgcacttctggaaacaccttggcgcaagctgtgctttggcaaacagctgttcctggaggccgtagaaaggtcccaggccctacctaaggacgtgttgattgctagcctgctcgacgtcctcaacaacgaggaggcccagcttcctgaccccgctatcgaagatcagggtggggagtatgtgcagcctatgctatcaaagtacgctgccgtctgcgttcgttgccccggatatggaacccggaccaataccatcattctcgtggacgcagacggccacgtgacattcacagagaggtctatgatggataaggacctgtctcactgggagactagaacctacgagttcactctgcagagctag

SEQ ID NO: 49245 - DNA, 324 bp, Artificial Sequence
  Description of Artificial Sequence: Synthetic coding sequence
atggcctcgggagctgcccgttggcttgtgctcgccccagtacgttctggcgcactcaggtccggcccttcccttcgaaaggacggtgacgtcagcgctgcgtggtctgggtctgggagaagcttagtgccgagtaggtcagtgatcgttacccgtagcggagctattttacccaaacctgttaagatgagcttcggtctgctgagggtgttctctatagtgatcccattcctgtatgtgggtactctgattagtaaaaatttcgctgccttactggaagaacatgacattttcgtcccggaagacgatgacgatgatgactag

SEQ ID NO: 49246 - DNA, 1704 bp, Artificial Sequence
  Description of Artificial Sequence: Synthetic coding sequence
atgatggccgcagtgccgccagggcttgagccttggaatcgggttcgcatacctaaggcagggaaccgctccgccgtcacagtacaaaaccccggagccgctctcgatctgtgtattgctgctgtcatcaaggagtgtcacctggtcattctgtcactaaagtcacagacgctggatgcagagacagatgtgctgtgcgccgtgctttactccaatcacaatcggatggggagacacaagccccacctagccctgaagcaagtcgagcagtgtcttaaaagactcaaaaatatgaaccttgaaggcagcatccaggatttgtttgagctcttcagcagcaatgaaaatcaacctctgacaactaaagtgtgcgtcgttccatctcaacctgtcgtggaactggttttgatgaaggtattgggagcctgtaagcttttgctgagactgctcgactgctgctgtaaaacgttccttctgaccgtgaagcaccttgggttgcaagagtttattattctgaacctggtgatggtcggcctggtaagcaggctctgggtgctgtataagggagttctgaagcgactgattcttctgtacgagccccttttcggattgctgcaggaagtagctaggattcagcccatgccatatttcaaagatttcacatttccttccgacattacagagttcttaggccaaccgtattttgaggcgttcaaaaaaaagatgcccatagccttcgctgctaagggtatcaacaaactccttaacaagcttttcctcataaacgaacaaagcccaagggcatccgaagagacccttctcggcatctctaagaaggccaagcagatgaaaattaatgtgcagaacaatgtagacctgggacagcccgtcaaaaacaagagagtcttcaaggaagagtcatctgaatttgacgtgagggctttctgcaaccagctgaagcataaagctacccaggaaacttccttcgatttcaaatgtagccagtcaagattgaagacaaccaaatactcttcacagaaagtaattggcactcctcatgcaaagtcattcgtccaaaggtttcgcgaggctgagagctttactcagctgtcagaggaaatccaaatggctgttgtctggtgtcggtcaaaaaagttgaaagcacaggcaatctttctgggcaataaactgcttaagtcaaaccgcctgaagcaccttgaggcccaaggaacttccctccctaagaagttagagtgtatcaaaacatcgatctgtaatcacttgctgcgcggatctggcatcaaaacctccaagcaccacttgcgacagaggcggtcccaaaacaaattcctacgcagacagcggaagcctcagaggaagctccagtcaaccctgttgagagagatacaacagttctcacagggcacccgcaagagtgctactgacacatctgcaaagtggcgcctttcccattgcaccgtccaccgcaccgacctctaccctaatagcaagcagttacttaacagcggtgtgtctatgcccgtgatccagactaaggaaaagatgatccacgagaatttgcgcggtatccacgagaatgagactgactcgtggaccgttatgcagattaacaagaacagcacaagtggtacgataaaagaaactgatgatattgacgatattttcgctctcatgggcgtatag

SEQ ID NO: 49247 - DNA, 1494 bp, Artificial Sequence
  Description of Artificial Sequence: Synthetic coding sequence
atgatggcagccgtgccgccaggtcttgagccctggaacagagtacggatcccaaaagctggcaacagatccgctgtgaccgtgcagaaccccggagctgcacttgatctctgcatcgccgcagtcatcaaggaatgccacctggttatcctcagcctgaagtcccagactctggacgccgaaacagatgtgctttgtgccgtgctgtacagcaatcacaaccgcatgggccgacataagccccacctggccttgaaacaggtggagcagtgtctcaaaagactgaaaaatatgaacctagaaggctccattcaggatctcttcgagctcttctcgtctaaagtcctgtacaagggagtgctgaaacggctgattctgctgtatgaacctctgttcggcctcctccaagaagttgctagaatacagcctatgccatacttcaaagactttacatttccatcagatatcacagaattcttgggacagccatactttgaagcttttaaaaagaaaatgcccatcgctttcgcagcgaaaggcatcaacaaattgctgaacaagttattcctcattaacgagcagtccccgagagcctcggaggagacgctcctgggaatctccaaaaaagctaaacagatgaagataaacgtgcagaataacgtggacctggggcagccagtaaaaaacaagagagtcttcaaagaggagagctctgagttcgatgtgcgtgccttttgcaaccaactgaaacacaaagccacccaggaaactagttttgatttcaaatgtagtcagagtcggctcaagaccacaaaatacagctcacagaaagtgattggcaccccccacgcgaagtcattcgtccagcggtttcgtgaggccgagagcttcacacagctatctgaggaaattcaaatggcggtcgtgtggtgccggtccaagaagcttaaggctcaggccatctttctcggaaacaaattactgaagtccaatcggttgaaacacctcgaggcccagggcacgagtctccccaagaaattagaatgcatcaagacctccatttgcaaccaccttctgagaggcagtggaattaagacaagcaagcatcatctgcgccagaggcgttcccagaataagttcctgcgacggcagcggaagccccagcggaagctgcagagtaccctgttgcgcgaaattcagcagttctcccagggcactcggaaaagtgccacagacacaagtgccaaatggcggctcagtcactgtaccgtccatagaaccgacctgtatccgaactcaaaacagctgctgaatagcggagtttctatgccagtcatccagacaaaagaaaagatgattcatgaaaacctaagaggaattcacgagaacgagactgattcatggacagtgatgcaaatcaacaaaaattccaccagcgggaccattaaagaaaccgacgacattgacgatatctttgccttgatgggtgtgtag

SEQ ID NO: 49248 - DNA, 1296 bp, Artificial Sequence
  Description of Artificial Sequence: Synthetic coding sequence
atgaaggtgctcggggcttgtaagttactgcttagattgcttgattgctgttgtaagacctttctgctgactgttaaacacttgggccttcaagagttcattatactgaacctggtgatggtgggcctggtgtcacgcctgtgggtgctgtacaagggtgtcctgaaaagattaattttgctgtacgagccactgtttggactgctccaggaggtggctcgaatccagcccatgccctacttcaaagatttcacattccctagcgatatcacagagtttctgggccagccctatttcgaggcatttaaaaagaagatgccaatagctttcgcggcaaaaggaatcaataagcttctgaacaagctgtttttgattaacgagcagtctccaagagcgagtgaagagactctgctgggtatatcaaagaaggccaagcagatgaagattaacgtgcagaacaatgtcgacctagggcagcccgtgaaaaacaaaagggtatttaaggaggagtcctccgagtttgacgtgcgggctttttgtaaccagctaaagcataaggctacccaggaaacttcattcgatttcaagtgctctcagtctagactcaaaacaactaaatattcttcccagaaagtcatagggacaccccacgctaagtcgttcgtgcaaaggttccgggaggcagagtcgttcacccaattatccgaggaaattcagatggctgtggtgtggtgtagatccaaaaaattgaaggcgcaggctatcttcctgggtaataagctactcaaaagcaataggcttaagcacttagaggcccaagggacctctcttccgaagaagttagagtgtatcaagacatcaatctgcaaccatctactcaggggttccgggattaagaccagtaaacaccacctgcgtcaaaggcggagtcaaaacaaattcctacgcaggcaaagaaagcctcagcggaagctccaatctaccttgctgcgcgagatacagcaatttagccaggggactaggaagagcgctaccgatactagcgccaaatggagactgtcccattgtactgtacatagaaccgatttgtacccaaattcaaagcagctcctgaacagcggcgttagcatgcccgtgattcagactaaagagaaaatgatacacgaaaacctcagaggaatacacgagaatgagactgatagttggactgtgatgcaaattaacaagaactcaacttccggcaccattaaggaaactgacgatattgatgatatattcgctctgatgggcgtctag

SEQ ID NO: 49249 - DNA, 645 bp, Artificial Sequence
  Description of Artificial Sequence: Synthetic coding sequence
atgcctaaggtgttgtgcaaagacagtgagcgtttgtctcccagccataatttcctgaaaaagtcacgctggcagctttacggggctggaaagaaacttaaggcgcaggccatattcctggggaacaaactgctcaagagcaacagactaaagcacctggaggcacaaggaacctcacttccaaaaaagttagagtgcataaagacgagcatctgtaaccacctgctccggggatcaggaattaaaactagtaagcaccacctgcgccagcgcagatcacagaacaaatttctgaggcgccagagaaagccccaaagaaaactccaatcgaccctcttaagggagatccagcagttttcccagggcacacggaaaagtgccacagatacatcagcaaaatggcgattgtctcactgcacggtgcatagaaccgatttgtaccccaactcaaagcagctcctcaattcaggagtgtctatgccagtgattcagacaaaagaaaaaatgatccacgagaatctgcgcggaattcatgagaacgagaccgatagctggaccgtcatgcaaattaataagaattctaccagcggtacaattaaagagactgacgacatagatgacatcttcgcgttgatgggcgtctag

SEQ ID NO: 49250 - DNA, 489 bp, Artificial Sequence
  Description of Artificial Sequence: Synthetic coding sequence
atgaactccagaacggcttccgctagggggtggttttcaagccggccacccacaagcgaatctgaccttgagccagcaacggatggacctgcctcagagactaccaccttgtccccagaagccaccacattcaatgacacacgcatacctgatgctgctggtggaactgccggagtgggcacaatgctcctgagtttcggcatcataaccgtcatcggcctggccgtggccctcgtcttgtatatccgaaaaaagaagagactggagaagcttcgacaccaactgatgcctatgtataattttgatcctaccgaggagcaggacgagttagaacaggaactgcttgaacacgggagagatgcagcgtcagtgcaggccgctacatctgtgcaggccatgcaaggaaagaccaccctgccatcacaggggccactgcagcggccatctcgactggtgtttacggatgttgcaaatgccatccacgcttag

SEQ ID NO: 49251 - DNA, 489 bp, Artificial Sequence
  Description of Artificial Sequence: Synthetic coding sequence
atgaattccaggaccgcctccgccaggggatggttcagctcacggcctcctaccagtgagagcgacctcgagcccgctaccgatgggccagccagtgagacgactactctgtctcccgaggccactaccttcaatgatactcgcatcccagacgccgctggaggaactgcaggtgtgggcactatgctcttatccttcggtatcataacagtgatcggtcttgccgtggcgctggtcttatacatccgaaagaaaaaacgcttagagaaactgagacaccagctcatgccgatgtataacttcgacccgaccgaggaacaggatgaactcgagcaagagttgctggaacatgggagggacgccgcatcagtgcaagctgcaacgtcggtgcaagccatgcagggaaagaccacgctgccaagccaggggccattgcaaagaccttccagactggtttttaccgacgtggcaaacgccatacacgcttag

SEQ ID NO: 49252 - DNA, 429 bp, Artificial Sequence
  Description of Artificial Sequence: Synthetic coding sequence
atgaattctcgcacagctagtgcacgaggctggttttctagtaggcccccaactagtgaatccgatctcgagcccgctaccgacggccctgcctccgagaccaccaccctttcacccgaagctaccacgtttaatgatacccgcattcccgacgccgcaggcggtaccgccggagtcctgtacatccggaagaaaaagcggctggagaaattacgacaccagctcatgccgatgtataatttcgaccccactgaggagcaggatgagttagagcaagagttgttggaacacggaagagacgcagcctcagtgcaagccgctacaagcgtacaggctatgcagggaaagactacactcccttctcagggacctctgcaacgtccatcccggctcgtcttcacagatgtcgctaatgctattcacgcgtag

SEQ ID NO: 49253 - DNA, 489 bp, Artificial Sequence
  Description of Artificial Sequence: Synthetic coding sequence
atgaactccagaacagcttccgctcggggatggttttcatcacggccaccgacatcagagtccgatctggagcccgctaccgatggcccagcgtccgagactacaacactgtctcccgaggccaccacattcaatgacacccggattccggatgcggctgggggaactgctggagtcggtactatgctcctttcattcggcataattaccgtaatcggtctcgccgtggcgctggtcctgtacataagaaagaaaaaaagactcgaaaaactgcgccaccaactgatgccaatgtacaatttcgatcctaccgaggaacaggacgagctcgagcaggagctgcttgagcacgggcgtgatgccgcttctgtccaagcagccactagcgtgcaagctatgcagggcaagacaacactacctagccaggggcctctgcagaggccctctaggctggtctttacggatgttgccaacgccatccatgcctag

SEQ ID NO: 49254 - DNA, 2715 bp, Artificial Sequence
  Description of Artificial Sequence: Synthetic coding sequence
atgtcgtacattaaatccaatctagagctctaccaacagtacaccgcaatggcccctaaattattggctcgcatctctaagctgctgatgatctgtcaaaatgccggaattagcgtgccgaagggcatcaggaacatcttcgagtttacttgggaggagctcatcagcgacccttcagtgcctacacctagtgacatcctgggcctagaggtttcttttggagcccctctcgtggtccttatggagcccacgttcgttcaggtacctacccttaagaaaccattaccgcctcccccacccgctcctccacgtccagttctcctggccacgactggtgccgctaagaggtcaaccctgagccctacaatggccagacaggtccggactcatcaggaaaccctgaaccgttttcaacagcagtcaatccacctcctgactgagctactgaggctcaagatgaaggccatggtggaatccatgtctgtgggagccaacccgttagatatcacccggcgtttcgtcgaagcaagtcagctcctccacttgaatgccaaagagatggccttcaattgtctgataagcactgcaggaagaagcggctacagcagcgggcagctgtggaaggaaagtctagccaacatgtccgcaatcggcgtgaatagtccctaccagctgatctatcacagttcgaccgcctgcctttcattctccctgagcgccggaaaggaggctaagaaaaaaattggaaagagtcgtaccaccgaggacgtgtcaatgccacccctgcaccgcggagtaggcacgcctgccaactcccttgagttcagcgatccgtgccccgaggcgagggaaaaacttcaggagctttgcagacacatagaggcagagcgagccacttggaagggcaggaatatcagctaccccatgatcctgcgcaactataaagctaaaatgccttcccacctgatgctggcacggaagggcgatagtcagacccccggattgcactatccaccgaccgcaggtgctcaaaccctttcccctaccagtcatcctagctccgccaaccaccacttcagccaacactgtcaggaggggaaggcaccgaagaaggctttcaaattccattacaccttttacgacgggtcatctttcgtgtactacccaagtgggaatgtggctgtctgtcagatccctacatgctgccgaggacgcacaataacctgcctctttaacgacatccctggattcagcctgctagctctatttaatacagaagggcagggctgcgtgcactataatctcaaaacgtcgtgcccctacgtcttgatccttgatgaagaaggaggaactaccaatgatcagcaaggttatgtggttcataaatggtcttggacatcccgaacagaaaccttgctcagcctggagtacaaagtgaacgaggagatgaagctcaaagtcctcggacaggattctattactgtgacattcacatcccttaatgagaccgttactctgaccgtttcagcgaacaactgcccccatggcatggcatacgacaaacgactgaatcgcaggatcagtaacatggatgacaaagtctacaaaatgtccagagctctcgcggagataaagaagaggttccagaagaccgtcacccagtttatcaatagtattcttctggccgctggattatttacaatcgagtatcccactaaaaaggaggaagaggaattcgtacggttcaaaatgcggtcaagaacgcatcctgagcggttgcccaagctgtcactgtactctggagaaagcctgctgaggagtcaaagtggacatctcgaaagcagcattgctgagacacttaaggacgagccagagtctgctccagtctctcccgtacggaagacaacaaagatccatactaaggccaaagtaacttcccgcggtaaggccagggagggaaggagcccaacccgctgggccgcactcccttctgactgcccactagttctccgtaagctgatgttgaaagaggatactagggccggttgtaagtgtctggtcaaggcccctttggtgtccgacgtggagttagagagatttctgctagcacctagagacccgagtcaagtgcttgtgtttggtataatttcttctcagaattacacatcaaccggacaactgcaatggctgcttaataccttgtataaccaccagcagagagggaggggaagtccttgcatccagtgccgttacgatagctatcggctgctgcagtacgatctggactccccactacaggaggatccgcctctaatggtgaaaaaaaatagcgtggtgcagggaatgatactcatgttcgccggaggcaaactgatattcggaggtcgcgtgctgaacggctatgggctttccaaacagaacctcttaaaacagatcttcagatcccagcaggactataagatgggatatttcctgccagacgattacaaattctctgtccccaactccgtgctttccctggaagactccgagagtgtaaagaaggctgaaagcgaagacatccaggggagctcttcatccctggcccttgaggactacgtggaaaaagagctgtcgttggaagccgagaaaactcgagagcctgaggtggagctgcatcctcttagtagggattcgaaaattacaagttggaaaaagcaggcctcaaagaagtag

SEQ ID NO: 49255 - DNA, 2349 bp, Artificial Sequence
  Description of Artificial Sequence: Synthetic coding sequence
atggctaggcaggtaaggacacaccaggaaactttaaaccggttccagcagcaatcgattcatctgctaactgaactgctgagactgaagatgaaggctatggtggaaagcatgtcagtaggcgctaatccccttgacattactaggcgctttgtggaagccagccagcttttgcacctgaacgccaaggagatggcattcaactgcttaatcagtaccgcaggcaggtcaggatacagcagtggacagctgtggaaggaaagccttgccaatatgtctgccattggcgttaattccccttatcagttgatttaccatagctccacggcttgcctatcattctccttgtcagccggtaaagaggctaagaagaagattggtaaatctcgaacaaccgaggacgtgagtatgccaccactccacaggggtgtggggacccctgcaaacagtctggagtttagcgatccatgtcctgaagcccgagaaaagcttcaggagttgtgtcgacacattgaggccgagagagctacctggaagggtaggaacatttcgtacccaatgatcctgcgaaattacaaagctaaaatgcccagccacctgatgctcgccagaaagggggattcacagacacctggcttgcattaccctcctactgccggtgcacagaccctctcgcctacttcacaccctagtagcgctaaccaccacttctcacagcactgccaggaaggaaaggcacccaaaaaggcctttaagtttcattacaccttctacgatgggtcctcattcgtgtactacccttccggaaacgttgcagtttgccagatccccacatgttgccgcggaagaacaatcacctgtttattcaacgacattccgggattttcactcttggctctgtttaataccgagggacaaggatgcgtccactacaacctgaagacttcctgcccctatgtgctgattttggacgaggaaggcggtacaaccaatgatcagcaaggatatgtggtccacaagtggtcatggacctcccgcaccgagaccctgctgtctctggagtacaaggtgaacgaggaaatgaagctaaaggtgttgggccaggattccataaccgtgacattcacttctctgaatgaaacagttactttgaccgtgtccgctaacaattgcccacacggcatggcatacgacaagcgactcaatagaagaatttccaatatggatgataaggtatacaaaatgtctagagctctggccgagatcaaaaaaagatttcagaaaactgtcacccagtttataaatagcattttgctcgctgcaggactcttcaccattgaatatcccactaaaaaggaggaagaagaattcgtaaggttcaaaatgaggtcccgtacccatcctgagcggctgcccaaactgagcctctactctggagagagcctcctccggtctcaatcgggccaccttgagtctagtattgctgagaccttaaaggacgagccagagagcgctcccgtgtcccctgtcagaaaaaccactaaaattcacactaaggcaaaagttaccagtaggggcaaggcaagggaaggacggagtcccacgagatgggccgcattgccttctgattgtccattagtcttgcgcaaacttatgctcaaagaagatactagagcaggatgcaagtgcctcgtaaaagccccactggtgagtgatgtggaactcgaaagattcttactcgcaccaagagacccctcccaggtattggtgttcgggatcatctcaagccagaactatacttcaacaggccagttacagtggttacttaatacactgtacaatcaccagcagaggggaagggggagcccttgtatccagtgtaggtacgacagctaccgtctgctacaatacgaccttgatagcccactacaggaggaccccccattaatggtgaaaaagaactccgttgttcagggaatgatcttgatgtttgcaggcggtaaactgatctttggtgggagagtgctaaatggctatggcctgtccaagcagaatctgctgaaacagatcttcaggagccagcaggactataaaatgggctactttttgcccgacgattacaagttcagtgttcccaactcagtgctgtctcttgaagattccgagtctgtcaagaaagctgagtccgaagacattcaaggaagtagcagcagcctcgctctcgaagattacgttgaaaaagagctcagtttggaggcagaaaaaacgagagaaccagaggttgagctgcatcccctgagcagagactcgaaaatcacctcctggaaaaaacaggcaagtaagaagtag

SEQ ID NO: 49256 - DNA, 2349 bp, Artificial Sequence
  Description of Artificial Sequence: Synthetic coding sequence
atggcaaggcaggtgcgtacccaccaggagactctcaatagatttcaacagcagtctatacatttgctgaccgagctcttaaggctgaaaatgaaagcgatggtggaatcgatgagtgtgggagctaatcccctcgacatcaccagaagatttgtcgaagcctcgcagctgcttcaccttaacgccaaggaaatggcatttaactgcctgatctccacagcagggagatctggatattcttctggtcagctgtggaaggaaagcctggctaatatgagtgccatcggtgtcaattctccttatcagctgatctatcattcgtctacagcatgtctgtcgttctccctttctgctggaaaagaagccaagaaaaaaattggaaaaagccggaccacagaggatgtctcgatgccaccactgcacaggggagtaggtacgccagccaattctctggaattcagcgacccttgccccgaggctagagagaaactgcaagagctgtgtcggcacattgaggctgagcgcgctacatggaaaggtaggaatatatcttaccctatgatcttacggaattataaggctaaaatgccttcgcacctgatgctcgcccgaaaaggcgattcccaaaccccgggtctgcactatcctccaaccgccggtgcgcaaactctgtcgccgacatctcatcccagctcagccaatcatcatttttcacagcactgtcaggagggaaaggccccaaagaaagcctttaagtttcactataccttctacgatgggtcttctttcgtgtactaccccagcggcaatgtggcagtgtgtcagataccaacatgttgtcggggtaggaccataacctgtctgttcaatgacatacccggatttagtttgctggccttgtttaatacagaggggcagggatgcgtgcactacaacctgaagacctcctgtccttacgtgctgattttggatgaggagggcggaacgacgaacgaccaacaagggtatgtagtgcataagtggtcctggactagtcggaccgagactctgctctcgctcgagtacaaggtcaatgaagagatgaaacttaaggttctaggccaggacagcatcaccgtcacttttacttcactgaacgaaaccgtgacacttacggtgtcagcaaataattgtcctcatggcatggcgtacgataagcgattaaacagaagaatttcgaatatggatgacaaagtctacaaaatgagcagggctctggcagaaataaagaagagattccagaagaccgtcacacagttcatcaactcaatccttctggccgcaggcctgtttacaatcgagtatccaaccaagaaggaggaggaagagtttgttcggttcaagatgcggagtcggactcacccagaacgtctccctaaactgtcactctactccggggaatcgttactgaggtcccagtctgggcatcttgaatcaagtattgccgaaacactgaaagacgagcccgagagcgcgcctgtcagcccagtgcggaaaaccactaagatccacaccaaggccaaggtgacgtcacggggaaaggcaagggagggaagaagtcctactcgatgggctgcccttccatccgactgcccgctggtactccgcaagttgatgctgaaggaggacactagagccggttgcaagtgcttggtgaaggctccactggtctctgacgtggaactcgagcgattcctcctcgctcccagagacccgtcacaggttctggtatttggaatcatatcaagtcaaaactacacctccactggtcagttgcaatggttgctgaacacactgtacaatcatcagcagcggggacgcggatctccttgtatccagtgcagatatgacagctatcggctcctgcagtatgatctggactcccccctgcaagaagaccctcctctgatggtgaagaagaacagcgttgtgcagggaatgatcctcatgttcgcagggggtaaactaatattcggtggcagagtgcttaacggatatggcctgtccaagcaaaacttacttaaacagatcttcaggagccagcaggactacaagatgggctactttctccccgatgattacaaattttctgtgccaaactccgtgctgagcctcgaggatagtgagtcggtaaaaaaagctgagtccgaagacatccagggttcctcaagctcactggctcttgaagattacgtagagaaggagctcagtctcgaggcagagaagacccgcgagccagaggtggagctccaccctttgtcacgcgattcaaaaattacctcatggaaaaagcaggctagtaagaagtag

SEQ ID NO: 49257 - DNA, 1491 bp, Artificial Sequence
  Description of Artificial Sequence: Synthetic coding sequence
atgttctgtcacttacggcctatgcggaggctgtgccttgagaagatcttcccacactggttccctttttctcgcgctttgagtggggcagaagcagtgaatgccctgagacccttctactttgccgtgcaccccgattttttcggccaacacccagtggaacgagaaataaatgaaaacagtctgaaaaggctctctgtctacttggagaatcttcagaaacctggatttaagtcgctgaagcccacacagttgaccttctacgttagagagacagaccagagttcctcagatgggcaggaacccttctccacctcaggctttagagccgtgaagtttaccctgcacactcgagatcttctaagcaccgtgctatacattctgaactcctgctccctctcagtagagcatatccagagcctcaacactaatatgcacacacagcctctgaaagaagcaaagcgcatgcctgatcggcctatcaagtgggataagtcttattactcatttactggattcaaggacccagatgaggacttagagcaagtgagccgtgtggagactacccttaccagttggctggataataatggaaagtctgcggtcaagaagctaaagaacagcctgcccctcagaaaggagctggacaggctcaaagatgagctgagtcatcagctacaacttagtgacattcgatggcagcgttcctggggaatcgcacaccggtgttctcaattacactccctctcccgcctcgcgcaacaaaatttagaaactcttaagaaagccaaagggtgcaccattatttttacagaccgctccggaatgtcagccgttggacacgttatgcttggcacaatggatgtgcatcatcattggactaaactgttcgagagactgccaagctacttcgatctccagcggagactaatgatcttagaggatcagattagttatctgctcggcggtatccaagtggtgtatatcgaagagctccagcccgtcctgacgctggaggagtattatagtctcttggacgttttttacaatcggctcctgaaaagcaggatcttgttccatccgaggtcgctgcggggactccagatgatactgaactccgataggtacgccccatcactgcatgagctgggccacttcaatatccccacgctgtgcgatccagctaacctacagtggttcatcttgaccaaagcccagcaagctcgggagaacatgaagagaaaggaggagctgaaggtcatcgaaaatgagctgattcaggcgagtaccaagaaattctcacttgagaaactgtacaaggaaccttccattagctctatccagatggtggattgctgcaaacgtttgctggagcagtcgctgccctatctgcacggcatgcacctgtgcatcagtcatttttatagtgtgatgcaagacggtgatctgtgtatcccatggaactggaaaaatggagaagccatcaaatag

SEQ ID NO: 49258 - DNA, 213 bp, Artificial Sequence
  Description of Artificial Sequence: Synthetic coding sequence
atgttttgccatctcagaccaatgcgcaggctgtgtctcgagaagatctttcctcactggttccccttttccagagcgttgtcaggtgctgaagctgtgaatgctctgcggcctttttactttgccgtccatcccgatttcttcggccagcaccccgtcgagagagatgacacctggaagtcctttcagtgtccaagcgacttcagcctctag

SEQ ID NO: 49259 - DNA, 213 bp, Artificial Sequence
  Description of Artificial Sequence: Synthetic coding sequence
atgttctgccatctgcgcccaatgagacgcttgtgtcttgaaaagatctttccccattggttcccattttccagggcgttaagcggcgctgaggctgtgaatgcactgcgaccattttactttgctgtgcatcctgatttttttgggcaacaccccgtagaaagagatgatacatggaagtcatttcaatgcccctcagacttcagtttgtag

SEQ ID NO: 49260 - DNA, 1491 bp, Artificial Sequence
  Description of Artificial Sequence: Synthetic coding sequence
atgttttgccatttgagaccgatgcgcaggttgtgcttggagaagatcttccctcactggtttccttttagtcgggcactgtctggagccgaagcggttaatgccctgcgcccattttatttcgcggtacatcccgattttttcggccagcaccccgtggaaagggaaataaacgaaaactcactgaagaggttgagcgtctacctggaaaacctgcaaaaaccaggcttcaagtccctgaagccaacacagctcaccttctacgtgagggaaaccgatcagtctagttccgatggtcaggaacccttctcaacgtccggcttcagggcagtgaagttcaccctccacacccgggatctgctgtctaccgtcctgtacattctgaactcctgcagcctgagtgtggagcatattcaaagtctgaataccaatatgcatacccagccactgaaggaagcaaagcggatgcccgacagacccatcaaatgggacaaaagttactactcattcactggcttcaaagatcctgacgaagacttggaacaagtttctagagtggagactaccctcactagctggctggataataatggaaagagcgccgtgaaaaaactgaagaattctctgccactgaggaaggaactcgataggttaaaggacgagctgtcccatcagctgcagctgagcgacatcaggtggcagcggagctggggcatagcccacaggtgtagccagctccactctctgagccgactggcacagcagaacttggagacactgaaaaaggctaaaggctgcaccatcatcttcactgatcgtagtggcatgtcagcagttggacatgttatgctgggtacaatggatgtgcaccatcactggactaagctgtttgagcggctgccgtcttattttgacctccagcgccgactcatgatcctggaggatcagatctcatacttactgggaggtatacaggtcgtgtacattgaggagctgcagccagtgctcaccttggaggaatactactccctgttagatgttttttataatcgtctgctcaagtcgcgcatcctattccaccctcggagtttgcgcggtttacagatgatcctcaattctgaccggtacgccccaagcttgcacgagctgggtcatttcaacattcccactttgtgtgatccggcaaatcttcaatggtttatcctgaccaaagcccagcaggcgagagagaacatgaaacgcaaggaagagctgaaggtgattgaaaacgagctgatccaagcgagcaccaagaaattctccttggaaaagttgtataaagagccttccatttcctccattcagatggtcgattgttgtaagcgcctcttggaacagagcctcccttacctacacggtatgcacctttgcattagccacttctactcggtcatgcaggatggcgatctgtgcatcccctggaattggaagaacggagaggccataaagtag

SEQ ID NO: 49261 - DNA, 885 bp, Artificial Sequence
  Description of Artificial Sequence: Synthetic coding sequence
atggccggtcagcctgctgctactgggagtccgagcgccgataaggatgggatggaacccaatgtcgtggctaggatttcgcaatgggccgacgaccaccttagattagtgcgtaatatttccactgggatggccatcgccggaataatgcttctcttgcgcagcattaggctcacaagcaagttcacctcttcgagcgacattcccgtcgagttcataaggcggaatgttaagctccgaggtcggctgcgcagaatcacagagaacggacttgaaatcgagcacatacccatcaccctgccaataatcgccagcttgcggaaagagccaaggggagccttattggtgaaactcgcgggagtggaacttgccgaaacgggaaaagcctggctccagaaagagttaaaacctagccaacttctgtggtttcagctgctgggaaaggagaacagtgcgttattctgctatttgctcgtgtcgaagggtggatacttttccgtgaacctgaacgaggagatcctcaggcgcggacttggcaagaccgtcctggtgaagggcctgaagtacgattcaaagatttactggactgtgcacaggaaccttttgaaggccgagctgaccgccctgaaaaagggggagggcatttggaaagaagacagcgaaaaagagtcctatttggaaaaatttaaagactcttggcgtgaaatttggaagaaggactctttcttaaagaccaccggctccgattttagtcttaaaaaggagagttattatgagaaacttaagagaacatacgaaatttggaaggacaatatgaacaactgtagtcttatcctcaaatttagggaactcattagcagaatcaacttcaggagaaaagggtag

SEQ ID NO: 49262 - DNA, 756 bp, Artificial Sequence
  Description of Artificial Sequence: Synthetic coding sequence
atggccatagccggaattatgcttctgctgagatcaattcgactgacctccaaatttacatctagctccgatattccagtagaatttatccgtagaaacgtcaagctgagggggagactacgcagaatcaccgagaacggactggagatcgagcatattcccatcaccttacctatcattgctagcttgagaaaagaacctaggggcgcactactggtgaaattggccggagtggaactcgccgaaacaggaaaggcgtggctccagaaagagctgaaacctagccagctcttatggttccagcttcttggtaaagaaaacagtgctttgttttgctatctgcttgtgtctaaaggcggttacttctctgtcaacctgaatgaggaaatcctacgtcgaggcctgggcaagaccgttctggttaaaggcctcaaatatgactccaaaatttactggacagtccacagaaacttgctgaaagctgaactgacggcactaaaaaagggtgagggaatctggaaggaagattccgaaaaggaatcatacctcgagaagtttaaggacagctggagagagatatggaaaaaagatagttttctgaagactactgggtctgacttttcactgaaaaaagagagctattacgaaaaattgaaacgcacatacgaaatttggaaggacaacatgaacaattgcagtctcattctaaagttcagagaactgatctctagaataaacttcaggagaaaaggttag

SEQ ID NO: 49263 - DNA, 885 bp, Artificial Sequence
  Description of Artificial Sequence: Synthetic coding sequence
atggctggacagcccgcagccacaggctctccatcagctgataaggacggcatggaaccaaatgtcgtggcaaggatcagtcagtgggccgatgatcacctgcgcttagtgcggaacattagtacaggcatggccatagcgggaataatgctacttttgagatcaattcgcctgaccagtaaatttaccagcagctcagatattccggtcgaatttataaggcgaaatgtcaaactgaggggacggctgcggaggattaccgagaacggactggaaattgaacacatccctattacactccccatcatagcctctctcaggaaggagcctcggggtgcccttctggtcaagctggctggcgtggaactggccgagacagggaaagcctggcttcagaaagaactgaagcctagtcaactcttgtggtttcaactgctgggaaaggagaactccgctttgttctgttacctactcgtctctaaaggcggatatttttccgtcaacctgaatgaagaaatactcaggagaggactcggcaagactgtgctcgtgaaaggcctgaagtacgactctaagatttattggactgttcaccggaacctgctgaaggccgagctcactgcccttaagaaaggtgagggtatctggaaagaagattcagagaaagagagctatctcgaaaaatttaaggacagctggagggagatttggaaaaaagattctttcttaaaaacaactggctctgacttctctctcaaaaaggaatcctattacgagaaacttaagaggacatatgagatatggaaagacaatatgaataattgttccttaatactcaagtttagggagctgatatccaggattaattttagaagaaagggatag

SEQ ID NO: 49264 - DNA, 513 bp, Artificial Sequence
  Description of Artificial Sequence: Synthetic coding sequence
atgaagacaatggctacccgcaagagatgcaaactgtccaggaccggcccagagtttgagaatgtgatcaagaggctcctatgcgcgagaaccttccatacgaggatcgggggtgatttgactcatggtattataaaccgcggtcgcagagcaaatgccgagcaaatgggactccagggttcagcgcagcattttaatatatttccgctggacctctggacacaggggaagaaaactgaagttcagaagagggaggggaccgattccattccggctgccggtagatcagggaccgccaatcagccttcaattgctcctcaccgctgtttgttctcgcggggtatcaccgcccttgatggcctgaagcggggacggggttgcaatggtgccgcacacttagtacgaggagacgcctggaagactaaattaggtgaaccatgggtctctattgcacttgcactggccggaccaggcgctattctgatattggagctgagctggtttcttgggtag

SEQ ID NO: 49265 - DNA, 360 bp, Artificial Sequence
  Description of Artificial Sequence: Synthetic coding sequence
atgaagacaatggcaacgaggaagcgatgtaaactcagccgcactggccctgagttcgagaatgtgataaagcggctgttatgtgcccgtacctttcatactagaattggaggggaccttacacatggcatcattaacagaggccgaagggcaaatgcggaacaaatgggcttacagggatctgcccaacattttaatatattccctttggatctttggacacagggggattgtatgctggtgtccctggccaaaaacaaggttaacgtgttcggcgcaattattaacatggccgcatccgtttcaggagtgatcggcggacttaagttcagtcggacctactatgtgaaagggatctag

SEQ ID NO: 49266 - DNA, 360 bp, Artificial Sequence
  Description of Artificial Sequence: Synthetic coding sequence
atgaaaaccatggctactaggaaaaggtgtaagctctcccgcaccggacctgagttcgagaatgtcatcaagaggctactgtgcgccagaacgtttcatactagaattgggggagatcttacccacggcattatcaaccggggtcgaagggccaatgcagagcagatgggacttcagggcagcgcccaacactttaacatattccccttagatctgtggacacaaggtgactgcatgctggtgtccttggcaaagaacaaggtgaatgtcttcggagcaattattaacatggctgctagcgtgagcggcgtcattgggggactgaagttttctaggacctattacgtcaaaggcatttag

SEQ ID NO: 49267 - DNA, 360 bp, Artificial Sequence
  Description of Artificial Sequence: Synthetic coding sequence
atgaagacgatggccacccgaaaacggtgcaaactgagccgaactggcccagaatttgaaaacgtgatcaaaaggctgttgtgtgcgagaacattccatacacgaattggcggtgacctcactcatgggattatcaatcgaggcagaagagcaaacgcggaacagatgggcttacaggggagcgcacagcactttaatatcttccctctggatctgtggacacagggagattgcatgctagtcagcctcgccaaaaataaagtcaacgtctttggtgcaatcataaatatggccgctagtgttagtggagttattgggggactcaaattcagtcgaacatactacgttaaaggaatatag

SEQ ID NO: 49268 - DNA, 237 bp, Artificial Sequence
  Description of Artificial Sequence: Synthetic coding sequence
atgaaaactatggctaccagaaaacggtgcaagctgtctcgcacggggcctgagttcgaaaacgtgattaagcggctcctctgtgcaaggacctttcatacacggatagggggtgacctgacccatggaatcatcaataggggcaggagggctaacgctgagcagatgggactgcagggatctgcccaacatttcaacatttttccattagatctatggacccaggggaagaagtag

SEQ ID NO: 49269 - DNA, 645 bp, Artificial Sequence
  Description of Artificial Sequence: Synthetic coding sequence
atgaacaacgagacaaccacgctgatttccttaaaggaagccatgaaacgggtcgaccacaaattgcaggctctcgaaacgcagttcaaggaactggatttcactaaagacaatctgatgcaaaaattcgaacatcattctaaggctttagcaagccaggctgctcaggatgagatgtggacagccgtgagggccctccaactcacaagcatggagctcaatatcctatatagctacgtgatcgaggtgcttatctgcctgcacacacgcgtccttgagaaactcccagacctggtgagaggccttccaacacttgccagcgtcttgcggagaaaggttaaaaataaacgcgtgcgcgtggtttgggaatccatactggaagaatgtggcttgcaagaaggagatataaccgccctttgcaccttctttatagcacggggaaacaaggccgagcactatacagctaaggtgaggcaaatgtacatacgcgatgtcacctttctgattaccaatatggtgaaaaaccaagctctgcaggatagtttgctgcgagctgtacaagtgattgagaagggtaaggctgtccgcactcccgaaaagcagaaatctagtttggaggaactcatcccgagcgtcaaaaactag

SEQ ID NO: 49270 - DNA, 495 bp, Artificial Sequence
  Description of Artificial Sequence: Synthetic coding sequence
atgcctagccttgccccagactgtcctttgctcgctatgcctgaggagacacaagaagatagtgtggctcccatgatgccctcacagcgttccaggggcccacttgcacctaatcacgtgcacgaggtgtgcctccatcaggtggagagtattagtgatcttcactctggagccggtaccctgagaccctatctgacggaggaggcccgaccttgggacgagctgctgggggtgctgccgccaagtctgtgcgcacaagccggatgtagtccagtttatcgaagaggcggattcctgctgcttctagcactgcttgtcctgacctgtctggtgctagccctgttggctgtctacttgtccgttctccaatctgaaagcctgcgcatcctcgcccacacactgaggacacaggaagagaccctgctgaagctgcggctggctagcttgtctcagttacggcgtctgaatagctcagaggctcaagccccttcctag

SEQ ID NO: 49271 - DNA, 219 bp, Artificial Sequence
  Description of Artificial Sequence: Synthetic coding sequence
atgaaggtcgtgggcaattaccgggtgaacacagccaattcctcaactgatacatctggagaacatctgacctgtttgaggagtcagctgttcgtcgcctacaggaacggcagagtggatgaagccgtctccctgggcttcctggactgttggatcggaggtgatctgaccaacttcaaggggtgctacttaacaaaccagctgccaatccagttctag

SEQ ID NO: 49272 - DNA, 873 bp, Artificial Sequence
  Description of Artificial Sequence: Synthetic coding sequence
atgttgggtcagcgcgctggagacggggagaggcccggtcttccgggagacggcgaaggtggtgtgcctgcacggcctggtcggcgagccgagagacctccacagagaccagctaaggttaataaggcagtgacatgtgctgctcatctccccggagccgctgcctcccgacccctttcccccaacaaacccgatagagttcggcctggacagcgagaccgcatcggagccaaacgccagaggcggaggcgcgctgacgctgggcaagcacgggctgcaagtagcaggcgggtcgttccaacagctccagaggtgctgggcgcagtggccagcctccctgatcggggacggccaaccgtcgcgcgtgtggctactggctctagactcgagggattgtttagtgccgcaagcctgaagttgagcgccctcacccaatctctcactagggtcaggcaagccccaactgcttcaggtgcgaccatacgactgcctgcgagccctgtggaaatgtttctgaccagcgcgttcctgacaggattctccttccactgcctgtattctggtattgggcatggcgaggacatactcgcatctgtggaacagatcactatcgtatccagacccctatcaggccagcggggagccggacccggaaatagcgcatatactcccagacgttctcaggggggacctcgggcagccaccactccaggctttcgcttcccttgtagaggtctggtgagacgtgctgtcctccggctaactgtgacggtgcaggactgcattctgaccgccctactggccgtgtcctttcattcgattggggtggtcatcatgacgagctcatacctgctgggaccggtagttaaatag

SEQ ID NO: 49273 - DNA, 213 bp, Artificial Sequence
  Description of Artificial Sequence: Synthetic coding sequence
atgttcacaagagctcaagtacggagaatcttgcaacgagtacctggtaaacaacggttcggcatttaccgatttctcccttttttcttcgtcctcgggggtactatggaatggatcatgatcaaagtgcgagttggacaagagactttttatgatgtgtatcggagaaaagcctccgagagacagtaccagcgccgactagaggacgagtag

SEQ ID NO: 49274 - DNA, 3189 bp, Artificial Sequence
  Description of Artificial Sequence: Synthetic coding sequence
atggagtcacaggagttcatcgtgctgtacactcatcaaaaaatgaagaaaagcaaagtatggcaggatgggattctgaaaatcacccatcttggcaataaggcaatattgtacgacgataagggagcgtgtctcgagagccttttcttgaaatgtctcgaggtgaaacccggagacgacttggagagcgatcgatatttaatcactgtggaggaagtcaaagtggctggcgcaattggcatcgtgaagcagaatgtaaacaaggaggctccagagctgaattcacgaacgttcatctctagtggacggtccctgggctgtcagcccagtgggttgaagcgcaagtttactggatttcaaggtcccaggcaggttccaaagaaaatggtgattatggaatctggcgaatcggccgcaagtcacgaagcaaagaaaacaggacctaccatcttcagtcccttctgctccatgccccctttgttccccaccgtcggaaagaaggacgtcaataacatcctggctgatcccgaaaatatcgttacctacaagaaccgggaaaggaacgcaatggactttagctcagtctttagcccttccttccagataaaccctgaggtgctgtgtgaagagaactatttttgctcaccggtgaactctgggaataagctatccgattcactcttgacaaacgaacccgtgaagagagacagcctcgcatcccactactctggggtctcgcaaaacatcagatctaaagctcagattcttgccctgctaaaatccgagtcttcctcttcatgtgaagaactgaattccgagatgactgagcactttccccaaaagcagcctcagggttcactgaaaatcgcaaccaaacccaaatacctgatccagcaagaggaatgtgccgaaatgaagtctacagagaacctctactaccaacaccagagcgaaaatactatgaggaacaaaagcaggtgggctatgtatctgtctagccagtcctcccctatccactcttcaactgtggatggcaatgacactgaacggaaaccgaaagcgcaggaagacgacgtgaattccaacttgaaagacctttctctccagaaaattatccagtttgtcgaaacatatgccgaggaaaggaagaaatataacgtggaccaaagtgtggggaataacgatccgtcgtggaaccaggaagtgaaattggagatcccaagctttaatgagtcatcttcattacaggtgacttgctccagcgctgagaatgacggcattctgtccgaatcagacatccaggaagataataagattccatttaaccaaaatgataaggggtgtatcaaaggctcagttttaattaaggaaaacgcacaagaagtgaacacgtgcggaacattagagaaagagtacgagcagtcagaaagtagtctccccgagctgaagcatctccagatagaatcctccaacaactctagaatctcagacgatatcacagacatgatctctgaaagtaagatggataatgaatcccttaactctattcacgagtcactcagtaacgtcactcagccattcctggaggttacatttaacctgaataatttcgaaactagtgatactgaggaagaatcccaggagagtaataaaatctcgcaggactctgaatcatgggtgaaagacatcctggtcaatgacggcaattcctgttttcagaaaagatcggagaacaccaactgtgaggaaatagagggcgagcatctgcctttcctgacttccgtgtcggataagcctacggtaacattcccggtgaaggaaactttgccaagtcagttttgtgataagacttacgtgggattcgatatgggcatatgcaagaccgagaataccggtaaagagatcgaagagtattcggacactctaagcaacttcgagtccttcaagtggactgatgccgtctatggcgataacaaagaagatgccaataagcctattcaagaagtcaggatcaactacgattttgccctacccccaaacaagagcaaagggattaacatgaacttgcacatcccccacatccaaaaccagatcgccgaaaactcaaacctgttcagtgaggatgcccagccacagcccttcattctgggctctgacctagacaaaaatgatgagcatgtcctcccttccaccagctcaagtgataatagtgttcaactcctgaataccaaccagaatcactatgagtgcatagcactggacaagagtaatacccacataagcaattccctcttttacccactcggaaagaagcacctcatatccaaagacactgaagcccatataagtgaaccagaggacctgggcaagatacgctcaccacctccagatcatgtggaagtggagacagcccgagagggaaagcagtactggaaccctcgcaacagctcagagttaagcgggctggttaataccatatctatcttgaagtccctttgcgaacactccacagcgctggattctttggaaatactgaagaaaaaaaacacggtgttccagcaggggacacaacaaacatacgagccagactctccccctgaagttaggaagccgttcatcacggtggtgtccccaaagtcgcctcatctgcataaagattctcagcaaatcctgaaggaagacgaggttgaactgtctgagcccctgcagagtgtccagtttagctcatccggatccaaggaagagacagcctttcaggccgtgatccctaaacaaatagagagaaaaacatgtgatcccaagcccgtggagtttcagggtcaccaggttaaaggctcagctacttctggcgtcatggtgcgtggacatagttctcaactaggctgcagccagtttcccgactcaaccgaatacgagaacttcatgactgaaacacctgaactgcctagcacctgtatgcaaattgattttctccaagttacttcccccgaggaaaacattagtaccctctccccagtctccaccttctccctgaactcacgagacgaggattttatggtggagttttccgagacgtcactgaaggctcggaccttgcccgatgatctccacttcttgaacctagaggggagtagatatcacattgcccttatctctgtttatagtttcaaaatgaaattctttatttag

SEQ ID NO: 49275 - DNA, 2748 bp, Artificial Sequence
  Description of Artificial Sequence: Synthetic coding sequence
atgttccaggctatcttgtatgacgacaagggggcatgcttggagagcctgttcttgaagtgcctagaagtgaaacccggagacgatctggagtcagataggtaccttattacagtcgaagaggttaaggttgcaggtgccatcggcattgtgaaacaaaatgtgaacaaggaagccccagagctgaatagtagaactttcatttcaagtgggagaagcctgggatgccaaccttcgggactcaagcggaaattcaccgggttccagggccctcgccaagtccctaaaaagatggtcattatggaaagcggcgaatcagctgcgagtcatgaggctaaaaaaaccggccctacgatattctcacccttctgttctatgccaccgctgtttcccactgtgggcaagaaagacgtgaataacatactggccgatcctgaaaacatcgtcacgtacaagaatcgagagagaaacgccatggatttctccagtgtcttctccccctcattccagatcaatccagaggtcttgtgtgaagaaaattatttttgtagccccgtgaacagcggcaataaactctccgactctcttctcaccaatgaacccgttaagcgggacagcctcgcatcccattactccggggtgagtcagaacatcaggagtaaggcccaaatccttgcactgttaaagagtgagagctcaagctcctgcgaggagttaaactcagaaatgaccgagcacttcccacagaagcagccacagggctctctgaaaattgcgactaagccaaaatacctgatacagcaagaggagtgcgctgaaatgaagtccacagagaacctctactatcaacaccagtcggagaacaccatgagaaacaaatcccgatgggcaatgtacctgtctagccagagctctccgatacacagtagtacagttgacggtaatgatacagaaaggaagcccaaggctcaggaggacgacgtcaactccaacctgaaggatctgagtcttcagaagattattcagtttgttgagacatatgctgaggagaggaagaagtacaacgttgatcagagcgttggaaataatgatccatcctggaatcaggaagtgaagctagaaattcctagcttcaacgagtcctctagcctccaggtcacctgcagctccgccgagaacgatggtattctctctgagtcagacattcaagaagacaataagataccctttaatcagaatgataaagggtgtatcaagggctctgtgctcattaaggagaatgcccaggaagtgaatacctgtgggaccctggaaaaagaatacgaacaaagtgaatcttcactgcccgaactcaagcacctgcagatcgaaagctccaacaacagtaggatcagcgacgatattacagatatgatttcagagagtaagatggacaatgaatctttaaactctatacacgagtcactgagcaacgtgactcagcccttcctagaggttacgtttaatctcaacaattttgagactagtgacaccgaggaagaatctcaagagtccaataaaatctctcaggactcagagtcctgggtaaaggatattctggtgaacgacggaaattcatgctttcaaaagagatcagaaaatactaactgcgaagaaatagagggcgaacatctaccgtttctcacttcggttagcgacaagccaactgtcaccttccctgtcaaggagacattgcctagccaattctgtgacaaaacatatgtgggattcgacatgggtatttgtaagacggagaataccggaaaagagatagaggagtacagcgacaccctgagcaactttgagagttttaaatggacagacgcggtgtacggcgacaataaggaagatgccaataaacctatccaggaagttcgaataaactacgatttcgcactccctccaaataagtccaaaggcatcaatatgaatctgcatatccctcatatccagaaccagattgctgagaattcaaaccttttcagtgaagacgcccagcctcagccattcatattggggtccgacctggacaagaatgatgagcacgtgctaccatcaacgtcttcaagcgataatagtgtgcagctgctgaatacaaaccagaatcattatgaatgtattgcgttggataaatctaatacacatatcagcaactcattattttaccccctcgggaaaaaacacctgatctcaaaggacactgaggcacacattagtgagccagaagatctgggaaaaattaggtcacctcccccagaccatgtcgaagtggaaacggctagagaaggcaaacagtattggaaccctagaaattcttctgaactgtccgggcttgttaacacaatatccatcctcaagagcttatgtgagcactctacagccctggactccctcgagattttgaagaaaaagaatacagtgttccagcaaggaacccagcagacttatgagcccgactctcccccagaagttcgcaagccctttatcacagtggttagcccaaagtcaccccatttacataaggactcacagcagaaaactgtgaaaaaaaaaatcaaacccactttgcctctgagaatcttcatcaatgtttcgcggttcttctgtgtacagctgaaaaaaatggtccggctcatgtacatcaactctttcatcagcttcccactgaatatcgtggtgctgagctatattattaataactccagctag

SEQ ID NO: 49276 - DNA, 525 bp, Artificial Sequence
  Description of Artificial Sequence: Synthetic coding sequence
atggaaagtcaagagtttattgtactctacacacaccaaaagatgaagaaatctaaggtttggcaggatggaattcttaagattactcatttggggaacaaggccattctgtatgacgataagggagcttgcttggagtctctgtttctgaaatgcctggaggttaagccgggtgatgaccttgaatccgaccggtacctaattactgtcgaggaggtgaaagttgctggtgccataggaatagtgaaacagaacgtcaataaggaggctcctgaactgaactctcggacctttatctcaagcggcagatcactcgggtgccagcccagcggcttgaagaggaaatttacgggtttccagggacctcgccaagtgcctaaaaagatggttatcatggagagtggcgagtcagccgcttctcacgaagcaaagaagactggcccaaccatctttagcccattctgttccatgccccctttgttccccaccgtggggaaaaaggatgtgaacaacattctggcctag

SEQ ID NO: 49277 - DNA, 600 bp, Artificial Sequence
  Description of Artificial Sequence: Synthetic coding sequence
atgactagcctgatcaactcccccatcaaccggcgaccactgcagaacgttgaagggaacaacagatgtcaaagaaaggccaagaattatggaaataaatactttattcactgcctggatttggaaaaaatcacactgagcccacggaggaagcacgatatcgagggaggggataagctcaatgtgaagttttcacagctcaggtccagacggcaacgcaaggccgagcccggtgcatgcgcgttgggtcgggttgggtccgagtgtatacctgagcctggggcaaggaggactgcccaggccgcaggcctgcgctcggtgtccggagcagcaaacaccaaagtgagagagctcaaacactttaggttcctcggcttattgagatcttgcaggtccgaaatggaggtagatgctccaggagtggacggaagggatggactgcgcgaaagaaggggattcagtgagggaggtaggcagaatttcgacgttcgcccacagtctggggcaaatggcctgccaaaacatagttattggcttgatctctggctattcatactgtttgacgttgtggtttttctgttcgtctacttcctcccatag

SEQ ID NO: 49278 - DNA, 201 bp, Artificial Sequence
  Description of Artificial Sequence: Synthetic coding sequence
atggaggtggacgcccctggggtggacggccgtgatggcctgagagagcgcaggggatttagcgagggagggaggcagaatttcgacgtgcggccacagagtggcgcaaacggcctgccaaagcacagctactggctggatctctggctcttcatcttgttcgacgtggtcgttttcctctttgtgtactttctcccctag

SEQ ID NO: 49279 - DNA, 399 bp, Artificial Sequence
  Description of Artificial Sequence: Synthetic coding sequence
atgtgcagtgccggagagctgctccgcggtggagatgggggtgagcgcgacgaggatggggatgctctggctgaaagggaagccgctggcacgggatgggaccctggagccagcccacgtcggcgagggcagcggccaaaagaatcagagcaagacgtggaggacagtcagaaccacactggcgagcccgttggcgacgattacaagaaaatgggaacccttttcggagagctaaataaaaatctcattaatatgggctttaccaggatgtactttggagaacggattgtagagccagtcattgtgatttttttctgggtgatgctctggttcctggggttgcaggccttgggactggtggcagtcctgtgcctcgttattatttacgtccagcagtag

SEQ ID NO: 49280 - DNA, 300 bp, Artificial Sequence
  Description of Artificial Sequence: Synthetic coding sequence
atggccgaaggcggatttgatccttgcgaatgtgtgtgcagccatgagcatgcaatgcgtagactgatcaatctgctgagacagtcccaaagctactgcactgacaccgagtgcttgcaggagctgccaggaccttcaggagataatggcattagcgttacaatgatacttgtggcttggatggtgattgctctgattttattcctcctcaggccacccaacttgagaggaagcagccttccgggaaagccaacctcacctcataatgggcaggacccccctgcgccacccgtagactag

SEQ ID NO: 49281 - DNA, 270 bp, Artificial Sequence
  Description of Artificial Sequence: Synthetic coding sequence
atggcagaaggcggatttgatccgtgcgagtgcgtctgttcgcatgaacacgcaatgcgcagactcataaacctgctaagacagagtcagagttattgcaccgataccgagtgcctccaggagctgcccggaccatctggagacaacggcatcagcgtgacgatgatcctggtggcgtggatggtcatcgcactcattctgttcttattgcgacccccaaacctgcgagggtcgtccctcccaggaaagcccactagtccacacaattag

SEQ ID NO: 49282 - DNA, 723 bp, Artificial Sequence
  Description of Artificial Sequence: Synthetic coding sequence
atgtacttacgcagggccgtgtcaaaaacactggctctgccattgagagctccacccaacccagccccacttggaaaggatgcctctctgcgacggatgtcttcaaacaggtttcccggttcctcgggctccaatatgatttattatctggtcgtgggcgtcacggtttccgccggaggatattatgcttacaagacagttacttctgatcaggcaaagcacaccgagcacaaaacaaatcttaaagagaaaacaaaagccgagatccacccttttcagggagagaaagaaaacgtggcagagaccgagaaggccagctcggaagccccagaggagcttatcgtggaagcagaggtggtggacgctgaggaatcccccagcgcaaccgttgtcgtcatcaaggaagcatcagcgtgccctggccacgtcgaagccgcaccggagaccactgccgtgtccgcggagactggcccagaggtgacagacgcagcagcacgcgagaccacagaggttaatcctgaaacaacccccgaagtgaccaacgccgctctggacgaggctgtgaccattgataacgataaagataccactaaaaatgaaacctccgatgagtatgcggagctggaagaggaaaattcacccgcagaaagcgaatccagtgccggagatgatctgcaggaggaagcctccgtaggctccgaggccgctagtgcgcaggggtag

SEQ ID NO: 49283 - DNA, 2337 bp, Artificial Sequence
  Description of Artificial Sequence: Synthetic coding sequence
atggactcaaaggagagcttaacacctggtagggaggaaaatccgagcagtgttttagctcaagagcgtggcgatgtgatggatttttacaagactctgaggggcggtgctacagtgaaggtgagtgctagttctccctcattggcggtcgctagccagtcagactcaaagcagcggaggctgctggttgattttcccaaagggagcgtgtctaacgctcagcagcccgacctgtccaaagcagtttccctttccatgggcctgtacatgggcgagacagaaacaaaagtgatgggaaatgacttggggttcccccagcagggacagatctctctctcatcgggggaaacagatctgaagctgctcgaagaatccatagccaatttaaaccgttccaccagcgtacccgagaatcccaagagcagtgcctcaaccgcagtctccgccgctccaaccgagaaggagtttcctaagacccactccgatgtctccagtgaacagcaacacctgaaaggtcaaaccggcacaaacgggggtaatgtgaaattgtacacaaccgatcagtctacgttcgacatcctgcaagatcttgaattctccagcggatcccccggaaaggaaacaaatgaatccccttggcgcagtgacttgctaatcgatgaaaactgtctgctgtcacctttggccggtgaagacgacagctttcttctggaaggcaatagcaatgaagactgcaaaccactcattctgcctgacacaaagcctaagattaaggataacggcgacctggtcctgagctcccctagtaacgtcaccctcccccaggttaagacagagaaggaggattttatcgaactgtgtactcctggagtaataaagcaagaaaaactgggcacagtctactgtcaggcctccttccccggagcaaacatcatcggaaataagatgtcagctattagcgtgcacggtgtttcgacatccgggggacagatgtaccattatgatatgaataccgcatccctgtcccagcagcaagaccagaaacccatttttaatgtaattccaccaattcccgtgggatcagagaactggaaccgttgtcaggggtccggcgatgacaacttgacaagcctcggaacactcaacttccccggtcggacagtattttccaacggatactcctcgccatcaatgagaccagacgtgagcagtccaccttcttccagcagcacagccactactggcccaccacctaagctgtgcttagtttgctcagacgaagctagcggttgtcactatggcgtcctaacatgcggttcctgtaaagttttcttcaaacgagcggtagaagggaggcagcataattatctgtgtgcaggcaggaacgactgtataatagataagattaggcggaagaattgcccagcatgtaggtacaggaaatgtcttcaagctggcatgaatctagaggccaggaaaaccaagaagaagattaagggaatccagcaagccaccaccggcgtatcccaggaaacctccgagaatccgggaaacaaaaccattgtgcccgcaacactgccccagcttactcccacgttagtatcacttctggaggtgatcgaacctgaagttttgtacgccggatatgactcctcagttcctgattccacatggcgcataatgacgacccttaatatgctgggcggtcgccaggtgattgctgccgtcaaatgggccaaagcgattccaggtttccggaacctgcacctggacgaccaaatgaccctcctgcagtattcatggatgtttctgatggcctttgccctgggctggagatcgtatcgccagtcatcagcaaacctgctttgcttcgcgccagatctgataatcaacgagcaacgaatgacccttccctgcatgtatgatcagtgcaaacacatgctgtacgtgtcatccgagctgcaccgcctccaggttagttatgaggagtatctgtgcatgaagactctgttactgctctctagtgtcccgaaagacggattgaagtcgcaggagctgttcgatgagatccgtatgacctatataaaggagctgggtaaagcaatcgtgaaacgtgaaggcaactcctctcaaaactggcaacgtttctaccaactgacgaagttattggacagcatgcacgaggtcgttgagaacctgctgaactattgctttcaaactttcctcgataagacaatgtctattgagttcccggaaatgttggccgagattataacaaatcagattcctaagtatagcaacgggaatataaaaaaactattatttcatcaaaaatag

SEQ ID NO: 49284 - DNA, 498 bp, Artificial Sequence
  Description of Artificial Sequence: Synthetic coding sequence
atgaagactaagcctaacttactgttccccaaatctgctccgccatccctgccccgacgcgtgcccaggaaggtcgaggaggacctgttgatgcttaacagctctccaagcaccgctaaggacacattggacaacggagactatggtgaaccggactatgattggacgaccgggccacgggatgatgacgaaagtgatgataccttagaagagaacagggggtacatggaaatcgaacagagtgtgaaatcattcaaaatgccctccagcaacattgaggaggaagatagtcacttctttttccatctgatcatcttcgccttttgtattgcagtagtgtacatcacctatcataataagcggaaaatatttctgctggtccaaagtcggaagtggcgggacggcctgtgctcgaagactgtggaataccaccgactggaccagaatgtgaacgaggccatgccttccttgaaaattaccaacgactatattttttag

SEQ ID NO: 49285 - DNA, 648 bp, Artificial Sequence
  Description of Artificial Sequence: Synthetic coding sequence
atggcatcagagacggagaagacccacgctctgttgcagacttgtagcacagaaagcctcatcagctctctggggctcggcgctttttgccttgtggccgaccgccttctccagttctctaccatacaacagaacgattggctgcgggcactgtctgacaatgccgttcactgtgtcatcggaatgtggagctgggcggtggtaacaggcatcaaaaaaaagaccgatttcggagagatcatcctcgccggatttctggcttcagtcatcgacgtcgaccacttctttctcgctgggtctatgtccctgaaggcggctcttactctgccccgacgcccatttcttcactgctcaaccgtgattccagttgtcgtactaactctgaagttcactatgcatcttttcaagttaaaggactcctggtgctttttgccttggatgttgtttatttcttggacttcacaccacattcgcgacggaatacgccatgggctctggatctgcccattcgggaaaacttcacccctccccttttggctgtacgtgatcataacatcaagtttgccccacatttgtagctttgtgatgtacctcaccgggacaagacagatgatgtcctcaaaacacggagtccgaatcgacgtatag

SEQ ID NO: 49286 - DNA, 648 bp, Artificial Sequence
  Description of Artificial Sequence: Synthetic coding sequence
atggcgagcgagacagaaaaaacccacgctttgcttcaaacttgctccactgagtcattgatatcatcattggggctgggagctttctgcttggttgcagacaggcttctacagttctccactattcagcagaatgattggctacgggcactgagtgacaatgctgtgcactgtgtcattgggatgtggagctgggcagtggtcaccgggataaaaaaaaaaaccgacttcggggaaatcattctcgctggatttctggcctctgtaattgacgtggatcatttcttcttggccggaagtatgtcactaaaagcagctctgaccctcccccgtaggcctttcctgcattgtagcacagtgatcccggtagttgttctgactttaaagttcactatgcacctcttcaaattgaaagattcctggtgctttcttccttggatgttgttcatatcatggacttcccaccatatccgcgatgggattcggcacggcttgtggatttgcccgttcggaaaaaccagccctttgccattttggctatatgtaatcatcacatcttcattgccccacatttgtagctttgtaatgtacctgaccgggacccggcagatgatgtcgtccaaacatggcgtgagaatcgatgtctag

SEQ ID NO: 49287 - DNA, 531 bp, Artificial Sequence
  Description of Artificial Sequence: Synthetic coding sequence
atggcaagcgagacagagaaaacccacgcactcctacagacttgcagcacggaatccctcatctcctcacttggtttaggtgccttttgtctggtcgccgaccgactcctgcagttctcaactatccaacagaatgactggttaagagccctttccgacaatgccgtgcactgcgtaattggcatgtggtcgtgggccgtagtgaccggcatcaagaaaaagacggattttggcgagataattctcgcaggtttcctggcgtctgtgattgatgtggatcacttctttctggccggatctatgtccctcaaggccgctcttacattgcctaggcggccattcctgcattgcagcaccgttatccctgtggtggtgctgactttaaagttcacaatgcacctcttcaaactgaaggatagctggtgcttcctgccatggatgttatttatcagctggacttctcatcacatccgggatggaattaggcacggcctgtggatttgtccattcgggaagacgagcccactttag

SEQ ID NO: 49288 - DNA, 648 bp, Artificial Sequence
  Description of Artificial Sequence: Synthetic coding sequence
atggcatctgagaccgagaagacccatgctctcctgcagacctgttcaaccgaatcattaatctcaagtctagggctgggagccttctgcctggtggctgacagactgctccagttttctactatccagcagaatgattggttaagggccctttccgacaacgctgtgcactgtgtgatcggcatgtggtcctgggctgtagtgacaggaataaaaaagaaaaccgactttggcgagatcatcctggccggtttcctcgcaagcgtgatcgacgtagaccatttttttctcgccggatcgatgagtctgaaagccgcattgactttgccccgtcgtccatttctgcattgctcgacggtgattcccgtagtggtgcttaccctcaagttcaccatgcatctgtttaagttgaaggatagttggtgctttctcccttggatgttgttcatttcatggacttcccatcacatccgagatggcatccgacatggcctgtggatttgccccttcggcaaaaccagcccattgcctttctggttgtatgtgatcattacatcatcattgccacacatttgttcctttgtcatgtacctcacaggtactaggcaaatgatgagcagcaaacacggagttcgtatcgacgtatag

SEQ ID NO: 49289 - DNA, 255 bp, Artificial Sequence
  Description of Artificial Sequence: Synthetic coding sequence
atgcacctgttcaaactcaaggactcctggtgttttctgccttggatgctcttcatttcctggaccagtcaccatattagggatggcatccgccacgggctgtggatttgcccatttggtaaaacatcccccctgccattttggctttacgtaatcatcacctccagtctgccccacatctgttctttcgtgatgtatttgaccggcactaggcagatgatgagtagtaaacacggtgtacggattgacgtatag

SEQ ID NO: 49290 - DNA, 1002 bp, Artificial Sequence
  Description of Artificial Sequence: Synthetic coding sequence
atgaagggtgaagcgggtcacatgttgcacaatgaaaaatccaaacaggaggggcatatctggggcagcatgagacggactgcctttatcctgggcagtggactgctgagcttcgttgcattctggaacagtgtgacctggcacctgcagagattttggggtgctagtggttacttttggcaggcacagtgggagcgcttattgactaccttcgagggcaaagaatggattctgtttttcatcggcgctattcaggttccatgcttatttttttggtccttcaacggccttctcttggtagtcgacactacaggcaaacctaatttcatctccagatatcgaatccaggtagggaagaatgagccagtggatcctgtgaaactcaggcagtccattaggactgtgctgtttaaccagtgcatgattagttttcccatggtggtttttttgtatccatttttaaaatggtggcgagatccatgccggagggagctgccaacctttcattggttcctcttggagcttgccatatttactctgatagaggaagtcctcttctactactcacaccggctgttgcatcatccgaccttttacaaaaaaattcataagaaacaccacgagtggactgcaccaatcggagtgatttctctgtacgcccaccccatagaacacgcagtgtccaatatgcttcctgtcattgtcggacccctcgtaatgggttcgcacctgtcttctattacaatgtggttcagcctggcccttattatcacaactatttcacattgtggctatcacttaccatttctacctagtcctgagtttcatgactaccaccacctgaaattcaaccaatgttacggcgtgctgggggttttggatcatctgcatgggacagatactatgttcaaacagacaaaagcgtacgaacgacatgtgttactcctcggctttactcccctctccgagagtatccccgactcacctaagaggatggagtag

SEQ ID NO: 49291 - DNA, 933 bp, Artificial Sequence
  Description of Artificial Sequence: Synthetic coding sequence
atgcggaggaccgcctttatcctggggagtggcctgttgtctttcgtcgcattttggaatagcgttacatggcatctccagcgcttttggggtgctagcggctacttctggcaggcacagtgggagcggctgctgacgacgtttgaaggaaaggagtggatcctcttcttcatcggcgctattcaagttccttgtttgttcttttggtctttcaatggtctgctgttagtggttgacacaacaggaaagccgaacttcatttctagatatcgcatccaggttggcaagaacgaaccagtggatcccgtcaaactgaggcagtctattcgtacagtgctgtttaaccagtgtatgatcagctttccaatggtcgtgttcttgtaccctttcttaaagtggtggagagacccctgtcgccgagagctgccaacctttcattggtttctcctggaactggcaattttcacactgattgaggaggtcctcttctactattcccaccgcctgctccaccatcctaccttctataagaagatccataaaaagcatcacgaatggaccgctcctataggcgtcataagcttgtatgcccatcccattgagcacgcggtgagcaacatgttgcccgttattgtgggtcccctggtgatgggatcgcacttgtccagtattactatgtggttcagtcttgccttgatcatcaccaccataagccattgcggataccatttacctttcctgccgagccctgagttccatgactaccatcacttgaagtttaaccaatgctatggagtgttgggggtgctagatcacctccacggaaccgatactatgtttaaacagaccaaagcgtatgaacgccatgtgcttttgttaggatttactccactgtcagagtccattcctgattcccctaagcgaatggaatag

SEQ ID NO: 49292 - DNA, 441 bp, Artificial Sequence
  Description of Artificial Sequence: Synthetic coding sequence
atgagacggaccgcatttatcttgggtagtggcctcctgtcctttgtggccttttggaatagcgtcacctggcacctgcagagattttggggcgcaagcgggtacttttggcaagcccagtgggaaagactcctaactaccttcgagggaaaggaatggattctgttctttatcggagccatccaggtaccctgcctttttttctggtcttttaacggcttactgttagtcgtcgacaccacaggcaaacctaatttcatcagccggtacagaattcaagtgggcaaaaacgagcccgtagaccctgtgaaactccggcagtctatacgtacagtgctcttcaaccaatgcatgattagcttcccaatggtcgttttcttatacccattcttgaagtggtggagggatccatgccggcgagagctcccaacattccactag

SEQ ID NO: 49293 - DNA, 99 bp, Artificial Sequence
  Description of Artificial Sequence: Synthetic coding sequence
atgaagggcgaagccggacacatgcttcataatgagaaaagtaagcaggagggtcatatctggggaagcatgaggcgcacggcattcattctagggtag

SEQ ID NO: 49294 - DNA, 225 bp, Artificial Sequence
  Description of Artificial Sequence: Synthetic coding sequence
atgtttgatattaaggcatgggcggagtatgtggtagagtgggctgccaaggatccctacggcttcctgaccaccgtgatattggctcttacaccccttttcctggcctccgccgtgcttagctggaaactagctaagatgattgaggcccgagaaaaggaacagaaaaagaaacagaaacggcaggagaatatcgcaaaagccaaaaggcttaaaaaagactag

SEQ ID NO: 49295 - DNA, 225 bp, Artificial Sequence
  Description of Artificial Sequence: Synthetic coding sequence
atgttcgatatcaaggcctgggctgaatatgtggtggaatgggctgcaaaggatccctacggttttcttacaaccgttatcttggctctgactcccctgtttctggcgtcggcagtcctgagctggaaactcgcaaagatgattgaggcaagagaaaaggagcagaagaagaagcagaagagacaggagaacattgctaaggcaaaacggttgaaaaaagattag

SEQ ID NO: 49296 - DNA, 183 bp, Artificial Sequence
  Description of Artificial Sequence: Synthetic coding sequence
atggacgctgtatcacaggtgcccatggaagtggtgttgcctaaacacatcttggacatttgggtgattgtgctgatcattctggctactattgtcatcatgacttccctgctgctgtgtcctgcaaccgctgtgatcatttaccgtatgcggacacaccccatcctgtcgggcgctgtctag

SEQ ID NO: 49297 - DNA, 1683 bp, Artificial Sequence
  Description of Artificial Sequence: Synthetic coding sequence
agcgtgctgaagatcaccttggcagtaattctgacgctgctcgggttagctattctggccattctgctgacacgctgggccaggtgcaagcaaagtgaaatgtacatttcaaggtactcatcagagcagtccgctagactgcttgactacgaggacggcagaggctcgaggcacgcctatagtacacagagtgataccagttacgacaacagggcacgatatgaagccccatttagtcccaagattgagaaactggccattagtaagtcgagcttggcccttcctcagggcagcatgagcagtattaagtgtctccagactaccgaggagcccccttgcatcccatgtgtcatgatactgatcttctataacgtccctgcaacacgcggaatgggcaaggtagtccgtaaacacattatgcagactcctggaccgatcggtaagctgcctgtgttttcggtgcggtctcatccccacacgattacaggtcctccatccgcccctcggggtaagcctgtttccacactgctcataagcaattctgtatgttcgtatctgacccagagttttcagtttcccgaggtgaggaccattgccaccaagaaacgcgctactactcaggggtcagtgattttgactggctatatggatgaggaactggccaagaagagttgctccaagatccaaatcctgaagtgtggcggtaccgctaggtcccagaactctcgggaggaaaataaggaggcactcaagaatgatatcatttttacaaatagtgtggaaagccttaagagcgcccatattaaagagcccgaaagagaggggaaaggcacagacttggaaaaagataagatcggcatggaggtgaaggtagatagcgatgcagggattccgaaaaggcaagaaacgcagttgaaaatttccgagatgagcatccctcaggggcagggagctcagattaaaaagagcgtgtctgacgtgccacgtggccaggaatcacaagtgaagaaatcggaatcaggggtgccaaagggccaggaagcacaggtgacgaaatccgggcttgtagtgctgaaagggcaggaggcacaggtggagaagtctgagatgggcgtgcccaggaggcaggagagtcaagttaagaagagtcagtcaggcgtgtccaaggggcaggaagcccaggtcaaaaagagagagagcgtcgtcctgaagggccaagaggcccaagtggaaaagtccgaactcaaagtccccaaaggccaagagggacaggtcgaaaagacagaggcagatgtccctaaggagcaggaggtgcaggagaaaaaaagcgaggcgggagtgttgaagggcccagagtcacaggtgaagaacacagaggtgtctgtgcctgagactcttgaatctcaggtgaaaaagtctgaatccggggtacttaagggtcaagaggcccaggaaaagaaagagtcctttgaagacaaaggcaacaacgataaggaaaaagaaagggatgccgagaaagatccaaacaagaaagaaaagggcgataagaacactaaaggagacaaaggcaaagataaagttaaggggaagcgggagagcgaaatcaacggtgaaaagtcaaaagggagcaaaagggccaaagccaataccgggaggaagtacaataagaaggtagaggagtag

SEQ ID NO: 49298 - DNA, 1704 bp, Artificial Sequence
  Description of Artificial Sequence: Synthetic coding sequence
atgactgtcctggaaattacgctggccgtgattctgaccctgcttggactggctattctggcgattttattgacccgatgggcccgttgcaagcagtcagagatgtatatctccagatacagtagcgaacaaagtgccagactactggactacgaagacggcagagtagagtgccaccacggtcaacaaaaggagacatctcatcgcaagaccgagcgaaaattacggagagaaagaaagaggattacaaatgaaaggcggctgatcggaactgagaagtccctaccacagggaagtatgtcgagcattaagtgcttgcagactactgaggagcctccctgtaaggggatggggaaagtcatccaggccaagcagttgttaaacatctcctggcccctggctgtgtccctctcgaaaccactttgcattatccacgatgttctggagtcgttcaagactattaatctgcagagtccggcagggtttcaggcggtcacatcccattgtaagaaaggtcgcgataagttccggaagatacttgtatataagaaggggacatctatcaagggcaagaaaattgaaatcaagagaaagtaccttatttccaagtctcgaccgttcgtggtctgctctgtgattctgacaggttacatggatgaagaactcgcaaagaagagttgcagcaaaatccagattttgaagtgcggcggaacagccagaagccaaaatagccgcgaggagaacaaggaagccctaaagaatgacattatctttactaattcagtggaaagcttaaagtccgcccacatcaaggaaccggagagagaggggaagggtaccgatcttgagaaagacaaaatcggcatggaagtgaaggtggattccgatgctggcatccccaagcgccaggagacacagctgaaaatcagtgacgagtacaccactagaacgggctcccctaataaagagaagtgcgtgcgctgcacgaagcgaacgggtcaggtgaagaagagtgaatctggggtgccaaaagggcaagaggcacaagtcacgaagtctggtctggtcgttctgaaaggacaagaagcccaggtagagaaaagcgagatgggggtgcccaggcgacaggagagtcaggttaaaaaatcacagagcggggtgtcaaaagggcaggaagctcaggtgaagaagcgggaatctgtggttttaaagggtcaggaggcccaggtcgagaaatctgagcttaaggtgcctaagggccaagaagggcaagtggaaaagactgaggcagatgtacctaaagaacaggaggtgcaagagaagaagtccgaggcaggggttttgaaggggccagaatcccaggtaaaaaataccgaggtgagcgtgcctgaaaccctcgagtcacaggtcaaaaaatcagaatccggcgttctgaagggacaggaggcccaggaaaagaaagagtctttcgaagacaagggaaacaacgacaaggaaaaggaacgcgatgcagaaaaagatccaaataagaaggagaagggagacaaaaatacgaaaggcgataagggaaaggacaaggtaaagggcaagcgcgagtctgagatcaacggtgaaaaatcaaaggggagcaagagacgccaaattcaagagggatcaactaccaaaaagtggaagtctaaggacaagttctttaaaggcccttag

SEQ ID NO: 49299 - DNA, 1686 bp, Artificial Sequence
  Description of Artificial Sequence: Synthetic coding sequence
atgacggtacttgaaattactcttgctgtgatactgaccctgctgggcttggcgatcttggcaatattgctgacccgctgggccagatgcaaacagagcgaaatgtacatctcgagatacagctctgagcaaagtgcacgccttctggactacgaggacggtcgcggaagcaggcacgcctatagtactcagtctgggaacttgtgcttccagcggtcaaagcgggactataccccttcaacgaactctcttgtgtcaatggccagcaagttctccctgggtcagacggaactcattttgctgctgatgtgcttcattctggccctgtcccgctcatccatcgggtctattaaatgtctgcagaccaccgaggagccaccttcgaggacagcaggagccatgatgcagttcaccgctccaatccctggggcaaccggaccaattaagctctcacagaaaaccatagtgcagacacccggacccattgtgcaatatcctggttccaatgcgggtcctccttctgctcccagggggccacctatggcaccaataatcatcagccaacggacagccagaattccacaggtacacacaatggattcatcagggaaaataactctgaccccagtcgtgatactcacaggctatatggatgaggagcttgccaagaagtcatgcagtaaaatccagattctcaagtgtggcggaaccgctagaagtcaaaatagccgcgaggagaacaaagaggccctcaagaacgatattattttcactaactcagtggaatctctgaaaagtgcacacatcaaggagccggaacgggaggggaaaggcaccgatctggagaaagacaaaataggtatggaagtcaaggtggatagcgatgccggtatcccaaagcggcaggaaactcagctgaagatttcggaaatgagcatccctcaagggcagggcgctcagattaagaaaagcgtgagtgacgtccctcgaggtcaggaatcccaggtgaaaaagagtgagtcaggggtaccaaaaggacaggaagcccaagtgaccaaatctggacttgtggtactgaaaggacaggaggcccaggtggaaaaatccgagatgggcgtgcccaggcgtcaggagagccaggtgaagaagtcgcaaagcggggtatccaagggacaggaggcacaggtgaaaaaacgggagtcagtagtcctcaagggccaggaagcacaagtggaaaaatctgaactgaaggtccctaagggccaggaggggcaggtagaaaagacagaagccgacgtacccaaggagcaggaagtgcaggaaaagaagagtgaagccggtgttttaaaaggaccagagtcacaggtcaagaacaccgaagtaagcgttccagagactttagagtcccaagtgaagaagtccgaatccggggtgctgaagggacaggaggcccaagagaaaaaagaaagctttgaagataagggaaacaacgataaggagaaggaaagggacgccgaaaaagacccgaacaaaaaggagaagggtgataaaaataccaaaggggacaaaggcaaggataaagttaaaggcaaacgcgaatccgagattaacggggaaaagagtaagggatctaagagggccaaggctaacaccgggagaaaatacaataaaaaggtggaagagtag

SEQ ID NO: 49300 - DNA, 1692 bp, Artificial Sequence
  Description of Artificial Sequence: Synthetic coding sequence
atgaccgtcttagagattaccctagcggtgatcttgactctcctgggactggcgatccttgcaattttgctgacccgctgggctcggtgtaagcagagcgaaatgtacattagtaggtattcttccgaacaatcagccagacttctggactacgaagatggtagagggtccaggcacgcatattccacccagtcagacacgagttatgataatcgggagcgaagtaagcgcgactacacgccaagcacaaactctcttgtcagtatggcctccaagttctccctcggacagactgaacttatactgcttctcatgtgttttattctcgcactgagccgatcttcaatcggcagcattaaatgtttacagacgacagaagaacctccctccagaacagccggtgctatgatgcagttcacggcacccatcccaggcgctaccggcccaatcaaactgtcacagaaaaccatcgtgcagacccctggcccaatcgtgcagtatccaggctccaacgccggaccaccatcagctccacgcggaccccctatggctccaataattatctcacaacgcactgcaaggatcccccaggttcacacaatggatagttcaggaaagatcacgctgacccccgtggtgattctgactggatacatggatgaagagttggcaaagaaatcttgcagcaagattcagatcctgaagtgcggcggaacagccagatctcagaatagccgagaggaaaataaggaggcccttaagaatgacattatctttaccaatagcgtggagagcttgaaaagcgcgcacatcaaagaaccagagagggagggaaagggaaccgacctagagaaggataaaatagggatggaggtcaaggtagattcagacgccggaatcccaaaacgccaggagacgcagctgaaaatttctgagatgtccattccgcagggacaaggcgcacagataaaaaagagtgtgtccgatgtacccagagggcaggaatcgcaggttaaaaagtccgagtctggagtaccaaagggccaggaggcccaagtgactaagtccggtctggtggtactaaaggggcaggaagcacaggtggaaaaaagcgaaatgggcgtgccacgaaggcaagagagccaggtcaaaaaaagtcagtctggggttagcaagggccaggaagcccaggtcaagaagcgagagagcgtggtgttgaaaggccaggaagcccaggtggagaaatctgagttgaaggtgcccaaggggcaagagggacaggtcgaaaagaccgaggccgatgtgcctaaagaacaagaggtccaggagaaaaagtccgaggccggtgttttgaagggcccagagtcacaggttaaaaacacggaggtgagtgttcctgaaacactggagagccaagtgaaaaagagcgagagtggcgtcctgaagggtcaagaagcccaggagaagaaagagagtttcgaggacaaagggaataacgataaagagaaagaaagggatgctgagaaggatcctaacaaaaaagaaaagggagataaaaacaccaaaggcgataaaggtaaggacaaggtgaagggaaaaagagagtctgaaatcaacggggagaagagcaagggatcaaaacgggctaaagctaacacaggtcggaagtacaacaagaaagtggaagagtag

SEQ ID NO: 49301 - DNA, 1692 bp, Artificial Sequence
  Description of Artificial Sequence: Synthetic coding sequence
atgaccgttctggagattaccctggcagttatattaacgttattgggacttgccatcctggccattttgcttactcgctgggctaggtgtaagcagtcagaaatgtacattagtcggtatagttccgaacagtctgctcgcctgcttgactacgaagatgggaggggctcaagacatgcctacagtactcagagcgacacttcctatgataacagagaaaggtcaaagagggactacactccatcaacgaattccctggtctcgatggcttcaaagttcagcctgggccagacagaacttatactcctcctcatgtgtttcatcctagccctctccaggtctagtattggttccatcaaatgcctgcagaccactgaggaaccaccctcgcggactgccggagctatgatgcagttcacagcacccattcccggagcaacaggacctattaagctaagtcagaaaacaatagtacagaccccgggaccgatcgtgcagtatcccggtagcaatgcgggaccaccgtctgccccacggggacctcccatggcccctatcattatctctcagaggacagcccgaattccacaggtgcatactatggacagcagtgggaagattactctcacgcctgtagtcatcctgactggctacatggatgaggagttggcaaagaaaagttgttcaaaaatccaaattctgaaatgcggtggcacagcaagaagtcagaactcgagagaggagaataaagaagcactcaaaaatgacatcatcttcaccaatagtgtggaaagcctgaagagcgcccatatcaaggaacctgaaagagagggaaaggggactgacctcgagaaggacaagatagggatggaggtcaaggttgatagtgatgcaggaatccctaagcgccaggagacccagttgaaaatttcagaaatgtcaattccccaaggccaaggggctcaaatcaagaagagtgtgtctgatgttcctcgtggacaggagagccaggttaagaagtctgaatccggggtgccgaagggacaggaggcgcaagtaaccaagagtgggttggtggtccttaagggacaggaggctcaggtcgagaaatctgaaatgggggtgcctcgcagacaggagagccaggtgaaaaagagccagtccggcgtgagtaagggacaggaagcacaggtcaagaaacgcgagtccgttgtcctgaaaggtcaggaggcccaggtcgagaaatccgagcttaaagtgcctaaggggcaggagggacaggtggaaaagactgaggctgacgtgcccaaggaacaggaagtgcaggaaaagaagtcagaggctggggtactgaagggaccggagtcacaagtgaagaatactgaagtctccgtgccagagaccctggagtcccaggtgaagaaatccgaatccggcgtcctgaagggacaggaagcccaggaaaagaaagagtcgttcgaagataagggcaataatgataaagaaaaagagagggacgccgagaaggaccctaataagaaggaaaaaggtgacaagaacacgaaaggtgataaaggaaaagacaaggtcaagggcaagcgtgaatctgaaatcaacggagagaaaagcaaagggtccaagcgagcaaaggctaatactggtaggaagtataacaaaaaggttgaggaatag

SEQ ID NO: 49302 - DNA, 1689 bp, Artificial Sequence
  Description of Artificial Sequence: Synthetic coding sequence
atgaccgtgttggaaatcaccttggccgtgatactcaccctgttgggcttagctatactcgccattttgctgacacgatgggctaggtgtaaacaaagcgagatgtacatttctcggtacagctctgaacagtcagctcgccttctcgattatgaagatggacggggaagtcgccatgcatactccacacagtccgatacttcttatgacaaccgcgaacgatctaaaagggattacacacccagcaccaatagcctcgctctctcacgatcctctatagctctaccacagggttccatgtccagtattaaatgtctacagacgactgaagaacctccgagcagaaccgccggagccatgatgcagtttaccgctccgattcccggtgctacagggcctatcaagttaagtcagaagacaattgtccagactccaggccctatcgtgcaatatcccggaagtaatgtgcggtcacacccacataccatcacagggccaccgtccgccccaaggggaccaccaatggctccgattatcatctctcagaggaccgcttcacagctggcagccccaattaggataccccaggtgcacactatggactctagcggcaaaattaccctaacacccgttgtcattctgacaggctacatggacgaagagctggcaaagaagtcgtgttcgaagatccaaattttaaagtgtggagggaccgccaggagccagaactcacgcgaggaaaataaagaagcccttaagaatgatataatttttacaaatagcgttgaaagcctcaagtccgcccatattaaggaacctgaaagagaaggtaaaggcacggacctcgagaaagataaaatagggatggaggtgaaagttgattctgatgcgggtattcccaagcgacaggaaactcaactgaaaatttctgaaatgtctataccacagggacaaggggctcaaattaaaaagtctgtctcagatgtgcccaggggtcaggaatcgcaggtgaagaagtctgaatccggggttccgaaggggcaggaggcccaagtaaccaaatccggcctagttgtacttaaaggtcaggaggcgcaggttgagaagtccgaaatgggggtccctagaaggcaggagagccaggtgaagaaatcccaatccggggtgtctaaggggcaggaagctcaagttaagaagcgcgaatccgtggtgctcaagggtcaggaggcccaggtagagaaaagcgagcttaaagttcccaaaggccaggagggtcaagtggaaaaaactgaagcggacgtgcccaaggagcaagaagttcaggagaagaagtccgaagccggagttctgaaagggcctgaaagtcaggttaagaacacagaagtgagcgtgcccgagacccttgagtctcaggtgaagaaatctgagtccggggtcctgaaagggcaggaggcacaagaaaaaaaagagtctttcgaggataagggtaacaatgacaaagaaaaagaacgagacgctgagaaggaccccaataagaaagagaaaggtgacaagaacaccaaaggcgacaagggcaaggataaggtgaagggcaaaagagagagcgagatcaacggtgaaaaaagcaagggctcaaagcgagcgaaagctaatacaggtaggaagtacaataagaaagtagaggaatag

SEQ ID NO: 49303 - DNA, 1686 bp, Artificial Sequence
  Description of Artificial Sequence: Synthetic coding sequence
atgaccgtgttggagattaccctcgctgtgatcctgaccctgcttggcctcgctatcttagccatcctgctgactcggtgggctaggtgcaagcagtctgagatgtacatctcccggtacagcagtgagcagtctgctaggctcctggactatgaagatgggagaggttctaggcatgcatatagtactcaaagtggaaacttatgcttccagaggtccaagcgggattacacaccgagcacaaattccctcgtgagtatggcgtcaaagttttctctcgggcagaccgaactgatccttctcctgatgtgttttatattagccctcagcaggtcctcaatcggctccatcaagtgtttgcagacaaccgaggaaccaccctccagaaccgcaggagctatgatgcagtttacggcccctattcccggagctactggcccaattaagttatcccagaaaactatagtccagactcctggaccgatcgtgcagtatcctgggagtaacgctggcccaccgtctgcccctcgtggcccaccaatggctcccatcattattagtcagcgtaccgcaagaatccctcaagtgcacacaatggattcctcgggcaagatcacacttactcctgtggtgatcctcaccggctacatggacgaggagctggccaagaagtcttgtagcaagattcagatcctcaagtgcggaggaacggcacggagccagaactcccgagaagaaaataaagaggctttgaagaacgacatcatttttaccaacagcgtggagtcactgaagtctgctcacatcaaggagcctgagcgcgaaggcaaaggaacagacctcgaaaaggataaaatcggtatggaagtcaaggtggactcagacgctggcatccctaaaagacaggaaacacaactgaaaataagcgaaatgagtatcccgcaagggcagggcgcacagatcaagaagtcggtgtctgacgtccccagaggccaagagtctcaagtgaagaagtcagaatccggggtccccaagggccaggaggctcaggtaaccaagtccggcctcgtggtgcttaagggtcaggaggcccaggtcgaaaaatcggaaatgggtgtgcccagaagacaggagtcccaggtgaaaaaaagccagagtggcgttagcaaggggcaagaagctcaggttaagaagcgggagtcagtcgtcctgaagggtcaagaagctcaggttgaaaagtcagaactgaaggtccctaaagggcaggaagggcaggttgagaagaccgaggctgacgtgcctaaagagcaggaagtccaggaaaaaaagagcgaggccggtgtgcttaaggggcctgagtcgcaggtgaagaataccgaggtctccgtgccggagactttagaatcacaggtgaagaagagcgagtccggcgtgctaaagggtcaggaagcgcaggagaaaaaagagtcctttgaggacaaagggaacaatgataaggaaaaggagcgtgacgccgagaaagatccaaataaaaaagaaaagggggataaaaacacaaagggagataaaggcaaggataaagtgaaggggaagcgggagagtgagatcaacggggaaaagtctaaaggatctaaaagggccaaggctaataccggcagaaaatataacaaaaaggtggaagagtag

SEQ ID NO: 49304 - DNA, 1683 bp, Artificial Sequence
  Description of Artificial Sequence: Synthetic coding sequence
agcgtcctcaagatcaccctggctgttattctcactctgttaggacttgcaatccttgctatcctcttaactcgctgggcccgatgcaagcaatcagagatgtatatctctagatattcctccgaacagagcgcccgactgctcgactacgaggatggtcggggatcacggcacgcgtattctacccagtctgacacgtcttatgacaatcgagcacgatacgaggcacctttttccccgaagatcgagaagctcgccatcagcaaaagtagcctggctttgcctcaggggtcgatgtctagcattaagtgtctgcaaacaacagaggagcccccatgtattccgtgcgtgatgattctcatcttttacaatgtgcccgctactaggggaatgggtaaggttgtcagaaagcacataatgcagacgcctggacctatcgggaaattgcctgttttctccgtgcggagccatcctcataccatcaccggcccaccaagtgcccctcgtggaaaacctgtctctacccttctgatttctaactcagtgtgtagctacttaacacaaagttttcagttccccgaggttaggacaattgctaccaagaaacgtgcaactacccagggctcagtgattctaaccgggtatatggacgaggagcttgcgaaaaagagttgctcaaaaatccagatcctgaagtgtggcggaactgccagatcccaaaactctagagaggagaataaagaagctttaaaaaacgatattattttcaccaacagtgtggaaagcctcaaatccgcccacattaaggaacctgaaagagagggcaaagggaccgaccttgagaaggataaaattggcatggaggtgaaggttgatagcgacgccggtattcctaagaggcaggagactcaactgaagatctccgagatgagcattccccaggggcagggggctcagatcaaaaagagcgtgtccgatgtcccacgagggcaggaatctcaggtgaaaaaatctgaaagcggcgtacccaaaggtcaggaagcccaggtgactaaatccggtttggtggtcctgaagggccaggaagcccaggttgagaagagcgaaatgggagtgcctagacgccaggaatctcaggtgaagaagtcacagtcaggagttagcaaaggacaggaggcccaggtgaagaaacgggagtcggtagtactaaaaggccaggaagctcaggtggaaaaaagcgaattgaaagtgcccaaggggcaagagggacaggtggaaaagaccgaggcagatgtacctaaggagcaggaggtgcaggaaaagaagagcgaggccggtgtcttgaagggtcctgaatcccaggtgaagaacacagaggtgagcgtgcccgagacattggagtctcaggttaagaaaagtgaatccggcgtgcttaagggacaggaggctcaggaaaagaaggaaagtttcgaagataagggcaataacgataaggagaaagagcgggacgctgaaaaggatccaaacaaaaaagaaaagggggataaaaataccaagggcgacaaaggaaaagacaaggtgaaaggtaaaagagaatctgagataaacggggaaaagagcaagggatcaaagcgagccaaggcgaatacagggcgaaagtacaataaaaaagttgaagagtag

SEQ ID NO: 49305 - DNA, 1704 bp, Artificial Sequence
  Description of Artificial Sequence: Synthetic coding sequence
atgacagttctggaaattacgctggctgtcatcttgactctgctgggactggctattctggcaatactgctgacgagatgggccaggtgcaagcagtctgagatgtatataagcagatactcctcagagcagagcgctcgtctgcttgattacgaggacggccgtgtcgaatgccatcacggccaacagaaggagacaagccaccgaaagactgaacgcaaacttaggcgcgagaggaagcggatcaccaacgaaaggaggttaattggaactgagaaaagcttacctcagggatcgatgtcttccattaagtgtctgcagaccaccgaagagcccccttgtaaaggtatgggtaaggttatccaggcgaagcagctgcttaacatctcttggcctctcgctgtcagtctttctaagcccctctgtattattcatgatgtgttggaatccttcaagacgatcaacttacaatcacccgctgggtttcaggctgtcacttcccattgcaaaaaggggcgtgacaaattccggaaaattctcgtgtacaaaaagggtacatctattaagggcaaaaaaatcgagatcaagcggaagtaccttatctctaaaagtcgccctttcgtagtgtgtagtgttatcctcaccggatatatggacgaggaacttgctaagaagagctgttccaaaattcaaatcctgaagtgtggaggcacggcaaggtcacagaattcccgcgaagagaacaaagaggctctgaagaacgacattattttcactaactcagtggagagcctcaaatccgcacacatcaaggaacctgaacgagaggggaaggggactgatttggaaaaggataagataggcatggaagtcaaagtggatagtgatgccggtattccgaaaagacaagaaacacaactcaagataagcgacgaatataccacaaggaccgggagtcccaataaggaaaaatgtgtccggtgcactaaaaggactgggcaagttaagaaatccgagtccggagttccaaaggggcaggaagctcaggtcactaagtccgggctggtcgtgctgaagggacaggaagcgcaggtggagaaatccgagatgggcgtgccccgtagacaggagtctcaggttaagaaaagccaatctggcgtctccaaaggccaggaggcacaagtcaagaagcgagaaagcgtagttctgaaaggccaggaagcacaggtggaaaaatcagagctcaaagtgcctaagggacaggagggacaagtggaaaagactgaggccgatgtccctaaggaacaagaggtgcaggagaaaaagtccgaagcgggtgtcctaaaaggccctgagagtcaggtgaagaatactgaggtgtcagtgccagaaaccctggagtcacaagtgaagaaaagtgagagtggagtgttaaagggccaggaggcccaggagaagaaagagtcatttgaggataaaggcaataatgataaggaaaaggaacgagacgccgagaaggatccgaacaagaaagaaaaaggagacaaaaacacgaagggcgacaaaggtaaggacaaggtgaaggggaaacgcgaaagcgagatcaatggcgagaaatccaagggcagcaagaggagacagatccaggaggggagcactaccaagaaatggaagtcaaaagacaagttctttaaaggcccttag

SEQ ID NO: 49306 - DNA, 1644 bp, Artificial Sequence
  Description of Artificial Sequence: Synthetic coding sequence
atgaccgtcctcgagatcacacttgctgtcatactgacattgttgggccttgctatcttggccatcctcctgaccaggtgggcaagatgtaagcaatccgaaatgtatatttcgcgctacagcagtgaacagtcagcaagactccttgattatgaggatggtaggggaagtagacacgcttacagcacccagagcgagcgctcaaaacgagattacacgcctagcactaattctctggccctaagtcgatcaagtatcgccctaccacaaggatcaatgtcatcaatcaagtgcctacaaaccacagaggagccaccctcccgcactgccggagcgatgatgcagtttactgcacctatcccaggcgctaccggaccaatcaagttaagccaaaaaactattgtgcagacacccggaccaatcgtacaatacccgggttcaaatgctggaccaccttccgcccctcggggtcctcccatggcaccgattattatttctcaacgaaccgcctctcagctggctgccccaatacgcattccacaagtacatacaatggacagttcaggcaaaataacattgacccctgttgttattcttaccggatacatggatgaggagctagccaagaaatcatgttccaagatacagattctcaagtgcgggggaacggcacgaagccagaatagcagagaggagaacaaggaagcactgaagaatgatatcatcttcacgaattcagtagagtctctgaagtcagcccatatcaaagagccagaaagggagggcaaaggaacagacctggagaaagacaagatagggatggaggtaaaagtggatagcgacgcagggattcccaaacgacaagaaacccagcttaagatttccgagatgtccatcccccagggccagggggctcaaataaagaaatctgtgtctgacgtccccaggggacaggaatctcaggtcaaaaaatccgaatccggtgtgcccaaaggtcaggaggcccaggtaacaaagtcaggacttgtggttctgaagggacaggaggctcaggtcgagaaaagcgaaatgggagtcccaaggcgacaggagagccaggtgaaaaaatctcagtccggcgtctccaagggtcaggaggcccaggtcaagaagagggagtcggttgtactcaaaggccaggaggcgcaagtggagaagtcagagcttaaggtacctaagggtcaggaagggcaggtggaaaagacagaggctgacgtcccaaaagagcaagaagtgcaggaaaagaagagcgaggctggcgtgctgaagggcccagaatcccaggtgaaaaatacagaggtctccgtccccgagaccctcgaaagccaggtcaagaagtctgaaagcggcgtgctcaagggccaggaagctcaggaaaagaaagagtcatttgaggacaaaggcaacaacgataaggaaaaggaacgagatgcggagaaggatccaaataagaaggagaagggcgataagaataccaagggcgataaggggaaggataaagtaaaggggaaacgagaatcagaaatcaacggcgagaaatccaaaggcagcaagagggctaaagccaacaccgggcgaaaatacaacaagaaggtggaagagtag

SEQ ID NO: 49307 - DNA, 306 bp, Artificial Sequence
  Description of Artificial Sequence: Synthetic coding sequence
atggccgctagcaggtacaggcgcttcctcaagctatgcgaagaatggcccgtagacgaaacaaagcggggtcgcgacctcggcgcatacctccgccagcgggtggcccaggccttccgagagggcgaaaacacacagtatccaaggccacgggacacctcattctcagggctatcactggaggagtacaaacttatcttgagtacagacaccctggaagagctaaaggaaatcgataaaggcatgtggaagaagttacaggaaaagttcgcccctaaggggcctgaggaggaccataaggcctag

SEQ ID NO: 49308 - DNA, 381 bp, Artificial Sequence
  Description of Artificial Sequence: Synthetic coding sequence
atggcagcttcccggtatcggcgttttttaaagctgtgcgaggagtggcctgttgatgaaaccaagagaggaagagatcttggggcttatcttagacaacgggttgctcaggcttttagggaaggagaaaatacccaagtggcggagcctgaggcgtgtgatcagatgtatgaatcattggcccgtcttcattctaactattataagcataagtatccccgtcccagagatacctcgttttccgggctatcactggaggagtataaattgattctgagtactgatacacttgaagaacttaaagagattgataagggcatgtggaagaaactccaggaaaagtttgcccctaaggggcctgaagaggatcacaaagcttag

SEQ ID NO: 49309 - DNA, 1491 bp, Artificial Sequence
  Description of Artificial Sequence: Synthetic coding sequence
atgtatcagccatcccggggagccgctcgacggcttggcccttgtttgagggcgtatcaggccagaccacaggttagcggcggtgaagaaggcggacggcgaggcggtggggaacgtccctcctcaaagcccgtccgaggtgccgagagggctcttggatccgcgcaggctcagcgtcaccctcctcctctaccgacttgcgccctccagcgagtggacagactgggagtggccggtgcgggtggacggagatgcagagcctgcagagcacgcacttccgtgctacctgggttacgggcagtccgtcgcggacaaggacaagccgctgggcgtgtttgtgttgccccagactctcctagactacctgttcccagaggtgacttgaagggtcgaggccgagagattcggtctcccgctgcggctccctcaaggtcgtcgccggctcagacacgcccagctggccgtcctcagcagccagccaggttggcactgggcgagaggtcgtggcaggagggcagacctgtttgcaccaggtttggccctctgcgacccggatggcaagatggacacgcaccctcccgcgacggggcatcgaggaccccatccgggacggaagaccaactctatcctggcaccttgccattcccacctctgtggccccattcaacaacaactaccagcccttcctctcctctgttctggtcaccacttcccccaagactcccaactcaaagactcccccaggttccgcctttgccactcccccaaattcaggccctgagctcagcctgggtggtgctgcctcctgggaagggggaagaaggtcccggaccagaactacattcaggttgtttagacggcctcagaagcctgttcgaagggccaccctgcccttacccaggtgcctggattccctttcaggtgccaggaacagcccaccctagcccagcaaccccatcgggagaccccagtatggaagaacacttgagcgttatgtatgaacgtctgcgccaggaactgccgaaattattcctccagagccatgattattctctctattccctcgacgttgaatttatcaacgagatcctcaatatccggactaagggacgcacttggtacatcctgtccctgactctgtgtcgcttcttagcttggaattatttcgctcatctgaggctggaagtgctacagctcaccagacaccctgagaattggactctgcaggcacggtggaggctggtcggcctgcctgtgcacctgctgtttctgcggttctacaaaagagataaagacgagcactaccgcacatacgacgcctacagcacattctaccttaattcctcagggctgatctgccgccatcgcttagataaattaatgccctctcattcccctccaacacccgttaaaaaattgttagtcggggcattagtggccctcggcctgtccgagcctgagccagacttaaacctctgttcaaaaccatag

SEQ ID NO: 49310 - DNA, 546 bp, Artificial Sequence
  Description of Artificial Sequence: Synthetic coding sequence
atgtatcagccgtctcgtggagccgctcgcagattaggcccttgtcttcgggcataccaggcaaggccgcagctgcccaagctctttctgcaatcacacgattactcgctgtatagtttggatgtggagtttattaatgaaattcttaatattagaactaaaggacgaacatggtatatcctctctttaacactatgcagattcctggcctggaactacttcgcacacctgcggttggaagtgctgcagctcacccgccaccccgaaaattggacacttcaggcacgatggcggctggtcggactgcccgtccacctactctttctcaggttctataagcgcgataaagatgaacactatcgcacctatgatgcatacagcactttttacctgaattcctccggcctcatttgccggcacaggctggataagctcatgccttcccattcgcctcccacacctgtgaagaagttgctcgtaggggctctagtggcgctagggctcagcgaacccgaacctgaccttaatttgtgtagtaaaccctag

SEQ ID NO: 49311 - DNA, 948 bp, Artificial Sequence
  Description of Artificial Sequence: Synthetic coding sequence
atgtaccagcccagccggggagccgctaggcggcttgggccttgcctccgcgcttaccaggcaaggccccaagaccagctctatcctggaactctgccctttccccctctgtggccccattctaccacaaccaccagcccatcttcgcccctcttttggtccccgctaccgccacgactgcccacacagagactgccacaggtgccacccctgccgctgcctcaaatacaggccctgagctccgcctgggtggtactcccacctgggaagggggaggaaggtccaggccctgaactacactcaggttgtctggatgggcttcgaagtttatttgagggtcctccctgtccgtaccccggagcgtggatcccatttcaagtgcccggaacagcccacccatcacccgcaactccatccggcgacccttctatggaggaacatctcagcgtgatgtacgagcgactgaggcaggagttgcccaaactctttctgcagtcgcacgactatagcctctacagtctggatgtggagttcattaacgaaatacttaatattagaacaaaagggaggacttggtatattctgagcctgacactatgtcgcttcctggcgtggaactattttgcccacctccggctcgaagtgctacaactgacccggcatccagagaattggaccctgcaggcacgttggcggctcgttggtcttcccgtccaccttctctttctgagattttataaacgcgacaaggacgagcactaccgcacttacgatgcctatagtaccttttacctgaactctagtgggctgatatgtcgtcaccggcttgataaactgatgcccagtcattctccccctactccggttaaaaagctattagttggagcccttgtggccttgggcttgtccgagccagaaccggacctgaacctgtgttccaaaccgtag

SEQ ID NO: 49312 - DNA, 519 bp, Artificial Sequence
  Description of Artificial Sequence: Synthetic coding sequence
atggaagagcacttgagtgtgatgtatgagcgcctgaggcaggagctgccaaaactcttcctacaatctcatgactacagtctgtacagtttggatgtagagttcatcaatgaaatcctcaatattagaacaaaggggagaacctggtacatcttgagcctaacactttgtaggttcttagcttggaattattttgcccacctgcggctcgaagttctccaattaactcggcatccagagaactggacattgcaggccagatggagactggtcggactgcccgtgcaccttctgttccttaggttctataaaagagacaaggatgagcactaccggacatacgatgcttatagcaccttctatcttaacagcagtggtctgatttgtcgccaccggctagataagctgatgcccagtcacagtccgccaacaccggtcaagaagctgctagtgggtgctttggtggccttgggtctgagcgagcccgaacccgatctgaacctgtgctctaaaccctag

SEQ ID NO: 49313 - DNA, 2541 bp, Artificial Sequence
  Description of Artificial Sequence: Synthetic coding sequence
atgtgttttctccggaggcccggagcacctgccagctggatctggtggaggatgttgaggcaggtcctccgaaggggactgcagagtttttgccaccggctgggactgtgcgttagtagacatcccgtcttctttctcaccgtacccgctgtgctgactatcacctttgggcttagcgccctcaatagatttcagcccgagggagatttagaacgtttggtcgctccgtctcatagtctcgctaagatcgaacggtcattggcctcctccctttttccattagaccagagcaagtcccaactttattcggaccttcacacccccggtagatacggacgcgttattttactatcaccaactggggacaacattcttttgcaagccgagggaatactccaaacccaccgcgctgttctcgagatgaaagatggcagaaattcctttataggacatcaattgggcggtgtggtggaggttcctaactccaaagaccagagagtaaaatctgctcgcgcaattcagattacatactatttgcagacatacggctccgcaacacaggatctgatcggcgaaaaatgggaaaacgaattttgcaagctcatccggaagttgcaagaagagcatcaggagttacagttgtattcactggccagtttttctctttggagggactttcataaaacatccatcctagctagatccaaagtattagtatctttagtcctgatcttgaccaccgctacactgtctagttctatgaaagactgtttacgctccaaacccttcctgggcctgctcggcgtgctgaccgtgtgtatttcaatcattacagctgccggaatcttcttcattacagatggaaagtacaatagtactctcctcgggatcccattctttgctatgggccatggcacaaaaggcgtcttcgagcttttgagcggttggcggagaaccaaggaaaaccttcccttcaaggaccgaatcgcagacgcatacagcgatgtgatggtgacctatactatgacctccagcttgtacttcataaccttcggcatgggggcatcccccttcaccaatattgaagccgtcaaagtgttttgtcagaatatgtgtgtgtctatcctcctgaattacttttacatcttcagcttcttcggcagttgcttggtatttgcaggtcagctggagcagaacaggtaccacagtatcttttgttgcaagattcccagtgctgagtatttagacagaaagcccgtttggttccagaccgttatgagcgatggacatcaacaaacaagccaccacgagaccaatccgtaccaacatcattttatccagcattttctccgagaacattataacgaatggatcactaacatctacgtgaagccctttgtggttatactttaccttatctatgcaagctttagcttcatgggctgcctacagatctctgatggagctaatatcatcaatttgctggccagcgatagtcctagcgtatcttatgcaatggtccaacagaagtacttctcaaactattcgccagtgattggattttacgtttacgagccactcgagtactggaattcttcggtacaggacgaccttcgaaggctgtgctccgggtttaccgcagtgtcgtgggttgagcagtattaccagtttctgaaagtgtcaaacgtgtctgccaacaataagtccgacttcatctcagttctgcagagttccttcctgaaaaagcctgagttccagcattttcgaaacgacatcattttctccaaggcaggcgacgagtcaaacattatcgcctcaaggctttacctggtggcccgaacctcgagggacaaacagaaggaaatcaccgaggtcctcgagaagttacggccactgtcactaagcaagtcaataaggttcatcgtcttcaatccctcgtttgtttttatggaccactactctttaagcgttacggtgccagtgctcatcgccggattcggggttctgctggtactgattttaacattcttcctggtgattcaccctctgggaaacttttggttgatactatcagtgacatcaatagagctgggcgttctgggactgatgaccttatggaacgtggacatggattgtatctccatcctgtgccttatatacacgttgaactttgcaattgaccactgcgcacctcttctgtttacattcgtgctagccaccgaacacacccgtacacaatgcataaagtccagcctccaagatcatgggactgcgattctgcagaacgtgacttcatttttgatcggactcgtcccacttctgtttgtgccatctaatctcacattcacacttttcaagtgcctattgcttacaggcggatgtactctattgcattgtttcgttatcctgcctgtctttctgacttttttccccccatcaaagaagcatcacaagaagaaaaaaagagctaagcgcaaagagagggaggagatcgagtgtatcgaaatccaggaaaatcctgaccatgttactacagtgtag

SEQ ID NO: 49314 - DNA, 936 bp, Artificial Sequence
  Description of Artificial Sequence: Synthetic coding sequence
taatgcttcctccgtaggcctggtgctccggctagctggatttggtggaggatgctccgtcaggttttgcgaagaggcttgcagagcttttgccaccggctggggctgtgtgtgtcaagacatcctgtgttttttctgaccgtccccgcagttttgacgattacgttcgggctcagtgcgctgaaccggttccaacctgagggagatctggagagacttgtcgcaccttcacactcactagctaagatcgagaggagtttagcttcatccctgtttcctctggaccagagtaagtctcagctgtacagcgacttacacacccccggaagatatgggagggtgattcttttgagcccaacgggggataatattctgcttcaggccgaagggattctccagacccaccgggctgtactggagatgaaagacggcaggaacagctttatcggccaccagctggggggtgtcgtggaggtgcccaatagtaaggatcagcgtgtcaaaagtgccagagccatacagattacatactacctgcaaacctacggatcagccacccaagatctgatcggcgagaagtgggaaaacgaattctgcaaacttatccggaagcttcaggaggagcaccaagagttacaactttattccctagcaagcttcagtctttggcgcgacttccacaagacatcaattttggcaagatcaaaggtgctggtgtctttggtattaatcctgactacggcaaccctgtcatcaagcatgaaggactgtcttcggagcaaacctttcctgggtttactgggcgtactgaccgtgtgcataagcatcattacagccgcaggaatcttctttattacagatggcaagtataatagcactcttctcggtattcccttctttgcaatgggcatttcaacagaattcacgtcctcttag

SEQ ID NO: 49315 - DNA, 885 bp, Artificial Sequence
  Description of Artificial Sequence: Synthetic coding sequence
atgcttcggcaagtgctccgcagaggcctgcagagcttctgtcaccggctgggcctgtgtgtttcacgccaccctgtgttctttctgaccgtccctgccgtacttactatcacatttgggttgtctgccctgaataggttccagcctgagggggatttagaaaggctggttgccccatcccacagtctggccaagatcgagagatcccttgcttccagcttgttccctctggatcagagtaaatcacagttgtactctgatctccatacccctggacgttatggtcgagtaatccttttgtcaccgaccggtgataatatactcctgcaggccgaaggcattttgcaaacacaccgggcagtcctcgaaatgaaggatggacgcaatagcttcataggacaccagttgggtggggtagtggaagtgcctaactctaaggatcaaagagtgaaatcggccagggccatccagattacctattaccttcagacctatggtagtgcaacccaggacctgataggcgagaaatgggagaacgagttttgtaagctgatccgcaaattgcaagaggaacaccaggaactgcagctttactcactcgctagtttctcactgtggagggacttccacaaaacatccatcttagccagaagcaaggtgttggtgtcactggtcctgatcttaacaacggccacactgtcgtcttccatgaaagactgcctccgatctaagccatttcttggccttctgggagtgctgaccgtgtgcatttctattattactgcagccggtatattctttatcacagacggtaagtacaactctaccctcttgggcatcccttttttcgcaatgggcatcagcaccgaatttactagctcctag

SEQ ID NO: 49316 - DNA, 339 bp, Artificial Sequence
  Description of Artificial Sequence: Synthetic coding sequence
atgcaggacacaggctcggtcgtgcctcttcattggttcgggttcggctatgcagccctcgtggccagcgggggaattataggctacgttaaagcaggaagtgtgccttcgctcgccgctggactcctctttggttctcttgccggattgggcgcttatcaactcagccaggacccccgaaatgtctgggtcttcctagcaacctccggcacactggcagggatcatgggtatgaggttttatcacagcggcaagttcatgcctgctggcttgatcgcgggagcgagccttctcatggtcgcgaaagtcggcgtgagtatgttcaacaggcctcattag

SEQ ID NO: 49317 - DNA, 294 bp, Artificial Sequence
  Description of Artificial Sequence: Synthetic coding sequence
atgtcaagcgcaccagagccgccaacctttaaaaaagaacctccaaaagaaaaagagtttcagagccccggtctgcgcggagtcagaactacaacgttgttccgagccgttaatcccgagctcttcattaaaccaaacaagccggtgatggcatttggccttgtgacactgagtttatgtgtggcttatataggctatttgcacgccatccaggagaacaaaaaagatctttatgaggcaatcgatagtgaagggcattcatacatgagacgtaagacctcaaaatgggattag

SEQ ID NO: 49318 - DNA, 2844 bp, Artificial Sequence
  Description of Artificial Sequence: Synthetic coding sequence
atgagccagccacctatagggggagccgctcctgcaaccgccgcagcaagcccagccgctgccgcaacagaggccagattgcatccagagggatcatcgcggaagcagcaacgtgctcagtccccggctaggccccgtgatagctctttgcgccaaaccatcgccgctacccggtcgcccgttggggctggtactaaactgaacagcgtgcgtcaacagcagctacaacagcagcagcagcagggaaacaagacaggatccagaaccgggcctccggcaagtatccggggaggcggtgggggtgctgaaaaggccaccccactagccccaaagggcgcagcccctggagctgtgcagccagtggctggggctgaggctgcccctgccgcaacactagccgcacttggtggaaggaggccaggccctcctgaagagccccctcgagagctggagagcgtgcctagtaagcttggggaacctcctccactcggcgagggtgggggagggggaggtgagggtgggggagctggaggcggttcaggagagcgggaaggaggagctcctcagccgccaccccctcgcggatggcggggaaagggcgtgagagcgcagcagcggggagggtctggcggagaaggtgccagcccttcaccaagctcgagctccgcaggcaaaacccctggtaccggttctagaaactcagggtccggcgtggcgggaggaggctctgggggtggaggctcctattggaaggaaggctgcctgcaaagtgaactgattcagtttcatctgaagaaagaacgcgctgccgctgctgcagccgcagctcaaatgcatgctaagaatgggggagggtcttcttcacggtcctctccagtctccgggccacctgccgtctgtgagacactggcggtagcctctgcctctcccatggcagccgctgccgaaggaccccagcagtctgctgagggatctgcctccggcggaggaatgcaggctgcagcacccccatcctcacagcctcacccccagcagctccaagagcaggaagagatgcaggaggagatggaaaaacttcgcgaggagaacgagacacttaaaaacgagattgatgagctgagaacagagatggacgaaatgcgtgacaccttctttgaagaggatgcatgtcagctgcaggagatgcgccatgagctggagagagctaacaaaaattgtcggattctgcaatatcggctgaggaaagctgagcgcaagcggctgcggtatgcccagactggcgaaattgatggcgagcttttaagaagtttagaacaggatttgaaggttgccaaagatgtgagtgtccgccttcatcacgaactcgagaatgtggaggaaaagagaaccacaactgaagacgagaatgagaaattgcgacaacagctgatcgaagtcgagatcgcaaaacaggcactccaaaacgagctggagaagatgaaggaactctcgcttaaaaggagaggctccaaagacctgccgaaatctgaaaaaaaagcccagcagacccccaccgaagaggacaacgaggacctcaaatgtcagctgcagttcgtgaaggaggaggcggcactgatgcgcaaaaagatggccaagatagataaagagaaggatcggttcgagcatgagcttcaaaagtatcggtccttttatggcgacctcgatagcccacttcccaaaggagaagctggagggcctccatctaccagagaagctgagctaaagctgcgtttgcgccttgtagaggaagaggcgaatatacttggccgaaagattgtggagctggaagtggaaaatcgcggattaaaagcagagctcgatgacttgaggggggacgacttcaacgggtcagcgaatcctctgatgcgggaacaatctgagagtctgtcagagttgcgtcagcacctgcagctggtggaggatgagaccgaactgctcagaaggaatgtggccgatctggaggagcaaaataagcggatcacagctgaattaaataaatacaaatataagtcgggtggccatgattccgcccgtcatcacgacaacgccaaaacagaggctctgcaagaagaactgaaagctgctaggctgcagattaatgaactatctggaaaagtgatgcagctgcagtatgagaaccgcgtcttgatgtctaatatgcaaaggtacgatctggcctcgcatctcggaattcgcggttctcctcgcgacagcgatgccgagtcagacgccggaaagaaagagtccgacgatgattccagacctccacaccgcaagagagaaggacctattgggggtgaaagcgattcggaggaggtgcggaatattcgctgcctgacccccactcgatcattttatccagccccagggccttggcccaaaagttttagcgatagacagcagatgaaggatatcagaagtgaagccgaacgtttgggcaaaaccattgacagactgatcgccgacaccagcactattattacagaagccaggatatacgtagctaatggagacctttttggcctgatggatgaggaagatgatggctctcggataagagagcatgagctcctgtatcggatcaacgcacagatgaaagcgttccgcaaggaattgcagacctttatcgatagactggaagtgcccaaaagcgccgacgaccggggagccgaggaaccaatttcggtgtctcagatgttccagcccataatcctgcttattctgatcctcgtgctcttctccagtcttagctataccacaatttttaaacttgtttttctgtttacattgttcttcgtcttgtag

SEQ ID NO: 49319 - DNA, 33 bp, Artificial Sequence
  Description of Artificial Sequence: Synthetic coding sequence
atgtctcagccaccgattggcggtgcggcatag

SEQ ID NO: 49320 - DNA, 2844 bp, Artificial Sequence
  Description of Artificial Sequence: Synthetic coding sequence
atgagtcagcctcctatagggggagccgctcctgcaaccgctgccgcaagcccggcagccgctgccaccgaggctcgcctccaccctgaaggcagcagccgcaagcaacagcgggcacagagcccagcacgcccacgcgactcatcgctgagacagacgatcgctgctacccggagcccagtcggagctggcacgaagctcaactcagtgcggcaacagcagctgcagcagcagcagcaacagggcaacaaaaccggatccagaactggcccaccggcatctatacgaggagggggagggggagcagaaaaagctacccctctggcacccaagggagccgcacccggagctgtccaacctgtggcaggggcagaagcagcaccagctgccacattagccgctctgggtgggagacggccaggccctcccgaagagcctcccagggaactggagagcgtcccgagcaaactgggagagccgcctccccttggcgagggagggggaggcggaggcgaaggtggaggggcaggagggggttctggggaacgcgaaggaggtgcacctcagcctccccctcccaggggatggcggggaaagggggtgagagctcagcagcggggagggagtggcggagagggggcatcaccctcaccttcctctagcagcgctggaaagactcctggtaccgggtcccgaaatagcgggagcggcgtggcaggaggtggaagtgggggtggaggcagttactggaaggaagggtgcctacagtctgaattgattcagtttcatttgaagaaagagcgtgccgctgctgccgctgctgccgcacagatgcatgccaaaaatggcggtggttctagttcaagatccagtccggtctccgggcctccggcagtgtgcgagaccctagccgtggcatcagcctccccaatggcagccgctgcagagggccctcagcagagtgccgaaggaagcgcctctgggggaggtatgcaggctgctgcccctccatcatctcagccccacccgcagcagctccaggagcaggaagagatgcaagaggaaatggagaagttgcgagaagagaacgaaaccctgaaaaacgagatcgacgagctgcgtaccgaaatggacgagatgagggacacctttttcgaagaggatgcctgccagttgcaggaaatgcgacatgagctggagcgggcaaacaagaactgcagaatcctacaatatagactgcggaaagcagagcgtaagaggctccgttacgctcagactggcgagattgacggtgagctcctgagatccctcgagcaagatctgaaagtcgccaaggacgtgtcagtgcgcctccaccacgagttagaaaatgtcgaagagaaaaggactacaacagaggatgaaaatgaaaagttacgccagcagttgatcgaggtggagattgcgaagcaggccctccagaatgaacttgagaaaatgaaggagttgagtctgaaacggagaggatcaaaagatcttcccaagtctgaaaagaaagcacagcagacacctaccgaagaagataacgaggacctcaaatgtcaacttcaatttgtcaaagaggaggccgctctgatgcggaagaagatggcaaagatcgataaagagaaagacaggtttgaacacgagttgcagaaatacagatctttttacggtgacttagattctcccctgccaaagggagaagccggtggaccaccctctacccgtgaagccgaattgaaacttaggctgcggttggtggaagaagaggccaacattctcggcagaaagatagtggagctggaggtagagaaccgcggtttaaaagccgagctggacgatctgcgtggcgacgatttcaatggatcagcgaacccactaatgagggagcagtcagaaagtttatcggagcttcggcagcacctgcagctcgtcgaggatgaaactgagttgctcaggcggaacgtcgcagacctggaagagcagaacaagcggattactgccgaactgaataagtataagtacaaatccggaggtcatgattctgcaagacatcacgacaatgcaaaaactgaagccttgcaggaagaattgaaggctgccagactccagatcaatgagctttctggaaaagtgatgcaattgcaatacgaaaaccgcgtgctcatgtctaatatgcagcgatacgatcttgcctctcacctcggcattcggggttccccgagagatagtgatgctgagtctgacgcaggaaaaaaagaaagtgacgatgacagccgccctccacaccgcaagagagaaggacctatagggggtgaatcagatagtgaggaggtcagaaatattagatgcctgacccccactcggtctttttatccagcacccggaccatggccgaaatctttcagtgatagacagcagatgaaagacattagatcagaagcggagcggcttggaaagaccattgatcggctcatcgctgatactagcactataataaccgaggcacggatctatgtcgcaaacggcgacctgtttggattgatggacgaggaggatgacggtagccgaattcgcgagcacgagctgttgtaccgcatcaacgcgcagatgaaggcttttcgcaaggagctacagacattcatcgatcggctcgaggttcccaagagtgccgacgaccgcggagcggaggaacctatctcagtttctcagatgtttcagccgatcatccttctcatccttattctcgtgttgttttcttccctctcttacacgacgatcttcaagctggtgttcctgttcacccttttcttcgtcctttag

SEQ ID NO: 49321 - DNA, 2844 bp, Artificial Sequence
  Description of Artificial Sequence: Synthetic coding sequence
atgagccagccaccgatcggcggagcagctccagctaccgcagctgcttcacccgctgccgcagccacggaagcgcgtcttcacccagagggcagttcccggaagcagcagagggcacagtcgccagcccgtcccagggatagttcgcttagacagaccattgccgcaacaagaagccctgttggagcagggactaagctgaattccgtgagacagcaacaactccaacaacaacaacaacagggaaataagactggatccaggaccggaccgcctgccagtattcgtggcggtggcggtggtgctgagaaggcgacgcctctagcccctaagggagccgcaccaggcgctgtgcagccagttgctggcgctgaggcagccccagccgctaccctggctgctctcgggggaagacgtcccggtcctccggaagagccacccagggagctggaatctgttcctagcaaactaggcgagcctccacccctgggcgaagggggaggcggtggcggtgagggcggaggagcaggtggaggatctggggagcgagagggtggcgcaccccagcctccgccacccaggggatggcgcggaaagggcgtacgggctcagcagaggggcggtagtggcggagagggggcttctcccagtccgtcgtcttccagtgctggcaagacccccggtacgggatcaaggaactcaggttccggtgtggccggtgggggtagtggagggggagggtcttattggaaggagggctgcctgcagtccgagcttatccagtttcatttgaagaaagaaagagccgctgcggcagccgcagcagctcagatgcacgccaagaatggaggcggatctagtagtcggagcagtccagtctccggccctcccgctgtatgtgaaacactcgctgtggcaagcgccagtcctatggcagcagcggctgaaggccctcaacagagcgcagagggatctgccagcggcggaggcatgcaagctgccgcacctccaagctcccagccccacccacagcagttgcaggaacaggaggagatgcaggaggagatggaaaaactccgggaggaaaatgaaactctcaagaatgagatcgacgagctgagaacggaaatggacgagatgagagacaccttctttgaagaggatgcttgtcagcttcaagaaatgcgccacgaactcgagcgggctaacaagaactgtcgcatcctgcaatacaggttacggaaagccgagagaaagaggctgagatatgcccaaactggagaaattgatggggaactgctgagaagcctggagcaggacctcaaagtggcaaaagatgtgtccgtgaggcttcatcacgagctggagaatgtcgaagagaaaagaactacgaccgaggatgagaacgagaagctgaggcagcagttaatcgaggttgagattgctaagcaagctctgcagaacgaactagaaaagatgaaagagctctctcttaagaggagagggtcaaaagatctcccaaagtcagaaaaaaaggcccagcagacccctactgaggaggacaatgaggatctgaaatgtcagctccaatttgtcaaggaggaggccgctcttatgcggaagaaaatggcaaagatagataaggaaaaagatcggttcgaacacgagctacaaaaatatcgctccttttatggcgatctcgactctcccctgcctaaaggcgaggcaggtggaccaccctctacgagggaggcggagctcaaactcaggctcagactggtcgaggaggaggctaacattcttggcagaaagattgttgagctcgaagtggagaatcgaggcctcaaagctgagttggatgacctccggggtgatgatttcaacggtagcgccaacccgttgatgagggaacaatctgagtccctgtctgaactccgacagcacctccagttggtggaggacgaaacagagctcctgcgccgaaacgtcgcggatcttgaggagcagaacaagaggattacagcagagctgaataagtacaagtacaaaagcgggggacatgattctgctcggcaccacgacaacgcaaaaacggaggccctgcaggaggagttgaaggccgctcgtctccaaatcaatgagttatctggaaaggttatgcagctgcagtatgaaaatagggttttaatgtccaacatgcagaggtacgaccttgcctcgcacctgggtattcgaggatcaccaagagatagtgacgccgaaagcgatgcaggtaagaaggaaagcgatgatgatagtcggccaccccatcggaagcgagagggccctatcggtggggagtcggattcggaggaagtacgaaatatccgctgcttaacacctacccgctctttctatccagccccaggcccatggccaaagtcattcagcgacaggcaacagatgaaggacataaggtctgaggctgaacgcttaggaaaaaccatcgatcgcttaattgcggacacaagcactatcattacagaagcacgcatttatgtcgctaatggggatttattcggattgatggatgaagaggatgacggcagtcgaatccgcgagcacgagttgttgtacagaatcaatgcccagatgaaggccttccgtaaggaactgcaaaccttcatcgatcgactggaggtgccaaagtcagccgatgatcgtggggcagaagaaccgattagcgtttcccaaatgttccagccgatcattctgttgattttgatactagtcctgttctcctctctctcgtacaccactatctttaagctagtctttctttttaccctctttttcgtgttgtag

SEQ ID NO: 49322 - DNA, 387 bp, Artificial Sequence
  Description of Artificial Sequence: Synthetic coding sequence
atggctctccaagttagggtcgcccctagcaaggtggtgctgcagaagtttttgctttgcgtgattttattctataccgtctactacgtgtccctgtcaatgggatgtgttatgttcgaagtgcatgaactcaatgtgctggccccattcgatttcaagactaatccatcttggctgaacatcaattataaggtacttcttgtgagcacagaagtcacatacttcgtatgtggcctgttttttgtgcccgtggtagaggagtgggtctgggattacgccatctcagtaacaatactgcacgtcgctattacatcaaccgttatgttggaattccccctgacaagtcactggtgggctgcgctgggtattagcaaactgcttgtttag

SEQ ID NO: 49323 - DNA, 387 bp, Artificial Sequence
  Description of Artificial Sequence: Synthetic coding sequence
atggcattacaggtccgggtcgcgccttcaaaggtagtgctccagaagttcctgctatgcgtgattttgttttacacagtttattatgtgtcactgtctatggggtgtgtgatgtttgaggtgcacgaactcaacgtgctggctccattcgacttcaagacaaaccccagctggttgaacattaattacaaggtcctgttagtgtcgactgaggtgacatactttgtgtgcggtcttttcttcgtacctgtggtggaggagtgggtgtgggattacgctatctcagtgacaatcctccacgtggctatcactagtacagtaatgctggaatttcctcttacctcccactggtgggccgcactaggcatctcgaagctgcttgtatag

SEQ ID NO: 49324 - DNA, 723 bp, Artificial Sequence
  Description of Artificial Sequence: Synthetic coding sequence
atggccatggccagtgttaagctactagctggggtgctgcgaaaacctgacgcatggatcggcctgtggggggtgctgagggggacaccctctagctacaagctgtgcacatcttggaatagatatctttacttcagtagcaccaagctgcgggcaccgaactataagaccctcttttacaacatcttttccctccggctgcccggtctgctgctctcacctgaatgtatcttccctttctcggtgcgtctgaaatccaacattcgttctaccaagtccaccaagaaaagcctgcagaaggtagacgaggaggatagcgacgaagagtcacatcatgatgagatgtctgagcaggaggaggagttggaagatgaccccacagtcgtcaaaaactataaagacctcgagaaggccgtgcagtcgttccggtacgacgtggtactgaagactggcctggacatcggaagaaataaagtcgaggacgccttttataagggcgaactgagactgaatgaggaaaagctctggaagaaatcccgaacagttaaggtgggtgacaccttagacctcctcataggggaagataaggaagctggcactgagactgtcatgcgcattctgttgaagaaagtgttcgaagagaagaccgaaagcgaaaagtatcgcgtggtgttgcgaaggtggaagtcactgaagcttcctaagaaaaggatgagcaaatag

SEQ ID NO: 49325 - DNA, 723 bp, Artificial Sequence
  Description of Artificial Sequence: Synthetic coding sequence
atggccatggcctctgttaaattgctcgcaggagtccttcggaagcccgacgcctggattgggctctggggagtgctacgcggaacgccctcatcttataaactctgcacaagttggaaccggtatctgtatttcagctctactaagctgagagcacctaattataaaactctgttttacaatatctttagcctcaggctgcccggtctcctgctgtcacctgaatgcatcttcccattctccgtcaggcttaagtctaatattaggtcaacaaaaagtaccaaaaagagcttgcaaaaagttgatgaggaagattccgatgaggaaagccaccacgacgagatgtccgagcaagaggaggaattggaagacgacccaaccgttgtcaagaactataaggatctcgagaaggcagtccagagcttcaggtacgacgtcgtgctgaagacaggtctggacattggcagaaataaagttgaggacgccttttataagggcgaacttaggttaaacgaagaaaagctttggaagaagtctaggaccgtgaaagtcggagatacgctagacctgctgattggtgaagacaaggaggcagggacggaaactgtcatgaggattcttcttaaaaaggttttcgaggagaagaccgaaagcgaaaaataccgcgtggtactacgacggtggaagagcctgaaactgccgaaaaagaggatgagtaagtag

SEQ ID NO: 49326 - DNA, 738 bp, Artificial Sequence
  Description of Artificial Sequence: Synthetic coding sequence
atgataattagtgccatggcgatggcctcagtcaagttgctggccggtgtgctgagaaagcctgacgcttggatcggactgtggggggtcctgcgcggaacaccctcaagctataagctgtgcaccagctggaaccgctacctgtacttcagctccacaaagctaagagctcccaactataagaccctgttctacaatatctttagccttagacttcccggtctgcttctctctccagagtgtatattcccttttagcgtgcggctgaagtccaatattagatctaccaagagcaccaaaaagagcttgcagaaagtagatgaggaggacagcgatgaggagagtcaccacgatgagatgagcgaacaggaagaggagcttgaagacgaccctaccgttgttaaaaactacaaagatcttgagaaggccgtacagagcttcagatacgatgtggttctcaagacggggcttgacataggacggaacaaggtagaagacgctttctacaagggtgaactcaggttgaacgaggaaaaactgtggaaaaagtctcgcacagttaaagtgggtgacacacttgatctgctgataggggaggataaggaggccggtacggaaactgtcatgcgaatcctcctgaagaaagtgttcgaagagaagaccgaaagtgaaaagtacagagtcgtgctccgaaggtggaaatcgctcaagctccctaagaagaggatgtcaaagtag

SEQ ID NO: 49327 - DNA, 582 bp, Artificial Sequence
  Description of Artificial Sequence: Synthetic coding sequence
atggccgtcttcctccaactgctccccttgttactgtcacgtgcccagggaaatccgggagccagtctcgacggaagacctggggatagggtcaatctgtcttgcggcggtgtgagccaccccatcagatgggtgtgggctccaagcttcccagcctgtaaggggttgagcaaaggacggcgacctatcctgtgggcaagcagtagcggcacacccactgtcccccctctccagccattcgtgggcaggcttagatcccttgactctggaatccggagactggaactgctgctgtctgcaggcgacagcgggacatttttttgcaagggccgacatgaggatgaaagccgtacagtcctgcatgtcctgggagatcgcacctactgtaaagctccgggaccgacccacgcactgtcccctccccactctagtacctgcgaaaatcgcgctccagaagccagcaagggtggtagggctcaggatagtagaggccctgggccaggcactgaacccgcactgtgcgggtccgggccatctagcccccagcaggctccgccagctgtgcattccggaccctgctag

SEQ ID NO: 49328 - DNA, 654 bp, Artificial Sequence
  Description of Artificial Sequence: Synthetic coding sequence
atggccgtgttcctccaattgctccccctgctactgtccagagcgcagggtaatcctggagccagcctcgatgggaggcctggcgatagggttaacctctcttgcgggggagtgtctcatcccatccgatgggtctgggcgccaagcttcccggcttgtaagggtctatcaaagggacgaagaccaatactgtgggccagttcttccggcacccctacggtgcccccactgcagccgtttgttgggagattacgctcactagactctggcattagaaggctagaactgctgctcagtgccggagattctggtacatttttttgcaagggccgtcatgaagatgagagtcggaccgtgctacacgtcctgggggataggacatactgcaaagccccaggtccaacgcacggtgcttgcccgaggaacagattcgaccactccctggatttgttgtgcccacctcatatcgcaccgttagtaaaaacagagccacaaagaccagtgaaggaagaggaacccaagatcccaggggacttggatcaagaacccagtctgctctacgccgacttggatcacctggccctaagcagacctagaaggcttagcaccgccgatcctgcggatgcaagcaccatttatgccgtggttgtctag

SEQ ID NO: 49329 - DNA, 726 bp, Artificial Sequence
  Description of Artificial Sequence: Synthetic coding sequence
atggcggtgttcttgcagcttctcccgctacttctcagccgcgctcaggggaatcccggagcatcattggacggcagaccgggagatagggttaatcttagctgcggcggtgtgtcccacccaatccggtgggtctgggcgccatcattccccgcttgtaaaggactgagcaaaggacgcaggcccatactctgggcctccagctcagggacacctaccgtgcctcctttacagccttttgtcgggagactgcgcagcttggattcgggcattagacgcctcgaacttcttttaagcgccggagactctggcacctttttctgcaagggcagacacgaggatgagagcagaaccgtgttgcacgtgctgggagaccggacatactgcaaggcaccaggacctactcacggttcggtgtatcctcagctcctcatccccctgttgggcgcaggcctagtattaggccttggcgctcttgggctggtctggtggctccataggcgcctgccccctcagcctatccggcctctccccagatttgctccgctcgtcaagacagaaccacagcggcctgtgaaagaggaggaaccgaagatacccggtgacctcgatcaggagccatcactcttgtatgctgaccttgaccatctggcactgtcaagacccagaaggctgtcaaccgccgaccctgcagatgcctctactatctatgctgtagtggtgtag

SEQ ID NO: 49330 - DNA, 714 bp, Artificial Sequence
  Description of Artificial Sequence: Synthetic coding sequence
atggccgttttcctccaattgctgcccctcttactgtccagggctcagggaaatccaggcgcaagtctggacggcaggcccggagacagagtcaatttgagttgcgggggtgtgtcccatcccatacgctgggtgtgggcaccaagtttcccagcctgtaaggggctgagcaaaggaaggcgccctatactttgggcatccagtagcggaacccctaccgtcccaccactgcagccatttgtaggaaggctacggtcccttgattcaggtattcgccgactagaactactgttatcagctggggatagcgggacatttttctgtaaagggagacacgaggatgagtccagaactgtgctgcacgtacttggcgatagaacttactgtaaagcaccagggcctacgcatggcagcgtatacccgcagttgctcatccccctgctcggagctggcctggtcctgggcctcggagcgctggggctggtgtggtggctgcacaggcggctaccccctcagcctatacggccactcccccgttttgctctttcaccccctcacagctcaacctgtgaaaatagggcccctgaagcaagcaaaggaggcagggcccaggactccagaggaccaggaccagggactgaaccggcactatgcggaagcgggccaagttctccacagcaagcccctccagctgtacactcagggccttgttag

SEQ ID NO: 49331 - DNA, 669 bp, Artificial Sequence
  Description of Artificial Sequence: Synthetic coding sequence
atggcggtgttcctccagttactcccgctgctgctttccagggcacaggggaacccgggagcttccttagatgggagacccggagacagagtgaatctctcgtgtggtggagttagtcacccgatacggtgggtgtgggcgccaagctttcctgcatgcaaggggcttagcaagggacggaggcccatattgtgggcatcttcatccggaactcctaccgttccacctttgcagcctttcgtcggacggctcagaagcctggacagcggaatcaggcgactcgagctgctgctgtcagccggtgactcaggaactttcttttgtaagggccgacacgaggatgagagtaggaccgtccttcacgtgttgggggatcggacctactgcaaggcaccaggacccactcacgggagcgtgtaccctcaactgctgattccacttcttggagctggcctcgttttgggtttaggtgcactcggactggtgtggtggctgcataggagactcccaccccagccaattagacctcttcctaggttcgcgctgtcccctccgcactccagtacatgtgagaaccgggctcccgaggcgtcaaaggggggtcgcgcacaggactctcgtgggcctggtcctggcaccggaaaggggatgggaatgggcagaggctag

SEQ ID NO: 49332 - DNA, 594 bp, Artificial Sequence
  Description of Artificial Sequence: Synthetic coding sequence
atggcggtcttccttcagctccttcccttactcctcagccgcgctcaagggaaccccggtgcctcactggatggcaggccgggagacagggttaacctttcctgcggaggagtatcacacccgatccgttgggtgtgggccccttcgtttcccgcttgcaaggggctgtctaagggccgtcggccaattctgtgggcatcctccagcggtactccaaccgtccctcccctccagccctttgtcgggaggttgcgatctctggactctggcatcaggcgcctggagctgctgcttagtgccggagatagcggaacattcttctgcaaaggcagacacgaggatgagagcaggaccgtgctgcacgtcctcggagaccgcacttattgcaaggctcccggacccacgcacgcacccctggtgaagactgagccccaaagaccagtcaaggaggaggagcccaagattccgggagacttggatcaggagccgtctctgctgtacgcagatttagaccatctcgccctgtctcgcccacgccgtctgtccacggcagaccccgcagacgcctcaactatctacgccgtcgtcgtgtag

SEQ ID NO: 49333 - DNA, 594 bp, Artificial Sequence
  Description of Artificial Sequence: Synthetic coding sequence
atggccgtgtttctccagttgcttcctctccttttgagtagggcacagggaaaccctggcgcatctttggatggaaggccgggtgaccgggtgaatctgtcttgtggtggggtctcgcatcctattcggtgggtgtgggcgccttccttccctgcctgcaagggcctgagtaagggaaggagaccgatattatgggcgtccagctcaggcactccgacggtgccaccattgcagccatttgtggggcgacttcgctcactagattcaggcatccgcagactagagctgctgctgagtgccggagattccggcaccttcttctgcaaagggcgacacgaagatgaatcaaggactgtcctgcatgtcctgggcgaccgaacctactgtaaggcccctggacctactcacgcccctctggttaagacggagcctcagaggccggtgaaagaggaggaaccgaagatccctggtgaccttgaccaggaacctagcctgctctatgccgatctggaccatctcgctctcagccggcctcgtcgactctcaaccgccgatcctgccgatgccagcaccatttacgcggttgttgtatag

SEQ ID NO: 49334 - DNA, 654 bp, Artificial Sequence
  Description of Artificial Sequence: Synthetic coding sequence
atggcagtgttcctccaattgctgcctctgcttttgagccgggctcagggcaacccgggagcctcattagacggtaggcccggtgatcgagtcaacctaagctgtggtggcgtctctcaccccattcggtgggtgtgggccccatcctttcccgcttgtaagggcttgagcaagggacgacggccaatcctttgggcttcttcaagcggcactcctactgtgcctcccttgcagccctttgtaggacgcctccggagcttggactcgggtattcgtcgcctagagctgctgcttagcgccggagattccggaacgtttttctgcaaagggagacatgaagatgagagtcgaacagtgctccacgttttaggggatagaacatactgcaaagcccctggaccgacacatggggcttgccctagaaaccgctttgatcacagcctggacctcctgtgtccacctcacatcgcaccactcgtcaaaactgaacctcagagacctgtgaaagaggaagagcctaagattcccggagacctggatcaggagcctagcctgctctatgctgacttagaccaccttgctctgtctcggccacgaaggctgagcaccgccgatccggctgacgcctcgactatttatgccgttgtggtatag

SEQ ID NO: 49335 - DNA, 714 bp, Artificial Sequence
  Description of Artificial Sequence: Synthetic coding sequence
atggcggtattcctgcaacttttgcctctgctgctgtctagagcccagggaaaccctggggctagtcttgatgggagacccggagatcgggtgaatctgtcctgcgggggagtgtctcacccgattcgatgggtgtgggccccatcctttcctgcctgtaaagggctgtccaagggcaggaggccaatactatgggcaagttcaagtggaacacccactgttccacccctgcagcccttcgtcggaaggctgcggtccctggatagcggaatacggcgtcttgaattgctattgtcagcgggtgatagcggcactttcttttgcaagggcagacacgaggacgagtctcgcaccgtgcttcacgtgctaggagaccgtacatattgtaaagcccctggccctacacacggctcagtttatcctcagctattgattcccctgttgggtgctggtctggtgttggggctaggcgctcttggtctggtatggtggctccaccgacgactgccccctcagccaatccggcctttgccacgtttcgctctcagtcctcctcatagctcaacgtgtgagaatagggcccctgaagcttcaaaagggggaagggcccaggattccaggggcccaggtccaggcacagagccagcgctctgtggttcggggccttccagtccacaacaggctccgcctgccgtccacagcggaccctgctag

SEQ ID NO: 49336 - DNA, 582 bp, Artificial Sequence
  Description of Artificial Sequence: Synthetic coding sequence
atggcggtgttcctgcagctactgcccctactgttgagccgggcacagggaaacccaggcgcatctctggatggtaggcccggagacagagtgaacttaagctgtgggggagtttcgcacccaattaggtgggtgtgggccccttccttccccgcatgtaaaggcctgagtaaagggaggcggcctatcctgtgggccagctcttctgggactcccacagtcccccctctgcagcccttcgtgggtaggcttagatcactggattctggaataaggaggctagaacttctactcagtgcgggagacagtgggacctttttctgtaaaggcaggcacgaggacgaaagcagaaccgtcctacacgttctcggagaccggacatattgtaaggctcctggacctacacacgcactaagtccccctcacagctccacctgcgagaatcgagctcccgaagcatcgaaagggggaagggcacaggattctagagggccagggcctgggactgagcctgcattatgtgggagtggaccctcatccccacagcaggcgccacctgctgtacactctgggccttgttag

SEQ ID NO: 49337 - DNA, 726 bp, Artificial Sequence
  Description of Artificial Sequence: Synthetic coding sequence
atggcggtcttcctccagcttcttcctctgctgctgagccgcgctcaaggcaatcccggtgcctcactggacgggagacccggtgatcgagtgaatttgtcctgtggcggtgtcagtcatcctattcgctgggtttgggcaccatcttttccggcatgcaaaggtctgagcaaaggcaggagacctattctgtgggcaagttcatcaggaacacccacagtacccccactgcaacccttcgtcggaagactcaggagccttgactccggtataaggcgcctggagctgttactctcagccggtgacagtggaacctttttctgcaaaggcagacatgaggacgagtcgcgcacggttctgcacgtgcttggtgataggacatactgcaaagccccaggccctacccatggctctgtctacccccagctcttgattccccttttgggcgctggtctagtactggggttgggggctctcggactggtgtggtggctacatagaaggttgccacctcaacccatccgccctctccctcgtttcgcacctcttgtgaaaacagaaccccagcgcccagtgaaagaagaggagcccaaaataccgggagaccttgatcaggagcccagtctcttatacgcagacttagatcacttggctcttagtaggcctagacgactgtcgacagcagatcccgctgacgcatccaccatctacgcggtggtcgtctag

SEQ ID NO: 49338 - DNA, 726 bp, Artificial Sequence
  Description of Artificial Sequence: Synthetic coding sequence
atggctgtgtttctccagctgcttccgctgctattgtctcgcgctcagggaaatcccggagcaagtcttgatgggagacctggagacagggtgaatctaagttgtggcggagtgagccaccctataagatgggtgtgggccccttcctttcctgcgtgtaaaggcctctcgaaaggaaggcggcctatactatgggcctctagctccggtaccccgaccgtgccacctctgcagccatttgtcgggcgtctgagatccttggatagcggaataagacgattggaactgcttctgagtgcgggtgatagtggcaccttcttttgtaagggcaggcacgaggacgagtctcgcacagtcttgcacgttttgggagacagaacatattgcaaggcacccggacctacccatgggtccgtgtaccctcagctcctcattcctctcctgggcgcaggattggtgctgggtctgggtgcactaggactggtctggtggctacacagaagattgccaccacagcccattaggcctctccctagattcgccccattagtgaagactgagcctcagaggccggtgaaggaagaggagcctaaaatccccggagacctggatcaggagccatccttgttgtacgctgatctagaccatctcgccctgtcaagacctaggaggttgagcactgctgatcccgcagatgcgtctacaatatatgccgtggtggtttag

SEQ ID NO: 49339 - DNA, 594 bp, Artificial Sequence
  Description of Artificial Sequence: Synthetic coding sequence
atggcagtttttttgcagcttctgcccctgttgttaagcagagctcaaggcaatccaggtgcctcgctagacggacgccctggcgatcgggtgaacctgtcctgcggaggcgtaagccatcctattcggtgggtgtgggctccttcttttcccgcttgtaaggggctatccaagggacgacgccctatcctttgggcatcaagtagcggaacccccaccgtgcctccccttcagccctttgtgggcaggttgcgctctcttgatagtggaatccgaagactggagctcttgttgagcgctggagatagcgggacattcttttgcaagggacggcacgaagatgaaagccgcactgtcctgcacgtgctcggtgaccgcacatattgtaaggccccaggcccaacgcacgcacccctggtgaagaccgaaccccagaggcccgtcaaagaggaagagccaaagatcccgggagacctggaccaggagcccagcctcctctatgccgacctcgatcacctagccctgagcagaccacgacggctttccactgcagacccagctgatgcttctactatctacgctgtcgtagtctag

SEQ ID NO: 49340 - DNA, 582 bp, Artificial Sequence
  Description of Artificial Sequence: Synthetic coding sequence
atggctgtgtttctgcagcttctgccacttctgctctcccgtgcccagggtaatcctggcgcaagtttagacgggaggcctggggatcgagtaaacctgtcatgtggtggcgtgtctcatccaatacggtgggtctgggccccatcatttcccgcttgtaaagggttatctaaaggaaggcggccaatcctatgggccagtagttctgggactcctacagtcccacccctgcagccttttgtggggagactccggtctctggactccggcattcgacgcctggagctgctactgagtgcaggcgactcagggacattcttctgcaagggtcgacacgaggatgagagcagaaccgtccttcatgttttgggagaccggacatattgcaaggcgccaggacccacccacgccctttctcctccacacagttcgacatgcgagaaccgagctcctgaagccagtaaagggggaagagcccaggactcacggggtccaggtccgggaaccgagccagccctttgtgggtccggaccctcatctccacagcaggcacccccagcagtacactctgggccatgctag

SEQ ID NO: 49341 - DNA, 654 bp, Artificial Sequence
  Description of Artificial Sequence: Synthetic coding sequence
atggccgtgttcctgcagctgctgcccctgctgctgagccgagctcaaggcaatccaggcgctagtttggatggcaggcctggagacagagtcaatttgagctgcggtggagtgtctcacccaatccggtgggtctgggcaccaagctttcccgcatgcaaggggctgagcaaaggtcggagaccaatactctgggcatcatccagcggtacgccgacagtcccccctctgcagccctttgttggaaggctccggtctctcgacagcggaattagaagactggaactgctgctctctgccggtgacagcggtacattcttttgcaaaggtaggcacgaggatgaaagtagaacagtattgcatgtgcttggcgatagaacctactgcaaagccccaggtcctacacatggcgcatgtcccaggaatcgctttgatcatagtctggacctgctgtgcccaccccatatagcccctctcgtcaaaaccgagcctcagcgccctgtgaaagaagaggaaccaaaaatacccggagatcttgaccaggaaccctctctcctctacgctgatttggatcacctggcactctctaggccacgaagactaagcaccgctgacccagccgatgcatctactatttatgctgtggttgtctag

SEQ ID NO: 49342 - DNA, 582 bp, Artificial Sequence
  Description of Artificial Sequence: Synthetic coding sequence
atggcagtgtttttgcagcttttgcctctgttgcttagtcgtgcgcagggtaaccctggggcttcattggatggacggccaggggatagagtgaatctttcctgtggcggagttagccatcctatccggtgggtgtgggccccatcgttcccagcttgcaagggcctctctaaaggccgacggccaattctctgggccagtagctctggaaccccgacagtacccccattacagccgtttgtgggacgcttgcggagccttgatagcggtatcagacggctagaactgcttttgtcagcgggagattccggcacattcttttgtaaaggcaggcacgaagacgaaagccggacagtgcttcacgtacttggagaccggacctactgtaaggctcctggcccaacacatgcgctgtcaccaccacattccagcacatgtgagaaccgggctccagaagcaagcaaggggggacgcgctcaggatagtcgcggacccggaccgggaaccgaaccagcgctctgcgggtcgggcccatccagccctcagcaggctccccctgctgtacattccggaccttgttag

SEQ ID NO: 49343 - DNA, 714 bp, Artificial Sequence
  Description of Artificial Sequence: Synthetic coding sequence
atggcagtctttctgcagctcctgccactgcttctcagcagagctcagggtaatcccggtgcctcattggatggacggccaggcgatcgtgtaaacctctcatgtggaggggtttcacaccccattcgctgggtctgggccccaagctttccagcttgtaaaggactcagtaagggtcgaagacctattctttgggcatcttcttcaggcacccctactgtaccacccttgcagccatttgtaggtcggctgcggtcactggatagtggcatcagacgccttgagttgctgctgagtgcaggagatagcggcaccttcttttgcaagggccgtcacgaagatgagtcacggacggtgctgcacgtactgggagacagaacctattgtaaggcacccggacctacccatgggtccgtctatcctcagctacttattcctttgctgggtgctgggctggtgttgggtttgggcgcattaggattagtgtggtggctacatcgcaggcttccaccccaaccaatccgaccactgcctcgtttcgcccttagccccccacactcttcaacctgcgaaaacagagcacccgaggcgagtaagggcggaagggcccaggactcgagaggccctgggcctggtacagaacctgcactttgcggttccggccctagcagtcctcaacaggccccacctgccgtccactccggcccttgctag

SEQ ID NO: 49344 - DNA, 714 bp, Artificial Sequence
  Description of Artificial Sequence: Synthetic coding sequence
atggccgtgtttttgcagctcctgcccctcctgctgtcacgagcccagggcaatcccggagcctccttggacggccgacccggagatagagtcaacctaagctgtgggggtgtatcacatccgattcgatgggtttgggctccctctttcccggcttgtaagggtctgtctaaagggagacgccctatactatgggcttcttctagtggcaccccaactgtcccgccactgcagcctttcgtaggacggctacgttcgctggattcagggattcgacgtctcgagttactgctcagcgctggtgactccgggaccttcttctgcaagggacgtcatgaagatgaatctcggacagttttacacgtgcttggagaccgcacgtactgcaaagctccaggtccaacgcatggtagtgtctacccacagctgctcatcccgttgcttggagctggattagttctgggactaggcgctttgggcctggtctggtggctccatcggcgacttcctccccagccaattcgtcctctccccagattcgccctgagtcctccccatagttcaacttgtgagaatcgggctcctgaggcctccaaagggggtagagcgcaagattctcgcggaccgggacccggaacagagcctgccctgtgcgggtccggccctagctcgccacaacaggcccctcccgctgtccatagcgggccatgctag

SEQ ID NO: 49345 - DNA, 594 bp, Artificial Sequence
  Description of Artificial Sequence: Synthetic coding sequence
atggccgtgttcctgcagctgctcccgctcctgctttcgagggcccaaggcaatcccggtgcttccttagacggcaggcccggagatagggtgaacttaagctgcggcggagtgagccatccgattaggtgggtgtgggctcccagcttccctgcatgcaagggcttgtcaaaaggcagaaggccaatcctctgggcttcgtccagcgggactcccaccgttcccccactccaacccttcgtgggccgtctgcgtagccttgacagtggcataaggcgtctggagctcctcttgagtgcgggagattcgggaacgttcttctgtaagggcagacacgaggacgaatctcggactgtcttgcatgtgctgggggatagaacttactgcaaggctcccggacctacccacgcccctctggtgaagacagagcctcagcgacccgttaaagaagaggagccaaagataccgggtgatctggaccaagagcctagcctgctgtatgcagacttggaccacctggccttgagtcggcctaggcggctaagcacagctgaccccgcagatgcatctacgatttacgcagttgttgtgtag

SEQ ID NO: 49346 - DNA, 654 bp, Artificial Sequence
  Description of Artificial Sequence: Synthetic coding sequence
atggccgtgttcctccagctgctgcctctactgctgagtcgggctcaggggaatcccggtgcttccttagacgggagaccgggtgatcgcgtgaatctgtcttgcggcggtgtctcccatcctatccgctgggtgtgggctccaagcttccccgcatgtaaaggcctctctaaaggacgcaggcccatcctctgggcctcatccagtgggacacccactgtgcccccactccaaccttttgtcggacgcctccgcagtttggactcaggaattcgccgtctcgagcttcttctgtctgcaggggacagtggaaccttcttttgtaagggcagacatgaggatgagagtcggaccgtccttcatgtgctaggggaccgaacatattgcaaagccccaggccctactcacggtgcttgcccgcgaaaccgattcgaccatagtcttgacctgctgtgtccgccacacatcgcccctcttgtcaaaactgaaccccagcgaccagtcaaagaggaggagccaaaaatacctggagacctggaccaagaacctagcctgctgtacgctgatttggatcaccttgcgttgagccggcctagacggctgtccaccgccgatcccgcagacgccagtaccatttacgcagtggttgtctag

SEQ ID NO: 49347 - DNA, 726 bp, Artificial Sequence
  Description of Artificial Sequence: Synthetic coding sequence
atggctgtctttcttcaactgcttccactgttgttaagtagggcccaggggaatcccggagccagtctagacggacgccctggagatagggtcaatttgagttgcggcggagtgtcacacccaatccggtgggtctgggctcctagcttcccagcttgtaaaggactgtcaaagggcagaaggccgatactgtgggcctcttccagtggcacacctacggtgcccccactccagccttttgttgggaggctcaggtccctggattccggcatcagaaggctagaactcctcttaagtgccggagattctgggacttttttctgtaagggtaggcacgaggatgagagcaggaccgtgctgcacgtgctcggtgaccgaacttattgtaaggctccgggacctacccacggaagtgtatatccgcagctattgatccccttgttgggagctgggttagtgctcggactaggggctctgggcctcgtctggtggcttcaccgacggctcccccctcagccaataaggccccttcctagattcgccccattggtgaagacagaaccacagagacccgttaaggaagaagagcctaagattccgggagacctggaccaggagccctccctgctgtatgctgacctcgatcacctcgccctgtcacgacctcggaggctgagcaccgccgatcctgccgatgcctcaacaatctatgccgtggtagtttag

SEQ ID NO: 49348 - DNA, 582 bp, Artificial Sequence
  Description of Artificial Sequence: Synthetic coding sequence
atggcagtattcctgcagctccttcccttactcctgtctcgcgcacaggggaaccctggcgcatccctcgacggacgacccggtgacagggtgaacctctcctgtggcggtgttagccatcctatcaggtgggtctgggctccttccttcccggcatgcaaagggctctctaaggggagaagacctatcctttgggcttcaagcagcggcacgccgacagtcccgccactgcagcctttcgttggcagactgcgctcgctggattcgggaattcggagattggaactgctgcttagcgccggtgatagtggcacttttttctgcaagggccgtcatgaagacgagtccagaaccgtattacacgttttaggagaccggacttattgtaaggcccctggaccaacccatgcgctgagtccccctcacagctcaacatgtgaaaacagggcaccagaagctagtaaaggcggacgtgcgcaggacagcagggggcctggtccgggtacagagccggctctgtgcggtagtggcccatctagccctcagcaggccccaccagctgtccactctggcccttgctag

SEQ ID NO: 49349 - DNA, 582 bp, Artificial Sequence
  Description of Artificial Sequence: Synthetic coding sequence
atggctgttttcctccaactcttacctctgctgctaagcagagctcagggcaacccaggtgccagtctcgatggacgtcccggtgatcgcgttaacctgagttgtggtggtgttagccacccgatccgatgggtctgggccccttcatttccggcttgcaaaggcttatcaaagggccgacgccctatcctgtgggctagcagttcgggtacacccacggtcccacctctccaacctttcgtaggtcggctgcgatctttggattcgggtatccggagactcgaactcctcctctcagcaggcgacagcgggacgtttttttgcaaaggcaggcacgaagatgaaagcagaactgtactgcatgttcttggcgaccggacttattgtaaggcgcctgggcctacccatgccttatctccacctcactcatcaacatgcgaaaatcgagctcccgaagcaagcaaaggaggtagggcccaagatagccgcggtcctgggcctgggacagagcccgctctgtgtggcagcggtccctcttcaccccagcaagccccacctgcggtacacagtggtccctgctag

SEQ ID NO: 49350 - DNA, 714 bp, Artificial Sequence
  Description of Artificial Sequence: Synthetic coding sequence
atggcggtgttcctgcagctgttgcctttactgctctctcgggcacaggggaatcccggtgcatcattggacgggcgaccaggcgatagagttaatttgagttgtgggggagtcagccaccctataagatgggtgtgggctccatcgttcccagcttgcaagggactgtccaaaggacgcaggcctatcctgtgggcctcttccagtggaacccccacagtccccccacttcagccttttgttgggaggttacgaagcctggattctgggattcgcagactggagctgctcctgtccgccggtgattcagggactttcttctgcaagggacgtcatgaggatgaatcacggactgttctgcatgtgttaggcgaccggacttattgtaaggctcccggacccacacacgggtctgtctatccacagctgctgatcccccttttaggggctggcttggtattaggcttgggagccttagggcttgtttggtggctacaccgtcgcctgccccctcagccgatacgcccactgcctcgcttcgctctttcgccaccccatagttctacatgcgagaatagagccccagaggcatctaagggcggtcgcgcacaggattcgcgcggtccagggccaggcacagagcccgctttgtgcggcagcgggccaagttcgccacaacaggctcctccggctgtgcatagtggaccttgctag

SEQ ID NO: 49351 - DNA, 654 bp, Artificial Sequence
  Description of Artificial Sequence: Synthetic coding sequence
atggccgtgttcctgcagctactccctctactgctctctcgcgctcaaggtaatcccggagcctctcttgatggtcgcccaggcgaccgggtaaatttaagctgtggcggagtctcccacccaatacggtgggtgtgggccccttctttcccggcatgtaagggcctctctaaaggcagacgtcccatcctgtgggcttcatctagcgggactccaacagtgccccctctccagccctttgtgggaaggttgagatcactggattcaggcatccgcaggttagagctccttctctctgcaggcgattccggtacgtttttttgcaaaggcagacatgaagatgaaagcaggaccgttctacatgtcttaggagaccggacatactgtaaagccccaggccctactcacggagcctgcccacggaataggttcgaccattcactcgacttattatgtccccctcatatcgctcccctggtcaagaccgagccccagcgaccagtaaaggaggaggaacctaagatccctggggaccttgaccaggaaccatcacttttatacgccgacctcgaccacttggccctctctcgtcctcggagactgagtacagctgatcctgctgacgcgtctaccatctatgccgtagtggtttag

SEQ ID NO: 49352 - DNA, 726 bp, Artificial Sequence
  Description of Artificial Sequence: Synthetic coding sequence
atggccgtgttcttacagctattgcccctcttgctgtctcgcgctcaggggaatccaggagctagtctggatggacgaccaggggaccgcgtgaacctgagttgcgggggagtgagccatcctatcagatgggtctgggctccctcatttcccgcatgcaaaggcctttctaaagggcgacggccaatcctatgggcgtcttcgagtggaaccccaacagttcccccattgcagccgttcgtaggcaggctgcgttcactggattccggcatccgcagactcgaactcctgctttcagccggagattctggcaccttcttttgcaagggtcggcatgaggatgagagtcgaacagtgctgcatgtgctgggcgaccggacttattgtaaagcacctgggcctacccatggtagtgtatatccccagctgctgatccccttactaggtgcgggacttgtcctgggcctgggcgctctgggcctggtgtggtggctgcaccggagactgccccctcagcctatcagacccttgccgaggttcgctcccctcgtgaaaactgaaccgcagcgcccagttaaagaggaggaaccaaaaatccccggagacctagatcaggagcccagtcttctttatgccgatctggaccatcttgcattgagtaggcccaggcgccttagcaccgccgaccctgccgatgctagtaccatctatgctgtggtcgtgtag

SEQ ID NO: 49353 - DNA, 594 bp, Artificial Sequence
  Description of Artificial Sequence: Synthetic coding sequence
atggccgtctttttacagctgttgcccctgttactatctagagcccagggtaaccctggcgcaagcttagacggtcgcccaggagacagagtcaacctctcctgcgggggtgtttcccaccctataagatgggtttgggcaccttcattccccgcttgcaaggggcttagcaaagggagacgtccaatattgtgggcttcttcatccgggactcccacggtgcccccactccagccgtttgtgggcaggctgcgctcactggactccggaattcgcaggctggagctgctgctgagtgccggtgacagcggcacttttttttgcaaaggaaggcacgaggacgagagtcgtactgtgcttcacgtgctgggagacagaacgtactgcaaggcccctggtcctacccacgctccgctggttaagaccgaaccacaacggcctgttaaagaggaagagccaaagattcctggcgaccttgaccaagaaccttccctcctgtatgccgacttagaccatctggccctgtctagaccacgtcgcctgagtacggccgaccctgccgacgcatccacgatttacgccgtcgtagtctag

SEQ ID NO: 49354 - DNA, 714 bp, Artificial Sequence
  Description of Artificial Sequence: Synthetic coding sequence
atggctgtgttcttgcagctgctgcccctactcctgtctagagcccagggtaatcccggagcgtcactcgatggaagaccaggagaccgagtcaacctctcgtgtgggggagtgtctcaccctattcgctgggtttgggcaccttccttcccagcttgtaagggtctctctaaaggtcgcagaccaattctctgggctagctcgtcaggaacccccaccgtgccaccgctgcaaccttttgtcggacgcctgcgctccctggatagcgggataaggcgactagagctgctactgtctgctggcgatagtgggacttttttctgtaagggtcggcatgaggacgagtcaaggaccgtactgcacgtcctcggagatcggacctactgcaaagctcccggacctactcatggctcagtgtatccccaactcctcatacctctgctgggtgccggactcgtgctcggtcttggggcactgggcctggtgtggtggctacatcgtcgcctaccaccccagcctattcggcctctgcctcgcttcgcacttagcccaccacatagttctacttgtgagaatcgggctccagaggcatctaaggggggtagagcacaggattcccgcggaccaggcccaggcacagagccagccctctgtggcagtggccctagttcaccacagcaggctccaccagcagtgcatagcggtccatgctag

SEQ ID NO: 49355 - DNA, 594 bp, Artificial Sequence
  Description of Artificial Sequence: Synthetic coding sequence
atggccgtgttcctccagttattacctctcctgttatcaagagcccagggaaaccccggagcttcgcttgacggaaggccaggagatagagttaatctgagttgcgggggtgtttcccatcctattcgctgggtctgggcgccatcttttcctgcttgcaaaggcctgtctaaaggcaggagaccaattctctgggcttcttcatctggaaccccgaccgttccccctttgcagccatttgtgggaagactgcgctcgcttgactctggcatcaggcgactcgagctcctgctgtcagcgggagactctggtaccttcttctgtaaaggtcggcacgaggacgaaagccgaaccgtactccacgtgcttggggatcgcacttattgcaaagcccctggccctactcacgcacctctggttaaaactgagcctcagcgtcctgtgaaagaggaagaacctaagataccaggggatctggaccaggagccaagcctgctgtatgcagacctggaccatttagcccttagccgcccaaggcggctgtcaaccgctgaccccgcagacgcttccacaatatacgccgtagtcgtttag

SEQ ID NO: 49356 - DNA, 654 bp, Artificial Sequence
  Description of Artificial Sequence: Synthetic coding sequence
atggctgttttcctccagctgttgcccctgttactctccagagcacagggaaatccaggggcaagcttagatggccgacctggcgatcgcgtcaatctgtcatgtggaggcgttagtcatccaattcggtgggtgtgggccccatcctttcctgcatgtaagggcttaagcaagggacggagaccaattctgtgggcaagctcaagtggtaccccaactgtcccaccactccagccttttgtgggtcgtttgcggtcattggattccggaatcaggaggttagagctgcttctgtccgccggagattctgggacatttttttgtaaggggaggcatgaggatgagtcgagaactgtgctccacgttctgggggatcgcacatactgtaaggctcccggtccaacacatggtgcctgccccagaaaccgcttcgatcatagcttagacctgctatgcccacctcacattgcaccattggtgaagaccgagcctcagcgaccagtgaaggaggaggagcctaaaatacctggggacctggaccaggaaccctccctcctctacgcggatctcgaccatcttgccctgtctcggcctcggagactaagcaccgctgaccctgccgacgcttcaactatctacgctgtcgtcgtgtag

SEQ ID NO: 49357 - DNA, 726 bp, Artificial Sequence
  Description of Artificial Sequence: Synthetic coding sequence
atggccgtgttcctgcagctattaccccttctattatctcgggcacagggcaaccccggagcctccctggacggcaggcctggggatcgggtcaacctgtcttgcggtggagtgtctcatcccatccggtgggtatgggcacccagctttccggcttgtaaggggcttagcaagggcagacggcctatcctgtgggcctcctcctcaggtacacctacggtgccccctctgcaaccgtttgtagggcgactgaggtcgctggattcaggaatacggagactggaactgctcctgagcgcaggcgattctggcactttcttctgtaagggccgacacgaagatgagtctcggactgtcctacacgtgctgggagaccgtacatattgcaaggcacctgggccaacccacggatcagtctacccacagctgttgattccccttttgggtgccggactggttctaggccttggagccctggggctggtctggtggctgcacagacgactccctccccagcccatccgtcccctgcctcgcttcgcaccactcgtgaaaaccgagcctcaaagacccgtgaaagaggaagagccaaagattcccggagatctggatcaggagccttctctcctctatgccgaccttgatcacctggcacttagcaggcctagaagattgagtaccgctgaccccgctgatgcttccacaatttacgccgtggtggtatag

SEQ ID NO: 49358 - DNA, 981 bp, Artificial Sequence
  Description of Artificial Sequence: Synthetic coding sequence
atggagttcctctgggacttcctgaaccaccaggaaggtcctaggataagggaccacctgagccacggtgagattaatctgcatgagttttcaaaggagactaccaatcagctcttagccttttctttggtgctgctcctaaggtttgtcgacgattgtctcttgagtgtgttcaaggagaaaagcgccgtcgagctcctgatatcactcgccgaaggctacagtagcagatgtcatcccgtttttcagctcaagaagcaggtgctgtcatgcgaggagtccatccgggtgtgggccctcctgccgtttcctgaggagctcacgagacaggcggtgcggctggaagacaattcagaaaccaacgcttgccactcgcttattaccaagatgactgatgagttatatcaccacatgcccgaaaaccgctgcgtgctgaaggacctagacaggcttcccactgaaacctggccccagctacttagagaactgtgcagcacacctgttcccactttattttgtccacggattgtcctggaagtgctggttgtccttcgttccattagcgaacagtgccggagagtatcaagccaggtgaccgtggcgtctgagttgcggcaccggcaatgggtcgaaagaactctccgctcaaggcaaagacaaaactatctacgcatgtggtctagtattcggttactgtccccagtcctcagcctgatcctcctgctgattgctctggaattagtgaacattcacgcagtctgtggcaagaacgcgcacgaataccagcagtaccttaagtttgttaaatcaattttacagtataccgaaaatctcgtcgcctacacttcatatgaaaaaaataaatggaatgaaacgatcaacctcacacacactgcacttctaaaaatgtggaccttctctgagaaaaaacagatgcttatccatttggcaaagaagtctactagcaaagtgctgctgtag

SEQ ID NO: 49359 - DNA, 1896 bp, Artificial Sequence
  Description of Artificial Sequence: Synthetic coding sequence
atggaagtgttgattggagatcccatcacgacgtgtctgagcccctcagtgtacgacattatctgtaatttggggtttcagctgagggagaattgcgacatcaattcaatagtaactcagaatggggaggtgtgttggaagaccattactgactgtgtatcttacactgaaagcgagcagggactggactattgggggagtgtcagacttctgggcccagtttgcgaggctgtacattctcactttctaagtttaactaagggacagtttgagatccgttacgctccctggtttcagtggacatcatttccagaactgtttccggagattttcgatgcactggaaagcctgcaatcacccgcaatcagcctgagtctcatgaaattgaccagctgcttagaacgagctctaggcgatgtttttctgctgatcggcaaggagtgtccatttttactgcgggatcttctatcctcggaagagttagctcaggtttttagtcagtctgtcatgaacgtcctgaaagtctttgtggggtccccatgtggcctcaatttaaggaatgtgctctggcacgggtttgcttcacccgaagagatccctccgaaatattgctctatgatgatcctgttaacagcaggtctaggccagctcctgaagagctacttgcagaatacgaagctgaccttagctcacagatcttttatttctctgaccaatcttgaagacctcatcgtttttccggacgtcacatacgaggtgctgtcggttttggaggaagtgatgatgaaatcggctttcatactaaagatcatgctgccatactgggaagtcgccttagtgaaatttaagtctcacagatttgctgactgcgccatactcctgctgacgcagcttgagacgggcttgcggaacgttttcgcaaccttgaaccggtgcccaaaaaggctgttgactgccgagagcacggctttgtacacaacgtttgatcaaattttagctaagcatctgaacgacgggaaaattaatcagctccctctgttcttgggagagcccgcaatggagttcttatgggattttctgaaccaccaggaggggccaaggattcgcgatcacctgtctcacggggagatcaacttgcacgaattttcaaaagagaccactaaccagctgctggccttcagcttggtgctcctactccgcttcgtggatgactgcctgctctcggtcttcaaggagaaatccgctgtggaattgctcatctccctggccgaaggttactcatctcgctgccaccccgtgtttcagttaaagaaacaggtgctgtcatgtgaggagtcgattcgggtgtgggctctcctgccctttcccgaggagctgacccgccaagcagtgcggctggaggacaacagcgagacgaacgcatgccacagcctgatcaccaaaatgacagatgagctgtatcatcatatgcccgaaaacaggtgcgtgctcaaggatctcgatcgcctccccaccgagacccctacatctgatacacctttagctctggcgccacgaaagccccagccatgcaggtgccgccgtcgggtgcggcctagtattaggttattgtcaccggttctaagtttaattttgcttttgatagccctggagctggtgaacatacacgctgtgtgcggaaaaaatgctcacgagtaccagcagtacttgaagtttgtgaaatcaattcttcagtatactgagaacttagttgcttacaccagctacgaaaagaataagtggaacgagacaatcaacctgactcacacagctctgcttaaaatgtggacgttctcagagaaaaagcaaatgctgatccacctcgccaaaaagtccacctccaaagtactgctttag

SEQ ID NO: 49360 - DNA, 2037 bp, Artificial Sequence
  Description of Artificial Sequence: Synthetic coding sequence
atggaggtcctgatcggggacccaattacaacctgtctgtcaccttccgtatatgacatcatctgcaatcttggcttccagttgagagaaaactgcgacattaactcaattgttactcaaaacggagaggtctgctggaaaacaattaccgactgtgtctcatatactgagtccgaacaggggctggactattggggctccgtgcggttgcttggcccagtgtgtgaggcagtgcacagccactttctcagtttgacaaagggacagttcgagatcagatacgcaccttggttccagtggacctcctttcccgaactgttccctgagatcttcgacgcacttgagtccctccagtcccccgctatttcgctgagcctgatgaaactgacaagctgcttagagcgggctctaggagacgtgtttctgctgatcggcaaagaatgcccgttcctactgcgcgacctactgtcctccgaggaacttgctcaggtgttttcacagagcgtaatgaacgtcctgaaagtgttcgtggggagcccatgcggattgaatctccggaacgtgctgtggcatggctttgcaagtcccgaggagatcccacccaagtattgttctatgatgatattgttgaccgctggcttaggacaactcctgaagtcatatttgcagaacacaaaactgactctagcccacagatcttttatttcattgactaacctcgaggatttgatcgtctttcctgacgtcacttatgaggttctgagcgtcctggaagaggtcatgatgaaaagcgctttcattctcaaaattatgctgccatattgggaggttgccctcgtaaaattcaagtcacaccggttcgccgactgcgccatccttctcctcacccagctcgagactgggttgcgaaacgtgttcgcaaccctgaatagatgcccgaagaggctactcactgccgagtctactgccttgtacaccacctttgaccagatccttgctaaacacctgaacgacgggaagatcaaccaactgcctctgtttctaggtgagcctgccatggaattcctctgggactttctcaaccaccaggaaggacccaggataagagatcacctgagccatggagagatcaatctgcacgaattttccaaagagacaactaaccagctgctggcatttagtcttgtcctccttctccgtttcgtcgatgactgtctgctgtctgttttcaaagaaaagtccgctgtggagctattgataagcctggcggaggggtatagtagtagatgtcatcccgtgttccagctaaagaaacaggtgttgtcttgtgaggagagtattagggtgtgggcgcttttgccctttcctgaggagctgacccggcaagccgtaagactggaagacaactctgaaaccaacgcatgtcacagcttaatcacaaagatgacagacgaattgtaccatcatatgcccgagaaccggtgcgtgttaaaggaccttgatcgactgcctaccgaaacatggcctcagttgctccgggaactgtgttcgaccccagtcccaacccttttttgcccccgaatagtgttggaggtgctggtggtgctaagaagtatttcagaacagtgtaggagagtcagcagccaggtaaccgtggcttcagagctgagacaccgccagtgggttgaaagaacactgaggtcacgccagcgtcagaactatctgaggatgtggtctagtatccgtttactctccccagtgttgtcactgatcctactgctgatcgccttggaacttgtcaacattcacgcggtctgcgggaagaacgctcacgaataccagcagtacctcaaatttgtcaagtctatactacagtatactgaaaacctcgtagcctacaccagctatgaaaaaaacaagtggaacgaaactatcaatctgacccatacagctttgttaaagatgtggacattcagtgagaaaaagcagatgctcatccatctagccaagaagtctacctcaaaagtgctcttgtag

SEQ ID NO: 49361 - DNA, 1659 bp, Artificial Sequence
  Description of Artificial Sequence: Synthetic coding sequence
atgaagctgaccagctgtctagaacgggcattaggtgatgtttttctactgataggaaaagaatgccccttcttacttcgggacttgttgtcctccgaggagctagcccaggtcttcagtcaaagcgtgatgaatgtgctgaaggtcttcgtcggctctccttgcggcctgaatctgcgaaatgtcctttggcacggctttgctagccctgaagagatccctccgaagtattgtagtatgatgattctcctgactgcaggactgggccagctgctcaagtcctacctgcaaaataccaagcttaccctcgcacaccgttcgtttatttcattgacaaacctggaggacctgatcgttttccccgatgtgacctacgaagtactgtccgtgcttgaagaggtaatgatgaagagtgcttttatcctgaaaattatgctgccttactgggaagtggcgttggtcaagtttaagagtcaccggtttgcagattgtgccattttattgctgacccaactagagaccggactcaggaacgtgttcgccacgctgaataggtgcccaaagagactactgacagccgagtcgaccgcgctctatacaaccttcgaccagattctcgccaagcatctgaacgatggaaagatcaatcaattaccgttattcctcggagagccggctatggagtttttgtgggattttctcaaccatcaggagggccctagaattagggatcacctatcacacggcgagatcaacctccacgaattctctaaggaaactacgaatcagctgctggctttcagtctggtattattgctgcgctttgtcgacgactgtctcctgagcgtgttcaaagagaaaagcgcagtggagttactgataagtttagctgaaggctactcatccagatgtcatccagtgttccagctgaagaaacaggtgttatcatgcgaggagtccatccgcgtctgggctctgctacccttcccggaggaactcacgagacaggcggttaggctcgaagacaatagcgaaacaaacgcatgccactccctgatcaccaaaatgaccgacgagctataccatcatatgccagaaaatcgatgtgttctcaaagatctggacagattgccaactgagacctggcctcaactgttgcgagagctctgcagcacaccagtcccgactctgttttgtccgaggatagtactagaggttctggtggtactgagatctatctcagagcaatgcagacgggtgtcttctcaggttacggtcgcttccgagcttcgacatcgccagtgggtggaacgaacattgaggtcccgacagcgccaaaactatctcagaatgtggagcagcattcgcttgctctcccctgttctctcactgattctgttgttaattgcgctggagctggttaacattcatgcggtttgtgggaagaatgcacacgaataccaacagtatcttaagttcgtgaaatcgatcttgcagtacactgagaacctggttgcctataccagctatgaaaagaataaatggaacgagacaataaatctgacacacaccgcccttctcaagatgtggaccttcagtgagaagaagcagatgctcatccatctggcaaagaagagcaccagcaaggtactcctatag

SEQ ID NO: 49362 - DNA, 1818 bp, Artificial Sequence
  Description of Artificial Sequence: Synthetic coding sequence
atggaggtgttaatcggcgaccccataactacctgcctttcaccgtccgtctacgacattatctgtaatttaggatttcagctgagagaaaattgtgacatcaatagcatcgtgacgcaaaacggcgaggtgtgctggaagaccatcaccgattgcgtgagctacacagaaagcgagcagggcctcgactattgggggagcgtgcgcctgctgggtcccgtatgcgaggctgtgcattctcattttctgagcctgactaaggggcagttcgagattagatacgcgccttggtttcaatggacatcattcccagaacttttcccagaaatctttgacgcacttgaaagcctccagtccccagcaatatccctgtcactaatgaaactgacttcttgcctcgaacgtgcactgggcgacgtcttcctcctcattggcaaggagtgtccctttttgttgcgcgacctactttcctccgaagagcttgcccaggtcttttctcagagtgtgatgaacgttctgaaggtattcgtgggttccccctgtggactgaatctacgaaatgttctgtggcacggatttgccagtcctgaggaaatacctcctaagtattgcagcatgatgatcctgctcaccgcaggcctgggtcagcttttgaagtcttacctgcagaacacaaagcttaccctcgcacacaggtccttcattagcttgaccaatctcgaggacctgattgtgttccctgacgtgacatatgaggtactgagtgtcttggaggaagtgatgatgaaaagtgctttcatccttaaaattatgctgccctactgggaagtcgccttggtaaagtttaagtctcacagattcgccgattgtgccattctcctgctaactcagctcgagacgggcttgcggaacgtgtttgcaacccttaacagatgccctaaacgtctgctgactgcagagtctacagctctgtataccacattcgaccagattctggctaagcaccttaatgatgggaagatcaatcaactgcccctcttcctcggagagccagcgatggaatttctgtgggactttcttaaccatcaggagggtccccgtattcgtgatcacttatcacatggagagattaacctgcacgagttctccaaagaaacaaccaatcaacttctggccttttccctagttctgctgttaagatttgtggatgattgtttactgagcgtcttcaaagaaaaatccgcggtggaacttcttatttctctggccgaggggtacagttcccgatgtcaccctgtctttcagcttaaaaaacaggtgctatcatgcgaagaatccatccgcgtgtgggctctcctcccttttccggaggaactgaccaggcaggccgtcagactggaggataactccgagaccaacgcctgccacagtttgattacaaaaatgactgacgagctgtaccaccacatgcctgagaaccgttgcgtgctcaaggacctggatcgcctgccaacggaaaccattagacttttgtcaccagtgctgagtcttatcctgctcctgattgctctggaacttgtgaacattcatgcggtgtgtggcaagaacgctcatgaatatcagcagtatcttaagttcgtgaagagtatcctgcaatacacagaaaatttagtggcctatacttcatatgaaaagaacaagtggaacgaaacaatcaatcttacccacaccgccttgctgaagatgtggacgttttcagaaaagaagcaaatgctcatacacttagctaagaagtccacctctaaagtactgctttag

SEQ ID NO: 49363 - DNA, 993 bp, Artificial Sequence
  Description of Artificial Sequence: Synthetic coding sequence
atggaaggggctccacctggatccctggcactgaggctgctgctatttgtagctctgccggcaagcgggtggctgacgacaggcgctccggaacctccgccactgtccggggctccccaagacgggatccgtatcaatgtcactaccctcaaagacgatggggacatcagcaagcaacaggtcgtgcttaacatcacatacgagtcaggacaggtttatgtgaatgatttacctgtgaatagtggggtcactaggatctcttgccagaccctgattgtaaagaacgagaacctcgaaaaccttgaagagaaggagtacttcggcattgtttcagttcgtatcctagtccacgaatggcccatgacaagcggcagtagcctgcagctaatagtaatccaggaggaggtggtagaaatcgatggaaaacaggtacaacaaaaggacgtgactgagattgacatcctcgtgaagaaccggggagtactgaggcattccaactacacccttcctctggaggagtctatgctctactccatctcacgggactctgacattctgttcacactgccaaaccttagcaagaaagagtccgtgtccagcctgcagacaacttctcagtatttaattagaaatgtggagactacagttgatgaagacgtcttgcctgggaaattacctgagacgcctctgcgcgcagaacctccatcttcttacaaggtcatgtgccaatggatggagaaatttagaaaagacttatgccggttctggtccaatgtctttcccgtgttttttcagttcctgaacattatggtggtgggcataaccggagccgcagtggtcattacaatcctcaaagtgtttttccccgtttcggaatacaaagggatcctacagctcgacaaggttgacgtgatccctgtaaccgcgattaacttgtatcccgatggcccagagaagcgtgccgagaacctggaggacaaaacctgcatttag

SEQ ID NO: 49364 - DNA, 396 bp, Artificial Sequence
  Description of Artificial Sequence: Synthetic coding sequence
atgactagtggatctagtttacagctgatcgtaatccaggaggaggttgtggagattgatggcaagcaggtgcaacagaaggatgttactgagatcgacatacttgtgaagaacagaggagttcttcgccattccaattacacgctccccctggaagagtcaatgctatactctatcagcagggattccgacattctctttacccttcccaacttgagtaaaaaggagtccgtcagcagccttcaaaccaccagtcagtacctgattaggaatgtggaaaccaccgtggacgaagacgtgctgcccggtaagcttcctgaaacacccctgcgtgcggagcccccaagtagctacaaggtgctggaaaccgtggacagcgcaccgttccggctgtag

SEQ ID NO: 49365 - DNA, 378 bp, Artificial Sequence
  Description of Artificial Sequence: Synthetic coding sequence
ttgcaactcatagtcattcaggaggaggtagtcgaaattgatggtaaacaggtgcagcaaaaagatgttacagagattgatatactagtgaagaatagaggcgtgctccggcattctaattatactctcccgttggaggaatccatgctgtatagcatctcgcgagattccgacatcctcttcacgctgcccaacctttccaagaaggagagcgtgagcagcctccagaccacaagtcagtatctgatccgaaacgtggaaacaacagtggacgaggacgtgctgcctggcaaactgccagaaactcctctccgggcagagcccccaagttcctacaaggtcctagagacggtcgattctgccccattccggctatag

SEQ ID NO: 49366 - DNA, 1065 bp, Artificial Sequence
  Description of Artificial Sequence: Synthetic coding sequence
atggatttcattctggaggacatggatctcgctgctaatgagatctcaatctacgataagttgagcgagaccgtggatctagtgagacagactggccatcagtgtggtatgtctgagaaggctatcgagaagtttattaggcagctgctggagaagaatgaacctcaacggccaccacctcagtatcccctccttatcgtggtctataaagttctagctacgctcggactgatcttactgactgcctatttcgtgatccagccatttagtcccctggccccagaacctgtactctctggggctcacacttggcgttcactgattcaccacataagacttatgtccctgccaatcgccaagaaatacatgtctgagaataagggcgtaccccttcacggtggcgatgaggatcgtccattccccgactttgacccctggtggactaatgactgtgagcagaacgagtctgagcctatcccagcaaactgcaccggctgtgcgcagaagcacttgaaagtgatgctcctggaagacgcgcctaggaagttcgaacggctgcatcctttagtaattaagaccggcaagccccttttagaagaggagatccagcatttcctgtgtcagtaccccgaagccacagagggcttctctgagggattcttcgctaagtggtggcgttgctttcccgagcgatggtttccatttccctacccttggagacgaccgcttaacagatcacagatgcttcgcgagctatttcctgtatttacacatttgccatttcctaaggacgcgtccttgaacaagtgttccttcctccacccagaaccagtggtgggatcgaagatgcacaagatgcccgacctttttatcattggctctggggaggcaatgctgcagcttatacctccgttccaatgcaggcgccattgccagagcgtggcgatgcctatagaaccgggtgacataggttacgtagacaccacgcactggaaggtgtacgtgatagccaggggcgtacagcctctggtcatttgtgacgggaccgccttttcagagttgtag

SEQ ID NO: 49367 - DNA, 726 bp, Artificial Sequence
  Description of Artificial Sequence: Synthetic coding sequence
atgtcactgccaatcgctaaaaagtacatgtccgagaataagggtgtccctcttcacggcggagacgaggatcggccatttccagactttgatccatggtggaccaatgattgtgaacaaaatgagagcgagcccatcccagccaattgcaccgggtgcgctcagaaacatttaaaagtgatgttgctagaagatgccccacggaagttcgagaggctgcatccattggttatcaagactggtaagcccctgctggaggaggagatccagcacttcctgtgtcagtatcccgaggcgacagaaggtttctccgagggtttcttcgccaagtggtggagatgcttccctgaacggtggtttccatttccctatccctggcgaagaccactgaataggtcccagatgctgcgggagctttttccagtcttcactcacctccccttccctaaggatgctagcctgaataaatgctcctttctccaccccgagcccgttgttggttccaaaatgcacaagatgcctgatttattcattatcggctcaggagaggccatgctgcagctgattcccccattccagtgtaggaggcattgccagtccgtggccatgcccatcgagcctggggacattggatacgtcgacaccacccactggaaagtctatgtcatcgcgagaggcgtgcagccacttgtgatctgtgatggcacggctttctccgagctctag

SEQ ID NO: 49368 - DNA, 1044 bp, Artificial Sequence
  Description of Artificial Sequence: Synthetic coding sequence
atggatttggccgctaatgaaatctcgatctatgacaagttgagcgaaactgtcgatcttgtccggcagaccggccaccagtgtggtatgtcagagaaggccatcgagaaattcattcggcagctgctggagaagaatgagcctcagagaccacctcctcaatatccgctactgatcgtggtctataaggtcctggctaccctcggtctgattctgctaactgcatacttcgtgatccaaccatttagccccctggccccagagcccgtcctgagtggtgcacacacgtggcgcagtctcatacatcacattcgcctaatgtcactgcccatcgccaaaaaatatatgtctgaaaacaaaggggtcccccttcacggtggggacgaagaccggccatttccggacttcgatccatggtggacaaacgactgcgaacaaaatgaatccgaacccattcccgctaactgcacagggtgtgcccaaaagcacctgaaggtgatgctgctggaggatgcccctagaaaatttgaaagactgcaccctttagtgataaagactggcaaaccactactagaggaggaaattcagcatttcctgtgtcagtaccctgaagccaccgaggggttcagcgagggattttttgccaagtggtggagatgctttcctgaacgctggttcccctttccgtatccatggcggcgtcccctgaacaggtcccagatgctgcgtgagctcttccccgtcttcacacatctgccttttccaaaggatgcgtcccttaacaagtgctcttttctgcatccggagccggtggtgggtagcaaaatgcacaagatgcccgatcttttcatcatcggatccggagaggcaatgctccagcttattccccctttccagtgcaggcggcactgtcagagcgtagcgatgccaatcgagcccggtgacatcggatatgtggacaccacccactggaaggtgtatgtgatcgccaggggcgtacagcccctagtgatctgcgacggaaccgcatttagtgaactgtag

SEQ ID NO: 49369 - DNA, 708 bp, Artificial Sequence
  Description of Artificial Sequence: Synthetic coding sequence
atggactttatcctcgaggacatggatttggccgcaaacgaaatcagcatctatgataagctaagcgagactgtcgatctggtgcggcagaccggccatcagtgtggcatgagtgagaaggccattgaaaagtttatcagacagctgttggaaaaaaacgagccgcagaggcccccacctcaatacccactcctcattgtggtctacaaggtgctcgccaccctcggcttaatattactgaccgcctactttgtgatccagccctttagccctctggccccagagcctgttctttccggtgctcacacctggaggagcctgatacaccatatcaggttgatgagcctgcctattgcaaaaaagtacatgagtgagaacaaaggtgtgcctcttcacggcggagatgaagaccgtccttttccggactttgacccctggtggacaaacgattgtgaacagaatgagtccgaacctattccagccaactgcacgggatgcgcccagaaacatctgaaggttatgctcctggaggacgcaccccgaaagttcgagcggctacaccctttggtaatcaaggagattgagctctgtaccggaacggcaagtagagccgagaatcaggttgaaaggggcaagattaagaccaagactatgaaactactgagcggtggctggctgctttcctacctgcccttcgcgtgcatgtag

SEQ ID NO: 49370 - DNA, 726 bp, Artificial Sequence
  Description of Artificial Sequence: Synthetic coding sequence
atgtccctcccaattgccaaaaaatacatgtcagagaataagggggttcctctccacggcggtgatgaggaccgcccattccccgatttcgacccctggtggactaacgactgtgagcagaatgaaagcgagccaattccagccaattgtacagggtgtgcacagaagcacctgaaagtaatgctactcgaggacgctccaagaaagttcgaacgtctgcacccccttgtgattaagaccgggaaaccactgctggaagaggagatacagcacttcctttgtcagtacccagaggcgacagaggggttttccgaaggcttctttgctaagtggtggaggtgctttcctgaacgctggtttcccttcccttacccctggcggagaccactcaatagatcccagatgcttagagagctcttccccgtgttcacacacctcccattccctaaggacgccagcctgaacaagtgctcatttctgcacccagagcctgtggtggggtcgaaaatgcacaaaatgcctgatctcttcattatcggatcaggtgaggctatgctgcagctgattccaccttttcaatgcagacggcactgccaatccgttgcgatgcccatcgagcccggagacatcggctacgtggatacaacccactggaaagtgtacgttatagctcggggagttcaacctctggtgatatgtgacggtacagctttctcagagttatag

SEQ ID NO: 49371 - DNA, 705 bp, Artificial Sequence
  Description of Artificial Sequence: Synthetic coding sequence
gactttattctggaggacatggatcttgctgctaatgaaatttcgatctacgataagctgtcagagacagtggacctggtccggcagaccggccaccaatgtggcatgagcgagaaggcgatcgaaaagttcatacgccagctgttagaaaagaacgaacctcaacggccaccccctcaataccctctccttatcgtggtctacaaggttttagcgacgctgggtctgattctcctcactgcttacttcgtcattcagcccttttcccccctcgcacctgagccagtattgtccggtgctcacacttggcgctcgctgattcatcatataagactgatgtctttacctattgcgaagaaatatatgagtgaaaataaaggcgtgcctctgcacgggggagacgaggacagacccttccccgattttgacccgtggtggactaatgactgtgagcagaacgaaagcgaaccgattcccgcaaattgcacagggtgcgcacagaagcatctgaaagtcatgttattagaagatgctccaagaaagtttgagcggctgcatccattggtgattaaggagatagagctgtgcactggcacggcctctagggccgagaaccaagttgagcgcggtaagattaaaacaaagacaatgaaattactgtcaggtgggtggctgctgtcgtacctgcctttcgcatgtatgtag

SEQ ID NO: 49372 - DNA, 651 bp, Artificial Sequence
  Description of Artificial Sequence: Synthetic coding sequence
atgctggcaagtcccgcacgcccaaccctgcgcatgctcgccaatcacgccctgtccacaccacattgcgcatgtagccccgctccagcaccgaggaccgccagcgcctcccggaggagatgcgttccagttgaagcccgagccgctggcgtgtttggggatcgccttgccggagtctttgggtcacggggactgaaacatggcggtgttcaggccccacgtccgcgagtcgtgagggcggagcccagggcgggatttgccgtggtgagaagtcccaggcgcttgtgtggacggtctcatgctccgcagccaccagcacatctcggcttgggaccagggtgcttccccgcagttgccgtcgtcgtacccgttccaggcagccgagctcatcgccctttcgctgctctcttggtggagggcagcttcctcggcgaccctccgattccccctcgaagaagtggggtactggcacgcggttctgcgggtgccgattgcctggcttcatcagttactccagggccttcactttggatcccccttctgctggtcgccggttgcgtgagctgttttgtggggctggctgtctgtgtgtggatgcaggccagagtgagtccagcctggccagccggtctgtttctgctgcctcgctag

SEQ ID NO: 49373 - DNA, 357 bp, Artificial Sequence
  Description of Artificial Sequence: Synthetic coding sequence
atggaagactttgctacacgcacctatggaacctcaggtctggacaaccgccctttgtttggagagacaagtgcgaaggatagaattatcaaccttgtcgtaggcagcctgacctccctgctgattctagtcacactcatctcagcttttgtgttcccgcagctcccccctaagccacttaacatctttttcgccgtttgtatttccctgtcctccattacggcatgtattcttatttactggtataggcagggggacctagagcctaaattcagaaaactcatctattatatcatcttttcaatcataatgttgtgtatatgtgcaaacctgtattttcacgacgtgggcagatag

SEQ ID NO: 49374 - DNA, 357 bp, Artificial Sequence
  Description of Artificial Sequence: Synthetic coding sequence
atggaggatttcgcaactaggacctacggaacctccggattagacaacagaccgctctttggagagactagcgccaaagatagaatcatcaatctggttgttgggagcctgacttctctgttaattcttgtgactctgatatccgccttcgtcttcccacagctgcctcctaagccccttaacatcttttttgccgtgtgcatcagcctcagttccatcaccgcctgtatcctgatttattggtatcgccagggagacctggaacctaagtttcggaagctgatctactatattatatttagcatcattatgctgtgtatctgtgctaatctatacttccacgacgtcgggagatag

SEQ ID NO: 49375 - DNA, 18 bp, Artificial Sequence
  Description of Artificial Sequence: Synthetic coding sequence
atggaagacttcgcctag

SEQ ID NO: 49376 - DNA, 705 bp, Artificial Sequence
  Description of Artificial Sequence: Synthetic coding sequence
atggggcctggtggcagggttgcaaggctactggctcctcttatgtggagacgagctgtgtcctcagtcgccggttccgccgttggggctgaaccgggtcttcgtctacttgctgtccaaagacttccagttggggcagccttttgtagggcatgtcagacaccgaattttgtgcggggactccattcagagcccggactcgaagaacgcgctgagggaactgtaaacgaaggaagacctgaatctgacgccgctgatcacaccggtcccaaatttgacattgacatgatggttagcctcctgcggcaggaaaacgccagagatatttgtgtcatccaggtgccccctgagatgaggtacacggactatttcgtgatcgttagcgggacgtccacacgacatttgcatgcgatggcattctacgttgtcaagatgtataagcaccttaagtgtaaacgggacccccatgtcaaaatcgaagggaaagacactgacgattggttatgcgtggactttggctctatggtcatccacctgatgctgccggagacacgggaaatatatgaactcgagaaactttggacactaaggtcatacgacgatcagcttgcccagattgctccagagacggttcccgaagactttatcctaggaatcgaggacgatacgtctagcgtgactcctgtggaattgaaatgcgagtag

SEQ ID NO: 49377 - DNA, 945 bp, Artificial Sequence
  Description of Artificial Sequence: Synthetic coding sequence
atgttttctatcaatccgctggaaaatttgaaggtatatatcagtagccggcctcccctcgtcgtctttatgatctctgtgagtgccatggctattgcttttttgactctgggatatttcttcaaaataaaggagattaagagcccagaaatggcagaagactggaacacattcttgctccggtttaatgacctggatctgtgcgtgagtgaaaacgagacactaaagcacttaacaaatgacaccaccactccggaaagcacaatgacctccgggcaggcccgtgcctctacccaatcgccacaagcattggaggactcaggacccgtaaacatctccgtaagcatcaccctcacactggatcccctgaagccgttcggtggctactctcgaaacgtcacccacctgtacagtaccattctgggccaccagatcggcttgtctggccgtgaagcccacgaggagattaacattacctttaccctgccaaccgcctggagttccgacgactgcgccttgcatggtcactgcgagcaagtggtcttcactgcctgcatgacgctcaccgccagccccggagtgttccccgttactgtgcagcctccacattgcgtcccagatacctattcaaatgctacactgtggtacaaaatattcaccaccgcccgtgatgccaacactaaatatgctcaggattacaacccattttggtgctataagggggctattgggaaagtctatcatgccttgaaccctaagctcacggtgatcgttcctgatgatgaccgaagcctgattaatctgcacctgatgcatacctcctacttcctgtttgtgatggtgatcaccatgttctgttatgctgtaattaagggacgtccatccaaactgcggcagtccaacccagaattctgtccagaaaaggtagcccttgcagaagcatag

SEQ ID NO: 49378 - DNA, 219 bp, Artificial Sequence
  Description of Artificial Sequence: Synthetic coding sequence
atgttctctatcaaccccctcgagaatctgaaggtgtacatctctagccgaccaccactcgtcgtcttcatgattagtgttagtgccatggcaatcgctttcttaacactgggctacttcttcaagatcaaggagattaagtctcctgagatggccgaggattggaacacctttctactccggttcaacgacctagatctgtgtgtcagcgagaattag

SEQ ID NO: 49379 - DNA, 285 bp, Artificial Sequence
  Description of Artificial Sequence: Synthetic coding sequence
atgttttccatcaacccactggagaatcttaaggtctacatctcctctaggccaccgctcgtagtcttcatgatctccgtgtcggccatggctattgccttcttaacactcggatacttttttaagatcaaagaaatcaagagccccgagatggccgaagactggaacacattcttactgagatttaacgatctcgacctctgtgtctctgagaacgagacgttgaagcatctcactaacgataccacaactcctgaaagcactatgacatccgggcaggcctag

SEQ ID NO: 49380 - DNA, 420 bp, Artificial Sequence
  Description of Artificial Sequence: Synthetic coding sequence
atgtttagcattaaccccctggagaatctgaaggtgtatatcagtagccggcctccattggtagtgtttatgatatcggtatctgccatggccatagcattcctcactttgggatattttttcaagattaaggaaatcaagtctcccgagatggccgaggattggaacacattcctgcttcggttcaacgatctggatctttgcgtcagtgaaaacgagactttaaaacatctgaccaacgacacaacgacccccgaatctaccatgacgtccggtcaggctagagcatctacgcagagcccacaagccctagaggattcaggccctgtcaacatttcggtctccattaccctcactctggatcctctcaagcctttcggtggatatagcaggaatgtaacccatctgtacagcacatag

SEQ ID NO: 49381 - DNA, 567 bp, Artificial Sequence
  Description of Artificial Sequence: Synthetic coding sequence
atggccctggcaatgttagtcctggtggtgagtccatggtcagccgctaggggcgtgctgagaaattactgggagcgcctgctccggaagctgccccagtcaaggccagggtttccttcaccaccctggggcccagctttagccgtccaggggccagcaatgtttaccgaaccagccaacgacacgtccgggagcaaagaaaactcttcattgcttgactcaattttttggatggccgcacccaagaaccgaaggacaatcgaggtgaacaggtgtaggcggaggaatccccaaaagctgatcaaggtgaaaaataatatcgacgtgtgtcccgaatgcggacatctgaaacagaaacacgtcttgtgtgcctattgttacgagaaggtctgtaaggaaacggcggagattaggaggcagatcggaaaacaagaaggcggaccgtttaaggctcccactattgaaaccgtggtcctgtacactggggaaacaccttccgaacaggaccaggggaagcggatcattgagagagatcggaagagacccagttggttcacacaaaactag

SEQ ID NO: 49382 - DNA, 441 bp, Artificial Sequence
  Description of Artificial Sequence: Synthetic coding sequence
atgatgtggcagaagtatgcaggttctcggcgaagcatgcctcttggcgctcgaatactttttcatggcgtgttctacgccggtggttttgcgatcgtctactatctgatccagaaattccactccagggcgctgtattacaaactggcagtggaacagctccaaagccaccctgaagctcaggaggccctggggccaccactaaatatccactacctcaagctgatcgatagggaaaactttgtcgatatcgttgatgcaaagctgaaaattccggtttccgggtctaagtccgagggcctgctgtacgtgcactcaagccgcggaggtccgttccagcgatggcatctggatgaggtatttctagaattgaaggatgggcagcagatccccgtttttaagcttagcggtgagaatggcgacgaggtgaagaaggagtag

SEQ ID NO: 49383 - DNA, 441 bp, Artificial Sequence
  Description of Artificial Sequence: Synthetic coding sequence
atgatgtggcagaagtacgctggatcccggagatctatgcctttgggagctaggattctatttcacggcgtgttctatgcaggagggttcgcaattgtctattaccttatacagaagttccattcccgggctctctattacaagctggccgtcgaacagctgcagtctcatcccgaggcccaagaggcgctcggtcctccacttaacatccactacctgaagctgatagatcgggaaaatttcgtggacatcgtagacgctaagctgaagatccctgtctcaggcagtaagagtgaggggctactttacgtccatagcagccgagggggaccctttcaacgatggcacctcgacgaagtgtttctggagttgaaggacgggcaacagatccctgtcttcaaacttagcggggagaacggagacgaggtgaaaaaggagtag

SEQ ID NO: 49384 - DNA, 441 bp, Artificial Sequence
  Description of Artificial Sequence: Synthetic coding sequence
atgatgtggcagaaatacgccggtagccgtagaagcatgccactcggagcgaggatcctgtttcacggcgtattctacgccggaggattcgctatcgtttattatctgatccagaagtttcattctcgggctctctattacaaattagctgtagaacaactccagtcacaccccgaagctcaagaggccctgggtcctccactaaacattcactacctgaaactcattgatagggaaaattttgtggatatcgttgatgctaagctgaagattccagtgagcggatctaagtccgaaggcctgctgtacgtgcattcatcacgtggaggacccttccagcggtggcatcttgacgaggtttttctggaattgaaagacgggcagcaaattccggtgtttaaacttagcggtgaaaacggagacgaggtgaagaaggagtag

SEQ ID NO: 49385 - DNA, 441 bp, Artificial Sequence
  Description of Artificial Sequence: Synthetic coding sequence
atgatgtggcaaaagtacgcagggtccaggcgcagcatgcctcttggcgctaggatcctattccatggtgttttttacgccggagggttcgctattgtgtattaccttattcagaaatttcactcacgtgcactctattataagttagcagtggagcagctccagagtcaccccgaagcccaggaggccctcggacccccactcaacatccactatcttaaattaatcgatcgggagaattttgtagatatcgtggatgctaaactgaagatccccgtgagcggttctaaatccgaaggactgctctacgtgcacagcagtagggggggacccttccaaagatggcatctcgacgaagtgttcctcgagctcaaagatggtcagcagatacctgtgttcaaattgtcaggggagaacggggacgaggtcaaaaaagagtag

SEQ ID NO: 49386 - DNA, 342 bp, Artificial Sequence
  Description of Artificial Sequence: Synthetic coding sequence
atgatgtggcagaaatatgctggaagccgtcgaagcatgccgctgggggcaagaatccttttccatggcgtgttttatgccggaggctttgcaatagtgtactacctcattcaaaagtttcacagcagagcactttattataagttagccgtggagcagctccaaagccacccagaagctcaggaggcactgggcccacccctgaacattcactatcttaaactaatagaccgggaaaatttcgtggatatcgtagatgcaaaattgaaaatacccgtgagtggcagcaaatctgaaggcctgttatatgtccacagttcgcggggaggacctttccagtag

SEQ ID NO: 49387 - DNA, 267 bp, Artificial Sequence
  Description of Artificial Sequence: Synthetic coding sequence
atgatgtggcagaagtacgccggatcacggcgaagcatgccccttggggcacggatcctcttccacggggttttctatgccggaggcttcgctatcgtctactacttgattcagaaatttcactctagagcgctgtactataaactagcggttgaacagctacagtcccaccctgaggctcaggaggccctcggtcctcccttgaatattcactacctgaaactcatcgacagggaaaattttgtggacatcgtggacgctaaatag

SEQ ID NO: 49388 - DNA, 441 bp, Artificial Sequence
  Description of Artificial Sequence: Synthetic coding sequence
atgatgtggcagaagtacgcaggtagtaggagaagcatgcccctgggagccaggattctgtttcatggggtgttttatgcaggcggatttgccattgtttattatctgatccaaaaattccactcccgtgcgctctattataagttggcagttgaacaactacaatctcaccctgaggcacaagaagctctaggacccccactcaacattcactacctgaaattgattgaccgcgagaacttcgttgatatcgttgacgcaaaattgaagatccctgtaagtggatccaaatccgagggccttctttacgttcactctagcagagggggtccatttcagagatggcatctcgacgaggtgtttctcgagctaaaggacggacaacagatcccggtcttcaaacttagcggcgagaacggcgatgaagtcaagaaggaatag

SEQ ID NO: 49389 - DNA, 441 bp, Artificial Sequence
  Description of Artificial Sequence: Synthetic coding sequence
atgatgtggcaaaaatatgccggtagtcgacgttctatgcctctgggggcaaggatacttttccacggagttttctatgcgggtggcttcgctatagtgtattacctgatacagaagtttcattcacgggctctgtactataagcttgccgtggagcaactgcagtcgcacccagaagctcaggaggctctgggtccgcctctgaacatccattacctgaagctgattgaccgcgagaatttcgtggacattgttgacgccaagctgaaaatccccgtttccgggagcaagagtgagggtctgttatatgtccattccagcagaggcggaccctttcagaggtggcacttagacgaggttttccttgaactgaaggacggacagcaaattccagtttttaagctcagcggcgaaaacggggacgaagtcaagaaggagtag

SEQ ID NO: 49390 - DNA, 441 bp, Artificial Sequence
  Description of Artificial Sequence: Synthetic coding sequence
atgatgtggcaaaagtacgcagggtctagacggagcatgcctctgggcgcaaggattttattccacggcgtgttttatgccggagggttcgcaattgtgtactatctgatccaaaaattccatagtcgagccctttattacaaactggctgtggagcaattgcagtcccaccctgaagcccaggaagcactgggcccacctctgaacatacactatctcaagcttatcgaccgagagaacttcgtagatattgtggacgccaagctgaagataccagttagcgggagcaaatccgaggggctattgtatgtgcattccagcaggggagggccattccagaggtggcacctcgacgaggtgttcctggagctgaaggacggccagcaaatacccgtgttcaagttaagtggtgaaaacggggatgaggtcaaaaaggagtag

SEQ ID NO: 49391 - DNA, 735 bp, Artificial Sequence
  Description of Artificial Sequence: Synthetic coding sequence
atgggcgatctcttctccctgttctgggaggtggatccacccccaatccctgtgaactgcgctatccccaaccaagattatgagtgctggaaggacgactcttgcggtacaattggatcatttctcctgtggtatttcgtgatagtcttcgtgctcatgttctttagcagggccagtgtgtggatgagcgaggacaaaaaagacgaaggaagcggaacttccacctcggtgcggaaggcatcgaaagagacaagctgcaaaaggcagtctaaggatagcgcgtgggacccttctcaaactatgaagaaacccaagcaaaaccagctgaccccagtgactaacagcgaggttgcactggtgaacgcatacccagaacaaagacgggctagaagacagagccagtttaacgaagtcaaccagaaccagcatgatagtgataccaccgagtatggaagcgaggagagtaactccgaggcaagctcatggaaggagagtgagtctgagcaccacccatctcctgacagcatcaagcgcagaaagatggctcagcgccaacgcaatctggggtcctatcagatgtctgaacgacactgtctgcattgcaaggcgttgaggaccaacgaatggctggcccatcattcaagacagaagccatcagtgacccctccaatgaaaagagattcccaggaggagagcagtatttctgacatcaataagaaattctccaagttctag

SEQ ID NO: 49392 - DNA, 396 bp, Artificial Sequence
  Description of Artificial Sequence: Synthetic coding sequence
atgacccactcgagtcaggatacaggatcatgtggcatccaggaggacggaaaattatatgttgtcgacagcatcaatgacctaaacaaactgaatctttgtcccgcaggaagccaacacctgttccctctcgaagataaaataccggttctgggcactaattcaggcaatggttctaggtctctgtttttcgtgggcctgcttattgtccttatcgtctccctggcattagtctttttcgttattttcttgattgtgcaaaccggtaacaagatggatgacgtctccaggcgtctcacagccgaaggcaaggacatagacgatctcaagagaatcaacaacatgatcgttaaaaggttaaaccagctgaaccagctggactctgaacagaattag

SEQ ID NO: 49393 - DNA, 180 bp, Artificial Sequence
  Description of Artificial Sequence: Synthetic coding sequence
atgacacactcctcccaggacacaggcagctgtggaattcaggaagacgggaaattgtatgttgttgattcaatcaacgacttaaacaagctgaatttatgccctgctggatcccagcatttgtttctgctcaggcagtcttcaaagaatttcccaaagagaagtaaagagatagcgtag

SEQ ID NO: 49394 - DNA, 396 bp, Artificial Sequence
  Description of Artificial Sequence: Synthetic coding sequence
atgacacacagttctcaggacacgggaagttgtggcattcaggaggacggaaagctgtacgtagtggactccattaatgacctgaataagctgaatttgtgccccgctgggtcccaacacctgttccccctggaagacaaaatccccgtccttggaactaactctggtaacggttcccgctctctcttcttcgtaggcctgctgatcgtcctaattgtttccctggctctggttttctttgttattttcctaatagtgcaaaccgggaacaagatggatgatgtgtctaggcggctgacagcagaaggaaaggacatcgacgatctcaaacggatcaataacatgattgtcaagcgcctgaatcagttaaatcagctcgactccgagcagaactag

SEQ ID NO: 49395 - DNA, 342 bp, Artificial Sequence
  Description of Artificial Sequence: Synthetic coding sequence
atggctgcccttggatcccccagccatacttttcggggactcctgcgggaactgcggtatctctctgccgctaccggaagaccgtacagggacaccgccgcttaccgatacttagtgaaggcgtttcgggctcaccgggtgaccagcgagaagctttgccgagctcaacatgagctgcacttccaagcagccacctacctgtgcctcctccggagcattcgcaagcacgtggcattgcatcaggaattccatggtaagggggagaggtcagtggaagagtcagccggacttgttggccttaagctcccccatcagcctggcggtaagggctgggaaccctag

SEQ ID NO: 49396 - DNA, 3081 bp, Artificial Sequence
  Description of Artificial Sequence: Synthetic coding sequence
atggtgtgtcggcctgtgtttccatgtcggagacgattctgtcctcggccattcctagttgggctcgttgtcgcgatctgcctgttttaccagaccctgactcttagggggagtcggaaactgactgctgctgcaccaggcgctgtgccccacacatccaccgagactcaagcaagcaggtgcaagaaaggctttagccaggataagcagtgctttctgctgagcggcaatgcccaggaaactcgaaaagtcaaggagtctatggaaactcacttcggcagccacggcaggagggccatactctacagaccacctttttacagcaaaacagagctccagctccatcagcacattttaacgcaacacggatacactgttgtcattgccgaggagcgccttaatgcagggttgggccctggactactggaacaaggagatttaggaagctgggacctgcttatttgtctgagttccaagaaggccgagggaactccgtgcatcagtaaagaagtgatgtgccagcttggactacatcagaaagcaaaccgtctgcccgagattcagcaacctctgtgtcgaaaagagggtttgtgccaaatagttcgtcgctttcctgagttacaacttcctgtgtcccccagcgtttgcttagaccagggcatgcaactcaagccatccaccagcagtcatctgctgaaaacagttaagccacgcgtgtggaagcctggggactggtcacgtgaacagctgaatgaaaccacggtactagcccctcacgaaacaatatttcgcgcagaggacctcagtgtcatcctcaaggcatacgtcttagtgacttccctaacaccgttgagagccttcatacactccactggaaccgtgtggaatcctcccaagaagaaaaggtttacagtaaaactgcagaccttcttcgaaacctttctgagagcctccagtccgcaacaggcgttcgatatcatgaaagaagccatcgggaagttgctgctcgctgccgaggtgttttcagagacttcaactttgggacccaagacattccacaggtgcaggttttgtttccaactcttgacattcgacattggttacggcagttttatgtaccccgtggtcctgcaagtgcatgagcatctaaattttcaggactacgacaacatggacttcgaagaccagaacaccgaggagttcctcttgaacgatactttcaactttctcttccccaacgagtcatccctatccatcttcagcgaaatctttcagaggctataccggtccgacgtgttcaagggagagaattatcagaaagagctcaatcagtgcctttcgctggaggagatcaattctatcatgacattcattaaggagctcggtagcctgggccagttccaactcctgttccccagtaccacgccgggaatacagtcccttatgcacgaattctatgatgttgccaatccagttgggaacccgggatccgtgctgacgcagtattggagcctgctgaacgtttttgagcagtttcagttcatgaacaaaaaaacacagccccatcctttggagtggaacagcttcactgaagacaagaacattgaaaagcctcaggtgccgtttgatgccattgagaataaaaaggctgcggtgccacagatcaaaaatgagaataaagagatacactgttccgatgacgagaataccccatgtcatattaagcagatctttacgcacccccacctggaactgaatcccgattttcaccctaaaatcaaggactattattgtgaagtgccattcgatgtagttactgtaacaataggcgtcgaaacgcccaagtgtctctgtaaggtccacctctatgaacaggccggacctagctttgcttcctatcctttagggctggggatgaataagatatcaatttttgtggttgacgagtctcccgctcatggggagactctcatcacctataagctcaccatttacagggaggatagaccaagcctgccactcttcgaggcctttaccgcctgtggatttgtccaagactgcggactgctgatccacccggaggagacctgtgggctgcagcccatctcgagcgattacattgaagccatcctccagagcgagttgaaacgttgtccctccggagatatgaagggccaatggattgttccgtgcctgagctgtagtgataaccgcacttgtgactggcgggaaatcacctggcagccgcacaactgccagtatggtgtgcttacaaagccacagctgcaacagtgtctagggggtagaaagatcctgtttatcggcgactccacaaacagaggtattatgtactacctcatcgagcggttgaatgaaacactgcaggagtggcaaaaagtccacggaacaaagttctatcacaatgtgaatggaggtaaaacactgattagttattcatattatccccagttttggatctccccatctctgagaccaacgttcgagaacgctctggaacatttgctgcagcgctctcgccctctcgaaaatactggacagactgtgctcgttgtgggtggcgtacaatggctcaatagtaatcacctgcagattattcataaggtcttaaagcgcgagaatctgctgaatatcctggtaatcattaagacgctggggatcggctttcaccttccagttgacggggtgcacttcctcacacaatctgaagttcagaatctttggaaagaaaatctgatcatactagacacagccaaaaaacatggctacgaggtggtggacacattcacaattaccatgggaaggtataaggagtttctccagggcaagtgcgggtgtcatttccacgaggtggtcaagagtaagctatccaaggagtataatttcattaaaatgaagcgaagtaggaatcatataatgggcagatattttagcaatcagtccaaactccagcagggtacagtgacaaacttcagaagtccctatcacgtgagaggacctataaaccaggtctgttcggaaatacttctgagtcgcatgtgcgcaaacaagcggactatgtag

SEQ ID NO: 49397 - DNA, 609 bp, Artificial Sequence
  Description of Artificial Sequence: Synthetic coding sequence
atggtttgcagacccgtctttccatgccgtagaagattctgtcctcgcccattcctggtcggcctcgtggtggccatttgcctgttttaccaaactctgaccctgcggggtagccggaaactgacagccgctgcgcctggcgcagttccccatacaagcaccgaaacacaggcatcccgatgcaagaaaggtttctctcaggataagcagtgcttcctgctatcaggaaacgcccaagaaactagaaaggttaaggaatctatggagacacacttcggcagtcacggcaggagagctatcctgtacagaccgccattctattcaaaaacagagctacagcttcaccagcacatcctcacacagcatggttatacagtcgtaatcgcagaggagagactgaacgctgggttgggccctggattacttgagcagggcgatttgggtagttgggatcttctgatctgcctaagctctaaaaaagccgagggcactccctgcatctctaaagaagtgatgtgccagctgggccttcaccagaagcaactacggagacgggaggagagacaacgtccaggttcccccgctagtagacgcctgtctgtgagatag

SEQ ID NO: 49398 - DNA, 1650 bp, Artificial Sequence
  Description of Artificial Sequence: Synthetic coding sequence
atggtatgccggcctgtatttccatgcaggagacgattttgccctcgccctttcctagtcggtctcgtggttgcaatttgtcttttctaccagacactcaccctccggggttccaggaaactgactgccgctgctccgggtgcagtgcctcatacatcaactgagacccaggcctctcgctgcaagaagggcttctctcaggataagcagtgctttttgctatccggtaatgcgcaggagaccagaaaggtgaaggagtccatggagacccatttcgggtcccatgggagaagggctatcctttacagacccccattttattccaaaactgagttacagctgcaccagcatatcctgacccagcacgggtacacggtggttattgcggaggagagactaaacgctggactggggcctggcctcctggagcaaggagatttgggctcttgggacctactgatctgtctttccagcaagaaggccgaagggacgccttgtatctctaaagaggtgatgtgtcagctcggcctgcatcagaaggccaatcgactgcccgaaattcaacagcctctctgccggaaggaaggtctgtgccagatagtccgcagatttcccgaattgcagcttccagtatctccttctgtttgcctggaccaaggcatgcagctgaagccgagtacctcctctcatctcctaaaaactgttaaacctcgggtgtggaaacccggagattggagcagggaacagctcaatgagaccacagtacttgctccccatgaaactatctttagagcagaggacctgagtgtgattctgaaagcatacgtgctcgtcacaagtctgacgccactccgggcatttatacactctaccggcacagtttggaacccacccaaaaagaaacgctttacggtgaaacttcaaaccttctttgagactttcctccgggcatcatccccgcaacaggccttcgacatcatgaaggaagcaataggtaagctcctactggctgccgaggtgttttccgaaaccagtaccttggggccaaagactttccaccggtgtagattttgctttcagctcttaacttttgacatcggctatgggagcttcatgtaccctgtggttctgcaagtacacgagcacttgaattttcaggactacgataacatggattttgaggatcagaacaccgaggagtttttacttaatgataccttcaattttctgttccctaatgagtctagtctgagcatcttttctgagatttttcagcgcttgtacaggtcagacgttttcaagggggaaaattaccagaaagaattgaaccagtgcctttccctggaggagattaacagcatcatgacgtttataaaggaactcggctcgctgggacagttccaactcttatttcctagtaccacaccaggcatccagtcactgatgcacgaattctatgacgtagccaaccctgttggcaatcccggttccgtgctcacgcaatattggagtctgttgaacgtattcgaacaattccaatttatgaacaagaaaactcaaccccaccctctggaatggaactctttcaccgaagataaaaacatagagaaaccccaagtgccctttgacgcaatcgagaataaaaagtag

SEQ ID NO: 49399 - DNA, 2352 bp, Artificial Sequence
  Description of Artificial Sequence: Synthetic coding sequence
atggtgtgtaggcccgtgttcccctgtaggaggagattttgccccaggccgttcctggtgggtctcgtggtggcaatctgccttttttatcagacactgacactccgagggtcgcgcaaacttacagctgctgctcctggcgctgttcctcatacaagcaccgaaacccaggcgtctcgctgcaagaagggatttagccaggacaaacagtgctttctgctctccgggaacgcacaagagactcgcaaggtgaaggagagcatggaaacacacttcggtagtcatgggcgaagggccatcctgtatcggcctccattctactcaaaaacagagctccaactccaccagcatattttaacccagcatgggtatacagtagttatcgccgaggaacggcttaacgcagggctcgggccaggcttactcgagcagggcgatctgggctcctgggaccttttgatatgcttatcatcaaaaaaggcggaaggcacaccttgtatttccaaagaagtgatgtgccaacttggcctgcaccaaaaagccaaccgacttcctgaaatccagcaacccctgtgtcggaaagaaggcctctgtcagattgtcagaaggttccctgagcttcagctccccgtgtcaccctctgtctgcctcgatcagggcatgcagcttaaaccatccacttccagtcacctactgaagacagtcaaacctcgtgtctggaaacctggagactggagtagggagcagctgaacgagactaccgtcctggccccacacgagacaatcttcagggccgaagatctgtcagtgattttgaaggcctacgtgttggtcacttcactcactccactaagggcctttatccactctacgggaaccgtgtggaatcctccaaaaaagaagagattcactgtaaaacttcagacatttttcgaaaccttcctgagagcctcctccccacaacaagcatttgatattatgaaagaagctatcggaaagttgcttttggcggctgaggtttttagtgaaacgtccacccttggacccaaaacgtttcatcgatgccgtttttgtttccagctccttactttcgatataggttatggatcgtttatgtatcccgtagtgttacaagtgcatgagcaccttaatttccaggactatgataacatggattttgaagaccaaaataccgaggagtttctgctgaacgatacttttaattttctgtttcctaatgagagttccctgagcatatttagcgagatatttcagagactgtacagatcagatgtcttcaagggggaaaactaccagaaagagctgaaccaatgtttatccctggaggaaatcaattctattatgacgtttataaaggaattggggtccctggggcagttccagctgctgtttccttcaactactcccggaatccaaagcttaatgcacgaattttacgatgtggccaatccagttggtaaccctggtagcgtccttactcagtactggtcattactcaatgtctttgagcagttccagtttatgaacaagaagacccaaccacaccccctcgaatggaacagcttcacagaagataaaaatatagagaaaccacaggtcccattcgacgccatagagaataagaaggcagctgtcccccaaattaaaaatgagaacaaggagattcattgctcagatgatgaaaatactccatgccatatcaagcagatcttcacacacccacacttggagcttaaccctgatttccatcccaagattaaggactattactgcgaggttccctttgatgttgtgactgtgacaatcggcgtagaaactcctaaatgcctatgtaaagttcacctgtacgaacaggccggtccttcttttgcctcttacccgctgggactggggatgaacaaaatcagcatttttgtggttgacgagtccccagctcacggggagaccttaatcacctacaagctcacaatatatcgcgaagataggcccagtctacccttgttcgaagcttttactgcgtgcggctttgtgcaggattgcggcctgcttatccaccccgaagaaacgtgcggccttcagccgatttcctcggactatatcgaagcaattctccaaagcgaactgaagaggtgtccctctggtgacatgaagggccagtggatcgtgccttgcctgagctgcagcgacaaccgcacctgtgattggagagaaattacctggcaacctcacaattgtcaatatggagtgctcacaaagccacagctgcaacagtgccttgggggtcggaaactcggcgttgacgtgcagcgggttccccgatcccgcaattag

SEQ ID NO: 49400 - DNA, 348 bp, Artificial Sequence
  Description of Artificial Sequence: Synthetic coding sequence
atgatggctgtgatgacaccttctgatggattatcccagctatccgtgccccacctgacgcatcagagactgtggagtctgagctgccttgctatgctgtttcaagcagtgctcatactgtccgcgcctcaaatgtcctgccttctgaaatgtttttacgcattagacccactccaccctgtcatgtcagaggagttctccgcccagtatagacatatgatggaccagcggtatcgtacacggatccacgaaggatatatttcacaggtgaaaggtgcctacctacgcatcgtccataagaaaccaataagttacgccaaatcttttcccaaggagatggggaactag

SEQ ID NO: 49401 - DNA, 300 bp, Artificial Sequence
  Description of Artificial Sequence: Synthetic coding sequence
atgggggagtgtccacatctggtggacgtccgcctaggtcatcggagcttggctacaggacccgaacagtcggatatttgccacaccggttcagaagctcgctggaccacaacgtggtacggaagcctttcattttcacgccataagtacaagatgctagccgatctgacgcccggagtggaaatgtcatgtagacactgggcgaggtggttgactccagtgattcctgccctttggaaggcagaggccggtggactgccagagctgcggtctagccggccagcctggaccacctggtag

SEQ ID NO: 49402 - DNA, 324 bp, Artificial Sequence
  Description of Artificial Sequence: Synthetic coding sequence
atggccggaggatatggagtgatgggcgatgatggctccatcgattacactgtccacgaggcatggaatgaggcgaccaacgtctatctgatagttattctggttagtttcggcctgttcatgtacgcaaagcgtaataagcgcaggattatgcgaattttcagtgtcccaccgacggaggaaacgctgtcagaaccaaatttttatgacactatttcaaagattagactccgccagcagctggagatgtattctatttctaggaagtacgactaccaacagccccagaatcaggctgactccgtgcaactttcccttgagtag

SEQ ID NO: 49403 - DNA, 324 bp, Artificial Sequence
  Description of Artificial Sequence: Synthetic coding sequence
atggccggtggctacggtgttatgggcgacgacggaagtatcgactacaccgtacacgaggcttggaacgaggcaaccaatgtgtacttaatcgtgattctcgtcagttttggcttattcatgtacgccaagagaaataagcgaagaatcatgcggattttttctgtacctcctactgaagagactctcagtgagcccaacttctatgatactatctccaaaattcgactgcgtcaacaactggaaatgtacagcatctcccgcaaatacgattaccagcagccccagaatcaggcggactcagtgcagctcagcttggagtag

SEQ ID NO: 49404 - DNA, 324 bp, Artificial Sequence
  Description of Artificial Sequence: Synthetic coding sequence
atggccggaggctacggcgtcatgggagacgatggatccatcgactataccgttcatgaagcctggaatgaggcaaccaatgtctatttaatcgtaatactcgtctcctttggcctttttatgtatgccaagcggaataagaggcgaatcatgcggattttttcagtgccacccacagaggagaccttatcggagcctaatttttatgataccatatctaagatacggctgaggcagcagttggagatgtacagtatttccaggaagtacgactatcaacagccgcagaaccaggctgattctgtacagctgagtttagaatag

SEQ ID NO: 49405 - DNA, 324 bp, Artificial Sequence
  Description of Artificial Sequence: Synthetic coding sequence
atggctggtggatatggcgttatgggcgatgacgggtctattgactacactgtacacgaggcttggaatgaagccaccaacgtgtaccttatcgtcatcctagtgtcctttgggctgttcatgtatgctaagaggaataagcgacgcattatgaggatttttagcgtacctcctaccgaggagaccctgagtgaacctaatttctatgacacaatttccaagatcagacttagacagcagcttgagatgtacagtatctcaagaaagtacgactaccagcaaccacagaaccaggcggatagtgtgcagctgtccctggaatag

SEQ ID NO: 49406 - DNA, 324 bp, Artificial Sequence
  Description of Artificial Sequence: Synthetic coding sequence
atggccggtgggtatggagtgatgggcgacgacggttccatcgactacactgtccacgaggcatggaacgaggcaaccaacgtctatttaatcgtaatattggtgtcgttcggcttgttcatgtatgccaagcgcaacaagaggcgcattatgagaatcttcagtgtgcccccaactgaggagacactgagcgagcctaacttttacgataccatctccaagatcagattgcggcagcagctcgaaatgtactctatttccaggaagtatgattaccagcagccacagaatcaggctgactcagtgcaactttccctcgaatag

SEQ ID NO: 49407 - DNA, 651 bp, Artificial Sequence
  Description of Artificial Sequence: Synthetic coding sequence
atgtggccgccatgtggaactctgcgcactctggcccttgccaggagccgaggcgcaagagcttgttccggagatgggggagttagttatacacaggggcagtctcccgaaccaaggactcgcgagtacttttactacgtggaccatcagggacaactattcctggatgactccaagatgaaaaatttcattacatgtttcaaggatcctcagttcctcgtcacttttttctctcgactgcggccaaaccggagtgggaggtacgaagctgcctttccctttttatcaccttgcggcagggaacgcaatttccttagatgtgaagaccggcctgttgtgttcacccacctgttgacagccgaccatggaccccctcggctgtcgtactgcggcggaggtgaggcgcttgctgtgccctttgagccggctaggctgctcccgcttgccgctaacggaaggctctaccaccccgctccagagcgggctggcggagtaggcctggtccgcagtgcactggcgtttgagctgtccgcatgcttcgagtatggtccaggagccccagccttgccttcccacgtaagatggcagggtcgcagactcgctttgacaatggatctggcccctctgctgctcgctgccaggtcaccttag

SEQ ID NO: 49408 - DNA, 261 bp, Artificial Sequence
  Description of Artificial Sequence: Synthetic coding sequence
atgggacggaaggatgctgccacgattaagttgccagtagaccagtatcgcaaacagattgggaagcaagactacaagaaaacaaagccgatacttcgagctaccaagctcaaggcagaagctaagaaaaccgctatcggcattaaggaggttgggctagtgttggctgccattctggccttgctgctggctttctacgcattcttctacctgcggttaacaaccgatgtggatcctgatctggatcaggatgaagattag

SEQ ID NO: 49409 - DNA, 228 bp, Artificial Sequence
  Description of Artificial Sequence: Synthetic coding sequence
atgggacgcaaagacgccgctactatcaaactgcccgtcgaccagtaccgcaagcagataggcaaacaggattacaaaaagactaagccaatcttgcgtgctaccaagctgaaagccgaagctaaaaaaaccgcaatcggaattaaggaagtgggtctcgtgcttgcagcaatacttgcactgctactggcgttctacgcctttttctacctacggcttacaacttag

SEQ ID NO: 49410 - DNA, 261 bp, Artificial Sequence
  Description of Artificial Sequence: Synthetic coding sequence
atgggccgtaaagacgccgctacaattaagctgcccgttgaccagtaccgcaagcagataggcaagcaggattataagaagaccaagcccattttgagagccactaagttgaaggcggaagccaagaaaacagctattggcatcaaagaagtaggactcgtcctcgctgccatcctggcattgctgctcgccttttacgctttcttttaccttaggttgaccacagatgtggatccagacttggaccaggatgaggactag

SEQ ID NO: 49411 - DNA, 261 bp, Artificial Sequence
  Description of Artificial Sequence: Synthetic coding sequence
atggggagaaaagatgcagctaccattaagctgccggtggaccaatataggaagcagataggcaaacaggactacaaaaagaccaaacctattttaagggccacgaagttgaaagcagaggccaaaaaaaccgccatcggcatcaaggaggtgggtcttgtcctggcggcaatcctcgccctcttgttagcattttacgcattcttttatctccggcttacaaccgacgtcgacccagacctcgatcaggacgaggattag

SEQ ID NO: 49412 - DNA, 261 bp, Artificial Sequence
  Description of Artificial Sequence: Synthetic coding sequence
atggggcgtaaggacgcggctactattaagttacctgtggaccagtacagaaagcaaatcggcaagcaggactacaagaagaccaagcctattcttagagctaccaagctgaaagccgaagccaagaaaacagctatcgggattaaggaggtgggcctggtgctggcagctatcctggccttactcttggccttttatgcattcttctatctgagactgacaacagatgtggatcctgacctcgatcaggatgaggactag

SEQ ID NO: 49413 - DNA, 261 bp, Artificial Sequence
  Description of Artificial Sequence: Synthetic coding sequence
atggggcgaaaggatgcggcaacaattaagctgcctgttgatcagtatagaaaacagattggcaaacaagattacaagaagactaagcctatcctgcgcgcaacaaagctcaaggccgaggcaaaaaaaactgccataggaatcaaagaagttggactcgtccttgcagcgatcctagccctgctcttggcattttatgcattcttctacctccgcctgaccactgatgtggaccctgatctggaccaggacgaagactag

SEQ ID NO: 49414 - DNA, 261 bp, Artificial Sequence
  Description of Artificial Sequence: Synthetic coding sequence
atggggcgtaaagatgcagctacgatcaaactgcctgtggatcaatacagaaaacagatcggaaaacaggactataagaagaccaagcctatattgcgggctactaagcttaaagccgaggcaaagaaaacggccatcgggataaaagaggttggactcgttctagctgccatcctagcattgctgctcgctttctatgccttcttttatctccgcctcacgacagatgtagaccccgatctagatcaggacgaagactag

SEQ ID NO: 49415 - DNA, 261 bp, Artificial Sequence
  Description of Artificial Sequence: Synthetic coding sequence
atgggtcggaaggatgccgcaactataaagctgcctgtggaccaatataggaagcagatcgggaagcaggactacaagaaaactaaacctattctgcgtgccacaaagctgaaagccgaggccaaaaagaccgccattggcattaaggaggtgggcttggtgctggcggctattctagccctgttattggcattctacgcattcttctacctgcgtcttacaacggacgtggaccctgacctggaccaggatgaggattag

SEQ ID NO: 49416 - DNA, 27 bp, Artificial Sequence
  Description of Artificial Sequence: Synthetic coding sequence
atgggacgtaaggacgccgctacttag

SEQ ID NO: 49417 - DNA, 261 bp, Artificial Sequence
  Description of Artificial Sequence: Synthetic coding sequence
atggggagaaaggatgcagccacaataaaactcccagtggatcagtaccgcaagcagatcggcaaacaggactataagaagaccaaacccatcctgcgagccaccaaactgaaggctgaagcaaaaaaaacggccatcgggatcaaggaggttggcctcgtgctggcagcgattttggccttattgttagccttttacgcattcttttatctccgcctgacaactgatgtcgaccctgatctcgaccaagatgaggattag

SEQ ID NO: 49418 - DNA, 261 bp, Artificial Sequence
  Description of Artificial Sequence: Synthetic coding sequence
atgggcaggaaggatgcggctactatcaagttaccagtggatcagtatagaaagcaaattgggaagcaagactataagaagactaagcccattctgagagctacaaagctgaaggccgaggcaaaaaagactgcaataggcataaaagaggtgggtttggtcttggccgcaatcctggcgctgttactggcattctatgcattcttctatctgagattgacaaccgatgtggatccagacctcgatcaggatgaagactag

SEQ ID NO: 49419 - DNA, 384 bp, Artificial Sequence
  Description of Artificial Sequence: Synthetic coding sequence
atgaattttatactgttcatctttatccctggtgttttctccctgaaatctagcactctgaaacctacaatagaagcactgccgaatgtgctcccactgaatgaggacgtgaataagcaggaggagaagaacgaggatcacactcccaattatgcgcctgccaacgagaagaatggaaattattataaagacataaaacaatatgtcttcacgacccagaacccaaacggaaccgagtccgaaatttctgtgcgggcaactacagacctcaacttcgcccttaagaatgacaaaaccgtgaacgctacaacgtatgagaaatccactattgaggaggagacaactacctccgagccaagccacaagaacattcagtctatttag

SEQ ID NO: 49420 - DNA, 885 bp, Artificial Sequence
  Description of Artificial Sequence: Synthetic coding sequence
atgaatttcatcctctttattttcatcccgggagtgttctcattgaagagcagcaccctgaagcctaccatcgaggccctccctaacgtactgcccctgaatgaggatgtcaataaacaagaggagaaaaatgaagatcacactcctaattacgcacctgcaaatgaaaaaaatggtaattactacaaagacattaaacagtatgtgttcactacccagaacccaaacgggactgaatctgagatttccgtcagggccaccactgacctgaacttcgcactcaaaaacgacaagaccgtgaacgccaccacttatgagaagtccactatcgaggaggaaactaccacctcagagccttctcacaagaatatccagcgatcaacccccaacgtgcctgcattttggacaatgctggcaaaagctattaatgggactgcagttgtgatggacgacaaagaccaactgttccaccccatacctgaaagcgacgttaacgcaacacagggcgagaatcagccagatctggaggatctcaagataaagattatgctcggaatttctctcatgaccttgctcctttttgtggttttgctggctttctgttcagccacactgtacaaattgcggcatctcagctacaaatcttgcgagtcccagtactcagtgaaccctgaactggccaccatgtcctattttcacccaagcgagggcgtgtcagatacttcctttagcaaatctgcagagtcaagtacattcctgggcacaaccagcagcgatatgcgcaggtccgggacacggacaagtgagagtaagattatgacagacatcatctctataggaagtgacaatgagatgcacgaaaatgacgagtcagtgacgcggtag

SEQ ID NO: 49421 - DNA, 798 bp, Artificial Sequence
  Description of Artificial Sequence: Synthetic coding sequence
atgaattttatcctgttcatcttcattcctggcgtgttctccctaaagtcaagtacactgaaacctactattgaagccctgcctaacgtgctgcctctgaatgaagacgtcaataaacaggaagagaaaaatgaggatcacactcctaactacgcccctgctaatgaaaagaatgggaattactataaagacattaaacagtacgtgtttaccacccaaaatccaaacggtacagaatccgaaatctccgtcagggctactaccgacttaaactttgcactgaaaaacggttccacgccaaatgtaccagcattttggactatgctggcaaaagcaatcaatggcaccgcggttgttatggacgacaaggatcagctgtttcacccaattcccgagagcgatgtgaacgccacccagggggagaatcagccagatctggaagacttgaagatcaaaatcatgctgggtatatcccttatgacactgttgctcttcgtagtcctactggccttttgcagtgcgacattgtacaaactgaggcatcttagctacaagagctgcgagtcccagtattccgtaaatcccgagttggcaacgatgtcatatttccacccgtcagagggggtgtccgatacatcattcagtaagagcgcagagtcctccactttcctaggtacaactagctcggacatgcgcagatctggcacccggacctccgaaagcaagatcatgactgatataatcagcattgggtccgataacgaaatgcacgagaacgacgaaagtgtgacgaggtag

SEQ ID NO: 49422 - DNA, 339 bp, Artificial Sequence
  Description of Artificial Sequence: Synthetic coding sequence
atgggctctcggttgagccagccctttgagtcttacattacagcccctcccggaaccgccgcagcacctgcaaaacccgctcccccagcaacacctggcgcacctaccagtccggctgaacaccggctgctaaaaacctgttggtcatgcagggtcctttccggactaggccttatgggtgccggtggttatgtgtattgggtcgccagaaagcctatgaagatggggtatccacccagcccctggaccatcacacagatggttatagggctgtccattgccacatgggggattgtggtgatggctgaccccaaaggaaaagcttaccgcgtcgtctag

SEQ ID NO: 49423 - DNA, 1212 bp, Artificial Sequence
  Description of Artificial Sequence: Synthetic coding sequence
atgtcaactagcacttcccccgctgcaatgctgctacgtcggctgcgacgactcagctgggggagcacagctgtgcagttattcatattaactgtagttacctttgggttgctcgctccactcgcctgtcataggcttctgcactcatacttctatctgagacattggcacctcaatcaaatgagtcaggagttcctgcagcagtccctgaaggagggcgaggccgcacttcactatttcgaggagctaccctccgccaatggctctgtccccatcgtgtggcaagcaactcctaggccttggctagtcattaccattatcaccgtagatagacaaccagggttccactatgttttgcaggtcgtgagtcagtttcatcggcttctgcaacagtgtggtccacagtgcgaaggccatcagctgttcctgtgcaatgtcgagagaagcgtttcccacttcgacgcgaagttgctgtccaagtatgtaccggtggcaaacaggtacgagggcacggaagatgactatggggatgacccctccacaaactcctttgagaaagagaagcaggactatgtgtactgccttgagtcctctctacaaacctacaaccccgattacgtgctgatggtggaggacgacgctgtgccagaagagcagattttccctgtcctagaacacctgctgagagcgagattttcggaacctcatcttcgggatgccctctacttaaaactttaccaccctgaacggttgcagcattacatcaaccctgagcctatgaggatcctggagtgggtaggagtggggatgcttctcggacctttgctgacctggatctatatgcggtttgcatctcgaccgggatttagttggccagtaatgctgttcttctctctgtacagtatggggttggtagagctagtgggtcggcactactttctcgaactccgacggctgtctccttcactctattctgtcgttcccgcatcgcagtgttgcacacccgctatgctgttccctgcaccagccgcacgcagaacattaacatacctctcgcaggtttattgccacaaaggttttggaaaggatatggccctctatagcctgctgagagctaagggagagcgggcatacgttgtcgagcctaacctggtgaagcatatcggcctgttttccagcttacgttataactttcatccttctctgttgtag

SEQ ID NO: 49424 - DNA, 1212 bp, Artificial Sequence
  Description of Artificial Sequence: Synthetic coding sequence
atgagcacatctaccagccccgctgccatgttgctgaggagactgcgaaggctctcatggggttccacagccgtgcagctgttcatcttgaccgtagtcacatttggtttgctagctcccctggcttgtcaccgactcctgcacagctatttctatctgcgtcattggcacttgaatcaaatgtcccaggagttcttgcagcagtctttaaaagagggtgaggcggcacttcattacttcgaggaactccccagtgcaaatggatcagtcccgattgtatggcaagccaccccgcgaccctggctggtaatcactattattactgtcgatcgacagcccggattccactacgtgctccaagtcgtatctcagttccaccgattgctccagcaatgcggcccacagtgcgaagggcaccaactgttcttgtgcaatgtcgagcgttccgtttcccacttcgacgcaaaactcttgagcaaatacgtgccagtggcaaatcgctacgaagggactgaggacgactacggggacgacccttccaccaacagctttgagaaggagaagcaggattatgtgtactgtctggagtccagcctgcagacctacaatccagattacgtcctgatggtggaggatgatgctgtgcccgaggaacagatctttcctgtactagagcatctcctgcgggctcggttttcggagcctcatctgagagacgccctgtacctgaagctctatcatcctgaacgtcttcagcattacataaaccctgagcctatgcgcatactggagtgggtcggggtcggtatgctcctgggacctctgctcacctggatctacatgaggttcgcctcccggcctgggttttcttggcccgtcatgttattcttttccttatactcaatgggcctggtcgaactggtgggtcgccactattttctcgaactgaggcgcctgtcgcccagcttatatagtgtagtgccggcatcacaatgctgcacaccggctatgctgttcccagctcctgctgctcggagaactctgacttacttatcacaagtgtactgtcataagggctttggaaaagacatggccctctatagccttctgcgggcaaaaggagagcgcgcttatgtcgttgaaccgaacctggtgaaacatataggcctattctcgtcgctccgttataactttcacccgtccctgctctag

SEQ ID NO: 49425 - DNA, 1212 bp, Artificial Sequence
  Description of Artificial Sequence: Synthetic coding sequence
atgtccacatcaacttcccccgctgctatgttgctgcgcaggttgaggcgcctctcttggggctccactgcggtacagttatttatcctgactgtagtcacttttgggctgctggccccactggcctgccacaggcttctgcacagttacttctatctgaggcattggcacctcaaccagatgagccaggagtttctgcagcagtctctgaaggagggagaggctgcattgcactacttcgaggagctacctagtgccaacggcagtgtgcccatcgtctggcaagccaccccacgtccatggctcgtgatcacaatcattacagtggatcggcaacctggattccactacgttttgcaggtggtgagccagtttcaccggctcctgcaacagtgtggccctcaatgtgaagggcaccagctcttcctgtgcaacgtggaacggtccgtctcacatttcgacgctaaactgcttagcaaatacgtccctgtagcgaaccggtacgagggcacagaggatgattatggtgatgaccctagcaccaacagctttgagaaggagaaacaagactatgtctactgtctagaatcgtcactccaaacgtataatcccgattacgtgctgatggtggaggacgacgcagttcctgaagaacagatcttcccagtcctcgaacacctcctgagggcccgtttttcggagccgcacctgcgcgacgccttgtacctgaaactgtaccatcccgagagactacagcactatattaaccccgaacccatgcggattctggaatgggtgggcgtcgggatgttgttggggccactgctgacttggatatacatgcggttcgcctcccgccctgggttcagctggccagtcatgctgttttttagcctttactccatgggtttggtggagctcgtgggcaggcactacttcctggagttgagacgcctgagcccaagcttatacagcgttgtgcccgcatctcaatgttgtaccccagccatgctatttccggctcccgctgccaggcgtacactaacatacttaagtcaggtctattgccacaaaggtttcgggaaggacatggccctgtacagcttattaagagccaagggcgagcgcgcatatgttgttgaaccaaacctcgtgaagcatatcggcctcttctcttccctgagatacaacttccacccttctctattgtag

SEQ ID NO: 49426 - DNA, 690 bp, Artificial Sequence
  Description of Artificial Sequence: Synthetic coding sequence
atggattccttggacagatcttgtcaggactggtgcgaccggaaacaacactggttagaaataggacctcctgatctggtcgagcgtaagggaagccttaccttgcgctctcaccataaaaagtattcaaaaccagtgctggtgtatagttggcacagagaccgggaggccttcccaaaaggctacgatatcgaggggcctgagaaagtcaaaaaactgtgcaatagtacctatcgtagactaggaaccgacgagagccctatatggaccagcgaaacacacgaaaagctgagtcaaatgtgtctgaacacagagtgggttgagatgaagagcaaggcactgctgaatgaggagactgtgtccagcggaataattgaaagggtcaccggactccccgcaacaggatttggtgccgtgttccccaggcaccccccagattggagtaaaatgtgcgcattgactacttactctgaggattacgtgcctccctacgattatcagcctcacgcatacccctgccaggatgactattctatcgttcacagaaaatgcaggtcacagtttacagacctgaacggttctaagagatttggcataaatacctggcacgatgagagcggaatttacgcaaatagcgatgtcaaacagaaactataccctctgacctccggccctattgtgcccatttag

SEQ ID NO: 49427 - DNA, 1272 bp, Artificial Sequence
  Description of Artificial Sequence: Synthetic coding sequence
atggacagggggcagccatctctggagcccgctgctgctgcgcctcgcgcatcaggcagatgcgtcatcgctcctgtccgcgctgtgctccgcttacgtagaagggtgtgcgtgttgcggaaacgtcgacttctacagccgggaggagggcctgacgtcggcacgggagcacctaggccagggtgtagcccccgagccccaagggctgacctcgatcagcccaaatttttcacctttgatagtcccgctgaactgccaagtcgaacacccagaaaaaagaggcggaggtctagactggtgctgtaccccgagacctcaagaaagtaccggcctagagtggaacaccgctccagagctcagcgatgtctgctgctgttggtagcgattgttggattccaggtgttaaacgccattgaaaatctagacgataacgcgcagcgctatgacctggacggcttggagaaagctctgcaacgagcagtgttcggtcagccagccgctgtaagtcgaattgtcgctcttatgagggattatctcgcaacccacgtacactcacgcccactcctcctggctttacatggaccctctggagtggggaaaagccatgtggggcgtcttttagccagacatttcaggtctgtgctggaagactctgcactggtgttgcaataccacgcaagacaccactgtcctgaggccagggccgcacaggattgccgagaggagctcgctaggcgggtggccgatgtggtggcaagagctgaagctgaggagaaaactccattgctcgtgcttgatgatgtcgagctgatgccaaggccacttctggatgagctccacgggttcttgcagccacagaggtcacatcactttcataacgccatatatgtgcttttgtctggagcaggtggcgcagaggttacgcgtttcgtgctgcagaacgcttcacgcgcacttcctttacgccctgacggttttaggagcgccgaagctgccgctgcccaagccgaggaggatctgcgcgctagcctcctcgctgtgctgtctcgggagcaccctctctggcaggccgctgctattgtacccttcctgctgcttgataaacgagatgtggtgtcatgcttccgcgatgaaatggcaggagagggcttctttccggaccaggcaagagccgagaacttagcagcacagctctccttctatagggttgcaggcagggaatttgcggtcacaggatgcaagcaggtcgtggccacagtcaacctgctgtag

SEQ ID NO: 49428 - DNA, 4941 bp, Artificial Sequence
  Description of Artificial Sequence: Synthetic coding sequence
atgtggcatggaaaccacgtgcagcctggggctactcaccggcctaatcagggcctggaaatgctccaaggactcgggatcgggatgaaagcattccataattttaactattttctgtttttctacaacgtcctcttgggtctgggggcttgtctgtctagactcttaatctcttgcttgttaggaatgtggctgatagcccgaatagatcggaccattatgcagtccggatacgagggcgcagatatgggattcagtgcttggattggaatgctctatatggatcactatcacattaacccagtcctcgtgtcgttctgccatatactgatcacaaaccaccgggagaaaaagcttcagcagtcaactaaatattggtgtctcaaccagtccgccgaatcgcttcggatctgcgctatgagagggggtgaaaatagaccccctgctagggttcagtcctcctctgaagaacttgaacttcggcaccagtctctggacgcatttccaggcaggagattgcccggacggggaattcagccagccgcaaagatgagctctgttggcaaggtcactcaggtgcccaacggcaaagcataccagcagatttttcaggcagaagtccagctggtgcattccttggcggcaactagaaagcgggcagcagaaagatcagtcacactcaagtccggcaggattcccatgatgaagaaggtcgagactccagagggtgaggttatgtcgcccaggcaacagaagtggatgcatagtcttcccaatgattggatcatggagaacccagtgttgcaccgggagaaagagagggctaagcgagagaaggcgagggagtctgagaacacaattgccgcacgggaagtgcgtggtctgatggatacaatcgtacctgagaagatttccacctcaactttccaacggcaggcagaacacaagcggaagtcttacgaaagtgcactcgccagttttcaggaggaaattgcacaggtcggtaaggagatggagccgttgattgttgacaccggcggattgtttctcaagaaactcactgagtccgatgaggagatgaatcgcctctttctgaaggtggaaaacgatacaaatctcgaggactatactattcaggccctactggagctctgggacaaggtcgcaggaaggctcttattaaggaaacaagagatcaaggagctggacgaggctctgcactcactggagttcagcaggacggacaagctaaagtcagtgctaaagaagtacgctgaggtgattgaaaagacatcctacctgatgcgccctgaagtataccgattgataaacgaggaggccatggttatgaactatgctttacttggaaatcgcaaagccctagcccagctcttcgtcaacctaatggagagcaccctccagcaagagctggattcacgtcacagatggcaggggctggtggacacatggaaagccttgaagaaagaagcgttgctccagagtttttccgagttcatggctagtgagagcatccacacccccccagccgtgaccaaagagttggaagtcatgttgaagacacaaaacgtgcttcagcagcgccgactgaagcacctgtgtacaatctgcgacttgctgccacccagctatagtaaaacgcaactgactgagtggcacagctcccttaatagcctcaacaaggaacttgacacatatcacgtggattgcatgatgcgcattcgactgctgtatgagaagacctggcaggaatgcctgatgcacgtgcagaattgtaagaagcagctcctagactggaaggcatttacagaggaggaggctgagaccctggtcaatcaattcttttttcaaatggtgggggcacttcagggcaaagttgaagaggacctggagctacttgacaagagcttcgagaccctcgctgatcagacggaatggcagagtagtcatctctttaagtactttcaggaggttgtgcaattatgggaagcgcaccagtcagaactgttagtgcaggaactcgaactggaaaaaagaatggaacagcacaggcagaagcatagcctggagtcgcaagtgcaggaggctcacctggataggctcctggaccagctacgacagcagagtgacaaagagaccctcgcattccacttagagaaggtaaaggattatctgaaaaatatgaagagccgctatgagtgttttcacacccttctaactaaagaggtgatggagtaccctgcaatcatgctgaaggagttgaattcttactcctctgcactctctcaatacttttttgtccgcgagatctttgagcagaatttagctggggaggtcatctttaaattcagacagcccgaagcacatgaaaaacccagccagaagagagtgaagaagctgagaaagaagcagggaagcaaagaggacatgacccggtcggaagagtcaatctcttccggaacctccacagccaggtccgtcgaggaggtcgaagaggagaatgatcaggagatggagtcattcattaccgaagaggtgttgggtcaacagaaaaagtcccctttgcatgcaaagatggacgagagcaaggagggctcaatccagggactggaggagatgcaagtcgagcgcgaaggatctctgaacccatcgctgaacgaggaaaatgtgaagggccagggcgagaaaaaagaggagagtgaggaggaagacgagaaagaagaggaagaggaggaggagaaacttgaagaagagaaggaagaaaaagaggctcaggaagaacaggaaagcttgagtgtcggtgaggaggaagacaaggaggagggactagaggagatttactatgaagatatggagtctttcaccatttcttctggtaacacatactttgttttcgtgcctctggaggaggaacattgtcgcaaaagccacagtacattttccgcaatgtttatcaacgatacgagctctgctaagttcatagaacaggtgactatcccctcaagattaatcttggagatcaaaaaacagctgttcagcgagggtggaaattttagccccaaagagatcaactccctctgcagccgactcgaaaaggaggcagcgaggattgagctggtggagtccgtgatcatgttgaatatggaaaaactggaaaatgagtaccttgatcaagcaaatgatgtcatcaataaatttgaaagtaaattccataacctgtccgttgatcttatttttattgagaaaattcagcgactgttgacaaacctgcaggtgaagatcaaatgccaggtcgcaaaatccaactctcagaccaatggactgaacttctctctccaacaactgcagaataagataaagacctgccaagagagtagaggggagaaaaccaccgtaaccactgaggagctgctgagcttcgtgcagacttggaaagaaaagctgagccagaggatacagtacttaaactgctctctcgacagggtgtccatgacagagctggtgtttacaaataccatcttgaaagatcaagaagaggacagcgacattcttacatcaagcgaggcactggaggaggaagccaagcttgatgttgtgacgccagagtcattcactcagctgtccagggttgggaagcctctgatagaagacccagctgtagatgttatcagaaaactgctccagcttcctaatacaaagtggcccacgcaccactgcgacaaggacccgtcacagaccggcttcaaacgacataggtgccaacccgagaattccggcaaaaaggccgtgccttcagctagcgccacatccgctgggtcgttgcagaccactcatccgccactgtcacattcgtttacccctcacccaaaacctaacaaaatggaacgcaagtaccgcgttctgggggataagcccccaccggctgcagaggacttcaaggggataatcctaaccctactgtgggagtcttccgagaatctgcttacggtagcggaggaattctatagaaaggagaagcgcccagttacaaggccggactgcatgtgcgacacatttgaccagtgcgccgagaatatcagcaaaaaaatcctcgagtaccagagccaagcaaacaaataccataacagttgcctcattgaattgagaatccagatccggaggttcgaagagttgcttccgcaggtgtgctggttggtgatggaaaatttcaaggagcaccactggaagaaattcttcaccagcgtaaaagagatccgaggtcagttcgaagaacagcaaaaaagactggagaaaaggaaggacaagaatgcccagaagctgcatctcaatctcggccatcctgttcatttccaggagatggaaagtctgcacttgtcggaggaagaacggcaggaggaactggattcaatgattcggatgaataaagaaaagttggaagagtgcacaaggcgcaatggacaggtgtttattactaacttggccacctttaccgaaaagttcctgctacaactggatgaggtcgtcacaattgacgatgtgcaagtagcaaggatggaaccccctaagcaaaagcttagcatgttgatcagaaggaagctggccggtctgtccctcaaggaagaatccgaaaaaccgctgatcgaacgtggctctcgcaaatggcccggaatcaagccaactgaggtcacgatccagaacaagattctgctgcaacctacatctagtatatccacaacgaaaacaactctgggccacctagctgccgtggaggcacgcgatgctgtttatctaaagtacctcgcctccttcgaggaggagctgaagaggatccaagatgactgcacatcccagatcaaagaggctcagcgctggaaagattcttggaagcaaagtcttcacacaattcagggcctgtacgtttag

SEQ ID NO: 49429 - DNA, 5105 bp, Artificial Sequence
  Description of Artificial Sequence: Synthetic coding sequence
atgcgtgggggagaaaaccggccacctgcccgagtccagtccagctcggaggagctagaactgagacatcaaagcttggatgcgttccccggtaggagactgcctggtaggggaatccagcctgcagctaaaatgtcatcagtgggcaaggtcacccaggtgcctaatggaaaagcgtatcagcagatatttcaggctgaagtccaactcgttcactccctggcagctactaggaaacgcgcagctgagagatccgtcactctgaaatccgggagaatcccaatgatgaaaaaggttgagaccccagagggagaggtcatgtctccgcgacagcagaaatggatgcattcgctcccaaatgattggattatggagaacccagtgctacatagagaaaaggaacgggctaaacgggagaaggccagggaatccgaaaataccattgccgctcgggaggtaagaggattaatggatacaattgtgcccgagaaaattagcacatctacattccaacggcaggctgagcataagcggaagtcctatgagtcagctcttgcatccttccaggaggagattgcgcaagtgggcaaagagatggaacccttaattgtcgacacgggcggactgtttttgaagaaactgacagaatccgacgaagaaatgaacaggctgttccttaaggtggaaaacgatactaacttagaagactatactatccaggcattgttggaactctgggacaaagtcgctgggaggcttctgctgagaaaacaggagataaaggagttggatgaagccttgcattccctggaattctcacggacggacaagttgaagagtgtcctcaaaaagtatgctgaggtgatcgagaaaacatcatacctgatgcggcctgaggtgtatagattgataaacgaagaagctatggtaatgaactacgccctactgggcaaccggaaggccttagcccagctgttcgtgaacctcatggagtcaactctgcaacaagagctggactcaagacatcgttggcaaggattagtcgatacctggaaggcacttaagaaagaagcactgttgcagtccttttccgagttcatggcctcagagtccattcatactcctccagcagtgacaaaggagctggaggtcatgcttaaaacacagaatgtgctccagcagagacgactgaaacacctgtgcacaatttgtgacctgctgccaccatcctattcaaaaacgcagcttaccgaatggcactcgtcgctgaattcccttaacaaagagctcgacacttaccacgtggattgtatgatgcggatccggctcctctacgagaaaacctggcaagagtgtcttatgcacgttcagaattgtaaaaaacagctactggattggaaggctttcaccgaagaagaagcggagacgctggtcaaccagttttttttccagatggtcggagcactgcagggcaaggttgaagaggacctcgagctcctagataagagtttcgaaaccctggctgatcagaccgagtggcagagctctcacctgttcaaatactttcaggaggtagttcagctctgggaagcccaccagtcagaactcttagtgcaggagctcgagctcgaaaagcgaatggaacaacacaggcagaaacattcactggagtcccaggtgcaggaggcccacttggaccggctgctggaccagctgcggcagcagtccgataaggagactctggctttccatctggaaaaggtaaaggactatctaaaaaatatgaaatcgcgttacgagtgtttccacaccctgctgactaaagaagtaatggaataccctgccatcatgctgaaggagcttaattcctattcctctgctctgtcccagtatttttttgtgagagagatattcgagcagaacctcgccggtgaagtgatttttaagttccgccagccggaagcgcacgagaaaccctcccaaaaaagggttaaaaagttaaggaagaagcaaggctccaaagaagacatgacccgttcagaggagtccatctcctcagggacctctaccgccagaagtgtggaagaagtcgaggaggaaaatgatcaagagatggaatccttcatcaccgaggaagtgctcggacagcagaagaagagccctcttcatgcaaagatggacgagagcaaagagggctccatccagggcttggaggagatgcaggtggaacgggagggatctcttaacccttctctgaacgaggaaaatgtgaagggacagggcgaaaagaaggaagaatccgaagaagaggacgagaaggaagaagaggaagaggaggagaagctggaagaggaaaaagaggagaaagaggctcaagaggagcaggagtcattaagtgtgggtgaagaagaagataaagaggaaggactcgaggaaatttattacgaagacatggaaagctttacaatctcaagtgggaatacgtatttcgtgttcgtgccactcgaagaggagcattgtcgtaagtcccactcaaccttcagcgccatgtttatcaatgataccagctctgctaagtttattgagcaagtgaccatcccaagtaggctgatcttggagattaagaagcagttgcgtgccggattcttcgaacatttggaaaagtggtttgaccagtgctcactgaatacgagagttacagtggctaccaagattaacgaactggattccgagctggaactgcacctgcacttgcaccaacccagagcacaacagatcgaaaaagacatacacaacgtgcgcgctgcagagttactactccaccaggagcaactggattctcattgcgccggagtgacagaaaccctgaagaagaagcgactcatgttttgtcagtttcaggaggaacaaaatgttaggagtaagaactttagactaaagatctacgacatggagcatatttttctcaacgctactcgaagccagaagctagtgaccctgtccaataccctgcaccaagaactcctatcttacgtcgacgtgacacaagtatcccttagatcctttagacagtatctcgaggaatctttggggaagctgagatatagtaatatagagttcataaaacattgtagactgttttccgagggcggaaacttttcccctaaggaaatcaattctctatgcagccgtctggaaaaggaggcagcacgcatcgagctggtagagtccgtcattatgctgaacatggaaaaattagagaacgagtatctggatcaggcaaatgacgtcatcaacaagtttgaaagtaaattccataatctgagcgttgacctgatattcatcgagaagatccaacgcctgcttaccaacctacaggtcaaaatcaagtgccaggtcgctaaaagcaactcccagacaaatgggctgaacttctccctccagcagctccagaataaaattaaaacttgccaggagtcgaggggggaaaagaccacagtgactactgaagagcttctctcttttgtgcaaacatggaaagagaaactcagccagcgcatacagtacttgaactgttcccttgacagagtctccatgaccgaattggtctttaccaacaccattctgaaggatcaggaggaagatagtgacatactcacatcctctgaggctttagaagaggaagccaagctggacgttgtcacaccagagtctttcacccagctttcacgggttggtaaaccattgattgaggacccagcagtagacgtgatcagaaagctgctgcagctgccaaatacgaaatggcctacgcatcactgtgataaggacccatcacagaccggacgaggcgcatgggcatgcgggagccgcggatcctctgaagcgggtgccggtggtgccgtttgttcacccccagtgctttgctcttgtccagggccatcaagccctaagggattcaagcggcaccggtgtcagcctgagaattctggtaaaaaagccgtgcctagcgccagcgctacatccgcaggatcctttacaccccatcccaagcctaacaagatggagcgaaagtacagggtactgggcgacaagcctcctccagctgctgaggacttcaaaggcataattctgacactcttatgggagtcgtccgagaacttattaacggttgctgaggaattctaccgcaaagagaaaaggcccgtgacccgccctgactgtatgtgcgacacctttgatcaatgcgcggaaaacatttccaagaaaattttggaatatcagtctcaggccaataaataccataatagctgtctgatcgagctccggattcagattagaagattcgaagagctgctccctcaggtatgctggctggtcatggagaactttaaagagcaccactggaagaagttcttcaccagtgtcaaggaaattcgcggtcagttcgaggagcagcagaagcgcctggagaaaagaaaggacaaaaatgcccagaagctgcacctaaatttgggccacccggtgcatttccaagagatggagagcctgcacctctcggaggaggagaggcaagaggaactagattctatgatacgaatgaataaggaaaaattggaagaatgcacccgcaggaacggccaggtttttatcaccaacttagcaaccttcacggagaaattccttctacagctggatgaagtggtcaccatcgacgacgttcaggtggccagaatggaaccaccaaagcagaagctctcaatgctgatccgcagaaaattggctgggctgtccctgaaagaagagtccgaaaagcctctgatcgaaagggggtcccggaagtggccaggaatcaagcccacagaggtgaccatccagaacaaaatcctactgcagcctacgagttccatcagcacaaccaagacaactttgggtcacctggctgccgtggaggctcgagatgccgtctatcttaagtacctcgcgtcgtttgaggaagagctgaagagaatccaagacgattgcacatcccaaatcaaagaggcccagcgctggaaagattcttggaaacagagtttgcacaccatacagggcctgtacgtgta

SEQ ID NO: 49430 - DNA, 663 bp, Artificial Sequence
  Description of Artificial Sequence: Synthetic coding sequence
atgtggcatggcaatcacgttcagccgggagccactcaccgccctaaccaaggacttgaaatgctacagggccttgggatcggcatcctcaccatctctatagtcgtgggcctcatgatactccagatgtgtatcgcagccagtttcttccttcagccgaagttaggaactgccgacaagcagaagccactggccctgaacaatagaaaagcctttcacaatttcaactactttctgttcttttataacgtgctgctgggcttaggagcgtgcctcagcagacttctgatcagctgcttattagggatgtggttgattgcgagaattgatagaaccatcatgcagtctggttacgagggagcggacatgggattcagtgcctggatcggtatgctgtacatggaccactaccatatcaaccccgtgctggtgtccttctgccatatcttaatcactaatcacagagagaagaagttgcaacaatcgacaaagtactggtgtctgaatcagagcgcaggcccacatgtatcagccaggtccaggactcgctggttcctgctccagaccttaatcgataatccacgcctcacgatgcaccgcaaactgaagctgggacattcctctcaggagagtcaaatattaatggcttgctccgagtcttag

SEQ ID NO: 49431 - DNA, 2049 bp, Artificial Sequence
  Description of Artificial Sequence: Synthetic coding sequence
atgtggcatggtaatcacgtgcaacccggagccacccaccgcccaaatcagggcttagagatgctgcaggggctgggcatcgggatgaaagcgtttcataacttcaactattttctctttttctataacgttttgctgggcttgggagcatgtctctccagacttttaatctcgtgcctactcggcatgtggttgattgcacgaatcgacaggacgatcatgcaatcaggatatgaaggagccgatatgggcttctcagcatggattgggatgctgtacatggaccactatcacatcaacccagtacttgtctcgttctgccatattcttattacaaatcatcgcgagaagaagctgcagcaaagcaccaagtattggtgccttaatcagtccgccgaaagtcttaggatttgtgccatgagaggcggagaaaatcgccctccagcacgggttcagagctcttctgaagagctggaactgcggcaccagtctctcgacgctttcccaggtaggagactgccagggagaggtattcagcctgctgcaaaaatgagttctgtgggtaaggtgactcaagtgccgaacgggaaagcttatcagcagatatttcaggccgaggtgcagttagtgcacagcctggcggctacccgcaagagggccgctgagcgctccgtcaccctgaaaagtggtcggatccctatgatgaaaaaggtcgagaccccagaaggcgaggtgatgagtccaaggcagcaaaaatggatgcactctctccctaacgattggatcatggaaaaccccgtcctgcaccgtgaaaaggagcgggctaaaagggagaaggccagagagagtgagaacaccatcgcagccagagaggtgcgaggacttatggatacaatcgtccccgaaaagatttccacatcgacctttcagcgccaggctgaacacaaacgcaagtcttatgaaagcgcactggcgtccttccaggaagagatcgctcaggtaggtaaggagatggagccactgattgttgataccggaggcctttttctcaaaaagctgacagagtctgacgaggaaatgaatcgcctgtttctgaaggtcgaaaatgatacaaatctcgaagactacaccattcaagccctgctggaactatgggacaaagtggcaggaagactgctattacgcaaacaggagattaaggagctggatgaagcgctgcactcactggaattctcccgaaccgacaagctgaaatctgtactaaagaaatacgcagaagtgatcgagaagacgagctatctgatgaggcccgaagtgtatagactgatcaatgaagaagccatggtgatgaattacgctctgttaggcaacagaaaagcactagcgcagctctttgtgaacttgatggaatcaaccctccaacaagaactcgattctcggcataggtggcaaggtttagtggacacatggaaggccctgaaaaaagaggctctgctgcagtctttcagcgatctgctgcctccaagttactccaaaactcagctaaccgaatggcacagttccctcaattccttgaataaggagctggacacctaccatgtggattgcatgatgaggatccggctgctttatgagaaaacctggcaggagtgtctgatgcacgtccagaattgtaagaaacagctgctagattggaaggccttcactgaggaagaggccgagacactggtgaatcagtttttcttccagatggtcggggcactgcaaggaaaagtcgaggaggacctcgaactcctggacgtgcgggctggcgattgctcaactggcgagctgagaaatcctagcagactctggcagatccggcagtcggggagggtgcacaccagttcttccatctctcgaaggtggtacaattgtggtagacatacgcgggcatcctgctggtgtcggtcttggtcctggcgtcggggatggagctctacaggcagatccaccgcctggcgtgcgagatgtaggaggcctactagcatcggcagctggaccaattag

SEQ ID NO: 49432 - DNA, 2712 bp, Artificial Sequence
  Description of Artificial Sequence: Synthetic coding sequence
atgcgcggtggtgaaaacaggccacctgccagagtccagagctcctctgaagaactagagcttagacatcagtctctggatgcatttccaggcaggaggctgcctgggaggggaatccagcccgctgccaagatgtcttctgtcggcaaggtaacccaggtacccaacggaaaggcatatcagcaaatcttccaagccgaagtgcagctcgtgcactctctggcagctacaagaaagcgagccgcagaaaggtcagttaccctgaagtcagggaggataccgatgatgaaaaaggtggaaacgccagagggggaggtaatgtcgccgcgacagcaaaagtggatgcattctttacccaacgattggatcatggaaaaccccgtactacatagagagaaggaacgcgcaaagcgagaaaaagccagggaaagtgagaacaccatagccgctcgagaggtgcgagggttgatggacacaatagtccccgagaaaatctctacttcaacctttcagcggcaagccgagcacaaaaggaaatcatacgaatcagccctcgcctcattccaggaagaaattgcccaggagatggagccactgatcgtggacacaggcggattatttctcaaaaagctcaccgagtccgacgaggaaatgaatcggctgtttctgaaggtcgagaacgatacgaatcttgaagactacacaatacaagctttactcgagctctgggataaagtggctgggagactgctcctgcgcaagcaggagattaaggaactggatgaagcactccacagcctggaattttcacggacagacaaattgaagagtgttcttaagaaatatgctgaggtgattgagaagaccagctaccttatgaggcctgaggtgtacagacttatcaacgaggaagcaatggttatgaattacgcattattggggaatagaaaagccctcgcacaactctttgtgaacttgatggagagcacactgcagcaagagttagatagcagacaccgttggcaaggactggttgacacatggaaagctttgaaaaaggaagcgctcctgcaatctttttctgaattcatggccagtgagagcattcatactccacccgctgtcacaaaggagctggaggtgatgctgaaaactcaaaacgtcctgcagcagcggaggttgaagcacctctgcacaatctgcgatttactcccaccaagctactcaaagacccagctgaccgaatggcattcaagcttaaacagcctgaacaaagaactagatacctatcacgttgattgcatgatgcgcattcggctgctgtatgagaaaacctggcaagagtgcctgatgcacgttcagaactgcaaaaagcaacttctggactggaaagcatttaccgaagaggaagctgagacactcgtgaaccagttcttctttcaaatggtcggcgcactgcaaggcaaagtggaggaggatctcgagctcctggacaaaagctttgagaccctcgcagaccaaactgagtggcaaagtagtcatctgtttaaatatttccaggaagttgtgcagctgtgggaggctcaccaaagcgaactgttggttcaggaacttgagcttgaaaaaaggatggagcagcatcgacagaagcacagcctggagtctcaggttcaggaagcgcatttggatcggctgcttgaccagctgcggcaacagagcgataaggagacattggccttccacttggagaaggtaaaagactacctcaaaaatatgaaaagtaggtacgaatgcttccacacactcctcacaaaagaggtgatggagtaccccgcaattatgttgaaggagctgaatagttattcttctgcactgtcccagtattttttcgtacgggaaatcttcgagcagaatctggctggggaggtgatatttaagttccgccagccagaggcccacgaaaaacctagtcaaaaacgcgtaaaaaaattgcgcaaaaagcagggcagcaaagaggatatgacgcggtcagaggagtctatttcttccgggacgagcacagcaagatccgtcgaggaggttgaggaagaaaacgaccaggaaatggagtcttttatcaccgaggaagtactgggtcagcagaagaaatctcccttgcacgccaagatggatgagagtaaagaaggaagtatccaggggcttgaagaaatgcaggttgaacgagaaggatccctcaaccctagtctgaacgaagagaatgtcaaaggccaaggtgaaaaaaaagaggagtcagaggaggaagatgaaaaggaggaagaggaggaagaggagaaacttgaggaggagaaagaagaaaaggaagctcaagaggagcaggaatctctatccgtgggcgaggaagaagacaaggaagaggggctggaggaaatttactatgaggatatggaatccttcacaatctcaagcggaaacacttacttcgtcttcgtgccactagaggaagagcattgtaggaagtctcactctacatttagcgcaatgtttatcaatgacacctcatcagccaagttcattgagcaggtcactatcccctccagactcatattggaaatcaagaaacacagggcatggtggtgcgtccctgtgatacccgctacgcaagaggcagaggcaggtgaaagccctgagcctcgcaggcgacgtctacagtag

SEQ ID NO: 49433 - DNA, 5106 bp, Artificial Sequence
  Description of Artificial Sequence: Synthetic coding sequence
atgcggggtggcgaaaaccgccctccagccagggtgcagagtagttccgaagagttggaacttaggcaccagagccttgatgctttccctggcaggcgcctgccaggtcgaggaatccaacccgcagccaagatgtccagcgtggggaaggtgactcaggtgccgaacgggaaggcataccagcaaatatttcaagccgaagtacagctcgtgcactcactggccgctacaagaaaaagggccgcagaaaggtcggtgacactcaagagcggccgtataccaatgatgaaaaaggtggagactccagagggagaggtgatgtcaccacggcagcagaagtggatgcattccctgccaaatgattggattatggaaaaccccgtgctccacagggaaaaagagcgggcaaagagagaaaaggccagggagagcgagaataccatcgctgcccgtgaagtcagaggtctgatggataccatcgtgcctgagaagatatccaccagcacatttcagaggcaggccgagcacaaaaggaaatcctacgagagtgctctcgctagttttcaagaggagattgcacaggtaggaaaggagatggagcccctaatagttgacaccggaggattattcttaaaaaagcttacagaatctgatgaggagatgaacagacttttcctgaaggtcgaaaatgatacaaacctcgaagactatacaattcaggctctgctcgaactctgggataaagtggcaggacggctcctcctcaggaagcaggaaataaaggaactggatgaggccttgcatagtcttgagtttagccggactgataaattgaagtccgtgctgaagaaatatgctgaagttattgaaaagacgtcatatctgatgagaccggaagtgtaccgcctaatcaacgaggaggctatggttatgaactatgcgctgttgggcaatagaaaggccctcgcccagctttttgtaaatcttatggagtcaactctacagcaggagctggacagtcggcaccgctggcaggggctcgttgatacatggaaagctctaaagaaggaggcattgctacagtccttctcagaattcatggcttccgagtctatccacactccacctgccgtgaccaaagaactggaagtaatgctgaaaacacagaacgtactgcagcagcggagactaaaacatttgtgtacgatttgtgatttgctgccgcctagctattccaaaacccagctgactgaatggcattcctctctcaattccctgaacaaggagcttgacacctatcacgtggactgcatgatgcgcataaggttgctctatgagaagacgtggcaggaatgcctcatgcacgtgcagaattgtaaaaagcagctgctggactggaaggcgttcaccgaagaggaggctgaaacactggtcaatcaattcttctttcaaatggttggtgcattgcaaggcaaggttgaggaggaccttgagttactggataagtcgttcgagaccttggccgaccaaaccgaatggcagagttcacacctgtttaagtattttcaagaagtcgtccagctctgggaagcgcaccaatctgaactcctagtacaagagctggaacttgaaaaacgcatggaacagcatcgccagaagcatagtctcgaatcccaagtccaggaggctcatctcgatcgactcttggaccaactgcgtcagcagtcagataaagagacactagcctttcatttggaaaaggttaaagactaccttaagaatatgaagtctaggtacgaatgctttcacaccttgctaacaaaggaagtcatggagtatccagctatcatgctgaaagaactcaattcttactcatcagccctctcccagtactttttcgtgcgtgagatctttgaacagaacctggctggggaggtgattttcaaatttagacaacccgaggctcacgagaagcccagccagaagagagtcaaaaagctgcgcaagaaacaggggtcaaaggaagatatgacccggagtgaagagtccatttcgagcggtacatccactgccaggtctgttgaagaggtggaggaggagaacgaccaggaaatggaaagcttcatcacagaggaggtgcttggccagcaaaaaaaaagtcccctgcacgccaaaatggacgaatccaaggagggatcgatccagggtctggaagagatgcaggtcgaaagagagggatcactgaacccctccctcaatgaggagaatgtgaaaggacagggcgagaagaaggaagaaagcgaggaagaagatgaaaaagaggaggaagaggaagaggagaagttggaggaagagaaggaagagaaggaagcccaggaggaacaggaatcgctcagcgtcggagaagaggaggacaaggaggaagggctagaggaaatctattacgaggacatggagagttttacgatctcctcaggcaacacttatttcgtattcgtgccgctcgaggaggagcactgtaggaaatcacattccactttcagcgcgatgttcattaacgacacctcttctgctaagtttatcgagcaagtgacaatcccctccaggctgatacttgaaatcaaaaaacaactgcgggcagggttcttcgagcacttagaaaaatggtttgaccagtgctcccttaatacaagagttaccgttgccacaaaaattaatgaactggatagcgagctcgagctacacttgcacctgcaccagcccagagcacagcagatcgagaaggacatccataatgtgagagccgcagagcttctcctccaccaggaacagttggactcccactgtgcgggagtgaccgagactctgaagaagaaacgcttgatgttctgtcagtttcaggaggagcagaatgtgcgctcaaagaattttcgccttaaaatttatgacatggagcacatttttctgaatgcaacccgaagccagaaattagtcaccctttccaataccctccaccaggaactgctgtcgtacgtggacgtgacccaagtttcacttcgctcctttcgccagtaccttgaggaaagccttggcaaacttagatattccaacattgagtttatcaagcactgcaggctattttccgaaggtggcaacttctcacccaaggagattaattctctgtgctcacggctggaaaaagaggcggctaggatcgagctcgtggaatctgtgatcatgctcaacatggaaaaattggagaatgagtaccttgaccaggctaatgacgtgatcaataagttcgagtccaaatttcacaatctctctgtggacctgatcttcatagaaaagatccagagacttctgacaaatctccaggttaagattaaatgtcaagtcgcaaagtccaactcccagacgaatggtctgaacttttctctgcagcagctgcagaataagatcaaaacttgccaagagagtcgtggtgaaaagaccaccgtgaccacagaagagctgctcagtttcgtacagacatggaaagaaaaattgagccaacgcattcagtacctgaattgtagcctggacagggtgagcatgaccgaactggtattcacaaatacaatactgaaggatcaggaggaagattctgatattcttacttcttcagaggcactggaggaagaagctaagcttgacgttgtcaccccagagtctttcactcagctttcccgagtgggtaaaccgcttatcgaagacccagcagtggatgtgatccgcaagttactgcaactgcccaacactaaatggcccacccaccattgcgacaaagatcccagccagacaggtaggggagcctgggcttgtggaagtaggggttccagcgaggccggagcaggcggagcagtctgtagcccacccgtgctttgcagttgtcccggaccatcaagccccaaaggctttaagagacaccggtgccagcccgagaatagtggaaaaaaggccgtcccatctgcctctgccacttcggcaggctctttcactcctcaccccaaacccaacaaaatggagcgcaagtatcgtgtgctgggggacaaaccgccacctgccgctgaggattttaagggtattattctcactcttctgtgggagagttccgaaaaccttttgacagtggccgaagagttttacagaaaagagaaaagacctgttacacgcccagattgtatgtgcgacacatttgatcagtgcgcggagaatatctcaaagaaaattctcgaataccagtcccaggctaacaaataccacaatagttgtctgattgaactccggattcaaataaggcgctttgaagagttgctgccacaggtttgctggttagtaatggaaaactttaaggaacaccattggaagaagtttttcactagtgttaaggagatcagagggcagtttgaagagcagcaaaagcgtctcgagaagcgcaaagacaagaacgctcagaagctgcatctcaacctggggcaccctgtgcacttccaggagatggaatcattgcacctgtctgaggaggaacggcaggaggaactggactctatgatcaggatgaacaaagagaagcttgaagagtgcacaaggcgaaacgggcaagttttcataaccaatcttgctacgttcacagaaaagttcctcctgcagctggacgaagtggtcactatagatgatgtgcaagtggccaggatggagcccccaaagcagaaattgtctatgctgatcagacggaaactggcagggttgtctctgaaggaggagtctgaaaagccgcttattgagcggggaagccgcaagtggcctgggatcaagcccaccgaagtcaccattcagaataaaatcctgctccagccaacgtcctccatctcgactaccaagacgacactgggccacttagccgcagttgaagctcgcgatgccgtctacctaaagtatttggccagcttcgaggaagaactgaagaggattcaggacgattgtactagccagataaaagaggcccagcggtggaaagattcatggaagcagtctctgcataccatccaggggctgtatgtctag

SEQ ID NO: 49434 - DNA, 2700 bp, Artificial Sequence
  Description of Artificial Sequence: Synthetic coding sequence
ggacggccagcagccgtggtcgcaggccctgctttggccgctctccgtgagagcttacgtatatgcgcgatgagaggaggtgagaaccgacctcccgctagagttcagtcgagctcagaggagctggaacttagacatcaatccctcgacgcttttcctgggaggcggctccccggacggggaatccagccggcagccaaaatgtcgagcgtggggaaagtgacccaagtaccgaacggaaaagcctaccaacagatctttcaggctgaggtgcaactcgtccactcactcgctgccactagaaagagagcagcggagaggtcagtaactctcaagtcaggacggattccgatgatgaagaaagtggagacaccagaaggagaagtgatgagtcctcggcagcagaagtggatgcactctctgccaaacgattggatcatggagaaccccgtactgcatcgcgaaaaggagagagccaagcgggagaaggctcgagagtcagagaacaccattgctgcaagggaagtccgaggtttgatggacactatagttccggagaagatttccacctccacctttcagaggcaagcagaacataaaaggaaatcttatgagtcagccctggcttccttccaggaggagatcgcccaggtagggaaagaaatggagccgctcattgtcgacaccggaggcctctttctgaaaaagttgaccgaatctgatgaggagatgaacaggctgttccttaaggtcgagaacgacacaaaccttgaggactatactatccaggccctgctggagctgtgggacaaggtcgcaggacgtctgctccttaggaaacaagaaataaaggagctggatgaggcactgcacagcctcgagttttcacgaacagacaaactgaagtccgtgctgaagaagtacgcagaggtgatcgaaaagacctcttacctgatgcgcccagaagtttacaggcttatcaatgaggaagccatggtcatgaattacgccttactaggtaaccgcaaagccctagcacaacttttcgtgaacttaatggagagcaccttacagcaagagctggactcacgtcacaggtggcaaggcctggtggatacatggaaggccctgaagaaagaggccctcttgcagtctttttccgagtttatggcatcagagagtattcacacaccgcctgccgtaacgaaggaacttgaagtcatgcttaaaactcagaacgtccttcagcagcggagactgaagcatctgtgcaccatctgtgatttactccccccttcctattctaagacccagctgaccgaatggcactctagtcttaactccttaaacaaagaacttgatacttatcatgtggactgtatgatgaggatccgtctgctgtatgagaaaacatggcaagagtgtctgatgcatgtgcaaaattgtaaaaagcaactgttagactggaaggcttttaccgaagaggaggctgagaccctggtgaaccagttttttttccagatggtcggtgctctgcagggcaaggtggaggaggatctggaactcctcgacaaatcttttgaaactctggcggaccagactgagtggcagtcctcgcacctgtttaaatacttccaggaggtggtccagctgtgggaggcccaccaaagcgaactgttggtacaggagctggagcttgaaaaacgaatggaacagcaccggcagaaacactcactggagtctcaggtgcaagaagcccatcttgataggctgctcgatcaactgcgacaacagagcgacaaggagacacttgcattccatttagagaaggttaaggattacttgaagaatatgaaaagtagatacgagtgttttcataccctcttgaccaaggaggtgatggaataccctgcgattatgctaaaggagctgaattcttatagctcagctctgagccagtacttcttcgtccgcgagattttcgaacagaatttagccggagaggtcatcttcaagttccgtcagccagaagcccacgaaaaaccttctcaaaagcgcgttaagaaactgaggaagaagcagggttctaaagaagatatgacgcgaagtgaggaaagcatttcctccggtaccagcacggcccgatctgtcgaggaagtggaagaagagaacgatcaggaaatggagtcctttatcacagaggaagtcctcggacagcaaaagaaatcccctcttcacgccaagatggacgagagtaaagaaggatcgattcaaggtctggaagagatgcaagtagaaagagaggggtcattgaacccctcgttgaatgaagagaacgtgaagggtcaaggggagaagaaggaagagagtgaggaagaagatgaaaaagaagaggaggaggaagaagaaaagctagaggaggagaaagaggagaaagaagcccaggaagagcaggaaagcctatcagtgggcgaggaggaggataaagaggaggggctggaggaaatatactacgaggatatggagagcttcacaattagttcagggaatacttacttcgtgttcgtgcctctcgaggaggagcattgtaggaagtctcatagtacattctccgcaatgttcattaacgacacctctagcgctaaattcatcgaacaggtgactataccatctagactgatactggaaatcaagaagtag

SEQ ID NO: 49435 - DNA, 585 bp, Artificial Sequence
  Description of Artificial Sequence: Synthetic coding sequence
atggcaaaacggagagcagctgaacctgtgacttttcacgttccttggaagcgattgctgctgtgtgactttgccgagcagcctcccccaccccctttatggattcgaccacctggtgtggcccatgctggccagctgcttggcgtgcccgagcagcacagaaagaggaagatcgacgcgggaactatggccgagccctccgctagcccttcgaaaaggcgggacagtggagacaattcagcaccttccgggcaagaaagggaggatcacgggttggaaactggtgaccctcccctgcctccccctcctgtccttcccggtcccggagaagaactacctggggcacgccttcccggtgggggaggagacgacggcgcaggccgtgccggtcctccccgtggcgattggggcgtcgcctcgagacagcataatgaggagttctggcagtataacaccttccagtattggagaaatcctctgcctcctattgaccttgctgatatcgaagacttgagcgaagacaccctgaccgaggctacccttcaggggagaaacgagggtgccgaggtggatatggagtcctag

SEQ ID NO: 49436 - DNA, 558 bp, Artificial Sequence
  Description of Artificial Sequence: Synthetic coding sequence
atgcctcggctgtttctgtttcatctcctagagttttgccttttgctgaaccagttctcccgagctgtcgccgctaagtggaaagacgacgtcatcaagctgtgcggtagggagcttgtcagggctcagatagctatttgcggtatgtccacttggtccaaacgctctctttcccaggaggatgctccccaaacgcctaggcctgtagcagaaatcgttcctagctttattaacaaagatactgagactattattataatgttggaatttattgccaatcttccaccagagctaaaggcggcattgagcgaaagacaaccctctttgcccgaactccagcagtatgtcccagccctgaaggactccaacctcagttttgaggagtttaaaaagctgatacgcaaccgtcagagtgaggccgcagattcaaacccctctgaattaaagtatttaggtctggatacacatagtcagaaaaagcgcagaccttacgtggccctgtttgaaaagtgctgcctcatcggctgcacaaaacggtccctcgccaaatactgttag

SEQ ID NO: 49437 - DNA, 486 bp, Artificial Sequence
  Description of Artificial Sequence: Synthetic coding sequence
atgaagaaaattgaaattagcggtacctgtctgtcctttcacttgctttttggacttgagatacgaatgagaaggattgtctttgcgggagtcattctgtttaggctgttgggtgttattctgtttcggctgttaggcgtgatcctgttcggtcgtctcggagacctggggacgtgtcaaaccaaaccaggccagtactggaaagaggaagtgcatattcaggacgttggcggtcttatctgccgcgcatgcaatttgagcctcccttttcacggctgtttgctggatctgggaacctgccaagcggaacctggacagtattgtaaggaggaagtacacatacagggcggaattcagtggtattccgtgaagggttgtaccaagaacaccagcgaatgtttcaagtcaacactggtgaaaaggatcctccagctgcacgaactagtaaccacgcactgctgtaaccactcactgtgcaacttttag

SEQ ID NO: 49438 - DNA, 384 bp, Artificial Sequence
  Description of Artificial Sequence: Synthetic coding sequence
atgggtgtgggatttaccgaactagaatatctcgccccatggctccgtcccccttttagcgacctgggtacctgccagacaaagccaggccagtattggaaggaggaggtccacatacaggacgtggggggactcatttgtagagcatgtaacctgtctttgcctttccacgggtgtcttctcgacctcgggacttgccaggctgagcctggccagtattgcaaggaggaagtgcacatccagggcggaattcagtggtattccgtcaaaggctgcaccaagaatacttccgagtgctttaaatctaccctggtcaaacgcatactgcagctccacgaactcgtgacaacccactgttgtaaccattctctgtgtaacttttag

SEQ ID NO: 49439 - DNA, 513 bp, Artificial Sequence
  Description of Artificial Sequence: Synthetic coding sequence
atgcaaaatagaaccggtcttatcctgtgcgctcttgcgttgctgatgggatttctgatggtgtgcctcggagctttctttatcagttggggtagcatcttcgattgccaggggtcgcttattgctgcgtatttgttattaccccttggcttcgttattctcctcagcggtatcttctggagtaactatcggcaggtcactgagtcaaagggcgtcctgcgacatatgctccgacagcaccttgctcacggcgctttgccagtcgccaccgttgatcggcctgacttttaccctcctgcctacgaggagtctctcgaagtggagaaacaaagttgcccagccgagcgtgaagcctctggaatcccaccacccctctatacggagactgggctggagttccaagatggcaatgactcacatccagaggcacctccctcctacagagaatcgatcgctgggctggttgttacggccatctctgaagacgcacagaggcgcggtcaggagtgttag

SEQ ID NO: 49440 - DNA, 4338 bp, Artificial Sequence
  Description of Artificial Sequence: Synthetic coding sequence
atgggtaaccttgtgataccgttaggtaagggaagagctgggagagtggagagcggacagaggatccctccgccagcccctaggccatctgttgagtgcactggtgacgacatcgctctgcagatggagaaaatgctgtttcctctcaagtctccctctgcgacctggctgtccccttcttccactccctggatgatggatttcattctcacgtcggtttgcggcctcgtgctgctcttcctgctgctgctgtatgtccacagcgatccaccctctccaccgcctgggaggaaacggtcttccagagaaccgcagagggaaaggtccgggaggagtcggtctcggaagatctcagccctgaaagcgtgccgcatactcttacgagagctggaagagacccgcgatctcaactacctgctcgagagtcacctgaggaagctggccggtgaaggctcctcccatttacctctgggcggagatccattgggagacgtgtgtaagccagtcccagctaaggctcaccagccacacggaaagtgcatgcaggatccttcaccagcctctctcagcccacctgccccacccgcacccctcgcgagcacactgagtcccggtccgatgactttctccgaaccattcgggcctcactccacgttgagcgcaagcggcccaccagagcccctgttgccgctgaaatgccccgcaacccagccacatgtcgtgtttccacctagtcctcaacctcatggccctttggcgtcatcgccccctccacctgactcctctctcgcaggcttacagtgcggaagtaccacttgccccgttcctcagtcttcccccctccataaccaggtcctgccccctccaacgcgcgtcatatcaggcctgggctgcagcagtgaccccatttgggatttgtactgctggagagaggcggctactacctggggcctgtcaacatacagccatgggaaatcacaaccacggcacctcccagatcacacatcagaggcctccttctggggcgaccctactccgaagcatatggaggtcggaggttgtactttcattcaccccgatgtgcagaaattactcgaaacattaattgccaaaagggcactcatgaagatgtggcaggaaaaagaaagaaaacgtgccgaccaccctcacatgacatctttaggaaaggaatgggacattacaactttaaacccattttggaacgtgagtacacagccgcaacagctgccacggcctcaacaggtgagcgacgccacaactgtgggtaatcacctgcagcaaaaacgctcccagctgttttgggaccttcccagcttaaactctgaaagcttggcaaccacagtctgggtctcaaggaatccatccagccagaacgcccacagtgtgcctttagataaggcctccacaagtctgccaggcgagccagaagtggaagccagtagccaactgagccaggcacctcctcaacctcaccacatggcccaaccccagcactttactcccgcatggcctcagtcccagcccccacctctcgctgaaattcagacccaggcacacctgtcccccccagtcccttctttaggttgctcctctccccctcagattcggggttgcggcgcttcataccccacatctcaagagcgcacacagagtgtgatcccaaccgggaaggagtacctggaatggcctctgaaaaaaagacctaagtggaaaagagttttgccgtctttactgaagaagtcacaggccgtcttgagtcagcctacggcccacctgccacaggagagaccagctagctggtcccctaaaagcgcacccattttacccggtgtggtcacttctccggaattacctgaacattggtggcaaggcaggaatgctatccaccaagagcagagttgtggccctccctctcggttgcaggcatccggcgaccttctgcaacctgatggggagttcccaggcagacctcaaagccaggccgaagatactcagcaggcattgctcccgtcccaaccttccgacttcgcaggtaaagggagaaaagacgtccagaaaactgggttcaggagctcaggcaggttttcagataagggatgcctggggagtaaactggggccagacccttcccgagatcaaggctcaggccgaacctccgttaaagccctggatgaagacaaagaagccgagggtgatcttcgcaggagctggaagtaccagagtgtgagtagcaccccacgagatccagacaaggaacaccttgagaacaaactgcagatccaccttgctcgaaaggttggcgagattaaagaaggttggatacctatgcctgttcggagatcttggttgatggccaagtgcgccgtgcctaagtctgatacccataggaagcccggaaagctggcgagttggcgaggcggtaaggcacatgtgaacacaagccaggagctgagcttcctccacccatgtacacagcagatcctcgaagtccatctggtacgcttctgcgtaaggcactcgtggggtacagacctccagagcctggaacctataaacgtgtggagcggggaggcacaggccccaccattcccacagtccacattcaccccttgggcgtcatgggtctctagagtggaatcagtgcctaaagtccccatattcttgggcaagagaccgcagaatgggcctggagataatcgcaccacctccaaatccgtgcctacagtgtcaggtcctctggccgctcctcctccagaacaagagggggtgcagaggccgcctcgcggaagtcaaagtgctgacactcatggccgtagcgaagcctttcctacggggcacaaaggccgaggttgttcccaaccgccaacatgtagtcttgtcggtagaacctggcagtccaggaccgtattggagagtggcaaaccaaaacctcgtctggagggttctatgggcagcgagatggcaggcaatgaagcttggttggagtccgaatcaatgtctcctggcgacccgtgttcttctcgtgcgctccaggttctgtccattggaagccagtgggcacgggcagaagatgctctgcaggctctgaaagtgggtgaaaagccccctacatgggaagtcactctgggcgcatccgtacgagcttcctccggctcagtgcaagaggatcttcgaagcacaggagccttgggtaccaccgggaacccgagcgcctctagcgtgtgcgtagcacaggaccctgagcaactccaccttaaagctcaagtggtgagcgaaattgcactaatcgttcaggtggattctgaggaacaactcccagggagggcacctggcattctgctgcaggatggagcgactggtctgtgcctgccaggcaggcatatggatatgctcaccgcagcagaccgtcttcctactcaggccccactcagtacatcacaaagtgtgtccggcaagaatatgactgccagccaaggtccctgtgcactgctttggaaaggcggagatagccccggacagcaggagccgggaagtccaaaggctaaggcgccacagaagtcacagaagaccctggggtgtgcagataagggagaggcgcaccggaggcctcgcaccggggaacaaggccaccggagcaaaggacctagaacatctgaggctagtggacgctctcacccagcccaagctagggaaattggcgacaagcaggaaagaaaatacaaccagctgcaactggagaaagggcagacaccacctgaatcccactttcagagaaagatttcgcatcatccacaggggctccacccaagaaaaggaggaacaagatgggaggacgtgttgcagaagggaaaacctggagcagacgcatttcagtcttgggggtctggcccaccccgtcagttcatggactgcatggctgacaaggcgtggaccatcagccgggtggtcggccagatcctggtggacaagctgggccttcagtgggggagaggtccaagtgaagttaaccgacacaagggggatttcagggctcaagagaatgtgccctcctgctgccaccggggacactgccaccaggagagatcacgtgagatgagagcactcgcctgttcgcctaaggccacccccaagggacaccattgcccagtgaagaaccggggtatccgtgaccgggatagttcatgggccccacccccacgtgagccagtcagccccgcaggtcctcaccatcataggccgagaatggcctcaacttccgggggtccccacccccagctccaagaactcatgagcgctcagcggtgtctcgcgtcttag

SEQ ID NO: 49441 - DNA, 1761 bp, Artificial Sequence
  Description of Artificial Sequence: Synthetic coding sequence
atggaggtcggcggatgtacttttatccatccagatgttcagaaattgttagagacactgatagccaaacgcgcattaatgaagatgtggcaagaaaaggagcgcaaacgcgctgatcatcctcatatgacatccttgggcaaagagtgggatataacgactctgaaccccttctggaatgttagcacacaaccacagcagctgcccagaccccaacaggtgagtgatgccacaaccgttggtaaccacctgcagcagaaaaggtctcagctgttttgggacctgccgagtctcaactccgagtctctcgctactactgtgtgggtgtcgcggaatcctagctcccaaaacgcacactctgtgcccttggataaggcctccacctcactcccgggtgaaccagaggttgaggctagttctcagctgtcacaggcgccaccccagccacaccacatggcacagccccaacattttacccccgcatggccccaaagccaacctccaccactcgctgagatccagacccaggcgcacctctccccccctgtcccatcactgggatgctccagccctcctcaaatacgaggctgcggagccagctatcctaccagtcaggagaggacacagagtgttattccgactggcaaggagtacctggagtggcctcttaagaagaggcccaaatggaagcgagtgctgcccagcctcctgaaaaaatctcaggcagtgctaagccagccgacagcacacttgcctcaagagcgtccagcctcctggtctcccaaatctgccccaatcctacctggtgtcgtgactagtcccgagctcccagaacactggtggcaagggagaaacgccatccaccaggaacaaagttgtggacctccttcacggttacaggcttctggcgatctgctgcagccagacggggaattccctggcagaccacagagccaggcagaggacacccaacaggccttactgccatcccagcctagcgatttcgctggtaaggggaggaaagatgtgcaaaagacaggttttcgctccagcgggaggttttccgacaaaggctgcctcggctcaaagctcggacccgatccatctcgcgaccagggttctggcagaacctctgtgaaagcgcttgacgaggataaggaggccgagggtgacctgcggaggtcctggaagtaccaatccgtctcctccactcccagggatcccgataaggagcacctggagaacaagttgcagattcacttggcacggaaggtaggagagatcaaggagggttggatacctatgcctgtgaggaggtcatggctgatggccaaatgcgcagtgcccaaaagcgacacacaccgtaaacccggaaaactggcaagttggcggggtggcaaagctcacgtgaataccagccaagagctatccttcttgcacccctgtacccaacagatcctggaggtccatctggtccggttctgtgtgcgtcattcatgggggacggatctgcaatcacttgagccgattaacgtttggtccggcgaggcccaggccccacccttccctcagtctacattcaccccctgggctagctgggtcagtagggtggaaagtgttcctaaggtcccgatcttcctaggtaaacgaccacaaaatgggcctggcgataacagaaccacgagcaaatccgtgccgacggtgtctggtcctctggccgctaccggggtaaccgctaccaaaaacgtggccgagcgctag

SEQ ID NO: 49442 - DNA, 1029 bp, Artificial Sequence
  Description of Artificial Sequence: Synthetic coding sequence
atggcatgtgagccacaggtcgaccccggagctactggacctctaccaccatcttctccaggctggagcgccctgccgggaggatccccaccgggatggggccaggaactacataatggacaagtactgaccgttctgcggattgataacacttgtgccccaatatcctttgacctcggcgctgctgaggagcagttacaaacctgggggattcaggtgccggcagaccagtacaggagcctggcagagtctgctctgctagagcctcaagtgcgtaggtacattatttataattcccgccctatgaggcttgcgtttgccgtagtgttttatgtagtcgtgtgggctaatatttatagtacttcacaaatgttcgcactcgggaaccattgggctggcatgctgctggttaccctcgctgccgtctccctgacactgactctggttcttgtcttcgaacgccatcagaagaaagctaacactaatacagatcttcgactggctgctgcaaacggcgctctgttacgccaccgggttttgctgggcgttaccgatacagtggaaggatgccagtcagtgatccagctttggtttgtctactttgacttagaaaactgcgtccagtttttgtcggatcacgttcaggagatgaagacatctcaagagtcgctgctgcggagtagactgtcccagctttgcgtagtcatggaaacaggagtctccccagccacagccgaaggcccagaaaacttggaggacgctcccttactgcctggcaacagctgccctaatgagcggcctttgatgcagactgaactgcaccagttggtgcctgaggcagagcccgaagaaatggcacgacagctcctggccgtcttcggaggttattacatccggctgcttgtgacttctcagttgccacaggccatgggaacccggcacactaacagccctcgcatcccctgcccctgccagctgattgaggcctacattctgggaacaggctgctgcccattccttgccaggtag

SEQ ID NO: 49443 - DNA, 1032 bp, Artificial Sequence
  Description of Artificial Sequence: Synthetic coding sequence
atggcctgcgagccgcaggtggatcctggggctaccggcccattacctccatcttctccaggctggtcagctctgcccggaggcagcccaccaggttgggggcaggagcttcataatggacaagtcctgactgtactccgaatcgataacacctgtgccccaatttccttcgacctgggggctgccgaagaacaactgcagacgtgggggattcaacaggttcccgctgaccagtaccgaagcctcgctgagtccgccctcctggaaccccaggtgcgtcgttacatcatctataattccagaccgatgagactggcgttcgcggtcgttttttacgttgtcgtttgggccaatatctatagtacctctcagatgttcgccctgggcaatcattgggccggaatgctgcttgtgaccttagcggctgtgtccctgactctgaccctagtactcgtctttgagcggcatcagaagaaggctaatacgaacactgacctacggctcgccgctgctaatggagcactgctgagacatagggtgctgctgggtgtgacggacaccgtggaaggatgtcagagcgttatccagttgtggtttgtatacttcgatttggagaactgcgtccagtttctgtctgaccatgttcaggagatgaagacctcacaggaaagcctgctgcgatctagactgagccaactgtgcgtggtgatggagacgggcgtcagccccgcaacggcggagggtcctgaaaacctcgaggatgcccctctgctccctggtaacagttgtcctaacgaaaggcctctgatgcaaactgagctccaccaactggtgcctgaggcagagcctgaggagatggcaaggcagcttctggccgttttcgggggttattatatccgtcttcttgtgacatctcaactccctcaggccatgggaaccagacatacaaatagccctcgaataccgtgtccttgccagctgattgaagcctatattctcggcactggctgctgcccatttctggccagatag

SEQ ID NO: 49444 - DNA, 2136 bp, Artificial Sequence
  Description of Artificial Sequence: Synthetic coding sequence
atggctagatctaggagtaggtcccccagatggaaacataggtctctgtctcctgtacccagaaatgctgagcactacaagcagcgccactctcacggccattatggctgcgagtacagaaaggaccctaagcgtcccgtagcttggaggatggatagcgaaaagcacggtcagagcaagcccagaataccttccagggggaacatttactaccagagttatgagcatcggtccccaagtcctaacattcgaaactctctggaaaacgtgtacatgtataaaccacataggggatattctccagggaggggagatagtaacagaagagcacagtatatgccaaaatatagcgagggcataccttacaaggagcacgagagaaatagttacccccagaaagtccagggaggccacagcccagatgaccatagagtgaggggatcggggaaaggaggtaagcccccacagagatccattgctgattcctttcggttcgaggggaagtggcacgaagatgaactgcggcatcagcgcatacaggaggaaaaatatagccagagcacgaggcgcggatctgaggatttcgagacaagaagttcttttcagaaaagatatcctgaggaccgagactttaggaagtacggccatacgtctaaaaggccaaaagatgttgaacgctacgagtctagggaacctgcgcgtaatcccaagtggaagccggaacattcccttcccccttatcaggaggacactgaccagtggaacctaggccctcagacgtaccggcacgcggagagggagcatccagagacgtcaagtgcaacaaaagtgagttacgactatagacataagcgtcccaagttgttggacggggaccaggatttcagcgacggaaggacacagaaatattgcaaggaagaggaccgcaaatactcgttccaaaaggggcctctcaatcgtgaactggattgtttcaacacaggccgaggcagggagactcaagacggccaggttaaggaaccctttaagcccagtaaaaaagactcaattgcctgcacctattccaacaagaatgacgtagatttgcggtcaagtaatgataagtggaaggagaagattaaaaaggagggcgattgccgtaaggagtcaaactccagcagtaatcagttggacaagagccagaagttgcctgatgtgaaaccttccccaataaatttgcgtaagaaaagtctaactgtgaaagtggacgtgaaaaagacggtggatacttttcgggtcgctagcagctacagtaccgaacgtcaaatgagccacgatctggtcgctgtgggaagaaagtccgaaaattttcatccggtgtttgagcacctcgacagtacccaaaacacagaaaataaacccacaggagagtttgcacaggaaatcattactattattcaccaagtaaaagcaaattatttcccatcacccggaattactctgcacgagaggttttcaactatgcaggacattcacaaggctgacgtgaatgagattcccttaaacagcgacccggagatccatcgtcgtatcgatatgtctttggcagagcttcagtccaaacaagccgtgatttacgagtccgagcaaacgctgatcaagattattgatccaaatgacttgcggcacgacatcgagcggaggagaaaagaaaggcttcagaacgaagacgagcatatattccacatcgccagcgccgcagagagagatgaccagaattcatcattctccaaggtcaagaatgtacatacagacgggttccagaagcccacacacttcattaagagcaatttccgaaagtgtatagagaagccttacatgaactacacaacccagcgcaaagacattatcacacataagcccttcgaagtggagggcaaccatagaaacacaagggttcgaccgtttaagagcaactttcgtggaggccgatgccagccaaactacaagtccggactcgtgcagaagtccctctacatccaggctaagtaccagcgcttgcgattcactggtccacgcggattcatcacccacaaatttcgagaaaggctaatgcgaaagaagaaagagtacacagacgtggcaactgggatctag

SEQ ID NO: 49445 - DNA, 1509 bp, Artificial Sequence
  Description of Artificial Sequence: Synthetic coding sequence
atggcaatccatcttgataaacagaatattattctaaagaatgataaagacgaatatttaaaaaagacccgcgatggagtgcttccaccataccaagatgctaaaccgccatcccccgcatcaattaaaaaaacctacactacctccaagttcaacgatgctgaaccagctaagggcaatctctttatcggcgtcgaggtcttacctgagaatcttcacctggacgaaagcgagacttctgaggaggatcacgggagcctggaaaaggagaagtatgagcagtttctttccctggaagaaggaaccaaggcccactacttttttgagaaagtggtgaatgccgctcagacctggttctccctttttggctggcccgagggacctcattccttttccatacccgaaacaatccggcgtgacgtgtacaaaatgcagttttacagctccacatcgcctccacagaaattctccaggcagaatgactttagcaagtataataagacgatatacgatgtgttactccatcttagcggaaaaatgcctcctggtataaacagttcacagtctctgccggtggacaaccacgagaagcgagttatacagctgcaccttcagcacagttcgctcctcgacttcctcaacgcccagggtggttgcatatcacacgtgttaccggaatttctcctggagccagaagattacaagcggtggattgaaataatgagcagcaccaataccatgccagtcagcagctgcaccccaaaaaagaagtgttccatagtgatcgagatgagtaaattcgaggcctggtcaaaacgggcatggacagacgtattcctgcagatttataaggtgttggtgttgagtagagtggttccatactgcagcaacaatatgccccctatttgcgtacagaatacacctaaggtcaacccttgctttgccagtagtaatatctattcagattcggaacggatattattatcttggatgaatatcaactatgaaaatactcgccacgttatctggaagaattgccacaaggacgtgattccatctgaaagatggattgtcaacttcgacaaggacttgtcagacggcctggtgttcgcgacccagctgggcgcttattgtcctttcctcatcgagtcccactttattaatatgtacacccgcccaaagtccccagaagagtatctgcataactgcctgattatcgtgaatactctgtatgagatcgactttgacgtggaaatccaggtgtgcctcagagtgttcccgaaggaaatggacgcaggagtgagtgggctgaggaaggaggatatgccatccgtgtgggtggtaaccataaggctcgcggtggccgtagccagaactaaaaggcagaagaaaggcgacatccaattcgcctgttttttcgtatgcctgttcttttttatatttgtggtcattagcttttcgctgtggtcaaggatgcacttttttctgcttttgccgttggatatctag

SEQ ID NO: 49446 - DNA, 1509 bp, Artificial Sequence
  Description of Artificial Sequence: Synthetic coding sequence
atggccatccatcttgataagcaaaatatcatccttaaaaatgacaaagacgagtatctgaaaaaaacgagggatggagtccttcccccttaccaggacgctaaacctccgagccccgcttcgatcaaaaaaacatacactacgagcaaattcaatgatgcagagccggctaaaggaaaccttttcatcggtgtggaagtcctaccagagaacctccacctggatgagtctgagactagtgaagaggatcatgggtctttggagaaggaaaagtacgaacaattcctcagcctggaggagggaactaaagcccattactttttcgaaaaagtggtgaacgccgcacagacttggttttcgctcttcggctggccggagggcccacactctttctcgatccccgaaacaatcaggagagacgtctataagatgcagttttatagctcaacaagtccgcctcagaaattcagccgccaaaacgatttcagcaaatataacaagaccatatacgatgtgctcttacacctttctggaaaaatgccgccagggatcaatagctcccaatcattgcccgtggataatcacgaaaagcgggtgattcagcttcacctgcagcactcctcactattggactttcttaatgcccagggagggtgtatttcccacgtgctgccagagtttctcctggagccagaagattacaaaagatggattgaaataatgtctagtacaaacacaatgccagtctcgtcctgcacgcccaaaaaaaaatgttctatagttatcgagatgtcaaagtttgaagcatggagcaaacgagcttggaccgacgtgtttttgcagatatataaggttttggtgctgagtagagtcgttccctactgtagcaacaatatgccgccaatatgtgtacagaacacccccaaggtcaatccttgcttcgctagctccaacatctactccgattctgagaggatactgctgagttggatgaatattaattacgaaaatactagacacgtaatctggaagaactgccacaaggatgtgattccatctgaaagatggattgtcaactttgacaaggacctaagcgacggactggtgttcgccacgcaactgggggcttattgccccttcctcattgaatctcatttcatcaatatgtatacccgcccaaaaagcccggaggagtatctgcacaactgcttgattattgtgaatacgctgtacgaaatcgatttcgatgtcgaaatacaggtgtgcctgagggtgttcccaaaggagatggacgccggagtgagtggtctgcggaaagaggatatgccctccgtctgggttgtcacaatcaggctagctgtggccgtcgctcggaccaagagacaaaagaagggcgatattcaatttgcatgctttttcgtctgcttatttttctttatcttcgttgtgataagcttctccctgtggtcaaggatgcacttcttcctgctgctccccctggacatctag

SEQ ID NO: 49447 - DNA, 471 bp, Artificial Sequence
  Description of Artificial Sequence: Synthetic coding sequence
atgcttctgaattacatccctgtgtgctataaaattttacatttaaccggcgaagtcaaaagccccgagcttctctttgaccccccttttatcttctttacgcctgtccctctggatattaccactgtgatggacatcaatattcttccacagaactacttccgaaattcaacattgtgcgtgcagattccgacagttaggctccttgatggcgaagagatccaccctctctcagttaagttccccaagggacgggtaatcccagggtcacacagcggaatcaacaataaactgacctgtcacttgtcatttaagtcctctaagccagtctcgttctttacaaatttgctgttctgcgatgaccgcaagaactggtgtttccactttcagctcctgcagcagcaaaaaacggccttcctgctctttacacatatctggcagtttatttggatcagcaaaactttattctag

SEQ ID NO: 49448 - DNA, 462 bp, Artificial Sequence
  Description of Artificial Sequence: Synthetic coding sequence
atgctcctcaactacattccagtgtgctacaagattcttcacctcactggggaggtcaaatctcctgaattactgttcgacccaccctttatattcttcacaccagtgccgctggatatcacgactgttatggacataaatatcttgccacagaactattttaggaatagtaccctgtgcgtacaaatcccaactgtgcgacttctagacggagaggagatccaccctctgagcgtgaaattccccaaggggagggtcatccccggtagccacagcggtattaataacaagctgacctgccacctgtcatttaaatccagcaagccagtcagtttcttcaccaatctgctgttttgtgatgataggaaaaactggtgtttccacttccaacttctgcagcagcagaagaccgcctttctcctgttcacgcacatttggcagttcatttggatttccaagtag

SEQ ID NO: 49449 - DNA, 1086 bp, Artificial Sequence
  Description of Artificial Sequence: Synthetic coding sequence
atgaatctggttatttgtgtgttgctgctaagcatttggaagaataactgtatgacgactaatcagaccaatggatcctcaaccacaggcgataaacctgtggaatctatgcagactaagctgaattatctacggcgtaacttgctgatccttgtgggcatcataatcatggtattcgtgttcatctgtttttgctaccttcactacaattgcctatccgatgatgccagtaaagccggtatggtgaagaaaaaaggcatagccgcaaagagctctaagacttctttcagcgaggctaagacggccagccagtgcagtcctgaaactcaaccgatgctttctacggctgacaaaagtagtgattcctccagcccagagcgggcttccgcccaatcaagcaccgaaaaactcattcgaccaagtagtctccagaagccttccattcccaactcagccggtaaactgaccaggccgtcataccccaagcgtagctcaaaatcgtcctgcagcaagaagttgtcaaaatctagtcacctggagaaggcccacaaaaaggggtcgctggaaaagttgtgcaagctggattatgcatgcaaacttgcttcctctgataagcccgtgcgccctccccaactgttcaagcccttgtactcttcccatccacaaaacgagatctctccatcaaagccttttggccctcaggagctggctaagccccctaagcatttcaatccaaaacgcagtgtatccctgggccgtgcagctcttctttccaatagcgagctggctgaaacatgccagccatataaaaagaagcatttggtcgccaaaacatacaggcctctggtcaacgatataagcgaagcgaaggagaaaaatacgcagaacctgcacgtctcgtcaaaagttaagtcctcatcacgatctttccgaaaacttgatagcagaaacaatgcttacggggaccacgtgaacgactccgatacaatgaagtattactcagaggtcgattctgataaagtgattatcattacgtgcgacaggggatacaatcaggtgacctctgaggtcactctcaacgactag

SEQ ID NO: 49450 - DNA, 300 bp, Artificial Sequence
  Description of Artificial Sequence: Synthetic coding sequence
atggagcctcaaaagttacttatcattgggttcctgctatgtagtttgacttgcttactcctcgagacagtggctagctccccactgccattgtccgctctggggatacaagaaaagaccgggtccaagccgaggagcggtggcaatcaccgcagttggctcaataactttcgggattacctctggcagctcattaagagcgccctccccccagccgctatcgtggcgttcttgctcacatcagcgctgatgggcatcttgtgttgcttcaccattctggttgtcgatcctgtgcactag

SEQ ID NO: 49451 - DNA, 6053 bp, Artificial Sequence
  Description of Artificial Sequence: Synthetic coding sequence
atgtccctcggcctggccagggcccaggaagtcgagctgaccctggaaacggtgattcagaccctggagagctcagtcctttgtcaggaaaagggcctcggcgctcgtgatttggcccaggacgcacagattactagtctcccagcactaattcgagagatcgttacccgaaacctctctcagcctgaatcccccgtcctgcttcccgctacagagatggcctccctgttgtcgctgcaggaagaaaatcagttactgcagcaggagctgtctagggttgaggacctccttgctcagtcacgggcagaaagagacgagctggcaattaagtataacgcagtaagcgagcgcctcgagcaggcactgcgcctggagccaggggagctcgagacccaggagccacgcggtctggtgcggcagagtgtcgagcttagacgccagcttcaggaggagcaagcatcataccggagaaagctgcaggcttaccaggagggacagcaacgacaggcgcagctggtgcagcgcctgcaaggtaaaattctccagtataagaagcggtgcagcgaactggaacagcagctcctggaacggtcaggcgagctcgaacagcagagactgagagacactgagcactctcaggatttggagtccgcacttattagactcgaggaagagcagcagcggtcagcaagccttgcacaagtgaatgccatgcttagagagcagctcgaccaggccggatctgctaatcaagcgctgtcagaagatatcagaaaagttacaaacgactggacacgatgcaggaaggaattagaacaccgggaggcagcctggagacgggaagaggagtcattcaatgcttatttcagcaacgagcatagtagacttttactgctgtggcgccaggtcgtcggtttccggagactcgtcagcgaggtgaagatgtttaccgaacgggacctcctgcagctcggtggcgagctggccaggacctctagagccgttcaggaggctggtctcggcctctccaccggcttgagactggcagaaagtcgagccgaagccgctctggaaaaacaggccctgttacaggctcaactggaagagcagctgagagacaaagtgctgcgtgagaaggacttggctcaacaacagatgcaatccgatttggataaggccgatctgtcagcgcgagtgaccgaattaggccttgctgtaaagcggctcgagaaacagaacctcgaaaaggatcaggtaaataaagacctgaccgagaaactggaagcactggagagcctccgtttgcaagagcaagcagctctcgagacagaagatggagaaggcttacagcaaactctgcgcgacctggcccaggctgtgttgtcagactccgaatccggcgtgcagttatcagggtccgagagaaccgccgatgcgtctaacggctcacttcgtgggctgtcagggcagcgcaccccctccccacctcgcagatcctcaccgggacggggtcgatctccacgcagaggcccttcccctgcatgttctgactcctctactcttgccctgattcattctgctctacacaagaggcagctgcaggtgcaagacatgcgtgggcgttacgaggcaagccaggacctcttgggaacgctgcgaaagcagttaagtgatagtgaaagtgagagaagagccctcgaagaacagttacagagactccgggataagacagatggggctatgcaggctcacgaggatgcccaaagagaagtccaacgactgcggagcgctaatgagttactaagccgcgaaaaatccaatttggcacatagcttgcaggttgcccagcaacaagcagaggagctgcggcaggaacgggaaaaactgcaggccgctcaggaggagttacgacgccaacgtgatcggttagaagaggagcaggaggacgccgtgcaggacggcgcaagggtccggagagagcttgaacgaagccaccgccagctggagcagctcgaggggaagcgctctgtgttggccaaagagctcgtagaagtgagagaggcactgagccgcgcaactttgcaacgcgatatgctgcaggccgagaaagctgaagtggcagaggcactgaccaaggccgaggccggacgagtggagctggaactctcaatgaccaagctccgcgctgaagaggccagcctccaggacagtctgagcaaattaagcgctctgaatgagtccctggcccaggataagttggatttgaacagactggtggctcagctcgaagaggagaaatctgccctacaggggagacagcgacaagcagagcaggaagccaccgtagcaagagaagaacaagaacgccttgaagagttgaggttagaacaggaggtggcccgtcagggactggaaggcagcctaagggtggctgagcaggctcaggaagccctggaacaacagctcccaactctgaggcatgagaggagccagttgcaagagcagctggcgcagctttctcgacagctctcaggtcgggaacaggagctggagcaggctagaagggaggcccaaaggcaggtggaagcacttgaaagggccgcacgagaaaaggaagccctcgccaaggaacatgccggtctggcagtgcagctggtagccgctgaaagagaaggacggaccctgagcgaggaagccacaagactgagactggagaaggaggccctggagggtagcctgtttgaagtgcagagacagcttgcacaactggaggcaaggcgagaacaactggaggccgaagggcaggcactcttgcttgcgaaggagacgctaacaggtgagttagccggactgaggcagcagatcattgccacccaggaaaaagctagtctcgacaaagaactgatggctcagaaactggtgcaggctgagagggaagcacaggcctccctccgggagcagcgggctgcacatgaagaagacctgcagaggctccaacgagagaaagaggcggcttggagagaactggaggccgaacgggcacagctccagtcccaactgcagcgcgaacaggaagaacttctggcccgactggaggcggaaaaggaagagctatccgaggaaatcgccgctttgcagcaagagcgcgatgagggacttctcttagcagaatctgaaaaacagcaggccttgagcttgaaagaatcggagaagacagcattgagtgagaagctgatgggtaccagacacagtcttgctacaatatcgttggaaatggagaggcagaaacgggatgcgcagtctagacaggagcaggatagatcaacagtcaacgctctgacttccgaactgagggatttgagagcacagcgtgaggaggccgctgcggcacatgcgcaggaagtgaggcggctgcaagaacaggcacgggacctgggaaaacaacgggactcgtgcctgcgggaagctgaggaactgagaacccagctgcgcctgctggaggacgcaagggacgggcttaggcgcgaactattggaggctcaacgcaaactgcgagagtctcaagaggggagggaggttcaacgtcaggaagccggtgaactgcgccgtagcctcggcgagggcgctaaagagcgggaggcactgagacggagcaatgaggaactacggtccgcggtcaagaaagctgagtccgagaggatcagcctgaaactggctaacgaagacaaagaacagaagctggctctgctagaggaggctcgtaccgccgttgggaaggaagccggagagctccggaccggcctccaagaagtggagcggtccaggttagaggcccgaagggaactccaggaactgagacgccagatgaaaatgttggatagcgagaacacccggctcggcagggagctggccgaactccaaggcaggctggcacttggagaaagggccgagaaggaatccagaagagaaacactgggcctgcgccaacgccttcttaaaggtgaagcctcattagaagttatgcggcaggagctccaggtggcccagcgcaagttgcaagaacaggagggagaatttcggacacgggaacgccgactgctgggctcgctcgaagaggctcgagggacggagaaacaacagctggatcacgcacgcggactggagctgaaactcgaagcagcacgggctgaggccgctgagctagggctcaggctctctgctgcagaaggtcgcgcacagggcttggaagctgagctggctcgggtggaggttcagagacgtgcggctgaagcccagctggggggtttacgttccgccctgcgcagaggtctgggcttagggagggctcctagcccggctcctcgcccagtgcccggatcccccgctcgggatgctcccgctgaaggctccggcgaggggctgaactcccccagcacactcgagtgtagccctggttcccagccaccaagccctggtcctgccacatctcctgctagtcctgatctggaccccgaggccgtcaggggagcgctgagagagttcctgcaggaacttaggagtgcccagagagagcgcgacgagctgcggacccagaccagcgcactgaacaggcaactggctgagatggaggctgaacgcgattctgccacctccagggcgagacagctgcagaaggccgttgccgagagcgaggaagccaggcgtagcgtggacggtcgattgtcaggggtgcaagctgagcttgccttacaggaggaatcggtacgtaggtctgagagagaacgcagagcgacactggatcaggtcgccacacttgagcgtagtctgcaagccacggaaagcgaactgcgagccagtcaggaaaaaatcagtaaaatgaaagccaatgagaccaagctggaaggcgacaaaaggcgcttaaaggaggtgctggacgcctcggaatcccgtacagttaagctcgagctccaacgcaggtcactggaaggggaattgcaacgcagccggctagggctgtccgaccgcgaagcgcaagcacaagccctgcaggatagggtggactcactacagcggcaagtggctgactcggaggtcaaagctggtacactgcagctcacagtcgagagactcaacggggcattggcaaaggtggaagagagcgagggtgccctaagggacaaggtccgtggactgactgaagccctcgctcagtcaagcgcctccctcaatagtactagggacaagaacctgcacctgcagaaagctctgacagcatgtgaacacgaccgccaagtgctgcaagagcggttagacgcagcacgacaggcactgtcagaggccaggaaacagtctagcagcctcggcgagcaggtgcagacactccgcggtgaagtggcggaccttgaactccaaagagtagaggctgaaggacagcttcagcagctgcgggaggtgcttaggcagcggcaggagggagaggctgccgcactcaacactgtgcagaaactgcaagatgaaaggagactgttgcaggagaggctcggctctttacaacgagctttggcccaattggaggccgagaagcgggaggtggagcgctcagcgcttagacttgagaaggaccgggtggcacttaggaggaccctggataaggtggaaagagagaagttacgtagtcacgaggacacagtgcgtttgtcagcggagaagggcagactggatcgcacattaaccggagccgaattggaactggccgaagctcagcggcaaatccagcagctcgaggcgcaggtcgtggttcttgagcagagccattcccccgcacaactggaggtcgacgctcagcagcaacaattggagcttcagcaggaagtggagaggctacgttcggctcaggctcagactgagcggactctggaggctcgagagcgcgctcacagacagcgagtcaggggtttggaggagcaagtgtcaactttgaagggccaactgcagcaggagctgagaagaagcagcgccccattttcgcccccttccggtccccctgagaagta

SEQ ID NO: 49452 - DNA, 5696 bp, Artificial Sequence
  Description of Artificial Sequence: Synthetic coding sequence
gagaaggggctcggggcacgcgatctggcccaggacgcccagatcacgtccctgcccgctctgattcgcgaaatagtgactcgcaatctgagccagcctgagtcccctgtgctgttgccagctaccgagatggcgagcctgctctccctccaggaggaaaatcaactactgcagcaggagctgagtcgtgtggaggatctactagcccagtcaagagccgaacgagatgagcttgccatcaagtacaacgcggtaagcgagagagacacagaacacagtcaagacctggaaagcgccctcattaggttggaagaagaacagcagaggagcgcttccctggctcaggtgaatgccatgcttcgtgaacagctcgaccaagctgggagcgcaaaccaggccctgtcggaggatatccgcaaggtgacaaacgattggactcggtgtagaaaggaattggagcatcgcgaggccgcttggcgtagagaagaggagagctttaacgcctatttctccaacgagcactctcgcctgctccttctgtggaggcaggtagtgggttttcgaaggctggtgtcagaagtcaaaatgtttaccgaaagagatttgttgcaactgggaggggagctcgccagaacctcccgagccgtgcaagaggccggtctggggctgtcaaccggcctgcgcctggcggagtcccgcgctgaagccgctttggagaagcaagccttgctgcaggcccagctggaggagcagctgcgggacaaagttctgcgcgagaaggatttggcgcaacagcaaatgcagtccgacctggacaaagccgacttgtcagccagagtgactgaactgggactggccgtaaagcgcctagagaaacagaacctggagaaggatcaggtgaacaaggatttaactgaaaagctcgaggctcttgagtcgcttcgcctgcaagagcaggcagctctggaaaccgaagacggggaaggccttcagcagacacttcgggatctggcacaagcagttctctcagattctgaatcaggtgtgcagctcagcgggagcgagagaacggccgatgcttccaacggaagcctgagagggctgtctgggcagagaaccccaagccctccgaggcgaagcagtcccggacggggtcggtcacccaggcgcggaccctctccagcctgttcggatagctctaccctggcccttattcactccgcccttcataagcgccagttgcaggtccaagacatgagagggaggtatgaggcatctcaagacctgctgggcacactgcggaagcagctgtcggactcggaaagcgagaggagagcactagaggagcagctgcaaaggcttcgggataagacagacggtgcaatgcaggcccacgaggatgcacagagggaggttcagaggcttcgtagtgccaatgagctgctgtcacgcgaaaagtctaatcttgcccatagcctccaagttgcccagcaacaggcagaagaactgaggcaggagcgcgaaaagctgcaggccgctcaggaagagctgcggcgtcagcgagatcgcctggaggaagaacaggaggatgcagttcaggatggcgcaagagtaaggagggagcttgagagatctcatcgccagctggaacaacttgaagggaagcgcagcgtcctggctaaagagcttgtcgaggtacgtgaggcactgagccgcgcaacgttgcagagagatatgctgcaagctgaaaaagcagaagtggcagaggccctcaccaaagctgaggctggcagggtggaactggagctgtcaatgacaaaactgagagccgaggaagcctccttacaagactcattgagcaagctctccgctctaaatgagtccctagcccaggacaagttggacctcaatcgcctcgtggctcagttggaggaagaaaagagtgctcttcagggcagacagcgccaggcagagcaagaagctacagttgcaagagaggaacaggaaagactcgaggaactccgcttagagcaggaggtggctagacaaggcctggaggggtcactccgtgtagccgagcaggctcaggaggccctggagcaacagctacccactctgagacacgagaggtctcagctccaggagcaactcgctcaactgtcccggcagctctctggcagggaacaggaactggaacaggcacgtcgggaagcccagcgacaggtagaggctctcgaacgcgcagccagggagaaagaagcattggccaaggaacacgccggtcttgccgtccaactagtcgcagcagaacgcgaagggaggaccctgagcgaggaggccacgcggcttaggctcgaaaaggaagctctcgaaggaagcctgtttgaggtccagaggcagctcgcccagttggaggcccgtcgagagcagctggaagcagaggggcaggcgttgcttctggccaaggagacactgacaggtgaactggctggactgcgacagcagattatagcaacacaggagaaagccagcctggacaaagagctgatggctcagaaactggtgcaagcggagagagaggcgcaggcaagtctccgggagcagcgagccgcacacgaagaggatctccaaagactgcagcgcgagaaggaggccgcttggagagagcttgaggccgagcgcgcacaactgcagagtcagctccagcgggaacaggaggagctattagccagattggaggccgaaaaggaagagctcagcgaagagattgccgctctacagcaggaacgggatgaaggcctgctcctggccgagagcgagaagcaacaggctctgtccctaaaggagtccgaaaaaacagcactgagtgagaaactcatggggacacgtcactctctggccacaatcagtttggagatggaacggcagaaaagggacgcccagtccaggcaggagcaggatagatccaccgtcaatgcactcacctccgaactgagagacctgcgcgctcagcgtgaggaagctgcagcggcacacgcacaagaggtgcgcaggctgcaggagcaggctagagacctgggtaagcagagggacagttgcctgagagaggcggaagaactgagaacacagcttcgtctgctggaagatgcacgagacggcctgagacgcgagttattagaggcacaacggaagttgcgggagtcgcaggagggtcgggaagtacagcgtcaagaagccggtgaactgcgtcgttcactaggcgagggtgctaaggagagagaagcgctgaggaggagcaacgaggagttgaggtccgccgtgaagaaggctgagtccgagaggattagcctcaaactagccaacgaagacaaggaacagaagcttgcccttcttgaagaagctcggacagccgttggaaaagaggcgggagagttaaggaccgggctgcaagaggtcgaacggtccagactggaggccaggcgggagctccaggaactcagacgtcagatgaagatgctggatagcgagaacactcgtctcgggcgtgaactggccgaattgcagggccgactggctctaggcgagcgggctgagaaggaaagccggcgtgagacccttgggctcagacaaaggctccttaagggcgaggcttctctggaggtgatgcgacaggagttgcaggtggcccagcggaaattgcaggagcaggagggtgagttccgcacccgcgaacgcaggctgctcggttcgctcgaggaagcgaggggtactgagaagcagcagctagatcacgcgcgaggactggaactcaagctggaagccgctcgggctgaggccgctgaactgggattgagactttctgcagccgagggaagagctcagggacttgaggctgagctggcccgtgttgaagtccagcgtcgagccgcagaagctcaactgggcggactccgctccgcgctacgcagagggctgggcttgggtcgggctccgtcaccagcccctcggcctgtgcctgggtcacccgcacgggacgcccctgcggagggatctggggaagggctcaacagtccttctacactcgagtgtagcccgggttcacagccccctagccctggccctgccacttcccccgcaagtccagacctagaccctgaggctgtgaggggagccctcagagaatttctacaggaactcagatcagcacagcgggagagggatgagctccggacccagacctccgcattgaatcgacaactggcagaaatggaagcggaaagagactcagccacttcaagggccaggcagctgcagaaggccgtcgctgaaagcgaagaggcaaggagatcagtcgatggtcgactttctggggtgcaggctgagttggccctccaggaagagtcagtcagacgtagtgaacgagagagacgggcaacactcgaccaggtggcgaccttggagcgcagtctccaggctaccgagagtgagctccgagcatcccaggaaaaaatatccaagatgaaagcaaatgagaccaagttagagggcgataaacgcaggctgaaggaggtgctggacgcatctgagagccgcacagtgaagttggagttgcagcggaggtccctggagggcgagctgcagagaagccggctcggtctaagcgatagggaggctcaggcccaagccctgcaagatcgggtggacagccttcagcggcaagtggcagattccgaggttaaggccggtaccctgcaactcacagtcgagcgccttaacggagccctggccaaagtggaggagtccgaaggggctctcagagacaaggtcaggggccttaccgaggctttagcccagagtagcgcttcactgaatagcaccagagacaaaaatctgcatctgcagaaagcgttgaccgcctgcgagcacgaccgacaggtgctacaagagcggctagatgccgcaagacaggccctgagcgaggcaagaaagcagagttccagccttggggagcaggtccagacactaagaggcgaggtagccgaccttgagctccagcgcgttgaagctgaaggacagctccagcagctgagagaggttctgcgacagaggcaagagggtgaggcggcagccttgaacactgtgcaaaaactgcaggatgaaaggaggctgctgcaggaaagacttgggtcgctacaaagagccttggctcagctggaggccgagaagagggaagtggagagatccgcccttaggctggagaaagatagggtcgccttgcggagaacacttgataaggtcgagcgcgagaagttgcgttcccatgaggacacagttcggctgagtgctgagaagggcagactcgatcgaactttgacaggagccgagctggagttggctgaagctcaacggcagatacagcagctggaggctcaagtggtcgtactagagcaatcacattctccagcccagctggaggttgatgcccaacagcaacagctggaactgcagcaggaggtggagaggctcaggtctgcccaggcgcagacagagcgtaccctggaggctagggagagagctcaccgccagagagtaagaggcctggaggagcaggttagtacccttaagggtcaactgcaacaggagcttcgcagaagctcagccccatttagtcctccatccggaccccctgagaagta

SEQ ID NO: 49453 - DNA, 3612 bp, Artificial Sequence
  Description of Artificial Sequence: Synthetic coding sequence
atggagcaggccccaaacatggccgagccccgtggacccgttgaccatggcgttcagatccggtttattaccgagcccgtttctggtgcagaaatggggactctcagacggggagggagaaggcctgctaaggacgcacgtgccagcacttatggggtcgccgtccgcgtccaggggattgcaggacagcctttcgtggttttaaacagtggagaaaagggcggagactcttttggagtccagatcaagggagctaacgaccagggtgcgtccggggcactaagcagcgatttggagctgcccgagaacccttactctcaggtgaaggggttccccgctccctcacagtcttctaccagtgatgaagaaccaggcgcatactggaacggaaagctgctgcggtcccattcccaggcttcactggccggacccggtccagttgacccaagcaaccgatccaactcaatgctggaactggccccaaaagtagcatcacccggtagtactatcgatactgctcccctaagttctgtcgattctctgattaacaagttcgattctcagctcgggggacaggctaggggacggactgggaggagaaccaggatgctcccccctgagcagcgaaaacgctctaaaagtctggattctaggttgccacgtgatacatttgaggagcgagagcggcagagcaccaaccattggactagctcaactaagtacgacaatcacgttggcacttccaaacagcccgcacagtcacagaacctgtcacccctcagtgggtttagccggagccgccagacccaagattgggttctacaatcattcgaagaacctcgacggtcagctcaggatcccactatgctgcagtttaagtccactcctgacctgctgcgcgaccagcaagaagccgcacctccgggatcagttgaccacatgaaggcgaccatctacggcattctcagagagggtagctcagagtctgaaacttctgtccggaggaaagtttcacttgtcctcgaaaaaatgcagcctctggtcatggtctcatctggcagtacaaaggcagtggcaggccagggggagttgacacggaaagtcgaggagctgcagagaaaactcgacgaagaggttaaaaagaggcagaagttggaaccgtcccaggtaggcctggagcgccagcttgaggaaaaaaccgaagagtgtagcagattgcaagagctgctcgaaagaagaaaaggggaggctcagcagtccaataaagagctccagaacatgaagcgtctcctggatcaaggcgaagatcttcgtcatgggctggaaacacaggtcatggagctgcaaaataaactgaaacacgtccagggtcccgagccagcaaaggaagttcttcttaaggacctcctcgagacgcgggaactgctcgaggaggtgctcgaggggaagcaaagagtggaggaacagctgcgcctgagagagagagagctgactgctctcaagggagccctgaaagaggaagtcgcctctcgcgaccaggaggtggagcatgtgcggcagcagtatcagagggacaccgaacagctacggcgttccatgcaggatgccacccaggatcatgcagtcctagaagccgagaggcagaagatgtccgctttagttagaggtctccagagggagcttgaggaaacttcagaagaaactggacactggcagagcatgtttcagaaaaataaagaagacctgcgggcaacaaagcaggaactgctgcaactccggatggagaaggaggagatggaagaggagctgggcgagaaaattgaggtgctgcaacgagaactggagcaggctcgcgcaagtgctggcgacacaagacaggttgaagtgctaaaaaaagaactcctgcgaacacaggaggagctgaaagagctgcaagccgagaggcaaagtcaggaggtggccggtcgacaccgagatagagaattagagaagcagctggcggtgttacgtgtcgaagcagacagagggcgagagctggaggaacagaatctacaactgcagaagacgcttcaacaactgagacaggattgtgaggaagccagtaaagctaaaatggtggccgaagccgaagccaccgtgctcggccagaggcgcgctgcagtggagacaaccctccgcgagacgcaggaggagaacgatgaattccgcagaaggatcctgggcctggagcaacaattaaaagagacccgcggtctggtcgatggaggtgaggcagtggaagctcggttacgtgacaaactccaaagattggaggcagagaaacagcagctggaggaggccctcaacgcttcacaggaggaggagggcagcctggccgcagccaaacgagctctggaggctagactggaggaagcccagcgcggattagcaaggctagggcaggagcagcagactcttaaccgggctctggaggaggaaggtaagcaacgggaggtgctgcgcagggggaaggccgagctcgaagagcaaaagcgcctcctggaccggacagtagatcggctgaataaagaattagagaaaattggggaagattctaaacaggcgcttcaacagcttcaagcacaacttgaggactacaaagaaaaggccaggagggaggtcgcagacgcccagaggcaggccaaagactgggcatccgaggccgagaaaactagtggagggctgagcaggttgcaggacgagattcagagactacgacaggcgctccaggcctcgcaggccgagcgggataccgcgcgactggataaagagctgctggcacagagactccagggtttggaacaggaggccgagaacaaaaagaggtcccaggacgaccgcgctcgccaactgaaggggttggaggaaaaggtttcccggctcgaaaccgagctcgatgaggagaaaaatacagtggaactcctgaccgatagagtgaaccgcggacgcgaccaggtggaccagttgagaactgaactgatgcaggaacgatcagccagacaggatttggaatgcgataagatctctttggagcgccagaataaggaccttaaaacccgtctggcgtcctccgaaggtttccaaaagccctccgcctcacttagtcaactggagtcccagaaccaactcctacaggaaaggctccaggcggaagagcgggaaaaaacagttctccagtccactaatagaaaactggaaaggaaggttaaagaactgagtattcagattgaagacgagaggcagcacgtgaacgaccaaaaggatcaacttagcctgagagtgaaggccttaaagaggcaagtggacgaagctgaagaggaaattgagagacttgatggcttaagaaaaaaggcccagagggaggtggaagagcagcacgaggtgaacgaacagttgcaggcgagaatcaagagtctggagaaggattcctggcggaaggcctcacggtcagcagcagaaagtgcactgaaaaatgaaggactctcctccgacgaggaatttgacagtgtgtacgatcccagcagcatcgctagccttctgactgagtccaatctgcagacatcaagctgttag

SEQ ID NO: 49454 - DNA, 876 bp, Artificial Sequence
  Description of Artificial Sequence: Synthetic coding sequence
atggagcaagcccctaatatggctgagccacgtggacccgttgaccacggcgtgcaaataaggttcatcactgagcctgtgtccggtgccgagatgggcaccttaagacgtggaggtcggcgtcccgctaaggatgcaagagcctctacttatggcgtcgctgtccgagttcagggcattgcaggtcagccctttgttgttttgaatagtggagagaaagggggtgactcatttggcgttcagattaaaggggctaacgaccaaggcgcttcgggggcattgtcaagtgacctcgagcttccagagaatccttattcgcaggttaagggcttccctgcaccaagtcagtcttccacctccgacgaagagcccggtgcatactggaatggcaagctgctccggtcccacagccaagcttccctcgcgggacccggacctgtggacccctccaatcgtagcaactctatgttggaactggctccaaaagtcgcctcccccggaagtaccatagatacagccccattaagcagcgtagactcactgatcaacaagtttgattcgcagctaggcggtcaggcaagggggagaaccgggagaagaacgcgaatgttgcctcctgaacaacgcaagaggagcaagtcccttgactcacggctcccacgggacacattcgaagagcgagaaagacaatcaacgaatcactggacgtcgtccacaaagtacgacaaccatgtggggacctccaaacagcccgctcagtcacaaaatctctctcccctctccggcttcagccgctccaggcagacacaagactgggtgttgcagtccttcgaggaaccaagaaggagtgctcaggaccccactatgttgcagtag

SEQ ID NO: 49455 - DNA, 513 bp, Artificial Sequence
  Description of Artificial Sequence: Synthetic coding sequence
atggagcaggctccgaatatggctgagccccgtggcccagtggaccatggagtgcagatccggttcataacagaacccgtgtctggcgctgagatgggtacattgcgcagagggggacgcagacccgctaaagatgcacgtgccagcacctacggggtggccgttcgagtgcagggaatcgctggccagcccttcgtagtactgaactctggggagaagggcggagactctttcggggtgcagataaagggcgcaaacgatcagggcgcttccggggctctgagcagcgacctggaactgcccgaaaacccctatagtcaagtcaaggggttccctgcaccttctcagtcatcgacctctgatgaggaacctggcgcatattggaacggtaaactgctcagatcacactcacaagcatcccttgctggccctgggcctgtcgatccttccaacagaagtaacagcatgctagaacttgcacctaaggtggctagtccaggcagcacaatttag

SEQ ID NO: 49456 - DNA, 513 bp, Artificial Sequence
  Description of Artificial Sequence: Synthetic coding sequence
atggaacaagctccaaacatggccgagccacgaggacccgtagatcacggagttcagattcggtttataaccgagcccgtctcaggtgccgagatgggaacacttcggaggggtggcagacgcccagccaaagacgcaagagcatccacttacggagtagccgtgagggtgcagggtattgctggacagccgtttgttgtgctgaactccggtgaaaaaggcggagattcctttggcgtgcagatcaaaggcgcaaacgatcagggcgcaagcggggcactcagctccgacttagaattgccagagaacccctatagccaggtcaagggatttccggctcccagccagtcttccaccagtgacgaggagccaggtgcctattggaatggcaaactgttgaggagtcatagtcaggcctcactcgcagggcctgggcctgttgaccctagcaataggagcaattccatgctcgaactcgctcctaaagtggcttcccccggatccacgatctag

SEQ ID NO: 49457 - DNA, 699 bp, Artificial Sequence
  Description of Artificial Sequence: Synthetic coding sequence
atgcccggttggttcaagaaagcttggtatgggctcgcatctctcctgtccttctcctcgttcattctgatcattgtagcccttgtagttccgcattggctctcgggaaagatcctgtgtcaaaccggagtggatcttgtgaacgccacagatcgggagctggttaaattcattggcgatatttactatgggctgttcagaggatgcaaagttcgacagtgcgggctgggcggaagacagagccagtttacaatttttccacatctggtgaaagaacttaatgctggcctacatgtcatgattctgctactcctttttctagcccttgccttggccttggtgtcaatgggttttgctatcctgaacatgatccaagtaccctaccgggctgtgtccggacccggaggcatctgcctttggaacgtgctggctgggggagtggtggccctggccatcgccagttttgttgctgcagtgaaatttcatgacttgacagaacgaatcgctaacttccaggagaagttgttccagttcgtggtcgttgaagagcagtatgaggaatcgttctggatttgcgtggcctctgcatctgcacacgccgcaaacctggtggtcgtggctatctctcagatccccctgcctgagataaagactaaaatagaggaagcaacggtaacagccgaggatattctgtactag

SEQ ID NO: 49458 - DNA, 681 bp, Artificial Sequence
  Description of Artificial Sequence: Synthetic coding sequence
atgcccacgaccaagaagaccctcatgttcctctcttccttctttacaagcctaggcagctttattgtgatctgcagcatcctcgggacgcaggcatggataacttccacgatcgccgtgagagacagcgccagcaacgggtcgattttcattacttatggtctctttcgtggagagagctccgaagagttgagtcatggtctcgcggagccaaagaagaaattcgctgtgctggaaattttaaataatagctcccagaagacacttcactctgtcaccattctattcctggtactgtctcttatcacgtcactgctcagctcaggctttactttttacaatagcattagtaacccctatcaaacatttctcgggccaacgggtgtttatacttggaacggtctaggcgcatctttcgtgtttgtcaccatgattctgttcgtcgcaaacacccagtcaaatcagttatctgaagaactgttccagatgctatatccagccaccacctcaaagggcaccacccattcgtatggctactccttctggctcattttattggtgatcctgctaaatatagtgactgtaacaattataatattttatcaaaaggccagataccagagaaagcaggagcaacgcaaacccatggaatatgccccacgagacggaattcttttctag

SEQ ID NO: 49459 - DNA, 687 bp, Artificial Sequence
  Description of Artificial Sequence: Synthetic coding sequence
atggcaagcacagcaagcgaaatcatcgctttcatggtttccatcagcggctgggtactggtgtcctccacactgccgaccgattactggaaggtttcaacgatcgatgggaccgtgataaccaccgcaacgtattgggccaatctgtggaaggcatgcgtcactgattctacaggagtgagcaattgcaaggatttcccctccatgctggctctcgacggttacatacaggcttgccgcggactcatgatagcagccgtgtcactaggcttcttcggcagtattttcgctttgtttggcatgaagtgtactaaagttggcggttccgataaggccaaagcaaaaattgcgtgtctcgcgggaatcgtgttcattttgtctggcttatgtagcatgactgggtgttccctgtatgccaataaaatcaccactgagttcttcgatccactatttgtcgagcagaaatatgaactcggcgcagcactgttcatcgggtgggccggagcgagtttgtgtataattggtggcgttatcttttgtttctcaattagcgataacaataagactccccgatacacatataacggcgctacttcagtgatgagctccaggactaaatatcatggaggagaggacttcaaaactacaaaccctagcaaacagttcgacaagaacgcttatgtttag

SEQ ID NO: 49460 - DNA, 222 bp, Artificial Sequence
  Description of Artificial Sequence: Synthetic coding sequence
atgatcgcggcagtttccctcggattctttggatccatctttgcgctattcgggatgaagtgcacaaaggtgggtggatctgacaaagctaaagctaagatcgcctgtctcgctggcatcgtgttcattttatcagggctttgctctatgaccggatgctctctttatgccaataaaatcactaccgaattctttgatcccctgttcgttgagcagaaatag

SEQ ID NO: 49461 - DNA, 681 bp, Artificial Sequence
  Description of Artificial Sequence: Synthetic coding sequence
atgagcagggcacagatttgggccctggtgagcggcgtcgggggattcggtgccctagtggcggcaaccacatcaaatgaatggaaggttacaactcgtgcttcttcagtcatcactgcgacgtgggtgtatcaaggcctgtggatgaactgcgctggaaacgccctcggatcttttcactgtagacctcattttactatcttcaaggtcgctggttacattcaggcctgccgtgggcttatgattgctgccgtgagcctcggctttttcggttccatatttgccctgttcggcatgaagtgcactaaagtgggcggttcggacaaggctaaagctaagattgcttgtctcgcgggtatcgtgtttatcttaagcggcctctgttcgatgaccggctgttccctgtacgcaaataagatcaccactgaattcttcgatcccctgttcgtggaacagaaatacgagctgggggcagctctgttcatcggctgggccggtgccagcctctgtatcattggaggagtgatattttgtttctcgattagcgacaataacaaaacccctcgctacacctataatggagcaacttccgtcatgtcaagccgtaccaagtaccatggcggtgaggactttaagactaccaatccaagtaaacaattcgataaaaatgcatacgtgtag

SEQ ID NO: 49462 - DNA, 735 bp, Artificial Sequence
  Description of Artificial Sequence: Synthetic coding sequence
atgggttgtagggacgtccacgctgcgacagtactgagttttctgtgcggtatcgccagcgtggcgggattgttcgcaggcacgctcctcccaaactggagaaaacttaggctgattacattcaaccggaacgaaaagaacttaacagtatacaccggcttgtgggtcaagtgcgcccgatacgacggaagttctgactgcctcatgtacgatacaacatggtactcttctgtcgaccagctagacctgcgtgtgctgcaatttgcgctccctctgtctatgctgatcgccatgggcgcactgctactatgcctgatagggatgtgtaatacagcctttcgttcgtccgtaccaaacattaagctcgccaaatgcctggtgaactcagcgggttgccatttggtggctggccttcttttcttcttggcgggaaccgtgtctctttctccatctatatgggtgattttctataacatccatctgaataagaagtttgaaccagtattcagctttgattacgctgtgtacgtgacaatcgccagtgccggaggattgtttatgaccagtctgattctttttatatggtattgcacctgtaagtctctcccaagtcccttctggcagcccttatacagccacccaccctcaatgcatacctattcacagccttattcggccagatcgaggctgtccgccattgagatcgacattccagtcgtttcccacacaacgtag

SEQ ID NO: 49463 - DNA, 564 bp, Artificial Sequence
  Description of Artificial Sequence: Synthetic coding sequence
atgggatgccgcgacgtgcacgcagcaacagtgttgtccttcctttgtggcatagcttccgtggcaggtctatttgctgggacactcctgcctaactggagaaaacttcgcctgatcacctttaaccggaatgagaagaatctgactgtgtacacgggcctttgggtgaaatgcgcaaggtacgacgggagttccgattgccttatgtacgacacaacctggtactcatctgtagatcagctggacctccgagtgttgcagttcgccctgcctctcagcatgcttattgccatgggggcactgctcctgtgcctgattggcatgtgcaacacagccttccggagctccgttcctaacatcaagttagccaaatgcctggtgaactctgctggctgccatctggtggccggtctcctcttcttcttagcgggaaccgtctccctgagtcccagtatatgggtgattttctacaacatacatctgaacaagaaatttgaacctgtctttagctttgattatgccgtgtatgtgactatagcctccgccggaggcctttttatgtag

SEQ ID NO: 49464 - DNA, 735 bp, Artificial Sequence
  Description of Artificial Sequence: Synthetic coding sequence
atgggatgccgagacgttcatgccgctaccgtgctgtcattcttgtgtggaatcgcgtccgtggcgggactgttcgccggaacactgcttccaaactggcggaagttgcgcctgataaccttcaatcgcaatgagaagaaccttaccgtgtatactggattatgggtaaagtgcgccagatacgatggctcttcagactgcctgatgtacgacaccacctggtactcttcagtagaccaactggacctgagggtgcttcaatttgcgttgccactaagcatgctgatcgcgatgggtgccctgctcctatgcctcatcgggatgtgtaacactgcatttcgctctagcgtcccgaatatcaaactggccaaatgtctggtgaatagtgccggatgccacctggtggctggactgttgtttttcctggccggaaccgtttcgctatcaccttcaatttgggtgatattctacaatattcacctgaacaagaaatttgaacctgttttctctttcgactacgctgtctacgtgaccattgcctctgcaggcggtcttttcatgacgtcacttattttgtttatatggtactgcacatgcaaaagcctccccagtcctttttggcaacccctatatagccaccccccttcaatgcacacctacagccagccttattcagccagatcccgactgtccgccatcgagattgacatccctgtcgtcagccatactacctag

SEQ ID NO: 49465 - DNA, 528 bp, Artificial Sequence
  Description of Artificial Sequence: Synthetic coding sequence
atgggatgccgggatgtccacgccgcaacggtcctctctttcctgtgcgggatagcctccgtggcagggctgttcgcaggcaccctgctgcccaattggcgcaagctgcggctgattactttcaatcgaaacgaaaagaacctcacagtgtacacaggcctgtgggtgaaatgcgcccgatacgacggcagttccgattgtttgatgtatgatactacttggtactcctccgtggatcaactcgacctccgggtgctgcagttcgcgttgcctctttccatgttgatcgcaatgggggcactcctgctctgcctgatcggcatgtgcaacaccgcgttccgctcctccgttcctaacattaagttagcgaagtgcctcgtgaactcagccggttgtcacttagttgcaggccttttgtttttcttagccggaacagtatccctgtccccaagtatttgggttattttttacaacatacacctcaacaagaagttcgaacctgttttctcttttgactatgcagtgtag

SEQ ID NO: 49466 - DNA, 528 bp, Artificial Sequence
  Description of Artificial Sequence: Synthetic coding sequence
atgggctgccgggacgttcacgccgcaaccgtcttaagttttctgtgtgggatcgcttcagtggccggattattcgctggaacactcctccctaattggcgcaagctgcgactgatcacctttaaccgcaatgaaaaaaatctcaccgtgtatactggcctgtgggtcaaatgcgcaaggtacgacgggtccagtgactgtctaatgtatgacacaacatggtattcttctgtagaccagcttgacctgcgggtcttacagttcgctcttcccctgagtatgttaatcgcaatgggagctctgttgctgtgcctaatcgggatgtgcaacacagcatttcgaagttcagtgcctaacattaagctcgccaaatgcctggtaaattcagctggctgtcacttagtggcaggcctgctcttcttcctcgccggaactgtctctctctcaccctcaatctgggtaattttctacaacatccatcttaacaaaaaattcgagcccgtgttttcattcgactatgcagtgtag

SEQ ID NO: 49467 - DNA, 381 bp, Artificial Sequence
  Description of Artificial Sequence: Synthetic coding sequence
atgggttgccgcgacgtgcacgcagcaacagtcctctcctttctgtgcgggatcgcttccgtagctggactgttcgctggcacgttactcccaaactggcggaaactgaggctgatcacattcaaccgcaacgagaaaaacttgaccgtttatacgggtttgtgggttaagtgtgccaggtatgacgggagttctgattgcttaatgtatgacaccacctggtactccagcgttgaccagctagatctcagggtgctccaatttgctctgccactatctatgttgatcgccatgggcgcactgctactgtgcctgatcgggatgtgtaataccgcctttagaagcagcgtgcctaacataaagctggcgaaatgcctgtag

SEQ ID NO: 49468 - DNA, 735 bp, Artificial Sequence
  Description of Artificial Sequence: Synthetic coding sequence
atgggatgccgcgatgttcatgccgctacggtgctgagcttcctctgcggaatagcatcagtggctgggttatttgccggaacgctcttacccaactggcgaaagctgcgcctgatcacatttaatagaaatgagaagaatctgactgtctataccggcctgtgggttaagtgtgcaaggtacgacggttcttccgattgcctaatgtatgataccacctggtacagctctgtggatcaactggacttaagggttctgcagttcgccctgcccctcagcatgcttatcgcgatgggagctctgctattatgcctgatcgggatgtgcaatactgcattccggtcctcggtccctaacataaaactggctaaatgcctagtgaactccgccggttgtcacctagtggccggattgttgtttttcctcgccggaaccgtgtctttaagcccttccatctgggtgatcttctataatatccacttgaacaagaaattcgaacccgtcttctccttcgattacgcagtgtacgtaacgatagcctccgccggtggcttgttcatgactagcttaattttgttcatctggtactgtacctgcaagtcccttccctcccctttttggcagcccctttattctcatccgccttccatgcatacatactcacagccgtatagtgccagaagcagactgtccgcaattgaaattgatatacctgtggtctcacatactacatag

SEQ ID NO: 49469 - DNA, 735 bp, Artificial Sequence
  Description of Artificial Sequence: Synthetic coding sequence
atgggctgtagggatgtgcacgcggctaccgtcctcagctttttgtgcgggattgcaagtgtggccggtcttttcgcaggaactctgctgcccaattggagaaaacttcgcttgattaccttcaacagaaatgagaagaacttgaccgtctatactgggctgtgggttaaatgtgcccgatatgacgggagcagcgattgtctcatgtacgacacaacttggtactcaagtgttgatcagttggacttgagggtcttacaattcgcacttccactgtctatgctgattgccatgggggctctgcttctgtgtttgattggtatgtgcaacacagccttcaggtccagcgttcccaacattaagcttgcaaagtgcctcgtgaacagtgcaggttgccacctggtcgccggtctgctgttttttctggccggaaccgtgagcctctctccgtcaatatgggttatattctacaacatccacttaaataagaagttcgaacctgtgtttagctttgactatgctgtttacgttacaattgcttcagccggtggcttatttatgacatctctcattcttttcatatggtattgtacatgtaagtcccttccttctccgttttggcaaccgttgtactcccacccacctagcatgcatacatactcccagccctacagtgcacgaagccgcctctccgcaatcgagatcgatatccctgtggtctcacataccacatag

SEQ ID NO: 49470 - DNA, 687 bp, Artificial Sequence
  Description of Artificial Sequence: Synthetic coding sequence
atgagtatggctgtggaaacctttgggttctttatggcgaccgttggcctactcatgctcggagtcacactcccaaattcctattggcgcgtctctaccgtgcatggaaatgttattactaccaataccatctttgagaatttgtggttctcctgtgccacagattctctgggcgtgtataactgttgggagtttccaagtatgctggcactgtcagggtacatccaggcctgtcgggctcttatgatcaccgcgattttgctgggttttctggggttgttactggggatagcgggtctacgatgcaccaatattggaggacttgaattaagtcggaaagcgaagctggcagccacggcgggtgccctacacattttggcaggaatatgtggtatggttgcaatctcctggtatgcctttaacataacccgggatttctttgatcctttataccccggaactaagtacgaactcgggccagcactttacctggggtggtccgcttcactcatatccatcctgggaggactatgcctgtgcagcgcttgttgctgcgggtcagacgaggacccagccgcttccgcacgcaggccatatcaggcacccgtctctgttatgcccgtagccacctccgaccaagagggggactctagcttcggtaaatacggtcgaaacgcttacgtatag

SEQ ID NO: 49471 - DNA, 687 bp, Artificial Sequence
  Description of Artificial Sequence: Synthetic coding sequence
atgagcatggctgtggagacattcggattcttcatggccacagtgggtctgttaatgctgggcgtgacactgcccaattcttattggagagtgagcacggttcatggaaatgtgatcaccactaacacaatctttgaaaatctctggttctcctgcgccaccgatagtcttggagtctacaattgctgggaatttccaagtatgttagcgttatccggctacatccaagcttgtagagcactcatgatcactgctatcctgttagggttccttggccttctgctcggaatcgcagggcttcgatgtaccaacattggcggactcgaactctccagaaaggcgaaacttgctgctactgccggagctttgcacatactggccggaatctgcgggatggtcgcaatttcctggtacgccttcaatattactagagacttttttgaccctttgtacccaggaacaaaatacgagctgggaccggctctgtacctgggatggtcagctagtctcatatccattctgggcggactgtgtttgtgcagtgcatgttgctgtggcagtgacgaggatccggcagctagcgctcgacggccttaccaggcccctgtcagtgtcatgcccgtcgctacatccgaccaggagggggactcgagcttcggtaagtatggccgtaacgcttacgtgtag

SEQ ID NO: 49472 - DNA, 675 bp, Artificial Sequence
  Description of Artificial Sequence: Synthetic coding sequence
atggcattttaccctctccagatagcaggcctggtcttgggttttctggggatggtcggtaccctggcaactacccttctgccccagtggagggtgagcgcctttgtgggctctaatatcatagtcttcgagagactatgggagggactgtggatgaattgtattcgacaggcccgtgtgagactccagtgtaagttttactcttccctcttggcactgccgcctgcactcgagacggcgcgagcattgatgtgcgtggccgtcgccttgagtttaatcgctttgctgatcggcatttgcggtatgaaacaggtccaatgcaccgggtccaacgaacgtgccaaagcctacttgctcggtacaagtggcgtgttgttcattctcaccgggatcttcgtcttaatcccagttagttggacagctaacatcattatccgagacttctacaatcccgcaattcacattggacagaagagggagctaggtgctgccttattcttaggctgggcttctgctgccgttctgttcatcgggggagggctgctctgtggcttttgttgttgtaaccggaagaaacaggggtacagatatcccgtgcctggttatcgtgtgccacacactgataaaaggcgtaacactaccatgctgagcaagacctctacatcctacgtttag

SEQ ID NO: 49473 - DNA, 693 bp, Artificial Sequence
  Description of Artificial Sequence: Synthetic coding sequence
atggcctctcttggactgcaactggtcggatatattctgggcctgctgggtctcctgggcacccttgtggccatgttgttgcccagctggaagacatcatcgtacgtcggggcatccattgttaccgccgtgggcttctcaaagggcctgtggatggagtgtgcaacccactccacggggatcacgcagtgtgatatttattcaaccttgctggggttacctgctgacattcaagctgcgcaggcaatgatggtgacttcaagtgccatctccagcttggcatgtattatatctgttgtcggcatgcggtgcaccgtgttttgtcaagaaagcagagccaaggaccgtgtggccgtagccggaggcgtttttttcattctggggggtttactaggctttatccctgttgcttggaaccttcatgggatactgcgagatttctattcaccactagtgccggattcaatgaaattcgaaattggagaagccctctatttgggaattattagtagcctattttccttgatcgctggaattatcctgtgcttttcatgtagcagtcaacgcaatcgctccaactactacgacgcttatcaggcacagcctctggccacacggagcagcccaaggccaggtcaacccccaaaggtaaaaagcgaatttaactcttattctctgacagggtacgtgtag

SEQ ID NO: 49474 - DNA, 693 bp, Artificial Sequence
  Description of Artificial Sequence: Synthetic coding sequence
atggccagcctaggcctacagctagttggttatatcctgggcctgctgggcctgctgggaacgctggtggccatgctccttccttcatggaaaacatctagctacgtgggcgcttccatcgtaacagctgtaggatttagcaaaggtctgtggatggagtgcgccactcattcaaccggcattacccagtgcgatatctacagtaccttgttgggcttgcctgctgatatccaggccgctcaggcaatgatggtgacatcgtccgcgatctcaagtcttgcgtgtatcattagcgttgttgggatgaggtgcaccgtgttctgccaggagtccagagctaaggaccgggtcgcagtggcaggcggtgtgttctttatattaggaggactgctgggctttattccagtagcttggaacctccatggcatcctgagggatttttatagccctctggtcccagacagtatgaaatttgagatcggcgaggctctgtatcttggcatcatctcttcactgttcagcctcattgcgggaatcattctttgtttttcctgctccagtcagaggaaccgttccaattactacgacgcttaccaggcccagcccctggccactagatcctcccctcggccaggccagccccctaaggtaaagtcagagtttaacagttactctttgaccggctacgtttag

SEQ ID NO: 49475 - DNA, 693 bp, Artificial Sequence
  Description of Artificial Sequence: Synthetic coding sequence
atggcttccctgggcctgcaacttgtgggatacatcttaggccttctcggcctgctgggcactctcgttgcaatgttgctcccttcctggaagacaagctcttatgtgggggcttccatcgttactgccgtgggcttctcaaaagggttatggatggagtgtgccacccatagtactggcattactcagtgtgatatctatagtacgctgctcggactacctgcagacatccaggcagctcaggccatgatggtaactagctcagctatctcttcgcttgcatgcataatcagtgttgtcggcatgcggtgtaccgtgttctgtcaggagtcacgggcaaaggatcgggtggctgtggctggaggcgtgttcttcatccttggaggtctcttgggttttatccctgtggcctggaatctgcatggcatactccgtgacttttatagccccctcgtgccagacagtatgaaattcgaaattggggaggctctttatctgggtattattagctcgctgttcagtctgatcgctggcattatcctgtgttttagctgttcttcacagagaaatcgatctaactactacgacgcctatcaggcacagccgctggctacgaggagttctcctcggcctggccagccaccgaaagtgaagagcgagtttaactcatactcactcacaggctatgtgtag

SEQ ID NO: 49476 - DNA, 660 bp, Artificial Sequence
  Description of Artificial Sequence: Synthetic coding sequence
atggctagcgccggtctgcagctcttggcgtttatcctcgctctgagcggcgtgtccggggtcctcaccgctacccttctgcccaactggaaggtcaatgttgacgtcgattcgaatattatcaccgccatcgttcaactacatgggctctggatggactgtacgtggtacagcactggtatgttctcctgtgcactgaagcactcaattctgtccctgcccatccacgtgcaggcagccagagccacaatggtgttggcatgcgtcctgtcagcactgggtatctgtacttcaacggtgggtatgaagtgtacccggctgggcggagatcgcgagactaagagccatgcctcgtttgccggtggggtgtgcttcatgagcgccggtatttctagcctaatctctaccgtttggtacaccaaggaaattattgcaaattttttggatcttacagtgccagaatccaacaaacatgagccagggggtgctatctacatcggcttcatatcagcaatgctgctcttcatctccggaatgatcttctgcacatcctgtatcaaaagaaatcccgaggcccgtctggatcctcccacgcagcagcctatctccaacactcagctagagaacaattccactcacaaccttaaggactacgtgtag

SEQ ID NO: 49477 - DNA, 663 bp, Artificial Sequence
  Description of Artificial Sequence: Synthetic coding sequence
atggcgctcgttttcagaactgttgcccaattggccggagtgtcgctctctctgctcggctgggtcctgtcatgcctgaccaactatctccctcattggaagaacttgaacctagacctcaacgagatggagaactggacgatgggtctctggcagacatgcgtcatacaggaagaggtgggaatgcagtgcaaagacttcgatagttttcttgcactgccagctgaattacgggtgagccgcattctcatgtttctctccaatggtctgggttttctcgggctgctagtcagtggcttcggattggactgtctgagaattggggaatcacagagggacctcaaaagaaggttattaattcttgggggaatactgagttgggcctccggcgtcacagccctggttcccgtatcctgggtggctcataagacggtccaggagttctgggacgagaacgttccggactttgtgcccagatgggagttcggcgaagctttattcctcggctggttcgctggcctgagcttactcttgggcggttgcctgctacactgcgcagcttgctctagccacgccccactcgcttccgggcattacgccgtcgcacagactcaggatcatcatcaagagttagagacaaggaatactaatctcaaacactag

SEQ ID NO: 49478 - DNA, 879 bp, Artificial Sequence
  Description of Artificial Sequence: Synthetic coding sequence
atgaggacccccgtggtgatgactctggggatggttttggccccttgtggtctgcttctaaaccttacgggaacacttgctcctggctggcgtttagtcaaaggttttctcaaccagcccgtcgatgtcgagctgtatcagggtttgtgggacatgtgtcgggaacagagttcccgtgaacgtgagtgtggtcagactgaccagtgggggtatttcgaggcccaacccgtgctggtcgcacgcgctctgatggtgacctccctcgccgctacagtcctggggctgctactggcatccctcggagttcgatgttggcaggatgagcccaactttgtactggccggactttctggggtcgttctgtttgtcgcaggcttattaggccttatccccgtttcgtggtataatcactttctgggagatcgtgatgtgttacccgcacctgcctctcctgtaacagtccaggtttcatatagcctggtcctaggctatctggggtcatgcctcctcctgctcgggggtttcagcctggccctgtcttttgctccttggtgcgatgaacgctgtcgtagacgaagaaaaggaccaagtgccggaccgagaaggtccagcgtttccactattcaggtagaatggcctgagccagacctggccccagctatcaaatactactctgacggacagcataggccccctccagcacaacaccgcaaacctaaacccaaaccaaaggtcggcttcccgatgcctcgtcccagaccgaaagcctatacaaacagtgtcgacgttctggatggtgaaggatgggaatcacaggacgcaccttcgtgttctacccatccttgcgactccagcctgccatgcgactccgacttgtag

SEQ ID NO: 49479 - DNA, 690 bp, Artificial Sequence
  Description of Artificial Sequence: Synthetic coding sequence
atggcttggtctttccgggcaaaggtgcagctgggcggtttacttctgtcactgctgggatgggtctgctcttgcgtgacgacaattttgccacaatggaaaactttgaatttggagctcaacgagatggagacttggattatgggaatatgggaggtgtgtgttgaccgcgaagaagtggccacagtctgtaaggccttcgagtccttcttaagtctgccacaggagctgcaggtggccagaattctgatggtggcctcgcacggcctgggtctgttgggactgctgctctgctccttcgggtctgagtgttttcagttccaccgtattagatgggtctttaagagacgcctcggattgctggggaggaccctggaggcatctgcctccgccacaactcttctcccagtttcatgggtcgcccacgccaccatccaagacttttgggacgacagcatcccggatataataccgaggtgggaattcgggggagccctttacctgggctgggctgccggaatttttttagcgctcggcggtcttctcctaattttctctgcatgcctcggtaaggaagacgttccatttccactgatggcgggacctacggtgcctctgagctgcgcacccgtcgaggagtccgacggttcctttcatctgatgctgcggccaaggaatcttgtcatttag

SEQ ID NO: 49480 - DNA, 663 bp, Artificial Sequence
  Description of Artificial Sequence: Synthetic coding sequence
atggcctcggctgggatgcagattctcggcgtcgttttaacactactaggttgggtgaacggactggtttcatgtgccctgcccatgtggaaagtcaccgcatttattggtaatagcatagtcgttgcccaggtagtatgggaggggctgtggatgagctgcgtcgtccagtcaaccggccaaatgcagtgtaaggtctatgattcgctcctggccttgccccaggatctccaagctgcccgtgctctttgcgtgatcgcattacttgtcgcactcttcggcctgttagtgtatttagcaggagcgaagtgtactacctgtgtggaggagaaggatagcaaggctaggttagtgcttacatcgggcatcgtgtttgtgattagcggggtactgaccctgattccagtgtgttggacggcgcacgcaataattcgagacttttataacccactggtggccgaggcgcaaaagcgtgaactgggggcatccctgtacctgggctgggcagcgagcggcttactactgttgggagggggactgctctgctgcacctgtcctagcggcggttcccaagggccaagccattatatggctcggtacagcacttctgccccagcgatcagccggggaccatccgagtaccctacgaaaaactatgtgtag

SEQ ID NO: 49481 - DNA, 663 bp, Artificial Sequence
  Description of Artificial Sequence: Synthetic coding sequence
atggcgtcagccggtatgcagattcttggggtggtgcttactctgctaggttgggtaaatggcctggtcagctgcgccctccccatgtggaaagtcaccgcattcatcggcaattccattgtagtggcccaggtggtgtgggaagggttatggatgtcctgtgtggtgcagagcaccgggcagatgcagtgcaaagtctacgacagtttgctggctttgccccaagatctgcaggcagccagagctctctgtgtgattgcgcttttggtagctttgttcggcctcctcgtatacctcgcaggtgccaaatgtactacctgtgtggaagagaaggacagcaaagcgaggctagtgctaactagcggcatcgtgttcgtgatcagtggtgttctgacgctaatcccggtgtgctggactgcacatgctatcattagggacttctataatccacttgtcgctgaggcccagaagcgagaactaggggctagtctttacctgggatgggctgcctccgggttgctcttgttgggtgggggactcctatgctgtacttgcccttctggcggatctcaggggcctagtcattacatggccagatattccacctcggctcccgcaatctcccgcggtccctccgagtatcccaccaaaaattatgtatag

SEQ ID NO: 49482 - DNA, 636 bp, Artificial Sequence
  Description of Artificial Sequence: Synthetic coding sequence
atggccaattcagggctgcagcttctgggtttttctatggccctgctgggctgggtgggcctcgtggcttgtaccgccataccccaatggcagatgtcttcttacgccggagacaacattatcacggcccaggcgatgtataagggcctatggatggactgcgtcacccagtccacaggaatgatgtcatgcaagatgtatgactcggtgctggcattaagtgctgccctccaagctacgcgcgctctaatggtcgtttctcttgttttgggcttcctcgctatgttcgtggcgacaatgggtatgaagtgcaccaggtgtgggggagacgacaaggtcaagaaagcgagaattgccatgggaggagggatcatctttattgtggctggattggctgccctggttgcctgctcatggtatggacaccagatagtcactgatttctacaaccccctgattccgaccaacatcaagtatgagtttggtccagccatttttataggttgggccggatccgctctagtgatactaggtggggctttgctctcgtgttcctgccccggaaatgaaagcaaggccggttatcgggtgccacggagttatcccaaaagtaactcaagtaaggaatacgtttag

SEQ ID NO: 49483 - DNA, 636 bp, Artificial Sequence
  Description of Artificial Sequence: Synthetic coding sequence
atggccaatagcggtctccagctgctggggttctccatggcactgttgggctgggtcgggttggttgcttgcaccgcaatcccccaatggcagatgagctcatacgccggagataacatcattactgcacaagcgatgtataaaggactctggatggactgcgtaacacagtccacaggaatgatgtcttgcaaaatgtacgactccgtgttagcactgagcgctgccctgcaggccacacgtgctctcatggtggtaagcctggtgctggggtttttggccatgttcgtggctactatgggcatgaagtgcacccgctgcggtggagacgacaaagtgaaaaaggctcgcatcgccatggggggtgggattatctttatcgtcgcaggactcgccgctttggttgcctgctcatggtacggacatcaaatcgtgacagacttttataatcccctgatacctaccaacatcaagtatgaatttggcccagctatctttatcgggtgggcaggctccgccttggtgattctaggaggggcattgctatcttgtagctgcccgggaaacgagagcaaagccggatatcgcgtgccaaggagttacccaaagagtaacagctctaaggagtacgtttag

SEQ ID NO: 49484 - DNA, 438 bp, Artificial Sequence
  Description of Artificial Sequence: Synthetic coding sequence
atggccaacagcggtcttcagctgttaggattcagcatggctctcctcggctgggtcgggctagtcgcatgtacagccatcccccaatggcagatgtctagctatgcgggagacaatatcatcacggctcaagctatgtacaaggggctgtggatggattgtgtgactcaaagcaccggaatgatgtcctgcaagatgtacgactcagtccttgccctgagtgcagcactccaagcaacccgcgctttgatggttgtgtcattggtactgggtttcctggccatgtttgtcgcgacaatgggaatgaagtgtacccgctgtggcggtgacgataaggtgaagaaagcgcgtattgccatgggcggtggcattatctttattgtggcaggtatgagtctcgcactgccatcacttctggccggacaaggtctgccgtag

SEQ ID NO: 49485 - DNA, 678 bp, Artificial Sequence
  Description of Artificial Sequence: Synthetic coding sequence
atggcaactcacgccctggagattgccggactcttcttgggaggtgtgggtatggtcggtaccgtagccgtgacagttatgccccaatggcgtgtgtctgcatttatagagaacaacatcgtggtttttgaaaacttttgggagggtctgtggatgaattgcgttaggcaggctaatattagaatgcagtgtaaaatctacgacagcctgctagctctgtcccccgacttgcaggcagccagagggcttatgtgcgctgcatctgttatgtctttcttggcttttatgatggctattctgggcatgaagtgcactagatgcactggtgataatgaaaaagtaaaagcacacatcttattaactgccggtatcatctttataattacaggcatggtggtccttatccccgtgtcctgggttgccaacgccattatccgagatttctacaacagcatcgtcaacgtcgctcagaagcgcgaacttggcgaggccctatacctgggttggaccaccgcactggttctcatcgtaggtggagctctcttctgctgcgtgttctgctgcaatgagaaatcctctagttatagatattccattccaagccacagaaccactcagaaaagctaccacacagggaagaaatccccgtctgtatacagcaggtctcagtatgtctag

SEQ ID NO: 49486 - DNA, 678 bp, Artificial Sequence
  Description of Artificial Sequence: Synthetic coding sequence
atggccacacacgctctcgagattgctggattatttcttggtggtgtgggcatggtaggcaccgtggccgtgacggtgatgccacagtggcgtgtgtcagccttcatcgagaataatatagtagtattcgagaatttctgggaagggctgtggatgaactgcgtgcgccaggcgaacatacggatgcaatgtaaaatttacgatagtctactagcccttagtcccgacctgcaggcggctaggggtttaatgtgtgcggcatctgtgatgtcttttctggcattcatgatggccatcctggggatgaaatgcacacggtgcacaggagataacgagaaagttaaggcacatatcctcctaactgcagggataatcttcatcatcaccgggatggttgtcctgattccggtctcatgggttgctaacgctatcatccgtgatttctacaactccattgtaaacgtggcccagaaaagagagctgggcgaggcattatacctgggttggactaccgctcttgttttaatagtcggtggggctctcttttgctgtgtattttgctgtaacgagaaatcctcctcatatagatacagtataccttctcatcggaccactcaaaaatcctaccacactgggaaaaaatctcctagtgtatacagccgcagccaatacgtgtag

SEQ ID NO: 49487 - DNA, 702 bp, Artificial Sequence
  Description of Artificial Sequence: Synthetic coding sequence
atggccactcatgctttagagatagcaggtctgttcctgggcggagtgggaatggtgggaaccgtggccgtgaccgtgatgcctcaatggagagtgtctgctttcattgaaaacaacatcgttgtctttgaaaatttttgggagggattgtggatgaattgcgtccgccaggcgaacattcgcatgcaatgcaaaatttatgatagcttgttagcactctcacccgacttgcaggccgcacgtggcctgatgtgtgccgcttctgtcatgtccttcctcgcattcatgatggcaattctgggtatgaagtgtactagatgcacaggcgataacgagaaagtcaaagcacatatcctattgacagcgggaatcattttcataatcacgggaatggtggtgctaatccccgtctcctgggtcgctaacgccatcatcagggatttctacaatagtatagtaaacgtagctcaaaaacgggaattgggggaggccctctatctgggctggaccacagccctggtgttgatagtcggcggtgccctgttttgctgtgtgttctgttgtaacgagaagagttcttcctaccggtattcgataccgagccacagaaccactcagaagagttaccacacagggaagaaaagtaggctgctacagaagtctgtgtgcgtagtggtttacgtgttcctcacattgctgtag

SEQ ID NO: 49488 - DNA, 654 bp, Artificial Sequence
  Description of Artificial Sequence: Synthetic coding sequence
atggcatccactggcctagagctgctcggaatgaccctggccgttttagggtggctcggtacactggtaagttgcgccctgcctctgtggaaagtgacagcatttattggcaactcaatcgtcgtagcccaggtagtgtgggagggactttggatgtcatgcgtggtgcagagcacagggcaaatgcaatgcaaggtttacgacagcctgctagccttgccccaagacttgcaagcagcaagagccctttgcgtcatcgctctcttactcgctttactgggccttctggtggctattacaggagcccagtgtaccacatgcgtcgaggacgagggcgctaaggcaagaattgtcctgaccgctggcgtgatactgttactcgccggtattcttgtcttgatccccgtctgctggacagcccatgcgattatccaggacttctataatccacttgtcgccgaggccctaaaacgcgagctgggggcttcactgtatctcggatgggccgctgctgccttactcatgttaggcggaggtctgctgtgctgcacctgtcctccaccacaggttgagaggcccaggggcccacgcctgggatacagcattcctagccgttctggcgcatctggattggataagagagactacgtttag

SEQ ID NO: 49489 - DNA, 762 bp, Artificial Sequence
  Description of Artificial Sequence: Synthetic coding sequence
atggacaatcgattcgccacggctttcgtgatcgcgtgcgtcctatctctgatttctaccatctacatggccgcatcaattggtacagatttttggtatgaatatcgttcccccgtgcaggaaaattcatctgatctcaacaaatccatctgggatgaattcattagtgacgaagctgatgagaagacatataatgacgcgttgtttcggtataatggaaccgtcggactgtggaggcgatgtatcaccattcccaaaaacatgcattggtacagccctccagagagaaccgagtcctttgatgtggtaacaaagtgcgtttcattcaccctcaccgaacaattcatggaaaagttcgtggatccgggaaatcacaactctggcatcgacttactaagaacttatctgtggagatgccagtttctccttcctttcgtgtccctgggactgatgtgcttcggagcgcttattggcttgtgtgcatgcatctgcagaagcctatatccaaccatagctaccgggatccttcacttgttggctggattgtgtactcttgggtccgtgagttgttacgtggctggcatagaattacttcaccagaagctggagctgcccgacaacgtgagcggcgaattcgggtggagcttctgcctggcctgtgtaagcgcacccctccagttcatggctagcgcattgtttatttgggctgcccatacaaatagaaaggagtacaccctgatgaaagcgtacagggtcgcctag

SEQ ID NO: 49490 - DNA, 762 bp, Artificial Sequence
  Description of Artificial Sequence: Synthetic coding sequence
atggacaatcggttcgcaaccgctttcgttatcgcatgtgttttgtccttgatcagcactatttatatggctgcctccatcggtacagatttctggtatgagtacaggtctcctgtgcaggagaatagctccgaccttaataaaagcatctgggacgagtttattagtgatgaggccgacgagaagacatataatgatgctctcttccggtataacggtacagtggggctgtggcgccgatgcattaccatccccaagaacatgcattggtactccccaccagagcgcaccgaatcctttgatgttgtaaccaagtgtgtgtcatttaccctgaccgagcagtttatggagaaattcgtagaccccggaaatcataactctggcatcgatttactgagaacctatctttggagatgccaatttctgttgccgttcgtgagcttgggcttaatgtgtttcggtgcgctgatcggattatgtgcatgtatttgcagaagcctgtaccctaccatcgctacaggcattctgcatctgctggccggactgtgtacacttggctccgtgtcttgctacgtcgcagggattgaactgttgcatcaaaaactcgaactcccagacaatgtgagtggggagttcggctggtccttctgtttagcctgtgtgtccgccccactgcagttcatggcctccgcgctgttcatttgggccgcacacaccaaccgcaaggagtacactctaatgaaggcttacagagtggcgtag

SEQ ID NO: 49491 - DNA, 762 bp, Artificial Sequence
  Description of Artificial Sequence: Synthetic coding sequence
atggacaatagattcgccacagcctttgtaatcgcctgtgtgttatcactgatttcaactatttacatggccgctagcattggcaccgatttctggtatgaatatcgatcacccgtccaggaaaatagctccgatctgaacaaaagcatctgggatgaattcatctctgacgaggccgacgaaaagacttacaatgatgcactgtttcggtataacggaacggtcggcctctggagacgatgcattactataccaaagaacatgcactggtattcacccccagaacgcactgagtcctttgacgtggttaccaagtgtgtttcctttaccctgacggaacagtttatggagaagtttgtggacccgggaaaccataatagcgggatcgacttactcaggacctatttatggagatgccaattcctgctgcccttcgtcagccttggcctgatgtgcttcggggcactgatcggtctatgtgcgtgtatctgtaggagtctttatcccacgatcgccactggcattctccacctactggccggactctgtactttaggatcagtgtcctgctacgtcgctggaattgagctgctgcatcagaaactggagttgcccgataatgtgtcgggagagtttgggtggtctttttgcctcgcctgcgtgagcgcccctttgcagtttatggccagtgctctgtttatttgggcagcgcacacaaaccgcaaggaatacaccctcatgaaagcataccgggtcgcttag

SEQ ID NO: 49492 - DNA, 762 bp, Artificial Sequence
  Description of Artificial Sequence: Synthetic coding sequence
atggataatcgatttgccactgcattcgtaatcgcatgcgtgctctccctgatcagtaccatttatatggctgcatccatcggcacagacttttggtatgaatatagatcccccgtgcaggaaaattcttccgaccttaataaaagtatttgggacgagttcatctccgatgaggcagacgaaaaaacctataacgacgctctctttcggtacaacggaactgtaggcttgtggcggaggtgcatcacgatacccaaaaacatgcattggtattccccaccagagcggaccgagtcctttgatgtggtgactaagtgcgtatcttttacgttgacagagcagttcatggaaaagtttgtagatccaggcaatcacaattctggcatcgacctgctacggacatacctctggcgctgccagtttcttctgcctttcgtctctctggggctcatgtgcttcggcgctctcatcggcctgtgtgcatgcatttgcagatccttataccctactattgcgacaggcatactccacttgctggccggtctgtgcacactgggatctgtttcttgctacgtcgcaggcatcgaactgctccaccagaagctggaactgcctgacaatgtgtctggtgagttcgggtggagcttctgcttagcctgtgtgtcagcacctctgcagtttatggcctctgccctttttatctgggccgcacatacaaaccggaaggagtacacgttgatgaaggcctacagggtggcctag

SEQ ID NO: 49493 - DNA, 831 bp, Artificial Sequence
  Description of Artificial Sequence: Synthetic coding sequence
atggggggagataggcttgaaaataagacgagcgtttccgtagcatcttggtcatccctgaacgctcgcatggataatcgcttcgccacagcatttgtgatagcttgtgtcctgtccttaatcagcaccatctatatggccgcttcaatcgggacagatttctggtacgagtataggtctcccgtgcaggagaattcgtcagacctcaacaagagcatctgggacgagtttattagcgatgaggccgacgagaaaacttataacgatgccctgtttagatataatgggaccgttggattatggcggcgttgtattaccattcccaaaaacatgcattggtacagtcctccggaacgcacagagtccttcgacgtggtgacaaaatgcgtctctttcacactaactgaacaattcatggagaaatttgtagatccaggaaatcacaacagtggcatagatctcctccggacatacctctggcggtgtcaattcttattgcctttcgttagcctaggactgatgtgttttggagcactgattggtttgtgtgcctgcatctgtaggtcgctctaccccactattgcaactggaatcttgcatcttctcgccggactctgcacactggggagcgtcagctgctacgtcgctgggatcgagttgctgcatcagaagctggagctccccgacaacgtgtccggagagttcgggtggtccttctgtctggcatgcgtgtccgctcccctacagttcatggcctcggcattgtttatttgggcagcccataccaataggaaagagtacacacttatgaaggcgtatcgagtggcctag

SEQ ID NO: 49494 - DNA, 720 bp, Artificial Sequence
  Description of Artificial Sequence: Synthetic coding sequence
atggacaatagattcgcaacggcctttgtcatcgcatgtgtgctgtctttaattagcacaatctacatggccgcaagtattggcaccgatttctggtacgaatatcgatctcccgtacaggaaaatagcagtgatttaaataaaagcatttgggatgaattcatttctgacgaagccgacgagaagacctataatgatgccctgtttagatacaacggaaccgtagggctctggaggcgatgtatcaccatcccaaaaaacatgcattggtactccccgcctgagcgcaccgagagtttcgatgttgtgactaaatgcgtttccttcaccctgacggaacagttcatggagaaatttgtggaccccggaaaccataattccggtattgatctgcttcgaacatatttgtggagatgccagtttctgctgcccttcgtctcgcttgggttgatgtgttttggcgcactgattggactgtgtgcgtgtatatgccgatccctctaccccactatcgccactggaatactgcatctcctcgctgggctctgtaccctgggtagcgtttcttgttacgtggcaggtatagaattactgcatcagaaactggagctgccggataacgtctccggagaattcggttggtcattctgcttggcttgtgtcagcgcccctctgcagtttatggcttcagctttgtttatatgggccgctcatacttag

SEQ ID NO: 49495 - DNA, 762 bp, Artificial Sequence
  Description of Artificial Sequence: Synthetic coding sequence
atggataacagattcgccacggctttcgtcattgcgtgcgtattgtcgctcatcagcacaatatacatggctgcaagtattgggactgacttctggtacgagtatcggtctcccgtgcaagagaatagcagcgacctgaacaagtcaatatgggacgagtttataagtgatgaggcggacgagaagacttacaatgatgctctcttccgatacaatgggaccgtaggcctttggagaagatgtatcaccattccgaaaaatatgcactggtattcgccacctgaaagaactgaaagcttcgacgtcgttactaagtgtgtctctttcacgctgaccgagcagttcatggaaaagttcgtggaccccggtaatcacaattctggcatcgacctgctgaggacatacctttggcgctgccagttcctcctgccattcgtctctctgggtctgatgtgctttggggcactgattggtttatgtgcttgcatctgtagatccctgtaccctacgatcgccaccggtatcttgcacctgctcgctggtctttgcaccctcggtagtgtgagctgctatgtggccggaattgaattgcttcatcaaaagctcgaattgccagataatgtgtccggcgagttcgggtggtctttctgcctggcttgtgtttctgctcccttgcagtttatggcctctgcgcttttcatctgggccgctcatacaaaccgaaaagagtataccttgatgaaggcttaccgcgtggcatag

SEQ ID NO: 49496 - DNA, 270 bp, Artificial Sequence
  Description of Artificial Sequence: Synthetic coding sequence
atggacaaccgattcgccaccgcatttgttatcgcctgtgtgctatcactaattagtaccatttacatggccgctagcataggtacagatttttggtatgagtacaggtcgccagtacaggagaacagtagtgacttaaacaaaagcatctgggatgagtttattagcgacgaggccgatgagaaaacttacaacgatgccttgtttcgatacaacggcactgttgggctgtggcgtcgttgcattactattccaaaaaatatgcattag

SEQ ID NO: 49497 - DNA, 534 bp, Artificial Sequence
  Description of Artificial Sequence: Synthetic coding sequence
atggataatcggtttgccaccgccttcgttatcgcttgtgtgctgagccttatttctaccatctacatggctgcgagcatcgggactgatttctggtacgagtacagaagtccagtacaggaaaactcatcagatcttaacaaatctatttgggacgagtttatcagcgacgaagcagacgagaagacatacaacgatgctctatttcggtacaacgggaccgtaggactatggagacggtgtatcacaattccaaaaaatatgcactggtattcacccccagagaggaccgaaagtttcgacgtggtgacaaaatgtgtatccttcaccttgactgagcagttcatggagaaatttgtggacccgggtaatcacaacagcggtatcgatcttctgcggacctacctctggcggtgtcagtttctattgccatttgtctccctgggccttatgtgctttggcgctcttatcggactctgtgcgtgcatctgcagaagcttgtatcccacaatcgccactgggatccttcattag

SEQ ID NO: 49498 - DNA, 438 bp, Artificial Sequence
  Description of Artificial Sequence: Synthetic coding sequence
atggacaatcggtttgccaccgcattcgtgattgcatgtgtcctgtcgctgatctccactatctacatggctgcaagcattggcacagacttttggtatgagtatagaagtccggttcaggagaactccagtgacctgaacaagtctatttgggatgaatttattagcgacgaggccgatgaaaaaacgtataatgatgccttatttcgttacaacggaactgtgggcctctggcgcagatgcatcactatccccaaaaacatgcattggtacagcccaccagaaagaaccgaatcgtttgacgtcgtgaccaaatgcgtttcattcaccctgacagagcagtttatggagaagtttgttgacccgggtaaccataactcgggaatagatctgctgcgaacttatctctggagatgtcagtttctgttacccttttag

SEQ ID NO: 49499 - DNA, 519 bp, Artificial Sequence
  Description of Artificial Sequence: Synthetic coding sequence
atggataaccgctttgctactgccttcgtgatcgcctgcgtcctctcattaatctccaccatctacatggctgcttcgatcggaacagatttctggtatgaataccgtagccctgtccaagagaattcatctgatctgaacaaaagcatttgggacgagtttatcagcgatgaggccgatgagaaaacctataatgatgccctattcagatacaacggaaccgtggggttgtggcggcgatgcattactatccctaagaatatgcactggtacagtccacctgagaggaccgagagttttgacgtcgtgactaagtgtgtcagttttaccctgaccgagcagttcatggagaagttcgtggacccagggaatcacaactcaggcatcgacctgctgaggacctatctatggaggtgtcagtttttgctgccttttgtttctctagggttaatgtgctttggggctcttatcggactgtgcgcttgtatttgcagatctctgtacccaacgatcgcctag

SEQ ID NO: 49500 - DNA, 714 bp, Artificial Sequence
  Description of Artificial Sequence: Synthetic coding sequence
atggacaacaggtttgccaccgctttcgtgattgcctgtgtgctctccttgatctctacaatttacatggcagcctccatcgggactgatttctggtatgagtacagatcaccagtccaggagaactcctcagatctgaacaaaagtatttgggatgagttcatctcagatgaggccgatgaaaagacttataacgatgctctcttccggtacaatggaacagtggggctctggcgtcgatgcattactatcccaaagaatatgcattggtactcacctccagagaggacagagagttttgatgtggttactaagtgtgtgtccttcacacttactgaacaattcatggagaaattcgtggatcctggcaaccataactcaggcatcgatcttctgcgcacatatctctggagatgtcagtttctactgccttttgtgtcccttggacttatgtgtttcggcgcactgatcgggctgtgcgcttgtatttgccgcagtttgtatcccaccattgccactgggatcttgcatttgctggcagggttatgtaccctaggatccgtctcctgctacgttgcagggattgagcttctccaccagaagttagaattgccagacaacgtgtccggggaattcgggtggtccttctgtcttgcctgtgttagcgccccactccagttcatggcttccgctttgtttatttgggcagcatag

SEQ ID NO: 49501 - DNA, 762 bp, Artificial Sequence
  Description of Artificial Sequence: Synthetic coding sequence
atggataatagattcgctacggctttcgtgattgcctgcgtcctctctctgatttccacaatttatatggccgcatccatcggaaccgatttttggtatgaatataggagcccagtgcaagaaaattcgtccgacctgaataagagcatctgggatgaatttatatctgatgaggcggacgagaaaacatataatgatgcattgttcaggtacaatgggacggtgggcctttggcggaggtgtatcacaattcctaagaatatgcactggtacagtccgcctgaacgcacggaatcatttgatgtcgtgacgaagtgcgtttccttcactttgacagagcagtttatggagaaattcgtcgaccccggtaatcacaattctgggatcgacttattaagaacctatctatggagatgccagttcctgctcccatttgtgagtttgggactaatgtgcttcggggcactcattggcctgtgtgcctgtatttgcagatctctctaccctaccattgcgacagggatattgcacctacttgcagggctctgtactctggggagtgtgagttgctacgtggccggtatcgagctgctgcaccaaaagctggagctgcccgacaacgtgtctggagagttcgggtggtccttttgtctggcctgcgtcagcgcccctctccaatttatggcaagcgcacttttcatatgggccgctcacaccaacaggaaggaatacactctgatgaaagcctacagagtagcctag

SEQ ID NO: 49502 - DNA, 477 bp, Artificial Sequence
  Description of Artificial Sequence: Synthetic coding sequence
atgggtgaaagctttgacgtcgtcacaaagtgcgtatctttcactctcactgaacagtttatggaaaagtttgtggacccaggtaaccacaactcgggtatcgatttactgagaacatacttgtggagatgtcagttcctgctgccatttgtttccttgggattaatgtgctttggcgctctgattgggttgtgcgcatgtatttgtcggtcactgtacccaacaatcgccacaggcatcctccacctcctcgcgggactctgcacattgggcagcgtgagttgttatgtcgccggaatcgagctcctccatcagaagttggagcttccggacaatgtatcaggcgagttcggctggagtttctgtttagcttgtgtctccgctccactgcaattcatggccagcgctctgtttatctgggccgcacacaccaatcggaaagaatacactctgatgaaagcgtaccgggttgcctag

SEQ ID NO: 49503 - DNA, 294 bp, Artificial Sequence
  Description of Artificial Sequence: Synthetic coding sequence
atggacaaccggttcgccactgcttttgtgatagcttgcgtcctttctctgattagcacaatctacatggcagccagcattgggacagatttctggtacgaataccggagcccagtgcaggagaatagtagcgaccttaacaaatcaatctgggatgagtttatatccgacgaagccgatgagaaaacatataacgatgcactgtttagatataacgggaccgttgggctgtggcgacgatgcattaccattccgaaaaacatgcactggtacagccctcccgaaaggacgtag

SEQ ID NO: 49504 - DNA, 762 bp, Artificial Sequence
  Description of Artificial Sequence: Synthetic coding sequence
atggacaaccggtttgcaaccgcatttgtgattgcctgtgtcctctccttgatctcaaccatctacatggcagcttccattgggactgacttctggtacgagtatcgcagcccggtgcaagagaacagcagtgatctcaataagtccatttgggacgagtttattagtgacgaagccgatgaaaagacatataacgatgcattgttccgctacaatggaactgttgggctgtggcgacgctgtattaccatccccaaaaatatgcattggtattcacccccagaaaggaccgaatctttcgacgtcgtaactaagtgtgtgagcttcactctgaccgagcaattcatggaaaaattcgttgacccgggaaaccacaactctgggatcgatttgctgcggacttacctgtggcgctgccagttcctgctgcctttcgtcagccttggtctgatgtgtttcggggctctgatcgggctctgcgcctgcatttgccggtcattgtacccaactattgctacaggcatactccatctcctagcaggcttgtgcacactggggagcgtctcctgctacgtggccggtattgaacttttgcaccagaaactcgaactcccggacaatgtgagcggcgagtttggatggtccttttgcctggcgtgcgtatcagcccctctacaattcatggcctctgcgctgtttatatgggctgcccacacaaatcgtaaggagtacaccctgatgaaagcataccgtgttgcctag

SEQ ID NO: 49505 - DNA, 738 bp, Artificial Sequence
  Description of Artificial Sequence: Synthetic coding sequence
atggacaatcgctttgcgaccgcttttgtcattgcctgtgtgttatcccttatctccaccatctacatggcggcttcgatcggaactgacttctggtacgagtatcggtcccccgttcaggagaatagttcggatctgaataaatcgatttgggacgagtttatcagcgatgaggctgacgaaaagacgtacaacgatgcattgttccgctataacgggacagtggggctctggagaagatgtatcactatccccaaaaatatgcactggtactcacctcctgaaaggacggagagctttgacgtggtaaccaagtgcgtcagctttaccctgaccgagcagttcatggaaaaattcgtggatcctggcaatcacaactccggcatcgatctcctgagaacctatctgtggagatgtcagtttctgctcccatttgtgagtctgggactcatgtgtttcggcgcacttattggcctgtgtgcgtgtatttgtaggtctctctatccgactatagcgacgggcatccttcacttattagctggtctctgcactcttgggtcagtgtcctgttacgtcgctggtatagaattgctgcatcagaagcttgagctccctgataacgtctccggcgagtttggttggtcattctgtctggcctgtgttagtgcccctctgcaattcatggcctcggccctcttcatatgggctgcccacaccaatagaaaagagtacacctag

SEQ ID NO: 49506 - DNA, 642 bp, Artificial Sequence
  Description of Artificial Sequence: Synthetic coding sequence
atggataaccggtttgctaccgcgttcgtcatcgcatgcgtgctgagcctgatttctaccatatatatggctgccagtatcggcacagacttctggtacgagtataggagcccagttcaggagaactctagcgatttaaataaaagtatctgggacgagtttatttccgatgaggctgacgagaagacttacaacgacgctttattccgctataacgggacagtgggactctggcgtcgctgcataacgattcctaaaaatatgcactggtactcccctccagagcgcaccgaatctttcgatgtcgtgaccaagtgcgttagcttcactctgacagaacagtttatggagaagtttgtggaccctggaaaccacaactcaggaatcgatcttttacgcacgtacctgtggagatgtcagttcctcctcccattcgtgagtttagggttgatgtgctttggcgcacttattgggctgtgtgcttgtatctgcagatccctctaccctaccattgccaccggcattctgcacctattggcgggtctgtgcacgttgggctctgtgtcctgttacgtggcgggtattgagctcctacatcagaaactggaactgcctgacaatgtctcaggcgagtttggatag

SEQ ID NO: 49507 - DNA, 543 bp, Artificial Sequence
  Description of Artificial Sequence: Synthetic coding sequence
atggacaatcgcttcgcaactgccttcgtcatcgcttgcgttctcagcctcatcagtaccatatacatggctgcatctattggaacagatttctggtacgaataccggtccccagtgcaggaaaacagttccgatcttaataagtctatctgggacgaatttatttccgatgaagccgatgaaaaaacctacaacgatgcattgttcagatataacggcacagtcggcctctggaggcggtgcatcacaatcccaaagaatatgcattggtattccccgcctgagaggaccgagagcttcgatgtcgttacgaagtgtgtctcctttaccctaacagagcagttcatggagaaatttgtggacccaggtaatcataacagcggaatcgaccttctgcgcacatacctatggagatgtcagttcctgttaccttttgtgagtttgggattgatgtgcttcggggctctcattgggctgtgcgcttgtatctgcagatccctctaccctactattgcgacaggcatcctgcacttactagcttag

SEQ ID NO: 49508 - DNA, 504 bp, Artificial Sequence
  Description of Artificial Sequence: Synthetic coding sequence
atgggcgtgaaaaggagtttacaatccggtggcattctgctctcactggtggccaatgtgcttatggtgctgtccactgctactaactattggacccgccaacaagaagggcattctggtctttggcaggaatgtaaccacggaatatgctctagtataccatgtcagactacactggctgtgactgtcgcgtgtatggtcctggcagttggcgtcggggtggtcggcatggttatgggactcaggattagatgcgacgagggagagagcctgaggggccaaacaacaagcgccttcctgttcctaggcggactattactcttaactgctctcattggatacaccgtgaaaaatgcttggaagaataacgtgtttttcagttggtcttacttctccggttggctggcccttccattttccatcctggccggattttgttttctcctcgcggatatgattatgcagtctaccgacgctatcagcggattccctgtttgcttgtag

SEQ ID NO: 49509 - DNA, 1065 bp, Artificial Sequence
  Description of Artificial Sequence: Synthetic coding sequence
atggggccagttagccttctgccgaaataccaaaagttgaacacctggaacggagacctggctaaaatgacacacctacaggctggcctgtcacccgagactatcgagaaggctcgtcttgagctgaacgaaaatcccgatgtcctgcaccaggacatccagcaggtacgagatatgataataacccggccagatatcggctttctgagaaccgacgatgctttcatcctgcgtttcttgcgagccaggaagttccaccaagctgatgcgtttcgcctgctggcccagtatttccagtaccgacagctgaatctggacatgttcaaaaactttaaggctgatgatcctggcatcaaaagagccttgatcgacggatttccgggagtcttggaaaatcgggatcactacggaagaaagatcctactgctgttcgccgctaattgggatcaatcccgaaactcctttacagacatcctacgcgcaattctgctttctcttgaggtgcttatcgaggatcctgagttgcagatcaatggtttcatcctcattatcgattggtccaattttagctttaaacaggcatccaaacttacaccttcaatcttgaaactggccatcgagggcctgcaagactcattccctgcaagatttgggggagttcatttcgtgaaccaaccatggtatatacacgctctctatacgctaatcaaacccttcctcaaggacaaaacacgcaagcggatcttcctccacggaaataatcttaactcattacaccagctgatccacccagaatttttgccatcagaattcggcggaaccctgcctccgtatgatatgggaacatgggcccgtacactgctgggcccagattattctgatgaaaatgattacacccataccagctacaatgcgatgcacgtaaaacacacttctagtaacttggagcgcgaatgtagccccaagctcatgaaaaggtcacagtctgtggtggaagccggaacgctgaaacatgaagagaaaggcgagaacgagaatacacagcccctgctggcactggattag

SEQ ID NO: 49510 - DNA, 1065 bp, Artificial Sequence
  Description of Artificial Sequence: Synthetic coding sequence
atggggcctgttagccttctgcctaaatatcagaagctcaacacatggaacggggacctggcaaagatgacccacttacaggcgggtctttcccctgagactattgagaaagcacgcctagaattaaacgaaaaccctgacgtgctgcaccaggacattcagcaggtccgtgacatgatcataacacgccctgacattggatttttgagaaccgacgacgctttcatcctacggttcctgagggccaggaagttccaccaggccgacgcctttcgcctgctggcccagtacttccagtaccggcagctgaacctcgacatgtttaaaaactttaaggccgacgaccctggcattaagcgcgctctgattgatggattccctggcgttcttgaaaatagggaccactacggtaggaagattcttctactttttgcagccaattgggaccagtctcgcaacagctttaccgatattttgcgtgcaatcctactctcactggaagtattgattgaagatcccgagttgcagattaatgggttcatcttgataatcgactggtctaacttttcttttaagcaggcgtcaaagcttaccccatcaattcttaagctcgcaattgaaggcctgcaggactcattcccggctcgatttggcggagtgcacttcgtgaaccaaccatggtacattcacgccctgtatacattaatcaaaccctttctcaaagataagactagaaaacggatatttttgcacggcaacaatctgaactccctgcatcaactgattcatcctgagtttctgccctctgagtttggtgggaccctaccgccttatgacatgggcacatgggcccgaacactgttagggcctgactactcagacgaaaacgattatacacatacctcatataatgccatgcacgtcaagcacacgagctccaacctggagcgcgaatgttcacccaaactgatgaagaggagccaatccgtggtcgaggccggtacactgaaacatgaggagaaaggtgagaacgaaaacactcagccattgctagctttagactag

SEQ ID NO: 49511 - DNA, 240 bp, Artificial Sequence
  Description of Artificial Sequence: Synthetic coding sequence
atgggaccagtctcactcctacctaagtatcaaaagctaaatacctggaacggagacctggctaaaatgacgcatctgcaagccggactctctcctgaaacaatagaaaaggcgagattggagcttaacgagaaccccgatgtgcttcaccaggacattcagcaggtgcgggatatgataattacccgtcctgacattggcttccttcgaaccgatgatgctttcatcctgaggttctag

SEQ ID NO: 49512 - DNA, 984 bp, Artificial Sequence
  Description of Artificial Sequence: Synthetic coding sequence
atgacacacttacaggcaggtctctcccctgaaacgttggaaaaggcacggttggagcttaacgagaatcccgacaccttgcaccaggacatacaggaggtccgggatatggtcatcaccaggcctgacatcgggttcctgaggactgacgacgcgtttattctacgcttcttgcgggctagaaagtttcatcattttgaggccttcagactcctggcgcagtacttcgaatatcggcagcaaaacttggacatgtttaaatcttttaaagctaccgaccccggaattaaacaggccctcaaggatggattcccgggaggactcgcaaacctggatcactatgggcgaaagatccttgtcctgtttgctgcaaactgggatcaatcccggtacaccctggtggatatattgagggctatcctcctgtcacttgaagcaatgattgaagatcccgagctgcaggtgaacggcttcgtcctcattatcgattggtctaacttcactttcaaacaggcctccaaactgacacctagcatgctccggctcgctatcgaaggtctccaagactcctttccggctcggtttggcggaattcatttcgtgaatcaaccttggtatattcatgcgctatataccgtcatccgtccatttctgaaggagaagactcggaaacgcatctttctgcatggcaacaacctgaattctctgcatcagttgattcatcctgagatcctgccttccgaatttggtggtatgctccccccttacgacatgggtacttgggcgcgaactttgttggatcacgagtatgacgatgattccgagtacaatgtcgactcttactccatgccggtgaaggaagttgagaaagagctttctcccaagtccatgaaacggtcacagtccgtagtggaccccaccgtcctcaagcggatggataagaacgaagaggaaaatatgcaacccctgttgagtctcgattag

SEQ ID NO: 49513 - DNA, 546 bp, Artificial Sequence
  Description of Artificial Sequence: Synthetic coding sequence
atgattgaggatccagaactccaggtcaatggttttgtgttgatcattgactggtcaaattttactttcaagcaagccagtaagttaacaccttctatgctgcgtttggctatcgagggcctccaagacagtttccctgcgaggtttggagggattcatttcgtgaaccagccatggtatatccacgcactatacaccgtgatcaggcctttcttgaaggagaagacgagaaaaaggatttttctgcatgggaacaacctgaactccctgcatcagcttatacaccctgagatactcccttccgaattcggaggtatgttgcctccgtatgatatgggaacttgggcccgaaccctgttggaccacgagtacgatgatgactctgagtataacgtggatagctatagtatgcctgttaaggaggtggagaaagaacttagccccaagtctatgaagcggagtcagagcgtggtggatccaacagtgctgaagaggatggataagaacgaggaagaaaacatgcagccactcttatcgctcgactag

SEQ ID NO: 49514 - DNA, 2010 bp, Artificial Sequence
  Description of Artificial Sequence: Synthetic coding sequence
atggccgctgcccaggaggctgatggcgcacgatcggccgtggttgcagccggtgggggtagcagcgggcaggttacatcgaatggtagcattggacgggatcctcctgccgaaacccaaccgcagaatcctccagctcagcctgccccaaatgcctggcaggtgatcaagggcgttcttttcagaatctttataatttgggccatctctagctggttccgtcggggacctgccccacaagaccaagctggaccaggtggtgccccaagagtagcaagccgtaatttgttccccaaggatactctcatgaatctgcatgtgtacatttctgagcacgaacacttcactgacttcaacgcaaccagcgccttattttgggaacagcacgacctcgtgtatggcgactggacttcaggtgagaactcagatggatgctatgaacatttcgcggagctggacattcctcagagcgtacagcagaatggttctatctacattcacgtgtacttcaccaaatccggcttccacccagatcccaggcaaaaagcgctctacaggagactggcgactgtccacatgtcacgcatgatcaataagtataagcgacgaagattccaaaagaccaagaatttattgaccggggagactgaggccgaccctgagatgatcaaaagagcggaggattatggacctgttgaggttattagtcactggcacccaaatattactattaacatcgttgatgaccatactccatgggttaaaggatccgtcccgccaccccttgaccaatacgtgaaattcgatgccgtatccggtgactattacccaatcatctattttaacgactattggaacctccagaaagactactatccaataaatgaatccttagcaagcctgcctctccgggtctcattttgcccccttagtttgtggagatggcagttgtacgctgcgcagtctactaaatcgccctggaacttcctgggggacgagttgtatgaacagtcagatgaggaacaagatagtgtaaaggtggcattgctggaaactaacccctatctcctagcacttaccattattgttagtatagtccactctgtgtttgagttcctggcattcaaaaacgacatccagttttggaactccaggcagagcctcgagggactgtcagttagatcagtgttctttggtgtatttcaatctttcgttgtgctgttgtacattttggataacgagaccaatttcgtggtgcaggtgtcagttttcatcggcgtgctgatcgacctgtggaagattactaaggttatggacgtcagactcgatcgggaacatagggtggcaggcatatttccaagactctcttttaaagacaagtccacttacatagagagtagcacaaaggtgtatgatgacatggccttcaggtatctatcatggatactgttccctctgctgggatgctatgcagtgtatagcctgctttacctggaacataaaggctggtattcctgggtgttatctatgctgtatggttttctgctcactttcgggtttatcaccatgacccctcagttgtttatcaattataaactcaagagtgtggctcacctgccttggcggatgctgacctacaaagctctgaatacttttatcgacgacttgtttgcatttgtgatcaaaatgccagtgatgtatagaattggctgtttgagagatgacgtcgtgtttttcatttacctctatcagagatggatttaccgggtggaccctacaagagtgaacgagtttggaatgagcggtgaggaccctacagccgcagcccctgtcgccgaggtgccaactgccgcaggggctctcactccaactcccgctccgaccaccacaactgccacccgggaggaggcatcaacgtctctcccaaccaagcctactcagggtgcatcgtccgcgtccgaaccacaagaggcccctccaaagccagctgaagacaaaaaaaaagactag

SEQ ID NO: 49515 - DNA, 2061 bp, Artificial Sequence
  Description of Artificial Sequence: Synthetic coding sequence
atggctgccgctcaggaagccgacggggcacggagcgcagttgtcgcggcaggcggaggcagctctggacaggttacgtccaacgggtcaatcggcagagatccccctgccgagactcagccccagaatcctccagctcagcccgctcccaacgcctggcaagtcattaagggggtgttgtttcgcatctttatcatctgggctatttcttcctggttcagacgagggccagcacctcaagatcaggctggccctggaggcgcacccagggtcgcatccaggaatttgtttcccaaagacacactcatgaacctgcatgtgtatattagcgagcacgaacacttcaccgacttcaacgcgaccagcgcattattttgggagcagcacgacctggtgtatggggactggacgtctggtgagaattcagacggttgctacgaacacttcgctgagctcgatatcccacaatcagtccagcagaatggatccatttatattcatgtctattttacgaagagtggatttcatccagatcccaggcaaaaagctttatacaggcgtctggctacagtccatatgagtcgaatgataaacaaatataagcgcagacgcttccagaaaacgaagaatttactgaccggggaaaccgaggctgacccagagatgattaagagagccgaggattacggcccagttgaggttatctcccattggcatccaaacatcactatcaacattgttgacgatcacacgccatgggtgaaagggagcgtgccacctcctctggaccagtacgtgaagttcgacgccgtgtctggcgactactaccctataatatatttcaatgactattggaacctgcagaaggattactaccccatcaacgagagcctggctagcctccccctccgggtttctttctgccccctctcgctgtggcgctggcagttgtacgccgcacaaagcaccaagtcaccctggaactttctgggcgatgagctgtacgagcaaagcgacgaagaacaagatagtgtgaaggttgctctgcttgaaaccaatccctacttgctggctctgactatcattgtgtcaatagtgcacagcgtgtttgagttcttagccttcaaaaacgatatccaattttggaacagccgccagtctcttgaagggctgagcgtgcgtagtgtgttcttcggcgtgttccagtcattcgtagtgctgttatacatcctcgataacgaaaccaacttcgtcgtgcaagtgagcgtatttatcggggttttgattgatctttggaagatcaccaaggtcatggatgtgcggcttgatcgggagcaccgtgtggccggaatcttccctcggctgagcttcaaagataagagcacttacatcgaaagcagtaccaaggtgtacgacgacatggccttccggtatttgtcatggattcttttcccactattagggtgttatgcagtgtattctctgttgtacctggagcacaagggatggtattcctgggtgctcagcatgctctacggctttctgctgacatttggcttcatcaccatgacaccgcagctctttattaactacaaacttaaaagcgtcgcgcacctgccatggaggatgttaacctataaggccttaaacacattcatcgacgatttgtttgccttcgtgatcaagatgcctgtgatgtaccggatcggatgcctccgagacgacgtggtgtttttcatctatctttatcagagatggatctacagggtggatccgacgagggtcaacgaatttggaatgtccggtgaggaccctaccgccgcagctccagttgccgaagtgcctacagctgcaggggctctcacgccaacacctgcacctacaactactacagccacgcgcgaagaggcctcaacgtcgcttcccacaaaaccaacacagggagcctcttcagcatctgagccacaggggctgtttgttgaagccctgagcgttcccttgagtctgtgcgtctcttcacacctcgccctgcccgcacagcaccattgggaatcctggtag

SEQ ID NO: 49516 - DNA, 1968 bp, Artificial Sequence
  Description of Artificial Sequence: Synthetic coding sequence
atgtctcggaaagcccacatcactgagaaggtgacatccaacggaagcatcggccgagatcctccggctgagacgcagcctcagaatcctccagcccaacctgccccaaatgcctggcaagttattaagggcgtgctcttcagaattttcattatttgggccattagttcatggttccgtcgtggacctgccccacaggatcaagccggtccaggaggagctcctcgcgtagcatccaggaacctctttcctaaagatactctgatgaacctgcacgtttacatttccgagcacgaacactttacagactttaacgctacaagtgccctcttttgggaacaacacgatttggtatacggcgactggacctcgggggaaaactcagacgggtgctatgaacatttcgcggaactggatattccccaatcagtacagcaaaatggttccatctatatacacgtgtacttcaccaagtctggttttcaccctgatccaaggcagaaagccctgtaccggagactggcaacggtgcatatgagccgcatgattaataaatacaagcgccgaaggtttcagaagactaaaaacctcttaaccggggagactgaagccgacccagagatgattaagcgggcagaggattatggaccggtggaggtgatatcacactggcatccaaatattactattaacattgtagacgaccacacgccctgggttaagggatctgtcccccctcccttggaccaatatgtgaaatttgacgccgtctcaggagattactaccccattatctatttcaacgactactggaaccttcagaaagactattaccctatcaacgaatcactggcctccttgcctctgagggtgagcttttgccccctgtctctgtggcgatggcagctgtatgctgctcagtctaccaaaagcccctggaatttcctgggagacgaactctacgaacagtcagatgaagaacaggactctgtcaaagtcgctctcctagagactaacccctacctgctcgccctgactatcattgtcagcatcgtgcactcagtttttgagttcttagcgttcaagaacgacattcagttctggaattccagacaatcactggagggcttgagcgttcgttcagtcttttttggcgtttttcagtcctttgttgtgctgctgtacattctggacaacgagacgaacttcgtggtacaagttagtgttttcataggagttctgattgatctctggaaaataaccaaggtaatggacgtgcgcttggatcgtgaacaccgagttgctggcatatttcctcggttgagcttcaaggacaaaagtacctacatcgaatcgagtacaaaagtctacgatgacatggccttccggtatctctcttggattctgttccccctgctggggtgttatgccgtatacagcctgctgtacctggagcataagggctggtattcctgggtcctcagcatgttatacggctttctgctcacgtttggttttatcacaatgactccacagctcttcataaattataaactgaaatcggtagcccacttgccatggaggatgttaacatataaagctttgaacacttttatcgatgatttgttcgcgtttgttattaagatgccagtcatgtacaggatcggctgcttacgggatgacgtggtattcttcatctatctgtatcagcgctggatttaccgggttgatcccaccagggtgaacgagtttggcatgagcggggaagatccgaccgcggctgcaccggtggcagaagtccctacggcagccggagcgcttactcctactcctgccccaaccaccacaacagctaccagggaggaggcctcaacttcgttgcctacaaagcctacccaaggcgcttcttcagcaagcgagccccaagaagcaccgcctaaacccgctgaggataagaaaaaggattag

SEQ ID NO: 49517 - DNA, 1704 bp, Artificial Sequence
  Description of Artificial Sequence: Synthetic coding sequence
atgaatctacatgtctatatctctgagcacgagcattttaccgactttaatgccacttccgccctcttctgggaacagcacgaccttgtctacggggactggacatctggagagaattccgacgggtgttacgaacacttcgccgaattggatattccacagtcagtccagcagaatggtagtatatacatccacgtctacttcacaaagagcggatttcaccccgaccctcggcagaaggcgctgtacaggaggttggctacagtgcatatgtcgagaatgattaacaaatacaaacgaagaagattccaaaaaaccaagaatctcctcaccggcgagaccgaagccgatccagaaatgattaaacgagctgaagattatgggcctgtggaggtcatctcgcattggcaccccaatatcacaattaatattgtcgacgatcacaccccttgggtcaagggcagcgtccctcccccactcgaccaatacgtgaagttcgacgcagtctccggcgactattacccgataatttacttcaacgattactggaacttgcagaaagactattatcccatcaacgaatccctggcttccctcccattaagggtttcattttgccccctttccttatggagatggcagctctacgccgcacagtcaactaagagtccatggaatttccttggtgatgaactgtatgaacagtccgacgaagagcaggactccgtaaaggtggcgctcttagagactaacccttatcttttggctcttacaatcatagtctcaatcgttcactccgtgttcgaattcctagcctttaagaacgacattcaattttggaacagccgccagtctctggaagggctctccgtgagatctgtattctttggcgtcttccagagttttgtggtgcttctgtacatcctggacaacgaaaccaacttcgtggtgcaagtcagcgtatttattggggtgctgatcgatttatggaaaatcacaaaggtgatggacgtgagattggaccgggagcatcgtgtggctggaatattccctcgcctgagcttcaaagataaatcaacttatatcgagtcgtcgacaaaagtatatgacgatatggcattccgctacctgtcctggatactgttcccactgttaggatgttatgccgtatattccctgctgtacctcgaacataaggggtggtattcatgggtactgtctatgctgtatggcttcttgctcacatttggcttcattacgatgacaccccaacttttcatcaattataagctcaagtccgttgcacacctgccatggcgcatgctcacatacaaagcgctgaataccttcattgacgacctgttcgcttttgtcataaaaatgcctgttatgtatcgtatcggttgtctgagagatgatgttgttttctttatttatttatatcagcgttggatatacagggtcgatccaacccgtgtaaacgaatttggaatgagtggcgaagacccaactgcagcagcccctgttgccgaagtgccaaccgcagctggggctctgactcctacccccgctcctacgaccaccactgccactagggaggaggcttccacaagcctgcctaccaaacctacccagggggcatccagcgcgagcgagcctcaggaagcaccccctaagccagctgaggacaagaaaaaggattag

SEQ ID NO: 49518 - DNA, 2124 bp, Artificial Sequence
  Description of Artificial Sequence: Synthetic coding sequence
atgttaggttctctcgtgctcaggcgcaaggccttagctcccaggctgttgttacgactcctgcggtctcctacactgaggggccatgggggagcttctggacgtaatgtgaccacaggatccctcggagagcctcagtggctccgcgtcgccaccggcggtcggccaggcacatccccggctctcttttccggaaggggggcagccaccggcggtagacagggcggtagattcgacacaaagtgtctggcagcagctacatggggccgattaccaggtccagaggaaactctgccaggtcaggactcttggaatggagtcccctcccgtgcagggcttggtatgtgtgccctcgccgctgcactcgtcgtgcattgctatagcaaatccccaagcaataaggacgcagccctcctggaagcggcacgagcaaacaacatgcaggaggtcagccggcttttgtctgagggcgcagacgttaacgccaaacacagactgggttggactgcacttatggtagctgctatcaaccgcaataactccgtggtgcaggtactgttggcagcaggagctgatcccaatcttggcgatgacttttcttccgtctataaaacggccaaggaacagggtatccacagcctagaggatggaggccaggacggcgcatcccgccacatcaccaatcagtggaccagcgccctagagttccgtagatggctggggctccctgcaggagtgctgattaccagggaagacgacttcaataaccgcctgaacaatagggccagctttaaagggtgcactgcgctgcactacgctgtgctggctgacgattatagaactgtcaaggagctcctggacgggggagccaaccccctccaacgaaatgaaatgggtcatacaccgctggattacgcgagagagggagaagtgatgaagctccttcgcacatccgaggccaaatatcaagagaagcagcgcaaaagggaggcagaggagcggcgacggttccctctggagcagcgtttgaaggagcacatcatcggccaagagagcgccatcgcgacggtcggtgctgcaataaggaggaaggagaatggctggtacgacgaagaacaccccctcgtcttcctgttcttgggatcatcaggaattggcaagactgagctggctaagcagactgccaagtacatgcacaaagacgcaaaaaagggctttatcaggttggatatgtctgaattccaggaacgccacgaggtcgcaaagtttattggatctcctcctgggtacgtgggccatgaggagggtgggcaactcacaaaaaaactgaagcaatgtccaaacgcagtggttctgttcgacgaagtggataaagcccaccctgacgtcctgaccattatgctacagctgttcgacgagggacgtcttactgacggcaaaggtaaaaccatagattgtaaggacgccatttttatcatgaccagcaacgtcgcctcagatgagatagctcaacatgctctgcagctgaggcaagaggctctagagatgagtaggaatcgcatcgctgaaaatctcggagatgtgcagatctccgacaagataacgatctctaaaaattttaaagagaatgtgattcgacccatccttaaagctcactttcgccgagacgaatttctcggacgaatcaatgagatcgtatatttcctaccattctgccattcagagctgatacaattggtgaacaaggagctaaatttctgggcgaagcgtgcaaagcagagacataatattaccctgttatgggatagagaggtggccgacgtgcttgtcgatgggtacaacgtgcattacggcgctaggagcataaaacacgaggtggagcggagggtagtaaaccagctcgccgcagcgtacgaacaggacctccttcctggaggttgtaccctgcggatcactgttgaagacagcgacaaacagctcctgaaatcaccagagctgccttccccacaggccgaaaagagactcccaaagttaaggctggaaattatcgataaggattcaaagactcgtaggctggacatccgagctccccttcacccagaaaaagtgtgtaacacaatctag

SEQ ID NO: 49519 - DNA, 1989 bp, Artificial Sequence
  Description of Artificial Sequence: Synthetic coding sequence
atgcctagaggatgtcacttgggcaccccaagctggtccaggcggaatacccctaggacaggacaactcgaaagaggccctcagcaaggtagaaccggacatgtgcgcccaggaagatcagcaggcggaagtctgctgcagcaggagtctgtgcaacaaggctgctctccagttggatcctgtccatgccagcagtacgcaagaagccaacaaccgcaagaaacagccaagaacgatgcacagagccggagctgggctgggctaaatgccggagtgagtcttaaaaacaccaagatctcctcttctgaatggcccctaaggctcctttccgaaggtgccgatgtgaatgcaaaacataggctcggctggactgccttaatggttgccgctattaataggaacaacagcgttgtgcaggttctgttggccgctggcgctgatccaaatttaggcgatgactttagcagcgtttataagacagccaaggagcagggtatccatagcctcgaagatggcggtcaggacggtgcctcccgtcatattactaaccagtggacctccgcactggagtttcggaggtggctgggtctacctgcgggagtgttgatcacgcgagaggatgacttcaacaacagactgaataatcgggcatcttttaagggttgcaccgcattacactacgcggttttggccgatgactacaggaccgtgaaggaactcctggacggtggggctaatcccctacagcgcaacgagatggggcatactcccctggattatgctcgggaaggcgaggtcatgaagctcttgaggacttccgaggcaaagtatcaggagaaacagcgcaagcgagaggcggaagaacgccgaagattcccgctggagcaacgtctgaaggagcatattatcggacaagagtctgcaatcgcaaccgtcggcgctgcgattcggagaaaagagaacgggtggtacgatgaagaacatccactggtgtttttgtttctcgggagctccggaattggaaaaacagagttagccaagcaaaccgcaaaatacatgcacaaggatgcaaagaaaggctttatcagactggatatgtcagagttccaggaaagacatgaagtggctaagttcatcggctctccaccaggctacgtcggccacgaggagggcggtcagttgacgaagaagctgaagcagtgccctaacgccgtcgttttgttcgacgaggtcgacaaggctcaccctgacgtgttaactattatgcttcagttgtttgatgaagggaggctgacagacggaaaagggaagaccatcgactgcaaggatgccatatttatcatgacatctaacgtcgccagtgacgaaatcgcacagcatgccctacagctgagacaggaggcattggaaatgtccagaaaccgtatcgcagagaatcttggggatgtgcagatatccgacaagatcactattagtaaaaatttcaaggaaaacgtgattcgcccaatactgaaggctcatttccgacgcgatgagttccttggcagaatcaatgagatcgtgtatttcctgcccttctgtcactctgagctgattcagctcgttaataaggagctaaatttttgggcgaagagagctaaacaaagacataacatcactctcctgtgggatcgggaagtcgccgatgtattagtggacggctacaacgtccactacggagctcgctccattaaacacgaagtagaacgccgtgtggttaatcagctcgccgcagcctacgaacaggacctcctgcctggtggctgcacgctacgaattacagtggaagactccgataagcagctgttgaaatctccagagctgccttccccccaagccgagaagcggctgcccaagctgaggctggaaattatcgacaaggacagcaagaccagacgcctcgacatacgtgcccctttacaccccgagaaagtttgcaataccatctag

SEQ ID NO: 49520 - DNA, 2034 bp, Artificial Sequence
  Description of Artificial Sequence: Synthetic coding sequence
atgctaggctcactcgtgttgcggaggaaggccctagcgccacggctgttactcaggctgctccgatcaccaacactgaggggccatgggggagccagcgggcgaaatgtgaccacagggagtctcggggaaccacagtggctccgagtcgctactggcggtcgccctgggacttcacctgcactgttcagcggcaggggggcagccacaggcggaagacagggtggcaggttcgatactaagtgcctggccgcagccacttggggcagattgcccggaccggaggagacattacctggccaggacagctggaacggcgtgccttcaagggccggtctgggaatgtgcgcacttgccgctgccctggttgtgcactgctactccaagagtccttcaaataaggatgcagcgctacttgaagcggctcgtgctaataacatgcaggaagtttccaggctgcttagcgaaggtgctgacgttaacgccaagcacagactgggatggactgccctgatggttgcggcaattaatagaaataattccgtggtgcaggtcctgctagcagccggagccgaccctaatctcggagacgacttctcatcggtgtataagacagcaaaagagcagggtatacatagtctggaggtgctaatcaccagagaagatgactttaacaatcggctgaataatagagcttcattcaaaggctgtacagctctgcattatgctgtgctcgcagatgactaccgcactgtgaaggagttacttgatggaggcgctaaccctctgcaaagaaatgaaatggggcataccccattggattatgcaagagagggggaagttatgaaactccttagaactagcgaggccaagtatcaagaaaaacagcggaagagggaagctgaggagaggagaaggttccccctggaacaacgactcaaggagcacatcatcggacaggagtcagccatcgctacagtcggcgctgctatacggcgaaaagagaacggatggtatgacgaggaacaccctctagtgtttctgtttttagggtctagcgggattgggaagacagagctggccaagcaaactgcgaaatatatgcacaaagacgcaaagaagggcttcattcggctcgacatgtctgaatttcaggagcggcatgaggtagcaaagttcattggatcaccgcctggttatgtcggccacgaagaggggggtcaactaacgaagaagttgaaacaatgccctaatgctgtggtcctgttcgacgaagttgacaaagctcatccggatgtactcacaatcatgctccagctgttcgatgaaggacggcttacagacgggaaaggcaaaaccatcgattgcaaggacgcgatttttatcatgactagcaatgtggcctctgatgaaattgcccagcatgccctgcagcttcgacaggaggctctcgagatgtcacggaataggatagccgaaaacttaggggatgttcagatttctgataaaattaccatttctaagaattttaaagaaaacgtgatccgccctattctcaaggcccacttccgtcgggatgaattcctggggcgaattaatgaaattgtgtactttttacccttttgccatagcgagctgatccagttggttaacaaggagttaaacttttgggcgaagagagccaagcagcggcacaacatcacactcctgtgggatagagaagtggccgacgtgctggtggatggatacaacgtgcactatggtgctaggtctatcaagcacgaggtcgagcgacgagtggtgaaccagctggccgctgcttacgagcaggatttgcttcccggtggatgcacgctgaggattaccgtcgaagactccgataaacaactcctaaagtcaccagagctcccttctcctcaggccgaaaaacgcttaccaaagttgagattggagattatcgataaggacagtaaaacacgcaggctcgacatccgggcaccgctgcaccctgaaaaggtttgcaatacgatctag

SEQ ID NO: 49521 - DNA, 1521 bp, Artificial Sequence
  Description of Artificial Sequence: Synthetic coding sequence
atggtcgcagcgatcaacagaaataacagtgttgttcaggtgctccttgccgcaggggcagatcctaacctcggggatgatttctcttccgtgtacaagactgcgaaggaacagggcattcatagcttagaggtactaatcacgcgagaggacgactttaataatagactgaacaatagggccagttttaaagggtgtactgctctgcactatgccgttcttgctgatgattaccgtacagtgaaagagcttctagatggcggagccaaccccctgcaacgaaatgagatgggccacacaccactggattatgctagggagggcgaggtgatgaagctgctccgcacttctgaagccaaataccaggagaagcaacggaagagagaagccgaggagcggcgacggtttcccctggagcagagactaaaggaacacattatcggccaagagagcgctattgcgaccgtaggtgccgctataaggcggaaagaaaacggctggtatgacgaggagcaccctttagtgttccttttcctgggatcaagtgggattggtaagacggaactggccaagcagacggccaagtacatgcacaaagacgccaaaaaaggatttattcgtcttgacatgagtgagttccaggagaggcatgaggtggccaagtttatcggcagtccaccaggatacgtgggtcacgaggaaggcggacagttaaccaagaagctgaagcagtgtccaaacgctgtggtgctcttcgatgaggtggacaaggcccacccagacgtgcttacaatcatgctgcaactgtttgatgagggaagactgaccgatgggaaaggaaagacaatcgactgcaaggacgcgattttcatcatgacctctaacgtagcctctgatgaaattgctcagcatgctctacagctgaggcaggaggctctggagatgtctcggaatagaattgccgaaaatcttggcgatgtgcagatttcggataaaatcactatatcaaaaaattttaaggagaatgtgattaggccaattcttaaggcccacttcaggcgcgatgaattcttggggcgtatcaatgagattgtgtactttctgccattttgccactccgagcttatccagctggtcaacaaggagctgaacttctgggctaaacgagctaagcagagacacaacatcaccctactgtgggatagggaggttgctgatgtgctggttgatgggtacaacgtacattacggagccaggtccattaaacacgaggtggagagaagagttgttaatcagctcgcagcagcttacgaacaagacctactgcccggagggtgcacgctaaggatcaccgtcgaggactccgacaagcagctgttgaagtctccagagttgccctctcctcaagcggagaaaaggctgcccaaactgcggctcgaaatcattgataaggatagcaaaacacggcgtctagacatcagggccccactacaccccgaaaaggtctgcaacactatctag

SEQ ID NO: 49522 - DNA, 1902 bp, Artificial Sequence
  Description of Artificial Sequence: Synthetic coding sequence
atgccgtcatgtggagcatgcacatgcggagccgcagccgtgcgattgattacgagctcactggcttctgcccaaagagggatttctggaggacggattcacatgtctgtgctgggccgtctcggaacctttgagacgcagatcttgcaacgtgctcccttgagatcctttactgaaacaccagcctactttgcgtcaaaggacggaatctcaaaggacggtagcggagatgggaataagaagtccgcatccgaaggtagctctaagaaatcaggatccggtaacagcggcaagggtggtaatcagcttcgttgtccaaagtgtggcgacctttgtacacacgtcgaaacattcgtttcgtcaactcgctttgtgaaatgcgaaaaatgccatcactttttcgtcgtgttatctgaggcggacagcaagaaatcaattattaaagaaccggaaagcgctgctgaagcggttaaactggccttccagcagaagccgcctcccccacctaaaaaaatctacaattacctcgacaaatatgtggtgggccaatccttcgccaaaaaggttctgagtgttgccgtctacaaccactataagcggatatacaacaacattccagcaaacctgcggcagcaggccgaggtggaaaagcaaacatcactaaccccacgagagctggagatcagacggagagaggatgaatatcggttcaccaaactgttacaaattgccggaatctccccacatggtaatgccctgggcgctagtatgcagcaacaggtgaatcagcagatcccacaggagaagagagggggagaggtgcttgattcttctcacgacgatattaagttagagaagtcaaacatcctgctgcttggtcctactggaagtggaaagacacttcttgctcaaacactggcaaaatgtttggatgtgccattcgctatttgcgattgtacaaccctgactcaggctggatacgtgggggaagacattgaatccgtgatagccaagctgctgcaagatgctaactacaacgtcgagaaggcgcagcagggcatagtgtttcttgacgaggtggacaagatcggatccgtcccgggaatccaccaactacgggacgtgggaggcgaaggcgtccagcaggggctactgaaactgctcgagggaactatagtgaacgtgcccgagaaaaatagcagaaagctcaggggcgagactgtccaggtggataccacaaatatactctttgttgctagtggagcgtttaacggtcttgaccgtatcattagccgccgaaaaaatgagaaatacctgggttttgggaccccctcaaatcttgggaaagggagacgcgctgcagccgctgctgatctcgccaatcgatccggggagtcgaacactcatcaagatattgaggaaaaggatagactgctgcgacatgtcgaggcgcgtgacctgatcgaattcggcatgatcccagagtttgtcggccgtttaccggtggttgtcccacttcactccctcgacgagaagactcttgttcagatcctgacagagcccagaaacgccgttataccccaataccaagctttattcagcatggacaagtgtgagttgaatgtcacagaggatgcgttgaaggcaattgcacgtctagccctggagcgaaagactggggcaagaggcctgcgttccatcatggagaaacttctgctcgaacccatgtttgaagtgcctaactctgatatcgtctgcgttgaagtggacaaggaagtagtggagggtaaaaaggaaccaggctacattcgcgcacccacaaaggaatcctctgaagaggaatatgactccggtgtcgaagaagagggatggccgcgacaggccgacgcggctaacagctag

SEQ ID NO: 49523 - DNA, 1602 bp, Artificial Sequence
  Description of Artificial Sequence: Synthetic coding sequence
atgccatcatgcggagcttgcacctgcggcgctgcagctgtacggctgatcacatctagtttggcctccgcccagcggggaatcagtgggggaaggatacatatgtctgtccttggtcgtctgggcaccttcgagacccagatcctgcaacgggcaccactcagatcttttacggaaacaccagcctattttgcctcaaaggatgggattagcaaggatgggtcaggcgacggtaacaaaaagagtgcctccgaggggtcctcaaagaagtccggatcggggaattcagggaagggaggaaaccagctgagatgtccgaaatgtggagatctgtgtacacacgtggagacattcgtatctagcaccaggttcgtgaaatgcgagaagtgtcaccacttttttgtcgtactgagcgaggcagactcaaaaaaatccatcataaaagagcctgaaagcgcagctgaggcagtaaagctcgccttccagcagaagccccctcccccacccaagaagatttacaactatctggacaagtacgtcgtgggccaatcttttgctaagaaggtgctgtccgtggctgtgtacaatcactacaaacgaatatacaacaacatacccgctaatctgagacagcaggctgaagtggagaaacagacaagtctgaccccgcgtgaactcgagattaggcgcagggaggacgagtacaggttcaccaaactgctgcaaatcgccggtatcagtccacacgggaacgccctcggcgcatcaatgcaacagcaggtgaatcagcagatcccacaggaaaagcgtggaggcgaagtgcttgacagtagtcacgatgatatcaaactggagaagagcaatatattgctgttgggtcccactggatcaggtaagacactgttggctcagaccctggccaagtgcctggatgtgcccttcgctatctgcgactgtaccacgttgacccaggctggatacgtcggagaagacattgagtcagtcattgccaaactgctgcaggacgcgaattataatgtcgaaaaggctcaacaggggattgtctttctggatgaggtggataagattgggtctgtcccaggcattcaccaactcagagatgtcggcggagaaggcgtgcaacaggggctgctgaagttactagagggcaccatcgtgaacgtccctgagaaaaactcaagaaagctgagaggcgagactgtgcaggtggacactacaaatatcctcttcgtcgccagcggagcttttaatggacttgatagaattatcagccgacggaaaaatgagaagtacctcggttttggcacgccatccaatctggggaaaggacgacgggcagctgcagccgctgatctcgcaaaccgctccggcgaaagcaacacgcatcaggatattgaggaaaaggaccggctgctacgccacgtcgaagctagagatctcatcgaatttgggatgattcctgaattcgtcgggcgtttaccagtggtggtgccactccattcattagacgagaaaactctagtgcagattctaacagagcctcctcatcccgctctattcaccattttcaatcccttctag

SEQ ID NO: 49524 - DNA, 2625 bp, Artificial Sequence
  Description of Artificial Sequence: Synthetic coding sequence
atgttaaagaaattcgataaaaaagacgaggagagtgggggaggatcaaacccttttcagcacctcgagaagagcgcggtgctccaggaagctcgggtctttaacgaaactcccatcaaccctagaaagtgtgcccatattctcacgaagatcctgtacctcatcaatcagggggagcacctgggcacaactgaagccaccgaggcctttttcgctatgactaaactttttcagtccaatgaccctacactacgaagaatgtgctacctcactattaaagaaatgagctgtattgccgaagacgtcatcatcgttacctccagtttgaccaaagatatgaccggcaaagaagacaactaccgcggacccgctgtgcgcgctttatgccagatcacggatagtactatgttacaggcgatagaacgatatatgaagcaagcgattgtggataaggtgccttcagtgagctcctccgcattggtatctagtttgcacctacttaagtgtagttttgacgtggtcaagcgatgggtgaacgaagctcaagaggcagctagtagtgacaacattatggtgcaatatcacgccctcggcctactctaccacgtgcgcaaaaacgatcggctcgccgtgaacaaaatgattagcaaggtgaccaggcatggcctgaagagtcctttcgcgtactgtatgatgataagggttgcaagtaaacagttagaggaggaagacgggtcccgagacagtcccctgtttgactttattgagtcttgtctgagaaacaaacacgagatggtcgtgtacgaggctgcctccgccatcgtgaacctgccaggctgcagcgccaaggagctggcccctgccgtctctgtgcttcagctgttttgtagcagccctaaggccgctcttcgttatgcagctgtacggaccctcaacaaagtggcgatgaagcatccctcggctgttaccgcttgcaatctggacctggagaacctggtgaccgattctaaccggtccattgctacccttgccattactacactgttgaagactggaagcgagtccagcattgatcggctcatgaaacagatcagcagcttcatgtccgagattagtgatgagtttaaggttgtggtggtccaagcaatctccgccctctgccaaaagtatcccaggaagcacgctgtgctaatgaactttctgtttaccatgttacgagaagaagggggatttgagtacaagcgggctattgttgactgtattatatccattattgaggaaaattcggaaagtaaggagactgggctttcccatctgtgtgaattcatcgaggattgcgagttcacagtgcttgcaacacggattcttcacttgctgggccaagagggtcctaagacgacaaatccctccaagtatattagatttatttacaaccgggtcgtcctggagcatgaagaagtacgcgctggagccgtgagtgccctggctaagtttggtgctcagaacgaagagatgctgccttcgattctggtactgcttaagaggtgtgtgatggacgacgataatgaagtgagggacagagcaacattctaccttaacgtgctagaacagaagcagaaagcccttaatgcaggctacattcttaacggactcacagtgtcaatccccggattggaaagggcactccagcagtatactctcgaaccgtctgaaaaacccttcgacctgaagtctgttcctctcgctacagcaccgatggcagagcaaagaaccgaatccacacccattaccgccgtgaagcaacccgagaaggttgccgctacaagacaagagatttttcaggaacagcttgcggcagtacccgagttcagaggactgggccctctcttcaaatcctcccccgagcctgtcgcccttacagaaagcgaaaccgagtatgtcattcgctgcacaaagcacactttcaccaaccacatggtttttcaattcgactgcactaacactctgaatgaccaaaccctagaaaatgtgactgtccagatggagcctactgaagcctacgaagttctgtgctacgtgcctgctcggtcactaccatataatcagcctggaacatgttacacgctggtggcccttcctaaggaagatccaacagctgtagcgtgtaccttttcatgtatgatgaaatttaccgtcaaggattgtgaccctactaccggagaaacagacgatgagggatatgaggacgagtacgtcctagaggatttggaagtcacggtggcagatcacatacaaaaggtgatgaagcttaatttcgaggcagcttgggacgaggtcggtgatgagttcgagaaagaggaaactttcactctgagcactattaaaaccctggaagaggccgtggggaacatcgttaagttcctggggatgcacccctgcgagagatccgataaggtgccagataataagaatacacacaccctgctcctcgcaggcgtcttccgtgggggacacgatatcctggtgcggagccgcttgctactgctggacacggtgaccatgcaggtgacggcccgatctttagaagagctgccagtggacatcatacttgcatctgtcggctag

SEQ ID NO: 49525 - DNA, 534 bp, Artificial Sequence
  Description of Artificial Sequence: Synthetic coding sequence
atggaggctttaatcttggagccctcactgtacacggttaaagctatcctcatactcgataacgacggcgatcgcctattcgcaaaatattatgatgatacataccctagcgtcaaagagcagaaggcctttgagaaaaacatttttaataagacacaccggaccgactccgaaattgcactgttggagggcctgacggtagtgtataagtcgtctattgacctgtatttctatgtcattgggagctcttatgaaaacgagctgatgttaatggcagtcctcaactgcttgttcgactcattaagccagatgctccggaaaaacgtcgagaagcgggcactactagaaaacatggaggggctttttcttgctgtggacgagattgtggatgggggagtaatcctagaatccgaccctcagcaggttgtccatcgagtggcgcttaggggcgaggatgtcccccttactgagcagaccgtgtcacaggtccttcagagcgcaaaagaacaaatcaagtggagcttactgagatag

SEQ ID NO: 49526 - DNA, 381 bp, Artificial Sequence
  Description of Artificial Sequence: Synthetic coding sequence
atgatggagatcgacttcctacccagtacaatgacaacgcccaccccagtatcgaggtccaaacggcctcttcggagaacattctccacacgccctatcgggctaacactgatgctgatggctgtgttaaactgtctatttgatagtctgtctcagatgcttcgtaagaacgtcgagaaacgggcactcctagagaacatggaaggactgtttctggctgttgacgagatcgttgatggaggcgttatcctggaatctgatcctcaacaagtggttcacagggtggccttacgtggggaggacgtgcctttgactgaacagaccgtgagccaggtcctgcagagcgccaaggagcaaatcaagtggtcccttctgaggtag

SEQ ID NO: 49527 - DNA, 465 bp, Artificial Sequence
  Description of Artificial Sequence: Synthetic coding sequence
atggaggctttgattctgtactacgatgatacatatccatccgtgaaggagcagaaagcttttgaaaagaacatcttcaacaagacacataggacggactccgagatcgccctgctcgaaggccttactgttgtgtataagagctccattgacctgtatttctacgtaatcgggtcaagttatgagaatgagctgatgttgatggccgtgcttaattgtctcttcgattccctgtctcagatgctgagaaagaacgtggagaagagggccctgctggagaacatggaaggcctcttcctggctgtggatgagatcgtcgacggaggcgtgatactcgaatctgacccccagcaagtagtccatagggtggctctgcgcggagaagacgtgcccctgaccgagcagacggtgtcccaggtactccagtccgccaaggagcaaatcaagtggtctctactgaggtag

SEQ ID NO: 49528 - DNA, 279 bp, Artificial Sequence
  Description of Artificial Sequence: Synthetic coding sequence
atggaagctctgattctggagcccagcctgtacaccgtgaaggccattctgatcctggacaacgacggtgaccgtctctttgctaaatactacgacgacacataccccagcgtcaaagagcagaaggcctttgagaaaaacatattcaacaaaacccacagaaccgacagcgagatcgccctcctagaggggctgaccgtggtctacaaatccagcatcgatctatatttctacgtgatcggctcctcatacgaaaatgagctgatgctcatggcctag

SEQ ID NO: 49529 - DNA, 744 bp, Artificial Sequence
  Description of Artificial Sequence: Synthetic coding sequence
atggcctgggcgggatctcgcagagtgcctgctgggactcgtgctgccgctgagaggtgctgccgcttgtcgctctctcctggcgcacagcctgcaccacctcccggacccctgccaccccctcggccaatgcgctttctgacatcatgctcgcttttgctacccagagcagcacagattttggctgctgaggcaggcctgccatcctcgcggtcgtttatggggtttgccgctcccttcaccaataaacgcaaggcctattctgagcgcagaattatggggtactcaatgcaagaaatgtacgaggtagtcagtaacgttcaggagtatcgggagtttgtcccgtggtgtaagaagtccctggtcgtaagcagtagaaaggggcaccttaaagcccagcttgaagtaggctttccacccgtgatggaaagatatacgtcagccgtgagcatggtgaaaccacacatggtcaaagccgtgtgcacagatggtaaactctttaatcatcttgagactatctggcggttttcccccggaatccctgcatacccccgtacctgtaccgtggacttcagcatttcattcgaattccgaagcctgttgcactctcagctggcaaccatgttcttcgacgaggttgtgaagcagaatgtagctgcgtttgaaagacgtgctgccaccaagtttggacccgagaccgccataccgagggagcttatgttccacgaagtgcaccaaacgtag

SEQ ID NO: 49530 - DNA, 648 bp, Artificial Sequence
  Description of Artificial Sequence: Synthetic coding sequence
atgctgctccaggtagttcgcgaggggaaattcagtggctttttgaccagttgcagcttgcttctcccacgggcagcacagatccttgccgcagaagctggattgccaagttccaggtcatttatgggatttgctgccccttttactaacaaacgaaaggcatattctgaacgcagaatcatggggtacagtatgcaggagatgtacgaggtcgttagtaacgtccaggagtacagagaatttgtcccatggtgcaagaaatcgcttgtggtctcaagccggaaaggccatttgaaggcccagctggaagtagggtttcccccagtgatggaacggtacacctcagccgtgtccatggtaaaaccccatatggtgaaggcggtgtgcactgatggcaagttatttaaccacctggagacaatctggcgtttctctccgggaatcccagcttaccctcgcacctgtaccgtagatttcagcatttcctttgaattccggtccctgttgcatagccagttggccaccatgttcttcgacgaagtggtgaagcagaatgtggccgcttttgagagacgagcagcgactaaatttgggccagagactgcaatcccgagggaactcatgttccatgaggtgcatcagacctag

SEQ ID NO: 49531 - DNA, 693 bp, Artificial Sequence
  Description of Artificial Sequence: Synthetic coding sequence
atgcatagctcatccccatcaccaactaacgaccggggactgcgtcggaccattaggttggccccactctcatttggcctacggttcctcacatcttgctccctcctactgccacgagctgctcagatcctggcggctgaggcgggactgccgagctctcgctccttcatgggattcgctgcgccttttactaataaaaggaaggcttacagtgagcgtcgaattatgggatactctatgcaggaaatgtacgaagtggtctccaacgtccaagagtaccgggagtttgttccatggtgtaagaaatcccttgttgtcagcagcagaaagggacacctgaaagctcaactagaggtgggctttccccctgtcatggagcggtacacctctgcggtttctatggtgaagccacacatggtgaaggccgtgtgcacagatggaaagttgttcaatcacctggaaaccatatggcgtttttcccccggtatcccggcatacccgaggacttgtaccgttgatttttctattagcttcgaattccgtagcctgctacacagccaacttgctaccatgttttttgacgaggtggtgaagcagaacgtggcagcatttgagaggagggccgctacaaaattcggccctgaaaccgctatacccagggaactaatgttccacgaggtccaccagacctag

SEQ ID NO: 49532 - DNA, 195 bp, Artificial Sequence
  Description of Artificial Sequence: Synthetic coding sequence
tgacggacgtgcaccgtcgatttttctatcagttttgaatttcggtcactgctccattctcagctggctacaatgtttttcgacgaggttgtcaaacagaacgttgctgcttttgaacgtcgcgctgccactaaattcggcccagaaaccgccataccaagggagctcatgtttcacgaagtgcaccagacatag

SEQ ID NO: 49533 - DNA, 717 bp, Artificial Sequence
  Description of Artificial Sequence: Synthetic coding sequence
atggcagccagaactgggcacactgccctccggcgagttgtgtccgggtgtcggccaaagtccgcaactgcggctggcgctcaggcaccagtgaggaacggaaggtatctcgcctcatgcggtatccttatgtcaaggactctccctctgcatacaagcattcttcccaaagaaatatgtgctcgtaccttttttaagattaccgcaccgttgatcaataaacgaaaagaatacagtgaaaggagaattctgggctacagcatgcaggagatgtacgatgtggtgtccggggtggaagactataaacatttcgtcccttggtgcaaaaagagcgatgtaatctctaagaggtcggggtactgcaaaaccaggttagaaattggattccccccagtgctggagcgctacacatctgttgtaaccctggtcaagcctcatctcgtgaaggcatcatgtacggatggacgactgttcaatcatcttgagaccatctggcgcttttcccccggtcttccgggataccccaggacatgcacactggatttttctatttcctttgaatttcggtctcttttgcattctcagttggccacactctttttcgacgaggtggttaaacaaatggtcgcggcattcgagaggagagcctgtaagctgtatggacctgagaccaacatcccacgcgaattaatgctgcacgaggtacaccatacgtag

SEQ ID NO: 49534 - DNA, 633 bp, Artificial Sequence
  Description of Artificial Sequence: Synthetic coding sequence
atgggcgtttgcgtctggaggtatctggcctcatgcggaatcctgatgtccagaactctccccctccatacctctatcctgcccaaagagatctgtgcacggacattctttaaaatcacggcccctctaatcaacaagcgcaaggagtattcagagcggaggattctggggtatagtatgcaagaaatgtacgatgttgtgagtggagtggaggattataagcacttcgttccgtggtgcaaaaagagcgacgtcattagtaagcgtagcggatattgtaagacgcgacttgagatcggcttccctcctgtgctggagaggtacacctcagtggttacactcgtaaaacctcacctggtcaaagcctcctgcactgacgggaggctattcaatcacctcgagactatctggcggttttccccagggctgcctggctatcctcgcacctgtacactggacttcagcatctcttttgaattcaggagcctgcttcattcccagttagctactcttttctttgacgaggtggtcaagcagatggtggctgcgtttgagcgcagggcttgcaaattgtacggtcccgaaacaaatatcccaagggaacttatgctgcatgaggttcaccatacttag

SEQ ID NO: 49535 - DNA, 588 bp, Artificial Sequence
  Description of Artificial Sequence: Synthetic coding sequence
atgtcccgcactctgcctcttcatacttcaattttgcccaaagagatttgtgcccgaacctttttcaaaattacagctcccctcatcaacaaaagaaaagagtatagcgagcggagaatactggggtattctatgcaggagatgtacgacgttgtgagcggtgtcgaagattacaagcacttcgtcccctggtgtaagaaaagcgatgtaatatccaagcgctctggttattgcaagactagactggagatcggcttcccaccagtgctggagcgatacacttccgtcgtgacactggtaaaaccgcacttggttaaggcatcttgcacagacggcagactgttcaatcatctggagaccatttggcgatttagtccaggactcccgggttaccccaggacttgcacgctggatttctctatctcgtttgaattcaggtccctgttgcactcacagctggccaccttgttcttcgatgaggtggtaaagcagatggtcgctgccttcgagcgcagggcctgcaaactgtatgggcctgagacgaatatcccgagggagctgatgctgcacgaggttcatcacacatag

SEQ ID NO: 49536 - DNA, 984 bp, Artificial Sequence
  Description of Artificial Sequence: Synthetic coding sequence
atggctgcgcctgggtcatgtgctctgtggtcgtattgcgggagaggttggtctcgcgcaatgagagggtgtcagcttctaggacttaggtcctcttggccgggagacctcctgtcagcacgactcctctcgcaagagaagcgcgctgcggagactcattttggatttgaaactgtctctgaggaagagaaaggaggcaaagtgtaccaggtctttgaaagcgtggccaagaaatacgacgtaatgaacgatatgatgtctctgggcattcatcgagtctggaaggacctcctgttatggaagatgcacccgctgcctggaactcagctcctggatgtggccggtggcactggcgatatcgcattcagatttctgaactacgtccagagccagcatcagcggaaacagaaaagacagctcagggcccagcagaacctcagttgggaagaaattgctaaagagtatcaaaatgaggaagatagtttaggtgggtcacgtgttgtcgtttgtgatataaataaggaaatgctgaaggtgggaaagcaaaaagcattagcccagggctatagggccggacttgcttgggtgttgggagatgcggaagagttgccattcgacgacgacaaatttgatatatacaccatcgccttcggcattcgcaacgtcacccacatagatcaggcattgcaagaagcccaccgcgtgcttaaaccgggaggaaggtttctgtgcctggagttctcacaggtgaataatcctctgatcagtcggctgtacgatctgtactccttccaagttatccctgtgcttggcgaagtgatcgcaggcgattggaaaagctaccagtacctcgtggaaagcattcgtaggttcccctcacaggaagagtttaaggacatgattgaagatgctggtttccacaaggtgacttacgagagtctgacatccggcatcgtggctattcacagcggattcaagctgtag

SEQ ID NO: 49537 - DNA, 741 bp, Artificial Sequence
  Description of Artificial Sequence: Synthetic coding sequence
atggcagccccagggagttgcgcactttggagctattgcgggaggggatggtccagagccatgcgcggatgccagctgctgggcctcagaagctcctggcccggagacttattgtcagctcgacttctatcccaggaaaaaagggctgctgaaacacactttggcttcgagacagtttcagaagaggagaagggcggaaaggtctaccaggtattcgaatccgtcgctaagaagtatgacgtgatgaatgacatgatgagcctgggaattcaccgtgtgtggaaggacctgttactgtggaaaatgcatcctctgcccggtacccagcttctggatgttgcaggaggaactggcgacattaacaaggaaatgctgaaggttggaaaacagaaggcactcgcgcaggggcacgaccggagatgcagactttctcagggcgacctgcgcaagagcaacatccgacactgtgggcatagcttctggctgcagacactgatccccttcctaagctggtccatgaaccagagctaccccgtggaaagcctggaactcaaagataacctagccaacgagaccgccgctgaacatctgcttctgaggattagagcactggacagttgcctgaaccggacagtgtctaagtggaaaaacaagttcctcagtctcttttatagtttcctgtggagttgcttctccccctctccacgaggaatctggagcgtgagcctcctcaattgctag

SEQ ID NO: 49538 - DNA, 1182 bp, Artificial Sequence
  Description of Artificial Sequence: Synthetic coding sequence
atgatatttacattcatgacacgaaaatcctgttgcagtaagcaggtgcaacgaaagtactggagaaactgccagaaacttaccgccaccggatcagccccattcccactggctctccaacgcttttctgtagtctgggacgcctgcagcgaggccctgatcatgttcgacaaagacaacctggacgacatgggctacatcgtggagaatgacgtcataatgcacgcactcacgaagcagttagaggccgtctctgatagagtgaccgtcctgtatcgctctaaagccatacggtacacatggccatgtcctttccctatggcagactccagcccgtgggtgcacatcacactgggtgatgggagcacgttccagactaaactcctcatcggggctgacgggcacaatagtggggtccgacaggccgtgggcatccagaacgtctcttggaattacgatcagtccgcagtagttgccaccctgcacctgtccgaagctacagagaacaacgtggcgtggcaacgattccttccaagtggtccaatcgcactgcttcccttgagcgacacgctgagctctcttgtttggtctacatcacatgagcacgcagccgagctcgtgtctatggacgaggagaaatttgtggatgctgtcaacagtgcattctggtcggacgctgaccacaccgactttatcgatactgccggagctatgttgcagtacgctgtgagcctgctcaagccaaccaaggtctctgcgcgacagctgcccccttctgttgccagggtggatgcgaaatctcgggtcctcttcccacttggtctcggacacgctgctgagtacgtgcgcccaagggtggcactgattggcgacgccgcacaccgagttcatccgttagctgggcagggagtgaatatgggattcggggacatcagctctttagcacatcatctcagtacagctgcattcaatggtaaagacctgggctccgtgagccacttaacgggatatgagaccgaaagacagcggcataacactgccttattggcagctacagacctgctgaagaggctgtatagtacgtctgcatcccccctggttctattgcggacctgggggctgcaggctaccaacgccgtatcaccactgaaggagcaaataatggcgtttgcatcgaaatag

SEQ ID NO: 49539 - DNA, 1407 bp, Artificial Sequence
  Description of Artificial Sequence: Synthetic coding sequence
atggctgcccgactggtttcaagatgtggggcagtgagagccgctccacatagcgggccactcgtatcttggagacgatggagcggtgcaagcacagacacagtttacgatgtggtggtctcaggcggaggactcgtgggggctgcgatggcttgtgccttgggttacgatattcattttcacgacaaaaagatcctattgctggaggccggaccgaaaaaagtactcgagaaactgtccgaaacatattccaaccgggtttcttctatttcgccaggttcggccacgcttctcagctcttttggagcatgggaccatatttgcaatatgagatatagagcatttcggaggatgcaggtttgggacgcatgctctgaagctctcatcatgttcgacaaagataacctggacgacatggggtacattgtcgaaaatgatgtgataatgcacgctttgacaaagcagcttgaggccgtatcagatagggtcacagtgttgtacaggtccaaggccatcagatatacatggccatgtcctttcccaatggctgactcttctccatgggtgcacattacgttgggggacgggtcaactttccagaccaaattattaataggggctgatggccataatagtggggttcggcaagcggtcggaatccagaacgtcagctggaactatgaccaatcagctgttgtagccaccctccacctcagcgaggccaccgagaacaacgtcgcatggcagcgctttttgccttctggcccaattgctctgctgccactgagtgatacactctcatcattggtgtggtcaacatcacatgaacatgcagcagagctagtatccatggatgaagagaagttcgtggatgcagtgaacagtgcattctggtctgacgccgatcatactgattttattgacacagcgggagcaatgctgcagtacgccgtgtcactgttaaaacccacaaaagtctcagcaagacagctgcctccttcggtagcccgtgtggatgctaaatcacgtgtcctgtttccgctgggactcggccatgcggctgaatatgtcagacccagagtcgcattgataggcgacgcagcacatagagtgcatcccctggccggacaaggcgttaatatgggattcggcgatatctcttcccttgcccaccatctctcaactgctgcttttaacggaaaagacctggggtcagtgtcccacttgacaggatatgaaactgaacgccaacgccataacacagccctcctggccgctactgacctcttaaaacgcctgtatagtacaagcgcttctccactagtactgttgagaacctggggacttcaagcaacaaatgcagtgtctcctctgaaagaacagatcatggcgttcgccagtaaatag

SEQ ID NO: 49540 - DNA, 1332 bp, Artificial Sequence
  Description of Artificial Sequence: Synthetic coding sequence
atgaggggacagggccctccattatcctcttttggcgtctggctggccagcagggcagctagcgacccgagccggccaaggagacagggctatgacatccactttcacgacaaaaaaatccttttgctggaagccggaccgaagaaagtgttggagaagctcagtgagacctacagcaatcgtgtatccagcatctccccaggatccgccacactgctgagctccttcggggcatgggatcatatttgtaacatgcgctaccgggcattccgacgaatgcaggtctgggacgcatgttcagaagctcttattatgttcgataaagacaacctggacgacatggggtacattgtggaaaacgacgtcatcatgcatgccctaacaaagcagctagaagccgtgtctgatagggtgactgtcctgtatcggtccaaagcaatcaggtacacatggccctgcccattcccaatggccgactccagtccctgggtgcatatcactctaggcgatggctcaacctttcagacaaagctcttgattggtgcagacgggcacaacagcggggtaaggcaggctgttggcattcagaacgtgtcctggaactacgaccagtccgcagtggtggcaaccctccacctttcggaggcaaccgagaacaacgtggcttggcaacggttcttgccctccggaccgattgcgctgttacccttatcagacaccctttcatccctcgtctggtcgacatcacacgagcatgcagctgagctcgtttctatggacgaggaaaaatttgtggacgcagtgaatagtgccttctggtctgacgctgatcataccgacttcatagacaccgccggagcaatgctgcagtatgccgtaagtctgctaaagccgactaaggtatcagccaggcagctacctccttctgtcgcacgcgtggatgccaaatcccgggtgctcttccctctcggtctgggccatgcagctgagtacgttaggccaagagtcgctctgatcggagacgccgcacacagagtccacccgctggctggtcagggtgtgaacatgggatttggtgatatctcctctctagctcaccatctctcaactgcagccttcaatggtaaggatctgggctccgtctcccatctgaccggatacgaaactgaaaggcagcgccacaatactgctttattggccgcaacagacctgctgaaacggctgtattctacctcagctagcccattggtgcttctccgaacctgggggctgcaggcaacaaatgcagtgtcccccttaaaggagcagatcatggcattcgccagtaagtag

SEQ ID NO: 49541 - DNA, 441 bp, Artificial Sequence
  Description of Artificial Sequence: Synthetic coding sequence
atggctgctcggctcgtttccagatgtggagccgttagggcagccccacattctggcccacttgtgtcctggagacgttggtccggtgctagtaccgataccgtgtacgatgtggttgtatcgggcggtggtctcgtgggagcagcaatggcatgcgctctagggtatgatatccatttccacgataaaaaaatcctgctcttagaggctggcccaaaaaaagtcctggagaagttgagcgaaacctactctaatagagtttcttccatatctccaggatcggcgacattgctgtccagttttggcgcttgggatcatatttgcaatatgagatatagagcttttcggcgtatgcaggtgcctctttatctgttcaacttcgtgaaaatgtcgtggtccgttcttcgctaccggagccctctgagtccatctgtcctgtag

SEQ ID NO: 49542 - DNA, 417 bp, Artificial Sequence
  Description of Artificial Sequence: Synthetic coding sequence
atgacctggtggtgccgcgtggaggcatggtgggcacttccgtggcctgtcccgtgggacatgatcttcacctttatgaccaggaaatcctgttgctccaagcaagtccaaaggaaatattggaggaattgccagaaactgacagccactggctcggctccatttccactggctcttcagcggttttcagttgtctgggatgcctgcagtgaagctctaataatgtttgacaaagataacctcgacgacatgggctatattgtggaaaatgacgtcattatgcatgcactgacaaaacagttggaggccgttagtgaccgcgtcactgtcctctacagaagcaaagcgatccgctacacttggccttgcccattcccaatggccgactcgtctccgtgggttcatataaccttatag

SEQ ID NO: 49543 - DNA, 789 bp, Artificial Sequence
  Description of Artificial Sequence: Synthetic coding sequence
atgatttttacctttatgacccggaagtcctgctgttcgaaacaggtgcagcgtaagtactggcgcaattgccagaaactgacggctacgggttccgcgccatttcctctcgccttgcagagattcagtgtagtctgggatgcttgctcagaggcactgatcatgtttgacaaggataacttggacgatatggggtatatcgttgaaaacgatgtgattatgcacgccctgacgaaacaattggaggccgtgtcggaccgggtgaccgtcttgtaccggtcaaaggccatccgctacacatggccctgccctttcccaatggctgatagcagcccatgggtgcatatcactctgggcgatgggagcacctttcagactaagttgcttattggagctgatgggcataatagcggtgtccggcaggccgttggaatccagaacgtttcctggaactatgatcagtctgccgtcgtcgcgacattacatctcagtgaggccaccgagaataacgtggcttggcagcggttcctgcctagtgggccaattgcactgctgcccctcagcgacacactgtcatccctggtctggtcaacgtctcacgagcatgccgcagagctggttagcatggatgaggagaaattcgttgatgcagtgaacagcgccttctggagcgatgctgaccacactgacttcatcgacaccgccggtgccatgttgcagtatgctgtgtcccttctaaaacctactaaggtgtctgctagacagctccctccttctgtcgcgagatag

SEQ ID NO: 49544 - DNA, 1176 bp, Artificial Sequence
  Description of Artificial Sequence: Synthetic coding sequence
atgattttcaccttcatgacgcgaaaaagctgctgctccaagcaggtgcagcgcaaatactggcgcaactgccaaaagctgactgcaacaggatccgcccctttcccactcgcccttcaaagattctcagtggtgtgggacgcttgctccgaagccctgataatgttcgacaaggataatctagacgatatgggatacatcgtcgaaaacgacgtcataatgcacgccttgaccaagcagctcgaagccgtcagcgacagagttaccgtgctatacaggtcaaaagcaatcagatacacgtggccctgcccttttcctatggccgactccagcccctgggtgcacattaccttaggggacggcagcacctttcagaccaagctcctgattggagcagacggtcacaatagcggagttagacaggcagttggcattcagaacgtgtcttggaattatgatcagtcagcggtagtcgcgacactgcacctcagcgaagccacagagaacaacgtcgcgtggcagaggttcctaccatctggacctattgcgctgttgcccctgagtgataccctttctagcctcgtgtggagcacaagccacgaacacgctgcagagcttgtgagcatggatgaagaaaagtttgtggatgctgttaactctgctttttggtccgatgcggaccacaccgacttcatcgatacagcaggggctatgttgcaatatgcagtgtccctcttaaaaccaacaaaagtgtctgcaaggcagcttccaccgagcgtggcaagagtggacgctaaaagccgtgttctgtttcctttgggcctcgggcatgctgccgagtacgtgcggccaagggtggccttgatcggcgacgctgcacatagggtgcaccccttagcaggccagggcgtgaatatggggtttggtgatataagttctcttgcacatcacctgagtactgccgcatttaacggcaaggacctgggatcagtgagtcatctcaccgggtacgaaaccgaaaggcagcgccacaatactgctctgctggccgcaacagaccttctgaaacgtctttactcgaccagcgcgtctcccctggttctcctgcgaacatggggtctgcaggccaccaacgccgtgagcccactaaagattatggcctttgcatccaagtag

SEQ ID NO: 49545 - DNA, 468 bp, Artificial Sequence
  Description of Artificial Sequence: Synthetic coding sequence
atggcaggcgctgtgtctctcctgggcgttgtggggttgctactggtttccgctctttccggcgtcctgggagatcgcgctaatcctgatctgcgagctcatcccggaaacgctgctcatcctggatctggcgcaacggagccgcgtagacggcctccacttaaagaccagagggaaaggacaagagctggtagcctccccctaggcgcactgtacaccgctgctgtggcagctttcgtactgtacaaatgccttcagggtaaagacgagacagctgttctgcatgaagaagccagcaaacagcagccgctgcagagcgagcagcagctagctcagctgacgcagcaacttgcccagactgaacagcacctcaacaatctgatggcgcagctggatccgctttttgaaagaccggctggcgcaagtgaacatgaggcaatggaccacccgagggccgctgccagatag

SEQ ID NO: 49546 - DNA, 414 bp, Artificial Sequence
  Description of Artificial Sequence: Synthetic coding sequence
atggcaggagctgttagccttcttggtgtggtaggactcctgctggtctctgccctcagtggtgtactgggcgacagagctaatccggaccttcgggcacaccctgggaatgctgcacatcccggttcgggagcaacagaacctcgacggagaccaccgctgaaagaccagcgggagcgcactcgggctggatcactacccctaggcgcactctataccgctgccgtcgccgcatttgtgctgtacaagtgtctgcagggaaaagatgaaaccgctgtgctccacgaggaggcgtctaagcagcagcctttgcaatccgaacagcaactggcccaacttacccagcagctggcgcagactgagcagcatctgaacaacctgatggcacagttagatcctctctttgagcgttag

SEQ ID NO: 49547 - DNA, 420 bp, Artificial Sequence
  Description of Artificial Sequence: Synthetic coding sequence
atggctggggctgtcagtctgttgggagtcgtggggctcctgctcgtctctgccctgtctggtgtgctgggggaccgagccaaccccgatctcagggcccacccaggcaatgccgctcatccaggcagtggcgcaaccgaacctcgcagacgtcccccactgaaagatcaaagggagcgcacccgtgccggaagcctgcccctgggagctctctataccgccgctgtcgctgcattcgtactgtacaaatgtttacaggggaaggatgaaactgccgtgcttcatgaggaggcatctaagcagcagccactgcagtcggagcagcagctcgcacagctcacacaacaactagctcagacagaacagcacttgaataacttgatggcgcagttagacccgctgttcgaaaggtccttctag

SEQ ID NO: 49548 - DNA, 771 bp, Artificial Sequence
  Description of Artificial Sequence: Synthetic coding sequence
atggctggagccgttagtctgcttggagtcgtgggactcctactggtgagcgccctgtccggcgtcttaggggatcgcgctaaccctgacttacgggctcatcccggtaatgctgcgcatcctggctccggcgcaaccgaacccaggcgtaggccccctctgaaggatcagcgggagaggacccgagccggttccctaccactaggagctctttacaccgccgcagtggccgcattcgtgctctacaagtgtctacaggggaaggatgaaaccgcagtgttgcatgaggaagctagtaaacagcagccactgcagtccgagcagcagctcgcccagctgacacagcagctggcccagacagagcaacacctgaacaacttgatggcacaattggatcccttgttcgagagggttacaaccctcgctggagcccagcaggaactgctcaacatgaagctgtggactattcatgaacttttgcaagacagtaaacccgacaaggatatggaggcttcggagccagaggcctctcggccactccccgaagatttctgtttgaaggaagacgaggaggagatcggagacagccaggcttgggaggaacccaccaactggagcactgagacatggaacctggcaacatcttgggaagtaggccgaggacttcgcaggagatgcagtcaggcagtggctaaaggcccttcacattccttgggctgggagggtgggactaccgccgagggaagactgaaacagtcactcttcagctag

SEQ ID NO: 49549 - DNA, 360 bp, Artificial Sequence
  Description of Artificial Sequence: Synthetic coding sequence
atggcaggggcagtctctttgctgggcgtggtggggctgctcctcgtcagcgccctgagcggcgtgctgggcgaccgggcaaatccagacctgagggcccatcccggtaacgcagcccaccccggaagcggggctacagagcccaggcgcaggccacctctcaaggaccagcgcgaaagaacaagagccggatcactccctttgggggcactgtataccgctgcagttgctgcttttgtgctctataaatgcttgcagggaaaagacgagactgccgtgctgcacgaagaggctagcaaacagcaaccgctgcagagtggaggctttagccggtcgctgtgctgggtcggcggagtctag

SEQ ID NO: 49550 - DNA, 852 bp, Artificial Sequence
  Description of Artificial Sequence: Synthetic coding sequence
atggccggtgccgtttcgctgctgggagtggtgggtctgttgctggtatccgctctgagtggtgtccttggcgatcgcgcaaatcctgatctgcgcgctcaccctgggaatgcagcacacccgggttcaggcgcaacggaacccagacgacgccctcccttaaaggatcagcgcgagcggactcgggctggctcactgcctctaggtgctctttacactgcggcagtcgcagcatttgtgctgtacaaatgtctgcaggggaaggacgagaccgccgttctgcatgaggaggccagtaagcaacagcctctgcagtcagagcaacagctggcccagctaacacagcagttggctcaaactgagcagcacctcaacaatttgatggctcaattggatcccctttttgaacgcgtcaccacacttgctggagcacagcaagagctgctgaacatgaagctatggactatccacgagcttctccaagactccaaaccggacaaggatatggaggcaagtgaacccggagaaggcagcgggggagagtcagccggaggaggagacaaagtttccgagaccggaactttcctgataagtccacacaccgaggcttcacgtcccttgccagaagatttttgcctcaaggaggacgaggaggaaattggcgattcacaggcctgggaagagccgacgaactggagtacagagacatggaacctcgcaacctcatgggaagtcggtcgcggacttagacggagatgctcgcaggcagtcgctaaggggccatctcacagcctggggtgggaaggcggaacaactgcagaaggacgcttgaagcagtcattgttctcatag

SEQ ID NO: 49551 - DNA, 1011 bp, Artificial Sequence
  Description of Artificial Sequence: Synthetic coding sequence
atgcttcaaaggggactgtggccttggcgcactagacttctccccacgccagggacctggagacccgctaggccgtggccgttaccacccccaccacaggtgcttagagtgaagctatgtggcaatgtgaaatactaccagtcgcaccactacagtaccgttgttccccctgacgaaatcactgtgatttatagacatggcctacccctggtgactctgacactaccgtccaggaaagagagatgccagttcgttgtgaaaccaatgctgtccacagtgggcagcttcctgcaggacttgcagaacgaagataaaggaatcaaaaccgcagccattttcaccgccgatggtaacatgatcagcgcctcgaccctgatggacatccttttgatgaatgacttcaagcttgtgattaataagattgcatatgacgtgcagtgccctaagagagaaaagccatccaacgagcatacggctgagatggaacatatgaagtctctagtgcataggctctttacaatcctgcatctggaagagtctcaaaagaaaagagaacatcacttgctcgagaagatagaccatctgaaagaacagctgcaaccacttgagcaggtcaaagctggtattgaagcacatagcgaggcaaaaacatctgggctcctgtgggccggacttgccttactgagtatacaagggggagccttagcatggctaacgtggtgggtctatagttgggacatcatggagcctgtcacttatttcatcacgttcgccaattccatggtgttcttcgcttacttcattgtcacgcggcaggattacacctactcagctgtcaagtctagacagttcctgcaattcttccataagaaaagcaagcagcaacatttcgatgtgcagcaatacaataaactcaaagaggacctggcaaaggccaaagagtcccttaaacaggctcgtcattcactttgcctgcagatgcaagtggaggaactgaacgagaagaattag

SEQ ID NO: 49552 - DNA, 1689 bp, Artificial Sequence
  Description of Artificial Sequence: Synthetic coding sequence
atggacctcccagagggcccagtaggcggacccacagctgagatgtacctgcgggaaaggcccgaggaagccaggctgggtatgcccgttagcctagaagaacaaatactcaactcaacctttgaagcttgcgacccacaacggactgggacggtggctgtcgcccaggtgctcgcctacctagaagccgtgaccggacagggccctcaggatgccagactacagacactcgcgaactctctggaccctaacggtgaggggccaaaggctacagtagatctcgacacattcctcgtggtgatgagagattggatcgctgcatgccagttgcacggcggattggagctggaggaggaaactgccttccagggggcactaacgagtaggcaactaccctctggctgcccagaagctgaagagccagcaaacctcgagtccttcggcggagaagacccgagacctgagctgcaggccactgcagacctcctaagctctctggaggacctcgaactaagtaacaggaggctggtcggcgaaaatgccaagctgcaacgtagcatggaaaccgcggaagagggtagcgcgaggctcggtgaagagatcctggccctgaggaagcagcttcactcgactcagcaagcattacagtttgcaaaagcaatggacgaggaactcgaagacttaaagactctcgcacgctccctggaggaacaaaacagatctctcctggcccaagccagacaggctgagaaggagcaacaacatctcgttgctgaaatggaaaccttgcaggaagagaacggtaagctgctggctgagagagacggggtaaagaaaaggtcccaggagcttgcaatggagaaagatacgctgaagcgccagctgttcgaatgtgaacatctgatctgtcaacgagatacaatcctctccgagcgcacacgtgatgtggagtctttggcccagaccttggaggagtatagagtcaccactcaggagttacggcttgagatttcccgtttggaagagcagctgagccaaacctacgaaggtccagatgaactgcccgagggtgcacaactgcgcagggtgggatggaccgagctgttacctccttccttaggattggagatcgaggctatcaggcagaagcaggaagtcgcgacagctgacctttccaatccattatgcggggtgtggcaatgggaagaggtgattcatgaaactagcgaagagacagaattcccaagcgaagctccagccggtgggcagagaaacttccagggggaaccagcgcatccggaagagggcagaaaagaacccagtatgtggctgactcggagggaggaagaagaggatgcagagtcccaggtgacagcagatttaccagtacctctgggcgcacccagacccggagacatccctgagaaccccccagaacggcctgctcgtagagagctgcagcaagcactagtgccagtgatgaagaaactcgtgcctgtgcgacggcgagcctgggggcagctctgccttccaccacaaaggttgcgggtgacccgacatcctttgatacccgctcccgtgctcggactgttactgttgctcttgctgtccgtgctcttattgggacccagtccacccccaacctggccacacctgcaactgtgttacttgcagcctccacccgtctag

SEQ ID NO: 49553 - DNA, 357 bp, Artificial Sequence
  Description of Artificial Sequence: Synthetic coding sequence
atgactaagaagaaaagagagaacctgggggtggccctagagatcgatggtctggaagagaaactctcccagtgtcggcgagacctggaagccgtcaattcacgcctacatagtcgagaactctcaccggaagccagggaagggaccgaggtgtcgtccgctagggaacctgaggagcacgctgccctctgcggacacctctatcctcccgacgcccgtctgtgtctgttggaccatgtcagtcttgccctccctcacaatcagcaccgactacccctgggccctctcatccggattaagcaggcactgcaagcttccatcggcccacggtgttggggagtcccactgcctacgtag

SEQ ID NO: 49554 - DNA, 294 bp, Artificial Sequence
  Description of Artificial Sequence: Synthetic coding sequence
atgactaagaaaaagcgcgagaatttgggggtggcccttgaaattgacggtcttgaagaaaaactctcccagtgtagacgcgatctggaagccgtgaacagccggctgcacagtcgcgagctgtcacctgaagctcggaggagtctggaaaaggagaaaaattccttaatgaataaggctagcaattacgagaaggagctgaaatttctaagacaggagaatcgaaagaacatgctgctgagtgtcgcgatcttcatcctcctaacgttagtttatgcatactggacaatgtag

SEQ ID NO: 49555 - DNA, 345 bp, Artificial Sequence
  Description of Artificial Sequence: Synthetic coding sequence
atgactaaaaaaaagcgcgaaaatctgggagtggctcttgaaattgatggcttggaggaaaagctgtcgcagtgccgaagagatctcgaagccgtgaacagccgcctccatagtcgagaattgtcaccagaggctagggaaggtacagaggtcagcagtgctcgggagcctgaagaacacgctgcactgtgcggccatttgtacccaccagatgccaggttatgtttactggaccatgtaagtctcgcacttcctcacaatcagcaccgattgcctcttgggcctttgatacggatcaaacaggcgctccaggcgagtatcggtccccgatgctggggcgtgtag

SEQ ID NO: 49556 - DNA, 753 bp, Artificial Sequence
  Description of Artificial Sequence: Synthetic coding sequence
atggctgccggaacaagcagctactgggaagacctcaggaagcaggcacggcagctggaaaacgaattggatctgaaactggtctcattcagtaagctgtgcactagctattcccatagttctacaagggacggacgccgtgatagatattcctccgacactacccctttgctaaacgggtcttcccaggatcgaatgttcgagaccatggctattgaaattgagcagcttttggcccgtcttacaggggtcaacgataaaatggctgagtatacgaatagcgcgggagtcccttcactgaatgccgctctgatgcacacactccaacgtcaccgggacatcctccaggattatacccacgagttccacaaaaccaaggctaactttatggccatacgcgagcgcgagaacctcatgggcagcgtccggaaggacatcgagagctataaatcaggaagtggggtgaacaataggagaactgagctgttcctgaaagaacatgatcatctgcgcaactctgatcggctcatcgaagaaacaatttcaattgcaatggcgacaaaggagaacatgacatcccaaagagggatgttgaaatcaatacactccaaaatgaacacacttgccaaccggtttccagcggtaaactcactgattcagcgcattaatttgcggaaacgcagagatagtctgatcttggggggtgtgatcggtatctgcactatcctgctccttttgtatgcctttcactag

SEQ ID NO: 49557 - DNA, 1452 bp, Artificial Sequence
  Description of Artificial Sequence: Synthetic coding sequence
atgaaagcatttcatacattctgtgtggtgctgctagtgttcgggagtgtttccgaagccaaatttgatgatttcgaagatgaggaagacattgttgagtacgacgataacgatttcgcggagttcgaagatgtcatggaggactcggtgacggagtctccccaacgagtgattatcaccgaagacgatgaggatgagacgacggtcgagcttgagggccaggatgaaaaccaggaaggcgacttcgaggatgcggacactcaggagggagacacggagagcgaaccgtacgacgatgaagagttcgagggatacgaggataagcccgatacctcttccagcaagaacaaagaccctatcactatcgtcgatgtgccagcccacttacagaattcctgggagtcgtattacttagaaattctaatggtaactggtcttctagcgtacattatgaactacatcattggaaagaataaaaactccaggctcgctcaggcatggttcaacactcacagagagttgctagagtcaaatttcacgctggttggtgacgatggcaccaacaaagaagctaccagtacagggaaattgaatcaagagaatgagcatatttacaatctgtggtgctccgggcgagtgtgttgcgaggggatgctaatacagcttcgcttcctcaaacgccaggacctacttaacgtgctggcgcgtatgatgagacccgtttccgatcaagtccagatcaaggtaactatgaatgacgaggatatggatacctatgtgtttgcagtggggacaaggaaagccctggtgcgcctgcaaaaagaaatgcaggatctgtccgaattttgttcagacaaaccaaaatccggcgcaaagtacggcctaccagacagtctagcgatactgtccgaaatgggcgaggtgactgacggcatgatggataccaagatggtgcactttttgactcattatgcagataaaatcgagagtgtgcacttctcggatcagttttcaggccctaagatcatgcaggaggaaggccagcctctaaaactgcctgacactaagcgcactcttctgtttacattcaacgttcctggaagtggcaacacctaccctaaggatatggaagctttgctccccctgatgaatatggtgatctacagcatagataaggctaaaaagtttcgcttaaacagagaggggaaacagaaagctgacaaaaatcgtgccagggtggaggagaacttcctcaagctgacacacgttcagagacaggaggccgctcagagtcgcagagaggaaaagaagcgggctgagaaggaaaggattatgaatgaagaggatccagaaaagcagcggaggctggaggaggctgcactgcgacgagaacaaaaaaaactggaaaagaagcaaatgaaaatgaagcaaatcaaggttaaagcgatgtag

SEQ ID NO: 49558 - DNA, 1236 bp, Artificial Sequence
  Description of Artificial Sequence: Synthetic coding sequence
atgatgggccgatctccaggtttcgccatgcaacacattgtgggtgttcctcatgtcttagttagaaggggacttctgggccgtgatctgtttatgacacgcacactgtgtagccctggaccgtcccaacctggcgaaaaacgccctgaagaggtggccttgggactccaccatcgcctgccagccttaggtcgagcactaggccatagcattcagcagcgcgctacttcaacggccaaaacttggtgggaccggtacgaagagtttgttgggcttaacgaggtccgggaggcacagggtaaggtgactgaagctgagaaagtgtttatggtggctcgcggactggtacgagaggcgagagaggacctggaggtgcatcaggcaaaactgaaggaggtccgcgataggctggatcgtgtttctcgggaagattcgcaatacctggaactggctaccttggaacacaggatgctgcaggaggaaaagagactgagaacagcttacttaagagcagaggactccgaacgggaaaagtttagcttgttctcggcggctgttagagagagtcacgaaaaagagaggacaagagctgaacggacaaagaactggagcctgatcggatcggtcctcggcgctcttatcggcgtagctgggagcacatatgtgaaccgggtcaggctccaggagttgaaggcgttgctcttggaggcacaaaaaggccctgtgagcttgcaagaagcgattagagaacaagcctcgagctactccagacagcaacgtgatttgcacaatctgatggtggacctgcgaggtcttgtgcacgcggcaggcccagggcaagactctggaagccaggccggatcaccccctacaagagaccgagacgtcgacgtactgtctgctgcattaaaggagcagctgtcacatagcaggcaagttcactcctgccttgagggactgagagagcagctggacggcttggaaaaaacatgctcgcaaatggcgggtgttgtgcagctggtgaagtctgccgctcacccagggctagttgaaccagctgacggtgctatgccgtcttttttgctggaacagggttctatgatccttgccctgtctgacactgagcagagattagaggcgcaggtcaatcggaacaccatttatagcactctcgtcacctgcgtaactttcgtcgctaccttacccgttttgtatatgctcttcaaagcctcctag

SEQ ID NO: 49559 - DNA, 1236 bp, Artificial Sequence
  Description of Artificial Sequence: Synthetic coding sequence
atgatgggacgatcccccggtttcgctatgcagcatatcgtgggcgtcccccatgtcctcgtaagacgcggactactcggcagggatctgtttatgacaaggacgctttgcagtcccggtccctcgcagccgggagaaaaacggcctgaagaagtcgcccttggcctacatcatcgcctacctgcactcggcagagccctggggcatagtatccagcagcgcgctactagcaccgccaaaacctggtgggatagatatgaagagttcgtcggactgaacgaagtgagggaagcgcagggcaaggtgaccgaagcagaaaaggtgttcatggtggccagaggcctagtgagagaggctcgggaggatttggaggtgcaccaggccaaattgaaagaagtgcgggaccgacttgatcgagtctctcgtgaagattcccagtacctggaattggcaaccctcgaacatcggatgctgcaggaagaaaaaagactgcgaacagcctacctgcgtgctgaagattccgagagagagaaattcagtttattcagcgctgccgtgcgggaatcccatgagaaagaaaggactcgcgcagaaaggacaaagaactggtctctgatcgggtctgtgctgggggcactgattggggttgcagggtcaacctacgtgaatagggtgcggttgcaggagctgaaggccttactcctcgaagcacagaagggtcccgtctccctgcaggaggccatccgcgagcaggcatcctcttacagtcgacagcagagagatcttcacaatctcatggtggaccttcgcggtttggttcacgcagccggtcccggtcaggactctggaagccaggccggaagcccaccgacacgcgatagagatgtggatgtcctgagcgccgcactcaaggagcagctgtctcatagtcgtcaggttcatagttgtcttgagggtctgcgtgagcagctcgatggccttgagaagacctgttcccagatggctggagtggttcagctggtgaaatccgccgctcaccccggtctggtggagccagccgatggggcaatgccatcgtttctgctggagcagggttcaatgatcctcgctctgtccgacaccgaacagagattggaagcccaggtcaaccgcaacactatctactccacactcgtgacgtgtgtgacctttgtggccaccctccccgttctctacatgctcttcaaggcatcatag

SEQ ID NO: 49560 - DNA, 909 bp, Artificial Sequence
  Description of Artificial Sequence: Synthetic coding sequence
atggttgcgagggggctagtgagagaggctagagaagatctggaagtgcatcaggcgaagctgaaagaggttagggatcggttggatcgggtgtcgcgagaggactcccagtacctggaactggcgacattagagcatagaatgctccaggaagagaagcgactccgaacggcctacctgcgtgcggaggattccgagagagagaaatttagcctgttttccgctgccgtgagggagtcgcatgagaaggagcggaccagagccgaacggacaaagaactggtcccttattggcagcgtgttgggcgctttaattggtgttgccggtagcacatatgtaaatcgcgttcgactgcaggagctaaaagccctgctgcttgaggcccaaaaaggcccagtgagtctgcaggaggctatcagagagcaagccagtagctatagcaggcagcagagagatctacataaccttatggtggacctgcggggtctggtgcatgctgcgggaccgggtcaggattcgggatcccaagcaggctctccccctacaagagatcgcgacgtcgatgtgctgtctgctgcccttaaggaacaacttagtcactcccgccaggtacacagttgcctcgagggactgagggaacagctcgatggtctggaaaagacatgctctcaaatggcaggcgtcgtgcaactggtcaaatccgcagcccaccctggcttagtggagcccgctgacggcgcaatgccttccttcctcctagagcaaggttccatgattctggctttgagtgataccgagcagcgactggaagcccaagtgaatagaaacaccatctacagtacactggttacctgtgtgacttttgtggcaaccctgcccgtactgtacatgcttttcaaagcttcttag

SEQ ID NO: 49561 - DNA, 189 bp, Artificial Sequence
  Description of Artificial Sequence: Synthetic coding sequence
atgatgggtaggtctccaggcttcgcaatgcagcacatagttggtgtgccccacgtgttggtccgtaggggactcctggggagagatctgttcatgacgagaactctgtgctctcccggtccctctcagcccggagaaaagagacccgaggaggtggccctggggctgcaccatagactgccagcttag

SEQ ID NO: 49562 - DNA, 909 bp, Artificial Sequence
  Description of Artificial Sequence: Synthetic coding sequence
atggtggctagaggtctggtcagggaagcacgcgaagatctcgaggtacatcaggcaaagttgaaggaggtgagggacagactcgatagagtctcaagggaggactcgcagtacctcgagcttgcaactctcgagcaccggatgctgcaggaagagaagcggctccgaacagcttacctccgcgctgaagatagcgagcgcgagaagttcagcctgttcagcgctgccgtccgcgaatcccacgagaaggaacgcactagagctgaaaggaccaagaactggtccttgatcggaagcgttttgggggcattgatcggcgtagccggttcaacatatgtaaaccgagtgcggctgcaggagcttaaggccctgctgctggaagcacaaaaaggacccgtgtctttgcaggaggctatccgagaacaggcgagcagctacagccggcagcagcgggatctgcacaacctcatggtggatctcagaggcctggtgcatgccgctggcccaggccaggacagtggctcacaggctgggtcgccgccaactcgtgatcgggacgttgacgttctgagcgccgctctcaaagaacagctcagtcattcacggcaggtgcactcttgtctcgagggcctgagagaacagttggatggcctcgagaagacctgtagccagatggctggcgtggtgcaactggtgaaaagtgcggctcatccgggtcttgtggagccagctgacggagccatgccatcctttctgctggaacagggctcaatgatcttagcactgagcgacacagaacaacggctggaagcccaggtgaatcgcaatacaatttattccacccttgtgacgtgcgtgacttttgtggccactctgcccgtcctctacatgctctttaaagcttcctag

SEQ ID NO: 49563 - DNA, 480 bp, Artificial Sequence
  Description of Artificial Sequence: Synthetic coding sequence
atgatggggaggtctccaggcttcgcgatgcagcacattgtgggggtgcctcacgttctcgtgagacgtggtctgctcgggagggacttgtttatgacaaggacactctgcagcccgggaccatctcagcccggagagaagcgtcccgaggaagtcgcacttggattacatcataggctgcccgctcttggacgcgcactaggacacagcatacagcaaagagctacatctactgcgaagacatggtgggaccggtatgaggagtttgtcgggctaaacgaagtcagggaggctcagggcaaggtgactgaggcagagaaagtgtttatggtggcgagagggctagtgcgcgaggccagagaggatctggaagttcaccaggctaaactcaaagaggtgcgcgaccgtttggacagagtctcaagggaagattcccagtaccttgagctggccacacttgagcaccgaatgttacagtag

SEQ ID NO: 49564 - DNA, 909 bp, Artificial Sequence
  Description of Artificial Sequence: Synthetic coding sequence
atggtcgccagagggctcgtcagagaggcgagagaggatctcgaagttcaccaggccaagttgaaagaagttcgcgacaggttggaccgggttagtcgagaggatagccagtatctggagctggcgacactggagcaccgaatgctgcaggaggagaagcggcttcgcaccgcttacttgagagctgaagactcagagcgagaaaaattctccttgttcagcgcagcggtgcgcgagagccatgagaaggagcggacccgcgctgagagaacaaaaaattggtccttgattggttcagtgctcggcgctctgatcggggtggcgggatccacttacgtgaatcgggtcagactgcaggaactcaaggccttgttactggaggcccagaaaggccctgtgagtctgcaggaggcaattagggagcaagctagcagctactctcggcaacaaagagacttacacaatctgatggtcgatctccggggactcgtgcacgcagctggtcctggccaggactctggaagccaggcaggaagtccgcctactcgcgaccgggacgtcgatgtcctcagcgcggctttgaaggagcagttaagccactcgaggcaggtgcattcctgtctggaaggccttagagaacagctagacggtttagagaagacctgttctcagatggctggcgtcgttcagctcgttaagagtgctgcccatcctggactcgtggagcccgcagacggagccatgccgtcatttttgcttgagcagggctccatgatcctggcactgtctgacaccgaacagcggctggaagcacaggtgaaccgcaataccatttattctacgctggtgacatgcgttactttcgtagcaaccctgccagttttatatatgctcttcaaggcctcttag

SEQ ID NO: 49565 - DNA, 321 bp, Artificial Sequence
  Description of Artificial Sequence: Synthetic coding sequence
atggcctctagcggcgctggggaccccctggactcaaaacgtggggaagcacccttcgctcagcggattgatcccacacgcgaaaagctaactcccgaacaactgcacagcatgcggcaggctgaactggcacagtggcagaaagtgcttccacggagaagaactcgcaacattgttacaggattagggatcggagcgttagttctagcaatatatggttataccttctacagtataagtcaagagcgcttcctggatgagctggaagatgaagcgaaagcagcgagggcaagggccctcgcgcgtgcctccggcagctag

SEQ ID NO: 49566 - DNA, 435 bp, Artificial Sequence
  Description of Artificial Sequence: Synthetic coding sequence
atggcagctccttctggtggagtaaactgcgaagagttcgccgagtttcaggagctcctcaaagtcatgcggacaattgatgacagaatcgttcatgagctgaatactacggtgcctacagcatctttcgcgggtaaaatcgatgcatcccaaacttgtaaacaactatatgagtcattaatggccgcacacgcttcaagggacagagtcattaaaaactgtattgcccagacatccgccgtcgtgaagaatttgagggaagagcgcgagaagaatctggatgacctgaccctgttgaagcagctgaggaaggagcagactaagctgaagtggatgcaaagcgaattgaacgtagaagaagtggtcaatgacagatcttggaaagttttcaatgagcgctgtagaatccattttaaaccccctaagaacgaatag

SEQ ID NO: 49567 - DNA, 774 bp, Artificial Sequence
  Description of Artificial Sequence: Synthetic coding sequence
atggattgcggcagtgtgggtggacaaaggacacagcgcctgcccggtaggcaaaggctgctcttcctccctgtgggactctctggtcgccctggcggttccgagacctctgcaaggcggtgcctatccgcactcagcgatggactgggtgctctgagaccaagggctcccgctgcaaggggtggcgtgagtagggcttcacctctcctactactgctccttgtccccagccctcggctggcagctgctgctccccgacggcagctgggggattgggaaaggtccaggctgggctacgctgcaccaccggcaggcagaagtagcgcatggcgttgctctcctggcgtcgccgctgccgctggagccttacctcagtatcatggcccagcccctgccttggtaagctgccggagggagctctcattgagtgcaggcagcttgcagctcgaaagaaaacggcgtgatttcaccagctccggttcaaggaagctgtactttgatacacacgcactagtatgtctgttggaagataatgagtctcactctttcatacaagccggagtgcaatggcactcactcgggctgctccagcctccaccacctggattcaaacgtagttcccatttgatccttctttctagctgggactaccgacacgccccacctcacctggacaatttctctgtgttcttgctggagacaggctttcaccacgtgggccaggctggactgaagctcctgaccagttccgatcccccaaccctggcgtcctag

SEQ ID NO: 49568 - DNA, 1080 bp, Artificial Sequence
  Description of Artificial Sequence: Synthetic coding sequence
atggattgtggcagcgttggtggccaacgcacccagcgcttgccaggcaggcagagattgctgtttctgcctgtgggtctttcaggtagacccggtggtagtgaaacatctgccagaagatgtctgtccgctctgtccgacgggcttggggcacttaggccaagggcaccagcagcacgtggtggagtgtctagggcctcaccccttttactcctcttgttagtcccgtcaccacgcctggcagcagctgctccacgaagacaactgggagattgggagagatccaggctcggctacgcggcaccccctgctggaaggagttcagcatggaggtgttctcctggcgttgcggctgcggcaggagcattgcctcaatatcatgggcctgcccctgctctcgttagctgtaggcgggagctgagtctctccgccggaagccttcagctcgaaagaaaacgtcgggattttacctcatcagggtcccgtaagctgtattttgacactcacgcactcgtttgcttgctcgaggataatggtttcgctacacaacaggccgagattatcgtttctgccctggtgaagatcctcgaggctaatatggacattgtttataaggacatggtaaccaaaatgcagcaggaaatcaccttccagcaagtgatgagccagattgcgaacgtcaagaaggatatgatcattttggaaaagtcagagttcagtgctttgagggcagagaacgagaagataaaattggaactccaccagctcaagcaacaggtcatggatgaagttattaaggtgagaaccgatactaagttggactttaacctagagaagagcagagtaaaggagctgtattcattaaacgagaaaaaattgctggaattaaggaccgagattgttgccttgcatgcccagcaggatagggcactgactcagactgacagaaagattgaaaccgaggtggcagggctaaaaaccatgttggaaagtcacaagctggacaatataaagtatctggcagggagcattttcacatgtctgaccgttgcgctcggcttttataggttatggatatag

SEQ ID NO: 49569 - DNA, 738 bp, Artificial Sequence
  Description of Artificial Sequence: Synthetic coding sequence
atgttagcgaactgcggtagtgtatgtgaggaaacacagttccgcggaactacagtggcacccgctttgggagagttcttcaccaccacgactaaagagggttatgaccgccgtcccgtggatatcacccccttggagcagcggaagttaacatttgatacacatgctcttgtgcaagacctcgagacacacggctttgataagacacaggcagaaactatcgtaagtgccctaaccgccctgagcaacgtctccctggatacaatctacaaagaaatggtgacacaggctcagcaagagatcacggtgcaacagttaatggcccatctcgacgccatcaggaaagatatggtgattttagaaaagagcgaattcgctaatctgcgagccgagaatgaaaaaatgaagatcgagctcgatcaggtgaagcagcagctgatgcatgagacatctcggattcgagccgataacaaactggatattaacttagagcgctccagagtgacagacatgtttaccgaccaggagaagcaacttatggagacgacgactgaatttaccaagaaggatacccaaaccaagagcataatttctgagacatcaaataaaatcgatgccgagattgcctcgctcaagacactgatggaatccaacaagctggaaactatccgctacctagcagcaagtgtgttcacctgtctggcaatagcactcggtttttaccgattctggaagtag

SEQ ID NO: 49570 - DNA, 462 bp, Artificial Sequence
  Description of Artificial Sequence: Synthetic coding sequence
atggtgacccaggcccaacaggagattacagttcagcagctgatggcccacttggacgcaataaggaaggacatggtgattctcgagaagtctgagttcgccaacttgcgagctgaaaatgaaaaaatgaagatcgagcttgatcaggtcaaacagcagcttatgcacgaaaccagtcggatcagagcggacaacaagctcgatattaacctagagagaagtagggtgaccgacatgttcactgatcaagaaaagcagctcatggagaccacaacagagttcacaaagaaggatactcaaactaagtctatcatcagtgagaccagcaacaagatagatgccgaaatagccagccttaaaactctgatggagtctaacaagctcgaaactatccggtatctagctgccagcgtttttacatgcctggctatcgcactcggcttctatagattctggaaatag

SEQ ID NO: 49571 - DNA, 462 bp, Artificial Sequence
  Description of Artificial Sequence: Synthetic coding sequence
atggttactcaggcgcaacaagaaataactgtccagcaattgatggcccacctggacgcgattcggaaggacatggtgatcctcgagaagagcgagttcgcaaatttacgggcagaaaatgagaagatgaaaatcgaactggatcaggtgaagcagcaactcatgcatgagaccagccgtatcagagccgataataagctcgacatcaacctggaacggtccagagtcactgacatgtttacagatcaagagaaacagctgatggagactacgactgagttcaccaaaaaggacacacaaaccaagagcattatctcggaaactagtaacaagattgatgctgagattgcatcacttaagacactgatggaatccaacaagcttgaaactatccgatatctggccgcaagcgttttcacgtgccttgcgatcgccctgggtttctatagattctggaagtag

SEQ ID NO: 49572 - DNA, 765 bp, Artificial Sequence
  Description of Artificial Sequence: Synthetic coding sequence
atgaactcccggcaggcatggcgactatttttaagtcaaggcagaggcgaccgctgggtttcacgccctcgcggtcatttcagcccagccctcagaagggagttttttaccacaacaaccaaggagggctacgataggcggccagtggacatcacgcctctggagcagcggaagctgacattcgacactcatgctctggttcaggaccttgaaacacatgggttcgacaaaacacaggccgaaaccatagtctctgcattgaccgccctctctaatgtgtccctggataccatttacaaagagatggttactcaagcacagcaagaaattaccgtgcagcagctaatggcccatttggatgcaattagaaaggacatggtgatcctggagaaatccgagtttgctaaccttagggctgagaacgagaagatgaaaattgagctggatcaggtaaagcagcagttaatgcacgagacctctcgtattcgggctgataataaactcgatatcaatctcgagagatcccgtgtcactgatatgttcacagatcaggagaagcagctgatggaaacaaccacggagttcactaagaaggatacgcagacgaaatctattataagtgaaacatccaacaaaattgacgcagaaatcgcctccctgaaaacactgatggagtctaataaactggagacaattcgatacctggcagcatctgtgttcacttgcttagctatagccctgggtttttatcggttctggaagtag

SEQ ID NO: 49573 - DNA, 1236 bp, Artificial Sequence
  Description of Artificial Sequence: Synthetic coding sequence
atgcctatgtggaataaagtaagtggtgttcatttgagtcctagttctcccgaaattgtactggaccgggaccattcctcctcaatcggatgtcttagcagtgatgccataatcagttccccggaaaatacacatgccgctaattctattgtgagccaaactatccccaaagcccaaatacaacagtcgactcacacacacttggacatttcacttttccccctcggattgacagatgaaaaatctaatggaaccatcgccctggtggatgactccgaggatcccggtgctaatgtcagtaatattcagctgcagcagaaaattagctctctggagatcaaattaaaggtgtcagaggaggaaaaacagaggatcaagcaggatgtcgagtccttgatggagaaacacaacgtcctagagaaaggctttctgaaggagaaggaacaagaagccatctcatttcaggacagatataaagagctccaggaaaagcataaacaggagctggaggatatgaggaaggcgggacatgaggccctgtccattatcgtagatgagtataaggccctcctgcagtcgagcgttaagcagcaagtagaggctatcgagaagcagtatatctcggccattgaaaagcaggcccataagtgcgaggagctcctcaacgctcagcaccagaggctgctcgagatgttggacactgagaaagagcttctaaaggagaagataaaggaggcactcattcagcagagccaggagcagaaagagattctagaaaaatgcctggaggaagaaagacagcgcaataaagaggctttggtttcagccgcaaagctcgagaaagaagccgtcaaggacgccgtcctcaaggtcgtggaggaggaaagaaagaacctggaaaaggctcatgccgaggaacgggagctgtggaagaccgaacatgccaaggatcaggagaaggtaagccaagagatccagaaggccatccaggaacagcggaagatctcgcaggagacagtaaaggccgctataatcgaggagcaaaaaagatccgagaaagcggttgaggaagcggtcaagcgcactcgggacgagctcattgaatacatcaaagaacagaaacggttggatcaggtaatccggcaaaggtccctgagcagtctggagctatttctatcgtgcgcacagaaacagttgtcagcactaatcgcaactgagcccgtcgacatcgaatag

SEQ ID NO: 49574 - DNA, 1218 bp, Artificial Sequence
  Description of Artificial Sequence: Synthetic coding sequence
atggacgatgacgacttcggtgggttcgaagccgcagagaccttcgatggcggtagtggcgagacccaaactacctctcccgcaatcccttgggctgccttcccagccgtctccggagtccacctgtccccctcaagtccggagatcgtgttggacagagatcactcatcctccatcggttgcctgtcctctgacgcaattatatcttcacccgaaaatacacatgccgcaaactcaatcgtctcccaaactattccaaaagcccagattcagcagtctacacatacccatttagacatttctcttttccccctgggactgacagatgagaagagtaatggtaccattgctttagtggatgatagcgaagatccaggagcaaatgtctcgaacatccagctgcaacaaaagatcagctccctggagatcaaacttaaggtgtctgaggaagagaagcaaaggattaagcaggatgtagagtccctgatggagaaacacaacgtgctggaaaaaggctttctcaaagagaaagaacaggaggccatctcctttcaggaccgctacaaggaattgcaggagaagcacaaacaggaactcgaagacatgcgcaaagccggacatgaggctctgtcgatcatagttgatgagtacaaacatcagaggttattagaaatgctcgataccgagaaagagttattaaaggagaagattaaggaggctctcatccagcagagccaggaacagaaagagatcctagagaagtgtttagaggaggagaggcagcggaacaaagaagctctggtgtcagcggctaaactggagaaggaagctgtaaaagatgctgtgcttaaagtcgtggaggaagaacgtaagaacctcgaaaaggcccacgctgaagaacgagagctgtggaagactgagcacgccaaagatcaggaaaaagtgtcccaggaaattcagaaggcgatacaagaacaaagaaagattagtcaggagacagtaaaggcagcaatcatcgaagagcaaaaaaggagcgaaaaggcagttgaagaagcagtgaaaaggacccgcgacgagctgatcgaatacatcaaggaacagaagcgactcgaccaggtgatcagacagagaagcctctcttcactggagctatttctcagctgcgcccaaaaacagcttagtgcgcttattgccaccgagccagtggacatcgaatag

SEQ ID NO: 49575 - DNA, 1326 bp, Artificial Sequence
  Description of Artificial Sequence: Synthetic coding sequence
atggatgatgacgatttcggaggattcgaggccgctgaaacatttgacggaggatcaggcgagacacaaactacttcccctgccatcccttgggccgctttccccgcagtttcaggagttcatctctccccctcctccccagaaattgttctggaccgcgaccactcgagctccattggatgtctgtcttctgacgctatcatttctagccctgagaacactcatgcagcaaacagcatcgtgagccaaacaatcccgaaagcacaaatccaacaatctacacacacccatctggatatttcactcttccccctgggcttaactgatgagaaatccaacgggacaatcgcactggtcgacgatagtgaagaccccggagctaacgtcagcaacattcaacttcaacagaagataagtagtctggagattaagctaaaagtgtccgaggaggagaagcagcgcattaaacaggatgtggaatcgctcatggagaaacataacgtcttggagaaaggctttctgaaggagaaagaacaggaggcaatcagcttccaggatcggtataaggagctgcaagaaaaacacaaacaggaacttgaggacatgagaaaggctggtcacgaagctctcagcatcattgttgacgaatacaaagctctattacaaagttcagtgaaacagcaggtggaggcaatcgaaaagcagtatatctccgccattgaaaaacaagcacacaaatgtgaggaattactcaatgctcagcatcagagattgctggaaatgttagatacggaaaaggagctgctgaaagagaaaattaaagaggctctgattcagcaatctcaggagcagaaagaaattctggaaaaatgtctagaagaggaaaggcagagaaacaaggaagccctcgttagcgccgcaaagctagaaaaggaggcagtaaaggatgcggtgctcaaagtggtcgaggaggagcggaagaacctggaaaaggctcacgctgaagagagggagctctggaagactgaacatgctaaagatcaggaaaaagtctcccaggagatccagaaggccatacaggaacagagaaagatttcccaggagaccgtaaaggccgcaattatagaggaacagaaacggagcgaaaaggccgtcgaggaggctgtcaaacggacccgcgacgagctaatcgaatatatcaaagagcagaaacgattggaccaggttatccgccagcgatccctttcaagtttggagctcttcctgtcatgcgcccaaaaacagcttagcgctcttatcgccactgaaccagtcgacatagagtag

SEQ ID NO: 49576 - DNA, 1086 bp, Artificial Sequence
  Description of Artificial Sequence: Synthetic coding sequence
atggacgatgacgactttggagggtttgaggcagccgagacgttcgacggtggatctggagagacacagacaactagtcccgcaattccttgggccgcattcccagcagtgtccggagtgcatctctccccctcatcccctgagattgtgctcgaccgcgatcacagcagctcgatcggttgtctgtcttccgatgctatcatctcttcccctgaaaacacccacgcagccaatagtattgtatcccaaacgattcccaaggcccaaatccagcaaagtacacacacccatttggacatttctctgttccccttgggcttaacagatgaaaagtctaatggaaccattgcactggtggatgactctgaagatccaggagcgaacgtttcaaatatccagctgcaacagaagatctctagcctagagattaaactgaaagtgtcagaagaggagaagcagagaatcaaacaggacgtggaatcccttatggagaagcacaacgtgttggaaaaaggatttctgaaagaaaaggagcaggaagcaatttcgtttcaggaccgttacaaagagctgcaggaaaaacacaaacaggaattagaggatatgaggaaggccggtcacgaggccctctcaatcatagtggacgagtataaggcactcctgcagtccagtgttaaacagcaggtggaagcaatagaaaaacaatacattagtgctatcgagaaacaggcccacaagtgtgaggagttgctgaatgcgcagcaccagcgccttctggaaatgctggacactgaaaaggagctcctaaaagaaaagattaaggaagcgttaatccagcagtcacaggagcagaaggagatcctggagaagtgcctggaggaggaacggcaacgtaacaaggaggctctggtgtccgcagctaaactcgagaaagaagctgtcaaagacgcagtgttgaaagtcgtggaagaggaaaggaaaaacctggagaaggcccatgcggaagagcgagagctttggaagacagagcacgctaaagatcaggagaaggtgtctcaggaaatccagaaggctatccaggagtag

SEQ ID NO: 49577 - DNA, 258 bp, Artificial Sequence
  Description of Artificial Sequence: Synthetic coding sequence
atggacgatgacgattttggcggattcgaagctgcagagacttttgacggcggaagcggagaaacacagaccaccagccctgctatcccatgggccgcttttcctgctgtatccggcgtgcacctctctccatccagccccgagatcgtcttagatcgcgaccattcttccagcatcggctgtctgtcaagcgacgcaattatatcgtccccagagaatacgcatgctgccaactccattgtctcccaaaccatctag

SEQ ID NO: 49578 - DNA, 1218 bp, Artificial Sequence
  Description of Artificial Sequence: Synthetic coding sequence
atggacgacgatgattttggcggttttgaagccgctgagactttcgacggtgggtcaggggagactcaaacgactagcccagcaattccgtgggcggcatttcctgccgtatctggggtacacctctcgccatcatctcctgagatcgttctggatcgggatcacagtagttccattggctgtctatcgagtgatgcaatcataagtagtccagaaaacacccacgcagcaaatagcattgtcagtcagacaatcccaaaggcccagatccaacagtcgacccacactcacctggatatttccctgtttccactcgggctcacagacgaaaagagtaatggcaccattgccctggtcgatgatagcgaagatccaggggctaacgtgtcaaacattcagctgcagcaaaagatttcatctctagagataaaactcaaagtctcggaggaggaaaaacagcgcataaagcaggacgtggaaagccttatggagaaacacaacgttttagagaagggttttctgaaggaaaaggaacaggaggcaatctccttccaggataggtacaaagagttgcaagagaagcataagcaggaactggaggacatgaggaaggccggacacgaagctctaagcatcatcgtggatgagtataagcatcagaggctcctggaaatgctggacacagaaaaggagttattgaaggagaagataaaggaggcgctgattcagcaaagtcaggaacagaaggaaatactggagaaatgtctggaagaggagcggcaacgcaataaagaggcgctcgtgtcagccgcaaaacttgaaaaagaggccgtgaaagacgctgtgctgaaggtggtggaggaggagagaaaaaatttagagaaggcccatgcagaagagcgcgagttatggaaaacagaacatgcaaaagatcaggagaaggtctcacaggagattcagaaggcaatccaagaacagcggaagattagccaggaaactgttaaggctgccattatcgaagagcaaaagaggtccgagaaggccgtggaagaggctgtcaagcggacgcgagacgaacttatagaatatattaaggagcagaaacggttggatcaggtgatcaggcaaagatctttatctagtttagaactgtttctcagttgcgcccagaagcagttgtctgctctgattgccacagagcccgtggacattgagtag

SEQ ID NO: 49579 - DNA, 276 bp, Artificial Sequence
  Description of Artificial Sequence: Synthetic coding sequence
atggatgacgatgacttcggtggatttgaggctgctgaaacgttcgacgggggttctggggaaacgcagacaacctctcccgcaatcccgtgggcagccttccccgcagtttctggggtgcacctttcaccatcctcccctgaaattgtcctggaccgtgatcactcttcttccataggctgcctcagctcagatgcaataatctcaagccccgagaatacacacgccgcaaattcaatcgtgagccagactataccaaaagcccagattcagtag

SEQ ID NO: 49580 - DNA, 1326 bp, Artificial Sequence
  Description of Artificial Sequence: Synthetic coding sequence
atggacgacgacgatttcggaggcttcgaggcggctgagacttttgatggaggatctggggaaacccagaccacgtctcccgctatcccctgggccgctttcccagcagtcagtggagtgcatctgtctccctcttcacccgaaatcgtactggacagagatcactcaagcagtatcggctgtcttagttcagacgcaattatctcaagtcctgagaacacacatgctgctaactctattgtttcccagactatcccaaaggcacagatccagcagtctacacacactcacttggacatatccttatttcctctcggtctcactgacgaaaaatcaaatgggacgatagccctcgtggatgactctgaagaccccggagcaaatgtgagcaacatccagctgcagcaaaaaattagttccttggaaattaaattaaaagtgtcagaagaagagaaacagcgcattaagcaagacgtagagtcactcatggaaaagcacaacgtactggagaaagggtttttgaaagaaaaggagcaggaggctatttcctttcaggatcgctacaaggagcttcaggagaagcataaacaggagctggaagacatgcggaaagccggacatgaggctctcagcataattgtggatgaatacaaggccctcctgcagagcagcgttaagcaacaggtggaggctattgagaagcagtacattagcgccattgagaagcaagcacacaaatgcgaggaactgctgaacgcccaacatcagagattactggaaatgctagatactgaaaaggaactcctaaaggaaaaaataaaagaggctcttattcagcagagtcaggagcagaaggagatcctggagaaatgccttgaggaggaaaggcaaagaaacaaagaggccttagtgagcgcagccaagctcgaaaaggaggcagtgaaggatgctgtgctcaaagttgtagaggaggaacgtaagaatttggagaaggcacacgctgaagaacgcgagctgtggaaaactgagcacgctaaggatcaggagaaggtctcacaagagatccaaaaagcgattcaagaacagcgcaaaatctcacaggagacagtaaaagccgctatcattgaggaacagaagcgaagcgaaaaggccgtcgaggaggccgtcaagagaacacgcgacgagctcattgagtatattaaggagcagaaaagactcgatcaggttatccggcagagatctctgtctagcctggagctcttccttagttgcgcgcagaaacagctctctgccctgatcgctaccgaacccgtcgacatcgagtag

SEQ ID NO: 49581 - DNA, 357 bp, Artificial Sequence
  Description of Artificial Sequence: Synthetic coding sequence
atggcaaccccttccctaaggggacgactggccagattcgggaatccacgcaaaccagtgctcaaacctaataagcctctgattctcgccaatcgagtcggtgagcgacggagagaaaagggcgaggcaacctgcattaccgaaatgagcgtcatgatggcctgttggaagcaaaacgaattcagagacgacgcatgtcgcaaagagatccaaggctttctggactgcgcagctagggctcaggaggcccgaaagatgagatccattcaggaaacactgggagagtcggggtcattgttaccaaacaagctgaataagctgctgcaacggttccccaacaaaccctacctgtcatag

SEQ ID NO: 49582 - DNA, 294 bp, Artificial Sequence
  Description of Artificial Sequence: Synthetic coding sequence
atggctacgcctagcctgcggggacgattggcccgatttgggaacccgcgtaaacctgttctcaaacccaataagccacttatcctagctaaccgggtgggcgagcgcaggcgtgagaagggggaagccacatgcattaccgaaatgtctgttatgatggcatgttggaaacaaaacgagtttcgggatgacgcatgcaggaaagaaatccaggggtttctggattgcgcagctagggctcaggtaaccgatggttcatggggggctttcagcggaaaggaatggggccgatag

SEQ ID NO: 49583 - DNA, 429 bp, Artificial Sequence
  Description of Artificial Sequence: Synthetic coding sequence
atgcctcggggatctaggtctgcagcaagccggccagccagcagacccgctgctcctagcgcgcaccctccagcccatcctcctccctccgcggcagctccagccccagcaccatctggacaacctggtcttatggctcagatggctacgaccgcggctggagtggcagtggggtcagccgtgggccacgtgatggggtccgctctgacgggagcttttagcggcggatctagtgagcccagccagccagccgtccagcaggcccctacaccggctgccccacagcccttgcagatgggaccctgtgcttatgagatcagacagtttctcgattgcagtacgacacaatccgacttgagcttgtgcgaaggtttttccgaggcccttaagcagtgtaagtactaccatgggttgagcagcctcccctag

SEQ ID NO: 49584 - DNA, 456 bp, Artificial Sequence
  Description of Artificial Sequence: Synthetic coding sequence
atgcctcggggatcacgctccaggacttcgcggatggcaccccctgcctccagagcgcctcagatgagagcagctccccgacctgctcctgtggcccaaccaccagcggcagcaccaccatcagcagtcgggagctcagccgctgctcccaggcagccaggactcatggcccagatggcaacgacagccgcaggagtggcagttggttccgcggtcggccacacactaggccatgcgattactggaggcttttcaggcggatctaacgccgagcccgcacgccctgacatcacttaccaagaaccccagggcactcagcctgcccagcagcagcagccctgtctgtatgagatcaaacagttcttagagtgtgctcagaaccagggagatatcaagctgtgcgaaggttttaatgaagtgctgaaacaatgtcggttagccaatggcctagcatag

SEQ ID NO: 49585 - DNA, 468 bp, Artificial Sequence
  Description of Artificial Sequence: Synthetic coding sequence
atgcccgtgtcctactcttcagtcaccactcgctattaccacagggccggagccgaggagggaaaggatagaatcattttcgttaccaaggaagaccatgagaccccttcaagtgcagaactggtggcagacgaccctaacgatccgtacgaggaacacggccttattctgcctaacggaaatattaactggaactgcccgtgccttggtggaatggcttctggtccgtgcggcgagcagtttaagagtgcgttttcctgcttccattatagcaccgaggagattaaagggtccgattgcgtggaccagtttcgggcaatgcaagaatgcatgcagaaatatcccgacttatacccgcaagaggacgaggacgaggaagaggagagagaaaaaaagccggctgagcaggcggaggagaccgcaccgatagaggctacggcaactaaggaagaagagggtagttcgtag

SEQ ID NO: 49586 - DNA, 429 bp, Artificial Sequence
  Description of Artificial Sequence: Synthetic coding sequence
atgagttactgtcgacaggaaggtaaagaccgcattatctttgtgacaaaagaagaccatgaaaccccttcgtccgccgaactggtcgctgatgaccccaacgacccctacgaagaacatggactgattctgcctaatggaaacattaattggaactgtccgtgtctcggagggatggcgtcaggaccctgcggtgagcagttcaaatcagccttctcttgcttccactattcgaccgaggaaattaaagggagtgactgcgtagaccagttccgagccatgcaagagtgtatgcagaaatatcctgacctgtaccctcaggaggatgaggacgaggaagaggagagagaaaagaaaccagccgagcaagccgaggagacggctcctatagaagccacagccactaaagaagaagagggctcatcctag

SEQ ID NO: 49587 - DNA, 1449 bp, Artificial Sequence
  Description of Artificial Sequence: Synthetic coding sequence
atggccagcttctcggctgaaacaaattctactgacctgttgtctcagccgtggaatgagcccccagtgatcctatcaatggtgatcctttcactgaccttcctcctaggactgcccggaaatggcctcgttctttgggtggcgggactaaaaatgcagcgcacggtgaacacaatctggttcttacacctcacacttgccgacctcctctgctgtttgtccctcccgttctcccttgcgcatcttgctctccagggacaatggccatatgggaggtttttgtgtaagcttatcccgagcattatagttctgaatatgttcgctagcgtgtttctgctgacagcaatatcgctggataggtgcttagtggtgtttaagcccatttggtgtcagaatcatcggaacgtggggatggcttgttctatatgtggttgcatatgggtggttgcatttgtgatgtgcattccagtgttcgtgtatcgtgagatctttaccacagacaatcacaatcggtgtggttataagttcggtctctcaagttccttggactatccagacttttatggcgaccccctggagaatagatcactcgagaatatagtgcagccaccgggtgaaatgaatgatagactcgaccccagtagctttcagacaaatgaccatccgtggaccgtaccaaccgttttccagccccaaacattccaaaggccttcagctgactctttaccccgaggttccgcccgtctaacctcccagaacctgtattccaacgtgttcaaaccggctgacgttgtcagtccgaagatccctagtggatttccaatcgaggatcatgagacctccccactcgacaattccgacgcttttctgtctacccacctgaaattgtttccctcagcctcttccaattctttctacgaatctgagcttcctcaaggatttcaagactattacaacttagggcaatttactgatgacgaccaagttccaacccctctggtggcaattaccatcactcgtctggtggttgggttcctgctgccttcggttatcatgatcgcctgctacagcttcatcgttttccgaatgcagaggggaagatttgccaagagccagagcaaaacctttcgcgttgccgtggtcgtagtggccgtatttttggtttgttggacaccgtatcacatcttcggagttctttctctgctgaccgacccagagacacccctcggaaagacactgatgagctgggaccacgtttgtatcgcactggcaagtgccaatagctgtttcaacccttttttatatgccctgctgggaaaagactttcggaaaaaagctcgccagtctatacaaggcatcctggaggccgctttttccgaagagctgaccagatccacacattgcccatccaacaacgtcatatccgaaagaaattcaacaaccgtgtag

SEQ ID NO: 49588 - DNA, 441 bp, Artificial Sequence
  Description of Artificial Sequence: Synthetic coding sequence
atggcatccttcagtgccgagaccaactcaacggacctcctgtcacaaccgtggaatgagcccccagttatcctttctatggtgatcttatcactgacttttctcctcggattacccggaaacggattagtcctgtgggtggctggcttgaagatgcagaggactgttaacaccatctggttcttacacctaactctggcagacctactttgctgtctgtctttacccttttctctcgcccacctggcactgcagggccagtggccgtatggcagattcttgtgtaagttgatacctagtatcatcgtgcttaacatgtttgcatccgtgttcctcctgacggccatctctctggacaggtgccttgttgttttcaaacctatctggtgccaaaaccacaggaatgttggaatggcttgcagtatctgcgggtgtatctag

SEQ ID NO: 49589 - DNA, 1053 bp, Artificial Sequence
  Description of Artificial Sequence: Synthetic coding sequence
atggactcgttcaattacactacacctgattatggccactacgacgacaaggatactttagacttgaatactcccgtagacaagacatctaataccctgcgggtccccgacatcttagccctcgtaattttcgccgtggtatttctcgtgggggtgctcggcaatgccctggttgtgtgggtgaccgcattcgaggcaaaaaggacaatcaacgccatttggttcctcaacttggccgttgccgatttcctatcctgcctcgccctgccgattctgttcacttcgatcgtgcagcaccatcattggccatttggaggcgcagcctgttccatcctgccctccctgatcctgttaaatatgtacgcctccatcctactgctcgccacaatttcggctgaccggtttttactcgtctttaagcccatttggtgtcagaacttccgaggcgctgggcttgcgtggattgcctgtgcagtggcctggggcctggcccttctcctcacaatccctagtttcctgtaccgcgttgtacgggaggaatacttccctccaaaggtgctgtgcggcgttgattattctcatgataagcgtcgtgagagagccgtggccatcgtgcgcctcgtgctgggttttctctggcctttgttgacactgacaatatgctacacctttatactcttgagaacatggagcagacgcgcaacgcgcagtactaagactctgaaagtcgtggttgctgttgtggcttcgttcttcatattctggctgccttatcaggttaccggcatcatgatgagcttcctggaaccatcgagccctacatttctgctgctcaagaaattggactccctgtgtgtgtcattcgcctacataaattgttgtatcaacccaattatttacgtcgtggctggacagggatttcagggacggctccgaaagtccctaccaagcctgctgcgaaatgtcctgacagaggaaagcgtcgtgcgagagtccaagtcatttacccgatccacagttgatacaatggcccagaaaacacaggctgtttag

SEQ ID NO: 49590 - DNA, 477 bp, Artificial Sequence
  Description of Artificial Sequence: Synthetic coding sequence
atggccttcatggttaagaccatggtgggcggacagttaaagaacctgacgggatcattgggagggggagaagataaaggcgatggcgacaagagcgctgctgaagcgcaggggatgagtagagaagagtatgaagagtatcagaaacagctggttgaagaaaagatggagcgggacgcccaattcacccagcgtaaggccgagagagcaaccctgaggtctcacttccgtgacaaatacaggctccccaagaacgagacagacgaatcccagattcagatggccggaggagacgtagaactgccacgggagctggctaaaatgattgaggaggacacagaggaggaagaagagaaggcatcagttctcggccagttagctagcctgcctgggctgaacttaggaagcctgaaagataaggctcaagcgacactgggagacctcaagcagtcagccgagaagtgccatgtgatgtag

SEQ ID NO: 49591 - DNA, 2142 bp, Artificial Sequence
  Description of Artificial Sequence: Synthetic coding sequence
atggagcctgtggagacctggactcctggcaaggtggcaacatggctccgcggactggacgattccctgcaggactatcccttcgaggattggcagctccctggcaagaacctgttgcaattgtgcccccagtcactggaagctctcgccgtccgttcgctgggacatcaggagttaatactggggggagtggagcagctgcaagcacttagctcacgactgcaaacagaaaaccttcagagcttaactgaaggacttctgggtgcgacccacgacttccaatccatcgtgcagggatgtctcggcgactgcgccaagacacctatcgacgtcctctgtgctgcagttgagctattacacgaagcggatgcgctcctgttttggctatctcggtatctcttttcacacttaaatgatttctctgcttgtcaggaaatacgagatctgctcgaagaattatctcaagtgctgcacgaagacggtcctgcggctgagaaagagggaactgttctgcggatctgtagtcatgtagcagggatctgccacaacatcctggtctgctgccctaaagaactcctggaacagaaagctgtcctcgagcaggtccagctggatagccccctgggacttgagattcacacaaccagcaattgccagcactttgtctcgcaggtggatactcaggtccccacagacagtagactgcagattcaacctggggacgaggtggtgcagattaatgagcaggtggtcgtgggctggcctagaaaaaacatggttagagaacttctcagagagcccgcaggtctgagccttgtgctaaagaagattcctattcctgagacacctccccagacccctccgcaggtgctcgatagtcctcaccaacgcagcccctctctgtctctggctccgttgtcaccacgcgcaccaagcgaggacgtattcgcattcgatttatcaagcaacccttcacccggaccttcgccagcgtggacggattctgcatccctgggccctgaaccattaccgataccccctgagcctcccgctatcttgccagcaggcgtggctgggactcccggtctgccggaaagccccgacaaaagtcctgtgggtcgaaagaaatccaagggtctagctaccaggctgagcaggagaagggtctcgtgtagggaactgggccgacctgattgtgacgggtggctcctcctccgaaaagcacccggaggtttcatggggcctcgatggaggagaagatggtttgtgctgaaaggtcacacgctatattggtatcggcagccacaagatgagaaagctgaagggttaattaacgtatctaattatagtctcgagtccggtcacgatcagaaaaagaaatatgtgttccaactcacccacgacgtttataagccctttatctttgctgccgatactctcactgacctgagtatgtgggtgagacatcttatcacatgtatctccaaataccagtcccccggtcgcgcaccacctcctagggaagaggattgctactccgagacagaagcagaagatcccgacgacgaagcaggatcacactctgcttctcctagtcccgcacaggccggatccccattgcacggcgacacgtccccagctgccactccaacacagaggagccctaggacttccttcgggtcgctcacagacagcagcgaggaggcattagagggtatggtccgagggctgagacaggggggtgtgagtctcctgggccagccccagcctctaacccaggagcagtggcggagctcgtttatgagacgaaatagggacccacagctgaacgagagggtacatcgagtgcgcgctctgcagtcaacactgaaagccaagctgcaagaattgcaggtgctcgaagaggtgttaggagaccctgaactcactggcgagaaattcagacaatggaaagaacagaaccgtgagctatactcagaaggactcggtgcttggggcgtggctcaggccgaaggctcctcacatattctgacttccgactccaccgagcagtctccacattcactccccagcgaccccgaggagcactcccacctgtgtccactgacctcggagagttctctccggccaccagatctctag

SEQ ID NO: 49592 - DNA, 2163 bp, Artificial Sequence
  Description of Artificial Sequence: Synthetic coding sequence
atggaacccgtggaaacttggacgccaggcaaagtggcaacctggctaaggggcttagacgacagcctgcaggactacccatttgaggactggcaactgcccggtaagaacctactgcaattgtgtcctcaaagcctcgaggctctcgctgttaggagccttggtcatcaggagctcattctgggaggcgtagagcagctacaggccctgagcagtagattacagactgaaaacctgcagtctctcaccgagggtctgctaggcgctacgcacgattttcagtctatcgttcaagggtgtctaggggactgcgcaaaaacacccattgacgtgttgtgcgccgctgttgagcttttgcacgaggctgacgccctattgttttggctgagtaggtatctgtttagccacttgaatgacttcagtgcttgtcaagaaataagggacctgctcgaggaactgagtcaagtgctgcatgaagatggcccagccgcagaaaaggaaggcacggtgctgagaatttgttcacacgtcgcaggcatctgtcacaatattctggtgtgctgcccaaaggagcttctggagcaaaaggccgtattggaacaggtccaactggacagccccctgggtcttgagatacacacaacctcaaattgtcagcacttcgtctcccaggtcgatacacaggttccaactgactctcgtctgcagatacaaccaggcgacgaggtagtgcagatcaacgagcaagtggtagttagggaggagcgtgatatggtgggatggcccaggaagaatatggtaagggaactcttgagagaaccagctggcctgtcgcttgtcttgaagaagatcccaatccctgagactcctccccaaacacccccacaagtcctggatagcccacatcagaggtcacccagtcttagtcttgccccactgtcgcctcgagctccctctgaggacgtcttcgccttcgacctgagcagcaatccttccccagggccatcacccgcatggactgactcagcctctctagggcctgaacccctcccaataccccctgagccacccgcaatcctgcccgctggcgtcgcgggaactcctgggttaccagaatcaccagacaagagccctgtgggaagaaagaagagtaagggactcgcaacacggttgagtcgacgtcgggtttcatgtcgcgagctgggaagacccgattgcgacggatggttgttgttgagaaaagctcctggcggatttatgggtccgcgatggcggcgacggtggtttgtcctgaaggggcacaccctatactggtataggcagccccaggacgagaaagcagagggtttgattaacgtgtctaattactcactggagtccggacatgatcagaagaaaaagtatgtatttcagctgactcacgacgtgtataaaccctttattttcgcggctgacacattaacagacttgtctatgtgggtcaggcacctcattacttgcatatccaaataccagtctcctggccgtgcacctcccccacgggaggaggattgttacagtgagaccgaagccgaggacccggacgatgaagcaggcagccactctgcgagcccttccccagcgcaagcaggatcaccattacatggagataccagccctgctgccaccccgacccagaggagccctagaacatcttttggttcgttgactgacagctccgaggaggccctcgaagggatggttcggggactgagacagggtggagtgtcattgctagggcagcctcagccattaactcaggagcagtggagaagttctttcatgcgacgtaacagagatccccagctcaacgagagagtgcatagggtccgagctctgcaatccactctgaaagccaagcttcaggagctgcaggtgctggaagaagtcctgggcgacccagagctgaccggtgagaagttccgccaatggaaggagcagaaccgcgaattgtattcagaaggtctcggcgcttggggggtggctcaggccgaaggaagctcccatattctgacctcagacagcaccgagcagtctccccactccctacccagcgacccggaggaacatagccacttatgccctctcacttccgaaagttcgcttcgccctcccgacctatag

SEQ ID NO: 49593 - DNA, 936 bp, Artificial Sequence
  Description of Artificial Sequence: Synthetic coding sequence
atggagccagtcgaaacctggactccagggaaagtggcaacctggctgagggggttggacgatagcctgcaagactatccatttgaagattggcagctgcccggtaaaaacctgctgcagctatgcccacagtctttggaggccctcgcagtgcggtcacttggccaccaggaactcatcttaggaggtgtggagcagctgcaagccttatcctcacgtttacagaccgagaacctgcagtcactcacggaggggttattgggcgcaacacatgactttcagtctattgtacagggctgcttgggtgattgtgccaagacaccaattgacgtcctatgcgcggctgtcgagctacttcatgaagcagatgccctgctcttctggctgagtcggtatctcttttctcatctgaatgacttttccgcctgtcaagaaatccgcgacttgttggaggagctctcacaggtacttcacgaggatctgcaacctcgcggttgggatttgccacagcaccctggattgttgccgcagggggctgccggtaccgaaggtagggctagggcgggagcggctggccagagtatcggacccaggaattcacatcaccacccccacacttgtttgcagacacctcccaacaggcacctcccgctgctgcgtccgccatcctcccttcagaccccccctcaagtcccagccccagccgctcctctgcccctcttacccccaaatctgctgagcgacccgtgtctgcattgtttcgtgccgggatgcagccctgatgcccctagtgggccaggactgcctgcacctgaagagcctattacggttagcggccctactgtctcacaggtgactggcagtgttcaggtgtgtctgggaggtgaaacagtgggttccagtcaccccccttgtccccctcaggggcctatctag

SEQ ID NO: 49594 - DNA, 4155 bp, Artificial Sequence
  Description of Artificial Sequence: Synthetic coding sequence
atgatgcacctgaggctcttctgcattcttctggctgctgtgagtggggctgaggggtggggttattatgggtgtgatgaggaattagtcggcccattatacgctaggtccttgggcgcatcatcttactattctctgctcacagctcccagattcgctcgactgcacggcatctctggatggtcccctcgcattggcgatcctaatccatggctgcaaatcgacctgatgaagaaacacagaatcagggctgtcgccacccagggctcgttcaatagttgggattgggtgacccggtatatgctcctgtatggggaccgcgtggactcctggacacctttttatcagcgagggcacaacagtacatttttcggtaacgtcaacgagtctgccgttgtccgccacgatcttcattttcacttcacagccagatatatacgcatcgtgcctcttgcctggaaccctagaggcaagattggcctccggctcggattgtatggatgcccatacaaagcggacatcctctacttcgatggagacgacgccataagttatcggttccccaggggggtgtctaggtctctgtgggatgtgtttgccttctcatttaagaccgaggagaaagacgggctgctgctccacgcagagggcgctcagggagactacgtgaccttagagctcgagggggcacacctcttattgcatatgagcctgggatcctcccccatccaaccgcgacccggtcatacaaccgtgagcgctggtggcgtcctgaatgatcagcattggcattatgttcgggtcgatcgatttggtcgggatgtaaattttactttggatgggtatgtgcagagatttatcctcaacggagattttgaaaggctgaacctcgataccgaaatgttcataggaggacttgttggtgccgcacgcaaaaatctcgcttataggcacaatttcagggggtgtatagagaacgtcatctttaatcgcgtgaacatagcagacttggctgtccgacgacactcccgcataaccttcgaggggaaggtggcttttaggtgcctggaccctgtgccacatcccataaattttgggggtccacacaattttgtgcaggtacccggatttcccagacgaggcagattggcagtgtcctttagatttcgcacctgggacctaacaggcctcttgctgttttcccggctgggagatgggctgggtcacgtggagcttactttgtcagaggggcaagtgaatgtctccatagcccagtccggcaggaagaagctgcaattcgctgccggatacaggcttaacgatggattctggcacgaggtaaactttgtagcccaggagaatcatgcggtgatcagtatcgatgatgtggagggtgcagaggtccgcgtcagttatcccctcctcatcaggacaggaacctcttatttcttcgggggatgcccaaaacctgcttcgcgatgggactgtcatagcaaccagactgcttttcacggttgcatggaactgctgaaagtggacggccagctggtaaacctcaccctggtcgaggggcgtcgcctgggattttatgccgaggttctgttcgatacttgcggaattactgaccggtgttcgccaaatatgtgcgagcatgatgggagatgctatcagagttgggatgacttcatctgttattgcgagttgaccgggtataagggcgaaacctgccatactcccctgtataaagaatcatgtgaggcctatcggctttctgggaagacctcaggtaatttcaccattgaccctgatggttccgggccactcaagccttttgtggtgtactgtgacatccgtgaaaacagggcgtggacagttgtgcgacacgatagactttggactactagggtgactgggtcaagtatggaacggccattcctgggcgctattcagtattggaatgcctcctgggaagaagtgtccgcactggccaatgcctcccagcactgcgagcagtggatcgagtttagctgttataactcgagactactcaataccgccggaggctacccatacagcttctggatcggcagaaacgaagagcaacacttttactggggtggcagtcagccgggaatccagcgttgtgcctgtgggctggatcgatcttgtgtggatccagccctgtactgtaactgtgatgccgaccaaccacagtggcggaccgacaaggggcttctgacttttgtcgatcatttaccagttactcaggttgtaatcggcgacacaaaccggagcacatccgaagcccagttttttcttagaccactgcggtgctatggagatagaaatagttggaacacgattagcttccacacaggagccgcactcaggtttccgcctatcagggccaaccatagcctggacgtgtccttctatttcaggacaagtgctccctctggggtttttctagagaatatggggggtccttattgtcagtggagacgcccatacgtgcgtgtcgagcttaacacttctcgggacgtggtctttgcgttcgacgtgggcaatggggatgagaacctgaccgttcattcggacgacttcgaattcaacgatgatgaatggcatctcgtacgcgcagaaattaatgtaaaacaggccaggctaagagtggatcacagaccctgggtgttacgcccaatgcctctgcagacatacatatggatggaatacgaccagcccctctacgttgggtccgcagaactgaagaggaggccctttgtggggtgcctgcgcgctatgcgactgaacggagtcacactgaaccttgagggcagagccaacgctagcgagggaaccagccccaactgcacaggccactgcgctcatcctagattgccttgtttccacgggggaaggtgtgtggaacgctattcctactatacctgcgattgcgacctgacagccttcgacggtccttattgcaatcatgacatcgggggattctttgaacctggaacatggatgcggtacaacttacaatccgccctgcggagtgctgcaagggagttctcccacatgttaagccgccctgtgcctggatatgaaccaggatatatacctggatacgacacaccagggtatgtgcccggttaccacggaccgggttaccgtctgccagactaccccagaccaggcaggcctgtgccaggctaccgcggaccagtgtataacgtgactggggaggaggtttccttttcatttagtacctcatctgctcctgctgttctcttgtatgtgtcctcattcgtgagggattacatggccgtcttaatcaaggacgacggcacactgcagctgcgctatcagctcggtacttctccttatgtttaccagcttacaacgcgcccagtgacagatggacaaccacacagcatcaatatcactagggtgtacagaaacctttttatccaggtggattactttccattaacagagcagaagttctccctcctggtggactcccagcttgatagtcccaaggctttataccttggacgcgtgatggagacaggggttatcgacccagagatccagaggtataatacaccgggattctcaggatgcttatccggcgtcagatttaataatgtcgctcctttgaagacccatttccgcacaccaaggccaatgacagctgagctggcagaggctcttcgggtgcagggggagttatcggagagcaactgtggagctatgccacgcctggtgagcgaagtgcctccagagcttgatccttggtacctgccgccagactttccatattaccatgacgaaggatgggttgctatactgctgggctttctcgttgcatttcttttgttgggtcttgtcggcatgctcgtccttttctatctgcagaatcaccggtacaaggggagctaccacacgaatgagccaaaggcagcacacgaataccatcctggctccaagccacccctgcctactagcggcccagcacaggtgccgacgccaaccgccgctcctaatcaagctccagcgtcggccccagctccagcgcctactcctgcaccggctcctggacctagagaccaaaacctgccacagatcttggaggagtctcgttctgaatag

SEQ ID NO: 49595 - DNA, 1143 bp, Artificial Sequence
  Description of Artificial Sequence: Synthetic coding sequence
atggcaagcgtggcctgggcggtcctgaaggttttgctgttactcccaacccagacctggtctccggtcggggctgggaacccccctgactgcgattccccactggcctcagcactcccaagatcaagtttcagctcctcctcagagcttagcagctcccacgggccaggcttttcgcgccttaatcgcagggatggagccggtggatggacaccgctcgtctcaaataagtaccagtggctccaaattgacctcggagaacggatggaggtgaccgctgtggctacccagggaggttatggatcttccgattgggtgacttcttacctcctgatgtttagtgacggcggtcggaattggaaacagtaccggagagaagaatctatttggggatttcccggaaatacaaatgctgactcagtggtgcactataggcttcagcccccattcgaggctagatttctgaggttcttaccacttgcatggaacccccgtggcaggatcggcatgcgcatcgaggtgtacggatgtgcctataagtccgaggtggtctactttgatggccaatccgcactgctctatactctggataaaaaaccactgaaacccattcgggatgtgatctcactcaagtttaaggcgatgcagagcaacgggatcctgctgcatagggaggggcagcatgggaaccatatcacgctggaactcataaagggaaaactcgtcttttttttgaattccggtaacgccaaacttccctctacaatcgcacctgtgaccctgactttgggaagcttgttagatgatcaacattggcatagcgttctgatcgagctcttagacacacaagtaaactttacagtggacaagcatactcaccacttccaggctaaaggggattcctccaacctcgacctgaattttgagatctcctttggaggtatcttgtctcctggacggtcccgagctttcacgcgcaagagtttccacggatgtcttgagaatttgtactataatggcgttgacgttaccgagctggccaagaagcataagcctcagatcttgatgatggaactggctcacgggctgcaggaccagaacttgaaaatcagcctgactgtgtgccatcagaccacgcagtag

SEQ ID NO: 49596 - DNA, 2241 bp, Artificial Sequence
  Description of Artificial Sequence: Synthetic coding sequence
atggcctcagtcgcttgggctgtcctgaaggtgcttttattgctgccaacacaaacctggtccccggtgggcgcaggcaaccctcctgattgcgactcccctctcgccagtgccctgccacggtcaagcttctcttcgtcgtccgaactgagctcaagccacggcccaggattctctcgcctgaatcgacgggacggggctggaggatggacacctctggtgtccaataagtatcagtggctgcagattgatctcggagaacggatggaagtgacggcagtagccacccagggaggatacggctcatcagattgggtgacctcctacctgctaatgttcagcgacggtggcaggaactggaagcagtataggagggaggaaagcatctggggattccccggaaataccaacgctgattctgtggtacattacaggctgcagcccccttttgaagctaggttcctaagatttctgcccctggcttggaatcctcgcggaagaatcgggatgagaattgaggtctacggctgtgcttacaagagcgaagtggtttactttgacggtcaatccgccctgctttacacgctcgataagaaacccttaaagccgatacgcgacgtgatctccctcaagtttaaagccatgcagtctaacggaattctattgcatagagaaggccagcacggcaaccacatcaccctcgagcttatcaaaggtaagctggtgtttttcctgaattcgggcaatgcaaagctgcctagcactatcgctcccgtcactcttacactcggctcccttctcgacgaccagcactggcatagcgtactgatcgagctgcttgacacccaggttaactttacagtggacaagcatactcaccatttccaggccaaaggagacagcagcaatcttgacctgaacttcgaaatctctttcggcggaatcctgagcccagggaggtctagggctttcacccggaagtcattccatgggtgcctggaaaacctttactacaacggtgtggatgtgactgagctggctaagaaacataagccccagatcctaatgatgggcaatgtgagcttcagctgccctcagccacagactgtgcccgttacctttctcagctctcgaagctaccttgcattacctgggaactcaggcgaagataaagtatctgtgacattccagttcagaacttggaatcgtgctggccacctgctcttcggagagctgcagcgagggtctggtagcttcgtactgttcctcaaagacgggaaattgaagttgtcactgtttcaagcaggacagagccctcgcaatgtcacagccggagctggacttaacgacggtcagtggcacagtgtgagtttcagtgcaaaatggagccacatgaacgttgtggtggatgatgacactgctgtgcagccactggtcgctgtcctgattgactcaggggacacttattacttcggcggttgtctcggtaactccagtggtagcggatgtaagagccccctggggggatttcagggctgcctacggctgatcactattggggataaggcagtggatcccatccttgttcagcagggcgcactcggttcctttcgcgatttacaaatcgacagctgtggcatcaccgaccgttgcctcccatcctactgcgagcatggcggtgagtgtagccaatcctgggacactttttcctgtgattgtctcggcactggttacacaggtgagacctgtcacagttccctctacgagcagagctgtgaagcacacaagcacaggggaaacccttccgggctgtactacattgacgccgacggcagtggcccattagggccttttctggtgtactgcaatatgaccgctgactccgcctggactgtcgtccgccatggaggacctgacgcagtcacactgcgcggagcaccatcggggcatccactgtctgccgtatccttcgcatacgccgcaggtgctggccagctccgagccgcagtgaacttggctgaaaggtgtgaacagaggttggcgctcaggtgtggtacagcaaggcgacccgatagtcgggatggaacccctctgtcatggtgggtgggtcgcaccaacgagacacatacaagttggggcggtagcttgcccgacgcgcagaagtgcacctgcggcctagaaggaaactgtattgatagccagtactattgcaactgtgatgcaggccagaacgagtggtag

SEQ ID NO: 49597 - DNA, 609 bp, Artificial Sequence
  Description of Artificial Sequence: Synthetic coding sequence
atgacttaccatttccaggaacactatactctaagcgagaactcatcaagcctggtatccagcctttaccgtgatgttaccctaacaagagaaatgattactctctctttcagaacaacccggtccccttccctcctcctgtacgtgtctagtttctatgaagagtatctgagcgtgatcctggctaacaacggaagcctacagatcaggtacaaattggaccgtcaccaaaacccggatgcgttcacctttgatttcaaaaacatggccgacggacagctacatcaggtgaaaatcaacagagaggaggctgtggtgatggtcgaggttaatcagagcgctaagaagcaagtgatactatcctcgggaacggagttcaacgccgtgaagtccctcatattgggaaaagtgttgggccgaagtggccctgtagacgagggcgaaccactggtcaacgccgatagacgagattcagcagtgatgggaggagtgatcgctgtggtaatcttcatccttctgtgtatcaccgctattgccatccgaatatatcagcagagaaaacttcgtaaggaaaatgagtccaaggtgagtaagaaggaggagtgttag

SEQ ID NO: 49598 - DNA, 3531 bp, Artificial Sequence
  Description of Artificial Sequence: Synthetic coding sequence
tgaggtcgagagttggagacaggccagggacggcagagcagcgtgggtgcagcgcaggggacgggggtgcgggctggagtccgggcaggaactacccagtctggacggagaagagcgcgagtctctggtaggcttgccgaggttagtatggcctctgtggcctgggctgttttgaaggtgctcctgctactccccacccaaacttggtctcctgttggggctggcaaccctccagactgcgactctcccctggcaagtgccctcccgagatcatcgtttagcagctcctccgagcttagcagctcccatggccctggatttagccggctcaatagaagagacggcgctggtggatggacccccctggtgtccaacaagtaccagtggctccagattgatctgggcgaacggatggaagtgacagcggtggctacccagggtggatatgggtcaagcgattgggtgactagctacctgttgatgttctcggacgggggacggaattggaagcagtacagaagggaggaatccatctggggcttcccgggaaatacaaatgccgatagcgtggtgcactaccgcctccaacctccatttgaagccaggtttctccgattcctgcctctggcctggaacccgcgtggtcgtatcggaatgcgaatagaggtgtatgggtgcgcatataagtcggaggtggtgtatttcgatgggcagtccgcccttctgtacactctggataaaaaaccattgaagcccattcgggacgtcataagtcttaagtttaaagctatgcagtctaatggtattcttctccaccgcgaaggccaacacggtaaccacattacgcttgaacttatcaaaggcaagctggtatttttcttgaattcagggaacgcaaaacttccctccacgatcgcaccagttaccttgacattagggtcgttacttgacgatcagcattggcattccgttctgatcgaactcctggacactcaggtcaattttaccgtggacaaacatactcatcacttccaggccaagggggattctagcaatctggacctaaacttcgaaattagtttcggtgggattctttcccccggaagatcaagggctttcacacgaaaatcttttcatggatgcctggaaaatctatattataacggagtcgacgtcaccgagctggcaaagaagcataaacctcagatcctcatgatgggaaatgtaagcttcagctgtcctcagccccaaaccgtgccagtcacctttcttagttcccgcagctatctagcattgccgggtaactcaggcgaagataaagtttcggtgactttccagtttaggacctggaacagagctgggcatctacttttcggggagctgcaacggggtagcgggagctttgtcttgtttctgaaggacggaaaattgaagctcagcctgtttcaggcaggccagtcccccagaaatgtaacagctggagccggactcaacgacggccagtggcattcagtctcgttcagcgccaagtggtcacacatgaatgtggtggtggacgatgatacagctgtccagcctcttgtggccgtactgatagacagcggcgatacctactactttggcggatgtcttggaaattcctctggttctggatgcaaatctccccttggcggatttcaaggctgccttagacttataactatcggggataaagcagttgatcctatcctggtccagcagggagccttgggaagctttagggacctgcagatcgatagttgcggtataaccgatcggtgtctgccctcttattgtgaacatggaggagaatgtagccagtcttgggacacattctcatgtgattgcctgggtacaggctacactggcgaaacttgtcacagctctctgtacgagcagtcatgcgaggcccacaagcaccgaggtaatccctccggcttgtactacattgatgccgatggtagtggaccgctaggccctttcctcgtgtattgcaacatgacggcggactcggcctggaccgttgtcaggcacggaggccctgacgccgtgaccctcagaggcgcaccctctggacaccccttgagtgctgtgagctttgcttacgcagctggtgctggccagctcagagccgcagtcaaccttgcagagaggtgtgaacagagactggcccttcgctgtggaaccgctagacgacccgatagcagagatggaactccgctctcctggtgggtgggcaggactaatgagacacataccagctggggcggatctcttcccgacgcccaaaaatgcacctgcgggctagaggggaactgtatcgattctcagtactactgcaactgcgacgcaggacaaaatgagtggacatcagatactatagtactgagtcagaaggagcacctgcctgtgacccagatcgtcatgaccgacacgggacagccgcattccgaagcagactacactctggggcctctgctgtgccgaggtgataagtctttctggaacagcgccagttttaataccgagacatcataccttcactttccagcattccacggcgagttgacagcagatgtgtgctttttcttcaagactaccgtctcctctggcgtgttcatggagaatctggggataaccgactttatcaggatcgagcttcgcgctccaaccgaggtgactttctcattcgacgtggggaacgggccttgtgaagtgactgtgcagagccctacaccctttaatgataatcagtggcaccatgtgcgggcagagagaaatgtcaagggggctagtctccaggtcgaccagttgccccagaaaatgcagcccgcaccagcagatggccacgtgcgccttcagctgaattcacagttatttatagggggaaccgctacacggcagagaggttttctgggttgcatacggtcactgcagctgaacggagtggcactggatctggaagaaagggccacagtaacacccggagtggaacccggatgcgctggacactgctccacgtatgggcacttgtgtcgcaacggtggaaggtgccgggagaaaagacgcggagttacgtgcgattgtgccttctccgcttacgatggacccttctgtagtaacgaaatttctgcatatttcgctacaggctctagtatgacctatcactttcaggagcattacaccttgtcagagaatagcagctctcttgtgtcttcactatatagggatgtcacgttaacaagagaaatgatcacattgtcttttagaactacaagaagtccctcacttctcttgtatgtgagctcattttacgaggagtatctctccgtaattctggcaaacaatgggtccctgcagattcggtacaagctggatcggcaccagaaccccgacgcatttacattcgactttaagaacatggcagatggacagcttcaccaggtgaagatcaacagggaagaggctgttgtcatggtcgaagtcatccctcaaatgcaaaaatccaactag

SEQ ID NO: 49599 - DNA, 3867 bp, Artificial Sequence
  Description of Artificial Sequence: Synthetic coding sequence
atggcatccgtcgcatgggcagtcctgaaggtgctactcctgctccccactcagacgtggtctccagtgggggcagggaaccctcctgactgcgattcccccctggcctccgccctgcctaggtcgagtttttccagctctagtgaactgagttcaagccacggtccaggattcagcaggctcaaccgcagagacggggcaggcggatggaccccactcgttagtaataaatatcagtggttgcagattgaccttggagagagaatggaagttacagccgtggccacacaggggggatacgggtctagcgactgggtaaccagctatctcttgatgttctctgacgggggacggaactggaagcaataccgtcgggaggagtctatttggggcttccctggaaataccaatgcggactccgtggttcactatcgtctgcagcctccgttcgaagcgcgatttctgaggttcttgcctctggcatggaacccaagagggcgtatagggatgagaatcgaagtgtatgggtgcgcttataaaagcgaggtagtgtactttgacggtcagtcagccttactttacaccctggacaagaaaccccttaagccaatcagagacgttatttcactgaaattcaaagcgatgcagtccaatgggatcctgttgcaccgcgaaggtcagcacgggaaccacattaccctggagctcattaaaggaaagttggttttttttttaaatagtgggaatgccaaattgccgagcaccatagcgccagttacattaaccctgggttccctgctcgacgaccaacattggcacagcgttctcatcgagttgctcgatacacaagtgaacttcaccgtagacaagcacacacatcattttcaggccaaaggcgatagcagcaatcttgacctaaacttcgagatcagttttggagggattctatcacccggaaggtcgcgggctttcacccggaagtcctttcacgggtgtctcgaaaacttgtattacaacggtgtagacgtgaccgaactggcaaaaaagcataagccacagatcctgatgatgggtaatgtgtcattctcttgtccacaaccccaaacggtgccagtgacattcctaagctcgaggagctatctggctctgcccggaaattctggggaagataaggtcagtgtcaccttccaattcaggacatggaatcgtgccggacacctgttgtttggcgagctccagcgagggtccggcagttttgttttgttcttgaaagatgggaagttaaagttgtccctgttccaggccggacaaagcccacgaaacgtcacagcaggcgcaggcctgaacgacggtcagtggcatagcgtttctttcagtgccaagtggtctcatatgaacgtggtagttgacgatgacaccgccgtccagcccctggtggccgtgcttatcgattccggggatacatactacttcggcggatgcctcgggaatagcagcggctcaggttgcaagagcccccttggaggcttccaagggtgtttgaggctgataacaattggggataaggcagttgatccaattctagtgcagcagggtgctttaggcagtttcagagacctgcagattgattcctgcggcattaccgacaggtgtctgcccagctattgtgagcatgggggagagtgcagccagtcttgggacacgttcagttgtgattgcctggggaccggatacaccggggagacttgccactcgtccctgtacgagcaatcctgcgaggcacataagcaccggggaaatccttccggattgtactatattgacgccgacggtagcgggccattgggtcccttcttagtgtactgtaacatgacagctgatagcgcgtggaccgtggtcagacatggaggtccagacgcagtaacactccggggagcgcctagcggacatcccttgagtgccgtctctttcgcgtatgccgctggtgccggtcagctgcgcgcagccgttaatctcgccgaaagatgtgagcagaggctcgccctgcgctgcggaaccgcgaggcggcctgattcccgcgacggtacgcccctcagctggtgggtaggaaggaccaacgaaacacatacttcatgggggggaagtttacccgacgcccagaagtgtacctgtggcttggagggaaattgtatcgattcgcaatattactgtaactgcgatgctggccagaacgaatggaccagcgatactatagtgttgtctcagaaagagcatttacctgttacgcaaatcgtcatgaccgataccggccagccacatagcgaagccgactatacactgggcccactactgtgtcgaggcgataaaagcttctggaattccgccagtttcaacaccgagaccagttacctacattttccggctttccatggcgagctgaccgccgacgtgtgcttcttttttaagacaacagtgtcttcaggagtgtttatggagaatctgggaattaccgacttcatccgcattgaactgagagcccctaccgaagtgacattttcatttgacgtcggcaacggaccctgcgaggtcaccgttcagtcacccacaccatttaatgataaccaatggcatcacgtgcgggcagaacggaacgtcaagggagctagtctgcaggtggaccagctgccacagaaaatgcaacctgccccagcagatggccatgttcggttacagctcaattctcaactattcatcggaggcacagcaacccggcaaagaggattccttggatgtatccggtctcttcagctgaacggggtggccctggacctggaagagcgggctaccgtgactccgggtgtggaacctgggtgtgcgggtcattgcagtacctacggccacttgtgcaggaacggtggacgctgccgcgagaagcgtaggggtgtgacctgcgattgcgcgttctccgcctacgatggcccattttgttcgaacgagatttccgcatactttgcaacagggtcttctatgacttatcacttccaggagcactacaccctgagcgagaacagcagcagcctcgtcagtagcttatatcgggatgtcacccttactcgggagatgataacccttagtttcagaactacccgaagcccctcactcttactgtacgtgagcagcttctatgaagagtaccttagtgtgattctagccaacaatggctcattacagatcaggtacaagctcgatcgccaccagaatcctgacgcctttacatttgacttcaagaacatggctgatggacagctccaccaggtgaaaattaatcgcgaagaggctgtagtgatggtggaggtaaaccagtccgctaaaaaacaggtgatactgagtagcggaacggagttcaacgccgttaagtcgctcatcctggggaaggttctcgaggcggctggcgcagacccagatacgcgacgggcagccaccagcggatttaccgggtgcctcagcgctgttcgcttcggcagggctgcgccactaaaggcagcactccggccttccggaccctcacgagtgaccgtgagagggcacgtggcccctatggcaagatgtgccgcaggagcggcttctgggagcccagctagggagttagccccaagattggctggcggagccggtcgcagcggcccagtggacgagggggagcccctcgtgaacgcagaccggagagatagtgcggtcatgggcggagtgattgctgtggtaatcttcatcctgctttgcataaccgccattgctatccggatctaccagcagagaaaattgagaaaagagaacgagtcaaaggtcagtaagaaggaggagtgttag

SEQ ID NO: 49600 - DNA, 1803 bp, Artificial Sequence
  Description of Artificial Sequence: Synthetic coding sequence
atggccagcgttgcttgggccgtgctgaaggtgctgctgctgctgccgacccaaacctggtctcctgtgggagccggtaatccgcctgattgcgactcaccactggcttcagccctgccacgctcttccttctcaagcagttctgaactctcaagctcgcacgggcctggctttagcagactcaaccgacgcgatggcgcagggggttggacccctctcgttagcaacaaataccagtggctacagatcgatctgggagaacgtatggaggtaacagctgtcgcaacgcagggcggatacgggagcagcgactgggtaacatcttatcttctgatgtttagcgatggaggccgaaactggaaacagtatcggagggaagagtctatttgggggtttccgggaaacactaatgcagatagcgtggtccactacagactgcagccaccattcgaagcaagattcctccggttcctaccgctggcctggaatcccagaggcaggatcgggatgcggatcgaagtttacggctgcgcctacaagtcggaagtcgtgtacttcgacggtcagtctgcgttactatacaccctggataaaaaacctctcaagccgattagggatgtgattagtcttaaatttaaggcaatgcagtctaacggaatcttgctccatagagaaggacagcacgggaaccatatcaccctggaattgattaaggggaaactggtttttttccttaacagtgggaatgcaaagttgccctccacaattgcccctgttacccttaccctgggctctctcctggacgaccaacattggcactcagtccttattgagctgctggacacacaagttaatttcactgtcgataaacacacacatcatttccaagccaagggagactccagtaacctggatctcaacttcgagatttctttcggtggaatcttatcgccgggacgcagtcgcgcatttacccgcaagagctttcatggatgccttgaaaatctttactacaacggagtagatgtgacggaactggctaagaaacacaagccacaaatcctgatgatgggcaacgtatctttctcctgtccccagccccagacagtgcctgtgaccttcctcagctcccggagctatttggccctgccgggaaatagcggcgaagataaggtctctgtgacgtttcagtttcgcacgtggaatcgagccggacatctgttatttggcgaacttcaaagaggctcggggtcatttgtcctgtttctgaaggatggtaagctgaagttatccctgttccaggctggccagagccctcgcaatgtcaccgctggagcgggacttaatgatggacagtggcacagtgtcagtttctccgccaagtggagccacatgaacgtggtcgtggatgacgacactgcagtacagcctctcgttgccgttctgattgacagtggagatacttactatttcggcgctctgtatgagcagtcttgcgaagctcataagcatcgcggtaatcccagcggcctttactatatcgatgctgatggcagtgggcctctgggaccattccttgtgtactgcaacatgaccgattccgcctggaccgtcgtaaggcacgggggaccagacgccgtgacgctcagaggagccccatctggccaccctttaagcgccgtgtcatttgcatatgccgctggagccggacagttgagggccgctgtcaatctagccgagcgttgtgagcagcgattggccctcagatgtggcaccgccaggcgcccagatagtcggggatag

SEQ ID NO: 49601 - DNA, 3921 bp, Artificial Sequence
  Description of Artificial Sequence: Synthetic coding sequence
atggattccctcccacgcctgacttctgtgctcacattgctcttctcaggtctgtggcaccttggactaacagcaactaattataattgcgatgaccctctcgcctctctgctaagtcctatggcgttttccagctccagcgaccttacagggacgcatagtccagcacagctgaattggcgcgtaggaaccgggggatggagtcccgctgactcgaatgcgcagcagtggctgcagatggacctggggaacagggttgaaattaccgctgtggccacccaaggacggtacggtagcagcgattgggtaaccagttatagcctcatgttcagcgacactgggcgtaactggaaacaatacaagcaggaggattctatttggactttcgctggaaatatgaatgccgactctgttgtgcaccacaaacttctgcactcagttcgggctcggtttgtgagattcgtgccattagaatggaacccaagcggcaagataggaatgcgcgtcgaggtgtacggttgtagctataagagcgatgtcgccgactttgacgggaggagcagcctcctgtataggttcaaccagaaactcatgtccactctgaaggacgttattagccttaaattcaagtcaatgcaaggtgacggagtcctcttccacggggagggccagcgtggggaccacatcaccctcgagctgcaaaaaggacgccttgctctgcacttaaatctgggcgatagcaaggccaggctgtcgagttcgctcccatccgctactctgggcagcctgttagacgatcagcactggcacagcgtgttgattgaacgagtcggcaagcaggtgaactttacagtggacaaacacacgcagcacttccggacgaagggggagacggatgcccttgacattgactacgaactatcgtttgggggtattcccgttcctggaaagccaggtacttttcttaaaaagaactttcatggctgcattgagaatctctattacaatggagtgaatataattgacttagcaaaaaggcgcaaacaccagatttatacaggcaatgtgacctttagctgttctgagccccaaattgtccccatcacattcgtcaattcatctggtagctacctgttgctgccaggtaccccccagatagatgggctgtccgtgtccttccagttccgaacgtggaacaaggacggcttgcttctgagcacagagttgtccgagggcagcggaacccttttgttatccctggaaggcggaattctccggctggtcattcagaaaatgacagaaagggtcgccgagatcctgactggatcaaacctgaatgacggtctgtggcattccgtaagcattaatgctagacggaatcggattaccctgacattggacgatgaggcagcgccacctgcccctgatagtacatgggtgcagatatatagcggcaatagttactattttggaggatgccctgataatcttacagactctcagtgtctgaatccaatcaaggccttccaggggtgcatgcgactcatattcattgataatcagccaaaagacctcatctctgtacaacaaggaagcctgggcaatttttcagatttgcacatcgacttgtgtagcatcaaagatcgctgcctcccaaattattgtgaacacggaggctcgtgcagtcagtcatggactaccttctactgtaactgttctgacacttcatataccggagccacttgccataatagtatctatgagcagagctgtgaggtctacaggcaccaggggaatacagctgggttcttctacattgactctgacggctcgggacccctgggtcccctgcaggtgtactgtaatattacagaagataagatttggacctcagtgcagcacaataacacagagctaactagagtccgaggcgctaatccagaaaaaccttatgcgatggcactcgactacgggggttccatggagcagctcgaggcggtcatagacggttccgagcactgcgagcaggaagtagcctaccattgtaggaggtcaaggctcttgaacacccccgatgggactccattcacatggtggattggcaggagtaacgaacgccacccatattggggagggtcaccacctggggtgcaacaatgcgagtgtggccttgatgaatcttgtttggatattcagcacttttgcaactgcgacgctgacaaggatgagtggactaacgacactggttttctgtccttcaaggaccacctccccgtcacccagattgtaattaccgacaccgataggtctaacagtgaggctgcttggaggataggaccattgcgctgctatggtgatcgaagattttggaatgccgtgtcattttataccgaagcatcttatctgcacttccccacttttcatgcagagttttccgcggacatttcctttttcttcaaaacgactgccctgtcaggtgtttttctggagaatctggggatcaaggactttataaggttagaaatttcttcaccatcagagattacgttcgcaattgacgtggggaacggtcctgttgagctggtggtgcagtctcccagcctcctcaatgataaccagtggcactacgtccgcgcagaacgtaatctcaaagaaaccagtttgcaagtggacaatttgccaagatcgaccagggaaacatcggaagagggccattttagattgcagctgaatagtcagttgttcgtaggtggcacttcatcacggcagaaaggttttctgggatgcattaggagcctgcatctgaacgggcagaaaatggacctggaggaaagggccaaggtgacctctggtgtaagaccagggtgccctggccattgctccagttatgggtctatctgtcacaatggcggtaaatgcgtggagaaacacaatgggtatctgtgtgattgcacgaatagtccctatgaggggccattttgcaaaaaggaagtgtcagctgtgtttgaggcaggaacatccgtgacctacatgttccaggagccttacccggtgaccaagaacatctctctgagctctagcgctatttacaccgactctgctcccagcaaggagaacattgctttgagctttgttacgacacaggcaccaagtctccttctctttatcaactcctctagtcaggactttgtcgtagtacttctctgcaagaacggatctctccaagtgcgatatcatctgaacaaagaggagacccacgtctttaccattgacgcagataacttcgccaatagacggatgcaccacttgaagataaatcgagagggaagagaattgaccatacagatggatcaacagctgcggctttcgtataacttctctcctgaggtggagtttcgggtcattcgatcactgaccctgggcaaggttactgagaacctcgggctggactccgaggtcgctaaggccaatgctatgggctttgccggatgcatgtccagcgtgcagtataaccacattgctccactcaaagcagccctccgccacgcaactgtggctcctgtgaccgttcacgggacacttaccgaaagctcatgcggattcatggtggacagcgacgtgaacgctgtaacaacggtccattcatcctcagaccctttcgggaagactgacgaacgggaacccctgaccaatgccgttagatctgactcggcggttattggcggagtcattgcagtggtcatcttcattatcttctgtattattggaattatgacccggttcctctatcagcacaaacaaagtcaccgtacaagccaaatgaaggaaaaggaatatccggagaacctggactcctcttttagaaacgagattgatctgcagaacaccgtcagtgagtgcaagcgcgagtatttcatatag

SEQ ID NO: 49602 - DNA, 3129 bp, Artificial Sequence
  Description of Artificial Sequence: Synthetic coding sequence
atgaaacagtccccagctcttgctcccgaggagcgctgccgacgcgcaggcagtccgaaaccagtcctgagagcggacgacaataacatggggaacgggtgctcgcagaaactggctactgcgaatctgttaaggtttctgctgctggtcctgataccatgtatctgcgcgttggttcttttattggtcatcctgcttagttatgtcggtaccctacaaaaggtgtactttaagtcaaatggatccgaacctctggtgactgacggggagatccaaggctctgacgtgattctgacaaacacgatctacaatcagagtactgtggtttccactgcccatccagatcaacacgtccctgcttggacaacggacgctagtctcccaggcgaccagagccaccggaacacctctgcatgcatgaacattacccactcccagtgccagatgctcccctaccatgctaccctcactccactgctcagtgtggtgaggaatatggagatggagaagtttctgaagttcttcacctacttgcaccggctttcctgttatcaacatatcatgctttttggctgtacactggccttccctgaatgcattatcgatggcgatgattcccacggcctgctcccctgtagaagcttctgtgaggccgctaaggagggctgcgaaagtgttctgggtatggtcaattactcatggcccgactttttgcggtgctctcaatttcgaaatcaaaccgaaagctctaacgtgtcacgaatctgtttcagcccacaacaggagaacgggaaacaactgctgtgtggcaggggagagaattttctctgtgccagtggcatctgtattcctggcaaattgcagtgtaacggatacaacgattgtgatgattggagtgatgaggcccattgcaactgttctgaaaacttattccattgtcacaccggaaagtgccttaattattccttagtttgcgacggctacgatgactgtggcgacttatccgatgaacagaattgtgattgcaatcctaccaccgagcataggtgtggcgatggacgatgcattgcgatggagtgggtgtgcgatggtgatcatgactgtgtagacaagtctgatgaggtgaattgtagttgccatagtcaaggactagtggaatgtcggaacgggcagtgcatcccatccaccttccagtgtgatggggatgaggactgcaaggacgggagcgatgaagagaactgcagcgtcattcagacaagctgccaggagggtgaccagcggtgcctctacaatccctgcctcgacagctgtgggggatcctctctgtgtgaccctaataattcattaaataactgcagccaatgtgagccaatcacattggagctctgcatgaatctcccctacaactctacgtcctatcctaactatttcggacacaggacgcagaaagaggcctccatctcctgggagtcatcactgttccctgccctagtccaaacaaattgctataaatacctgatgttctttagctgtaccattctggtgccaaaatgtgacgtcaacacaggcgaacacatcccaccatgtagggccctgtgcgagcacagtaaagaacgctgtgaaagcgtgctaggcatagttggcctgcagtggcctgaggatactgattgttcacagtttcctgaggaaaactctgacaatcagacttgtttgatgccagacgagtacgtcgaggagtgctctccctctcatttcaagtgtagatctggtcagtgtgtgctcgcttcgaggaggtgtgatggtcaggccgattgtgatgacgattccgatgaagaaaactgtggctgcaaagaaagggatctctgggaatgcccgtctaacaagcagtgtctcaagcacaccgtcatctgcgatggatttccggattgtccagactatatggacgagaaaaattgctccttttgccaggacgatgaactggagtgcgctaaccacgcgtgcgtgtcccgtgacctctggtgtgatggcgaagctgactgttctgacagctctgatgaatgggactgtgtgacacttagcatcaacgtgaatagcagcagctttcttatggtgcatcgcgcagctactgaacaccacgtgtgtgcagatgggtggcaggagattctgagtcagctggcgtgcaaacaaatgggccttggcgagccctcagtgacaaagctcattcaggaacaggaaaaggagccacggtggttaacactgcactcaaattgggaatccctcaacgggaccacactgcatgaactactggttaacggccaaagctgtgagtcacggagcaagatatctctgctgtgcaccaaacaggattgtgggaggagacccgcagctcggatgaacaaacggatactggggggtcgaacatcaaggcccggaaggtggccttggcagtgctcacttcagtcagagccgagcggccacatctgcggctgcgttttgattgctaagaaatgggtgctgacagtcgcccattgtttcgaagggcgtgaaaacgcagcggtgtggaaagtggttcttgggatcaacaatctggaccatccatctgtcttcatgcagactcgattcgtgaaaacaattatcctgcaccctcggtatagccgggctgtagttgactatgacatcagtatcgtggagctcagtgaagatatatctgaaactggctacgttcggcctgtatgcttgccaaaccctgagcagtggctcgagccagatacctattgctatattacaggatgggggcacatggggaataagatgcctttcaaactacaggagggtgaggtgaggattataagcctggaacattgccaatcctacttcgatatgaagaccatcaccacccggatgatctgtgcagggtatgagtccggaaccgtcgactcatgtatgggtgactccggagggcctctggtctgcgagaaaccagggggacggtggacgctctttggtctgacctcttggggctcagtttgtttctccaaggtcttgggccctggggtttactccaatgtctcctattttgtggaatggattaagagacaaatctatatccagactttcctgctcaattag

SEQ ID NO: 49603 - DNA, 2928 bp, Artificial Sequence
  Description of Artificial Sequence: Synthetic coding sequence
atgaaacagtctcctgcactcgcacccgaggagcgttgtcgccgtgctggatctcccaagcctgtgctccgagctgatgataacaatatgggaaacgggtgctcccagaaattggctactgccaatttgttgcgatttctgctcttagtactcatcccctgtatctgcgccctagtgctcctgctggtgatcctgttaagttacgtcggagcttgtatgaatatcacccactcccagtgccaaatgttgccttatcatgctacgctaactcccctgctgtcagtggtgcggaatatggagatggaaaaattcctgaaatttttcacgtacctgcatagactctcttgctaccagcatataatgttgtttggatgcaccctggccttccctgagtgtatcatcgatggggatgacagtcatggactcctcccctgtcggagtttctgcgaagctgcaaaagaggggtgtgaaagtgtgttaggcatggtgaattatagctggccagattttctgcggtgcagccagttccgaaatcagaccgaatcttccaacgtttcccgcatttgttttagtccccagcaggagaacggcaaacagttattgtgcggccgaggagagaacttcctgtgtgcgtctggcatctgtatcccaggtaagcttcaatgtaatggctataatgactgcgacgactggtccgacgaagcccattgcaactgtagtgaaaacttgtttcattgtcacaccgggaaatgcctcaactactctctggtatgtgacgggtacgatgactgcggagacttgtccgatgaacagaattgcgattgcaatcccacgactgagcatcggtgcggagacggaaggtgtattgctatggagtgggtatgcgatggcgatcacgactgtgtcgacaaatctgatgaggtgaattgtagttgtcatagccaggggcttgtggaatgccgcaatggccagtgcatccccagcacctttcagtgcgacggtgacgaggactgtaaggacggctccgatgaagaaaactgtagcgttatccaaacttcatgccaggagggggaccaacggtgcctatataacccctgtttagactcctgtggcggatctagcctttgtgaccctaataactctttgaataactgctctcaatgcgaacccatcacactggaactttgcatgaatttaccgtacaattctaccagctaccccaactactttgggcacagaacccagaaagaagcaagcataagctgggaatcttccctgttcccggctcttgtccagaccaattgctataagtatctgatgttctttagttgcacgattctggtgccaaagtgcgacgtgaataccggcgaacatattcctccttgccgcgctctgtgcgaacactcaaaagaacgctgcgaatctgtgctgggaatcgtcggccttcagtggccagaagacaccgattgctctcagttccctgaggagaattctgacaatcagacatgtcttatgccggacgagtacgtggaggagtgttctccgtcccatttcaagtgtagatcaggtcagtgcgttcttgcttcccgtcgctgcgatggccaggctgactgcgacgacgactctgatgaggaaaactgtggatgcaaagagcgggacctgtgggaatgtcctagtaacaaacaatgtctaaaacacaccgtcatttgcgatggttttcccgactgtcccgattacatggatgagaagaactgttctttctgccaagatgatgaattggaatgcgccaatcatgcctgtgtgtcccgtgacctgtggtgtgatggcgaggccgattgttccgattcttccgacgagtgggactgtgtcaccctcagcattaatgtgaactctagcagtttcctcatggtgcaccgcgcagccactgagcaccacgtatgtgcagacgggtggcaggagatcctctcccaactagcatgtaagcagatgggactgggcgaacccagtgtcaccaaactgattcaagaacaggagaaagagcccaggtggttaacgctgcactcaaattgggagagtctgaatgggacaactttacatgagcttctggtcaatggccaatcttgcgagtctaggtctaagatcagcctgctctgcacaaaacaggactgtggtaggagacccgcagcacggatgaataaacgcatccttgggggtcgaacatctaggcctggacgctggccttggcagtgtagtttacagtccgaaccatccggacacatatgcgggtgcgtgctgatcgccaaaaaatgggtgctcacagtcgcacattgttttgagggcagggaaaatgctgccgtgtggaaggtggtcctggggattaacaatctcgatcaccctagtgtattcatgcagacaagatttgtgaagactattatcttgcaccccagatacagccgggctgtcgtggactatgatatttcaatcgtggagctgagcgaggacatatccgaaactggatatgttaggccagtatgccttcccaaccctgaacagtggctggagccggacacgtattgttacattaccggttgggggcacatgggcaacaagatgcccttcaagcttcaggagggcgaggtgcgcatcattagtctcgagcactgtcagtcatattttgacatgaagactatcacaacgcgcatgatttgtgcagggtatgaatccggcactgtggatagctgcatgggtgacagcggtgggccactggtatgcgaaaaacccggtgggaggtggaccttatttggtctaacctcttggggttcagtttgcttttccaaggtcctcgggcctggagtgtatagcaatgtgagctacttcgtggaatggattaaaagacagatctatattcagacctttttgttgaactag

SEQ ID NO: 49604 - DNA, 3018 bp, Artificial Sequence
  Description of Artificial Sequence: Synthetic coding sequence
atgaagcagtcccctgccctggccccagaagaacgatgccggagagcaggaagtcctaagccggtccttcgcgctgacgataataatatgggcaacggttgcagtcagaaattagccactgcaaatttactgcgctttctcctgctcgttcttatcccatgcatatgcgccctcgttctgctgctggttatcctgctgagttacgtcggcacactgcagaaggtctacttcaaaagtaacggaagtgaacccctggtgactgatggcgaaatccaggggtccgacgtaattttgactaacactatctacaatcagtcaacagttgtcagtacggcccaccccgatcaacacgtacctgcatggacaaccgacgcctctttgcctggcgatcagtctcatcggaatacctctgcgtgcatgaatatcacccattcccagtgccagatgctgccgtatcatgccacactcacgcctctcctgagcgttgtgcgaaatatggaaatggaaaaattcctgaaattctttacgtatctacacagactctcatgctatcagcatattatgctatttggatgtaccctcgcttttccagagtgtattatagatggggatgacagccacggattgctgccctgtaggtccttctgtgaggcggcaaaggaaggctgcgaaagcgtactcgggatggtgaactactcatggccagacttcctcaggtgttcgcaatttcgcaaccagaccgagagttcaaacgtctccagaatatgcttcagtcctcagcaggaaaatggtaaacagcttttatgcggacgtggggaaaatttcctgtgtgcctccggaatctgtatcccaggtaagttgcagtgcaatgggtataacgattgcgatgactggagtgatgaggcgcactgcaattgctccgaaaatctattccactgccacaccggcaagtgcctgaactatagtttggtgtgtgacggctacgacgactgtggagaccttagtgatgaacagaactgcgcctgccattcacagggcctggtggagtgcaggaatggccagtgtatcccttccactttccagtgcgacggagacgaagactgtaaagacggcagtgacgaagagaattgcagtgtgattcagacgagttgtcaggaaggagatcagaggtgtctgtacaacccttgcctggatagttgcggcggttccagtctgtgcgacccaaacaacagtcttaacaactgcagtcaatgcgagcccattaccctggagctgtgtatgaacctgccatataattccactagctaccccaactacttcgggcatcgaacccaaaaggaggccagtataagctgggaaagctccctcttccctgccctggtccagaccaactgttacaaatacctgatgtttttcagctgtactatcctggtgccaaaatgcgatgtgaatacaggcgaacatatcccgccttgccgggctttgtgtgagcattccaaagagaggtgcgagagcgttctgggtattgtggggctgcagtggccagaagatacagattgttcccagtttcccgaggagaacagtgacaaccagacttgtctgatgccggacgaatacgttgaggagtgtagtcctagtcactttaaatgtcggtctggccagtgtgttttagcttctaggcgctgtgacggccaggcggactgcgacgatgatagtgacgaagagaattgcggttgtaaagagagggatctctgggagtgtccttcaaacaagcagtgtctgaagcacacggttatttgtgacggctttccagactgtcctgattatatggatgagaaaaactgttcattctgtcaggacgatgaactggaatgcgctaatcacgcctgcgtcagccgcgatctgtggtgcgacggagaagcagattgttccgacagctccgatgagtgggactgcgttaccctgagcattaacgtaaattcttccagctttctgatggttcaccgggcagcgaccgaacaccatgtctgcgcggacgggtggcaagagattctgtctcagcttgcctgcaagcaaatggggctgggcgaacccagcgtgaccaagctgatccaggagcaggaaaaagaaccccgttggttaaccctccactccaactgggagagcctgaacggcacaactctgcacgagctgctggtgaatggccagtcttgcgagtcaaggtctaagatctcattgctgtgcactaagcaagattgtgggcgtaggcctgccgcaagaatgaataagagaatcttagggggacggacatcccgccctggccgttggccatggcagtgcagtctccagtccgagccaagcggccacatttgcggatgcgtactgatcgctaagaagtgggtgctgaccgtggcccattgctttgagggccgagagaatgctgccgtgtggaaagtggttcttggaatcaacaacttagaccatccgagtgtctttatgcagactcgtttcgtcaaaaccatcatattacatccgagatatagtagagccgtggtcgattacgacatcagcattgtcgaactgtctgaggacatttctgagaccggatacgtaaggcctgtgtgcctgcctaacccagaacagtggctggaaccagatacctactgctacatcaccgggtgggggcacatgggcaataagatgcctttcaagcttcaggagggcgaggtcaggatcatttccctggagcattgtcaatcatacttcgatatgaagactataacaacaaggatgatctgcgccggatatgagtctggaacggtggacagctgcatgggcgattcaggtggcccactggtgtgtgaaaagccgggaggcaggtggaccctctttggtttaacttcatggggaagcgtttgcttttctaaggtcttgggtcccggagtgtatagcaacgtgtcctatttcgtggaatggatcaaaaggcagatttatatccaaactttcctgctgaattag

SEQ ID NO: 49605 - DNA, 555 bp, Artificial Sequence
  Description of Artificial Sequence: Synthetic coding sequence
atgaaaccagacgagaccccaatgtttgacccctccctgctgaaagaggtcgactggtcccaaaatacagccacgtttagtcctgccattagcccaactcatccaggcgaggggctggtgcttagacctctgtgtactgctgatttaaacaggggctttttcaaagtattgggccagctgaccgagacaggggtggtgtcgcctgaacaattcatgaagtcgtttgagcacatgaaaaagtcaggcgattattacgtcaccgttgttgaagacgttacgctcgggcaaatcgtcgcgactgcgacgttaattattgagcacaaattcatacactcatgcgcaaaaagagggagggtggaagatgtagttgtttctgatgagtgccgtggcaagcagcttggtaagctcctgctgtcaaccttgaccctcctttccaaaaagttgaactgttacaaaattaccctggagtgtctcccccagaacgtaggattttacaagaaatttggctatactgtctcggaggagaactatatgtgtaggaggttccttaagtag

SEQ ID NO: 49606 - DNA, 291 bp, Artificial Sequence
  Description of Artificial Sequence: Synthetic coding sequence
atggcgtttactttcgccgcattttgctacatgttggctctgcttctgaccgccgctctaatctttttcgccatctggcacatcatcgcttttgatgagctcaaaacagattataagaaccccatagaccagtgtaatacactgaatccactggtgttaccagaatatttaattcacgctttcttctgcgtgatgttcctttgcgccgcagaatggctaacactgggcctgaatatgcctctgttggcctatcacatatggagcatgatttatgtgctggtgtcaagttag

SEQ ID NO: 49607 - DNA, 483 bp, Artificial Sequence
  Description of Artificial Sequence: Synthetic coding sequence
atggctttcacatttgcagccttctgctatatgttaacattggtcctgtgcgccagcctaatctttttcgtaatctggcatatcatcgcgtttgacgagttacggaccgactttaagaacccaattgaccagggaaaccccgctagagccagggagcggctcaagaacatcgaaagaatttgctgtctgctgcgtaaattggtggttcctgagtactctattcacggactgttttgccttatgtttttatgtgccgctgaatgggtaacattgggactgaacattcctctcctgttctaccacctttggagatacttccataggcctgcagatggcagcgaggtgatgtacgatgctgtttcaatcatgaacgcagatatcttgaactattgtcagaaggaatcatggtgcaaacttgcattttatctgctgtccttcttttattatctttactccatggtgtacactctagtatccttctag

SEQ ID NO: 49608 - DNA, 483 bp, Artificial Sequence
  Description of Artificial Sequence: Synthetic coding sequence
atggctttcaccttcgcggcattctgctacatgttgtccttagtcctctgcgccgcactgatcttcttcgcgatatggcatatcatagcattcgacgagctcagaaccgactttaagagccccattgaccagtgtaacccagtgcacgcgcgagaacggctgaggaacattgagaggatctgcttcctgttgcggaagctggtgctcccggagtacagcatccacagcctgttttgcattatgtttctttgcgcacaagagtggctaacactaggcctgaacgtgccgctcctgttctaccatttttggcggtattttcactgtcccgctgattcttccgaactggcttacgaccctcctgtcgtaatgaatgcggacacgctcagttattgccaaaaggaagcttggtgtaagttggcattctatctgctctcttttttctattatctctactgcatgatctacactttggtgtcctcctag

SEQ ID NO: 49609 - DNA, 414 bp, Artificial Sequence
  Description of Artificial Sequence: Synthetic coding sequence
atggaggcagtggtcttcgtgtttagcttacttgactgttgcgccttgatctttctctctgtgtacttcatcatcaccttgagtgatttagagtgtgactatataaacgcgaggtcatgctgtagtaaattgaacaagtgggttattcctgagttaatcggacacactatagtcacagtactcctgctcatgtccctacactggttcatattccttctcaacctgcccgtggctacctggaacatctatagatatatcatggtcccatccgggaacatgggggtgttcgatcccaccgaaattcacaaccggggacaactcaaaagccacatgaaggaggcgatgataaaactgggcttccacctactgtgcttcttcatgtacctgtacagcggatctaactgcccttgttag

SEQ ID NO: 49610 - DNA, 279 bp, Artificial Sequence
  Description of Artificial Sequence: Synthetic coding sequence
atggaggcagtagttttcgtctttagtctccttgactgctgcgccctgatcttcctcagtgtctactttatcatcacgctctccgatcttgagtgtgattatatcaacgccagatcttgttgttctaagctgaacaaatgggtcataccagaactgatcggccacactatcgtaaccgtgctgttattaatgtccttacactggttcatatttctgctgaacctgcccgtcgccacatggaatatctaccggatgatactggctctgatcaatgattag

SEQ ID NO: 49611 - DNA, 273 bp, Artificial Sequence
  Description of Artificial Sequence: Synthetic coding sequence
atggaagcagtggtcttcgtgttttctctgctggactgctgcgccctgatcttcctgtccgtgtactttatcatcacattgtccgacctggaatgcgactacatcaacgctaggagttgttgcagtaagttgaataagtgggttattcccgagttgattggacacaccatcgtgaccgtcctattgttgatgagcctgcactggttcatatttctactcaacctgcctgtggccacttggaatatttacaggggatcaaactgcccctgttag

SEQ ID NO: 49612 - DNA, 420 bp, Artificial Sequence
  Description of Artificial Sequence: Synthetic coding sequence
atggaagccgtggtgtttgtgttctccctgctcgactgttgcgctctgatatttctgagcgtatactttattataaccttgagtgacctagagtgtgactacatcaatgcgaggtcatgctgctcaaaactcaacaagtgggtcataccagagctgatcggccacaccattgtgacggtactgctcctgatgagcctccattggtttatatttttactgaacctgcctgtggctacttggaacatctacaggtacatcatggtcccatctggcaatatgggcgtgttcgatcctacagagattcacaatagggggcaactcaagtcgcatatgaaggaggccatgatcaagctcggattccacttgctctgcttctttatgtatttatacagtatgattctggcactgataaacgattag

SEQ ID NO: 49613 - DNA, 246 bp, Artificial Sequence
  Description of Artificial Sequence: Synthetic coding sequence
atggatggaggccagcccataccttccagcctcgttcctctgggcaacgagtcggccgatagctccatgagcttagaacagaagatgacattcgtctttgtgattctattgtttatttttctgggtattctgattgttcgctgtttcagaatcctgctggacccttatcgatctatgcccactagcacgtgggctgacggcctggagggcctcgaaaaaggccagtttgatcatgccctggcttag

SEQ ID NO: 49614 - DNA, 246 bp, Artificial Sequence
  Description of Artificial Sequence: Synthetic coding sequence
atggacggcggacaacctataccgtcaagtttggtcccgctgggcaatgaaagcgctgacagctcaatgtccctcgaacagaaaatgacatttgtgttcgtaattctacttttcatctttttggggattcttatcgtgcgatgcttccgcattctcctcgacccttaccgttccatgcctacttcaacttgggccgatggactagaaggcctggaaaaagggcagttcgaccatgccctggcttag

SEQ ID NO: 49615 - DNA, 114 bp, Artificial Sequence
  Description of Artificial Sequence: Synthetic coding sequence
gtttacacggattacatttacttcaacagcttccttgaaagtttccagggctttttcgtctcagtgttttattgcttcctgaattctgaggttaggagcgcaatacggaaatag

SEQ ID NO: 49616 - DNA, 723 bp, Artificial Sequence
  Description of Artificial Sequence: Synthetic coding sequence
atgtctcctgaagtgcaccagtccaacgtgggctggtgcaggctggtcactgctgcgtacaattacttccacgtgaccaattttttctggatgtttggggaaggttgctatttacacactgctattgtcctgacctacagtacagacaggttaagaaagtggatgttcatttgtatcggctggggagtgccattccccattatcgtagcatgggccattggaaagttatattatgacaatgagaagtgctggtttggtaagcgccctggagtgtacaccgattacatttaccaaggtcctatgatcttagttctgctcattaacttcatcttcctgttcaatattgtgagaatcttaatgaccaaactgcgggcatctacaacatccgagactatccaatatagaaaggcagtgaaagccacactggtgcttttgcctttacttgggattacatacatgctctttttcgtaaaccccggtgaggatgaggtgagtcgagttgtgttcatttatttcaattctttcttagagtcttttcagggcttctttgtgagcgtgttctattgtttccttaatagtgaggtgaggagtgccattcggaaacggtggcataggtggcaggacaaacactctattcgagccagggtggcaagggccatgagcattcctactagcccgacaagagtcagttttcacagtataaaacaatccactgccgtgtag

SEQ ID NO: 49617 - DNA, 1206 bp, Artificial Sequence
  Description of Artificial Sequence: Synthetic coding sequence
atggggggacacccgcagctgaggttggtcaaagctctgctcttgctgggactgaatcccgtatcagccagccttcaggaccagcattgcgaatcactgtccctggccagcaatatttcaggcctgcagtgtaatgccagcgtggacctgatcgggacatgctggcctagaagccccgctggccaattggttgtccgtccctgcccagctttcttttacggagttagatacaacacgaccaataacgggtacagggagtgtctggcgaacggatcttgggccgcaagagttaattatagcgagtgtcaggaaatactgaacgaggaaaagaagtcgaaagtgcactatcacgtagccgttataataaattacctcggccactgcatttctttagtcgcccttctcgtggccttcgtcctgtttctccgactccgcagcatcaggtgcctaagaaacatcatccactggaacctgatttcagcctttattctccggaacgcgacttggttcgtggtgcagctgactatgtcaccggaggtacaccagagcaatgtcgggtggtgtcgcctagttacggcagcgtataattatttccatgtcaccaattttttttggatgttcggggaaggttgctacctccatacagcaattgtgctgacatattcaaccgatcgccttcggaagtggatgttcatttgcattggatggggtgttcctttccctattatagtcgcttgggccattggaaagctgtactatgataacgaaaaatgctggtttggaaagcgaccgggtgtgtatacggactacatctaccaggggccaatgatattggtcctgcttatcaacttcatctttctcttcaatatcgtccgtatacttatgaccaaactacgggcatctacaacatccgagacgatccagtatcggaaggcagtcaaagcaaccctcgtgttgctccctctgctgggcatcacttatatgttgttttttgttaatccgggagaggacgaagtttctagagtagtattcatttatttcaacagtttcctggaatcatttcaggtaaggtccgccattcgtaaacgttggcatcgatggcaagacaagcattccatacgagcacgggtggccagagcaatgtccatcccaacgtctcccacacgcgtgtcctttcacagcatcaaacaaagcactgcagtgtag

SEQ ID NO: 49618 - DNA, 1128 bp, Artificial Sequence
  Description of Artificial Sequence: Synthetic coding sequence
atgggcggtcacccacagttaaggctggtaaaagcccttttacttctgggcctaaatcccgtttcagcaagtctccaggatcagcattgtgaatctcttagcttggcttcgaacatttcagataacggctaccgcgagtgcctggccaatggctcttgggctgcccgagtgaattattctgagtgccaggagatcctgaacgaagagaaaaaatccaaagtgcattaccacgttgcagtgataattaactacctggggcactgcatttctctggtcgctttactagtggccttcgttctgttcctccgccttagatcgatccggtgtctgaggaatattatccactggaatctcatctcagcgttcatacttaggaatgccacatggttcgtggtccagttaacaatgagccctgaagttcaccaatccaatgtgggatggtgcaggctggttaccgcggcttataactactttcatgtgacaaacttcttctggatgtttggagagggatgctatctgcacacagccatagtgctaacttacagcacagacagacttcgtaaatggatgttcatttgtatcggatggggggtaccatttcccatcattgtggcctgggcaatcgggaaattgtattatgacaacgagaaatgctggtttggaaaacgcccaggggtctacaccgactatatatatcagggacctatgattctggtactactcatcaactttattttcctgttcaacatcgtgaggattttgatgaccaaactgcgggcttctacgaccagcgagactatccaatacagaaaagctgtaaaagctactctggtactgcttccgttgctgggtattacgtacatgctgttcttcgtcaaccctggtgaagacgaggtgtctcgcgtggtgtttatatactttaatagctttctcgaaagcttccagggtttctttgtgagcgtcttttattgtttcctcaatagtgaggtgaggtcagccatacggaagagatggcaccgttggcaagataagcactcaatccgggctagggtggccagagccatgagcatcccgacaagccctacaagggtgtccttccattcgattaagcagagcaccgccgtgtag

SEQ ID NO: 49619 - DNA, 378 bp, Artificial Sequence
  Description of Artificial Sequence: Synthetic coding sequence
atgggaggacacccccagctgagactcgtgaaggctctgctgctgctgggcctgaatcccgtcagcgcttcactccaagaccagcactgtgagtccctgagcttggcatcaaacatctctggcctccagtgtaacgcaagcgttgacctcatcggtacttgctggccacgtagccccgctggacaactcgttgtcaggccctgtccagcgttcttttatggagtcagatacaatacaaccaacaatggatatagagaatgcctcgcaaatgggagttgggctgctcgagtgaattacagcgaatgtcaggaaattctgaatgaagaagagcccggaacgcaagcacagcctgggcgagctcatagaggaggcacttag

SEQ ID NO: 49620 - DNA, 1248 bp, Artificial Sequence
  Description of Artificial Sequence: Synthetic coding sequence
atgggaggtcaccctcaattgcgcctcgtaaaagccttactcctactgggccttaaccctgtgtccgcctctctgcaagatcagcattgcgaatcactatctttggcatccaatatcagcggcctgcaatgtaatgcctccgtagacttgattggtacgtgctggccgcgttccccagctggacagcttgtggtgcgaccatgccccgcatttttttacggcgttcgctacaatacgaccaacaatggctacagagagtgtctggctaatggcagctgggcagccagggtgaactacagtgagtgccaagaaatactcaatgaggagaagaaatcaaaagtgcactaccacgtggccgtgatcatcaattatttggggcactgtatcagcctggttgccctcctggtggcattcgtcctcttcctgcgtttgcgatccatcaggtgtctgcgcaatattatccattggaatctgatatctgcctttattctgaggaatgccacttggttcgtggtgcagctgacaatgagccctgaggtgcaccagtctaacgttggatggtgcaggttagttacagcggcatacaattacttccatgtgaccaacttcttttggatgttcggtgagggctgttatctgcatactgcaatagtcttaacctattctactgaccggctacgaaagtggatgttcatctgcattggctggggagtcccattccctatcatagtcgcctgggcgatcgggaagctctactatgacaacgagaagtgctggttcgggaaaaggcctggagtctatacagactacatctaccagggccctatgattctggtcctgctgatcaacttcatttttctgttcaacatcgtacggatactgatgacaaagcttagggcatctacgacctcagagaccatccagtatcgcaaggccgtgaaagccaccctggttttgttgcccttgctcggaataacatacatgctttttttcgtcaacccaggcgaagatgaagtgtcacgcgtagtttttatctacttcaatagttttttggagagctttcagggcttctttgtgagcgtcttttattgctttctgaatagtgaagtacggtctgctatcaggaagaggtggcatagatggcaggataagcactctatccgggctagggtggcaagagcaatgtctattccaacttcaccaactagagtcagctttcactccatcaagcagtcaacggcagtatag

SEQ ID NO: 49621 - DNA, 858 bp, Artificial Sequence
  Description of Artificial Sequence: Synthetic coding sequence
atggtatcagctaccatccctcaaaaaaaatcaaaagttcactatcacgttgcagtgattattaactatttgggccactgcataagtctggtggcattgctagtggcctttgtccttttcctccgtctgcgttctatccgttgtttacgcaatatcattcattggaatctgatctctgcgtttatattaaggaatgccacctggtttgtggtgcaactgactatgtcacccgaggtgcaccaatctaacgtcggctggtgtagactggtcaccgcagcgtataactacttccatgtcaccaatttcttttggatgttcggggaaggttgttatctccacacggctattgtcttgacgtactccactgatcgcctaagaaagtggatgttcatttgcatcggatggggggtgccgttccctataatcgtggcttgggcgattggtaaattgtactacgacaatgaaaaatgctggtttggaaagagacccggagtgtacacggactatatttaccaaggcccaatgattctggtactcctgatcaatttcattttcctgtttaatattgtgcgaatcctgatgacgaagctgagagcctctacgacctccgaaaccatccagtaccgcgcaagcctctgtctgtgcagcaccgtcagtagtatagttcgttccgtgttgccaagcggacgtggagggactgggggacggactagcactcgaagcgtacccgagtggcccgtgccgtgtccatcacctccaccacagcctgtctctgccttcaccgcctcctccagtccccagcagtctgagcttgcgggtcacggtgcagcaccaaaacagctgtggttaggaggttag

SEQ ID NO: 49622 - DNA, 1335 bp, Artificial Sequence
  Description of Artificial Sequence: Synthetic coding sequence
atggggggacatcctcagctcagactggtcaaagcgctgcttctgctgggcctgaatccagtgagtgccagtctccaagaccagcattgcgaaagcctaagcctggcaagtaacatttcaggactccagtgcaacgcctcggttgatctcatcggcacctgttggccccgttctccggctggacagctcgtggttcgtccctgtccagctttcttttacggagttagatacaatacgaccaataacggctaccgggaatgtctggccaatggctcatgggccgcacgggtgaattactccgaatgccaggagatcctcaacgaagagaagaaaagtaaggtgcactatcacgtggccgtgattataaattatttgggccactgtatttcactcgtggccctcctggtggctttcgtgctgttcctgcggttgagacctggttgcacacattggggggaccaggctgatggcgctttggaagtgggtgccccttggagcggcgctccttttcaagtgaggcgctcaatacgctgcctgcggaatatcatccattggaacctcattagcgcattcatcctccggaatgccacttggttcgtcgtgcagcttaccatgtctcccgaggtacaccagagcaacgtcggctggtgtagattagtgacagccgcatacaactacttccatgtgaccaatttcttctggatgttcggggagggatgctatttacatactgccattgtgctgacgtattctacggaccgactgcggaagtggatgtttatttgcatcggatggggcgtgccattccccattatcgttgcatgggccatcggtaagctgtactacgataacgaaaagtgttggtttggcaagaggcccggagtgtacacagattatatttaccaaggacccatgatcttagtgttgctgattaatttcatttttttgttcaacatcgttcggattcttatgacaaagttaagggcatctactacttctgagactatccagtatcgcaaggccgtcaaggctactcttgtcctacttcccttgttggggatcacctacatgctgtttttcgtgaatcccggagaggatgaggtgagccgcgtggtatttatttattttaactctttcctggagtctttccagggtttctttgtttcagtattctactgttttctaaatagcgaggttaggagtgctattagaaagagatggcatagatggcaggataagcattcaattagggcccgtgtcgctagggccatgtccatccccaccagtccaacccgggtgtcattccactcgattaagcagtcgaccgcagtctag

SEQ ID NO: 49623 - DNA, 321 bp, Artificial Sequence
  Description of Artificial Sequence: Synthetic coding sequence
atggcattggaccctgccgatcagcaccttaggcacgttgaaaaggatgtactgatcccgaagatcatgcgagagaaagcgaaggaaagatgttcagagcaggtccaggacttcacaaagtgttgtaaaaattccggagtgctcatggtggtgaaatgtagaaaagagaacagcgctctgaaggagtgcctgactgcttattacaacgacccagctttctacgaggagtgtaagatggagtaccttaaggagcgcgaggagttcaggaagactggcattccaaccaaaaaacgactccagaaactgccaacatcgatgtag

SEQ ID NO: 49624 - DNA, 321 bp, Artificial Sequence
  Description of Artificial Sequence: Synthetic coding sequence
atgtttgctcccgctgtgatgcgggcatttcgtaaaaataagaccctcggttacggggtgccaatgctactgctgatcgtaggcggatcctttgggctccgagagttctcacagatacgctacgatgccgttaagtcaaaaatggatccagagctggagaaaaaattgaaggagaataagatctcactagagtccgagtacgagaagataaaggattctaagtttgacgactggaagaatattaggggccctcgtccttgggaggatcccgacttgttgcagggtcgtaatcctgaatccctcaagacgaagaccacgtag

SEQ ID NO: 49625 - DNA, 1002 bp, Artificial Sequence
  Description of Artificial Sequence: Synthetic coding sequence
atgctttgccgactgggtggacggtggcttagacctttaccagccctgcaattgtgggcgagagatttgcctctggcccctgtccctacatcaggcgcaaaacgcccaaccctgcccgtgtgggccgttgcgccagtgagcgccgtgcacgccaacggttggtatgaggctcttgccgctagtagccccgtacgagtcgccgaggaagtcttgctgggcgtccacgcagcaaccggactgccatggtggggaagcatcttactctccacagtagcactgcggggagccgtgactctgcctttagctgcataccaacactacatcctcgccaaggtggagaacttgcaaccagagattaaaaccatcgcccgacatctgaaccaggaggtagctgtgcgtgccaatcagttggggtggagtaagcgggacgctcgattgacttacctcaagaacatgagaaggttgatctcagagctttacgttcgggataactgccaccctttcaaggccacagttctagtgtggatccagctccctatgtggatctttatgtcattcgccttacggaatttgagcacaggagcagcacattccgaaggttttagtgtgcaagagcagctcgccactggcggaatcctgtggttccctgaccttactgctccagactctacgtggattctgccaatttcagtcggcgttatcaatcttctgattgtagagatttgtgccctacagaagatcggaatgtcgcggttccagacttatatcacctattttgtacgtgccatgagcgtgctgatgattcctattgcggctaccgtcccgtcttctatcgtgctttactggttatgcagctcatttgtcggcctgtcccagaacctgcttctcagatcgcccggtttcagacagctttgccggattccaagcactaagtcagattctgaaactccatataaggacatctttgccgcattcaacactaaatttatcagccgtaagtag

SEQ ID NO: 49626 - DNA, 1005 bp, Artificial Sequence
  Description of Artificial Sequence: Synthetic coding sequence
atgttatgtcgcctgggaggccgatggttacggcctctgccagctcttcagctgtgggcaagagacctgccactggcccctgtccctacaagcggcgctaagcgacccacgttgcctgtttgggcggtggctcctgtgtccgcagtgcatgccaatggttggtacgaggctctcgcggcatcttcccctgtacgagtcgccgaggaggtgctgcttggagttcacgcggctaccgggttaccatggtgggggtccatactgttgtcaacagtggctttgaggggcgctgtgacgctgccccttgctgcttaccagcactacatcctggccaaagtcgaaaaccttcaacctgagataaagaccatagccagacacctgaatcaagaggttgcagtgcgagctaaccaattggggtggagcaagagggacgcccgtttgacgtacttgaagaatatgcgtcggctgatctctgaactatatgtgagagataactgtcacccctttaaagcaacagtgctggtgtggattcaactgccgatgtggatctttatgtcttttgcgttaagaaaccttagcaccggcgcagcccactctgaggccggtttttctgttcaggagcagctggcgaccgggggaattttgtggttcccagatctaacggctccagactccacatggatcctgccgatttcagtgggtgtgataaatctgttaatcgtagagatttgtgccctccagaagatcggaatgtccaggtttcagacatatatcacttactttgtccgagccatgtccgtgctcatgatccccatcgctgccaccgttccttctagcattgtgctttactggctctgttcaagcttcgtgggcttatcccagaatttactgctgcgcagtccaggattccgacagttgtgcagaatcccaagtaccaaaagcgacagcgagacaccctataaagatatcttcgcagcgtttaatactaaatttataagccggaagtag

SEQ ID NO: 49627 - DNA, 2334 bp, Artificial Sequence
  Description of Artificial Sequence: Synthetic coding sequence
atggaggaacccggagcaacaccccaaccatacctgggcctggtactcgaagagcttcggagggtggtcgctgctcttccagagtcaatgagacctgatgagaacccctatggttttcccagtgaattagtggtgtgcgctgctgtcattggtttttttgtggtgttgctgttcctctggcgcagctttaggtccgttcgttccaggctctatgtgggacgcgaacagaagctcggcgctacgctcagcggactgatcgaggagaagtgtaaattgctagagaagttcagccttatccaaaaggaatatgaagggtatgaggtggagagctcactcgaggatgcttcatttgagaaggctgccgcagaagaagcacgctctctcgaagctacctgtgaaaaactcaatcgtagcaattcagagctggaagacgagattctgtgcctggaaaaggacctgaaggaggaaaagagtaagcactcccagcaagatgagctgatggcggatatatcgaaatccatccagtccctagaagacgagtccaaatccctgaagtcacaaatagcagaggctaagattatctgcaagacatttaaaatgtccgaggagcgccgagcaatcgcaatcaaggacgccctcaacgaaaacagtcaactgcaaactagccacaaacagctgtttcagcaggaagctgaagtttggaagggggaagtgagcgagctgaacaagcagaaaatcaccttcgaagactccaaggtccacgcagaacaggtgctaaatgacaaggaaaaccacattaagaccctgacaggacacttgcccatgatgaaggatcaggctgccgtcctggaggaagacaccactgacgatgacaatctggagcttgaggtgaattcgcagtgggagaacggagcaaatctggatgatcctctgaaaggtgccctgaaaaaactcattcacgccgcaaaacttaacgtctccctaaagtccttggagggtgagcgcaaccacattatcattcaactatccgaagttgataaaaccaaagaggagttaacagaacacatcaagaatctgcagactcagcaggcttctttgcaaagcgaaaatatttacttcgagagcgagaaccagaagctgcaacagaagttgaagattatgaccgaattctatcaagagaatgaaatgaaactatatcgcaagctgaccgtcgaagagaattatcggatcgaagaggaggagaagctttcccgcgtggaggagaagatctcaagggctaccgagggtcttgagacctatagaaaactggccaaagacctggaggaagagttagagagaaccgtgcacttctaccagaagcaggtgatctcctatgaaaaacggggacacgacaattggcttgccgcacgcactgccgagcggaatctttcggatctaagaaaggaaaatgctcataacaagcagaaactcaccgaaacagaactaaagttcgagctcctcgagaaggaccctaatgccctggatgtgagtaataccgccttcggtagagaacatagtccctgtagtcctagcccactcggcagaccatcttctgaaacacgggcatttccttctccacagaccctgcttgaagatccactccggcttagtccggtgctgccaggaggtggtggacgaggcccatcttcccctgggaatcctctcgaccaccaaattacaaatgaaaggggagaaccatcttatgatcgtctcattgatcctcacagagctccctccgatacaggctccctaagtagtcccgtggagcaggacaggcggatgatgtttcccccaccaggtcagtcatatcctgacagtaccctgcctccccagcgcgaggacagattctattcaaattccgagcggctaagcgggccagctgaaccccgaagcttcaaaatgacatccctcgacaagatggaccggagcatgccgtccgagatggagtcctcaaggaatgatgcaaaagatgatctgggtaacctgaacgttcctgactcttcattgcccgcagagaatgaagccacgggcccaggtctcatcccccctccgctggcccctataagtgggccacttttcccggtagacacccgtggcccttttatgaggagaggacctccgttcccaccccctcctccaggcaccatgtttggcgctagtcgaggctatttcccgcctagggattttcccggaccccctcatgctccattcgccatgcgcaatatatacccaccacgtggcctgcccccatatctgcaccccagaccgggattctacccgaacccaactttttag

SEQ ID NO: 49628 - DNA, 2334 bp, Artificial Sequence
  Description of Artificial Sequence: Synthetic coding sequence
atggaagagcccggagccacaccccagccctacctgggcctggtactcgaagaactgaggagggtggtggcagctctgcctgagtctatgcggccagacgagaacccatatggtttccctagcgagctggttgtctgcgcagcagtgattgggttctttgtggtcctgttattcctctggcgatcattccgctctgttagatcacgcctctacgtaggccgagagcagaagctaggagcgacactttccggtctcattgaggagaagtgtaaactgcttgaaaagtttagtctgatccaaaaagagtacgagggttacgaggttgagagttctctcgaggacgcttctttcgagaaggcagctgcagaagaagccaggagtttggaggcaacctgtgaaaaactaaataggagcaacagtgagttggaagacgaaatcctctgtctcgaaaaggatctcaaggaggagaaatccaagcattcccaacaggatgagctgatggcagatatctccaagtccattcagtctctggaggacgaatccaaatcgctgaagtctcagatcgcggaggccaagattatatgcaagacatttaagatgtcagaggagcggcgagctatcgccatcaaagacgctctcaatgagaacagccagctgcaaacttcgcataaacagcttttccaacaagaagccgaggtctggaagggccaggtcagcgaacttaacaagcagaaaataactttcgaggattcaaaggttcatgctgagcaggtgcttaatgataaggaaaaccacattaaaactctcacaggacacctgcccatgatgaaggatcaggctgcagtgcttgaggaagacactacggatgacgacaatcttgagctcgaggtcaattcacaatgggagaacggcgctaatctggacgaccccctcaaaggggctctgaaaaaactgatccacgctgccaagctaaatgtgtcccttaagagtttggagggggaacgaaaccatattattatacagttatccgaggtagataagacgaaggaagaacttaccgagcacatcaagaatcttcaaacacagcaggcttctctgcaatctgagaacatctacttcgaaagcgaaaatcaaaagctccaacagaaactcaagattatgaccgaattttatcaagagaacgagatgaagctgtaccggaaacttacagttgaggagaattatcgtatcgaggaggaagagaaactttctagagtggaggagaaaatttctcgcgctaccgaaggattagaaacgtatagaaagttggctaaagacctggaagaagaactcgaaagaaccgttcacttctatcagaaacaggtgatcagctacgaaaagaggggccacgacaactggttagctgcaaggaccgccgaacggaatctcagtgatcttagaaaggagaatgcccacaacaagcagaagctgaccgagactgaactgaaatttgaattattggagaaggaccctaatgcccttgatgtgtctaatacagcctttggccgagaacacagcccgtgttcaccaagtccactgggcaggccaagcagcgagacaagggctttcccttcaccacaaaccctgttagaggatcccctgagattgtcccccgtgcttcccggtggagggggaagaggccctagctcccctgggaatcccctcgaccatcagattactaacgagaggggggaacctagttacgaccgcctcatcgaccctcacagggctccttcggacacaggatccctgagtagtcctgtcgagcaggaccgtcggatgatgttccctcctcctgggcagagctaccctgatagtactttgccccctcagcgagaggaccggttctacagtaactcggagcggcttagtggccctgctgaaccccgaagttttaagatgacgtcactggacaaaatggatcggtccatgcctagcgaaatggaatcttcccgaaatgatgcaaaagatgatctcggaaacctgaacgtgcccgactcttccctccctgcagagaatgaagccaccggcccaggtttcataccccctcctcttgcccctgtccgcggacccttgttccctgttgacactaggggcccttttatgaggagaggcccaccctttccccctccgccaccgggtacgatgtttggggctagcagagggtacttcccaccgagagatttccccggacctccacacgccccattcgccatgcgtaacatttatcctcccagaggcctcccaccttacttacacccaaggcccggtttctatcccaatccgacattttag

SEQ ID NO: 49629 - DNA, 2334 bp, Artificial Sequence
  Description of Artificial Sequence: Synthetic coding sequence
atggaggagccaggcgcaacacctcagccctacctgggcctagtcctggaagagctcggcagggttgtggccgctcttcccgaaagtatgaggccggacgaaaatccatatggttttccaagtgagctggttgtatgcgcagcagtgatcgggttcttcgttgtgctgctgttcctctggcgttcatttcgctctgtcagatcacgactatatgttggtagagagcagaagttaggcgcaacactgtcaggactgatcgaagaaaaatgtaaactgctcgagaagttttccctcatccagaaggaatatgaaggctacgaagtcgaaagctccctggaagacgcctcgttcgagaaggccgctgctgaagaagcccgatctctggaggcaacttgtgagaagctgagccggtcaaacagcgagctggaggacgagatattatgtctggagaaggatctgaaagaggagaagagtaagcattcccagcaagacgaactcatggcggacatctccaagtcaatccaaagcttagaggacgagtcgaaatctcttaagtcccagatcgctgaggctaagataatctgcaagacgtttaaaatgtccgaagaacggagagccatcgcaatcaaagatgcccttaacgaaaattctcagttacagacaagccacaaacagcttttccagcaggaggctgaggtctggaagggccaggtgagcgagcttaataagcaaaagatcacctttgaagacagtaaggtccatgccgaacaggttctaaacgacaaggagaaccatattaaaacattgactggtcatttacctatgatgaaggaccaagccgcagtgttagaggaagatactactgacgacgacaacttagagctaaaagtgaattcccagtgggaaaatggtgcgaaccttgatgacccccctaagggcgctttgaaaaaactcatacatgctgcaaaactcaatgtatcactcaaatcactggagggagaaagaaaccacatcattatccagctgtccgaggtggacaaaacaaaggaggaactcacagagcacattaagaatcttcagacacaacaggcatcgcttcagagcgagaatatttactttgaatcggaaaaccagaagctccagcaaaagctaaagataatgacagaattttaccaggagaatgagatgaaactgtaccggaagctgactgttgaagagaactatagaatcgaagaagaggaaaaattatctagggtggaagagaagatcagtcatgccacagaagaactggagacttatagaaagctcgcaaaagacttggaagaagagttggagagaaccgtacatttctaccagaaacaagttatttcttacgaaaagaggggacatgataattggttagcggctcggacggccgagcgaaatctaagtgatttaaggaaagagaatgcccacaacaagcagaagctcacagagcgcgagctcaaattcgagcttttggaaaaggatccaaatgccctggatgtgtccaacaccgctttcggaagagagcactccccctgctcaccatcaccgttggggagacctagcagcgaaacacgggctttccccagcccccagactttgctcgaagacccactgcggctgagccctgtgttgccgggagggggaggcaggggccctagctcccctggcaaccccctggaccatcagattactaatgaaaggggggagccaagctatgacaggctgatagacccacatagagctcctagcgatactggctcgctgagcagtcccgtcgaacaggacaggcgcatgatgtttcccccacctggacagagctatccggattccaccctgcccccacaacgggaagataggttctacagcaattccgagcgcctgagcggcccagcagaacctcgttccttcaaaatgacctcccttgataagatggatagaagcatgccttccgaaatggagtcctctcgcaatgacgctaaggacgacctgggaaatctgaatgtaccagactctagcctgcccgctgaaaatgaggctactggtcccggtttgattcctccgccactggccccaatcagtggccctttattccctgttgatactcggggacctttcatgagacgtggacctccttttccaccgcctccgcctggtacgatgttcggggcatcccgcggatactttccccctagagactttccaggcccacctcacgccccattcgccatgaggaacatttaccctccacgcggtctaccaccgtacttgcatccacggccaggtttttaccccaaccccacgttttag

SEQ ID NO: 49630 - DNA, 735 bp, Artificial Sequence
  Description of Artificial Sequence: Synthetic coding sequence
atgatgcgcacgcagtgcttactgggcctcagaacattcgtggcttttgcagcgaaactctggtctttcttcatctaccttcttagacgacagattcgaacggtgatacagtaccagaccgtgcgttacgacatactccctctcagtccggtcagtcggaacagactggctcaagtgaagagaaagatcctggttctcgacctggacgaaacactgattcatagccatcatgacggcgtcttgcgccctaccgttaggcccggaactcccccagacttcatcctcaaagtggtcatcgacaagcaccctgtgagattcttcgtccacaagcgtcctcatgtggatttcttcctcgaagtggtgtcacagtggtatgaactcgtggtcttcactgcttccatggagatctatggtagcgccgtagctgacaagctcgataactctcgttctattctcaagaggcgatattatcggcaacattgtacactcgaactgggtagctacatcaaggacctcagcgtggtgcactccgacctttcttccatcgtgatcctagacaacagccccggtgcttaccgtagccatcccgacaacgctatccctataaaatcctggttttccgacccttccgatacagccctgctcaacctgttaccaatgttagacgcacttagatttacagctgacgtacggtcggtgctctcaaggaaccttcaccaacatcggctgtggtag

SEQ ID NO: 49631 - DNA, 735 bp, Artificial Sequence
  Description of Artificial Sequence: Synthetic coding sequence
atgatgcgtacacagtgcctgctaggactgcggactttcgttgcgttcgccgcaaagctctggtccttcttcatatacctgttgaggcgccagatccgaacagtcatccagtaccagactgtccggtatgatatcctgccgctgagtcctgtcagtcgaaaccgacttgcccaagtaaaaaggaagatcctggtgctggatctcgacgagacgctgattcacagtcaccacgatggcgttctgcgcccaactgtgcggcctggaacaccaccagactttattctcaaggtagtgattgacaagcaccccgtgcgctttttcgtgcataagagaccacatgtggattttttccttgaggtggttagccaatggtacgagctggtagtgttcaccgcttctatggagatttacggcagtgccgtcgcagacaaactcgacaattccagaagcatccttaaaagacggtactaccgtcagcattgcacactggaattggggtcttacataaaagacctctcagttgtccatagcgatctatcttccatcgttatattagacaactctccgggagcctatcgctctcacccagataacgccatcccaatcaagtcctggttcagcgatccttctgacacagctctcctgaatttgctccccatgctcgacgcgctgagattcacagccgatgttagatctgtactttcacggaatttgcatcagcaccgtttatggtag

SEQ ID NO: 49632 - DNA, 690 bp, Artificial Sequence
  Description of Artificial Sequence: Synthetic coding sequence
atgcaggatgaggacggctatattactcttaatattaagacaaggaaacccgcactcatctctgtgggctccgcctcttcaagctggtggcgcgttatggcattaattctgttaatcctgtgcgtcgggatggttgttggtctcgtagccctggggatttggtctgttatgcagcgcaactatcttcagggcgaaaacgaaaacaggaccgggacactccaacagctagccaagcggttttgtcagtacgtggtgaagcaatcagaacttaagggcacatttaaagggcataaatgctccccctgcgatacaaattggaggtattatggggatagttgttacggtttctttcgacataacctgacctgggaagaatcaaagcagtattgcaccgatatgaatgctacactgctcaagatcgacaatagaaatatcgtggaatacatcaaagctaggacccatcttatccgctgggtcggcctgagtcggcagaagtccaacgaagtgtggaagtgggaagacggctcagtgataagcgaaaatatgtttgaatttctcgaggatggcaaaggcaacatgaactgcgcttactttcacaatggcaaaatgcaccctaccttttgcgagaataaacactatctgatgtgtgagcgcaaagccggaatgacgaaggtggaccagctcccctag

SEQ ID NO: 49633 - DNA, 591 bp, Artificial Sequence
  Description of Artificial Sequence: Synthetic coding sequence
atgcaggacgaggatgggtacatcaccctcaatattaagacgagaaagcctgcactaatttctgccgtgatgcagcgcaactacttacagggagaaaacgaaaataggacgggcactctgcagcagttagccaagaggttttgccagtacgtagtaaaacagagtgagcttaagggtacctttaagggccacaaatgctcaccttgtgacactaactggagatactacggcgacagctgttacggatttttccgacataaccttacatgggaagaatctaaacaatattgcacagacatgaatgcaactctgttgaagattgacaatagaaacattgtcgagtacattaaagcccgtactcatcttattcgctgggtcggcctgagtcgccagaaaagtaatgaggtatggaagtgggaggatggcagcgtgatctcagagaacatgttcgagttcctcgaagatggcaaggggaatatgaactgcgcctattttcataacggaaagatgcatcccacgttctgtgaaaataagcactaccttatgtgtgagagaaaggccggtatgactaaggtggaccagcttccatag

SEQ ID NO: 49634 - DNA, 417 bp, Artificial Sequence
  Description of Artificial Sequence: Synthetic coding sequence
cataaatgcagtccttgtgacaccaactggcggtactacggtgacagctgttacgggttcttccgccataacttaacatgggaggaatccaaacaatactgtactgacatgaatgctacactgctaaaaatcgactctaaagaagagaagttgtttcttaccagtttcaggattctgactatagttttcatatgggtcggcttgagcagacagaagtccaacgaggtgtggaaatgggaagatggcagcgtaatcagcgacagtctgttctcacagtccaacttccaaaacggaaaaggaaacatgaattgtgcatatttccacaatggcaaaatgcatccaaccttctgtgagaataaacattacctcatgtgtgagagaaaggcaggtatgacaaaagtggatcaacttccttag

SEQ ID NO: 49635 - DNA, 591 bp, Artificial Sequence
  Description of Artificial Sequence: Synthetic coding sequence
atgcaggatgaagatggatacattacacttaacattaagacgaggaaaccagcacttattagcgctgtgatgcagagaaactacctgcagggtgagaacgaaaataggaccggcacactccagcaactcgcaaagagattttgccagtacgtcgtcaagcagtcagagctcaaagggacatttaaggggcacaagtgctccccatgcgacactaattggcgatactatggggactcctgctatggctttttccggcacaatctgacctgggaggaaagtaagcagtattgcaccgacatgaatgctaccctgctgaagattgataataggaatatcgtagagtacatcaaggcaagaacgcatctgattcgttgggtggggctaagccggcagaagtctaatgaagtatggaaatgggaggatggttcggtgatcagcgagaatatgtttgagtttctcgaggacggcaagggcaacatgaattgtgcttactttcataatggcaaaatgcacccaaccttttgtgaaaacaagcactatcttatgtgtgagcgcaaagcaggaatgaccaaggtcgaccagcttccatag

SEQ ID NO: 49636 - DNA, 831 bp, Artificial Sequence
  Description of Artificial Sequence: Synthetic coding sequence
atgtcagaggaagtcacatatgccaccctgacattccaagatagcgctggtgctcgaaacaaccgcgacggaaataacctgcgaaagcgcggtcaccccgcaccatcaccaatctggcgtcatgccgctctgggtcttgtgaccctgtgtctgatgctgctgatcggcctggtgacactgggcatgatgtttcttcagatctcgaatgatattaatagtgacagcgaaaagttgtctcagctacagaaaacaatccagcagcagcaggacaatctaagtcaacagctgggaaactcaaataacttaagtatggaagaggaatttctgaaatcacagatttcctctgtccttaagcgccaggaacagatggcaatcaagctctgccaggagcttataattcacacctcagatcatagatgtaatccttgccctaagatgtggcagtggtatcaaaatagttgctactactttacaacaaatgaagaaaagacttgggccaactcccggaaggattgcattgacaaaaacagcaccctcgtgaagatcgactcactggaggagaaagactttctcatgagccagccgttgctgatgttttcattcttctggttaggcctttcgtgggactcgtcgggtaggtcttggttttgggaagacgggtccgtgccgagcccctccctgttttccacgaaggaattggaccagatcaacggcagcaaaggttgtgcatatttccagaaaggcaacatctatatcagcaggtgttccgccgagatattctggatatgtgagaaaactgccgcacctgtcaaaaccgaagatctggattag

SEQ ID NO: 49637 - DNA, 699 bp, Artificial Sequence
  Description of Artificial Sequence: Synthetic coding sequence
atgtcagaggaggttacctatgctacattgaccttccaggattcggcgggtgccagaaataacagagatggtaataacctgcgcaagaggggacaccccgcaccctcaccaatctggaggcacgccgctctcggcctggtaacactgtgcctgatgctgctcataggcctcgtgacgcttgggatgatgttcctccagatcagcaatgacataaatagtgacagcgaaaaactcagtcagctgcagaaaactattcagcagcagcaagacaatttatcacagcagcttggaaattccaataatttatctatggaggaggaattcctcaaatcccagatatcgagcgtgcttaaaaggcaggaacagatggctattaaactgtgccaagagctgattattcatacttcggaccacaggtgcaacccatgtcccaagatgtggcagtggtaccagaactcctgctactactttacgaccaacgaggaaaaaacctgggcaaactcgcgaaaggactgcatcgataagaattctactctcgtgaaaattgatagcctggaagagaaggactttctcatgagtcaaccactcctaatgttctcctttttttggctgggcctgagttgggacagtagtgggcgatcatggttttgggaggacggctctgtaccatccccgtccctgtatgtatcaaattactag

SEQ ID NO: 49638 - DNA, 1473 bp, Artificial Sequence
  Description of Artificial Sequence: Synthetic coding sequence
atgagacctgcctttgccctgtgtttgctgtggcaggcattgtggccaggaccgggaggaggagaacatccaaccgctgaccgggctggctgtagcgcctcaggtgcgtgttatagtctccaccacgcaaccatgaaaagacaggcagctgaagaggcctgcattttgcggggaggtgctttgtccaccgtaagggccggtgctgagttacgcgcagtcctggccctgctcagagccggaccagggcctggcggaggcagcaaggatctactcttttgggttgcacttgagaggaggcgctcacattgcacactggagaacgaacctctgcggggtttttcttggctgagctctgaccctgggggtctagaatcagacactcttcagtgggttgaagagccccagagaagctgcaccgcacggcgatgcgctgttcttcaagctacaggtggcgtcgagcctgcagggtggaaggagatgaggtgtcatctcagggcaaacgggtatctgtgtaaatatcagttcgaagtcctgtgtcctgcacctcgccctggagccgcttctaacctctcttacagggctccttttcagctgcattccgccgcattagacttcagcccccctgggaccgaggtgtcggctctgtgtcgcggacagcttcccatcagcgtgacctgcatcgccgacgaaataggcgctaggtgggataaactgagcggagacgtgctgtgcccatgccctgggcgatacctgcgggctggtaagtgcgccgaactacccaattgcttagatgaccttgggggattcgcctgtgagtgcgctacgggattcgaattgggtaaagacgggaggagttgcgttaccagtggtgagggacagccaacgttgggcggtacaggggtccctacacggagaccaccagctacagccacaagtcctgtcccgcaacgcacctggcctattcgggtcgacgagaagctcggcgaaacacctctggttccggagcaggacaattccgtcacgagtatacctgagatccctaggtggggctctcagagcaccatgtcaactctgcaaatgtctctgcaggcagagtcgaaggccacaatcactcctagcggctccgttatttctaaattcaattctaccacctcatccgccactcctcaagcattcgactcttcatccgctgtcgtgtttatcttcgtcagcacggccgtcgttgtattggtgattttaacaatgaccgtcttaggtcttgtgaagctctgttttcacgaatccccgtcctcacagccgagaaaggagagtatggggccacccggtcttgaaagtgaccctgagcccgctgcgctaggtagctcttctgcccactgtacaaacaatggcgtgaaagttggagactgtgatctgagggatcgggctgaaggggcactgctggccgagtcaccgttaggctcctcagatgcctag

SEQ ID NO: 49639 - DNA, 633 bp, Artificial Sequence
  Description of Artificial Sequence: Synthetic coding sequence
ggtacaaacagcagggccatgtgttgcgtacctcccggacggtacttgcgcgcaggcaagtgtgcagagcttcccaactgcctggacgatctgggtggattcgcctgcgaatgcgctactgggttcgagttagggaaggatgggcgatcatgcgtcacgtccggtgaaggtcagccaacgctgggcggaacaggagtacctactagaaggcctccagctaccgccacatcccccgtgcctcagcggacctggccaataagggtagacgagaaactgggtgaaacaccgctggtgcctgaacaggataacagcgtgaccagcattccagaaataccacgatggggctcacagagcactatgtcaacccttcagatgtccttgcaagccgagagtaaagccaccatcacgccttcaggaagtgtgattagtaagtttaactccactacttcctctgcgacaccccaggcctttgacagtagtagtgctgttgtcttcatttttgtgtccacagcggtggtggtgttagtgatccttacaatgacggtgcttggcctggttaaactgtgtttccacgagtccccctcatcgcagccacgcaaggagtcaatgggccctccaggtctggaatcttag

SEQ ID NO: 49640 - DNA, 870 bp, Artificial Sequence
  Description of Artificial Sequence: Synthetic coding sequence
atgcacaacctttattcaatcacaggctatcccgatccacctggaaccatggaggaggaggaggaggacgacgattacgagaacagcactccgccatataaagacctgccaccgaaacccggaaccatggaagaagaggaggaagatgacgactacgaaaacagtactcctccctataaagatctgccgccaaagccggctctgaccctttcttttagttcacctggaagttcagcaccaccccgaccgcctcgggctgctaaagagaccgaaaagccaccattgccatgcaagccacgtaatatgaccggtctagaccttgcggctgtcacatgcccaccaccacaactggccgtcaatctggaacccagtcctcttcagccctctctcgcagccacgccagtgccgtggctgaatcagcggtctggcggaccgggatgctgtcagaagcggtggatggtgtatctgtgcctgctcgtggtgactagcctgtttttggggtgcctggggttaactgtgacactgatcaagtaccaggagctgatggaagagctgcgcatgctttcatttcaacagatgacatggcggacaaatatgacaggaatggccggattagccggattaaagcatgacattgctcgggttcgggcagacaccaatcaaagtttggtggaactgtgggggctgctggactgtagacgcattacatgtcccgaagggtggctgccattcgaaggcaaatgctactactttagtccctctacaaaatcctgggacgaggcaagaatgttttgccaagaaaactatagccacctggtcattatcaattcgtttgctgagcatttgctgggcgctaggggaacccagtag

SEQ ID NO: 49641 - DNA, 1137 bp, Artificial Sequence
  Description of Artificial Sequence: Synthetic coding sequence
atgcacaatctgtattccataacagggtaccccgatccccctgggaccatggaggaggaagaggaagatgatgactacgaaaactccacccccccatacaaggacttgcctccaaaacctggcaccatggaagaggaggaggaggacgatgactatgaaaattctaccccaccttataaggatctgccccctaaacccggaactatggaggaagaagaggaggacgacgactacgagaacagcactcccccatacaaggatctcccaccgaaaccgggaagctcagccccacccaggcccccaagggccgcaaaggaaaccgaaaagcctcccttgccctgcaagccgaggaatatgacaggcttggacctcgctgccgtcacctgcccacctccgcagctggccgtcaacctcgaaccatcgcccttacagcccagtctcgccgcaactccagtgccgtggctgaatcagagaagtggagggcctggctgctgtcagaagagatggatggtatatctctgcctgctggtggttaccagtctctttctaggctgtctcggcctcacagtgaccctgattaaatatcaggaacttatggaggaactgagaatgctgagctttcaacagatgacctggagaaccaacatgaccgggatggctggactggccggattaaagcacgacatcgcaagggttcgcgcagacaccaatcaaagcctggtggagctttggggcctcctcgactgccggagaatcacttgtcccgagggatggttacccttcgaggggaaatgttattacttttctccatcaacaaagagttgggacgaggccaggatgttttgtcaggagaactactcccatctggttattatcaactcattcgctgagcataacttcgtagcaaaagcccacggctctccgcgagtctactggctgggccttaatgatcgtgctcaggagggtgattggcgttggctggacggctcaccagtgacactcagtttttgggagcccgaggagcctaataatattcacgacgaagactgcgctacaatgaataaaggaggcacgtggaacgatctgagctgctataagaccacttattggatctgtgaaaggaagtgttcctgctag

SEQ ID NO: 49642 - DNA, 921 bp, Artificial Sequence
  Description of Artificial Sequence: Synthetic coding sequence
atgcacaacctgtacagcatcaccgggtatcccgatcctcccggaacaatggaagaagaggaggaggatgacgattatgaaaatagtactcccccttacaaggacttacctccaaaacccggtactatggaggaagaagaggaagatgacgactacgagaacagcacccctccttacaaggacctacccccaaaacctggaaccatggaggaggaggaagaggacgatgactacgagaactcgacgcctccgtataaggacttgccccctaaacccggttctagcgcacccccaaggcctcctcgcgctgccaaagaaacagagaaaccgcctctcccttgcaaacctcgcaatatgacaggcttggatctcgccgcagtcacatgtccgcctccccaactcgccgtgaacctcgagcctagccctctgcagccatcacttgcagccactcccgttccctggctgaatcagcgatctggcggtccagggtgctgccagaaaaggtggatggtttacctgtgtttactcgtggttactagcctctttttaggttgcctgggtttaacggtgactcttatcaagtatcaagaattaatggaagagttgcggatgttaagcttccagcagatgacttggcgaaccaacatgactggcatggcgggtctggctgggttgaagcacgacatagcacgagttcgggctgacaccaaccagtccttagtggaactttggggtctgctggactgtagacgcataacatgtccagaaggttggttgcctttcgaaggcaagtgctactacttcagcccttcgaccaagagctgggacgaggctcgtatgttttgtcaggagaactattctcacctggtgataattaattcttttgctgaacatctcttaggtgctcgaggtacgcagtag

SEQ ID NO: 49643 - DNA, 1770 bp, Artificial Sequence
  Description of Artificial Sequence: Synthetic coding sequence
atggatggcgaggccgtgcgtttctgcactgataaccagtgcgtctctttgcaccctcaagaggtcgactcagtcgcaatggcacccgcagccccaaaaattccacgacttgtgcaggctactccggcttttatggcggtgactctggtgtttagtctagttactctcttcgtcgtggttcagcaacagacccgtccagttcccaaacccgttcaggccgtgattttaggcgacaacattacaggacaccttccatttgaacctaacaaccaccatcattttggtagggaagcggaaatgagagaactgattcagacattcaaaggccatatggaaaatagctcggcatgggtcgtggagattcagatgttaaaatgccgtgttgataacgttaattcccagctccaggtcctgggggaccacctcgggaatacaaacgcggatattcagatggttaaaggcgtcctaaaggatgccacgaccctttctctgcagacccaaatgcttcgcagtagcctggaggggactaacgccgagattcagcgtctgaaggaagacttggagaaggccgacgccctgacattccagacactaaactttcttaaatcctccctcgagaacacttcgatcgagctgcacgttttgtcacgcggtttggagaacgctaattccgaaatccagatgctgaatgcttcactggaaaccgctaacacccaagcccaactggcgaattcctcactcaaaaatgcaaacgcagaaatatacgttctgaggggtcacctcgacagcgtgaacgacctcaggacacagaaccaggtactccgaaactccctggaaggagctaatgctgaaatccaggggctcaaggagaacctccagaatactaacgcactaaatagtcagacacaggccttcattaaaagctcatttgacaacacatcagccgagatccaatttctacggggtcacttggaacgagctggggatgaaattcacgtgctaaagcgcgatctaaaaatggtgacagcccagacccagaaggcaaacgggagacttgaccaaacagacacccaaattcaagtcttcaaatccgagatggaaaacgtgaatacccttaatgcccagatccaagtgctcaacggacacatgaagaatgcatcccgcgagatccaaaccctgaagcaaggtatgaagaacgcgtccgctcttacatctcagacacagatgctggattctaacctgcagaaggcatccgccgagattcaaaggctgcggggtgacctcgagaacacaaaggccctcactatggaaattcagcaggaacaaagcaggttaaagacccttcatgtggtgattacaagccaggaacagcttcagcgcactcaaagtcagcttctgcagatggttctgcaagggtggaagttcaacggaggctccctctactacttctcttcagttaaaaagtcttggcatgaggcagagcagttctgcgtgtcacagggagcccatctggccagcgtggcttcaaaagaagaacaggctttccttgtggaatttaccagtaaagtttactattggattggtctcacagaccggggaactgagggcagttggcggtggaccgacggcacaccatttaatgcagcccaaaacaaagcccctggtagtaagggatcatgtccattgcgaaagtatatcattgtcaactcaggaatgggagcctgctccttcatagacactcctccatgcccctggattctctccaactag

SEQ ID NO: 49644 - DNA, 882 bp, Artificial Sequence
  Description of Artificial Sequence: Synthetic coding sequence
atggacactacccgttattcaaaatgggggggatcatcagaggaggtccctggtgggccttggggccgttgggtccattggtcacgtaggcctttatttttggccttagctgtactagtaaccactgtattatgggccgtcatcctcagcatcctgctatccaaagcgagtacggaacgagctgccctgctggacggacacgacttgttgagaaccaacgcctcaaaacagacagcggctctgggggcacttaaagaagaggtgggcgattgtcattcatgctgctcgggcacacaggcacagttgcagaccactcgggctgaattgggtgaggcacaggcaaaactcatggaacaggaaagcgccttgagagagcttagagagcgggtcactcaggggttggccgaagccggacgcggaagagaggatgttcggacagagctgttcagagcattagaagctgttcgattgcagaacaactcctgcgagccctgccctacatcctggcttagtttcgaaggaagctgctatttctttagcgttcctaaaaccacttgggctgcagcccaagaccactgcgctgacgcgtcggcacatctcgtgattgttggaggtctggatgaacagggctttctaaccagaaacactcggggaagaggttactggctgggtcttcgcgcagtccgccacctgggtaaggtgcagggttaccagtgggtggatggcgtgagtttgagcttcagtcactggaatcaaggcgagccaaatgacgcttggggaagggagaattgtgttatgatgctgcacacgggtctgtggaatgatgcaccgtgtgatagcgaaaaagatggctggatctgcgagaagcgccacaattgctag

SEQ ID NO: 49645 - DNA, 759 bp, Artificial Sequence
  Description of Artificial Sequence: Synthetic coding sequence
atggagcaagagagcgctcttcgcgaactccgggagcgcgtgacacagggcttagccgaggccggacggggtcgggaagacgtgagaacggagctctttcgcgcactggaagctgtgagactccagaataactcatgtgaaccctgcccaacctcctggctctcttttgaaggaagctgttacttcttctcagttcccaagaccacttgggctgctgcacaggatcactgtgcggatgcgtcagcccacttggtgattgtcgggggattggacgaacaggggtttttgacccggaatacacggggtaggggatattggctaggcctgcgagccgtgcggcatttaggtaaagtgcagggctatcaatgggtggacggtgtctccctgtcattctctcactggaaccaaggcgagcccaacgacgcatggggtcgagagaattgcgtgatgatgttgcacacaggcctttggaacgacgcaccctgcgatagcgaaaaggacgggtggatttgcgaaaaggctcagcttctgacccctcccagtgccctcgagcccaggcccctccaacatgtggtgtcatggggactgcttaccagcctcgcccctggcgcagattgccaacgcgtgtttagctctagcagcacagccgctgaaagtcaaaaacacttagcacaacacagccctgtacagccctccgcgtgggctttggggcctccttgtagacctcacccaaactctacccacgctgaccccacttag

SEQ ID NO: 49646 - DNA, 726 bp, Artificial Sequence
  Description of Artificial Sequence: Synthetic coding sequence
atgcacgaggaagagatttacacttctttacaatgggattcccccgctcctgatacataccaaaaatgcctgtcgtccaataagtgtagcggagcatgctgtctcgtaatggtgatcagttgcgtgttttgcatgggacttctgactgcctccatcttcctgggtgttaaactgctgcaggtgtccaccatcgcaatgcagcaacaggaaaagctcattcagcaggagcgcgcattactgaactttactgaatggaagcgctcttgtgctttgcagatgaaatattgtcaggcctttatgcaaaactctttgagctccgctcacaacagcagcccttgccctaataactggatccagaacagggagagttgctattacgtctccgagatctggtctatatggcatacgtcccaagaaaactgtctgaaggaaggaagcactctgctgcaaatcgaatcaaaagaagagatggacttcataacgggcagtctcaggaaaattaaggggtcatacgattactgggtgggcctgagccaggacgggcactcaggcagatggttatggcaagacgggagcagcccatcccctggtttgctcccggcagagaggtcacagagcgctaatcaggtctgcgggtatgtgaagtccaattctcttttgtcctcaaactgttcaacttggaagtactttatctgtgagaagtacgcactccggtccagcgtatag

SEQ ID NO: 49647 - DNA, 504 bp, Artificial Sequence
  Description of Artificial Sequence: Synthetic coding sequence
atggtcagtaatttttttcacgtgatccaagttttcgaaaagtcagccactctgatctccaaaaccgagcatatcgggttcgtgatctacagctggcgaaagtcaactactcacctaggatcgagacgcaagtttgccatatctatctatctctcagaggtcagcctgcaaaaatatgattgtccgttctctggtaccagctttgtggtcttcagtttgttccttatctgtgcgatggcaggggatgttgtgtatgctgacataaaaactgttaggacctcccccctggagcttgcgttcccactgcagcgttccgtctctttcaacttcagtaccgtccacaaatcttgtccagccaaggactggaaagtgcataagggcaaatgctactggatagcggaaacgaaaaagtcctggaacaagagccagaatgattgtgcaattaataactcgtatctgatggttatacaggacatcaccgccatggtacgattcaacatttag

SEQ ID NO: 49648 - DNA, 108 bp, Artificial Sequence
  Description of Artificial Sequence: Synthetic coding sequence
caggatatcactgccatgcttatcactttcttactttacctgcagatggcctttctacaatgtgtctatatcagtgatgtgagtgtctacccaaacttcttcctctag

SEQ ID NO: 49649 - DNA, 726 bp, Artificial Sequence
  Description of Artificial Sequence: Synthetic coding sequence
atgggacacaacagcactgttgaaattatctatatcaccgaggatgacgttatacagtcccagaacgcactgggtaagtacaatacatcaatggccctctttgagagtaacagtttcgagaagactatcctggagtccccgtattatgtcgatctgaatcagacactctttgtgcaggtgagcttacacacctccgatcccaatttagtcgttttcctggatacatgccgagcctcacctacttcagactttgcatctcctacgtatgacctcatcaagagtggctgctcccgcgacgaaacctgtaaggtgtatcctctgtttggacactatggacggttccagtttaacgctttcaaatttttacgctcaatgtccagcgtttatctacagtgtaaagtgctgatctgtgatagtagcgatcatcagtccaggtgtaaccagggttgcgtgtcaaggagtaaacgcgacatctcttcttacaaatggaagaccgactcaattataggtcctattcgtctcaagcgcgaccgctctgccagtggcaattcaggattccaacacgagacgcacgccgaggaaacacccaaccaacccttcaattcggttcacctcttctctttcatggtgctggcattgaatgtagtaaccgtggccacaattactgttagacattttgtaaatcaacgagcggactacaaatatcagaagttgcagaactattag

SEQ ID NO: 49650 - DNA, 981 bp, Artificial Sequence
  Description of Artificial Sequence: Synthetic coding sequence
atgcgggtgattatatcaaaaagttacctggaagcgttcaactccaatgggaacaatcttcagcttaaggatcccacatgccgcccaaagcttagtaatgtggtagaatttagcgttcccctaaacgggtgtggcaccatcaggaaagttgaagatcagagcatcacctatactaatatcatcacattctcagcgtcaagtacatctgaagtaattacccgacagaagcagctccaaatcatcgtgaagtgtgagatgggccacaattccacggtcgagatcatatatattaccgaagatgatgtgattcagtcgcagaatgccttgggcaagtataacactagtatggcactcttcgagtctaacagtttcgaaaaaacaatcctcgaaagcccctactacgtggatcttaaccaaactttgttcgttcaggtatcactgcatacttctgaccccaacttggtggtgttcttggatacgtgccgcgcttccccaacctccgacttcgctagtcctacatatgatctgattaagtcaggatgttccagagacgagacttgcaaggtgtatcccctctttggtcactacggcaggtttcaatttaacgccttcaagtttctacggagcatgagcagcgtgtaccttcagtgtaaagtgctgatctgtgattctagtgaccatcagagccggtgcaaccagggatgcgttagccgttcgaaaagagatatcagcagctacaagtggaaaacagactctatcatcggccctatcagacttaagcgggacaggtcagcctccggcaattccgggtttcagcatgaaacacatgccgaggagacgcctaatcagcctttcaacagcgtacatctattttccttcatggtactggctctgaacgtggtaacagtggcaacaataaccgtccgccacttcgtcaatcagcgcgcagattacaagtaccagaagctccagaattattag

SEQ ID NO: 49651 - DNA, 981 bp, Artificial Sequence
  Description of Artificial Sequence: Synthetic coding sequence
atgcgcgtcattatatccaaatcctatcttgaggcattcaatagtaatgggaacaatctgcagctgaaagaccccacctgccgaccgaagctatcgaacgtggtggaattttctgttcctcttaatggatgcgggacaatccgaaaagtggaagaccaatccattacatacactaatatcataactttctctgcctcttccacttccgaggtgattacacgtcagaagcagctgcagataatcgtcaaatgtgagatgggccacaatagcaccgtcgagattatctatattacagaggatgatgtaattcagtcccagaacgccctgggcaagtacaacacgagcatggcactgtttgagagcaatagttttgaaaagaccattctggagtccccttactatgtggacttgaaccagacccttttcgtccaagtctcactgcatacaagcgaccctaatctggtcgtgtttctggacacttgtcgcgcaagcccaacctccgacttcgccagccctacatacgatctgatcaaatctggttgctccagggacgaaacttgcaaggtctaccccctgttcggccactacggcaggttccagtttaacgcttttaaattcctccggagcatgagcagtgtctatctgcagtgcaaggtccttatctgcgattcctccgaccatcaatctcggtgtaaccagggatgcgtctcccgctcaaaacgggatatcagcagctataaatggaagacagactccatcattggacccatccgcctgaagagagacaggtccgcttccggcaattccggttttcagcacgaaacccatgcggaggaaactcctaatcagccttttaatagtgttcatctgttcagcttcatggtcctcgcgcttaatgtcgtgaccgtggctacaatcacggtcaggcattttgtcaaccagagggctgactacaaatatcaaaagctgcagaattactag

SEQ ID NO: 49652 - DNA, 981 bp, Artificial Sequence
  Description of Artificial Sequence: Synthetic coding sequence
atgcgcgtgataattagcaaaagttacctggaggccttcaatagtaatggaaataacctccagctcaaagatcccacatgtcgcccaaaactctcaaatgtggtggaattcagcgtgccactcaacgggtgcgggactattaggaaggtggaggatcagtccatcacctacaccaacattatcaccttctcagccagctccaccagcgaggtgattacacgtcagaaacagctgcagatcatcgttaaatgcgaaatggggcacaatagcacagttgagatcatatacatcactgaagacgacgttattcagagccagaacgccctaggcaagtacaatacgagcatggctctgtttgaatcaaacagctttgagaagaccattcttgaatccccctattacgtggacctgaatcagaccctgttcgttcaggtgtcactgcacacaagtgatcctaacctagtagtgttcctcgacacctgtagggcctcacctacttcagattttgccagccccacttacgatctcatcaagtctggctgcagcagagacgagacatgtaaggtgtatccgctttttgggcactacggcagattccagttcaatgcctttaaatttctgcgtagcatgtcttcagtctatctgcagtgtaaggtcttgatctgcgactccagcgatcaccagagtaggtgtaatcagggatgcgtgtcccgatcaaagagggacataagctcctataagtggaagacagatagcatcataggcccaatcagacttaaaagagaccgctctgcatctggtaattcagggtttcagcacgagacccatgcagaagagacccccaatcagcctttcaattcggttcatcttttcagtttcatggttctggccttaaacgtggttaccgttgcaacaatcacggttagacacttcgtgaaccagcgcgcagactacaagtatcagaaactgcagaattattag

SEQ ID NO: 49653 - DNA, 1824 bp, Artificial Sequence
  Description of Artificial Sequence: Synthetic coding sequence
atggaactcgtgcgtaggctgatgccgctgaccctcctcattctctcctgcctcgcggaactaacaatggcagaggctgaaggcaacgcgtcctgcaccgtttcactgggaggtgccaacatggccgagacgcataaggccatgattctacagctcaaccccagtgagaattgcacatggactattgagagaccagaaaataagtccatccgtataatcttttcttatgtccaactggatcccgacggttcatgcgagagtgagaacatcaaggtctttgacgggaccagcagtaatggcccattgttaggtcaggtctgctctaaaaacgattacgtgccggtcttcgaatcctccagttcaactctgacatttcaaatcgttacagactccgcacgaattcagcggactgttttcgtcttctattactttttttccccaaacatctcaattcccaattgcggaggatacctggacaccttggagggctcatttacttctcctaattacccgaaaccccatcctgagctcgcttactgcgtgtggcacatccaggtggagaaagactacaaaatcaagcttaactttaaagaaatctttttagaaatagataaacaatgtaagtttgacttccttgccatatacgatgggccatcgactaattcaggactgattggccaagtgtgcggtcgtgtcactccaacttttgagtctagctccaactcactaacagtggtgctgagtacagattacgccaattcatacaggggattcagcgcctcttatactagcatctacgctgaaaatattaacactacttcacttacctgtagtagcgatcggatgagagtgattatctccaagtcttatctcgaagcctttaattctaatgggaataacctgcagttgaaagatccaacgtgccggcctaaactcagtaacgtggtagagtttagcgttcctctgaacgggtgcgggaccattcgtaaagttgaggatcagtctatcacttacaccaacatcatcaccttctcggcaagctctaccagtgaggtgatcaccagacaaaagcagctccaaataatcgtcaagtgcgagatgggccacaactctactgtcgagattatttacatcactgaggatgatgtgatccagtctcaaaacgcactgggaaagtataatacttctatggcccttttcgagtctaattctttcgagaagacgatcctggagagcccctactatgtcgacctgaatcaaaccctgtttgtgcaggtatctctgcacacatctgatccaaacctggtggtctttctcgatacatgccgggcttcccccacgagtgactttgcaagtccaacctatgatctgataaagtctgggtgtagtagggacgaaacatgcaaagtgtatcctctgttcggccattatggacgtttccaattcaatgctttcaaattcctgcgatctatgtcttccgtttatctgcagtgcaaagtactaatctgtgacagcagtgaccaccaaagtcgatgcaatcaggggtgcgtcagtagatccaagcgggatatctcctcctacaagtggaagactgatagtatcataggccctatacgcttgaaaagagatcgatctgcatccggcaactctgggtttcagcacgaaacccacgctgaggagacccctaaccaaccatttaatagcgtccatctcttcagctttatggttctcgctctcaatgtggttactgtcgccaccattactgtgagacacttcgtgaatcagagggccgactacaaatatcaaaagctccagaactattag

SEQ ID NO: 49654 - DNA, 2238 bp, Artificial Sequence
  Description of Artificial Sequence: Synthetic coding sequence
atgcggcctgacagccacccatatgggttcccatgggagctggttattagagccgcagtcgccggattttttgcggtccttttcttgtggaggtcctttaggtccgtgacctctaggctgtacgtcaggcgcgagaagaagttcgcagtggcactgagcgggctcatcgaggaaaaatgcaagctactggagaaattttctctggttcaaaaggaatatgagggctacgaggttgaaagctccttgaaaaatgcatcctttgagaaagaagccaccgaggctcaatcgttggaagccacctgtgagaagctaaataggttcaattcagagctggtgcatgaaattctgtgtctggaaaaagaacttaaggaggagaagtcaaagcattcagagcagaacgagctgatggctgatattagcaagcgcatacaaagtctcgaggatgagagtaagtccttgaaaagtcaggttgccgaggcaaagatgacgttcaagagatttcaggccaatgaggaaaggctagagatagaaattcaggacgcatggaaagagaactcagagctgcaggaaagccagaagcaactgctacaggaggccgaggtgtggaaggaacaggtgtccgagctgatcaaacagaaacgtaccttcgaggattccaaggtgcacgctgagcaggtactcaacgataaagaaaatcatatcaaaacgctaaccgaacgcttgttgaaaatgaaggacggtgtggctatgctggaagaagatgtgacagacgacgacaaccttgagctggagatgaatagcgagagtgaggacggcgcttacctcgacaatcctccaaagggagcattgaagaagctcatccacgctgctaagttgaatgctagccttaagactcttgaaggtgaacgcaaccagatctatatccagttgtctgaggtagacaaaacgaaggaggagctcaccgaacacattaaaaacctccagaccgaacaggcaagccttcagtcagagaacactcacttcgagagcgagaatcagaagctgcagcagaaactgaaggtgatgacggagttatatcaggagaatgaaatgaagctgtacagaaaacttatcgtggaggaaaagtgtaggctggaaaaagaagagaagttaagcaaggtggacgaaatgatcagtcatgccaccgaggagttggagacatataggaagcgagccaaagatctgaaggagttcgagaaaacaattcatttctaccaaaaaaaaataatcctgcacgagaagaaggcacatgacaactggagcgcagcctggacggcggagcgcaatctcaatgacctacggaaagaaaacgctcataaccggcagaagcttacagaaattgaatttaagatcaagctcttggaaaaggacccgtacggactggatgtgcctaacactgctttcggtcgccagcactcgccctacggcccatcgccactgggttggcccagctcagagacacgggcttccctgtaccctcccaccctacttgaaggaccgctgcgactatctccacttctgccacggggaggcggacggggttcgaggggacccggaaatccccctgatcatcaaataacaaaggaaagaggcgaaagcagctgtgacagactgacggatcctcatagagctccctccgacgccggaccgctggcgccaccctgggaacaggactatcgcatgatgttccccccaccgggacagagctaccccgactcagccctgccgcctcaaagacaggaccggttttattcaaactgcgctaggctcagcggacctgccgaactgcgcagtttcaacatgccgtccctggacaaaatggacggctcaatgcccagcgagatggaatccagcagaaatgataccaaggacaatctgggaaatctgaaagttcccgattccagtctccctgctgagaacgaggctacaggcccagggtttgtacccccacctctggctcctatccgcggactcttatttcctgtggataccagagggccttttatcaggagaggaccaccgtttccaccgcctcctcctggcactgttttcggggcatctcctgactactttagtcctcgagacgtccccggtccaccgagagccccattcgctatgaggaatgtgtaccttccgaggggcttcctgccctaccggccaccacgtcccgctttttttcctccagctcctaccttttag

SEQ ID NO: 49655 - DNA, 225 bp, Artificial Sequence
  Description of Artificial Sequence: Synthetic coding sequence
atgtttgtcatcatcagcctgcacaactgcgttgtgatcagttttgtcctgtttctgtttggcggtaacaatttcatccagaacttctatctgccccagaattacatcgatcagttccttctgacctcatttcctacatttacaagcgtcggcgtgctcattgtccttgtattatgctcagcattcctgctgctttggcagggggaaggagtgaacctgcgctag

SEQ ID NO: 49656 - DNA, 4518 bp, Artificial Sequence
  Description of Artificial Sequence: Synthetic coding sequence
atgctttgtgttgctggtgcccgtttgaagcgcgaactggacgcaactgctactgttctcgccaatcgacaagatgagagcgagcagagcagaaaacgtctcattgaacagtctagagagtttaagaaaaataccccagaggatctgagaaaacaggtagcaccccttttgaagagtttccagggagagatcgacgccctgtccaagcgttcaaaggaggctgaagccgcattccttaacgtctataaacggctgatcgatgtccccgatccagtgcctgcactggaccttggacaacagctgcagctaaaggttcagcgacttcacgatattgagaccgagaatcaaaagttgagagaaacactggaagaatacaataaggaattcgcagaagttaagaaccaggaggtaactatcaaagctttgaaggagaagattagggagtatgaacagactctgaaaaaccaagctgaaaccatcgcattagaaaaagagcagaagctgcagaacgattttgccgaaaaggagcgcaagcttcaagaaacccaaatgagcacaacatctaagctagaggaggctgagcataaagtccagagtttgcagacggctctagaaaaaaccagaacagagctattcgacctaaagaccaagtatgatgaagagactaccgcaaaagcagacgagattgagatgatcatgacagaccttgaacgcgcaaatcagagggccgaggtcgcacaacgagaggctgaaacattaagggaacaactgtctagtgcaaatcactccttgcaacttgcatcccagatccagaaggcccctgatgtcgagcaagctatcgaggttctgacccgctcttcacttgaagtggagcttgcggcaaaggagcgggagatcgcacagcttgtggaagatgtacaacgactgcaagctagcctaaccaagctacgagagaactccgcaagccaaatctcccagctggaacagcaactgagtgcaaagaatagcactctaaaacagctggaagagaagctcaaaggccaagcagattatgaggaggtgaaaaaggaacttaacatcttaaagtccatggaattcgcccctagcgaaggagcaggtactcaggacgcagcaaaaccgctcgaagttcttcttttggaaaagaatagatctctgcagtctgagaacgccgcactccggataagcaatagtgacctcagtggaagcgcgaggagaaagggaaaggatcagcctgaatctcgacggccaggttcactccctgcgccaccgccttcacagctgcctcggaatccgggtgaacaggcatctaacaccaatggaacccatcagtttagtccagccggattgtcccaggacttcttttcgagtagcttagcctctccttccctccctctggcctcaacgggcaaattcgccttgaattccctcctgcaacgccagctcatgcagagcttctacagcaaagctatgcaggaagccggatccacctcaatgattttctccacaggaccttactctaccaactccattagttctcagtcgccgctgcagcaatcaccagatgtcaacggaatggcgccatcccctagccagagcgagagcgccggttctgtatcagagggtgaggaaatggacactgcagagatcgcccgtcaagtgaaagagcagttaataaaacacaatattggccagcgcatctttggacactacgtcctaggtttgtctcagggctccgttagcgaaatcctggctcggcctaagccttggaataagctgactgtcaggggcaaagaaccctttcataagatgaaacagttcctcagtgacgagcagaatatcctcgcattgcggagtatacaggggagacaacgagagaaccccggacagtccctgaatcggttgttccaagaagtacctaagcggagaaacggctctgaggggaatatcactacgagaattcgggctagtgagacaggttctgatgaggctattaagtccatcctggaacaggccaagcgggagttacaggttcagaagacagcagagcccgcacagccaagcagcgcctcaggttctggcaatagtgacgatgcgattagaagcattctccaacaagcacgcagagaaatggaggcgcagcaggcagcactggaccctgcactcaagcaagcccctttatctcaaagcgacataacaatccttactccaaagctactgagcacatcgcccatgcccaccgtgtcttcctatccccctctggctatcagcctgaagaaaccaagtgccgctcccgaagctggcgctagcgccctgcctaaccctccggcactgaagaaggaagcccaagatgctcctggcctagacccacagggagcagcagattgcgcgcagggggtgttacgacaagtgaagaatgaagtgggccgatcaggggcttggaaagaccactggtggtccgccgtgcagccggagaggcgcaacgctgcatcatccgaagaggctaaggcggaggaaaccgggggtggaaaagaaaaggggagtgggggaagtgggggaggctcccagccacgcgctgagagaagccagttacagggtccctcctcctccgagtattggaaggagtggccaagtgcagaaagtccatattcccaatctagtgagctcagtctgacgggggcttctcgcagcgaaacgcctcagaatagtcccctgcccagcagccccattgtacctatgagtaaacccaccaagccttccgttcccccactcactccagagcagtacgaggtgtacatgtatcaggaggtggacactatcgaacttactcgccaggtgaaggagaagctggcaaaaaatggcatctgccagcgcatattcggggagaaagtcctcggattaagtcagggctccgtgtccgacatgctgtcccgtcctaaaccatggagcaagttgacgcaaaagggcagggagccttttattcgaatgcaactttggctgaatggtgagctggggcagggcgtgttgcccgtgcaggggcaacagcaaggacccgttctgcatagtgttaccagtctgcaggacccactgcaacaaggctgcgtgtcaagcgaatccacacctaaaacctccgcaagctgttcccccgcacctgagtctccgatgtcttcctcagagtccgtgaaaagcctcacagagctggttcaacagccatgcccgcctatagaagcgtccaaggattctaaaccgcctgagccgagtgatcccccagccagcgacagccagcccaccacgcccctccctctttcaggtcattccgccctctccatccaggaacttgtcgccatgagccccgagctggacacatacggaattacaaagcgggtgaaggaagtcctcactgacaataacttgggacagaggctttttggcgaaacgatcctcggcctgacccaggggtctgtatcggatttgcttgcccgaccgaagccctggcataaactgtccttgaaaggaagggaacctttcgtgagaatgcagctgtggctgaatgatcccaataacgtggaaaaattgatggatatgaagcggatggaaaagaaagcctacatgaagcggaggcattcttcagtatctgattcccagccctgcgagcctccttccgtgggcacagagtattcacaaggcgcttccccgcagccacaacaccagttgaagaagccaagggtcgtcttggctccagaggagaaggaagcgttgaaacgagcttaccagcagaaaccctatcccagccccaagacaatcgaggacctcgctacccagctaaacttgaaaacatcaaccgtgatcaattggttccataactaccgctctcgaatccggcgtgagctgttcatcgaggagatacaggctggctcacaggggcaggccggtgccagcgacagtccctccgcgcgttcgggacgagctgccccttcctctgaaggggattcctgtgatggtgtggaggcaacagagggcccaggcagcgccgacaccgaggagcctaagtctcagggagaggctgagagggaggaagtgcccagacctgcagagcagaccgagccaccgcctagcggaacccctggcccagacgacgcaagagatgatgatcatgaaggaggaccagtagaagggccaggtccactgcccagtccagcctccgccaccgcaaccgccgcaccagccgcacccgaggatgcagccactagcgctgccgcagcacctggcgagggcccagccgcacccagtagcgcccctcctccctcaaactccagcagctcgtccgcgcctagaaggccctcttcattgcaatccctctttggactgcccgaggctgcaggggcaagggattccagagacaatccactgcggaaaaagaaggctgccaatctgaactctattatccacaggctggagaaggccgcatcccgtgaagagccaatcgaatgggagttttaa

SEQ ID NO: 49657 - DNA, 2037 bp, Artificial Sequence
  Description of Artificial Sequence: Synthetic coding sequence
atggctgctaacgtcgggagcatgtttcaatactggaagcggttcgacctgcagcagctgcagcgcgagctggatgcaactgccactgtgctcgccaatcgacaggatgaaagtgaacagtcaagaaagcggcttattgagcaatccagagaattcaagaagaatacacctgaggacctaaggaaacaggttgctcctctgctcaagtcttttcaaggtgaaatcgatgctttgtcgaagcggagcaaagaggcagaagctgctttcttgaatgtctacaagcgcctgattgacgtgcctgatcccgtcccggctctagacttaggccaacagctgcagctaaaggtccagaggttgcacgatatagaaactgaaaaccaaaagctacgagagactctcgaagaatacaacaaagaatttgcagaagtaaagaatcaggaggtgacaattaaagcccttaaggagaaaattagggagtatgagcaaacccttaaaaatcaggctgaaacgattgcattagagaaggaacaaaagcttcaaaatgatttcgccgagaaggaacgcaaactccaggagactcaaatgtcgactacctccaaactcgaggaagctgaacataaggtccaaagtctccaaactgccttagagaagactcgcacggaactgttcgacctcaagacaaaatatgatgaggaaacaacagcgaaggcagatgaaattgaaatgataatgaccgacctcgaacgggcaaaccagcgggcagaagtagctcagagggaagcagagactttgcgcgaacagctctcgtccgcaaaccatagtctgcaattggcatcgcagatccagaaggctcctgatgtggagcaggctattgaggtgctgacccggagttccctcgaggtcgaacttgccgcaaaggagcgggagatagctcagctggtggaggacgtgcagcgcttacaggcctccctgacaaaactgagggaaaattccgcttcccaaatctcacagctggaacagcagctctctgccaagaatagcacgctgaagcagctcgaggagaaactgaaaggtcaggctgactatgaggaggtcaaaaaggaactgaacattttgaagtccatggaatttgccccaagtgagggggcagggacccaggacgctgctaagcccctggaggtgctattgttggaaaagaaccgctccctgcagtcagaaaacgcagccctcaggatctccaattctgacctgtctggaagatgtgccgaattacaggtgagaatcactgaagcagtggccactgccacagagcagagagaattaatcgccagactagaacaggacctgagcatcatccagagcattcagcggcctgatgccgagggtgcggcagaacatagactcgagaagattcctgaacctatcaaagaagccactgcccttttttatgggcctgcggcaccagcatccggcgctcttcccgaagggcaggtggatagtctgttgagtatcatctccagccagagggaaaggtttcgggctcgtaaccaagaattggaggcagagaatcggctggcacagcataccttgcaggctttacagtccgaattagatagtctcagagctgataacattaagctgttcgagaagattaagttcctgcagtcctatcctggaagaggctcaggatcagacgatactgaactgcgctatagttcacagtacgaagagagactggatcctttttccagcttctcaaagcgggaacgccagaggaaatatctgtctctctccccatgggataaagcaaccttgagcatggggagacttgtgctgagcaataagatggcacgcactattgggtttttctacactctgtttctgcattgcctcgtcttcctggttctgtataaactcgcctggagcgaaagtatggagcgggattgtgccacattctgcgctaagaagtttgcggaccacttgcataagttccacgagaacgacaatggggctgccgcaggggatctttggcagtag

SEQ ID NO: 49658 - DNA, 4550 bp, Artificial Sequence
  Description of Artificial Sequence: Synthetic coding sequence
atggctgcaaacgtgggctctatgtttcaatactggaaacgattcgatctccagcaattgcaaagggagttagatgcgacagctaccgtgctggccaatagacaagacgaatcagagcagtctaggaaacgactgatagagcaatctcgggaatttaaaaagaatactccagaagacctgaggaagcaagttgcccctctcctcaaatcctttcaaggggaaattgatgccctaagcaagcgaagtaaggaggccgaggcagccttcctgaatgtgtacaagcgcctcatcgacgtgcccgaccctgtgccagctctggatctggggcagcagctccaattaaaggtgcagagacttcatgacatcgaaactgagaaccagaagctgcgcgagacgctggaggagtataacaaagagttcgcggaagtcaaaaaccaagaggtgaccataaaggccttgaaggagaaaatccgagagtatgaacagacactaaaaaatcaggctgagacaatcgcactggaaaaggaacagaagctgcaaaacgattttgccgagaaggagagaaaattgcaagaaacccagatgtcaaccacaagtaagttagaggaggctgaacataaagtgcagtcgctccaaaccgcactggagaaaaccaggaccgaactcttcgatcttaagaccaaatatgacgaggagactacagccaaagctgacgagatcgaaatgatcatgacagatcttgaacgggcaaatcaaagggccgaggttgcccagagggaggccgaaaccttgcgagaacagctcagctccgccaatcactccctgcagcttgctagtcagattcaaaaggcccctgatgtagaacaggcaattgaagttctgactcgatcttcattggaggtggaacttgcagcaaaggaacgggagatcgcacagttggttgaagacgtgcaacggctccaggcatcactcacgaaactcagggagaactcagcatcccagataagccagctggagcagcagttgtccgcaaagaattcaaccctgaagcaattagaggaaaagctgaagggacaggccgactatgaggaggtgaagaaagagctcaacatattgaaatcgatggagttcgccccttccgagggggcagggacacaggatgctgcaaagccgctggaagttctcctccttgaaaagaataggtctctgcagtccgagaacgcagctttgagaatctctaatagcgatctctcgggctctgctaggcggaaggggaaggatcagccagagtcaagaaggccagggagcctgcctgcccctcccccttcccagcttcccagaaaccccggtgaacaggcttctaacacgaacggcactcatcagttctccccggcaggcctcagtcaggattttttctcctcctcactcgcgtccccctcattacctctagctagtacgggcaagtttgccctgaatagcctcctgcaaagacagctcatgcaaagtttttattcgaaggcgatgcaagaggccggttcgacctctatgattttttccaccggcccatacagtaccaactctatatcttcccagtcaccactacagcagtcgcctgacgtcaacggaatggccccaagcccgtcccaaagcgagtccgctggaagcgtgagtgagggggaagaaatggacacagcggaaattgcccgtcaggtgaaggaacagttaatcaagcataatatcggtcagcggatcttcgggcattatgtgctgggcctgtctcaggggtcagtgagcgagatcctcgccaggcctaagccttggaacaaactgaccgtacggggaaaagagccgttccataaaatgaagcaatttctgagtgatgagcagaatattttggccctccggtccatccaggggcgacaaagggagaatccaggacaaagcctgaatagactgtttcaagaagtgcccaagcggagaaatggatcggagggcaacatcaccactagaatacgagcatccgagacaggaagtgacgaagctatcaagagtatcctggagcaggccaaaagggagctgcaggtgcagaagacagccgagcccgcacagccatccagtgccagcgggtcgggtaattccgacgatgctatccgctctatcctgcaacaggccagaagggaaatggaggcacagcaagctgctctagatcccgctcttaagcaagcacccctgagccagtcagatataaccattctcacaccaaaattgttatctacatcacctatgcctactgtgagctcgtatcccccactggcaattagcctgaaaaagccgtcggctgcgcctgaagctggtgcaagtgctctgcctaaccccccagccctgaagaaagaggcacaagacgctccgggactggacccgcagggcgcagcggactgcgcccagggggtccttcggcaggtaaagaacgaagtgggccgaagcggcgcttggaaggaccattggtggagcgcggtgcagcccgaacggaggaacgcagcctctagcgaagaagctaaggccgaggaaaccgggggaggaaaagagaaagggagcggtgggtctggcggaggctcacagcctagggctgagcgtagtcagttgcaggggcctagttcctctgagtactggaaggaatggccaagtgccgagtctccttactcacagagttccgagctaagcctgaccggagccagccgctccgagactccacagaactctcctctgccatcgagccctatcgtccctatgagcaaacccaccaagccctcggtccctccactgacccccgaacagtacgaggtgtatatgtaccaggaagtggacacaatcgagcttacaaggcaagttaaggagaaattagccaagaatggaatatgccagagaatctttggggagaaggtactgggcctctcccagggttcggtgtctgacatgttgtcccgccctaaaccttggtctaagcttacacagaagggtcgggagccctttattaggatgcagctgtggcttaatggggaactgggacagggagttctcccagtgcagggccaacagcagggcccagtgctgcattccgttacatccctccaagatccacttcagcagggttgcgtcagtagcgagagcacccctaagacaagcgcttcatgcagcccggctcctgagtcaccaatgagctcatctgagagtgtgaagagtctgacagagctggtccagcagccttgcccgccaatcgaggcatcaaaggattccaagccgccagagcctagcgatccgccagcctctgactcacaaccaaccaccccccttcccttgtctggtcacagcgcgctctccattcaggaattggtggccatgtcacccgagcttgacacctacggtattacgaaaagggtgaaagaggtattaactgacaataatctcggccaacgactatttggtgagacaatactcggcctgacacagggctccgtgagcgacctattagctcgtccaaaaccctggcataaactctctctaaagggacgagagcccttcgttaggatgcagctgtggctgaacgaccctaacaacgtcgagaagctaatggacatgaagcggatggaaaaaaaagcgtatatgaagaggcgccactcttcagtttccgactcccagccttgtgagcccccatctgtgggcaccgagtattcccagggtgcatcaccccagccccagcatcaactcaaaaagccacgggtcgtgcttgccccagaagaaaaggaggccctcaagagggcataccagcaaaaaccctatccatctccaaagactatcgaggacctggccacccagttgaacctgaaaacaagcactgtgatcaattggtttcacaattatcggagtcgtatccggagagaactgtttatcgaagagattcaggccggtagccagggacaggctggagcttccgacagcccttccgctaggtcagggagagcagcaccctctagcgagggggattcttgcgatggcgtggaggccacagaaggacccggatccgcagacaccgaagagcccaagtctcagggggaagccgagcgggaggaggtgcccaggcccgctgagcagactgaacccccaccttctggtacccccggaccagatgacgccagggatgatgatcatgaaggagggcctgtggaaggtccgggacctctgccaagccctgcctctgccacggccaccgctgccccagccgctcctgaggacgccgcaacttcagccgctgccgctcccggagaaggtccagctgcccctagcagcgccccaccgccatctaacagttccagttccagcgcccctcggcgacctagcagtctccagagcctcttcggacttcctgaagcggctggggctcgagattctcgggacaatccattaagaaagaagaaagcagccaatctgaactccatcattcacagactggagaaggcggctagcagagaggaacctattgaatgggagtttta

SEQ ID NO: 49659 - DNA, 1920 bp, Artificial Sequence
  Description of Artificial Sequence: Synthetic coding sequence
atggccgcaaatgtgggttctatgttccaatattggaaaaggtttgatttgcaacagcttcaggacttgcggaaacaggtggccccattgctcaaatctttccaaggtgaaattgatgctctgagtaagaggtccaaggaggcagaagcagcatttctaaacgtatataaaaggctgattgacgtacctgatccagtgccagctctggacctgggccaacagctccagctgaaagttcagagactgcacgacatcgaaacagagaatcagaagcttcgcgaaaccctcgaggagtataataaggaattcgcagaggtaaagaaccaagaggtgaccatcaaggctcttaaggagaagattcgggaatatgaacagactctgaagaatcaagccgaaactattgccctcgagaaggagcaaaaacttcagaacgactttgcagaaaaagagcgcaaattgcaggaaacccaaatgagcaccacaagcaagctggaagaggctgagcacaaagtgcaaagcttgcagaccgccctggagaaaacacgaaccgagctctttgatcttaaaactaagtatgatgaggagacaacagctaaggccgatgagattgaaatgattatgacagatttggaacgcgcaaaccagcgagcagaggtcgcgcaacgggaagccgaaactttgcgagagcagctgagctccgcaaaccactccttacaactggccagtcagatacagaaagccccagatgttgccattgaggtcctcacccgatctagcctggaagtggaactcgcggcaaaagaacgagagatcgcccaactggtcgaggatgtgcagcggttacaggcaagtcttaccaaactgcgcgagaattccgcttctcaaatttcacagcttgagcagcagctgagtgctaaaaattctactctgaagcagttggaggaaaagttaaaaggtcaggcagattatgaggaggtcaaaaaagagctgaatatcttaaagtctatggaattcgcccctagtgaaggggctggaacccaggatgccgcaaaacccctggaggtgctccttctcgagaagaaccgcagcttacagagtgagaacgccgctctgcgcatctctaattcggacctgagcggaaggtgcgctgagctgcaggtacgaatcacagaggcagtggcaacggccaccgagcagcgggaacttatcgccaggcttgagcaagatctgagtatcattcagtcaatccaacggccagatgctgaaggagccgctgaacacaggcttgaaaagatacctgaaccaatcaaagaggccacagctttattttatggaccagcagcaccagcatcaggcgctctacccgagggacaagtcgactcgctcttgtccattattagctcccagagggaacggtttagggccagaaatcaagaactggaagctgagaaccgactggcccagcataccctgcaggcactgcagagtgagctagacagcctgcgggcagataatataaaactttttgaaaaaatcaaatttctgcagtcttacccgggtcgcggatcgggctccgacgacactgaattacgctatagcagtcagtatgaagagaggctggaccctttctcttccttctcgaagcgcgaaagacaaaggaaatacttgagcctgtccccttgggataaggctacactgtctatggggagactggtgctctctaataagatggcgcgaaccattggcttcttttacaccctatttctgcactgtcttgtttttctggttctgtacaaacttgcctggagcgagagtatggaacgggattgtgctacattctgcgctaaaaagtttgccgatcatctgcataagttccatgaaaacgataacggcgctgcggcaggagacctgtggcagtag

SEQ ID NO: 49660 - DNA, 1899 bp, Artificial Sequence
  Description of Artificial Sequence: Synthetic coding sequence
atggcggcaaacgttggctcaatgtttcagtactggaaaaggttcgatcttcagcaattacagagagagcttgatgccaccgctactgtcttagccaacaggcaagacgagtccgagcagagcaggaaacgcctgattgagcagtctagggaatttaaaaagaacacccccgaagatctgcgcaagcaggtcgccccactgctcaaatcttttcagggggagatcgatgccttatccaagaggagcaaggaggcagaggctgctttcctgaatgtttataaacgcctgatcgatgtacctgaggttaccataaaagctttgaaagagaaaattcgcgagtacgaacagacgcttaaaaaccaagctgagaccattgccctggagaaagaacagaagttgcagaacgattttgcggaaaaggagagaaagctgcaggagactcagatgtctactacctctaagctggaagaggccgagcacaaggttcagagtctacaaaccgcactggaaaaaaccaggacagagctgtttgatttaaaaaccaaatatgacgaagagacaaccgcaaaggccgatgagatcgagatgattatgaccgatctggagcgcgcaaaccagcgggctgaggtggcccagagggaggcagagactctgcgcgaacagcttagtagcgccaaccactcactacagttggcctctcagatccaaaaagcaccagacgtggagcaggcaattgaagtgctgactcggtcctctttggaagtggagcttgccgcaaaagagcgggagatagcacagcttgtcgaggatgtccagagactccaggcaagcttgacaaaactccgggagaattcagcctctcagatctcacagcttgagcagcaactgtcggccaagaatagcacccttaaacaactggaagagaaactgaaaggacaggcggattatgaggaagtcaaaaaagagctgaatatactgaaatcaatggagttcgctccaagcgagggggctggcacacaggatgccgctaaaccattagaggttctgctgttagagaagaatcgttcactgcaaagtgagaatgccgcactgcgcattagcaacagcgacctctcgggtagatgtgccgaattacaggtgcgtatcactgaggccgtggctacggccacggagcagcgagagctgatcgcgaggctagagcaggatttgtccattatccagtcaattcaacgcccagatgccgagggagctgccgaacataggctggaaaagatccccgaacctattaaggaggcaacagcgctgttctatggtcctgccgctcctgctagcggggctctgcctgaaggtcaggttgatagcctgctgagcattatctcttcacagcgggaacgcttccgggctcgtaaccaagagctggaggccgaaaacagactggctcagcacaccctgcaagccctacagtctgaacttgattcactgcgcgcagataatattaaattgtttgaaaaaatcaagtttctgcaatcataccctgggcgtggctcgggctccgatgatacagagttgcgctattcttcccaatacgaggaaagactcgaccccttctcatctttttcaaagcgggagcgacagcgcaagtatctctctctgagcccttgggacaaggctaccctgagcatgggtaggctcgtactgagtaataagatggcgaggaccatcggtttcttctacacacttttcctccattgtctggtgtttttagtgctctataaactagcgtggtcagagtcaatggagcgcgattgtgccacattctgtgccaaaaaatttgcagaccatctccacaagttccacgagaacgacaacggggctgcagccggagacctttggcagtag

SEQ ID NO: 49661 - DNA, 2031 bp, Artificial Sequence
  Description of Artificial Sequence: Synthetic coding sequence
atggccgctaacgtgggcagcatgtttcagtactggaagcgtttcgaccttcagcaactccagcgagagcttgatgccaccgccaccgtcttggcaaatcgacaggatgagtctgagcagtcgagaaagagattgattgagcagagcagagaattcaagaagaacacgcccgaggacctgcgtaagcaggttgctccacttttgaagagcttccagggcgaaatcgacgccctttctaaacggtctaaggaagcagaggccgcatttctcaacgtgtataaacggctcatcgacgtccctgatccagttccggctctcgatctagggcagcagctccagctcaaggtccagcggctccatgacatcgaaacagagaatcaaaagcttcgtgagacactggaggagtataacaaagaattcgccgaggtcaagaaccaagaagttactattaaagccctcaaggagaaaatcagggagtatgaacaaaccctaaagaatcaagctgagaccatcgccctggaaaaagagcagaagttgcagaatgactttgccgagaaggagagaaagctgcaggagactcaaatgagcactacatcgaagctcgaagaagcggaacacaaggtgcagtcattgcagaccgcactggaaaagacacggactgaactctttgatctgaagactaaatacgatgaggaaacaaccgccaaagccgatgagattgaaatgattatgacagatctggaaagagccaaccaaagggccgaagttgcccagagagaagccgaaacacttagggagcagctgagttccgcaaaccattcattgcaactcgcttctcagatccagaaagcacctgacgtggctatagaggtcctaacccggtctagccttgaggtggagctggcggcaaaggagcgggaaatcgctcagttggtggaggatgtccaacggctacaagcctcactgaccaagctgcgagaaaactctgcaagccagatctctcagctagagcagcagctgagcgcaaaaaactcaacattgaaacagctggaggaaaagctgaagggacaggcggattacgaggaggtcaagaaggaactcaatatcctgaagagtatggagtttgccccatccgaaggcgctggtacacaagatgccgctaagccccttgaagtgctgctcctcgagaaaaataggtctctgcagtctgaaaacgccgctctgaggatttccaattcggacttatcaggcaggtgcgctgagctacaggttagaatcacggaggcagtcgccacagccaccgagcagagagagcttatagccagactagaacaggacctgagcatcatccagagcatccagcgacctgacgcagagggggctgccgagcaccgactggaaaagatcccggaaccaatcaaggaggccaccgctctcttttacgggccagcagctccggcttctggtgctctccccgaaggacaggtcgattcgctgctctctatcatttccagtcaaagggaacgtttccgggcaagaaatcaagagctggaagcggagaaccgactagcccagcatacgctacaggctttgcagtccgagctggatagcctccgcgcagataacattaagctgttcgaaaaaattaagtttctacaatcgtaccctggcagggggagcgggtccgatgacacagaattgcgctacagcagtcaatatgaagagagattggatcccttttcctccttcagcaaacgcgaacgacaaaggaagtacctgagcctctccccgtgggacaaggctactctatctatgggcaggcttgtcctatccaataagatggccaggaccatcgggtttttttataccttgttcttacactgtctggttttcctcgtactgtataagctcgcgtggtcggagtctatggaaagggattgtgcaacattctgtgctaaaaaattcgccgaccacctgcacaaatttcacgaaaacgataatggggctgctgctggtgatttatggcaatag

SEQ ID NO: 49662 - DNA, 4212 bp, Artificial Sequence
  Description of Artificial Sequence: Synthetic coding sequence
atgctctgtgtggccggagcgaggctaaagagagagctcgacgcgactgcaactgtcctcgccaacaggcaggacgagtctgaacaatcacgaaagcggcttattgaacaatcccgtgagttcaagaagaacaccccagaggatttgcgcaagcaagtggctcctttattgaaatctttccagggtgagattgacgctctgagcaaaaggtccaaagaggcagaagccgctttcttgaatgtgtataagaggctaatcgatgtgcctgatcctgtcccagctttggatctggggcagcagctgcagcttaaagtgcagcgtctgcacgatatcgagaccgagaaccagaaactgcgcgagacactggaggagtacaacaaggagtttgctgaggttaaaaatcaagaggtgacaatcaaggcactcaaagagaagatccgcgaatacgaacagaccctcaaaaaccaagctgagaccattgctctcgagaaggagcagaagctgcaaaacgacttcgccgagaaggagaggaaactccaggagacacagatgagtactactagtaagctggaagaggctgaacataaagtccagtccctccaaaccgccctcgagaaaacacgaacagagctcttcgatcttaagacgaaatacgatgaggagacaactgcgaaagccgatgagatcgagatgattatgacagaccttgagagagctaatcagcgcgctgaagtagctcagagagaagctgaaacattaagggaacagttgagctctgcaaaccattcactccagctggccagtcagattcagaaggctccagatgtcgagcaagcaatcgaagtcctgaccaggagcagtctggaagtggaactcgccgcaaaggaaagggagattgcccaactagtagaggacgtgcaaaggctccaggccagcctgacaaagctcagagagaacagtgcgtcacagatttctcagttggaacagcagctctctgccaagaattctacattaaaacagctagaagagaagctcaagggccaggcagattacgaggaggttaaaaaggaactaaacatcctgaagtctatggagtttgctcccagtgagggggctggtactcaggatgctgccaaacccttagaagtgttgttgctggagaagaatcgtagcttgcagagcgagaatgctgcccttagaatcagcaacagcgacctgagcggtccatattccaccaacagcatctcctcgcaatccccactgcagcagagccccgatgttaacgggatggccccaagtccttcccagagtgagtccgctgggagcgtttctgaaggggaggaaatggacacagctgagattgcaaggcaggttaaagagcagctgatcaagcacaacattggacagcgcatatttggtcactacgtgctgggtctgagtcagggatctgtctccgagatactggcgagaccgaaaccgtggaataaactcactgtcagaggcaaggagcctttccataagatgaaacagtttttgagcgatgaacaaaacatactggctttgagaagcatacaaggtaggcagagggaaaaccctggtcagtcattaaatcgcctgttccaggaggtgcccaaacgccgtaacgggtccgaaggcaacattactacacggatccgggcttctgagactgggtccgatgaggctatcaaaagtatcctagaacaagcgaagcgggagttgcaggtccagaaaaccgcagagcctgcacaaccttcttctgctagtggatctggaaactcggatgatgcgatccgtagcattcttcagcaggcacgcagagagatggaagctcagcaagcggctcttgatccagctctgaaacaggctccattgagtcagtcagacataacaattctgacccccaaactgcttagtacttcaccaatgcctacagtatcttcttaccccccactcgcaatatcactcaagaagccttccgctgccccagaagccggagcttcagcacttccaaatccacctgctcttaagaaagaagcccaggacgcacctggtttggacccccagggggctgcggactgtgcccagggggtgcttcgccaggtgaagaacgaggtgggacggagtggcgcatggaaagaccactggtggagcgccgtgcagccagagcggagaaatgccgcaagctccgaagaagctaaggctgaagagacagggggaggcaaggagaaaggctcgggtggaagtggcggagggtcccagccgagggccgagcggagccagctgcaaggaccatcatcctcagagtactggaaggagtggccatctgccgaatctccttattcacagtcatcggaactcagcctgacaggggctagccgctcagagacaccccagaatagtcccctgccaagctcacccatagttcccatgagcaaaccaaccaagccctcagtccccccactgacccccgaacagtacgaggtgtatatgtaccaggaggtggataccatcgaacttactaggcaggttaaggagaaactggcaaagaacgggatctgccagagaatcttcggagagaaggtcctgggtctgagtcaaggtagtgtttctgacatgttgagcaggcctaaaccatggtcgaaactgacacaaaagggtagggagccgttcattaggatgcagctgtggctaaatggcgaactgggccaaggtgttctgcctgtccagggccagcagcagggccctgtattacacagcgttaccagcctgcaagacccacttcagcagggctgtgtgtcctctgagtccacccccaaaacttcagcatcctgcagtcccgcacctgagagtcctatgagcagctctgaatcagtgaagtcgctgaccgagctcgtgcagcaaccttgtccccctatagaggctagcaaggattcaaaaccaccagagccctcagatcccccagcaagtgactctcaacccaccacaccattgcctcttagcgggcatagtgcgttgagcatacaggaactggttgcaatgtccccagaattggatacctacgggatcaccaaacgcgtgaaggaagtactgacagataataacttgggtcagaggttgttcggggagaccatattgggactaacccagggctccgtgtctgacctgctggccaggcctaaaccatggcacaagctctccttgaagggtcgggagcccttcgtccgtatgcaactttggctaaacgaccccaataatgttgaaaaactgatggacatgaaacgcatggaaaagaaagcatatatgaagaggagacattcaagcgttagcgatagtcagccttgcgagcccccttctgtcggcacggagtactcccagggtgcaagtccccaaccccagcaccagctaaagaaaccccgagttgtgctagcgccagaagagaaggaagccttgaaaagggcatatcagcaaaaaccataccccagtcccaagacgatcgaagatctcgctactcagcttaacctaaagacatccacggtaattaactggttccacaattatcggagccggattcgtagagaactttttatagaagaaatccaggcaggtagtcagggccaggccggtgcatccgatagtcccagcgcacgctcaggcagagccgctccctccagcgagggggattcttgcgacggagtggaggcaacggaggggcctggttccgcagataccgaggaaccaaaatctcaaggtgaggccgaaagagaagaggtgccgagaccagcagagcaaacagaaccaccgccatctggaaccccaggcccagatgacgcccgagatgatgatcatgaaggcggaccagtggaggggcctggaccactcccctcgccagcatccgcaaccgcaaccgccgcaccagcagccccagaagatgctgccacctcggccgcagctgcgcctggggagggtcccgctgctccttcaagcgctcctcctccatcaaactcaagttccagctccgccccacgtcgccctagttccctgcaaagccttttcggcctaccagaggctgccggtgctcgcgactccagagacaaccccctcaggaagaaaaaagctgccaacctaaatagcataattcacaggctagaaaaagcggcatctagagaggagcctatcgaatgggagttttag

SEQ ID NO: 49663 - DNA, 1989 bp, Artificial Sequence
  Description of Artificial Sequence: Synthetic coding sequence
atggccgcaaacgtgggctccatgtttcagtactggaaaaggttcgacctccagcaattgcagagggaattggatgccaccgcaactgttctagcgaaccgccaagacgagagtgaacagagtcgtaaaagattgattgagcagagtagggagttcaagaaaaacacccccgagattgacgctttgagcaagcgcagtaaagaggctgaggccgcttttctaaatgtatacaaacgattgatcgatgtacccgaccccgtgcctgccctcgacttagggcagcagctgcaacttaaagttcagcgcctacatgacattgaaaccgagaatcagaagctacgggaaactctggaggagtataataaggagtttgcagaagtaaaaaatcaagaggtgacaataaaggccctcaaggaaaaaatccgggaatacgaacagacgttaaaaaaccaagctgaaacaatcgcgcttgagaaagagcaaaagttacagaatgatttcgccgaaaaagagcggaagcttcaggagacacaaatgtccacaaccagtaaactggaagaggctgagcacaaagtacagagtctgcaaactgccctcgaaaagactagaacagagctgttcgatcttaaaacaaagtatgatgaggagacaaccgccaaggctgatgaaatcgaaatgattatgacagaccttgaacgagccaatcagagagcagaggtggcacagagagaggcagagacacttcgagagcaactgtcgagtgctaatcatagcttacaattggcatcgcaaatccagaaagcaccagatgtggagcaggctatagaagtcctgacaaggtcctcactggaagtcgaattggcagccaaggagagggaaatcgctcagttggtggaggatgttcaacgtttacaggcctcactaactaagctcagagaaaactcagcctcgcagatctcgcagttggagcagcaactgtctgctaagaacagtacgttgaaacagctggaagaaaagctcaaaggccaagcagattacgaggaggtcaaaaaagagctgaatattcttaagagcatggagtttgcaccctctgaaggggcaggaactcaagacgcggcaaagcccctggaggttcttctgctcgagaagaatcgaagcctgcagagcgagaacgctgctctgcgtatcagcaacagtgatctgtcgggcaggtgcgccgagctgcaagtccgaataacagaagcagtggcaactgccaccgaacagagagagttgattgcacgcttggagcaggacctttcaatcatccagtccatccagcgccctgatgcagagggagccgcagagcacagactggaaaagatccccgagcctatcaaagaggctaccgccctcttttacgggccagcagctcctgctagtggagctcttcccgaagggcaggtcgatagcctgctctctatcatttcttctcaaagagagaggtttcgcgctaggaaccaagaactagaggcagaaaataggctagcacaacacacactccaggccctgcagagtgaactggactccctgcgagccgacaacatcaagctcttcgagaagatcaagttcctgcaatcatatcctggaaggggttcaggaagtgatgatactgagttacgctacagcagccagtatgaagagcgtctggatcctttctccagtttctctaagcgagaacgtcagcgcaaatacttgtcactatctccatgggacaaggcaacgctctccatgggacggctcgttctgtcgaataagatggcccgtacaatcggcttcttctacaccttatttctgcattgtcttgtcttcctggtgctgtataagctggcttggtccgaatcaatggagagagattgtgccacattttgtgctaagaaattcgcagaccacctgcacaagttccatgagaatgataatggggctgccgcaggagacctgtggcaatag

SEQ ID NO: 49664 - DNA, 4452 bp, Artificial Sequence
  Description of Artificial Sequence: Synthetic coding sequence
atgctttgcgtggccggtgcccgtctgaagagagagctggacgccaccgccaccgtgttagccaatagacaagacgagtctgaacagagtagaaagaggctcatagaacagtccagggaattcaaaaaaaatactcccgaagatctgaggaagcaggtagcgccactgctgaagtctttccagggggaaattgatgccttgagcaagcgatctaaagaggctgaggccgcattcttgaatgtgtataaaaggcttatcgacgtgcccgatcccgtgcctgcattggatctcggacagcagctgcagcttaaggtgcagaggctccatgacatcgagacagagaatcagaagctacgggaaaccctggaggaatacaacaaagagtttgccgaggtgaagaatcaagaagtgaccattaaggcactgaaggagaaaatccgagaatacgagcagaccttaaaaaatcaggcagaaacaatagctctggaaaaggaacaaaaattgcagaatgactttgccgaaaaggaacgcaaacttcaagagacccagatgtccactacctcaaaactcgaagaagccgagcacaaggtgcagtctctacagaccgctctggaaaagacgcgcaccgaactctttgacttgaaaacaaaatatgacgaagagaccaccgccaaagccgacgagatcgagatgattatgaccgacctggagcgggctaatcagcgagcagaggtggcgcagcgagaagccgagacattgcgtgaacagctctcaagtgccaaccattcactccagctggcctctcagatccagaaggctcccgatgtggaacaggcaatcgaggtgctgacgcgatcctcactggaggtggaattagcagccaaggaacgagagatcgcacaacttgtggaggacgtgcagcggctgcaagcctcgctaaccaagttacgcgagaattccgcatcacagatcagccagctggagcagcagctgtctgcgaaaaactctacactcaagcagctggaggagaagctgaaaggacaggccgactatgaagaggtgaaaaaagagctgaacattttaaagtcaatggagttcgctcccagtgagggagctgggacccaggacgctgcaaaaccccttgaagtgctactgctggaaaagaatcggagcctgcagtccgagaatgctgctctccgtattagcaattccgatctgtccggaagtgcccgaaggaaaggaaaagatcaacccgagtcgcggaggccagggagcttaccagcccctccgcctagtcagctgccaagaaatcccggagagcaggcctcaaacacaaacggtacgcaccagttctcccctgctgggctgagccaggactttttctcttctagtttggcgagcccttcgctccctctggcctcaaccggcaagtttgcactgaattccctgctgcagaggcagctgatgcagtcattctacagtaaagccatgcaggaagctggctccacttccatgatcttttcaactggcccatattcaaccaattctataagttcccagtcccccctgcagcagtcacccgatgtcaatgggatggctccctcaccaagccaaagcgagtctgctggcagcgtgtctgagggcgaggagatggacacggcagaaattgcgaggcaggtaaaggaacagctaattaagcacaacattggccagcgcatctttggtcattatgtcctgggcctcagtcaggggagcgtcagcgagatactggcaagacctaaaccctggaataaactcaccgtgaggggcaaggagcctttccacaagatgaagcagtttctgagcgacgagcagaacatccttgccctgagatctatacaaggcagacagcgtggcaatattacaactcggattcgtgcttccgagaccggttctgatgaggccataaagagtattctggaacaagcgaagagggaactgcaggtgcagaagactgcagaaccagcccagccgagcagtgctagtggcagcggaaacagtgatgatgccatcaggagcatcttgcagcaggccagacgggagatggaggcccagcaagccgctctggacccagccctgaaacaggccccactgtctcagagcgacatcacaatactgacacctaaactgctgtctaccagccccatgcccactgtgagctcttatcccccactggccatctccctcaagaaaccttccgccgctccggaggcaggcgctagtgctctgccgaatcccccagcactgaaaaaagaggcacaagacgctcctggtcttgacccacaaggggcagcagactgtgcacagggtgtgctgaggcaagtgaagaacgaggtgggacgttctggggcatggaaggatcactggtggtctgccgtccagcctgagagacgcaacgcagccagttcagaggaagctaaagccgaagagactggcggaggaaaggaaaagggatccggtggttctggagggggatcccagccaagagcagaaaggtcccagctgcaagggcctagttcttctgagtattggaaggagtggccctcagccgagagtccttatagtcagagttctgaactgtccctgacaggcgcaagcagatctgagacaccccagaattcccccttgccatcatctccaatagtacccatgtcaaagcccacaaagccatccgtgccacctctgacccccgagcagtatgaggtgtatatgtaccaagaggtcgacacgattgaactcacccggcaggttaaggagaagttagccaaaaatgggatctgtcagcgtatcttcggcgagaaagtcctcgggttgtcgcaggggtctgtgtccgatatgcttagcaggcctaaaccttggtcgaagctgactcagaaggggcgtgaaccattcatcaggatgcagctgtggctgaacggagagttgggccaaggcgttctgccagtccagggacaacagcagggtccagtactgcactccgtgaccagcctccaagacccgctgcagcagggttgcgtttccagtgagagcactccaaagacctcagcctcctgctctcccgcacctgaaagcccaatgtcttccagcgagagtgtcaaaagcctgactgagctggttcagcagccttgtccaccaattgaggcctccaaggattctaagccccctgagccatctgatccaccggcaagcgattcccagccaacgaccccactgcctctgtcagggcactcggccctctcaatccaggaactggtagccatgtcgccggagttggatacgtatggaatcaccaaaagggtcaaggaggtcctgaccgacaacaacttggggcagcgtctgttcggtgagacaatcctgggcctgactcagggctccgtttccgacctgttagctcgacctaagccttggcacaaactgtctctcaagggaagggagccatttgtgagaatgcaactgtggcttaacgatcctaacaatgtggaaaagcttatggacatgaaaagaatggaaaagaaggcctatatgaaacgcaggcacagctcggtgtcagactctcaaccatgtgaaccaccatccgtggggaccgaatactcacagggcgcatccccccagccacaacatcaactgaagaagcctcgagttgtgttggcacccgaagaaaaagaagccctgaagcgcgcttaccagcagaagccttatccatctccaaagacaatcgaggatctggccacacaattgaacttgaaaacaagcactgtgatcaactggttccacaattacagatcaagaatcagacgggagctgttcatagaggaaattcaggccggttcccagggtcaagccggtgcctccgactcgcctagtgctcgctccggtagagccgctccttcaagtgaaggggatagttgcgacggagttgaggcaacagagggccctggcagcgccgatacagaggagcctaagagccagggagaagcagaaagagaggaggtacctaggccagccgagcagacagaacccccacctagtgggactcctggcccagacgatgccagggacgacgatcacgaaggaggtcccgtggagggccctgggcctctgccgtcacccgctagcgcaaccgccacagccgcacccgcagctccagaggacgctgcaacctccgccgcagccgctcccggtgagggcccagccgcaccctctagtgcacctccaccatccaatagctcgtctagttctgctcctcgtcgacctagctctctacagagtctttttggacttccagaggccgctggagcacgggactctagggataaccccctgagaaagaagaaggccgctaacctcaactccataattcatagactcgaaaaggccgcatcaagagaagagcctattgaatgggaattctag

SEQ ID NO: 49665 - DNA, 4350 bp, Artificial Sequence
  Description of Artificial Sequence: Synthetic coding sequence
atgctttgtgtggccggtgccagactgaagagagagctcgatgccacagcaactgtactggcaaatcgccaggacgagtccgagcagtccaggaagcgactgatcgagcagagcagggaattcaaaaagaacactcccgaagatctgcgcaaacaggtagccccattgctgaaatctttccaaggagaaatagatgcattatcgaaacgctcaaaggaagcagaagcagcattccttaacgtgtacaagcgcctcatcgatgtacctgacccagtcccagcccttgacttaggccagcagctccagctcaaggtgcagcggctacacgacattgaaaccgaaaaccaaaaactgcgcgagacgctcgaagaatataacaaggagttcgccgaagttaaaaatcaggaggtaaccatcaaggctctaaaagagaagatacgcgagtacgagcagacacttaagaatcaggccgagactatagccctagaaaaagaacagaagctgcagaatgactttgccgagaaagagcgaaagctccaggaaactcagatgtctacgacgtctaagttagaggaagctgaacataaagttcaaagtctgcagaccgcgctggaaaagaccaggacagagctctttgatttaaagaccaagtacgatgaagaaaccacggccaaggctgacgaaattgaaatgatcatgacagatttagaacgagccaatcaacgtgctgaggtggcccaaagagaggcagaaactctccgcgaacagctgagcagcgcgaatcacagtcttcaactcgccagtcagattcagaaggcccctgacgtggagcaagccattgaagttctaacaaggagttcactcgaggtagagttagcagcgaaagaacgagagatcgcgcagctcgtggaggacgtccagagactgcaggcctcgttgaccaaactcagagaaaattccgcatctcagattagtcagttggaacagcagcttagtgcaaagaactccactctgaaacagctggaggaaaaattgaaaggtcaggccgactatgaagaggtcaaaaaggaactgaacatcctcaagtcaatggagtttgccccatctgagggagccggaactcaagacgcagctaagcccctggaggtgctcctgttagaaaaaaacaggagccttcagagtgagaacgcagctctccgtatttctaatagcgatctgtccggatcagcccgtcggaaaggaaaagatcagccagagagccggaggcccggatcgctacccgcaccacctccctcacagttaccacggaacccaggagaacaggccagcaacacaaatggtacccatcaatttagccccgctggcctgagccaggatttttttagtagttcgttggcatcccccagtctgccgcttgcctctaccgggaagttcgctctgaattctctgctccagcggcagctgatgcaaagcttttattccaaggctatgcaggaggcagggtctacttccatgatattttccactggcccttattctaccaatagcatttcatcccagtccccattacagcaatctcctgacgtgaatggaatggccccatcaccatcccagtccgagtcagccggttcggtttctgaaggcgaggaaatggacacggcagaaatcgcgaggcaggtaaaggagcagctgattaagcataatattggccagcgtatcttcggacattacgtgctcggcctgagtcaggggtctgtatccgagatcctagctcgaccaaagccatggaacaagctgacagtacggggaaaggagccattccataagatgaaacagttccttagtgatgagcagaacattctcgctctaagaagcattcagggcaggcaacgggctgaacctgcacaaccctcctctgcatcaggaagtggcaattctgatgatgccattcggtctatcctgcagcaagccaggcgggagatggaagctcaacaggcagcactcgatcccgcactgaaacaggcgcctctttcccagtcagacattactatcctgacccccaagttactctccaccagcccaatgcccaccgtcagctcttaccccccacttgccattagtctgaagaaaccgagcgcggcacctgaggcaggcgcatccgctctacctaatcctccggcattgaaaaaggaggcacaggatgcaccgggactcgacccccagggcgctgccgattgcgcacagggggtgcttcgccaggtgaaaaatgaggttggacgatccggtgcctggaaggaccactggtggtcagctgtacaacctgagagaaggaatgcagcttcttctgaagaggccaaggctgaagaaacaggcggaggtaaggagaagggatctggcggttcagggggtgggagtcagcccagggcagaaaggagccagctgcaagggccttcctcttccgagtactggaaagaatggccgagcgccgagagcccttattctcaaagctcagagcttagcttgaccggcgcttctagatctgaaacaccccaaaacagcccacttccctcctctccgatcgtgccgatgagcaaacctacgaagccatcagttcctcccttgaccccagagcagtatgaagtttacatgtaccaagaggtggataccatcgaactcacgcggcaggttaaagagaaactggccaaaaacggtatctgccagcgcatctttggagagaaggtgctggggctctcacagggtagtgtatccgacatgctgtcccgacccaagccctggagcaagctgacccagaaaggcagagaaccttttatccgcatgcagttgtggctgaacggcgaactaggccagggggtcttacccgtgcagggccagcaacaggggcctgttctgcattctgtgactagcttgcaagacccactgcagcagggctgtgtctctagcgagagcacccccaaaacctcagccagttgcagcccagcacctgagtccccaatgtctagtagtgaatcggttaaaagcttgaccgagctcgttcagcagccttgtccaccaattgaagccagtaaagactcaaaacctcctgaaccatctgatcctcctgcttccgatagtcagcctaccactccccttccactatctggacactccgcactgtccattcaggagctggtcgctatgtcaccagagttggatacctacggaattacaaagagagtcaaggaagtgttgaccgacaataacttggggcagcgcctctttggtgagaccatactgggcttaacgcaggggagtgtctcagacctgctagccaggcctaagccatggcacaaactgagcttgaagggccgagagccttttgtaagaatgcagttgtggctgaacgatccaaacaacgtggagaaactgatggatatgaaacgcatggaaaaaaaggcatatatgaagagaagacattcatcagtgtcagattctcagccgtgcgagcctccttcggtcggcaccgaatactctcagggtgctagcccacagccccaacatcagctgaagaagccacgggtggtcctggccccagaggaaaaggaagcgttgaagagagcttatcagcagaaaccttaccccagtccgaagacaattgaagatcttgcaacccagctgaaccttaaaactagcacagtgattaattggttccacaattaccgttcgaggataaggagggagcttttcattgaagaaatccaggccggatctcagggccaggccggtgcctctgattcccctagtgctcgctcaggcagagctgctccctcaagcgagggcgactcctgcgatggagtggaggcgaccgaaggcccaggatccgccgataccgaggagcctaaatcacagggggaagctgaaagggaagaggtgccacgcccagcagagcagaccgaacctccccctagcggaaccccagggccagacgacgcgagggacgacgaccacgagggaggacccgtcgagggtccaggacctttgccctcacctgccagcgccaccgctaccgcggcacccgctgcccctgaggacgcggctacttctgccgctgccgcacccggtgaggggcctgcggcaccttcaagtgctccgccaccaagtaatagtagctcttcctcggctcccaggcggccttcaagtctgcaatcactttttgggctgccagaggccgctggtgccagagattctcgcgataacccgctccgaaaaaagaaggcagcaaacttgaattcgattatccatcgtttggaaaaggcagcttcgcgtgaggaaccaattgaatgggagttttag

SEQ ID NO: 49666 - DNA, 4044 bp, Artificial Sequence
  Description of Artificial Sequence: Synthetic coding sequence
atgctttgtgtagccggtgccaggctcaaacgagagctcgatgcgactgctaccgttttggccaaccgacaagatgaatcggaacaatcgcggaaacggctgattgagcaatcacgcgaatttaagaagaacactcccgaggatttgcggaagcaggtcgcccctctattgaaatcctttcagggagagattgatgccctcagcaagcgatcaaaagaggctgaggctgcctttctcaacgtttacaagcggcttatagatgtcccagatcctgttcccgctctcgatcttggacagcagctccaattgaaagtgcagagactgcacgatattgaaaccgaaaatcagaagttgagagagacactagaagagtataataaggagtttgccgaggtaaaaaatcaagaggtgaccataaaggctttaaaggagaagataagagagtacgaacagaccctcaaaaaccaggctgaaactatcgctctggaaaaggagcagaaattgcagaacgattttgcagagaaggaacgcaaattgcaagagacgcagatgtccacgacaagtaagctggaagaggctgaacataaagtccaatcactacaaaccgctctggaaaagaccaggactgaattgtttgatctcaagaccaaatatgatgaggaaactactgcgaaagctgatgagattgagatgatcatgaccgatctggaaagagccaaccaacgtgcagaagtcgcccagagggaagcagaaaccctccgagaacaattgtccagcgctaaccattctttacagttggcttcgcaaattcagaaggctcccgatgttgagcaggccattgaagttctgacacgttcgtccttggaagtggagttggcagcgaaggaacgcgaaatagcacagctcgtggaagacgtgcagcggctccaagcatcattaactaaactccgggaaaactccgcaagccagatctctcagctggagcagcaactgtctgcgaagaattctactctgaaacagcttgaagaaaagctgaaggggcaggctgactacgaggaggtgaaaaaagaattgaatattctcaaaagtatggaatttgctcccagtgaaggggctggcactcaagacgctgcaaagcccctggaagtactgctattagagaagaaccgatccctgcaaagcgagaacgccgctctgcggatcagcaacagcgacttgtccggaccgtactcaacaaatagcattagcagtcagtcacccctacagcaatctccagatgtcaatggcatggctccatcgcctagccagtcagaaagtgccggttccgtgtcggagggcgaggaaatggatacagccgaaatcgctcgccaggtgaaggaacaattgatcaaacataacataggtcagcggatctttggacactacgtgctgggcctgtcccagggaagcgtgagtgagatattggctaggcccaaaccatggaacaaactgacagtgcgcggaaaggagccttttcataaaatgaagcagttcctgagcgatgaacagaacatcctggcattacgcagtattcaggggaggcaaagagccgagccggcacagcccagcagcgcctccgggagtggcaactcagacgacgccatcaggtctattctacaacaggcgagacgcgagatggaagcacagcaggcagcattagaccctgctctcaagcaggctcccctgtcacaatctgatattacaatattaactcccaagcttctgtctacatctcctatgccgacagtgtcaagttatcctccactggcaatttctctcaaaaaacccagcgccgcacccgaagcaggagcctccgccctgcccaacccccctgcactgaagaaagaggcacaggacgctcccggtttggacccgcaaggcgctgcggattgcgcccagggtgtgctacggcaggtgaaaaatgaagtaggcaggagcggggcatggaaggaccattggtggagcgccgtgcaaccagagagacgtaacgcagctagctctgaagaagcaaaggcggaagaaactggtggaggcaaggagaaggggagtggtgggtcggggggtggtagtcagcctagggcagagaggtctcagctccagggaccttcttctagtgaatactggaaagaatggcccagcgccgagtccccctattctcaatcttccgagctgtcactaacaggcgctagcaggagtgagacgccacagaacagtcccctgcccagctcacccattgtaccaatgtctaaacccactaagccaagcgttcccccattgacaccagagcagtatgaggtgtatatgtaccaggaggtggacacaatcgagctcacccggcaagtgaaagagaagctggcgaaaaacggcatatgtcagagaattttcggagaaaaagtgctcggtctcagccaaggttctgtgagcgatatgctttcacggcctaagccatggagcaaattgacccaaaaagggcgagagccattcattagaatgcaactgtggttgaacggagagctcgggcagggggttctgcctgtgcagggccaacagcaggggcctgtattacacagtgtaacatcattgcaggacccactccagcaggggtgtgtttcctccgagtccaccccgaaaacctctgcgtcatgcagccctgctcccgagtcccccatgagctcatctgagtcagtgaagagcctgactgagctggtccagcagccgtgcccccctattgaggcaagtaaggactccaagccgcctgagccaagcgaccccccagccagtgatagccagcctactacacccctgcctttgtcggggcattctgcgctgtccatccaggaacttgtggcaatgagtcctgagctggatacctacggcattaccaaaagggtcaaagaggtcttgactgataataatctgggccagcgactgttcggggaaaccattcttggactcacacaggggtcagtctccgatcttttagctcgaccaaagccctggcataaactgtccctgaaaggccgagaacccttcgtccgcatgcagctttggttgaacgatccaaacaatgtggaaaagctgatggacatgaaaagaatggaaaagaaagcctacatgaaacggagacatagtagtgtttccgactctcagccttgcgagccgccatctgttgggactgagtacagtcagggcgcttcccctcagccccagcaccagctgaagaagcctcgggttgtgctggcccctgaggaaaaagaggctcttaagagggcctatcagcaaaagccctacccctcccccaaaacaatcgaagacttggctacacaacttaatctgaaaacttccactgtgataaattggtttcataactacagatcccgaattcgtcgcgaactattcatcgaagaaattcaggccggaagccagggacaagccggagcctctgactccccatctgccagaagtggtcgcgctgcaccttcttctgaaggagatagctgtgacggggtggaagctacagagggcccagggagcgctgacactgaggagccgaagtcacagggggaagccgaacgagaggaggtcccacgacctgcggagcagactgagccaccaccaagtggcacaccaggaccagatgatgcgcgtgacgatgatcacgaaggcggaccagtcgagggccctggacccctgcccagccccgcaagtgccacggctacagcggcaccagctgcacccgaggacgcagccacttccgcagcggctgctccaggtgagggccctgccgcaccttcctctgcccctccccctagcaacagttcatcctcctctgccccacgacgcccatctagcctccagagcctgtttggactccccgaggccgctggggcacgagatagccgagataatccgttacggaaaaaaaaggcagccaacctcaactccatcatccatcgcctggagaaggctgcaagcagagaggagcccatcgaatgggaattttag

SEQ ID NO: 49667 - DNA, 1902 bp, Artificial Sequence
  Description of Artificial Sequence: Synthetic coding sequence
atgaagatctcagcgtggttaatgtgcgcgagagggaaggatctgcgcaagcaggtggcaccactcctcaagagctttcaaggtgagatcgacgcgctgtcgaaacgaagcaaagaggcggaggcagctttcctgaacgtgtataagcggttgatagatgtcccagaccctgtgcccgctctcgatctaggtcagcagctgcagctcaaggtgcagagactccacgatatcgagactgagaaccaaaagttacgggaaacgctcgaagaatataacaaagagttcgctgaggttaaaaaccaggaggtgactataaaagccctgaaagagaaaattagagaatatgagcagacactgaaaaatcaggccgagacaatcgccttggaaaaggaacaaaagctgcagaatgattttgccgagaaggaacgaaagctgcaggagactcagatgagcacaacttccaaactggaggaagcggaacacaaggtccaaagtctccagactgcccttgaaaagactaggacagagctgtttgatttgaagacaaagtacgatgaggaaacaaccgcgaaggccgacgagatagaaatgatcatgacggacctggagcgggcaaaccagcgcgctgaggttgcccagcgagaggctgaaactctaagggaacagctgagttcggccaaccactcactgcagctggcgagccaaatccagaaggccccagacgttgagcaggcaatagaggtgcttaccagatcgtccttggaggttgagctagcggctaaagagagggagatcgcacagttggtggaagacgtgcaacgtcttcaggcgagccttaccaagttacgggaaaactcggcctctcagatctcccagctggagcaacaactgagcgctaaaaactccaccctgaagcagctcgaggagaagctcaagggtcaggccgattacgaagaagttaagaaggagctgaacatcctgaagagtatggagtttgcaccaagtgaaggggcaggaactcaggacgctgctaagccattggaggtacttctgctcgaaaagaaccgatcactccaatccgaaaacgccgcactccgaatctccaattctgacctttccggacgttgtgccgaactgcaggtgcgaatcacagaggccgtcgcaaccgccaccgagcagagggagcttatcgctcgcctcgagcaggatctcagtattatccagagtatacagcgaccggacgccgagggcgctgctgagcacaggctggagaaaatccccgagccgataaaagaagctaccgccctgttttacggaccggcagctcctgctagcggagcattgcccgaaggccaggtagactcccttttgagcatcatcagttcccagagggagaggttccgagcccgtaaccaggagctggaagccgagaaccgactggcacagcataccctgcaggctttgcagtctgagttagactccctgcgggctgacaatatcaagttgtttgaaaagatcaaatttctccagagctatccaggtcggggtagcggatcggatgacacagaacttcggtattcatcccagtacgaggagaggctggatccgttttcatccttctccaaaagagaaagacagcggaaatacctgtcattgtccccatgggacaaggccacgctgtctatggggcgtctagtacttagcaacaagatggctcgaacaattgggttcttctataccttgtttctgcattgtttggtgtttttggtgctgtacaagcttgcttggtcagaaagtatggagagggattgcgcaacattctgcgccaagaagtttgcagatcacttacataagtttcacgagaacgacaacggggcagctgcgggtgatttgtggcaatag

SEQ ID NO: 49668 - DNA, 2079 bp, Artificial Sequence
  Description of Artificial Sequence: Synthetic coding sequence
atgagtgccggtacaggaaagggtgggccacaaactccagtggaaagtcctacggcatcctctaaattaccacaggcccactggctttgcagcccgggaatcaaaagggaactggatgctactgcaacagtgctggctaatcgccaggatgagagtgagcaatcccgtaaaagattgatcgagcagtctcgcgagttcaagaaaaatacgcccgaagacctgcggaaacaagttgctccgctgctcaagagtttccaaggggagatagatgccctgtccaagcggagcaaggaggccgaagccgcattcctgaatgtctataaacggctgatcgacgtcccagatcccgtgcctgcgctcgatctgggccagcaattgcagctgaaggtacagcggttgcacgatatcgaaaccgagaaccagaagcttcgcgagaccctggaggagtacaacaaggaattcgccgaagtgaagaatcaagaggtgactattaaggccctaaaggaaaagatcagggagtatgaacaaaccctgaagaatcaggcagaaactattgctctcgaaaaggagcaaaagctgcaaaatgattttgccgaaaaggaaagaaagctacaagagacacagatgagcaccacctccaagctcgaggaggcggagcataaggttcagagtctgcagacagctttggagaaaacgaggaccgagctgtttgatctgaagacaaaatatgacgaggagacgaccgcaaaggctgacgagattgagatgatcatgacggatttggagcgggcaaaccagcgggctgaagtcgctcagagagaggccgagaccctgagagaacagctcagttccgccaatcactccctccagctggcttctcaaattcagaaagctccggatgtagagcaggccatagaggtcttaacgagaagttcactagaagtggaacttgcagcaaaagagagggagattgcacagctcgtcgaggacgtgcagcggctgcaggcatcattgacgaaacttcgcgagaactcggcctcacagatctctcagttagagcagcagctgtctgcgaagaactccacactcaagcagctagaagagaagctgaaaggccaggccgattacgaggaggtgaagaaggaactcaatatcctcaagtcaatggagtttgccccttccgagggggcagggacgcaggacgcagcaaagcctctggaggtactgctgctggagaagaatagatctctgcaatctgaaaacgcagctttacgtatcagcaattccgacttgagcgggcgttgcgcagaattgcaggtgagaattaccgaggctgtggcaactgcaacagaacagagagaactcattgcccgtcttgagcaggacctgtctatcatccagagcatccagaggccagacgccgagggcgcagctgaacacaggctggagaagatacctgagccaattaaggaggccacggctctgttctacggcccagccgcacccgcatccggggctctcccagaaggtcaagttgactctctcctgtctataatcagtagccagagagaacgctttcgtgccaggaaccaggaactggaagcagagaaccgcttggctcaacatactctccaggcccttcagtccgaactggactccttaagggctgacaatatcaagttatttgagaagattaagtttcttcaaagttatcccggtcgcggaagcgggtccgatgacaccgaactaaggtactcctcccagtatgaggagcgccttgatcccttctcatcattcagcaaacgagagaggcagcgcaagtacctgagcctctctccctgggataaggcaacactttctatgggccgactggtcctctcgaacaaaatggctcgaaccatagggttcttttatacactatttcttcattgcctggtgttcctggtgctgtataaattggcatggtcggagtccatggaacgagactgtgccacattttgcgcaaagaagttcgctgaccacctgcacaaatttcacgagaacgacaatggggctgcagcgggagacctgtggcaatag

SEQ ID NO: 49669 - DNA, 1719 bp, Artificial Sequence
  Description of Artificial Sequence: Synthetic coding sequence
atggatcgcgctggcgcagacatgtgggcttcaaccttcaccttggccatggctgagcgcaagccccaagacgtgtgggtgctgctgccagagcacagcctggtacctggatgtctcgatggtgggggtgtgcagtacctccttgtgggactgtcacggttgcaatgcgggcactgccccggtacgtgggattctgcccatgtccatgtgctgttccacctctggtgggatagggcctctcatcgcggattggtgaaaatgagaatctggggacagaggtgccgcctctgtcctgccccaggagactgtcaggtgaggccacccggtgaacagccattcctctcgcgactggtgctgcacatactccaggattgctatggcgacggtcctggcccagctcgccatcccagggaggcatacgaaggctgttgcgaagcatgcgagctgggggtgtgctttttgcagaaggcacccgaccccgcttggagcgctaatgctacaaaaggaaattttcccgcaaccgcctgggggggtaccggtacagtgagtcgtggcaagcccctgtcaacacccggagacgatctgggaaaaggcggtgtagttatcgcgatcccttttagcctcgtgggtacaagcaatgatcaggtgccaatcgccgagggccctgccccaccggcaggagctagtctgccagtgaccggatcctgcgaagccctggtgatcgggcagggaagcattttccttagtggggatagcgtggcaatgccaggcggaaaggggttccctgttgccatcggggaccccctcttccatgggcctgggctgctggggagctctatacagacattcgagctgaaggggttcttattcaaggggcgtggatcactatgctcccctgtgggagttgctcagggctggggacccatcagcctgaacaacgggctcgtccctgtggggaagcacacacccaccgtgttctactgcgtgggcctgagtgcgtcgggcgagggttcactcacgtttccatcatctctgaccagcattttcacgaataccctgtccgagcccacagatggccctgtagcgacaaaagaggcttccataacctttccctttatcttcaccgacgtgaaggacgccgtcgctgaagtcgccgagggcaacggtaaagagggagggggacagggcctcgtgcccgtgggccatgacgcactccctgaaacaaatgcaggcggactaccctcacaggtgaagggatcactcgctttgccgttcccagccgatgtgcaggggaaggacgcctttacagacattaccgagggaaaagaaaaggagggaggcctggtgactgcgggacatgacgcacctcttgaggcgaatgcagaaggacccattacagtatccgagggctgcattacaattcccttcgctgtttttgatgtgattaaacgtaagggcggagggcatgttgcctatggtccccagggaaacggctgtttctctcaagggtactaccagaagcgccagctaaggagtcggttccacaaggccaggtgcggatgtcgacgcgaggaagacgaacgaccaggacgcgcttgcaggaggcctcatgcagaaccctatgaagatttttggatctgggtgtctatgacagtgtgcgtcttctggctgatgtgcatgtgccgcctgaacccaggaatttacccccaacaagtctag

SEQ ID NO: 49670 - DNA, 1728 bp, Artificial Sequence
  Description of Artificial Sequence: Synthetic coding sequence
atgagccaggacaccaaagtgaagaccactgaaagttccccccctgctcctagcaaggccaggaagctgctccccgtgctggatccttcaggcgactactactattggtggctgaatactatggtatttccagtgatgtataatctgattatactagtctgtcgagcctgttttcccgaccttcaacacgggtacctggtggcctggttggttctcgactatacaagtgatcttctgtacctgctcgatatggtagtcaggtttcatacaggattcctggagcaggggatactggtggtggacaagggaaggataagcagcagatatgtgcggacatggtctttctttctcgatctcgcaagccttatgccaacagatgttgtctacgtgcggctggggcctcatacccccaccctgcggttgaatcgctttctaagggctcctcgcctgttcgaagccttcgatcgcaccgagactcgcacggcttacccaaacgcctttcgcatcgcgaagcttatgctttacatctttgtagtcattcattggaatagttgcctttacttcgcgctgtctaggtatctcgggttcggacgggatgcatgggtgtaccctgaccctgcacagcccggatttgagagactacgtagacagtacctatactctttctactttagcaccctcattttgactaccgtgggcgacacccccccacctgcacgggaagaggaatatttgttcatggtgggggatttcctgttggctgtgatgggcttcgccaccattatgggctcaatgtcttctgtcatctataacatgaatactgctgacgcagccttctatccggaccacgctctcgtcaaaaagtacatgaagctccagcatgttaaccgtaagttagaacgcagagtgattgactggtatcagcacctccagattaataagaaaatgaccaatgaagtggccatcttacagcatttgcccgagaggcttcgcgcagaggtcgccgtgtcggttcatcttagtacactgagtcgcgttcagatttttcaaaattgcgaggcttcgcttctcgaggagctggtcctcaagctgcagccccagacctatagccccggtgagtacgtgtgccgtaagggcgacatcggccaggagatgtacattatcagagagggacagctagccgtggtggctgacgacggaatcactcagtatgctgtgttaggcgctggattatacttcggtgagatctctataatcaacatcaaggggaatatgagcggcaacaggcgaactgcaaatatcaagtccctgggctactccgacctgttttgcctctcgaaagaagacctgcgggaagtgttgtccgaatatccacaggctcaaaccatcatggaagagaaaggaagagaaatcctgctaaagatgaacaagctcgatgtgaatgctgaggctgcagagatagccttacaggaagctacagaatcccggctccggggtttagaccagcagctggacgacctccagacaaagttcgcccgattattggccgagctcgaatccagtgcactgaaaatcgcatatcgcatcgaaagactggaatggcagactcgggagtggccaatgcccgaagatttggccgaggctgacgatgaaggagagcccgaggagggaacctcaaaagatgaagaaggcagagcgagccaggaagggccacctgggcctgaatag

SEQ ID NO: 49671 - DNA, 1164 bp, Artificial Sequence
  Description of Artificial Sequence: Synthetic coding sequence
atgatggatgagccatggtgggaggggagggtggcttctgatgtccattgcactctaagagaaaaagagttaaagcttcccacatttcgggcacatagcccactccttaagtctcgcagattcttcgtcgacattcttactcttctaagctcccactgtcagctttgcccagctgccaggcacctcgcagtttacctgctggatcattttatggatcgctacaatgtaacaacttccaagcagctctatacagttgctgtatcctgtcttctgttggcttcgaagtttgaagacagggaagatcatgttcctaaactggaacagatcaattcaacacgcatcttgtcctctcagaattttacactcaccaaaaaggagttgctcagcacagaattactgttgttggaggccttcagctggaatttatgcctgcctacgccggctcattttctagattactacctgttagctagtgtgtcgcagaaggatcatcactgccatacctggccaacgacatgccccagaaaaaccaaggagtgcctgaaagaatacgcgcactactttttggaggtcaccctacaggaccacattttttacaaatttcagccttctgtcgtggcagccgcatgcgtgggggcttccagaatctgcttacagctatctccgtattggactagagacctccagcggatctcctcctatagcctcgagcacttaagcacatgtatcgagatcctactcgtggtgtacgataatgtgctgaaggatgctgtcgcggtaaaatctcaggccctggctatggttccaggtaccccgcctactcctacgcaggtgctgttccagccacccgcatatccagcgctgggccagcccgctactactctggctcaatttcagactccagttcaggacctctgtctcgcgtaccgagacagtcttcaggcccacagaagcggatcactgctatcagggtcaaccggctcttcactgcatactccataccagcctctgcagccattggacatgtgcccagttcctgtgccagcatctctgtccatgcacatggccatcgcggctgaacccagacactgcctggctaccacttacgggagttcatatttcagcggttcccatatgtttccaacagggtgtttcgaccggtag

SEQ ID NO: 49672 - DNA, 1308 bp, Artificial Sequence
  Description of Artificial Sequence: Synthetic coding sequence
atgatggacgagccttggtgggaggggagagtggcctccgatgttcattgtacattgcgcgaaaaggaactgaaattgccaacttttcgggcacattcacctttactaaaatcgcggcgttttttcgtggatattctgacactgctaagttcacactgtcagttgtgccccgcagctagacatttggccgtgtatctattggatcacttcatggatagatataatgtcactacatctaagcagctgtacactgtggctgtgtcctgtctgctcctggcaaatggagtatctttactcagcccccgtctgaagtgctccggcatgatatccgcacattgtaatcttcacctgcccggttcctccaattcacccgcttccgcaccacatccccctcctacccctccacaagtcgcagagacaaccgggaaattcgaggaccgcgaagatcacgtgccaaaactcgagcagattaacagcacccgaatattgagtagtcagaatttcacgcttactaagaaggaacttctttccaccgagctcttgttgctggaggcattctcctggaatctctgcttacccacaccagcccacttccttgactattatctgctggcctcggtgtcacagaaagatcatcattgtcatacatggcccacaacttgcccacggaagacaaaagagtgtctgaaggagtatgcacattactttttagaggtaactcttcaagatcatatcttctacaagtttcagccgagtgtggtagctgctgcatgcgtgggggcttcaagaatctgcttgcaactcagcccttattggaccagggaccttcagcggattagcagttactccctggagcatctttcaacatgcattgagatcctcctggtcgtctacgacaacgtcctgaaggacgctgttgcggttaagtctcaggcgcttgccatggtacccggtacaccacctacgccaactcaagtactgtttcagcccccagcctacccagctcttgggcaacccgcaacaaccctcgcgcagttccaaaccccagtgcaagacctgtgcctcgcatatagagattcccttcaggcacatagaagcggaagtttgctcagtgggtccacgggtagctcactccataccccttatcaacccctgcagcctctggatatgtgtcccgtgcctgtaccagcgagcctctctatgcacatggccattgctgccgagccaagacactgcttggccactacatacgggagttcttattttagcgggtcacatatgtttcctactggatgtttcgacagatag

SEQ ID NO: 49673 - DNA, 501 bp, Artificial Sequence
  Description of Artificial Sequence: Synthetic coding sequence
atgcggcacaccagcaagcggaaacctcaatactatgaagctgaaatggtattgaagtattataagcatctggaagagggctctgtgtcactttgttgcccgggttggagcgccgttgcacaaagccgactgacagctgcaagcacctttggcgctcaggtcatcctgctttttcaactgtctgagcagctgcgcctgcaggagttgaagctgcctacttttcgcgctcattcacctcttctgaagtcccggcgtttttttgtagatatcctgactctgttaagctctcactgtcagctgtgccctgccgctcgccacttggccgtatatttgcttgaccactttatggaccggtacaatgtgaccaccagcaagcaactgtatactgtggcggtgagttgcctcctgttggcctcaaggaacaagggctccggaagcccagtgcccacacggtcagctcagcagtgtagacaaacctgggctcgtggttccccctggtag

SEQ ID NO: 49674 - DNA, 759 bp, Artificial Sequence
  Description of Artificial Sequence: Synthetic coding sequence
atgatggacgaaccatggtgggaaggtagggtggcctctgatgttcactgcacactacgggaaaaggaactgaaattgcccaccttccgggctcactcgccactgctgaagagtcgcaggttcttcgtggacatcctgaccctcctttcctcccactgtcagctatgtcccgctgcacgacatttagccgtatacctcctggaccacttcatggacagatacaacgtcactacatccaaacaactatataccgtggccgtatcttgcctcctcctggcaagtaagttcgaggaccgggaagatcacgtgcccaaactggagcagatcaattcaactcgaattctctcttcccaaaactttacactcactaagaaagagctcctctccacagagctgctgctgctcgaggctttctcttggaatctttgcctgcctacaccagcgcattttcttgactattatctgttagccagtgtgagccagaaggatcatcattgccatacctggcccaccacatgccctagaaaaactaaggagtgcctgaaggagtacgcacattactttcttgaggttaccctgcaggaccatatcttttacaaattccagccttctgtcgtcgctgcggcatgtgtcggcgctagtcgcatatgtctgcagttgtccccatactggacacgggacttgcaacgcatatcttcctactccctcgaacatctttctacctgcatcgagatcttgctagtgccgctcttcaggtag

SEQ ID NO: 49675 - DNA, 756 bp, Artificial Sequence
  Description of Artificial Sequence: Synthetic coding sequence
atggacgaaccctggtgggaaggacgcgttgcctctgacgtgcattgcaccttacgggaaaaggaactcaagcttccaacttttcgcgcacactcacctctcctgaaatctcgccgtttttttgtggacatccttactttactgtcttcccattgtcagttgtgtcccgctgcaagacacctggcagtgtatctactggaccattttatggacagatataacgtgacaactagcaaacagctttatacggtagcagtgtcatgtctattactggccagcaagttcgaagaccgggaagatcacgttcccaagctcgagcagattaacagcacaagaattctctcctcccagaatttcactctgacaaagaaagagctcctcagtacagagctgctgcttttagaggccttctcttggaacctgtgtttgccgactcccgcacactttcttgactactatctgctagctagtgtctcacagaaagatcatcactgccatacttggccaacaacgtgccctcggaagacaaaggaatgtctaaaagaatacgcccactacttcctcgaggtcactcttcaagaccatattttctacaaatttcagccaagtgttgtggcggctgcctgcgtcggagcaagtagaatttgcttacaattgagcccctattggacccgggaccttcagcgcattagctcttactctctcgaacacctctcgacttgtattgaaatcctgttagtgccccttttccgttag

SEQ ID NO: 49676 - DNA, 1233 bp, Artificial Sequence
  Description of Artificial Sequence: Synthetic coding sequence
atggacctgacgggactgctcctggatgaggaaggcacattctcgctggccggtttccaggacttcacctttctccccggacaccaaaaactgagtgcccgtattcgacgcagactgtattacgggtgggactgggaggccgattgttccctggaggagctgtcaagccctgtagcagacattgctgtcgaactgcttcagaaagccgcaccgagccccatccgccgtctgcagaagaagtatgtggcccacgtctccagggaagcctgtatttccccatgcgccatgatgctcgcgctggtgtatattgagcggctcaggcaccgcaaccctgattacctgcagcacgtgagtagcagtgacttgtttctgattagcatgatggtcgcctctaaatacctctatgatgagggggaggaggaggaagtcttcaatgacgagtggggggcagctgggggtgtggcagtgcctacactgaacgcccttgagcgagggttcctgtcagcaatggactggcatctatacactgaccctcgggagatcttcgaggtgctttcctggctggaatcctgtgtcgccgagcaacaggggcgatggagaggatggtatacgtacactgacctttgtgtgctgctggaacagcccacatggcagctagccctaggaagcctgtgccagcgactcgtgaaactgagctgcctccttgccgtggcttatgtaagttccgtggcattagccgtggcaagtgttgccgtgatccatcagagcctggggcttagctgcattcctaccccgggtcctcccgatttgggcttaacaagtagatgtctgctggaaccttgtatacccagcgtgccccagtgcttaccaagtttagccaatgttagcagttgcctggagggttcaatggggctccgctctttgtggggttcgttgctggcaagcctcacccctccacccctgcctcccccagatcctcctgctcctccaactcttcttcacaactgtcacctgtgccagaaacttcagcgggactccccaacctgccatgcctgtcttcatccaaacagaaccgtcccaacggccctgagttccccgtggtatcacacctacgggcttgctccaccttggccctggtcgcccgtgttattatcgctcccacagccccaacaatgcagtttatttagcgttatggaactcgcacggctcaaatcatttgtgttcccgggttag

SEQ ID NO: 49677 - DNA, 1233 bp, Artificial Sequence
  Description of Artificial Sequence: Synthetic coding sequence
atggatctgaccggcctgcttctggacgaagagggcaccttttctctcgccggtttccaagattttaccttcctgccaggccaccagaagctatcagccagaattaggcgaagattatattacggttgggattgggaggcagactgcagccttgaggaactgagttcgccagttgcagatatcgccgttgagcttctgcagaaggcagcacccagtcctatcagaagactgcagaaaaaatacgttgcacatgtgagcagagaggcttgtattagtccttgtgcaatgatgctagcgctggtgtacatagagaggctcaggcatcgaaatcctgactacctgcagcacgtgtcaagttctgacctgttcctgatcagtatgatggttgcatccaaatacctgtatgacgagggggaggaggaggaggtcttcaatgacgagtggggggcagctggcggtgtcgctgtaccgaccctgaatgcgcttgagcggggattcctgtccgctatggactggcatctgtacactgacccccgagagatcttcgaagtactatcgtggctcgagagttgcgttgctgaacagcagggcaggtggagaggttggtatacatatactgatctctgtgtactcctggaacagcctacatggcagctggctctgggctccttatgccagaggctggtgaagctaagctgtctattggctgtcgcctacgtcagcagtgtggcactcgctgtggccagtgtcgccgtcatccaccaaagcctgggtcttagttgcattcccactcctggaccaccggacttaggcctcaccagccgttgcttattagagccatgtataccatctgtaccacaatgcctgccaagtcttgctaacgtgtctagttgtcttgagggtagtatgggcttgagatcactatggggatcacttctcgcatccctgacacccccaccgttgccacctcccgatcctcctgcccctcccaccctcctgcataattgccacctctgccaaaagctccaaagggactcacctacatgccacgcttgcctccaccccaatcgtacagttcccaccgcgctgtccagcccctggtaccatacttacggattggccccaccttggccatggtcccctgtgctgttgtccctcccacagccgcagcagtgttcactcttcagcgttatggagctcgctcgtctgaaatcattcgttttcccaggatag

SEQ ID NO: 49678 - DNA, 927 bp, Artificial Sequence
  Description of Artificial Sequence: Synthetic coding sequence
atggatttgacgggcctcttactagatgaggaaggcacattcagcctggcaggatttcaggacttcacctttctccccggtcaccagaaactgtccgctcgaattagaaggcgactgtactacggttgggactgggaggccgactgcagccttgaagaactgagttctcctgtggccgatattgctgtagagctcctgcagaaagcggctccctcccccattagaaggcttcagaagaagtacgtggctcatgtgtccagagaggcatgcatttcaccttgtgccatgatgcttgctttagtttatatagagcgacttcgccaccgaaaccctgactatctacagcatgtatcctccagtgatctgtttctcatctccatgatggtcgcctccaaatacttgtacgacgaaggggaagaagaagaagtgtttaacgatgaatggggggcagccggtggggtggcggtgcctacgctcaacgccctcgagcgcggattccttagcgctatggactggcacctttataccgacccgcgagagatttttgaagtcttatcctggctggagtcatgcgtcgccgaacagcaagggcgttggcgcggttggtacacatacacagacctgtgtgtcctgcttgagcagccgacatggcagctggcccttggatctctgtgtcagaggttggtgaagttgagttgtctgctggccgtggcctacgttagctctgtggctctcgccgtggcctctgtagccgtgattcaccagagtttgggtttgtcctgtatacctacccctggccctcccgatttggggctaacttctcggtgcttactggagccctgtatccccagcgtcccccagtgccttccctcccttgcaaatgttagctcctgtctggaggggtcaatgggcctcaggtctctatag

SEQ ID NO: 49679 - DNA, 1356 bp, Artificial Sequence
  Description of Artificial Sequence: Synthetic coding sequence
atgcacggctattttgggtgtaatgccgcagccgagcccggatactccgcattcgtgggcacaccacagatctgcgttactaagatgagtacgcgaaattgtcaggggatggattccgtgattaagcctctagatactattccagaggacaaaaaggtcagagtgcagcggacacagagtaccttcgacccctttgaaaaacccgcaaatcaggtgaaacgggtccacagcgagaacaatgcatgcattaatttcaagaccagttcgacgggcaaagaatccccgaaagtgcggaggcatagttcccccagctctccaacctcaccgaaattcggcaaggccgatagttatgagaagctggaaaagctgggagaaggatcatatgccacggtctacaagggtaaaagtaaggttaacggcaagcttgtggcactaaaagtgatcaggctgcaagaagaggaaggaacacccttcaccgccataagggaagcatccctgcttaaaggcctgaagcatgccaacatcgtgctgctgcacgatatcatacacacgaaagagaccctgaccctggtttttgaatacgtgcataccgatttatgtcagtacatggacaaacatcctgggggactccacccggataatgtgaagctgtttctgttccagctgttgcggggtctatcttacatacatcagcgctatatcctccatagggaccttaagcctcaaaatttgctcatcagcgatacaggagaactgaaactggcagacttcggccttgctcgggcaaagtccgtgcccagccacacctacagcaatgaagtggtgaccttgtggtacagacctccagatgtgctattaggctccacagagtactctacctgtctggatatgtggggcgtgggatgcatctttgttgaaatgattcagggggtggccgcattcccgggaatgaaggatattcaggatcagctggaacgaattttcttagttctgggtacccctaatgaagacacttggccgggagtgcattccttgcctcactttaaacccgagcgcttcacgctctattcttccaaaaatctgcgccaagcttggaacaagttgtcgtatgttaatcatgccgaggacctggcttctaaacttttgcagtgttctccaaagaatcggctgtccgcccaggccgcactatcacacgagtatttctccgatcttccgcctcggttgtgggagctgaccgacatgagctcaattttcactgtccccaatgtcaggctgcagccagaggcaggggagtccatgcgcgcattcggcaagaacaacagctatggaaaaagcctgagcaattcgaagcactag

SEQ ID NO: 49680 - DNA, 1410 bp, Artificial Sequence
  Description of Artificial Sequence: Synthetic coding sequence
atgtgtgatctgatcgaaccacagcctgcagaaaagatcgggaaaatgaagaagttgcgcaggacactgtctgagtctttctccaggattgcactgaaaaaagacgatacgacttttgatgaaatttgcgtcacaaagatgtcgactcggaattgtcagggcatggactctgtgattaaaccacttgatactataccggaggacaaaaaggtccgggtacagcgaacccagtctacctttgacccatttgagaagcctgccaaccaggttaaaagggtgcactccgagaacaacgcttgtattaactttaagacaagctcaactggcaaagagtcacccaaagtgcggagacatagcagccctagcagccccacatcccccaagtttgggaaggccgacagctatgagaaactggagaagctgggcgaggggtcttacgcgactgtctacaaaggtaaaagcaaagtgaacggaaaacttgtagccttgaaagtgattcggctgcaggaggaggaaggcacaccgtttacggccataagagaagcttccctgctaaagggtctaaaacatgccaatatcgtgctgttacacgacattattcacacgaaagaaactcttacactcgtgtttgagtacgttcacacagatctctgccagtacatggacaagcaccccggaggcctgcaccctgacaacgtgaagttgttcctctttcaactgctcaggggtttgagctacatccaccagcgctacatcttgcacagagatctgaaaccacaaaaccttctgatttcagacaccggagaactgaagctggcggattttggactggcaagagctaaaagcgtgcctagccatacatattctaatgaagtagtaacactctggtaccgtcccccagatgttctgctggggagcacggagtactctacctgtctggatatgtggggcgtggggtgcatcttcgtggagatgattcagggcgttgcagcattccccggaatgaaagatattcaagaccaattggaaaggattttcttggtgctcggcacccccaacgaggacacatggcctggcgtgcacagtcttccccatttcaaaccggaacgattcacgctctactcaagcaaaaatctgagacaagcatggaataagttgtcgtacgtgaaccacgctgaggatctggccagcaaattgctccagtgcagccccaagaaccggctgtctgctcaggctgcattgtcacatgagtatttctccgacctgcccccacggctgtgggaattgacagacatgtcaagcatttttacagtgccgaacgttagattgcaacctgaagctggcgaaagcatgagggctttcggaaaaaacaactcttacggcaaatctttgagcaattcaaagcactag

SEQ ID NO: 49681 - DNA, 1023 bp, Artificial Sequence
  Description of Artificial Sequence: Synthetic coding sequence
atgctggctttgacattgagaccgccacccctggcgaaatcccatctgaagctgggaggaacccctgctcccgctagggtcaacggaaagctggtggctctgaaggtgattagactccaggaagaggaggggactcccttcacagccatacgggaagcctccctgctgaaaggattgaagcatgcaaatattgtgctgctgcatgatatcattcacaccaaggagacattaaccttagtgtttgagtatgtccacaccgacctatgtcagtacatggacaaacatcctggagggctccaccccgataacgtcaagctattcctctttcagctgcttcgagggcttagttatatccatcagcggtacatcttacatagagacttgaagccccaaaacctgctcatcagcgacacaggggagcttaagttggctgatttcgggctggcgagggcaaaaagtgtgcccagtcacacctattcaaatgaggtcgtgacactctggtatagaccacccgacgtactactgggaagcacggaatattccacttgcctcgatatgtggggggtcgggtgtatctttgtggaaatgatacagggcgtcgctgcgttcccaggaatgaaggatatccaggatcagcttgaaaggatcttcctggtgttggggacccctaacgaagacacatggcctggagtccattcactccctcactttaagcccgagcgcttcaccctttatagttctaagaatctgagacaggcttggaacaagctcagctacgttaatcacgcagaggacttagcaagtaaattactccagtgctcacccaagaataggttaagtgcacaggctgcactgagccatgaatacttctccgacctgcccccaaggttgtgggaactgaccgatatgtcatccatatttactgtgcccaacgtgcgactgcagcccgaggccggtgagtctatgcgagctttcgggaaaaacaacagttatggaaagtccctgtccaatagcaaacactag

SEQ ID NO: 49682 - DNA, 1353 bp, Artificial Sequence
  Description of Artificial Sequence: Synthetic coding sequence
atggatcaatattgcatactgggcagaatcggggagggggcacatgggattgtcttcaaagcaaaacatgtcgaaactggggaaatagtggcactgaagaaagttgcccttagacgactcgaagatggcttccccaatcaggctctgcgggagatcaaagccctgcaggagatggaggataaccagtacgtggttcagctgaaagcagtgttcccgcacggcggtgggttcgtgctggcgtttgaatttatgctgtcggacctagccgaagtcgtacgccacgctcagcggccattggcccaagcacaagtcaaatcttacctccagatgctgcttaaaggggtcgccttctgtcacgcaaataatatcgtgcatagggatcttaaacctgcaaatctgctgatctccgcttcaggccagctgaagatcgcggacttcggactggcccgtgttttcagccctgacggcagcaggttatatacgcaccaggttgctacccggtctgtcggctgcatcatgggggagctgctgaatggaagtcccttattcccagggaaaaacgacatagaacagctgtgctacgtcctgcgaattcttggaacccctaatcctcaagtctggcccgaactgaccgaactgccagattataacaagatttccttcaaggagcaggtccctatgcctctggaggaagtgctccctgatgtgtctccacaagcactggatctgctgggacaattccttctgtaccctccccatcagcgtatcgcagcttctaaggcactgttgcatcagtacttttttaccgcccctttacctgcgcatccgtccgagctcccaatcccccaacgattgggaggtccagcccctaaggcccatccaggccctccacacatccatgatttccatgtggacaggcctttagaggtagccgtcgaaccaagggccgactccgccctgcacccaggaggtgttcggtcatggccatggtctaggctacccgctcctcaggatcactctgttcacctgttcttgtgccacctgccaggttttaccctgcagggcttgcctatggccaccgttgggccacaccatactcttcccctgtcaccttgtgagggatggtcccgcggtcgcggacacgtgccttcccaagaatatgagaacattcaaagtagcaggggcgattcctggccggtgctgggagaaccgtacctgctctgcgccacagacgttccgatccggacggttagctcagcagccagccagggcttgcacatgcaaaatgacgatgcctgcttaggtgctgctccggagtgttgtctattggttaaagaaaagtgtagggagtag

SEQ ID NO: 49683 - DNA, 1041 bp, Artificial Sequence
  Description of Artificial Sequence: Synthetic coding sequence
atggaccagtattgcattctgggtcgcattggagagggagcacacggaatcgtgttcaaagcaaaacatgtggaaacaggggaaattgtggccttgaagaaggttgcactccgcaggctggaagacggcttccccaaccaggccctccgcgaaattaaggccctgcaggaaatggaggataaccagtacgtggttcagcttaaggccgtgtttcctcatggaggtggctttgtgcttgcttttgaatttatgctgagcgatctcgcagaggtagtacggcatgcgcagagacccctggcacaggcccaggtgaaaagttacctgcaaatgctgctgaagggggtcgccttctgccacgctaacaacatcgttcatagagatctgaaacccgctaacttattgatctccgcgtcaggccagctcaagatagccgattttggcctcgcccgagtcttttcgccagacggctcccgactgtatacgcaccaagtggccaccaggtggtatcgcgctcctgaactcttgtacggagcccgacagtacgaccagggggtagatttgtggagtgttggctgcattatgggcgaattgttgaacggctcccccctgtttccagggaagaacgatattgagcagctgtgttacgtgctgcggatcctgggcacacccaatccacaagtatggcccgagctgactgaactcccagattacaataagatcagcttcaaggaacaggtgcctatgccgttggaggaagtactgcccgatgtgtcgccacaagccctagatctcctgggacaatttctactctatccaccacaccaacgcatcgccgcttctaaggcactcctgcaccagtacttcttcacggcccctctccctgcccacccgtccgagcttcccattccacagcggctgggtggcccagcaccaaaggcacaccccggtccgcctcacattcatgacttccacgttgataggcctcttgaagagtctctgcttaatccagagctgatccggcctttcatccttgaagggtag

SEQ ID NO: 49684 - DNA, 1017 bp, Artificial Sequence
  Description of Artificial Sequence: Synthetic coding sequence
atggatcagtactgtatccttggcaggatcggcgagggcgcacacggcattgtcttcaaagccaaacacgtggagcccagagtgggatggcagtgtctgccgagcattttgcagaccggtgagatagtggctctcaagaaagtggcgttgcggaggctggaagatgggttccctaatcaggcccttagggaaattaaggccctacaggagatggaggataaccagtatgtcgtgcagttgaaggcagtgtttccccacggtggcggatttgttctcgcatttgaattcatgctttcagatctggccgaagtcgtgcgccacgcacaacggccattggctcaggctcaggtgaagagttacctccagatgctgctgaagggggtggcattctgtcacgccaataatatcgtgcaccgcgacctcaagcctgccaacctcctgattagcgcctctggccaactgaagatagccgatttcgggcttgctagggtgttctctcccgatggcagtagactatacacccaccaagttgccactaggtctgtaggctgcattatgggcgagctcctcaatggcagtcccttgtttcctgggaagaacgatatcgaacagctttgctatgtgcttagaattcttggtacccctaaccctcaggtgtggcccgagctgacagagctgcccgattacaataaaatcagctttaaggaacaggtacctatgccactcgaagaagttctgcccgatgtgtcaccacaggctctggatttgctgggccagttcctgctgtacccgcctcaccaacgtatcgctgcttcaaaagcactcttgcaccagtactttttcaccgcacctctgccggctcacccttccgaactgcccatcccccaacgcttgggaggcccagcccctaaagcccaccccggtcctccccatatccacgattttcatgtcgatagacctctagaggaatcccttctgaaccctgagctcatccgccctttcatacttgaaggatag

SEQ ID NO: 49685 - DNA, 732 bp, Artificial Sequence
  Description of Artificial Sequence: Synthetic coding sequence
atggaccagtactgcattcttggaaggatcggagagggtgcccacggaattgtcttcaaggctaagcacgtagagacaggggaaatcgttgccctcaagaaagtggcccttagaaggctcgaggacgggtttcctaaccaagctctgcgcgaaattaaagctctgcaggaaatggaagacaatcagtacgtcgtgcagctgaaggcggtgttcccgcatgggggtggttttgtactggcattcgaatttatgctgtctgacctcgcagaggtggtgcgtcatgcccagagaccactggcgcaggcgcaggtcaaatcgtacctgcagatgcttctgaagggcgtggcgttttgtcacgctaataatatcgtgcatcgggacctcaagcctgcaaacctccttatttcagcaagcggacaactaaagattgccgacttcggattggcccgagttttttcccctgacgggtctagactgtacacacatcaggtggctaccagaagctccctgtcctgcaggaccactaccagatcccctcttcgtagcaggtgcccctgcccctggagaaggtgctgtttgacttccctgccacggcactggatttgttgggtgaactcattctccactctgctcacttcagccagccagctgccccgtctgtctagtatttcgacatctagtcagcttccttgtcttccgattcatttgagctgcagattcttgtccgtttag

SEQ ID NO: 49686 - DNA, 978 bp, Artificial Sequence
  Description of Artificial Sequence: Synthetic coding sequence
atggaccagtattgcatactcggcaggataggagaaggcgcacatggcatcgtttttaaagctaaacacgttgagacgggtgaaatcgttgctctgaaaaaggtggcccttaggcgcctggaggacggttttcctaatcaagcactgcgcgagattaaggcactgcaggagatggaagacaaccagtatgtcgtgcagttgaaggctgtttttccccacggaggagggttcgtgctggctttcgagtttatgctgtccgatttggccgaagtggtccgacacgcgcagaggccccttgctcaggcccaagtgaagtcatatttgcagatgctcttgaagggagtggccttctgccacgcaaacaatatcgtccacagggacttaaagcccgcaaacctgttaatctcagctagtggccagttaaagattgcagacttcggtctggctagggttttttccccggacggcagtcgcctctatactcaccaggtagccacccggagcgttgggtgcattatgggtgaattactgaacgggagccccctctttcctggaaagaacgacatagaacaactctgctacgtcctgcgtatcctcgggaccccaaaccctcaagtctggccagaactgactgagctccccgattataataaaataagctttaaagagcaagtgccgatgccactcgaagaagtgctccctgacgtgagccctcaggccctggatctgttggggcagtttctgttgtaccctccacaccagagaatcgctgcttccaaggcgttgctgcatcagtacttctttacagctccgctgccagcccacccgtcagagttaccgatccctcagcgcctggggggtcctgcacctaaggcccatcctggaccgccacacattcatgactttcacgttgatagacccctcgaggagagtttgttgaaccctgagttaataaggcctttcattctggaagggtag

SEQ ID NO: 49687 - DNA, 465 bp, Artificial Sequence
  Description of Artificial Sequence: Synthetic coding sequence
atggatgctccacggttgccagtgcgtcctggggtgcttttgcctaagttggtgctcctgttcgtgtacgccgacgactgcctggcccagtgtggaaaggattgtaagagctactgttgtgatggcacaacaccttattgttgcagctactatgcatacatcgggaacatactgagtggaaccgcaattgctggcatagtgttcggcatcgtgtttataatgggtgtaatagccggaattgctatatgtatctgtatgtgtatgaaaaatcacagggccacacgggtgggcatactgagaaccacccatattaacaccgtgagttcctatcctggccctcctccttatggccacgaccacgaaatggaatactgcgctgatctgcccccaccttactcaccaaccccacagggccctgcccaacggtccccacctcccccatatcctgggaatgcgaggaaatag

SEQ ID NO: 49688 - DNA, 519 bp, Artificial Sequence
  Description of Artificial Sequence: Synthetic coding sequence
atgaagtgtgaacccggatggccaagaactcctgagtggcctccctctccaaggctgtccgcagtggggagagacaaggagacctgggccccttccgccgcacgccttggccctcgcgcacctcagcttcgaggtgtgcctcagtccctggccagggatgcacccggaccaggctcactcggtcgtctccccagacagtggcccggactgtgtagcacgcgcctgtccggcgcacttctgagccccagcgaccggcctccaagctctccgtttcctcctgttccaggctcaccatttgccccatcactgagacctccagcatggatggatgctccacgattgccagtcagaccgggagttctcttacctaagctagttctgctgttcgtctatgccgacgattgtcttgcacaatgtgggaaggactgtaagtcctactgctgtgacggcacgaccccatattgttgctcctattacgcttacatcggtaatattcttagttgctgttgtcctcgatag

SEQ ID NO: 49689 - DNA, 675 bp, Artificial Sequence
  Description of Artificial Sequence: Synthetic coding sequence
atgtctatcctgttgcccaacatggccgagtttgacacaatttccgaattagaggaagaagaagaggaagaagccgctacatctagctccagcccaagttcatcatcgtccgtttctggcccagacgatgacgaggaagatgaggaagaagaagaagaagaggaggaggaggaggaggaggaagaggaagaggaggaagaagaggcacccccaccccctagagtggtgagcgaggaacacctgcggagatacgccccagaccccgtactggtgagaggcgctggccatatcacagtttttgggctgtcaaataagtttgatacagaattcccaagcgtgcttactgggaaggtcgcacccgaggaatttaaaaccagcatcggcagagtcaatgcctgcctcaaaaaagcactcccagtcaatgtcaagtggctcctatgtggctgtctctgttgttgttgcaccctgggttgtagcctgtggccagtcatttgcctgaacaaacgcactcgaaggtctattcaaaagctcattgaatgggagaacaatcgcctgtaccacaaacttgcattgcactggaaattgaccaagcggaagtgtgagaccagcaacatgatggaatatgtcatcctgatcgagtttctccccaagtaccctatcttcaggccagattag

SEQ ID NO: 49690 - DNA, 615 bp, Artificial Sequence
  Description of Artificial Sequence: Synthetic coding sequence
atgagcatcttactgcctaatatggctgaattcgatactatcagtgagcttgaagaagaagaggaggaagaggcagctacctctagtagttcaccttcttcctcttcctcggtgtcagggccagacgatgacgaggaggatgaggaagaggaggaagaggaagaagaggaagaagaagaagaagaggaagaggaggaggaagaggcaccgcctcccccacgcgtggtcagtgaagaacatttacggcgatatgcacctgatcccgtgctagtgcgcggtgcaggacatattactgtgttcgggttatctaacaagtttgataccgagttcccaagcgtgttaaccgggaaggtggcacccgaagagttcaaaacctcaatcggacgggttaacgcatgcctaaagaaggctcttcctgtaaatgtgaagtggctgttgtgtgggtgtctgtgttgctgctgcacactcgggtgctcactatggccagtgatttgccttaataaaaggacccgaagatcaatacagaaacttatagagtgggagaataacagactataccacaaggtgatcctgattgagtttttgcccaagtacccaatcttccggccagactag

SEQ ID NO: 49691 - DNA, 1341 bp, Artificial Sequence
  Description of Artificial Sequence: Synthetic coding sequence
atgcacgaaccctccctatgcgctaatgtcgagtgtcctccggcacatacgtgtccctgtggggtgccggcatgttcctgcgcccacgtggaatgccctccagcccacacctgccgatgtggtgtaccagcctgctcacacatgcccatgtggtctgccaggctcctgaccagggcccacgtcgaatgtcctcctgcgcatacacgcgtccatgtcgagtgcccgcctgctcacgtgccaatgtggtcagcacaccttctgacatgcgcagatgtggagtgccatttgctcacacatgtaccgatgtggtcggcacgcctgctcacatgcccttgcggcgtccctgcctgttcacatgtcccaatgcgcagcgcaaggctcctgacaagggcccacgccgaatgccctcccgctcacacctgtccctgtggcgttccggcatgttcccacgttcctatgcgcagcgcacgactcctgacacgggctgacgtagagtgtcctccggctcatacctgcccttgtggtgttccggcttgtagccatgtgcctacatggagcgctaggcttattacaagggcacacgtggagtgtagtcccgctcatacgtgccggtgtggagttcctgcatgtagccacgtaccaatgtggtcagtgcgcctgctgaccagggccgacgccgaatgcccccctgcacacacctgccggtgtggcgttccagcctgctcccacgtgcccatgtggtccgcacggctcctgacctgtagatgcggtgtgcctgcatgctcgcatgtgccaatgtggagcgcacggctccttacgtgtcgctgcggcgtgccagcttgtagccatgttccaatgtggtccgcaagacttctgacgagggctcatgtagaatgcccaccggcacacacatgtagacgcggagtgcccgcatgttcgcgggcacatatggaatgtcctcctgcccacacttgccactgtggcgtgcctgcttgttcacacacgtgccggtgcggtgtgccagcttgttcgcatgtcccaatgtggtcggccaggctgctgacaagggcacacgtggagtgccctccagcccacacaagagcccatgtggagtgccccccagcacacacctgcccctgtggcgtccccgcatgcagccacacatgtccttgtggcgtgcccgcttgctctcacaaggccctggcttggtggttctgccgattcccagttcttccagccgagagtgacgcagtcactgtccatagcacccacggcggatttctgatcaggttttatgtcaaagatccgttctatatcagtctgcatctggagataacatag

SEQ ID NO: 49692 - DNA, 1167 bp, Artificial Sequence
  Description of Artificial Sequence: Synthetic coding sequence
gctaacgtcgaatgcccacccgctcacacttgcccatgtggtgtgcccgcttgttcttgtgcccacgtggaatgccctccggcacacacttgtcgatgcggagtgcctgcgtgttcccacatgcctatgtggagtgctaggctcctgacacgtgctcacgtagagtgccctccagctcataccagggtgcatgtggagtgccctccagcccatgtgcccatgtggtccgcccaccttctcacatgcgccgatgtagagtgtcacctcctcactcatgtcccgatgtggagcgccagactccttacacgagctgatgcggagtgtccacccgctcatacatgcccatgcggcgtgcctgcctgttctcacgttcccatgcggtccgctcggctattaacacgtgctcacgccgaatgtcctcccgcacacacctgccggcgaggcgtgcccgcttgtagccacgtcccaatgtggtctgccaggttgcttactcgtgccgacgctgagtgccctcctgctcatacttgtaggtgcggtgtgcctgcctgtagtcacgtccctatgtggagcgcccgattactgacttgcagatgcggagtgccagcttgctcgcatgtaccgatgtggtcagcccgactgctcacctgcaggtgtggggtgccggcttgtagccacgtgccaatgtggtcggctcgtcttctgacgcgcgctcacgttgagtgtccccctgctcacacctgtaggcgaggagtacctgcttgcagccgggctcacatggagtgcccacccgctcatacctgtcactgcggtgtgcctgcctgctctcatacctgtagatgcggagtacccgcatgtagccacgtccccatgtggagcgctcggctgctcactcgagcacatgtcgaatgcccacccgctcatacccgtgcacatgtggaatgccctccagcacatacttgtccctgcggcgtgccagcttgttcccatacatgtccatgcggcgttcctgcgtgctcacacaaggccttggcatggtggttttgtagattcccagtcctaccagcagagagtgatgccgtcaccgtgcactccactcatgggggattcctcatccggttttacgtcaaagatccattctacatatcccttcaccttgaaatcacgtag

SEQ ID NO: 49693 - DNA, 861 bp, Artificial Sequence
  Description of Artificial Sequence: Synthetic coding sequence
atggcaatggaaggatattggcgttttctggccttgctggggtctgcgctgctcgtgggtttcctgtcagttattttcgccctggtgtgggtgttacactatcgggaggggctcggctgggacgggtcggcattggaatttaactggcacccggtgctgatggtcacaggtttcgtctttatccagggcatcgccatcattgtatatagactgccttggacatggaaatgctccaagttgctgatgaagagcatccacgctgggctgaatgcagtggcagcaattctggccatcatctcagtagtggcagttttcgagaaccacaacgtcaacaacatcgcaaacatgtacagcctgcacagctgggtgggactgatagctgtgatatgttatctgcttcagctgcttagtgggttctcagtgttccttctcccgtgggcacctctcagtcttcgtgcttttctgatgcccattcacgtgtattccggcattgtaatctttggcacggtaattgcaactgctctcatggggctgaccgagaaacttattttttctctccgggacccagcttactccacgtttccgcctgagggcgtttttgttaataccctcgggctgcttatcctcgtatttggcgcactcattttttggattgtgactagaccacagtggaaacgtcccaaggagccaaatagcactatcttacacccgaacggaggcaccgaacagggcgcaagaggctccatgccagcatacagcggaaataatatggataaatctgacagcgagctcaactcagaagtggctgctcgcaagaggaacttagcccttgacgaagcaggacagcggtccaccatgtag

SEQ ID NO: 49694 - DNA, 474 bp, Artificial Sequence
  Description of Artificial Sequence: Synthetic coding sequence
atggcaatggaaggctattggcgctttttggctctgctggggtccgcccttttggtgggatttctgtccgtgattttcgcgctagtctgggtgctccattacagggagggcctgggctgggacggtagcgccctcgaattcaactggcaccccgtcctcatggtgaccggatttgtttttatccagggcattgcctcatttaggttcttctccctgtcggccagcatgggctcggccttcagtccatctatctcacacgcgcatacttgtctgttctggaactgtcatctgtggaacagtgattgtaatagcacatacggcattgatagagagaccgactttttccccgagagatcttgcatccagtacatacctgcccgacgatgtttccgtaagtatgcctggccctcagatccgggtgttcgaggcccacatttcctagatagtcatcagacggccatggagactagctag

SEQ ID NO: 49695 - DNA, 687 bp, Artificial Sequence
  Description of Artificial Sequence: Synthetic coding sequence
atgctcgacgaaggagaggccattatagtgtataggttaccctggacatggaagtgcagtaagttgctcatgaagagtattcacgctggtttgaatgctgtggccgctatcctggcaatcatttctgtggtcgcagtgtttgaaaatcacaatgtgaacaacatagccaatatgtacagcttgcactcttgggtcggactcatagctgtaatttgttacctcctgcagctgctgtcagggttcagcgtgttcctgcttccatgggctcctttaagtctaagggccttcctcatgccaatacatgtgtacagtggtatcgttattttcggcaccgtgatcgcaactgctctcatggggctcacagaaaaattgatcttttccctgagggatccggcttactcaaccttccccccagagggggtgtttgtcaataccctcggattgctgattctggtgtttggggctctcattttctggatcgtcactcggccacagtggaagcggccaaaggaacccaacagtaccatcttgcatcctaacgggggtacggagcagggcgctcgtggctccatgcccgcttactctgggaacaatatggataagagcgacagcgagctgaactcagaagtggcggcacgtaagaggaacctggccctggacgaagctggccagaggtctactatgtag

SEQ ID NO: 49696 - DNA, 729 bp, Artificial Sequence
  Description of Artificial Sequence: Synthetic coding sequence
atggtttccgggcgtttctacctgagctgtctcctgctcggttctctcggctccatgtgtatcttatttaccatctattggatgcagtattggagggggggattcgcttggaatggtagcatatacatgtttaactggcaccccgtgttaatggtggcgggtatggtggtcttctacggcggtgcgtccctggtgtaccgtttgcctcaatcatgggtggggccaaagctgccttggaagcttctccatgctgccctgcacctgatggccttcgtgctaactgtcgtggggctcgttgccgtgttcacatttcataatcacggcaggaccgcaaatctttatagcttacattcatggctgggcatcaccaccgtgttccttttcgcttgccagtggttcctgggattcgctgtgttcttgttgccatgggcttcaatgtggctaaggtccctattgaagccaatccatgttttttttggggctgctatcttgagcctctcaatcgcatcagttatctctggcatcaatgagaaactgttcttctcactaaaaaacacaaccaggccatatcactccctgcctagcgaagctgtgttcgcaaattctaccggcatgctcgtggtcgcatttggacttctggtgctctacatcctcctcgcatcttcttggaagagaccagaaccaggcattttaaccgaccggcaaccactactccacgatggcgaatag

SEQ ID NO: 49697 - DNA, 780 bp, Artificial Sequence
  Description of Artificial Sequence: Synthetic coding sequence
atgggcaaaaatttttcagacagctttcttagtcgcgaatgtgtgattagaatggtgtccggaaggttctacttgtcatgcctgctcctggggtctctgggtagcatgtgtattctattcaccatttactggatgcaatactggaggggagggtttgcatggaatggttcgatctatatgtttaattggcatcctgtgcttatggtggctggaatggttgtgttttacgggggtgcgtcactcgtctaccggctccctcagtcctgggtgggccctaagttaccatggaagttactgcatgctgcactgcatcttatggcattcgttctgaccgttgttggcctggtcgccgtgttcacattccacaaccatgggagaacagccaatctgtactccctgcattcttggcttggaatcactactgtgttcctgtttgcctgccagtggtttctgggcttcgctgtgtttctcttgccctgggcctcaatgtggttacgctcactgctcaaacccatccacgtttttttcggagcagccatccttagtttgtctattgcctctgtgatatccggaatcaacgagaagttgtttttctcactgaaaaataccacccggccataccactccctgccatcggaggccgtctttgccaatagtactggcatgctagtcgtcgccttcggcctcttagtcctttacatcctcttggcatcgagctggaagaggcccgagccaggcatcctgaccgatcgccagcctttattacatgacggcgaatag

SEQ ID NO: 49698 - DNA, 729 bp, Artificial Sequence
  Description of Artificial Sequence: Synthetic coding sequence
atggtgagcgggaggttctacctcagctgcctgctgctgggaagcctcggctctatgtgtattctgttcactatctactggatgcagtactggagagggggatttgcttggaacggatcaatctatatgttcaactggcaccccgttctgatggtggccggaatggtggtcttctatggaggcgcatccctcgtgtatagactgccccaatcctgggtgggccctaagctcccctggaagctgctgcatgccgctcttcatctgatggcttttgtgctaaccgtggtcggcctcgtggctgtgtttaccttccacaaccatggacggactgccaatctctatagtcttcactcctggctggggattactaccgttttcctcttcgcgtgtcagtggttcctggggttcgctgttttccttctaccatgggctagcatgtggctgcgcagcctgcttaagccgatacacgttttcttcggcgctgctattctgtccctgagcatagcgtccgtcatctcaggcataaacgaaaagttgttcttcagtctcaaaaacaccacacgcccttaccactccttgccttccgaggctgtcttcgctaatagcacaggaatgctcgttgtggccttcggtcttctggtgttgtacatccttttggctagctcatggaaaaggccagagcctggcattttgaccgatagacagcccttgctgcacgacggagagtag

SEQ ID NO: 49699 - DNA, 549 bp, Artificial Sequence
  Description of Artificial Sequence: Synthetic coding sequence
atggtctctggacggttttacctgtcttgtttgctgctgggctcgttaggctcaatgtgcattctgttcaccatctactggatgcaatactggagggggggatttgcatggaatggatctatttatatgttcaactggcatcccgtgcttatggtggctggcatggttgtgttctatggcggagcttctttggtctataggctgccacagtcctgggtgggtccgaaacttccttggaagctgttgcacgcggcacttcatttgatggctttcgtgttgaccgttgtgggcctggtggccgtttttactttccacaatcacgggaggaccgcaaacctctattccctgcacagctggctgggtattactactgtgttcctttttgcttgccagtggtttttgggcttcgcagtgttcttactcccttgggcctctatgtggctcagatcactgctgaaacccattcatgtattttttggtgccgcaattttatcgctatcaatcgcctctgtgatctcgggtattaatgagaagttgtttttttcctag

SEQ ID NO: 49700 - DNA, 87 bp, Artificial Sequence
  Description of Artificial Sequence: Synthetic coding sequence
atggtgagcggacgcttctacctgtcctgtctcttgctgggcagcctgggtagtatgtgcatcctgttcacaatctactggatgtag

SEQ ID NO: 49701 - DNA, 348 bp, Artificial Sequence
  Description of Artificial Sequence: Synthetic coding sequence
atggtgtcaggaaggttttatttaagctgtctgctccttggatccctgggttccatgtgcattctgtttaccatctattggatgcagtactggcgaggcggtttcgcttggaatggctctatctatatgtttaattggcacccagtattaatggtcgctggcatggtggttttctacgggggagccagtctggtataccggctgccacagtcttgggtgggacccaagctgccttggaaactgctgcacgccgctctgcacctcatggcgttcgtcctcacagtggtggggctcgtggctgtgttcaccttccataaccatggcaggaccgcaaatctctactcatag

SEQ ID NO: 49702 - DNA, 603 bp, Artificial Sequence
  Description of Artificial Sequence: Synthetic coding sequence
atggtgtcaggccgtttctacctgtcttgtctcctcttgggcagccttggttccatgtgtatactcttcactatctattggatgcagtactggcgtggcggttttgcatggaacggcagcatctatatgttcaattggcatcctgttctcatggtggccggaatggttgtcttttatggtggcgcttcactggtctacaggctcccacagtcatgggtaggccctaagctgccttggaagcttctgcatgccgcactccaccttatggctttcgtgcttacagtagttgggctcgtagctgttttcacgtttcataatcatgggagaaccgctaacctgtacagcctacatagctggttgggcataactaccgtctttctcttcgcctgccagtggtttctcgggtttgcagtttttctactgccatgggctagcatgtggttgcggagcttactcaagcccatccacgtattctttggcgcagcaatcctttcgctcagtatagcttctgtgatctctggcatcaacgaaaagcttttcttctcccttaaaaacaccacacgcccttatcactccctcccctcagaagccgtgttcgcttag

SEQ ID NO: 49703 - DNA, 168 bp, Artificial Sequence
  Description of Artificial Sequence: Synthetic coding sequence
atggtcagcggaaggttctacctctcttgcctcttgctaggaagtcttgggtccatgtgcatactttttacaatttactggatgcagtactggcgtggcggattcgcatggaatggttcaatctacatgttcaactggcatcccgtcctgatggtcgcaggtatgtag

SEQ ID NO: 49704 - DNA, 918 bp, Artificial Sequence
  Description of Artificial Sequence: Synthetic coding sequence
atgggtatccagacatccccggtgttactggccagcctgggcgtaggcctcgtaacactgcttgggctcgcggtgggctcctatttagtgcgtagatcacgcaggccacaggtcactctgctggaccctaatgaaaagtatctgctacgactcctggataagaccacagtgagtcacaacaccaaaaggtttcggttcgcactgcctactgcccaccatactctgggtctccccgtgggcaagcacatatatctgtccactaggatcgacggctctcttgtgattcggccatacactcccgttacctcagatgaggatcagggttacgtcgatctggtgatcaaagtgtatctgaaaggggtgcaccccaaattccctgagggagggaaaatgagtcagtacctggacagtctgaaggtcggagacgtggtcgagttcagaggtcccagtggcttgctcacttacactggaaaagggcacttcaacattcaaccgaataaaaagtcccctcccgagcccagggtggccaaaaagctcgggatgatcgccggaggaaccgggatcactcccatgctacagcttattagggcaatccttaaggtgcccgaggaccccactcaatgttttctcctgtttgcgaaccagaccgagaaagatataattctgcgcgaagatcttgaggagctgcaagctagatacccgaacagatttaagctttggttcacgctcgatcaccctcccaaagactgggcttatagcaagggttttgtcaccgccgatatgatcagagaacatctgcctgccccaggggacgatgtactggtcctgttatgtgggccaccacccatggtgcaactcgcttgtcatccaaatttagacaagctcggctattcccagaaaatgcgtttcacatactag

SEQ ID NO: 49705 - DNA, 681 bp, Artificial Sequence
  Description of Artificial Sequence: Synthetic coding sequence
tgaaccgctcatcacaccctgggactgcctgttggaaagcatatatatcttagcacccgcatcgatggcagcttggtgattaggccatatacaccagttacctctgacgaggaccagggatacgtcgatctcgtgataaaggtgtatcttaaaggcgtgcatccaaaattcccagagggagggaagatgagccaatacctcgactcactgaaagtcggcgatgtcgtggagtttagagggcctagcggccttttgacgtacaccggtaagggccactttaatatccagccaaataagaagtcaccgcctgagccaagggtggcaaaaaagctcgggatgattgccggtggcacggggataacgcccatgctgcaactgatcagagccatcctgaaggttccagaggatccgacacaatgttttctgctctttgcaaatcagacagagaaggatatcatactgagagaggacctcgaggaactgcaagccaggtacccaaatcgctttaaattgtggttcacactcgaccacccccctaagggaattctaccgatatccgggcaccccacgatcccatcttctagtaagtcaaaaccatgtcccttcgtgaattcgggattcattgagatcaacctggcatctcattgccagttgggttcactctcagctcagactcagtag

SEQ ID NO: 49706 - DNA, 402 bp, Artificial Sequence
  Description of Artificial Sequence: Synthetic coding sequence
atgcagccactggaggttgggcttgtgccagcaccagccggtgagccgagactcacccgctggcttaggagaggaagtggaattctggctcacttggttgctctggggtttacaatattcttaaccgcactgtctcgacctggaactaagactggccctttgatggaagatcggagcgaagggggtcgggcaagatgggtgatgcccgaaatacccgcactgtgggaagccgatgcgggaggctcactggaggttttcagcccgggtactctctatagttggccatggaggtcagccagtgcatggctgaagccctcttacagtagccacctcaataccccgtgctctagctctgcccctgagaagcacggttcaggctcaactgggcagggacgaccatag

SEQ ID NO: 49707 - DNA, 756 bp, Artificial Sequence
  Description of Artificial Sequence: Synthetic coding sequence
atgcagcccttggaggtcggattggtacccgctcctgccggagaaccccgtctaaccaggtggcttcggcgaggaagtggaatcctcgctcacctggttgccctcggattcaccatatttctcaccgctctgtccaggcctgggaccaagacgggcccactcatggaggatcgttctgagggcggtcgggctcggtgggtaatgccggaaattcccgctttatgggaggccgatgctggcggatccctcgagttctgcttgtgcatggccgaagcaattctcttgttcagcccagagcacagcctgttctttttctgtagtcggaaagccagaatcagactacattgggccggacagacactggctattctgtgtgccgcactggggctaggctttatcatctcaagtcggacaaggagcgagctcccacacctggtcagctggcatagttgggtgggagcattaaccctccttgctacggcggtccaagcactctgtggtttgtgccttctctgcccgagggcagctagagtgagccgcgtggcacgactcaagctgtaccaccttacatgtgggctggtggtgtacctcatggccacagtgacagttcttcttggaatgtactcggtctggtttcaagcgcagatcaagggggctgcctggtacctgtgtctcgctcttcctgtataccctgcacttgtgattatgcaccaaatttcaagaagctatctgcctcgtaagaagatggagatgtag

SEQ ID NO: 49708 - DNA, 519 bp, Artificial Sequence
  Description of Artificial Sequence: Synthetic coding sequence
atgcagccccttgaattctgcttgtgtatggcagaggctatccttctgtttagccccgaacactcccttttcttcttttgcagcaggaaagcacggatcaggctgcactgggccggacagactcttgccatcctttgtgccgcactcgggctgggcttcatcatatcttcccggacgagatcagagctacctcatctggtttcctggcattcatgggttggagccctgacgcttctggcaactgccgtgcaggctctgtgcgggttgtgtctgttatgtcctagggccgcacgggtcagtcgcgtcgcgaggctgaagctgtaccacctcacatgtggactcgtcgtttatcttatggcaactgtgacagtattgctgggcatgtattcggtgtggttccaggcccaaatcaagggggctgcctggtacttgtgcctcgccctccccgtgtacccggcactcgttatcatgcaccaaataagcagatcttatttgcccaggaagaaaatggagatgtag

SEQ ID NO: 49709 - DNA, 690 bp, Artificial Sequence
  Description of Artificial Sequence: Synthetic coding sequence
atgcaacctcttgaagtgggactcgtgcccgctcctgcaggagagccgcgactgactcggtggctgcgtagagggagcggtattttagcacaccttgtcgcactggggtttacaatctttcttactgccctcagcagacccggaacaagcctttttagctggcatcctgtcttcatggccctcgctttttgtctgtgtatggctgaggctattctgctcttcagcccagagcactcattgtttttcttctgcagtagaaaagccagaatcaggttacactgggcaggtcagaccctggccattctgtgcgcagctctaggattgggcttcatcataagctccagaacccgcagcgagctccctcacctggtctcttggcattcatgggttggggcattaacactcttggccacagcagtgcaagccctatgcggtctgtgtttgctgtgtccgcgtgcggcaagagtcagccgagtagctaggctaaaactctaccatctgacctgcggactcgtggtgtatctgatggcgacagtgaccgtgcttctgggcatgtactcagtctggttccaagcacaaatcaagggagctgcttggtatctatgtctcgcacttcccgtgtacccagctctggtcattatgcatcagatttcacgtagctacctcccgaggaagaagatggagatgtag

SEQ ID NO: 49710 - DNA, 387 bp, Artificial Sequence
  Description of Artificial Sequence: Synthetic coding sequence
atgcagcctctcgaagtcggcctggtgcctgctccagctggcgagcctagactcactcgctggctcaggaggggatccggcattctggcgcacttagttgccctgggtttcaccatttttctgaccgctttaagtaggcccggtaccaagaccggacccctgatggaggacagatctgaggggggaagagccaggtgggtgatgccagaaattcctgcactatgggaggcagatgcaggcggatccttggaggtcttctctcctggtaccctctactcgtggccatggcgtatgtatgagagtacctccttctttagtggtctccaagccaggcacgaagcctactggttgagccctatgttcactgtactgcccttgcacgggtag

SEQ ID NO: 49711 - DNA, 225 bp, Artificial Sequence
  Description of Artificial Sequence: Synthetic coding sequence
atgcctaagtattatgaagataagccacagggtggagcgtgtgcaggccttaaagaagacctgggcgcatgtctccttcagagtgattgcgtggttcaggaaggcaaatcacctcgtcagtgcctcaaagagggttactgcaactcattgaagtacgctttcttcgagtgtaagcggagtgtgctggacaacagagccagattccgaggacgcaaggggtactag

SEQ ID NO: 49712 - DNA, 330 bp, Artificial Sequence
  Description of Artificial Sequence: Synthetic coding sequence
atggctgccgtgggcgtcttttccgtctctcggctgctaggccgtagcaggccccagctgggcaggccaatgagttctggagcacacggcgaggagggctccgcacggatgtggaaaacgctcacctttttcgtggccctgccgggtgtagcggtatccatgctcaatgtgtacctaaaaagccatcacggggagcatgaacgcccagagtttattgcatatccccatctcaggatcaggacgaaacctttcccttggggagacggcaatcatacactgttccacaacccccatgtgaacccactgccgacaggttatgaagacgaatag

SEQ ID NO: 49713 - DNA, 294 bp, Artificial Sequence
  Description of Artificial Sequence: Synthetic coding sequence
atggccctcccgctcagacctctcacgcggggactcgcatctgccgctaagggtggacatggaggtgccggtgctcgtacctggcggcttcttacattcgttctcgcactcccgagcgtggccttgtgcactttcaattcgtacttgcatagcggtcaccgcccacgtccagagtttaggccatatcaacacctgcgcataagaactaagccttatccctggggcgacggtaatcatactctattccataactcccacgttaacccacttcccaccgggtatgaacatccgtag

SEQ ID NO: 49714 - DNA, 267 bp, Artificial Sequence
  Description of Artificial Sequence: Synthetic coding sequence
atgctggatgtagaagcccaagagcctcctaaaggcaagtggtctactccacccttcgacccccgttttccttcacagaaccagattagaaactgctatcagaacttccttgattaccatagatgcttaaaaaccagaaccaggcggggaaagtctacccagccctgtgaatactacttccgtgtttatcatagcctgtgccctattagctgggtggagagctggaacgagcagataaaaaacggcattttcgcaggtaaaatatag

SEQ ID NO: 49715 - DNA, 243 bp, Artificial Sequence
  Description of Artificial Sequence: Synthetic coding sequence
atgttcccactggtaaaatcagccctgaaccgtttgcaagtgaggtctatccagcagacgatggctcggcagtctcaccaaaagcggacgccagattttcacgacaaatatggaaacgctgtgctcgcatccggagcgactttctgcattgtgacatggacttacgttgctacacaggtgggaatcgaatggaacttgtcgcccgtcggaagggtgacgccgaaagaatggcgcaatcagtag

SEQ ID NO: 49716 - DNA, 210 bp, Artificial Sequence
  Description of Artificial Sequence: Synthetic coding sequence
atgtctgtactgacacccctgcttctaagaggtctgacaggcagcgcgaggagactgcccgttccacgagcaaagatccattccctgccccctgagggcaaactcggcattatggagctggccgtagggctcacctcctgcttcgtaacctttctgcttccagctggctggattctctcacatcttgaaacttaccggcgtccggagtag

SEQ ID NO: 49717 - DNA, 219 bp, Artificial Sequence
  Description of Artificial Sequence: Synthetic coding sequence
atgcctttgcttcggggacgctgtcccgcacgccgtcattatcggagactggccctgttggggctccagcccgctcccagattcgcccacagcggacctcccagacaacgacctctgtccgccgctgagatggccgtgggcttagtcgtgttctttacaaccttccttactcctgcagcgtatgtgcttggaaatcttaagcagttccggaggaactag

SEQ ID NO: 49718 - DNA, 1092 bp, Artificial Sequence
  Description of Artificial Sequence: Synthetic coding sequence
atggctcctgaggcaacgaagaatttcctccccctactggatgcggtgagtagagacttcgtttccgtactgcatagacgcatcaaaaaagctggatctgggaactactcaggcgatatttctgacgatctgttcaggtttgcatttgaatcaattacaaatgttatatttggagaaaggcaaggtatgctggaggaggttgtgaatcctgaggctcaaagattcattgacgccatctatcaaatgtttcatacgtccgttccaatgcttaatctgcctcccgacttatttcgactgttccggaccaaaacatggaaagatcatgttgctgcatgggacgtgatcttctcgaaagctgacatctacacacagaacttttattgggaactgcggcagaagggcagtgtacatcacgattaccggggtattttgtatcgcctcctcggggactccaaaatgtctttcgaggacattaaggccaacgtcactgaaatgctagctggtggagtcgataccaccagcatgactctccaatggcatttatacgagatggccaggaacctgaaagtccaggacatgctgcgagcagaggtgctggcagcccgtcatcaggctcaaggggacatggctacaatgctgcagcttgtgccccttctgaaagcttccattaaggaaaccctgcgccttcacccaatctcggtgaccctgcagaggtacctcgtgaacgatctggtgctgcgggattatatgatccccgcaaaaaccctcgttcaggtcgcaatttatgccctgggcagggagcccacattcttttttgaccccgaaaattttgaccctacccggtggctcagtaaggataagaatataacctatttccgcaacttgggatttggctggggtgtaaggcagtgtctggggcgtcgcatcgcagaactggagatgaccattttcctgatcaacatgttagaaaattttcgtgtggaaatccagcatttgtccgacgttgggacaactttcaacctgatactgatgcctgaaaagccaatttcattcactttctggccctttaaccaggaggccacccaacagtag

SEQ ID NO: 49719 - DNA, 1566 bp, Artificial Sequence
  Description of Artificial Sequence: Synthetic coding sequence
atgttggccaagggcctccctcctagatctgtgctcgtgaaggggtgccaaaccttcttatccgctccccgagaggggctgggaagattgcgcgtgcctaccggggaaggggcaggcatttcaacgagaagccctcggcctttcaatgagattccgtctcctggagataacggttggttgaacctgtaccacttctggcgagagactggaactcataaggtacatctgcaccacgtgcaaaactttcagaaatacggtccgatttaccgggagaagcttgggaatgttgaaagcgtttacgtaatcgaccctgaagatgtggccctgctttttaaatccgagggacccaaccctgagagattcctcattcctccctgggtcgcttaccatcaatattaccagaggcctattggagttttgctaaagaagtccgctgcgtggaaaaaggatcgggtcgccctcaatcaggaggttatggctcccgaagccaccaagaactttctgccactgctggacgcagtgagccgggacttcgttagtgtgttgcatcggagaatcaagaaggcgggaagtggaaattactctggagatatttccgacgatctctttcgtttcgctttcgaatctattacaaacgtaatttttggtgaacggcagggaatgttggaggaagtggtgaacccagaggcccagcgtttcatagatgccatctaccaaatgttccacaccagtgtgccaatgctcaatctgcctccagacttatttagactgtttagaactaaaacatggaaagaccatgtggccgcatgggacgtcatcttttcaaaagccgacatttacactcagaacttctattgggagctgcgccagaagggttctgtccaccatgactatcggggtatactttacagacttctgggtgactctaaaatgagttttgaggatattaaagcgaatgtgacagagatgctggctggcggagtggatacaacctctatgaccctccagtggcacctttatgaaatggcgagaaacttgaaggtgcaggacatgctccgcgctgaggtactggctgctcggcatcaagcccagggtgatatggccaccatgttgcagctggtcccccttttgaaggcctcgatcaaggagactttacgactccatcccatttctgttacactgcagaggtatctcgtgaacgaccttgtcctgagggactatatgatccccgctaagacactcgtccaggtggcaatctacgccttgggccgtgagccaactttcttttttgatcctgagaacttcgacccaaccaggtggttgtctaaagataaaaatatcacctacttccggaacctggggtttggttggggtgtacgacagtgcctcgggagaaggatagcagagctggagatgaccatatttctcattaacatgctcgagaacttcagagtcgagatccaacacttgtcagatgtagggacgactttcaatttgatcctcatgccagagaagcccatctctttcacattctggccctttaatcaggaagccactcaacagtag

SEQ ID NO: 49720 - DNA, 1092 bp, Artificial Sequence
  Description of Artificial Sequence: Synthetic coding sequence
atggcccctgaagcaacaaagaacttcctcccgctgctagatgcggtgtcacgggatttcgtgtccgtgctccatcgtagaattaaaaaggctggttccgggaactatagcggggatatatcggacgacctcttccggttcgcttttgagagcataaccaacgtgatctttggcgaaagacaaggaatgctcgaggaggtggtaaatcctgaagcccagcggttcattgatgctatttaccagatgtttcacacaagcgttcccatgctgaatctgccccctgatctgttccggctgttccgaacaaagacctggaaagatcacgtcgcagcttgggacgtgattttttcaaaagcagacatatacacacagaacttctactgggagctgcgccaaaagggcagcgtccatcatgactaccgcggtatactgtacaggcttctgggcgattcaaagatgtctttcgaggacatcaaagccaacgttactgagatgcttgccggtggggtggatactacctccatgaccctgcagtggcatctgtatgagatggcaaggaacctgaaagtacaagacatgctgcgcgcagaagtgctggccgcacgccaccaggcacagggagacatggctaccatgctgcagttggtgccactactcaaagcctccatcaaagagacacttcgcctgcacccaattagtgtgacactccagcgctaccttgtaaatgacttagtccttagggactacatgattcccgctaaaactttggttcaggtagccatttatgctctgggacgcgaaccaactttcttttttgaccccgagaattttgatcctacccgatggctgagtaaagataaaaacatcacctacttccggaatctgggcttcggttggggggtgcgacagtgcttggggagacgcatcgcggaacttgaaatgaccatctttcttatcaacatgttagagaattttagggttgagatccagcacctgagcgatgttggcacaacctttaatcttatcttgatgcccgaaaaacccattagctttaccttttggccatttaatcaagaggcaacacagcagtag

SEQ ID NO: 49721 - DNA, 1245 bp, Artificial Sequence
  Description of Artificial Sequence: Synthetic coding sequence
atgctggcaaagggattacctcccagatccgtactcgtcaaaggctgccagacttttctcagcgcacctcgtgagggactcggaagactgagggtccccacaggtgagggcgctggcatttccactagaagcccaagacctttcaatgaaatcccatcacccggtgacaatgggtggctgaacctttatcacttttggcgggagaccgggactcataaggtgcatctacatcacgtccagaacttccaaaagtatggaccaatttatcgcgaaaagctcggaaatgtggagagcgtgtacgtcatcgatcccgaggatgttgccttgctttttaagagtgagggaccgaacccggagcgtttcctgataccaccctgggtggcgtatcaccagtactaccaacgtcctattggagtgttactcaagaagtccgccgcttggaaaaaagatagggtggccctcaatcaggaggtcatggcaccagaggctactaaaaatttccttccgctcctagatgccgtttctcgcgactttgtttccgtgctgcatagacgcatcaagaaagctggaagcggaaactacagtggggacattagcgacgatctctttcggttcgcttttgaatccatcacgaacgtcattttcggcgagcggcaggggatgctagaggaagtggtgaatcctgaggctcagcggttcatagatgccatataccagatgttccacaccagcgttcctatgctgaacttgcctcccgatttattcagattatttcggaccaaaacgtggaaggaccatgtggcagcttgggatgtgattttttccaaggccgatatttacactcaaaatttttattgggaattgcgtcagaagggatctgtgcatcatgactaccgcggaatactgtaccggcttctgggagatagcaagatgtcatttgaggacattaaggccaatgtgactgaaatgttagccggtggagtcgacactacttccatgacacttcaatggcatctttatgaaatggcacgcaatttaaaggtacaggatatgctgagggccgaagtgctcgccgcaaggcatcaggcgcagggtgatatggccaccatgctgcagctggtgccgctcctgaaagcctccatcaaagaaacattgaggcattggtgtaaatggccgagcatgctatgggcagagtcaccccctagctcttcaactaggaaaattctcactcaacccgatggatag

SEQ ID NO: 49722 - DNA, 861 bp, Artificial Sequence
  Description of Artificial Sequence: Synthetic coding sequence
atgccctcaactaggtgcagtacgcctgcttccccctgcagcacatttccacagacatgctctgtgtgcagcggccctcgccctaaggatcatgttgccgcatgggatgtgatattctccaaggctgacatctacacccagaacttctactgggagttgcgccagaagggatcggtccatcatgattacagaggcatcctatatcggcttttgggcgattctaagatgtctttcgaagacatcaaggccaatgtgactgaaatgctggctggtggggtggatacaacaagcatgacactgcagtggcacctctatgaaatggctcgaaacttaaaagtacaagatatgctgcgcgcagaggtcctcgcagcaaggcaccaggctcagggcgacatggccaccatgctgcagctggtccccctcctcaaagctagcattaaagaaactctgagactgcaccccatctctgtgaccctgcaacgatacctggtgaacgatttagtcctccgcgattatatgataccggctaaaacactggtgcaggtggccatttacgcgctcggcagagaacctacattcttctttgatcctgagaattttgaccctaccagatggcttagtaaggacaagaatattacctactttagaaacctggggttcggctggggagtgagacaatgcttgggaagacgtatcgccgagctggaaatgaccattttcctgatcaatatgctggagaatttcagagtggaaatccaacaccttagcgacgtcgggacaacgtttaacttgatcctgatgcccgagaagcccatcagtttcactttctggccctttaaccaagaggctacccaacaatag

SEQ ID NO: 49723 - DNA, 435 bp, Artificial Sequence
  Description of Artificial Sequence: Synthetic coding sequence
atgctcgcaaaagggttaccgccacggtccgttctggtgaagggttgccaaacattcctttctgcacctagggagggcctaggcaggcttcgtgttccaaccggtgagggcgctggcatctcgactagatcccccaggccctttaacgagattccatcgcccggagataacggctggttaaacctgtaccacttttggcgggagaccggaacacacaaggtgcatctgcatcatgtccagaacttccagaagtatggaccaatatacagagaaaagctgggaaatgtcgagtcagtttatgtgattgaccccgaggatgtcgccctgctatttaagagcgaaggacccaacccagagcgatttctgatacctccgtgggtagcctaccaccagtattatcagcgccctataggagtgttactgaatcaccactag

SEQ ID NO: 49724 - DNA, 1473 bp, Artificial Sequence
  Description of Artificial Sequence: Synthetic coding sequence
atggatcctgcagtggcactggtcctctgtctttcctgtctgtttctgctgagcctgtggcgtcagtctagcggtagagggagactgcccagcgggcctactcctctgccaattattggcaacatattacaactcgatgtgaaggacatgtctaagagcctcactaattttagtaaagtgtacggaccggtcttcaccgtgtattttggactaaagccaatcgttgtgctgcacgggtacgaggccgtcaaggaagctctgattgatcacggtgaggaattcagcgggaggggaagcttcccagtcgccgaaaaagttaataaagggctgggaatcctgttctccaatggcaaacgctggaaagagatcagacgattttgtttgatgaccctgcggaacttcggaatgggtaagcgcagtatagaagaccgcgttcaagaagaagctagatgcctggtcgaggagctgcggaaaacgaacgcctcgccctgtgatccaacgtttatcctcggatgcgctccatgcaatgtgatatgttcggtcatttttcacgatcgcttcgattataaggaccaacgtttcctcaatttgatggaaaaattcaacgagaatctccgaattctctcttcgccttggattcaggtgtgcaataattttccagctctgatagactatttgccaggttctcataataagatcgctgagaacttcgcttacatcaaaagttacgtgttggagcgtatcaaggagcaccaggaaagcctggatatgaattcagcaagggattttattgactgctttctgatcaagatggagcaggaaaaacataaccagcaaagcgaattcacagtggagtctctgattgccacagtgacagatatgtttggagctggcacggagactacatctactaccttaagatatggactgctgcttttactgaagtacccagaggtcaccgccaaggtccaggaagaaatagagtgcgtcgttgggcgtaacagaagcccttgcatgcaggacaggtctcatatgccctatacggatgcggtggtgcatgagatccagcggtatattgacctacttccaacaaacctgcctcatgccgtaacctgtgacgtcaagttcaaaaactacctgatcccaaaggggacaaccataattaccagcctaaccagcgtgctccataacgataaagagttccctaatcccgaaatgtttgatcctggccattttctggataaatccggtaattttaaaaagtccgactacttcatgccgttttctgccggtaagcgcatgtgcatgggcgaaggcctggccaggatggagttgtttcttttccttaccaccatcctgcagaactttaacctcaaaagccaagtggatccaaaagatatagacatcactccaatcgccaacgcctttggccgtgtcccccctctttaccagctgtgtttcataccagtgtag

SEQ ID NO: 49725 - DNA, 1296 bp, Artificial Sequence
  Description of Artificial Sequence: Synthetic coding sequence
atggatcccgcagtggcattggtactttgcctaagctgtctgttcttgctgagcctgtggaggcagagctccgggaggggtcggctgccttcgggcccaaccccgctaccaataatcggcaacattctgcagctggacgtgaaagatatgagtaaatcactaactaatttctccaaagtgtacggaccagtatttacggtctatttcggcctgaaaccaatagtggtccttcacggatacgaggccgtgaaggaagccctcatagatcatggggaggaattttcagggagagggagcttccctgtggccgaaaaagtaaataagggcctcgggatacttttttccaacggcaagcgctggaaggagatccgacgattttgcctgatgacgcttagaaattttggcatgggaaaaagaagcattgaagaccgggtgcaagaggaagctcgatgccttgtcgaagagctgagaaaaacgaacgccagcccatgcgacccaaccttcatcctcggatgtgctccatgtaatgtcatctgctcagtgatttttcatgacaggttcgattacaaggatcaacgattcttgaacttgatggagaaattcaatgagaatctgcggatcctctccagcccctggatccaagagaagcacaaccagcagagcgagttcactgtggaatcacttatcgcaacagtgacagatatgttcggagccggtaccgagactacaagtaccacgctccgatacggactccttctactgctcaagtatcctgaggtcactgcgaaagtacaagaggagattgaatgtgtagttggcagaaaccggagtccatgcatgcaggataggagtcatatgccgtacactgacgccgttgtgcatgagattcagaggtacattgacctgctgcccaccaacctgccccatgctgtgacgtgcgatgttaagttcaaaaactatctcatcccaaaaggtacaactattattactagcctcacttctgtcttacacaacgataaagagtttccgaaccccgagatgtttgacccaggtcactttctggataaatcagggaacttcaagaagagcgactactttatgcctttttctgctggtaagagaatgtgcatgggagaggggcttgcgagaatggaactgttcctgtttttgacgacaatactgcagaactttaatctaaaaagtcaggttgaccctaaagacattgatatcacccccattgcaaacgctttcggtcgcgtccctcccttataccagctgtgctttatacctgtctag

SEQ ID NO: 49726 - DNA, 1473 bp, Artificial Sequence
  Description of Artificial Sequence: Synthetic coding sequence
atggctctacttctgttgctttttctgggactcttagggctgtggggccttttgtgcgcttgcgctcaagatcctagccctgccgcacggtggcccccaggcccacggccacttcccctggtgggcaacctgcatttgctgagactgagtcagcaggaccgtagcctgatggagctgtccgagcgatatggacctgtgttcacggtccatctgggacgccagaagacagtggttctcaccgggttcgaggcggtgaaagaagccctcgccggaccaggacaggaactggcggacaggccccctattgcgatttttcaactgatccaaagggggggtggcatcttctttagcagtggagctagatggagagcagccagacaatttaccgtgcgggcactgcactccttaggggtgggacgggagcccgtcgctgataaaattctccaggagcttaaatgcctctcaggacaactggatgggtatcgcggaaggcctttcccactggcactgctgggatgggcaccctcgaatattacctttgccctcctgttcggccgtcggttcgactacagagatccagtgtttgtgtccctgctggggctcattgatgaagtaatggtcctgctgggctcccctggtctgcagctgtttaacgtgtacccttggctaggcgcactgctgcaacttcacaggcccgtgctgcggaagatcgaggaggtgcgggctatccttcgcacccttctcgaggctcggcgaccccacgtgtgtcccggagatcctgtttgttcctatgtcgatgctctgatccagcagggccagggcgacgaccccgaggggctgttcgctgaggcaaatgctgtggcttgtacactggacatggtgatggcaggtacagaaacaacctctgccactcttcaatgggctgcgctcttgatgggacgacatcctgacgtgcaaggacgcgtgcaagaagagctggaccgggtcttaggccctggccgaacccctaggctggaggaccagcaagccctgccatatacctcagccgtgctgcacgaggtgcaacggttcatcacccttctgccccatgtgccaagatgtacggcagctgacacccaactgggtgggttcttattgcctaaggggacgcctgttatccccctgttaacaagtgttttactggatgagacccagtggcagactcctgggcaatttaacccagggcatttcctcgacgcaaacggtcactttgtcaagagggaggcattcctccccttcagtgccggacgacgcgtgtgcgtgggcgaaaggctggctcgaaccgagcttttccttctatttgctggactgctgcagagatacagactcctgccgcctcctggggtgagtcccgctagtctggacactactcccgcacgcgcttttactatgagacctcgagctcaagccttgtgcgccgttccaagaccctag

SEQ ID NO: 49727 - DNA, 1389 bp, Artificial Sequence
  Description of Artificial Sequence: Synthetic coding sequence
atgcttgattttgccattttcgccgtgaccttcctactagcacttgtgggggctgtcttgtacctgtaccccgcatcccggcaggccgcagggatcccgggtatcacccctaccgaggaaaaggacgggaacctgcctgatatcgtgaactcaggaagcctccatgagttcctggttaacctgcacgagcgctacgggccagtcgtgagtttttggtttggacgaagactggtggtgtccctcggaactgtggatgtcttgaaacagcatatcaaccccaataagacttccgacccttttgagactatgctcaagtctctgctgaggtatcagtctggtggcggaagcgtaagcgaaaaccatatgagaaagaagctgtatgagaacggcgtgactgactctctgaaatcaaacttcgccttactactgaaattgtccgaagagctcttggacaagtggttaagctatcccgagacacagcacgtccctctgtcacaacatatgctgggattcgccatgaagtccgttactcagatggtcatgggcagtactttcgaagacgaccaagaggttatacgctttcaaaaaaatcacggaactgtgtggtcagagatcggtaagggctttctggatggaagccttgacaaaaacatgaccagaaagaagcagtacgaggatgcattaatgcaactggagagcgtcctaaggaacattatcaaggagcgtaagggcagaaacttttcccagcacatttttatcgattcccttgtccaggggaatctaaacgaccaacaaatcctcgaagactcaatgattttcagcctggcctcctgcatcattactgccaagctgtgtacctgggccatctgctttctgaccacctccgaggaggtccagaagaaactgtatgaggaaatcaaccaggtcttcggtaatggcccagtaacgcctgaaaagattgaacagctgcggtattgccagcatgttctttgtgaaactgtccggaccgctaaattgacacccgtgtccgcacagcttcaggacattgaggggaagatcgatcgctttataatccccagggagaccctggtactgtacgctctgggagtggtgcttcaggaccctaatacctggccgtcaccccataaatttgatccagacaggtttgacgatgaactggtgatgaaaacattcagctcgctcgggttcagcggaacgcaagagtgccctgagcttcgattcgcttacatggtaaccactgtcttgctgagcgtgctcgtaaagcgcctgcatctcctgagcgtggagggccaggtgatcgagactaagtacgaactggtgacatctagcagagaggaagcctggattaccgtttccaaaagatactag

SEQ ID NO: 49728 - DNA, 1308 bp, Artificial Sequence
  Description of Artificial Sequence: Synthetic coding sequence
atgctggacttcgcgattttcgccgttacattcttgcttgctctcgtcggggcagtgctctacctgtaccctgcatcaagacaggctgccggaatcccgggtattacccccactgaggaaaaagatggcaacctgccggatatcgtgaactccggctctcttcacgaattcttggtcaacctccatgagcggtacggccctgtggtgtcattctggttcggtaggaggctcgtggtgagcctgggcacagtagatgtgctgaaacaacacatcaacccaaataagacttccgacccgtttgagacaatgttgaaaagtttacttcgatatcagtctggaggtgggtctgtgtcagaaaatcacatgaggaaaaaactgtatgaaaacggagtgactgattctttgaagagcaacttcgctctgctcctgaaactaagcgaggagttgttggataagtggctctcctacccagaaactcagcacgtgcccttatctcagcatatgctcgggtttgctatgaaaagtgtgacacagatggttatgggctcaacttttgaagatgatcaggaggttattcgtttccagaaaaatcacggcaccccctcttgtaactggtctttattcaaggagcaccataagcgcacaaaacgcaaggagctgcagtcaacctactttatcgatagcctggtacaaggaaaccttaatgaccagcagatcctagaagatagtatgatattttcacttgcaagctgtatcattaccgccaagctgtgcacctgggcaatttgcttccttacgacatcagaggaagtgcaaaaaaagctgtacgaggaaataaatcaggtgttcggaaatggcccagttaccccggagaaaatcgaacagttaaggtactgccaacacgtgctttgcgaaaccgtccgcaccgccaaacttacgccagtgagtgcgcagcttcaggatatagagggcaagatcgacagattcatcattccgcgagaaaccctggtgctgtatgccctgggtgtggtacttcaggacccaaacacatggccctctccacataaatttgatcccgaccggtttgatgacgagcttgtgatgaaaacttttagttccctgggcttttctgggacgcaagaatgccctgagctccgattcgcatacatggtcacaaccgttttgctaagtgtcctggtgaagcgactgcaccttcttagtgttgaaggacaagttattgaaactaagtacgagctggttacctcttcacgggaggaggcatggatcacagtgagcaagcgttactag

SEQ ID NO: 49729 - DNA, 1539 bp, Artificial Sequence
  Description of Artificial Sequence: Synthetic coding sequence
atgctgttcgaggggcttgacctggtgtccgctctggctactctggcggcttgccttgtcagcgtaacccttctccttgcagtgtcccaacaactatggcagctgcgttgggcagcgacaagggataaatcctgtaaattgccaatccctaaaggcagcatgggcttccctttaattggcgagaccggacactggttactgcaaggtagtggatttcagtccagccggagagaaaaatatgggaatgtctttaaaacacacttgctcggtcggcctctaattcgggtcactggggcagagaatgtgcgaaaaattctgatgggcgagcatcacttggtgtctacggaatggccgagatctactcgcatgttactgggcccaaatactgtgtctaattccattggtgatatccatcgaaataaacgtaaagtgtttagcaagattttctcacacgaggccttagaaagctacctcccgaagatccagctcgtgatacaggacacactgcgggcttggagtagtcaccccgaggctataaatgtatatcaggaggcccagaagcttactttccgcatggccattcgggtgctgctgggtttcagcatcccagaagaggatcttggccacctgttcgaggtttaccagcagttcgtggacaacgtgttctctctgcctgttgacctcccttttagcgggtacagaagaggaatacaagcccgacagatcctgcagaaggggctggagaaagctattagggagaaactccagtgcacccagggaaaggattacctggatgctctagatcttctcattgagtcatctaaagagcacgggaaggagatgacgatgcaggagcttaaggacggtaccctggagctcatcttcgctgcatatgcgactaccgcatcggcgtcaacatcactcattatgcagctgctgaagcatccaaccgtcctggaaaagttgcgcgacgaacttcgggcacacggcatcctccattctgggggttgtccctgtgagggaactcttaggctggatactctcagcggactcagatacttggactgcgttataaaagaggtaatgcgcctctttactccaatctcggggggttatcggactgtgttgcagacttttgaactcgacggcttccagattcctaagggatggagtgtcatgtacagcataagggatacccacgataccgctcccgtattcaaggacgtcaacgtgtttgaccccgatcgatttagccaggctcgttctgaagataaggatggacgattccattacttacccttcggcggaggtgttaggacatgcctggggaagcatctggctaagttgtttctcaaggtccttgcagtggagctggcttccacgtcgcggtttgagctcgcaactaggacatttcctcgaataaccctagtgcccgtgttacaccccgttgatggtctgagcgtcaagttcttcggcctcgatagtaatcaaaatgaaatcttgccggaaactgaggctatgctatcagcgacagtttag

SEQ ID NO: 49730 - DNA, 1314 bp, Artificial Sequence
  Description of Artificial Sequence: Synthetic coding sequence
atgttgtttgagggattagacttggtaagtgccctggctaccctcgcggcatgtctggttagtgttaccctcttactggccgtctcacagcaactgtggcagctccgttgggcagcgactcgcgataaaagctgtaaactccctattcccaagggctcaatggggttcccacttatcggagagacagggcattggctgttacaggtgttttccaaaatctttagccatgaagcgctggaatcctatttgcccaagatacagctcgttattcaagacactctgcgtgcctggtcttcgcatcccgaggccataaacgtgtaccaagaggcccagaagctaacctttagaatggccattagggttcttctggggtttagtattcccgaagaagatttaggccatctgttcgaggtctatcaacaatttgttgataacgtattttcactgccagtggatctgcccttcagtgggtataggagaggcattcaggctcgccagatcttgcagaaagggctcgagaaggctatccgggaaaagctgcaatgtacccaaggcaaagattacctggatgcactcgaccttttaatagaatcgagcaaagagcatggtaaggaaatgaccatgcaggagctgaaagatggtacactggagcttattttcgccgcttatgcaaccaccgcatcagcatcaacaagcctcattatgcagctgctgaaacaccctaccgtcctggagaagcttagggatgagctacgtgctcatggcattctgcacagtggcggttgcccatgcgaaggtaccctccggttggacaccctgtcaggcttgagatatttggattgtgtgattaaagaggtgatgcgattgttcaccccaatatccggaggctatcggaccgtgttacaaacgtttgagctggacggcttccagatcccgaaaggctggtccgtgatgtacagcatcagggatacacacgacactgcccctgtattcaaggacgtcaacgtgtttgaccctgatcgcttttctcaggctagaagcgaagacaaggacggtagatttcattacctgccttttgggggtggggtgagaacctgtctcggcaaacacttggccaaactgtttttgaaggtgcttgcagtggagctggcatccacatccaggttcgagctggcaacccggacattcccgagaataacactagtgccagtcctgcaccccgtggatggcctttcagtgaaattttttgggctcgacagcaaccagaacgagatcctgcctgagacagaggcaatgttgagtgcgactgtgtag

SEQ ID NO: 49731 - DNA, 1368 bp, Artificial Sequence
  Description of Artificial Sequence: Synthetic coding sequence
atgtctgtgtctgtgctatcccctagtaggcgcttggggggagtgagcggcatcctgcaagtgacttcattgctgatacttctcctgcttctgattaaggccgctcagctgtatctgcatagacaatggctcctgaaagcactacagcagttcccttgtccaccctcacattggctctttgggcacatccaagaattccagcacgaccaggagctgcaaaggatacaggagcgggtgaaaactttcccctccgcatgcccctattggatctggggaggcaaagtgagggtgcagctgtatgacccagactatatgaaggtgatcctggggaggtctgatccaaagagtcacggctcatataagtttctcgccccacgcattggctacggcctcttacttcttaacggccagacttggttccagcacaggcgaatgctcacaccagctttccacaatgacatcctaaaaccttacgtggggctaatggcagactcagtgagagtcatgcttgacaagtgggaagaattgcttggccaggatagccctctggaagtctttcaacatgtcagcctgatgaccctggatacaataatgaagtcggctttctcccaccaaggcagtattcaggtcgatagaaacagccagtcatatatccaggcaattagcgacctgaattccttagtgttctgctgtatgaggaacgccttccacgagaatgataccatctactccctgacaagtgccggaagatggactcacagggcatgtcaactggctcaccagcacacggaccaggtcatccagctcaggaaagctcagcttcagaaagagggagaactagagaagattaaacgcaaaaggcatcttgactttctcgatattctccttctcgcaaaaatggaaaacgggagtatcctatctgacaaagacctgagggcagaggtggacaccttcatgttcgagggccacgatacaacagctagtgggatcagttggatactgtatgccctggccactcacccaaaacatcaggagcgttgcagggaagaaatccatggtcttttaggtgatggtgccagcatcacttggaatcatctggatcagatgccatatacaaccatgtgtatcaaggaggcacttcgcctttaccctcccgtccccggtattggtcgggagctgtctacacccgtgacattccccgatggtcggtccctcccaaaagggatcatggtgttactcagcatctacggcctccatcacaaccccaaggtgtggccgaatctcgaagttttcgatccttctagatttgctccgggatccgcacagcattctcatgcttttttgcccttctccggagggtcccgttag

SEQ ID NO: 49732 - DNA, 1266 bp, Artificial Sequence
  Description of Artificial Sequence: Synthetic coding sequence
atgagcgtgtccgttttgtctccctcccgaaggctgggaggcgtgtctggaatcctgcaggtcaccagcctgctcatcttgcttctgcttttaatcaaagccgcacagttgtacctgcacaggcagtggctgcttaaagccttacaacagtttccttgcccgccaagccactggctgttcgggcatatccaggagttccagcacgaccaggagctccagcggattcaggagcgagtcaaaaccttcccctccgcttgcccgtattggatctggggcggtaaggttagggtccagctgtatgatcccgactatatgaaagtaatcctcggaaggtccgaccccaagagccatggctcttacaagtttctggctcctcgcatcgggtatggactgctgctgctgaatggacagacgtggtttcagcatagacggatgctcacccctgcctttcacaacgatatcctgaagccctatgtagggttaatggccgattctgtgcgcgtgatgttggacaaatgggaggagctgctggggcaggacagccctctcgaagtattccagcacgtcagcctcatgaccctagacacgatcatgaagtctgcttttagtcatcagggatccatacaggtggaccggccttccgaccccactgaagaaggaagcacaacagaaggtggcggtgcaggcgaggatcaggaagaagaggccttgggcttcagcggccacccgcctttagggcagcgggcaccagggttgccaaggccgtgttggtgttccggatggaactgctttcggaatcatttggatcagatgccatatactacaatgtgcataaaagaggccctgcgtttgtatcccccagttcctggtatcggaagggagctcagtactccagttaccttccctgatggtcgctcgctcccaaagggcattatggtgctgttgtctatttacggtctgcatcacaacccaaaggtctggccaaacctggaagttttcgatccatcacggttcgcaccagggagtgcacagcactcccacgcattcctccccttttctggaggatcacggaactgtataggcaagcagtttgctatgaatcagctcaaagttgctcgcgcactgaccctgctgagattcgagctcctcccggacccaacgcgcatccccatcccaatggcgagactggttttgaagtccaagaatggaatccacttacggctgcgtcgactgcccaacccctgcgaggacaaagaccagctatag

SEQ ID NO: 49733 - DNA, 1560 bp, Artificial Sequence
  Description of Artificial Sequence: Synthetic coding sequence
atgagtgtgagcgttctcagcccctcgagaaggttgggtggagtgtccggaatcctgcaggtgacgagtctgctcattctgctccttctccttataaaagccgctcaattgtatctgcataggcagtggttacttaaggccctacagcaatttccctgtcccccttcacactggctgttcggccacattcaagaatttcagcacgatcaggaactgcagcgtattcaggagcgagtcaagacattcccctccgcatgcccatattggatttggggcggtaaagttagagtacagctttacgacccagattacatgaaagtcattttagggaggtctgatccaaagtcccacggcagttataagtttctcgctccgagaataggctacgggctgctcctgctaaatggacagacatggtttcagcacaggaggatgttgactcccgctttccacaatgacatcctgaaaccatatgttggactcatggccgattcagtgagggtcatgctggacaaatgggaagaattgctgggacaggattcgcctctggaggtcttccagcacgtgtccctgatgactttagacacaatcatgaagtcagctttctcccaccaggggagtatacaggtggatcgcaattcccagagctatatacaggcgatcagtgacttaaatagtctggtcttttgctgtatgcgtaacgcgtttcatgagaacgacacaatctatagtctgacgtcagctggaagatggactcaccgcgcttgtcagctggcccatcaacatactgatcaggtcatccagctacgcaaagcacagctgcagaaagagggagagcttgagaagatcaagaggaaacgccatttagactttttggacattcttctgctggccaagatggagaatggaagtatccttagcgacaaggacctgcgggctgaagtggacacttttatgtttgaagggcacgacacgaccgcatctggaattagctggatcttgtacgcattagcaacccaccctaaacatcaagaaaggtgtcgggaggagattcatggtctgctgggcgacggcgcttccatcacctggaaccacctcgaccaaatgccttatactacaatgtgcattaaggaagccctgaggctataccctcctgtccccggaattggcagggaactgtcaacccccgtcaccttcccagacggcagaagccttcctaagggaatcatggtgctgttatccatctatggactccatcataacccaaaagtatggcccaacctggaggttttcgacccctcccggttcgcgccaggatcagcccagcattctcacgcctttttgccattctcaggtgggtctcgcaactgcatcggaaagcaattcgccatgaaccagctaaaggtcgcaagagctctcactctgttgaggtttgagctgctgccagatccgactcgtatcccaatccccatggccagactcgtgctcaaatctaaaaatggaatccacctgagactccgcagactgcccaacccctgtgaggacaaggatcagctatag

SEQ ID NO: 49734 - DNA, 1536 bp, Artificial Sequence
  Description of Artificial Sequence: Synthetic coding sequence
atggttccctcttttctgagcctgtccttttcctctctcggattatgggcatccgggcttattctggtactgggatttttaaaactaattcatttgctactccgcaggcagactctggccaaggctatggacaaatttcctggtccacccacacactggctttttggacacgcactggagatccaggagacaggtagtttagataaagttgtgtcgtgggctcatcagtttccatacgcgcatccactgtggttcgggcagtttatcggattcctgaacatatacgaaccagactacgcgaaagccgtgtattcacgtggcgaccctaaagcgccagacgtgtatgacttttttttgcagtggattgggaggggactgcttgtcctggaagggcctaaatggctccagcacaggaagcttttaacaccgggttttcattatgatgtccttaagccgtacgtggccgtgttcacggaatccaccaggatcatgctcgacaaatgggaggagaaagccagagaagggaagagttttgacatcttttgcgatgtcggccacatggcgttaaacaccctgatgaaatgcacttttggccgaggcgatactggactcggccatcgggacagttcatactatctggctgtgtctgatttgacactgttaatgcaacaaagattagtctcttttcagtaccataacgactttatttattggctcaccccacacggtcggagattcctccgcgcatgccaggtggctcacgaccacaccgatcaagtcatccgagaacggaaggctgctctccaggacgagaaagtgagaaaaaaaattcagaatcggcgtcatctggactttcttgatattctgctgggtgcaagagatgaggatgatataaagctatctgacgccgatctgcgcgctgaagtggatacatttatgttcgagggccacgacactacaacctcaggcatcagctggtttttgtactgtatggctctgtatcccgagcaccaacaccgctgccgggaggaagtgcgtgagatccttggggaccaggacttttttcagtgggacgatctcgggaaaatgacctacctgactatgtgtatcaaggaaagttttcgcctgtatccaccagtgccccaggtttaccggcaactctccaagccagttacattcgtcgatggccgatccctgccggcaggatcactcatttccatgcatatctacgctttacatcggaactcagctgtatggcctgacccagaggtgtttgattcccttcgattcagtactgagaatgccagcaagaggcacccttttgctttcatgcctttctctgctgggccacgcaattgtattggccagcaattcgcaatgtctgagatgaaggtggtgacagccatgtgtttgctgagatttgagtttagcctggatccttcccggcttccaattaaaatgccccagctggtcctgcgctccaagaacggattccatctccatctgaaacccctgggcccagggtctggcaagtag

SEQ ID NO: 49735 - DNA, 1494 bp, Artificial Sequence
  Description of Artificial Sequence: Synthetic coding sequence
atggtgccttctttcttatctctgtcattctcttcgttgggtctgtgggcttccggcctgatactggtgttgggtttcttaaagctgattcaccttctcctcaggcgccagacgttggccaaggcaatggataaattccctggtccaccaacacactggttgttcggccacgccctggaaatacaagagaccgggagcctggacaaagtcgtctcttgggctcatcagttcccctatgcccacccactctggtttggccaatttattggtttcttgaatatctacgaaccagattacgccaaagcagtttactctagaggtggcaggggtttgctagttttggaaggcccaaaatggctccagcatcgtaagctccttaccccaggcttccattacgatgtcctgaaaccatatgtggctgtgttcacagaaagtacccggattatgctagacaagtgggaggaaaaggcacgcgagggtaagtcgttcgatatcttctgtgatgtggggcacatggctctgaacacattaatgaagtgtacatttgggcgaggcgacactggcctgggccattcaagggactcctcttattacttagccgtgtctgacctgaccctgcttatgcaacagcggcttgtatcctttcagtatcataacgactttatctactggctgacacctcatggccgtcggtttcttcgggcatgccaggtcgcacatgatcacaccgatcaagtaatacgagaacggaaggccgcacttcaggacgagaaggtgcgaaaaaagattcagaacagacggcacctggactttcttgatatcttattgggggctcgtgatgaggacgacataaaactcagcgacgccgatctgcgggcagaggtcgacaccttcatgttcgaaggtcacgacactaccacaagtgggattagctggtttctctactgcatggccttgtaccccgagcaccaacataggtgtagagaggaggtacgagaaatcctcggggaccaagactttttccagtgggacgatctcggtaaaatgacttaccttaccatgtgtattaaagaatccttccgactttacccaccagtaccccaggtgtatcggcaactcagtaagcctgtgacttttgtcgacggccgttctcttcccgctggtagcctcatcagcatgcacatttacgccctgcaccgcaacagcgccgtctggccggatccggaagtatttgacagccttcgtttttctacagagaacgcatctaagagacacccctttgcatttatgcccttcagcgctgggcctcgaaattgtattggacagcaattcgccatgtctgagatgaaggtggtcacagccatgtgcctgctgagattcgagttttccctggacccatctcgcttgccaattaaaatgccgcagctagtactgcgctcgaaaaatggattccacttgcacctcaagcccttggggccaggcagtgggaaatag

SEQ ID NO: 49736 - DNA, 1539 bp, Artificial Sequence
  Description of Artificial Sequence: Synthetic coding sequence
atggtgccttcttttctgtccctgtccttttcttcgttgggcctttgggccagcggcttaattctggtcctggggtttctcaagttaatccacctccttctgcgccgacaaaccctggcaaaagccatggacaaatttcccggtcctcctacccactggctctttggccatgcactcgagatccaagaaaccggatctctggacaaagttgtgtcttgggcacaccagtttccttatgctcatccactgtggttcggccagtttataggatttctgaacatatatgaaccggactatgccaaggccgtctatagccgaggggatcccaaggctcccgacgtttacgatttcttcctgcaatggattggtagaggtctgttagttttagaaggtcccaaatggcttcagcacagaaagctactgacaccaggttttcattacgacgttctgaaaccctatgtggccgtgttcacagagtccacacggattatgctggacaaatgggaagagaaggctagggagggtaagtcttttgatattttctgcgacgtggggcatatggccctgaacacgctgatgaaatgcacctttggacgcggagataccggtcttggacacagccgcgatagtagctactacctggcagtcagcgatctcaccctcctgatgcagcagaggctggtctccttccagtaccacaatgactttatttactggctaacaccccatggcaggaggttccttcgagcatgccaggtcgctcacgatcataccgaccaggtcattcgtgagcggaaggcggcactgcaggacgagaaagtgagaaagaaaatccaaaaccggagacaccttgactttctagacatcctgcttggcgctcgcgatgaggatgatataaaattgtccgatgccgacttgcgagctgaggtcgatacgtttatgtttgaaggccacgatacgactacctctggaatctcatggtttctgtactgtatggcgctctaccctgaacaccagcaccgctgtcgggaggaagtgcgtgaaatcctcggggaccaagattttttccagtgggacgatctgggcaaaatgacataccttacaatgtgtattaaggagtcttttaggctctaccctcctgttcctcaggtctatagacaactttctaagcctgtgacctttgttgacggccgtagccttcctgcgggtagccttatctctatgcatatctatgcactgcaccgtaactccgctgtttggcccgatccagaggtgttcgactctcttcgcttctctaccgagaatgcctccaagaggcaccccttcgcctttatgcctttctcagcaggccctcggaattgcatcggtcagcagttcgccatgtctgaaatgaaggtcgtcactgccatgtgcctgctaagattcgagttctcacttgacccatccagactccctatcaaaatgccccaactcgtcctccgctccaagaacggctttcacctgcacctgaagcccctcgggccaggtagcggtaagtag

SEQ ID NO: 49737 - DNA, 573 bp, Artificial Sequence
  Description of Artificial Sequence: Synthetic coding sequence
atgctaactcccgcattccatttcaacatcctaaaaccgtacatgaaaatcttcaacgagagtgtgaacataatgcatgccaagtggcagctacttgcatccgaaggatctgcatgtctggatatgtttgagcacatctcgctcatgaccttggatagtctgcaaaagtgcgtatttagcttcgactcccactgccaggagaagccatctgaatacattgctgcaatcctggagctctcggctctggtctctaagcggcatcacgagatcctactgcacattgacttcttgtactatctgaccccagacggacagagatttcggcgtgcctgcaggctggtgcatgacttcacagatgctgtgatccaggaaagaagacgtacgttaccaagccagggtgtagacgactttctgcaagccaaggcaaagagcaaaactctggatttcatcgacgtgttgctgttgtccaaagccatgacacccaggcctgtggtctcacctggcagttgcactactctgcagtctacccaaaatacacggtccgccgctgggagaagatgtaagaatttttag

SEQ ID NO: 49738 - DNA, 1974 bp, Artificial Sequence
  Description of Artificial Sequence: Synthetic coding sequence
atggcaagtgcccgaaaggctagcagaccgatgagggatgtctttggagattttagcgatgtgagcctggaggacagtacgatggaggaaataaggaattttcagataagtagaaacctcaccaaaatcgctccaggtcatagtcggtttctgaaacgtaatcagacacttgatgaaaagcatctgctgttaaaggagaatccagtgctggggtctggtcccaggctcgcctcctgtaggccccctaccacagcctccaggatccgagccaatgcagcccttatgaagctagcacagctggagacccgtattatgaatagaaagcttcagcgcaatcttagcgatacagagtccgatagcatgaccgccgatgctgggctccccaaaagggccgaccgcatcctttcaggtggggctctggagttggctagtcagaacactgacaagacaagccagaaccaggctcgagagttgccggtgactgagaataatgcccagaatgccaaagtaagtcgctttttgaagaaaaagcaagctccagttgagaacatcagccccgaggcccctgccggtaaggagagaaccttacaaacacccaaacaaaaagaacccgctcggacattcgatagccccgattccgacgaggaggagatgaaagtgcttctcgggtccttaatggacagcagcagggagaagaataccaaccaagggttttcaagtgcaaacgtaagtgaagaagaggagcgcaaactgttctcagtgccctctcagctacgggcttttaccgtgccttcagtagaattatcctcagctaagccatctcagaccagccacctgccaacctcccttgctgccgacagaactctgcatagtaccaggtcaagggctgactaccctcaatctcacgtgtctagcgacaccgctagccacacccccagcgtctcgataaccggcgctttcagtaacagcgtgtctttgaaaatgggacacgtgaagctggtgtcaagccccggacggtctgaagctgaaaccgtcgacgagcctgtttcagagggagcagatgattcactggacgagtttcggatcaatatcctctcactggacggactggcgccagcagtctccgagaattcagaccttgagcaggaagaggaatctgcccagcgtcaaaaaactgccggtaagatcttccgagccgaggcctctactgggcaggatgctcccagacaggcccaggcaaggagttgggcctcccagggcaaggccgcatccgcagagggcgacgagagcgaagtctccgagcatctttcggcatcttctgcctcagcaatacagcaagattcaacaagttcaatgcagccccctagcgaagctcccatggtaaacaccgtgagcagcgcgtattccgaggatttcgagaactcgcccagtctgactgcttccgagccgacggcccatagcaaagaaagccttgacagaacactcgacgccctgtcagaaagctcatcctctgtgaaaacggacttgcctcagactgccgagagtcggaagaagtccggccgacatgtgactcgcgttctggtgaaggatacagcagtgcaaactcctgatcctgctttcacctacgaatggactaaggtggcttcaatggctgcaatgggccctgccctaggtggcgcatacgtcgatccaacgcccattgccaatcatgtgatcagtgccgacgctatcgaggcactgaccgcttacagccccgctgtcctagctctacacgacgtacttaaacagcagcttagccttactcagcagttcatccaggcttcccgacacttacacgccagcctgcttcggtccctcgacgccgatagcttccactaccacaccttggaggaggcaaaagaatatatcaggtgtcatcgcccagccccattaactatggaagatgccttagaagaagtgaataaagagctgtag

SEQ ID NO: 49739 - DNA, 1116 bp, Artificial Sequence
  Description of Artificial Sequence: Synthetic coding sequence
atgctcacacccgcttttcactttaacattcttaagccttatatgaaaattttcaatgaatcagtaaatatcatgcacgccaaatggcaactgctggcgtctgagggttcagcgtgccttgatatgtttgaacacatttctttgatgacactggacagcctccagaagtgcgtgttctctttcgatagccattgtcaggagaagccctcagagtacatcgctgccattttggaattgagcgctctggtgtccaaaaggcaccacgagatcttgctgcatattgattttctgtactatcttactccggatgggcagcgttttcggcgtgcctgtcgccttgtccacgattttaccgatgccgtgattcaggagcggcgaaggacattgccctcccagggagtggacgattttctgcaagcaaaagccaagagtaagactctagatttcatcgacgtcttacttctatcaaaagacgaagacggcaagaaactctccgacgaggacataagagctgaggcagataccttcatgttcgagggccatgacacaacagccagtgggctgtcctgggtgctctatcacctagctaagcaccccgagtaccaggaacgctgcagacaagaagttcaggagctgctaaaggacagggagcctaaggagattgaatgggatgatctggcgcacttgccattcctcaccatgtgtatgaaggaaagtctacgcctacaccccccagtgccagtgatatcacggcacgtgacccaagatattgtgctaccagacggtagggtcatccctaaaggaattatctgcctcattagcgtctttggcacgcatcataacccagctgtgtggcccgatcctgaggtatacgaccctttccggttcgatccagaaaacataaaggagcgttcccctctggcctttataccattcagcgcaggccctaggaactgtatagggcaaacatttgccatggcagaaatgaaggtcgtcctcgccctcacgctgctgcgtttcagggtgctacctgatcacactgaaccccgacgaaagccagagcttgtactgcgcgcagaggggggactgtggctccgagtggagccgctaagctag

SEQ ID NO: 49740 - DNA, 1530 bp, Artificial Sequence
  Description of Artificial Sequence: Synthetic coding sequence
atggagttttcatggctggagacccgctgggctcgacccttctatctggcattcgtgttttgtcttgctctggggctcctgcaagctatcaagctgtatctgcgcagacagcgtctgctccgggacttaaggcctttccccgctcctcctacacattggttcctgggccatcaaaagttcatccaggacgacaacatggagaaactcgaggagataatcgaaaagtatccaagagccttcccattctggatcggcccattccaggccttcttctgtatctatgatccagactatgcaaagacccttctttctcgcactgatcctaagagtcagtacctgcaaaagttctccccgcctcttctgggaaaggggctagccgcactagatggacccaagtggttccaacacaggcgcctgctgacacccggatttcattttaacatactgaaagcatatatagaagtgatggcccactccgtcaagatgatgctcgacaaatgggagaagatttgcagtactcaggacacctcggttgaagtgtatgaacatattaactccatgtctctcgacattatcatgaagtgtgcgttctctaaggaaaccaactgtcagacaaatagtacccacgatccctacgctaaagctatcttcgagctgtccaaaataatctttcaccgactgtattcactactgtaccatagcgacattatcttcaagttgtctcctcaaggatacagattccagaagctctccagggttctcaatcagtacaccgatactattatccaagaacgaaaaaagtcactccaagctggagtcaagcaggataacaccccgaaaagaaagtaccaagactttctggatatcgtgctgtccgcgaaagacgagagcggcagttccttctctgatattgacgttcattctgaggtctccacctttttactggcagggcatgatactctggctgccagcatatcctggatcctctactgcctggccctcaatccggagcaccaagagcgatgccgagaagaggttagggggattttgggggatggctcctcaataacttgggaccagctgggcgaaatgtcgtatactaccatgtgtatcaaggaaacttgccgactgatacctgccgtgccttccatctctagggacctctctaagcccttgaccttccccgatggttgcaccttgccagctggtatcactgtcgtgttgtcaatttggggcctgcatcataaccccgctgtgtggaaaaaccccaaagtcttcgatcctctcaggtttagtcaggagaactccgaccagaggcacccctacgcctatctgcctttcagtgccggttctcgaaattgtattggtcaggagtttgcaatgatcgagctcaaggttacgattgccctgatcttgctccacttcagagttacccctgacccgaccagacccctaacttttccaaaccactttatactgaaacctaagaacggcatgtacctgcacctgaagaaactgtcggagtgttag

SEQ ID NO: 49741 - DNA, 1527 bp, Artificial Sequence
  Description of Artificial Sequence: Synthetic coding sequence
atgatgtgggggggtgggctggatttgtgcccaatgccgggacagctgaagtttccaccatgtctctcccggtgtttgctgtgggagccacctagcctgtatctaacccagccaacctcaagtctggccgagccacaggccttaatttgtatgacgagctcctcaagcgggctcttcatacaagacgacaacatggaaaagctagaagagataatcgagaagtatcctcgggcatttcccttctggataggcccattccaggcttttttttgtatttacgatcctgactacgcaaagacccttctgagcaggactgatcctaagtcacagtacctgcagaagttctctcctccacttttggggaagggtctggcagcattggatggacccaaatggttccaacaccggcgactgctcacaccgggttttcacttcaatattctgaaagcgtacattgaagtgatggcccatagcgttaagatgatgttggacaaatgggagaaaatctgtagcacacaggacacaagcgtcgaggtgtacgagcacatcaactctatgtctctcgacatcatcatgaaatgcgccttcagtaaggaaacgaattgtcagacaaacagcactcacgatccatatgccaaggccatttttgagctgtctaagattatttttcataggctgtattctctgttataccactccgacatcattttcaagctctcaccccaagggtaccggttccaaaagctgagtagagtgctgaatcagtatacagatacaattatccaggaacggaaaaaatcgttgcaagcaggagtgaaacaggacaatactccaaaaagaaaataccaggacttcctagacatagtgctatctgcgaaagacgaatctggatcctcatttagtgacatcgacgtccactcagaggttagcacctttctgttggctggccatgacactttggccgcaagcattagttggatactttactgtttagctcttaacccagagcaccaggaaaggtgtcgcgaagaggtgcgtggaatcctcggcgacggctcatccatcacctgggaccagctaggagagatgtcctacactaccatgtgtattaaagagacatgcaggctaattccagccgtgccctctatctctcgggacctgtccaaacctcttacgtttcccgacggatgtaccctaccagctggtatcacagtggtgcttagcatctgggggttacatcacaatcctgcggtctggaaaaatccaaaagtattcgatcccctaaggttcagccaggagaattctgatcagcgacacccttacgcttatctgcctttctctgccggttccagaaactgtattggacaagagttcgccatgattgagctgaaagtgacaattgccctaatcctccttcactttagggtgacgcccgatccaacccggccactcacattccctaaccacttcatcctgaaaccaaaaaacggaatgtacttacacctcaagaaactctcagagtgctag

SEQ ID NO: 49742 - DNA, 1518 bp, Artificial Sequence
  Description of Artificial Sequence: Synthetic coding sequence
atggaaccctcttggttgcaggaattgatggcccacccgttcttgctcctgatcctgctgtgtatgtcactccttttatttcaggtgatacggctctaccagcgccgacgctggatgattcgggcattacacctttttcccgctcctcctgcccattggttttatggccacaaggagttctacccggtcaaggaatttgaggtgtaccataagctgatggaaaaatacccctgcgcagtccctctttgggtgggaccattcactatgttcttcagcgtgcatgatccagattatgccaagattttgctcaaacggcaagatcccaagagcgccgtcagtcacaaaatcctggagtcttgggtaggacgtggtctggtcaccctggacggatccaagtggaaaaaacacaggcaaatagtcaagcctgggtttaatatctctatcttgaagattttcattaccatgatgagcgagagcgtaaggatgatgctgaataaatgggaggagcatatagctcagaattcccggctggaactgtttcagcacgtctcactgatgactttggactcaatcatgaagtgcgctttcagccaccaggggagcatacaactggacagcacactcgattcgtacctgaaagctgtctttaacctgagtaagatctccaatcagagaatgaataattttcttcatcacaatgatctggtgtttaagttcagtagtcaggggcaaatctttagcaagtttaaccaggaacttcaccaatttacagagaaggtgattcaagaccggaaggagtccctgaaggacaaactgaagcaagataccacgcaaaaacgaagatgggactttcttgacatcctcctctccgcaaaaagtgagaacacaaaggacttcagcgaggcagatctacaagccgaggtaaagacattcatgtttgctggccacgacaccacatcgtctgctatctcctggatattatactgtctggccaagtaccccgaacaccagcagagatgtcgcgacgaaatcagagagctcctgggagatggatccagcattacctgggaacatttatctcaaatgccatacactacgatgtgcatcaaagaatgtttacggctttatgccccagtggtcaatatctccagactgcttgacaagcctatcacgttccccgatggcagatccctgcccgcaggcataaccgtgtttatcaatatctgggcccttcaccacaatccctacttctgggaggacccacaagtttttaatcccctgcgatttagtagggaaaatagtgaaaagatacatccatacgcgtttattcctttctccgccggactgcggaactgtattggccagcactttgccatcatcgaatgcaaggtcgccgtcgccctcaccctgctgcggtttaagctcgctccggatcattcacggcctccgcagcctgtgcgccaagtggtccttaaatcaaaaaacgggattcatgtgttcgcaaagaaggtatgttag

SEQ ID NO: 49743 - DNA, 1809 bp, Artificial Sequence
  Description of Artificial Sequence: Synthetic coding sequence
atgccgagtgctaagcagagaggttcgaaaggcggacatggagcggcatctccatctgagaagggggctcacccatcaggtggtgccgatgacgtggctaagaaaccaccccctgcccctcagcagcctcccccaccccctgcccctcacccgcaacagcaccctcagcagcaccctcagaatcaggctcatggaaaagggggacatcgtggaggcggtggcggagggggaaaaagctctagctcctctagtgcctccgcggctgccgctgctgctgctgcgtcttctagcgcgagttgtagcagacgacttgggcgagctcttaattttctgttttacctcgccctggtcgcagccgctgccttctctggctggtgcgtgcaccatgtgttagaggaggttcagcaagttagacgctctcaccaggatttcagccggcagcgcgaggaactcgggcaaggacttcaaggcgtggagcagaaagtccaatcactgcaggccacttttggaactttcgagagtattttgcgaagctcccagcacaagcaagatctcaccgaaaaggctgtgaaacaaggtgaatccgaagtgtctcggatttctgaagtgctccaaaagttacagaacgagatcttgaaggatctcagtgacggaatccatgtggtgaaagatgccagagagagagatttcacaagccttgaaaatacagtcgaggagcgactcacggagctcacaaagtcaattaatgataatattgcgatattcaccgaagtccaaaaaaggtcacaaaaagagatcaacgatatgaaggccaaagtcgcatccctcgaagaatcggagggcaacaaacaagatctcaaggcacttaaggaagctgtgaaagaaatccagacaagtgccaaatcccgagaatgggacatggaagcacttcggtctaccttgcaaacgatggagagtgacatctacacagaggtacgggaactggtgtcgctgaaacaggaacagcaggcattcaaggaggctgccgacacagaacggcttgccctgcaagctctcacggagaagctgctgaggagcgaagagagtgtgtcgcggcttcctgaagagattagacgcctagaggaagagctgaggcagttgaagtcagacagccacggtcctaaggaggacgggggtttcagacatagcgaagcatttgaagccctgcagcagaagtcccagggactggacagccgtttgcagcacgtggaagacggcgtcctgtctatgcaggtggcctctgctcggcagactgagtcactggagagcttactttcaaaatcacaagaacacgaacagcgactggctgctctgcagggaaggctagaaggactgggttcatcagaagcggaccaagatgggctggcctctactgtgcgcagcctgggcgaaacccagctcgttctgtatggcgacgtagaagaactgaaacgatccgtgggggaactgccatctacagtggaatcattgcagaaagtgcaggagcaggtgcataccttactgtcacaggaccaagctcaggccgctcggctccccccacaggacttcctcgatagactgtcttcactcgacaatttaaaagcaagcgtcagtcaggtggaggccgatctgaaaatgttacggaccgcagtggactcccttgttgcctattctgtgaaaatcgagacgaatgagaacaatctcgagagcgcaaaggggctcttagacgacctccggaatgatctcgatcggttgtttgtgaaagtcgagaagatccatgaaaaggtgtag

SEQ ID NO: 49744 - DNA, 9896 bp, Artificial Sequence
  Description of Artificial Sequence: Synthetic coding sequence
atgcagaaggaactaggcatcgtaccaagctgtcctggcatgaagtcacccagaccccaccttttgctgccactattgttgttactgctcctgcttctgggtgccggagtcccaggcgcatggggtcaggccggttcactcgacctgcagatagacgaagagcagccagccggaacactgattggggacatctctgcaggtctccccgcagggaccgctgcccctctgatgtactttatttctgcccaagaagggtctggcgttggcaccgacctggccatcgacgaacacagcggcgttgtccgaacagcgagagtgctggacagggaacagcgggataggtatcggtttaccgcagtgacaccagacggggcaactgtggaagtcaccgtgcgcgtggccgatatcaacgaccatgccccagccttcccccaggccagggctgccctccaggtgcctgagcataccgccttcggaacaaggtaccccctcgagccagccagggatgccgatgccggaaggctgggcacccagggttatgccctgtctggcgacggcgctggagagacgttccggctggagactagacctggtcctgacggtaccccggtgcccgaactggtggtcacaggagagctggatcgtgagaatcgaagtcactacatgttgcagcttgaggcttacgacggcggatccccgccacggagggcccaggcccttcttgacgttaccctgcttgatattaatgaccatgcgccagcctttaaccaatctagataccatgcagtggtgtccgagtccttagcacccggaagccccgtgctgcaagtcttcgcctcagatgcagacgccggagtaaacggagctgtgacctacgaaatcaacagacgacagagtgagggtgatggacccttcagcatcgacgcccatacaggcctactgcagctggaaagacctttagacttcgaacagcgacgcgtgcacgagctggtcgtgcaggctcgtgatggcggtgcgcatccagagcttgggagcgcgttcgtaacggtccatgtacgagacgcaaacgataatcaaccatctatgaccgtcatcttcctgtctgcagatggcagtccacaggtcagtgaagccgctccccctggacagctggttgctcggatttctgtctctgatccagacgacggcgatttcgcccatgtcaacgtgtccctggaaggcggagaaggtcactttgctctgagcacccaggacagtgttatttatctggtgtgtgtggccaggaggctcgatagggaggaaagagacgcctacaatcttagggtaaccgctaccgactctgggtctccaccactcagagccgaagcggctttcgtgcttcacgttacagacgtaaatgataacgcacctgccttcgatagacaactttatcgcccagaaccattgccagaggttgcgctgcctggcagctttgtcgtccgcgtcacagccagagacccggaccagggtaccaatggtcaggttacctattccctggccccaggggcacatacccactggttcagcatcgaccctacttcgggtatcataactaccgccgcatccttggactacgaactggagcctcagccgcagctgatcgttgtcgctaccgacggaggcctccctcccctagccagttcagccactgtatccgtggccctgcaggatgtgaacgacaatgaaccacagttccagagaacgttctataatgcatcactgccagagggtacgcagcctggtacatgcttccttcaggtgactgcgaccgatgccgacagtggccctttcggcctactctcttactccctgggcgcaggcctgggttcatctggcagcccaccttttagaattgacgcccactccggagatgtgtgcactaccaggaccctggatcgtgatcagggcccttcatctttcgactttacagttactgctgtcgatggaggagggctcaagtctatggtttacgtgaaagtttttctttctgacgaaaatgacaatccccctcagttctatccacgagaatatgccgcatctataagcgcccagtccccacccggtactgctgttctcagactgcgtgcacacgacccggatcaagggtcccacggcaggctatcttatcacatcctcgccggaaactctcccccactgtttacattagatgagcaatcgggactgttgactgtggcctggcccctggcacgtcgagctaatagcgtggtacagttggaaattggagccgaggatgggggaggactgcaggcagaacctagtgctcgcgtggacatctcaatcgttccaggcacccctaccccacccatctttgaacaactgcagtacgtgttctctgtgccagaagacgttgctccagggacttcagtggggatagtgcaagcccataatccgcctgggaggttggcgcctgttaccctctcactcagcggtggagatcccaggggcctcttctctttggatgccgtgtcaggattgctgcagacacttagacctctagatcgcgaattactgggcccagtactggaactagaagtgagggcaggcagcggggtcccaccggcattcgccgtggccagagtgagagtcctgctcgacgatgttaacgataattcccccgcatttcctgccccagaggatactgtgctgctgccgcctaacacagcacccggaaccccgatctacactctgcgggctctggatccagactctggggtgaactcgagagtgacattcacgctgttggccggtggcggaggagctttcactgtagatcccaccaccggccacgttcggcttatgcgccctttggggcctagcgggggacccgcacacgaattggagctggaggctagagacgggggatctcccccaagaacttcccatttccgactccgggtcgtggtgcaggatgtcggaacgaggggtctggccccacggttcaatagcccgacttaccgggtggatctaccatcaggtaccacagctggaacccaggtgctccaagtacaggcccaagccccagacggcggaccaattacttatcacttggctgctgagggcgcttcttctccattcggactcgaaccccagtccggctggctgtgggtccgtgctgccttagatcgcgaagctcaggagctgtacatcttaaaagtcatggcggtctcagggtccaaggctgaacttggtcaacagacaggcaccgcgaccgttcgcgtaagcattctaaatcaaaatgaacactccccaaggctctcagaagaccccacatttctggctgtggccgaaaaccaaccaccgggaacgtcagtcggacgggtttttgctacagatagggactcgggtcctaacggacgcctaacctactctctacagcagctaagcgaggattctaaggccttcaggatccacccccaaaccggagaagttacaacactccagaccctcgacagggagcagcagtcctcatatcagctgctggtgcaggtccaggatggtggttcaccaccaaggtccacaacaggaactgtgcatgttgccgtcctggatttaaacgacaatagcccaacattcctccaggcctctggcgcagccggtggagggcttcccattcaagtcccagacagggtgccacccggaacactagtgacaactctgcaggcaaaagatccggacgagggggaaaatggaaccattctctacaccctcaccggccctggcagcgagctcttcagcttacatccccactcgggcgagttgctcaccgccgctccactgataagggccgagcggcctcactacgtactgactctctctgctcatgaccagggaagcccacctaggtccgcgtccttgcagctgcttgtgcaggtgctgccaagcgccaggctggctgaacctcccccagacttagctgaacgggaccccgctgcacccgtgcctgtggtgttgactgttactgctgccgaaggactgagacccggatccctgctgggttccgtcgccgctccggagccagcgggagtgggagccctcacctacacactggtgggaggcgctgatcccgaaggcacgtttgcgctcgatgccgcttcggggaggttataccttgctcgtcctttggattttgaagcaggaccaccctggagggccctgactgtgagagcagaggggccaggcggagcgggagcaaggcttttgagagtccaggtacaggtgcaggacgagaatgaacatgccccagccttcgcgagggacccgttggcactggccttacccgagaatcctgagcctggcgctgcgctgtatacattccgcgcatcagatgcagatggtcctggaccgaatagcgacgtccgttacaggcttctgaggcaggaaccccctgtgccagccctgcgcctggacgcgaggacaggggcactctctgccccacggggtctggatagggagacgacgcccgctctgctcctgctggtcgaggccacagacagaccagccaacgcttcccgcagacgtgccgctcgggtgagtgcaagagtgttcgtcacagacgaaaatgacaatgctccagtgtttgcctcgccctcaagagtgcggctgcccgaagaccagcccccagggccagctgctctgcacgtcgtggctcgtgaccccgatctcggagaagcagccagggtaagctaccggctggcaagtggcggagatgggcatttccgtctccacagctctaccggcgcactatccgtcgtccgacccctggatcgggagcagcgggcagaacacgtcctgacagtcgtggcttctgaccatggctctccacccagatctgcaacacaggtcctgactgtatccgtcgcggacgtgaacgatgaagcacctacctttcagcagcaagaatattcagtactccttagagagaacaatccccctggcacctccctgctgaccctgcgagctacagacccagatgtgggcgcaaacgggcaagtgacgtatggtggcgtaagcagcgaatccttctccctggacccggacacaggggtcctgaccaccctgcgggctctcgatagagaggaacaggaggaaataaacttaactgtatatgcacaggatcgcggttctccgcctcagttgacgcacgtcaccgtgcgagtagccgtcgaggatgagaacgatcacgcacccacttttggaagcgcgcacctttccctggaagttcccgaggggcaggatccacaaacactaaccatgctgcgtgccagcgaccccgacgtgggagctaatggacagttacagtaccggattctggacggtgatccatcaggggcatttgttttggatctcgcatccggcgagtttggcacaatgcgtcccctcgatagagaagtggaacccgcatttcagctgcgcattgaggccagggacggaggacagccggcactttccgcgacactgctgctgaccgtgactgtcctggatgctaacgatcatgctcccgctttccccgtgcctgcttactctgtcgaggttcctgaggatgttcctgctggaacactcctcctgcagctccaggcacatgatcctgacgctggtgcaaatggacacgtcacctattatctcggagctggaacagccggagctttcctccttgagcccagctctggggagctgaggaccgcagccgcactcgacagggagcagtgtccatcatatacgttttccgtgagtgcagtggacggagctgctgccggtccattaagcaccacagtgagtgtaaccatcaccgttcgggatgtaaatgaccacgcccctactttcccaacttcccccctccggctgcgactcccaagaccgggaccgtccttctctacccctacgctggcgctggccacgctgagggcggaagaccgagatgctggcgctaatgcgtcaatcctctataggttggctgggacaccccctcccggaacaacagttgattcttacaccggtgaaatccgagtagcccgatcgccagtggcccttggaccccgagatagagttttgttcattgtcgccactgatctgggccgaccagctagatccgcaactggagtaatcatagttggcttgcagggcgaagccgagcgtggacccaggttcccacgcgcatcttctgaggccacaattcgagagaatgctcctcccggaacaccaattgtcagcccaagggccgttcacgctggaggcaccaatggcccaattacatatagtatattaagtggcaacgaaaaggggaccttctctattcagccatctaccggcgctataactgtgcggtctgcagaggggttggacttcgaggtgtctcctcggttacgactggtgctgcaggccgaaagcggaggggcattcgccttcaccgttcttacgctcaccctgcaggacgccaatgacaacgcccctaggttcctccggcctcactatgttgcatttcttccagagtctcggcctctggaggggccactattacaagttgaggccgacgatctggatcagggatctggtggccagatcagctattctctcgctgcttctcagccagctaggggcctgttccacgtcgatcccaccacaggcactattacaacaacggcaatccttgatcgggagatctgggcggagactagactggtgctgatggcaaccgatagggggtccccagcccttgtcggtagcgctaccctcacggtcatggttattgacacgaatgataaccgccctaccataccccagccctgggagttacgcgtgtcggaggatgcactgttaggcagcgaaatagcgcaggttacaggtaatgacgtggactccggcccagttctgtggtacgttctgtctcctagcgggccacaggacccattctccgtgggccgatatgggggtcgcgtttccctcacggggcctctcgacttcgaacaatgcgatcggtaccaactccagctcttggcccatgatggccctcacgaaggtagggccaatctgactgtactcgttgaggacgtcaatgataatgctcctgcctttagccaaagcctctaccaagttatgctgctggaacatacaccccctgggtcggccatccttagcgtatctgcgaccgatcgagactctggcgcaaatggacacatctcttatcacctcgcaagcccggcagacggattcagtgttgaccctaataacgggacactgtttacaatagtcggcactgttgctctgggccacgacgggtcaggcgcagtagacgtcgtgttggaagcccgtgaccatggtgcaccgggacgcgctgccagagcaacagtgcatgtgcaactacaggaccagaatgaccacgcgccttcatttacattgtctcattacagagtggcagttacagaggatctgccaccaggctctacgctcttaacactggaggcaaccgatgccgacggcagcaggagccatgccgctgtggactactcaataatctctggaaattggggtagggtcttccagctggagccccgtctggctgaggccggagaatcagcgggacccggtcccagagccctcggctgtctcgtgctgttggagccgcttgacttcgaaagtctcactcagtacaatcttaccgtggccgcagctgatagggggcagcctccacagagctctgtcgtacccgtgacagtcaccgttctggacgtgaatgacaacccccctgtcttcaccagggcttcttaccgcgttaccgtcccagaagacaccccagtgggagcagaactgctgcatgtggaggcatctgacgcagatcctggcccacacggtctggttagattcactgtgagttctggagatccctccggtctgttcgagctggacgaatcgtcgggcactctgagactagcacacgccctggactgtgaaacccaggccaggcatcagctcgttgtgcaggccgcagatcctgctggcgcacattttgctttggctccagtgacgatagaggttcaggatgtaaacgatcacggacctgcattcccactgaatctcctcagcacttctgtggccgaaaatcagcctcctggaacccttgtcaccaccttgcacgctattgatggtgatgccggagccttcggcagactgcgttactctctattagaggccggacccggaccggaggggagagaggcattcgcactaaatagtagcactggtgaattaagggccagagtcccatttgactacgaacataccgagtcctttcggctgctcgtgggagcagcagatgcaggtaacttatctgcaagcgtgactgtctccgtgctcgttaccggagaggatgagtatgatcctgtcttcctggcacccgcttttcacttccaggtgcctgaaggggcaaggaggggacacagtttgggtcatgtacaggcaactgacgaggatggcggagcagacggtctggtgctgtattctcttgcaaccagctcaccgtactttggcattaatcagactacgggagcactctatctgagggtcgacagtcgggctccaggcagtgggactgccacttccggcggtgggggtaggacccggcgtgaagctccaagagagctcaggttagaggtaattgccagagggcctctccccggtagtcggtctgcgactgtgccagttaccgtggatatcacgcacaccgcccttgggctagctccagatttgaatctgcttctggtaggggctgtcgcggcatccctcggagttgttgtcgttctggcgctggccgcattggttctcggtctagtccgcgcacggtcccggaaagctgaagcagctcccggacccatgtcccaggctgctccattagcttcagattctctgcagaaactcggacgagagcctccaagccctcctccttccgagcatctgtaccaccagaccctcccttcttatgggggacctggtgccggtggtccatatcccaggggcggaagcctagatcccagccactctagcgggagaggctccgccgaagccgcagaggatgatgaaattaggatgatcaatgagttccctagggtagcatccgtggcctcttccttggctgcccgtggccctgattctggcatccagcaggatgctgacggcctgagcgatactagctgcgagcccccagccccagatacctggtataaaggaaggaaggccggactgctgctccccggagccggagcaacactctatagggaggaaggtccacccgcaacggccacggcttttctgggaggctgcggcctgtcccccgcacctactggcgattacggatttcccgctgacggaaagccttgcgtggctggcgcactgacagccatcgtggccggagaggaggagcttcgtggatcctacaactgggactatttgctgtcatggtgcccccagtttcagccactcgcctcggtgttcacagagatagctaggctcaaagatgaggcaagaccctgtccgccagccccacgtatcgatcctccgcctctgattacagcagttgcccaccctggcgcaaagtctgtccctcccaagcccgctaatacggctgcagctagggccatttttccacccgcttcccataggagcccaatcagccacgaggggagtctgagcagcgcagccatgtcaccatctttttccccttccctgtcacctctagctgcgagatcacccgttgtttctccctttggcgtggctcagggaccctctgcgtcggcgcttagcgctgagagtgggttggaaccccctgatgacactgaactccatattta

SEQ ID NO: 49745 - DNA, 462 bp, Artificial Sequence
  Description of Artificial Sequence: Synthetic coding sequence
atgaaagcaccctgcccccagctgccctgtcctccggcatcgcaccctctttgccttctgtggctgctcgcccatccgctgtctcatcatctcggctggcctcgggtgccgcaacctcagcactccgcacagagtctggcctggtcccatctgatgacgagatcttgtacctcttcatgcggccctggctgggcccctacctgggacgcgcatagcgtgccaaatgctggtcctaccctgtccctgccctgggccgcttctgattacgattggttgcgcggtggccaccaccaagcccctgccctccaccccgagttgccatcccccctgcgcgtgctcggccctcagaagccatgctgctcccttacgtgtgatcaggttcaatgcggtgagaagtatgagggtggctcttcccctggctttagttccgttcgtgacccctgccccgctccggcaccatag

SEQ ID NO: 49746 - DNA, 2121 bp, Artificial Sequence
  Description of Artificial Sequence: Synthetic coding sequence
atggatatcaaacaccaccagaatgggacaaggggccagagacgcaaacaacctcacacaaccgtgcaaaggctgctgacctggggactgcccgtgtcctgctcttggttcctttggcgacagccaggtgaatttcctgtgaccgcactcctgttgggagcgggtgccggagggttgctggctatcggactgtttcaattgcttgtcaaccccatgaatatctacgaagagcagaaaataatgtttctctacagcctggtgggtctcggggcaatgggctggggaacctctccacacatcagatgtgcttcactgctattagtgcctaaaatgctggggaaggaggggcgtctctttgttctcggatacgctttggctgcgatctacgtggggcctgtcgctaacctgcgtcataatctgaataatgtgattgcctctctgggctgcaccgtggagttgcagatcaataatacaagagccgcatggaggatatctaccgcacccttaagagccatgtttaaagacctcctttcttcaaaggaattacttagggccgagacgcggaacatcagcgccaccttcgaggatctggacgcccaggtgaatagtgagacgggctacacacccgaggacaccatggatagcggagagaccgcccagggtagggaggctcgacaggcccctgcaagtagactgcacctgagtactcagaaaatgtatgagctgaagacaaagctcaggtgctcttatgtcgtcaatcaagcaatactcagctgccggagatggttcgaccgtaagcatgagcagtgcatgaagcatatttgggttccgctgctcacgcacctgctgtgcctgccaatgaagtttaagttcttctgtggcatcgctaaggtgatggaggtatggtgtcgtaacagaatcccagttgagggcaatttcggacagacctacgattcactcaatcaaagtatccgcggattggatggagagttttccgccaatatcgattttaaagaagagaaacaggctggcgtactaggtctgaatactagctgggaacgcgtgtctacagaggttcgcgactacgtttaccgccaggaggctcggctggagtgggctctgggcttgcttcatgtgctcctgtcttgtacgttcctcctggttctgcatgcgtccttcagctatatggatagctacaatcatgacatccgctttgacaatatctatatttccacttatttttgtcagatcgacgacaggcgcaaaaaactgggaaagagaactctgctcccgctgcggaaggcagaagaaaagaccgtcatctttccttgtaaacccaccatacaggcgtccgaaatgtccaatgttgtccgggaactgcttgaaacgcttccgatccttctgttattggtcgttctgtgtggcctggactgggcactttactctatttttgacacaatccgccaccattctttcctacagtactcatttcggagctcacacaagctcgaggttaaggtcggcggagatagcatgttggcccgtttgcttagaaaaactatcggtgcccttaacacctcttccgagaccgtaatggaatcaaacaacatgccctgtctgcctcaacccgtcggcctcgatgcacgggcttattggcgggctgccgtcccgattggattgcttgtttgtctctgtcttctccaggccttcggttatcgcctgcgcagggtgatcgccgcattttacttcccaaagagggaaaaaaagcgaatactctttctctataatgatctgttgaagaagagagctgccttcacaaagcttcgtcgggctgcaatcctgcgtagagagcgccagcagaaagcccctcgtcatccacttgccgacatcctgcaccggggatgcccgttgctgaggcggtggctgtgtcggcgttgtgtcgtgtgccaggccccagagacgccggagagctatgtctgccggaccctagactgcgaggccgtatactgttggtcttgttgggacgatatgaggcaacggtgtcctgtgtgtacccctagggaagagctttctagctcagctttttcagacagtaacgacgacaccgcatatgctggttag

SEQ ID NO: 49747 - DNA, 1995 bp, Artificial Sequence
  Description of Artificial Sequence: Synthetic coding sequence
atggatattaagcaccatcaaaatggtaccagaggccaacgtcgcaagcagcctcatactaccgtgcaaagattgttaacttggggcctccctgtcagttgctcctggtttttgtggagacagcccggagaattcccagtcacggcacttttgctgggtgccggagcgggaggcctcctggcaatagggctctttcaactcctggttaaccctatgaatatctatgaggaacagaaaatcatgtttttgtattctctagtcggtcttggcgctatggggtggggaacatctccgcatatcagatgcgcatctctcttgctggttcccaaaatgctgggaaaagaaggacggctcttcgttttaggttatgccctcgccgcaatctacgtcgggccagtagctaatctgagacataacctgaacaatgtgattgccagcctgggctgtactgtggagctgcagataaataatacccgtgcagcttggcgcatctctaccgcgcctctccgggctatgtttaaagatctcctgagctccaaagagctccttcgcgcagagacccgcaacatttctgcaacgttcgaagacctggatgcccaggtgaattctgagactggttatacaccagaggacacgatggactccggggaaacggctcagggaagggaggccagacaggccccagcatccaggcttcacctttcaactcagaagatgtatgagctcaaaaccaagttacgatgcagctatgtagtaaatcaagccatcctgtcctgcagaagatggtttgataggaagcacgagcagtgtatgaagcacatctgggtgccactgctcacacatctgctctgtctgcccatgaagtttaaatttttctgtgggatcgcaaaggtgatggaagtctggtgcaggaatcggattccagtggagggcaactttggccagacttatgactcccttaaccagagcattcggggtctggacggagagtttagtgcgaatatcgacttcaaagaagagaagcaggccggtgtgttaggactgaacacctcctgggagagagtgagcactgaagtcagagattacgtctatagacaggaagctcgcctggaatgggccctgggattgcttcatgtactcctgtcctgtacattcctgcttgtgctccacgcctccttttcatatatggacagctataatcatgatattcggtttgataacatttacatctccacatatttctgtcagatcgacgacagaagaaagaaactcgggaaacggaccctgctccctcttcgaaaggctgaagagaaaaccgtgatattcccatgcaagcccacaatacaggcctctgaaatgtccaacgttgtacgcgagctcctggagacactgccaattcttctgctgctcgtggttctttgcggcctcgattgggcattgtactccatatttgataccatccggcaccactcttttttacaatacagcttccgatcctcacataagttagaagtgaaagttgggggtgattccatgctggctcgcctgctgcggaaaacaatcggtgccctcaatactagttccgagaccgttatggagagcaacaacatgccctgtttgccgcagcctgtcgggctggatgctcgcgcttactggagggctgccgtaccgattggcctcctggtttgtttgtgtctacttcaagcttttggataccggctccggagggtcatcgctgccttctactttcccaaaagggagaaaaaaagaattctgttcctatacaacgaccttctgaaaaagcgggctgctttcacgaagttacgaagggccgctatcctcagacgggagagacagcagaaagctcccgtgtttaccgagccgcaatttcttccactgaaaaatggcaagactggcgaaatctgcaaagcctgctctttggagatcagtttggagtggtggagcggcgtagggctgcgatgccagagggcttag

SEQ ID NO: 49748 - DNA, 1995 bp, Artificial Sequence
  Description of Artificial Sequence: Synthetic coding sequence
atggatattaagcaccatcagaatgggactcgaggccagagaaggaaacaaccccacacaaccgtgcagagacttctcacgtggggccttcctgtaagctgctcttggttcctgtggcggcagccaggtgagttccccgtcacggcattgctgttaggtgctggcgctgggggactcctggctattggactatttcagctcctggtgaaccctatgaatatttatgaagaacagaagattatgttcttgtattcgctggtgggacttggcgctatgggatgggggacgtccccccacataagatgcgcttcactcctcctcgtgcccaagatgcttggcaaagagggcagacttttcgtcttgggctacgctcttgctgctatctacgtggggccagtagcaaacttgcgtcacaacctcaataacgtgatagcaagcctgggatgcactgtggaactacagatcaataacacacgcgctgcctggcggatcagcacagcgccactcagagcaatgttcaaagacctgcttagttctaaagagctgctgcgggctgagacacgaaacatctctgctacctttgaagatttggacgcacaggttaatagcgaaacggggtacacacctgaagacaccatggattcgggagaaactgcccagggaagagaagctagacaggccccagcgagtaggctgcacttgagcacccagaagatgtatgagctgaagaccaaactccgctgctcgtacgttgtgaaccaggcgattctgtcctgtcgccgatggttcgaccgtaagcacgaacagtgcatgaagcacatatgggtgcccctgctgacacatttgctgtgcctccccatgaaattcaagttcttctgtggcatcgcaaaagtaatggaggtctggtgtcgaaacagaattccggtcgagggaaattttggccagacttacgattcattaaatcagagcataaggggattggatggcgagttttccgcaaacatcgattttaaagaagagaaacaggctggggtcctaggcctgaacacaagctgggaacgagtgtccacagaagtgcgggattacgtgtatcgccaggaagcgagattagaatgggctttgggcctcctccacgttctgctcagctgtaccttcctccttgtcctgcacgcatccttctcctatatggacagctacaatcacgacatcagatttgacaacatctacatatccacatacttttgccagatcgatgacagacgcaagaagctcggaaagcgaacactgctgcccctgagaaaggccgaagagaaaaccgttattttcccgtgcaagcctacaatccaggcttcagagatgagcaacgtggtgcgggagctgctggagacactcccaattctgttgctcctagtcgtgctgtgcggccttgattgggctctgtactctattttcgataccatacgccaccactcttttctgcagtattcatttagaagttcacataagttagaagtgaaggtgggaggggattcaatgttggcacggctgctgcgcaaaactatcggagccctgaacacaagttccgagaccgtcatggagagcaacaacatgccatgcctgcctcagcccgtgggtctggatgcaagggcctactggcgggctgcagtgccaatagggctccttgtatgtctttgtctgttacaagcattcggatatcggctgcgaagagtcattgccgctttttattttcctaaaagagagaaaaaacggatcctttttctgtacaatgatctgctcaaaaagcgcgctgcattcacaaagcttaggcgcgctgccatcttaaggagagagagacaacaaaaagcacccgtgtttactgagccccagtttttgcctctaaagaacggtaagacaggggagatctgcaaggcctgttccctcgaaatttctctggaatggtggtcaggggtaggactgaggtgccagcgggcttag

SEQ ID NO: 49749 - DNA, 2046 bp, Artificial Sequence
  Description of Artificial Sequence: Synthetic coding sequence
atggatattaaacatcaccaaaacgggactcgtggccagcgccgtaagcaaccgcatacgaccgttcagcgactcttaacttggggcctgcccgtgagctgttcatggttcctgtggcggcaaccaggtgagttccctgtcactgcgctgctgctgggcgctggcgctggcggactgctggccataggcctcggcgcaatggggtggggcacctctccacacatcaggtgtgcttcacttctactggtgcccaaaatgctgggcaaagagggaaggctgttcgttctaggttacgccctggccgcaatttatgtcggacctgtggctaatttgcggcataatttgaacaacgtcatcgcctcgctcgggtgcacggttgagctacaaattaacaatacccgggcagcttggagaatctccaccgccccactcagagcaatgtttaaggacctcctttctagcaaggagctcctgcgagcggagacacggaatatatcagcgacattcgaggacctggatgcacaagtgaactccgaaacgggctatactcccgaggataccatggatagtggagagaccgcccaggggagggaggccaggcaggctcccgctagcagattgcatttgagcacccagaagatgtatgagctgaaaacaaaactgcggtgttcttacgtggtcaaccaggccatactgagctgtcggcgatggttcgacagaaagcatgaacagtgtatgaaacacatctgggtaccactgctaacacacctgctgtgcttaccaatgaagtttaagttcttttgcggaattgctaaagtaatggaagtctggtgccgaaatagaatcccggtggaaggtaactttggccagacctatgatagcctgaatcagagtattcgcggtctggacggtgaattctctgcgaatatagattttaaggaggaaaagcaagccggagtcctcggactcaacacatcatgggaaagggtgtctaccgaagtccgggactatgtgtacagacaggaagccaggctagaatgggctctcggtctgttgcatgttctgctctcctgcaccttcctattggtcctgcacgcctcttttagttatatggattcatataaccatgacattaggttcgacaacatctatatcagcacatatttttgtcagatcgatgacagaagaaaaaagttggggaagcgtactctccttccactgcggaaagctgaagaaaagactgtgatattcccttgtaagcccacaattcaggcctcagagatgagcaacgtggtgagggagctattggaaacattgcccattctcctgctcctggtggtgctgtgcggactcgattgggcactctactctatctttgataccattaggcatcactcttttctacaatactcctttcgttcaagtcacaagctggaggtgaaggtgggcggagatagcatgcttgcccgattactgcgtaagaccattggtgctctcaatacatcatctgagaccgtcatggaatccaacaatatgccatgcttaccccagcctgttggtctggatgcacgggcttattggagagcagccgtacctattgggctgctcgtgtgcctttgcttactgcaggctttcggatatcggctaagacgcgtaatcgctgccttctactttcctaagcgtgaaaagaagcgcatcctcttcttgtataatgatctactcaagaaaagagctgcgtttaccaaattacgaagggccgctatcctccgaagggaacggcaacaaaaagcccctagacatccgttagctgatattctgcaccgcggatgcccactacttcgaaggtggctgtgtcgaagatgcgtggtctgtcaggcccctgaaacaccggaaagctatgtgtgtcggacactggattgtgaggcagtctactgctggtcatgctgggacgatatgagacagaggtgtccagtatgcacccctcgagaggagctgtcatcctctgccttcagtgacagcaatgacgacacagcttacgcaggttag

SEQ ID NO: 49750 - DNA, 1920 bp, Artificial Sequence
  Description of Artificial Sequence: Synthetic coding sequence
atgccgaaggtgatgaaggatgtggtccatcccctgggcggtgaagaacctagtatggcacgcgcagtcgtgaggtcagtgggaggcttcaccctgggactgtcactggctacagcctacggtctgctggagctactcgtcgaagggcactcaccatggggatgcttagtgggaaccctgaccctggccgcattcctgtccctgggcatgggcttctctagacaggtccgcgctaccgttttattactgctgccgcaggcattttcccggcagggccgtactctcctgttggtagcagcattcggactcgtgctgcaggggccatgtgccaacacattacgaaacttcaccagagctagcgaggcagtggcgtgcggagcggaactggcactgaatcagacagcagaggtgcttcaacgcgctaagcagccactggtgtccgctctcaataaaattaaagctatcgcacgcaaaactaaggaggtcgccgatagagtgaggaagttcttccggagcattatggacggtgtgaagcatattgctagggctctgaggaacgtttggcaatggctgctgcacatcggggatgtctgcaattccgaactcggaaacccttacctcaagtgtgcccgagtgtttgacgacgctaaggactcctgcatgatggtgattccccaagcttaccatttatgttatgttttgatgccatttaaattggccctgtgtggactggctagcctcgtgcaagtcttctgcgtaatccccaaatatattcaaccatttctcaggcagaccatcgggacacctgtcattcagctgctaaaccgcgtcaggcaagaattcgaattcaatatgaccgctacacatcactttagtgtagacctcaatgcctcacgatcattgtcccaggtggcaatggatctccatgaagcagtcagcatgaagcttcacagggtacgggaagctctggccttgatgggctttacaacgcccctcctcctcgtcttactttacctccaggctctgttctacaggtattgttatttaaattgggatcactacgacaacatctacatcacttcacgctttttgcgcatggaggctgtgaggagcactgcaggtctccccacagtcctgcccctctcggctcatgaagctcgacggtatattccacctggatcaatttttctgtcgcagtgggaaaaatttttttacattctggagacctttaacttgattaggcatctgctcctggtcttgtttcttgttttcctggattacgccgtcttctgggtgctcgacctggcacgccatcaattacagggagagattgtggccaggagcccagtgcttgtgtccttgaccgtggagggtaccggctatgccggtaacatctaccgtgacctcgttagcgcatttgatgtattgcaacagggaaatatttccatcctatcccgacgttgtctgctgcggccatctgagcctgactccacaggctacatcgtcatcggcgtgatgtatggcctgtgctttttcattactctctttggatcctacgtgtctagactgcgcagggtgatttgtgctagttattatccttcccgggagcaggaaaggatctcttacctgtacaatgtgctgctttcaagacgaacgaacctcctcgccgcactacatcgatccgtgcggagacgtgcagccgaccagggccacaggtccgccttcctcgtgctggcatctcggtgcccgtgcctgggccctttcgtctcccacttctggctccaccaagcctattgcttgggttgtggccagccccaagacgaaggtgacatggagaataccgtgagttgttcaacacctggctgccagggctttatatgcaagtggcattgtagctcttccctcgtctgcacaccatag

SEQ ID NO: 49751 - DNA, 2322 bp, Artificial Sequence
  Description of Artificial Sequence: Synthetic coding sequence
atgccaaaggtcatgaaagatgtggtccatcctctgggcggtgaagagccctccatggcgcgtgctgtcgtgagatccgtcggcggattcaccctcggcctctcacttgctaccgcgtacggactcctggagctgctcgttgagggtcatagtccttgggggtgcctggtgggtactctgacactggccgcattcctgagcctcggtatgggattcagccgccaggtacgagcgaccgtgctgctcttacttccacaggcgttctctagacaggggaggaccctcctcctggtggccgctttcggtctcgtgctgcaggggccttgcgccaatacattgagaaattttactcgcgcttctgaggcagtcgcatgtggggcagaactggcgttgaatcagactgcagaggtactccagagagcaaagcagcctctggtctctgcccttaataagatcaaggctatcgcgaggaagacaaaggaggtcgcggaccgggtgcggaaattcttccgctccatcatggatggggttaagcacatcgcacgagctttgcgtaatgtatggcagtggctactccacattggcgatgtctgcaatagtgagctaggtaatccctacctaaaatgcgccagggtttttgacgatgccaaagactcatgcatgatggtcattccccaggcctaccatctgtgctacgtgctcatgcccttcaagctggcgctgtgcgggctcgcttcccttgtgcaggtgttctgcgtcattccaaaatacatccaaccgtttctacggcagactatagggactcccgttattcagctgcttaaccgggtgaggcaagaattcgaattcaacatgacagccacccaccacttttcggtggatctcaatgcctcccggtctctgagccaggttgccatggacctacacgaagccgtctcaatgaagttgcacagagtcagggaggctttagcactgatgggatttacaactcccctcttgctcgtgctgttatacttacaggccctgttttaccgttactgctaccttaactgggaccattacgataatatctatattacctctcggttcctgcggatggaggccgtgaggagcaccgctggccttcccacagtcctacccttatctgctcacgaggccagacgatacatcccccctggctctattttcctttcacaatgggagaaatttttctacatcctggagacatttaatttaatcagacatttattattggtgctatttcttgtctttctggactacgcagtgttctgggttctggatctggcacggcaccagctgcaaggtgagattgtggcgcgatccccagtgctcgtgagcttgacagtagagggcactggatatgctggtaacatctaccgcgatctggtcagtgccttcgacgttctgcaacaagggaatatctccatcctgtctcgcaggtgtctgcttcggcctagtgaacctgacagtacgggatatatcgtgattggcgtaatgtacggcctgtgtttttttattaccctgtttggctcttatgtttctcgcctgcgacgcgtgatctgcgcaagttactacccttcccgggaacaagagaggattagctatctctataatgtgctgctctcacgacgtaccaatctgctcgccgcactccaccgcagcgtgagacgcagggcagcagatcagggccatagatctgcatttctggtgctggcctcacgctgcccatgcctggggccattcgtgtctcatttctggctccatcaggcctactgcctgggatgtggccaacctcaggacgaaggcgacatggaaaatacagtatcatgcagcacccccggttgccagggcctgtactgcctcacatgcttccggctgctggacaacacatgcagtgtctgtgcatcgcccctcagctaccagggtgacctggatctcgagctggacagctccgacgaggaaggcccacagttgtggcttgcagccgctcagcggaaggatcctgagcaggcgtggctgctgcagcagcaactacaggaggttctggggcgaagcctgtctatggaaagcacgtccgagtcttctgacttggatgaggaaaaggggccacaacaacgaaagcatggtcagcagccactcccagaggctcaccaacccgtctccattcttacgtcccccgagccccatcggcctccagaaaccagctctgcaacaaaaggtgcacctaccccagcctcggaaccatctgtccctctctctccgccatctctgcctgatcctagccacccccctcccaaatag

SEQ ID NO: 49752 - DNA, 1563 bp, Artificial Sequence
  Description of Artificial Sequence: Synthetic coding sequence
atggggcctaccaggaaaccaaatgtttgcagtcggcttagccggagagcgctcggctgcttcagtcgtgatgcaggagtcgttcagaggaccaatttgggcattttgcgcgcactcgtatgccaggagtctacgaagtttaaaaatgtgtggaccacgcactctcgtagtcccatcgcatacgaacggggtcggatatactttgataactatagaagatgcgtctcttctgttgcatccgagccccgaaaactttatgagatgcccaagtgttctaagtccgaaaagatcgaggatgctttactctgggaatgccctgtgggcgacatactgcccaattccagcgattacaagtcatctctcattgcactgactgcccataattggctgctgagaatttccgctaccacaggtaagattctcgagaaaatctacctggcaccttattgcaagtttaggtacctgtcctgggacacacctcaggaagtcatagccgtgaagtctgcacaaaaccgcggatccgctgtcgcacgccaagctggaatccagcaacacgtgcttctctatttggcagtgtttcgcgtacttccgtttagcctggtaggaatcctcgagatcaacaaaaaaatcttcggcaacgtgactgacgctaccctttcccacggaattctgatcgtcatgtattcatcaggtctggtgagactttatagtttccagactatcgctgagcagttcatgcagcagaaactcgatctggggtgtgcctgtagatggggtggcaccacaggcacagtgggcgaagctcctttcggcattccctgcaatattaagattacagatatgccaccactgctgtttgaggtgagtagtctagaaaatgcctttcaaatcggagggcacccttggcattacatcgtgacacctaataagaagaagcagaaaggcgtgtttcatatatgcgcactgaaggataattcactcgcaaaaaacggtattcaggagatggattgttgcagcttggagagtgattggatatattttcaccctgacgcgtccggccgtataattcacgttggccctaaccaggtgaaagtcctgaagcttactgaaatagagaataactcctctcagcatcagatctccgaggattttgtgattctagccaatagggagaatcacaaaaatgagaatgtgctcaccgtcacagcgagcggtcgggtggttaaaaagtcttttaacctactcgatgacgaccccgagcaagagacattcaaaattgtggactatgaagacgaactggatctgcttagcgttgtcgccgtgacacagatcgacgcagagggcaaagctcatttagattttcattgcaatgagtacggaacacttctgaaatcgataccgcttgtggaaagttgggacgtgacctacagccatgaggtttacttcgacagagacctggtgctacacattgagcaaaaaccaaacagagtgttttcttgttatgtttaccaaatgatatgcgatacaggagaggaagaggagactattaacagatcatgttag

SEQ ID NO: 49753 - DNA, 813 bp, Artificial Sequence
  Description of Artificial Sequence: Synthetic coding sequence
cggcatagcacaacatgttttgccgttccttgcagcgtgccctcttccaccttctttacatgcagggactctcgtgatcagcaaaaggacatgccacccctgctgttcgaggttagttcactcgagaatgcattccagatcggcggtcatccatggcattacatcgttacgccaaataagaagaaacagaagggtgtctttcacatctgcgcactgaaggacaattcactggctaagaacggaatccaggaaatggattgctgcagcctggagtctgattggatatattttcacccggatgcttccggcagaattatacacgtaggacctaaccaggtgaaagtcttgaagctcacggagattgagaataattcgtctcaacaccagatttctgaggattttgtaatactagccaacagggaaaaccacaaaaacgagaacgtgttgactgtgacagctagcgggcgtgtcgtgaagaagagctttaacttactcgacgacgacccggagcaggaaacattcaagatcgtagactatgaggacgagctggatctcctctccgtagttgccgtgacccagatcgacgccgagggcaaagcacaccttgacttccattgcaatgagtacgggactctcctgaagagtattcctctcgtagaatcatgggatgtgacatactcccacgaagtttacttcgaccgggatcttgtgctgcatatagagcaaaaaccgaatcgtgtgttctcctgctacgtgtaccaaatgatctgcgacactggcgaggaagaggaaaccatcaaccgctcttgttag

SEQ ID NO: 49754 - DNA, 1362 bp, Artificial Sequence
  Description of Artificial Sequence: Synthetic coding sequence
atgggccctaccagaaaacctaacgtatgcagccgcttgtctaggagagcacttggatgtttcagccgagacgcaggggttgtgcagaggactaacctcggaatcctccgcgcactggtgtgccaagagtccactaaatttaaaaacgtgtggacaactcattcgcggagccccatagcctatgaacgtggacgtatttattttgacaattatcgtaggtgcgtgtctagcgtggcttccgagccacggaagctgtacgagatgcctaagtgctctaaaagcgagaagatcgaggatgcactcctgtgggaatgcccagtcggcgatatccttcctaactctagcgattacaagtctagcttaattgctctgactgcacacaactggctcctgcgtatttcggcaacaaccgggaaaattctagagaaaatttacctcgccccttattgcaagttccggtatttgtcatgggacacgccccaggaggttatcgcggttaagtcagcgcagaatcgcggtagcgccgtggctcgccaggcgggtattcagcagcatgtcttgctctatttggcggtcttccgggtattgccgttctccttagtcgggattcttgagatcaataagaagatcttcggaaacgtgacagatgcgactcttagtcacggtatcctgatcgtgatgtacagcagtggcctcgtgaggctttatagcttccagacaatcgctgaacagttcatgcagcagaagctggatctgggatgtgcctgtcggtggggcggaacaacggggaccgtgggagaggcccctttcggcatcccttgcaacatcaagatcacggatatgcctccactccttttcgaggtgtctagtctggaaaacgcttttcagattggcggtcatccttggcactacatcgtgactccaaacaaaaagaagcaaaaaggagtgtttcacatttgcgcactcaaggataactccctcaacgaaaatgtcctcacggtaacagcttctggacgcgttgtgaagaagtccttcaacttactggacgatgatccggagcaggaaaccttcaaaattgtggactacgaagatgagttagatctgctgagcgtagtcgccgtaacgcagatagacgccgagggaaaagcccacctcgacttccattgcaatgagtacgggacactgcttaagtccattcctttagtggaatcctgggatgttacttatagtcatgaagtctatttcgacagagatctcgtcttgcatatcgagcaaaaacccaaccgcgtgtttagctgctacgtctatcaaatgatctgtgacactggagaggaggaggagactatcaatcggtcatgctag

SEQ ID NO: 49755 - DNA, 945 bp, Artificial Sequence
  Description of Artificial Sequence: Synthetic coding sequence
atggtggcccctgtgtggtatcttgtcgcagctgcccttcttgtcgggtttatcttattcctgactcgaagccggggaagggccgcaagcgctgggcaggagcctctacataatgaagaactcgccggtgctggtcgcgttgcacagcctggaccactggaacccgaggagcccagagccggaggtcgccctaggagacgacgagatcttgggagcaggctgcaagctcagagacgggctcagcgtgtggcgtgggccgaagcggacgaaaatgaggaggaggcagtgatcctcgcccaggaagaggaaggagtggagaagccggcagagacccacttgtctggtaagattggggctaagaagctccggaaattggaggagaagcaagctagaaaagcccagagagaggccgaagaggcggaacgggaagagcggaaacggctcgagagtcagcgcgaggccgagtggaaaaaggaagaggagcggctcagactcgaagaggagcagaaggaggaggaggaacgcaaggcgagggaagagcaagcgcaaagagaacacgaagagtaccttaagctcaaggaggcttttgtggtagaagaggagggagtgggggaaacgatgacagaggagcagtcccagagcttcttgacagagtttatcaattacattaagcagtccaaggtcgtgttactcgaggatttggcctcgcaagtggggctgagaactcaagacaccattaacagaatccaggacctcttagctgagggcactattacaggcgtgattgatgatcggggtaaatttatttatattacacctgaagagctggcagctgtcgcaaactttattcgtcagcgcggtagagtctctatcgctgaactggcccaggccagcaatagccttatcgcctggggcagggagagcccagcccaagctccagcatag

SEQ ID NO: 49756 - DNA, 897 bp, Artificial Sequence
  Description of Artificial Sequence: Synthetic coding sequence
atggttgcccctgtctggtacctggttgcagcggctttactcgtgggcttcattctcttcctcacaaggtcacgcggacgcgctgcctctgccggacaggagccactccataacgaggagctggctggcgctgggagggtggctcagcctggaccactggagccggaagaaccgagggccggaggtcgaccaaggcggaggagggatttgggaagtcgtcttcaggcccaacggagggctcaaagggtagcatgggcagaagccgatgaaaatgaggaggaggccgtgatcctggcccaggaagaagaaggcgtggaaaaacccgctgagacccacctaagcggaaagattggggctaagaagttacgcaagctggaagagaaacaagctcgcaaggcccagcgagaggccgaagaggctgagcgggaggaacgaaagaggcttgagtcccagcgagaggcagaatggaagaaagaagaggagagactaaggctcgaggaagaacaaaaggaggaagaagaaagaaaggcacgtgaggaacaggcccagagggagcatgaggagtatttgaagctgaaggaggcatttgtggtagaagaggagggcgtgggcgaaaccatgactgaggaacaatcgcagagcttccttacagaatttattaactatatcaagcaatctaaagtggtgttactggaggatttggcaagccaggtgggcctgaggacacaggttagccctgggacatggccagccgtctgctccgtggcacgtgggctctggttggcagaacggacttgccccaaggaccgggtcttaatgcacaggttaccgtgcccacagcctcgagtgtctagcgcacagaaatcgcccggaaccctggggattttgcacttctag

SEQ ID NO: 49757 - DNA, 942 bp, Artificial Sequence
  Description of Artificial Sequence: Synthetic coding sequence
atggttgccccagtgtggtatctcgtcgcggcagccctgttagtgggctttattctctttctgacaagaagtaggggcagggctgctagtgccggacaggaaccactgcacaacgaggagctggcaggggctgggagggtggcacagcccggaccgctggaacccgaggaaccaagggccggtggacggccaagaagacggagggacctcggttcccgccttcaagctcaacgcagagcccagagggttgcctgggcggaagccgatgagaacgaagaagaggccgtgattctggctcaagaggaggagggggtggagaagcccgctgaaacacacctttctgggaaaattggcgctaagaaactgcgaaaactggaagagaaacaggcgagaaaggcacagcgagaagcagaggaagctgagagggaggaacggaagcgacttgagagtcaacgagaagccgaatggaaaaaggaggaggaaagactccgtctagaggaggagcagaaagaggaggaggagcggaaggccagggaggaacaggctcagagagagcatgaagagtacctgaaactgaaagaggctttcgtcgttgaggaggagggcgttggagaaaccatgacggaggaacaaagccagagttttctgaccgagttcatcaattatatcaagcagtcaaaagtcgttctgctggaagacctggcaagccaggtgggtttgcgcacacaggtgagccctgggacctggcctgccgtttgctccgtagccaggggtctgtggttggccgaacgtacgtgtcctaaggatagggtcttgatgcaccgcctgccctgtccccagccccgtgtgtcatccgctcagaagagccctggcaccctcggcatactgcacttttcattgatcgcttggggtagagagtcccctgcacaagcacccgcttag

SEQ ID NO: 49758 - DNA, 324 bp, Artificial Sequence
  Description of Artificial Sequence: Synthetic coding sequence
atggctaacgaggtccaggacctgctgtcgcctagaaaggggggacaccccccagctgttaaggcaggtggcatgaggatcagcaagaagcaggagatcggcactctggagaggcacacaaagaaaacaggctttgagaagaccagcgctatcgccaacgttgccaagatacagacactggacgctctgaacgacgctctggagaagctcaattataagtttcccgcaactgtacacatggctcatcagaaacccacaccagccctggagaaggtggtaccccttaagaggatctacattatccagcagcctcgcaagtgctag

SEQ ID NO: 49759 - DNA, 2760 bp, Artificial Sequence
  Description of Artificial Sequence: Synthetic coding sequence
atggcttcagctacagctgcagccgctcgacggggtcttggtcgcgctctgccattattctggagaggataccaaaccgagagaggcgtgtatgggtatcgtcccagaaagcccgagagcagagagccgcaaggcgcactggagaggccccctgttgaccatggcctggctcggctggtcacagtgtattgcgaacacggccacaaggctgccaaaattaatcctctgttcactggacaggccctgttagaaaacgtcccggagattcaggcgctggttcaaacccttcaaggcccattccacacagctggactgctcaatatggggaaagaggaggcctccctggaggaagtactcgtgtatctgaaccagatttactgtggacagattagtattgaaacttcccagctgcagtctcaagacgaaaaggactggttcgcaaaaagatttgaggagctgcagaaagaaacctttacgaccgaggagcgtaaacacttatccaagcttatgcttgagagtcaagagtttgaccatttcctggctacgaaatttagtacggtgaaaaggtacggcggagagggtgccgaatctatgatgggattcttccatgagctcctcaagatgagcgcatattctggcatcaccgatgtgattattggcatgcctcatcggggtagacttaatctgttaaccggcctcttgcagttccctcccgagcttatgttcaggaaaatgcggggactcagcgagtttcccgagaattttagcgccaccggagacgttcttagtcatctgaccagttcagtagacctctattttggagcccaccatcctttgcatgtcaccatgttaccaaacccaagccatctggaagctgtcaaccccgttgcggtcggaaagacacgcggacgtcagcaaagccggcaggacggcgactactccccagataattcagctcaacccggagaccgtgtaatctgtctgcaagtgcatggcgatgcaagcttttgtggacaagggatcgtaccagagaccttcaccctgagcaacttgccccactttagaatcggcggaagtgttcatctcatagttaacaatcagttaggttacactaccccggctgaacggggacgctcatctctatattgcagtgacatagggaagcttgtcggctgcgcaatcattcatgttaacggcgattcgcctgaggaagtagttcgcgcaacacgattggctttcgagtaccagaggcagtttcgaaaggatgtgattatcgatctactgtgctatagacagtggggccacaacgagctggacgagccattttataccaaccccatcatgtataagattattagggctcggaagagcattcctgatacttacgcagaacacctaatagccggaggactaatgactcaggaagaagtgtcggaaataaagtcaagttattacgctaagcttaacgatcatctgaacaacatggctcattatcgcccaccggctctgaatctgcaggcacactggcaggggctggctcaaccagaggctcagatcacgacttggagcaccggagtccccctggatcttcttagatttgtcggtatgaagtccgttgaagttccgcgagaacttcagatgcatagccacttactcaaaactcacgtacaatctaggatggaaaagatgatggatggaataaaactcgactgggcaactgcagaagcactggccctgggaagtctgcttgctcagggctttaacgttaggctgtcgggccaggatgtggggagaggaaccttttcacaacggcatgccatcgtggtatgccaggagacagatgacacctatataccactcaatcatatggatcccaaccagaagggttttctcgaggtatccaacagccctcttagtgaggaagccgtgctgggcttcgaatatggtatgagcatcgagagcccgaagctcctgccattatgggaggcacagtttggtgatttcttcaacggcgcacagatcattttcgatacttttatcagcggtggtgaagcaaagtggttactgcagtccggcattgtgattctgcttccacacggatacgacggagccggacccgatcactcttcctgcagaattgaacgctttctgcaaatgtgcgactctgctgaggagggcgtggacggcgatacagtgaatatgttcgtagtccaccctaccacccccgcacagtatttccaccttctgcggcgacaaatggtcaggaatttccggaaacctctgatcgtcgcatccccgaagatgctgctccggctgcctgccgcagtcagcacacttcaggaaatggcaccaggcacaaccttcaacccagtgatcggggatagctcagtcgatcctaaaaaggtaaagactcttgtgttctgttctggaaaacacttctacagcctggtgaaacaacgagagtcgctcggcgctaagaagcacgatttcgctattattcgggtggaggagctctgtcccttccccttggactccttgcaacaagaaatgtctaaatataagcatgtgaaggatcacatttggagccaggaagaaccacagaacatgggaccgtggagcttcgtaagccctagatttgagaagcaactcgcctgtaagttgcggctggttggtcggccaccccttcctgttcctgccgtgggcattgggaccgtccaccttcaccagcacgaagacatactggcaaagacattcgcttag

SEQ ID NO: 49760 - DNA, 486 bp, Artificial Sequence
  Description of Artificial Sequence: Synthetic coding sequence
ggccgacagcaatcaaggcaagacggtgactactcacccgataactccgcccagcctggcgatcgcgttatctgtctgcaggtccacggcgacgccagtttttgcggtcaggggattgtgccggaaacttttacattgtcaaacctccctcattttcgaatcggcggatctgtgcacctcattgtgaacaaccagctgggatacaccacacctgcggagcgcggaaggtccagcctatattgctcagacattggaaaattagtgggatgtgccataattcacgttaatggggattctcctgaggaagtggtgagagccacgaggctggccttcgagtaccaacggcagtttcgtaaagacgtgattatcgatctactgtgctaccgtcagtgggggcacaacgagctcgatgagccattctacacgaacccaatcatgtataaaattatcaggtacaattacaaaccattgtgcgacatgccatag

SEQ ID NO: 49761 - DNA, 927 bp, Artificial Sequence
  Description of Artificial Sequence: Synthetic coding sequence
atggcttcggccaccgctgctgctgctagacggggactaggcagggcattgcctctgttctggaggggatatcagacagagcggggagtgtacgggtaccgacccaggaagcctgagtcaagagagccccagggcgctctggaacggccaccagtggaccacggcctggccagactggtgactgtttattgtgagcatggccataaagccgctaagattaatcctctgttcaccgggcaggccttactggagaatgttcccgaaatccaggccttagtgcagacactgcaggggccttttcatactgccggactgctgaatatgggcaaggaggaagcttcgcttgaggaggttctggtttacctcaaccagatatattgtggccagattagcattgagacaagccagctgcagtcacaagacgagaaggactggttcgctaagcgattcgaagaactgcagaaggagacatttacgactgaggaacggaagcaccttagcaaactcatgctggagtctcagttgatgttcagaaaaatgcgtggtctgagcgaatttcccgaaaattttagtgctacgggggacgtgctttcccatctgacatcaagcgtagacctctactttggagcccatcacccactgcatgtgacaatgctccctaacccctctcacttggaagccgtaaacccagtggcagtgggaaaaacaaggggccgacaacagtctagacaggacggcgattatagtccagataattcagcccagccaggagacagggttatatgcctgcaagttcacggcgacgcttctttctgtggtcaggggatcgtgccggagacctttactctgtctaaccttccgcactttcgcatcggtggttctgtacatctcatcgtgaacaaccagctgggctacaccaccccttag

SEQ ID NO: 49762 - DNA, 645 bp, Artificial Sequence
  Description of Artificial Sequence: Synthetic coding sequence
tgaaaaatcattcgggcacggaaaagcatccccgatacatacgcagagcacctgatcgcaggtggcctcatgactcaggaagaagtgagcgagattaagtcatcctattacgccaagttaaatgaccatttgaataacatggcccactacagacccccagcactcaacttacaagcgcactggcaagggcttgcacagcccgaggcacagattaccacttggtcaaccggcgttccattggatctcttgcggttcgtgggaatgaagagcgtggaggttcccagagaactgcagatgcattcccacttgctgaagacccatgttcaatcaaggatggaaaagatgatggatggaatcaagctggattgggccaccgccgaagcacttgctctcgggtctctgttggctcaaggcttcaacgtcaggctttctggccaggacgtcgggagagggacattttcacaacggcatgctattgtcgtgtgtcaggaaaccgacgacacctatattcccctgaaccacatggacccaaaccagaaaggttttcttgaagagcgaccttctggaagctataaggccgcaagtagttcttcatttcacatggcgactatgggcctgggacagacgacacaccctgtggaatag

SEQ ID NO: 49763 - DNA, 942 bp, Artificial Sequence
  Description of Artificial Sequence: Synthetic coding sequence
atggcggctcccatgaatggccaagtgtgcgtagtcacaggcgcttccaggggaattggcagggggattgcactgcagctctgtaaagctggtgccacagtttacattactggcaggcatttggatacactgcgggttgttgcacaagaggctcagtctctgggcggacagtgtgtgccagtggtttgcgattccagccaggaaagcgaggtgcgatccttgttcgagcaagtcgatcgcgagcagcaaggcaggctggatgtgctcgtaaacaacgcgtacgcaggagttcagacgattttaaatactagaaacaaagccttctgggagacccctgcttcaatgtgggatgacataaataatgtgggacttagaggacattacttttgctcagtttacggagcaagacttatggtgcccgctggccaaggccttatcgtggttatctcatcccctggctctctgcagtacatgtttaacgtgccatatggagttggcaaagccgcttgcgataagttagccgctgactgtgcccatgagctgagacggcacggagtctcctgtgtctccttgtggccaggaatcgtccaaacagaactgctgaaggagcatatggctaaagaggaagtgcttcaggatcccgttttaaagcagttcaagagcgcctttagttccgctgagacgaccgagttgtctggcaagtgtgtcgtggcactcgcaacagacccaaacatcctgtccctgagcgggaaggtgctgccgtcttgtgacctagcacggcgttacggactcagggacgtggatggcaggcctgttcaggattacttgagcctcagttctgtgctatcacacgttagcgggctcgggtggctggctagttacttgccaagtttcctgagggtgccgaaatggatcatcgctctgtacacatcaaaattctag

SEQ ID NO: 49764 - DNA, 942 bp, Artificial Sequence
  Description of Artificial Sequence: Synthetic coding sequence
atggccgctcctatgaacggccaagtgtgcgtagtgacaggggcatctcgtgggattggcaggggaatcgcactccagctttgcaaggccggagccaccgtttacattacaggcagacacttggacactctacgcgttgtggcccaggaagcccagagcctcgggggtcagtgtgtaccggtggtgtgtgattccagtcaggaaagcgaagtgcggtccctcttcgaacaggtcgaccgggagcaacagggcagactggatgtgctagtgaacaatgcatacgcgggagtccagaccatattgaacactaggaacaaagcgttctgggaaaccccggcatctatgtgggatgatataaataatgtgggacttcgaggtcactatttctgtagcgtgtacggggcaagattaatggtgcctgccggacagggcctcatagtagtcatctcctcacctgggtctttgcagtacatgtttaacgttccgtacggcgtggggaaggccgcttgcgacaagcttgcagctgattgtgcccacgagctgcgtaggcacggtgttagttgtgtgtccttgtggccaggcattgtgcagacagagcttctcaaggaacatatggccaaggaggaggtgctgcaggacccggtgctcaaacaatttaagtccgcgttttcgagtgcagaaaccaccgaactctccggaaagtgtgtggtggcactggcgactgatccaaatattctatcactgtcaggcaaagtgctcccctcatgtgatctggcccgacggtacggcctgcgagatgtggacgggagacctgtacaggactatttatccctctctagtgtgttgagccacgtgagcggacttggctggcttgcgtcttacctgccctcatttttgcgcgttcctaagtggattatcgccctctatacatcaaagttctag

SEQ ID NO: 49765 - DNA, 978 bp, Artificial Sequence
  Description of Artificial Sequence: Synthetic coding sequence
tttatcagtggtagcagtagaaagagcctgcccaaggtgaaagccatggattttattacgtcaactgcaattttaccactgttgtttggatgtctgggcgtgttcggactgtttagactccttcagtgggtgcgtggcaaagcatacctgcgcaatgcagtggtagtgatcaccggggcaacgtctgggttggggaaggagtgcgcaaaagtattctacgccgctggagccaagttagttctctgcgggcgtaatggaggagcattggaggaactgattcgcgaactgactgccagccatgcaacgaaggtccagacacacaagccttacctggtgaccttcgatctaaccgattcgggtgctatcgtggccgcagctgcggagattctccagtgtttcggctacgtggatatcttggtgaataacgccggtatatcttacagggggaccatcatggatacaacagtggatgttgataaacgcgtgatggaaaccaattattttggcccagttgcattgaccaaggcactcctgccatcaatgatcaagcggagacagggccatatcgtggcgattagcagcattcaggggaaaatgtctattcctttccggtccgcctacgcggcttccaaacatgccacccaggccttcttcgattgtcttcgggctgaaatggagcaatacgaaattgaggttaccgtcatctctcccggttacatccatacaaacctcagcgtgaacgcgattacagcagatggctcccggtacggtgttatggatacaacaacagcccagggcagaagccccgtggaagtggctcaggatgtgcttgcggctgtgggtaaaaaaaagaaggatgtgattctcgccgatcttctccctagccttgccgtgtacctgaggacattggcccctggcttgtttttcagtcttatggcttcgagggccaggaaagaaagaaagagcaaaaattcatag

SEQ ID NO: 49766 - DNA, 978 bp, Artificial Sequence
  Description of Artificial Sequence: Synthetic coding sequence
atggtctctccggcaacccgcaaatcactccctaaggtgaaggcaatggattttatcacctcaaccgcgattctgcctctgctgtttggatgcctcggggtgttcggcctgtttagactccttcagtgggtcagagggaaggcctatctgcgcaatgctgtcgtggtaatcacgggcgctacttctggcctgggcaaagaatgcgctaaggtgttttatgcagcaggagcaaagttagttctttgtggccgtaacgggggagcactggaagagttgatccgggaactgactgcaagtcacgccacaaaggttcagacgcataaaccttacttggttaccttcgaccttactgattctggcgcaatcgtggctgcagcggctgagattctgcagtgtttcggttacgtggacattctggtgaataatgccggaatctcatatcggggaactatcatggacacgaccgtcgacgttgataaacgggtgatggagacaaattacttcggtccggtcgccctcacaaaagctctgcttccttccatgatcaaacggagacaggggcatattgtcgccatctcgtctatacagggaaagatgtcgatacccttccggagcgcctacgcggctagcaaacatgccacacaggctttttttgattgtctgagggccgaaatggaacagtacgaaattgaggttaccgtgatcagccccggatacatccatacaaacctgagcgttaatgccatcacagccgatggctctcggtatggagtcatggacacgacaacagctcagggccgatctcctgtcgaagtagcccaagatgttctggccgcagtaggaaagaaaaagaaggacgtaatattagccgatttgctgccaagtctcgccgtatacctgaggactttagcaccaggattgttcttttctctcatggccagcagggcgcgaaaagagcggaaatcaaagaactcttag

SEQ ID NO: 49767 - DNA, 4587 bp, Artificial Sequence
  Description of Artificial Sequence: Synthetic coding sequence
atgtcagtggccatcaggaagaggagctgggaagaacacgtcacccactggatgggacagccctttaacagcgacgaccggaacaccgcttgccatcacgggctggtggcagatagcctccaggcatctatggaaaaagatgcaaccctgaacgtggacagaaaggaaaaatgcgtgagcctgccggactgctgccacggaagtgaattgcgggatttcccaggaaggcctatgggccacctatctaaagacgtcgacgaaaatgactctcatgagggagaagatcagtttcttagccttgaggcgagtacagagactttggtacacgtgtcggatgaagacaataatgccgatttgtgcctgaccgacgacaaacaggttttaaatacacaggggcagaaaacatcaggtcagcacatgatccagggggctggatctctggagaaagccctgccaattattcaaagtaaccaggtaagttccaactcctgggggatagccggtgaaaccgagctggcccttgtgaaggagtctggggagcgcaaagtgaccgatagcatctctaagagcctcgagttgtgtaatgagatttcattgtcagagatcaaggacgcccctaaagttaatgctgtcgacaccctgaatgtgaaggacatagccccagagaaacaactgctcaattccgctgtgatcgcccagcaaaggcggaagcctgacccccctaaagacgaaaatgaacgaagcacttgcaacgtggttcagaatgagttcctggacaccccttgcaccaatcgtggcctacctctgctaaagactgattttggaagctgtctcctgcagccaccttcttgtcctaacggtatgagcgccgaaaacggcctggaaaagtctggcttctctcagcaccagaacaagtccccgcctaaggtcaaagccgaggacggcatgcagtgtttgcagcttaaagaaaccttagccacccaggagcctaccgacaatcaagtgcgcctccgtaaacggaaagagatacgcgaggatcgtgacagagcaaggctggatagcatggtcctcctcatcatgaagttagaccagcttgaccaagatatcgaaaacgctctttctaccagttccagccctagcggaactcctactaatctgagacgccacgtacccgacctggaatccggctcagagagcggcgctgatactattagcgtgaaccagacccgagtcaatctgtcctccgacaccgaatccaccgacctgcccagcagcacccctgtggcaaacagcggcacaaaaccaaagacaactgccatacagggaatctctgaaaaagagaaagctgagatagaagctaaggaggcctgcgattggctacgcgcaactggcttccctcagtacgctcaattgtacgaagattttttattccccatagacatcagcctggtaaagcgcgagcacgacttccttgaccgggacgccattgaggctctatgcaggcgtctgaatacccttaacaaatgcgccgttatgaagctagagatatctcctcatcggaagaggtcggacgatagcgatgaagatgaaccttgcgcaattagtggcaaatggacctttcagagggactcaaagcggtggtcccgcctggaggaattcgacgtgttcagcccgaagcaagatctggtgccagggagccccgacgactcacatcccaaagacggcccatccccgggaggcaccctgatggacttgagtgagcgccaggaagtgagttcagtgaggtccctatcctcgacaggatcgctcccctcccacgccccaccatccgaagatgctgccaccccccgaactaactctgttatctccgtgtgctcatccagcaacctggccggaaatgacgactcatttggcagcctaccaagtccaaaggaactgagcagcttctcattcagtatgaaaggccatgagaagaccgctaagagtaaaactcgctcacttttgaagaggatggagagccttaaactcaagtcctctcatcattccaagcacaaggcgccaagcaagctcggactcatcatctcaggcccaatactccaggagggcatggacgaagagaaactgaaacagttgaattgtgtcgagataagcgccttgaacgggaatcgcataaacgtcccaatggtgcggaagaggagcgtctcaaattctacacagactagctcttcttccagtcagagtgagacctcatcggccgtgagcacccctagtcccgtgacacggacaagatctctgtccgcttgcaataagcgcgtcggtatgtacctggaggggtttgatccttttaaccagtcgacctttaataatgtggtggagcagaactttaagaaccgtgagtcgtaccctgaggatacagtgttctatatccccgaggatcacaagcccggtacattccctaaagcattgaccaacggctcctttagcccctctggcaacaatggctccgtgaattggcggaccggctcgtttcatggacccggacacattagccttagaagagagaattccagtgattctcccaaagagctgaagcgacggaactcaagctctagcatgagttcacgactaagcatttatgacaacgtgccagggtctatactatacagtagcagcggtgacttggcagacttggagaacgaagatatctttcccgagttggatgacattctgtatcacgtcaagggcatgcagcggattgtgaaccagtggtcagaaaagttttccgatgagggggactctgatagcgccctggacagcgtttctccttgcccttcctcgccaaaacagattcatcttgacgtcgacaacgaccgaacgacccccagcgatctggactctaccgggaactcgctgaacgaacctgaagagccctctgagattcctgagcgcagggatagcggagtcggcgcttcactcacacgctctaatcgccatcggctgcgctggcactcctttcaatccagccacagaccctctttaaatagcgttagcttgcagataaactgtcaaagtgtggcccagatgaatctcctccagaagtacagtttgctgaagttgacagctctattggaaaaatacactccctcaaataaacacggcttcagctgggcagttcccaagttcatgaagcgaatcaaggtacccgactacaaggatcggtctgtttttggcgtgccactgaccgtgaacgtgcagcggacaggacaaccattacctcagtctatccagcaagccatgaggtacctgagaaaccactgtcttgaccaggtgggcctgtttaggaagagcggggtgaagtccaggatccaggccctgaggcagatgaacgagggtgctatcgattgcgtgaattatgagggtcaatccgcttacgacgtggcagatatgctgaaacagtatttcagagatctgccagagccattgatgaccaataagctaagcgaaacatttctccagatctaccagtatgtgcccaaggatcagagactccaggccattaaggcagcaatcatgctgcttcctgacgagaatagggaggtgcttcagaccctcctttacttcctaagcgatgtaacggccgcagtgaaagagaaccagatgaccccgacaaacctggctgtgtgtctcgcaccttccttgttccacttgaatacccttaaacgagaaaatagcagccctagggtgatgcagagaaagcagtctctcggcaagcccgaccagaaggacctcaatgaaaatctcgctgctacacaggggctggcccacatgatagccgaatgtaagaagctctttcaggtgcctgaagaaatgtccagatgccggaacagctatacggagcaggagcttaaacccctgacactggaggccctcggacatctcggtaatgacgactcggccgattaccagcactttctccaagattgcgttgatgggctgtttaaggaggtgaaagaaaaattcaaaggctgggtgtcatatagcacttcggagcaagccgagcttagctacaagaaggtgtcagagggaccaccgctgagattatggcgatctgtaatcgaggtccccgctgtgcccgaagaaatacttaagaggctgttgaaagagcagcacctttgggacgtggacctgctcgattccaaagtgatcgaaatactggactctcaaactgagatctatcagtatgtgcagaactcaatggcaccacaccctgcccgagattacgtggtcctgagaacttggcgcaccaatctcccgaagggcgcatgcgccttgctgcttaccagtgtcgaccatgatcgggcacccgtggtgggcgtgcgggtgaacgttctgctgagcaggtaccttattgaaccctgtggccctggaaaaagcaaacttacctacatgtgccgcgtcgatctccggggtcacatgccggagtggtacacaaaaagcttcgggcacttatgcgccgctgaagtagttaagatcagggacagctttagtaatcagaacactgagactaaggataccaaaagccggtag

SEQ ID NO: 49768 - DNA, 1497 bp, Artificial Sequence
  Description of Artificial Sequence: Synthetic coding sequence
atgagtgttgcaattcggaaaagatcctgggaagagcacgtgactcattggatgggccaaccgtttaatagcgatgacagaaacaccgcatgtcaccacgggctggtggccgactctctgcaggcgagtatggaaaaggatgcaacactgaacgtagatagaaaagagaaatgcgtcagtttaccagactgttgccatgggtctgagttgagggactttcctgggcgaccaatgggccacttaagtaaggatgtcgatgaaaatgatagccacgagggggaggaccagttcttgagcctagaggccagtaccgagacattggttcatgtctccgacgaggacaacaacgctgatctctgtctaactgacgacaaacaggtattaaacacacaggggcagaaaacgagtggccaacatatgatacagggagcaggctcgctggaaaaagccctacctattatacagtcaaatcaagtgtcttccaattcttgggggatcgctggggagaccgaactggccctggtgaaggaaagtggggagagaaaggtgactgactctatctccaaaagcctcgagctttgtaacgagatatccctctcggagatcaaagacgcaccaaaggtcaatgccgtggacaccctgaacgtgaaggacatcgcacctgaaaagcagctcctcaattctgccgtcatcgctcagcaacggagaaaaccggatcccccaaaggatgagaatgaacgatcgacctgtaatgttgtccagaacgaattcctggacacaccctgcaccaacagaggtctgcctctgctcaagacagactttggcagctgcctgctgcagccaccatcttgccctaatgggatgtctgccgagaacggcctcgagaagagcgggttttcccagcatcagaataaaagcccccctaaggttaaggcagaggacggaatgcagtgcctccagctgaaagagacacttgctacacaagagcctacagataatcaggttagattgcgcaagcgtaaggagataagagaggatagggatagggccaggcttgattctatggttttgctgattatgaaattggatcagctggaccaggacatcgaaaacgccctgagcacatcgtctagtccctccggcactcccactaatcttaggagacacgtccccgacctggagtccgggagtgaatctggcgctgataccataagcgtcaaccagacacgtgtgaatctctcatccgacaccgaaagcaccgacctaccctcttccacaccagtggccaattccggaaccaagcccaagacaacagcaatccagggcatcagtgagaaggaaaaggcagctgttaaatctgtcaagctggaggttgatgaagataagtctaccaagggctcaaacttttcgaacagcgaagttgcgataggactcagcccctacacttttccccaaaaaaggctgttccatgttgctggcgaggagaacatcacatag

SEQ ID NO: 49769 - DNA, 3276 bp, Artificial Sequence
  Description of Artificial Sequence: Synthetic coding sequence
atgtgccggaagaaaccagacaccatgattctgacccagatcgaggccaaagaagcctgtgactggctccgagccaccggcttcccacagtatgcccagctgtatgaggatttcctgtttcccattgacatctcgttggtgaaacgcgaacacgatttcctagacagggacgctatcgaggccttgtgccgtaggctcaacacattgaataaatgtgctgtcatgaagctcgagattagcccacacaggaagcgctcagacgattcggatgaagacgaaccttgcgcaataagtggaaaatggacctttcaacgagatagcaagcgatggtcccgcctggaggagtttgacgtgttttcccctaaacaggacttagttcccggaagcccagacgattcccacccgaaggatggaccatcccctgggggaaccttaatggacctaagcgaaaggcaggaagtgtcctccgttagaagtctgtcttccaccggatccctcccctcccatgcaccaccatccgaagacgcagcgacaccccgaactaatagtgtcatctccgtctgcagttcttctaatctagctgggaacgatgatagttttggtagtctcccatcacctaaagagctcagctcttttagctttagtatgaagggtcacgaaaaaaccgccaagagcaagactcgcagcctgttgaaacgaatggagtctctgaaactcaagagttcccatcattccaagcacaaggccccatctaaactggggctcattatttccggacctatcctccaggagggaatggacgaggagaagctaaaacaactaaactgcgtggaaatctccgccctcaatggaaaccgaatcaacgtgccgatggtgcgaaaaagatctgtgtccaactctactcagacttccagttcctcctcacagagtgagaccagtagcgctgtctcgacccccagccccgtgaccagaacccgaagcctttctgcctgtaataagcgcgtgggaatgtatctggaaggctttgaccccttcaaccagtccacctttaacaatgtcgttgagcaaaactttaagaacagggagtcttatccagaggacacggtcttttatattcctgaggatcataagcctgggaccttccctaaagcactgactaatggaagtttctcaccttcagggaataacggctcagttaattggaggacggggtccttccacgggccaggacatattagcctacgtcgggagaatagctccgactcccccaaggaactcaagcgccgtaactcttcaagcagcatgtcatctagactatccatttatgacaatgtgcctggctccattctgtactcttcatccggggacctcgcagacctggaaaatgaagatatttttccagaactcgatgatattctgtaccacgtcaagggaatgcagcggatcgttaatcagtggagtgaaaaatttagtgatgagggagattccgattctgcgctggatagcgttagtccctgcccttccagcccgaaacagatccacctagatgtcgacaatgaccgaacaacacccagtgacttggatagtactggcaatagcctgaatgaacctgaggagccatctgaaatcccggaaaggcgtgattccggtgtcggcgcaagtctcaccagatccaaccgccatagattgagatggcacagtttccagtcaagtcacaggccatcgttgaattccgtatctttacaaattaattgccaatcagtggctcagatgaatcttctgcagaaatacagtctactgaagctcactgcactcctggagaagtacaccccaagtaacaagcacgggttttcatgggccgtgccgaaattcatgaagcgcatcaaagtccccgattacaaagatagatcagtgttcggcgtcccactgaccgtgaacgtccaaaggaccgggcagcccctccctcagtccatccagcaagctatgaggtatctaagaaaccattgtctggatcaagtcgggctctttagaaagtccggagtgaaatcacgaattcaggctctccgccagatgaacgagggggctattgactgcgtaaattacgaaggacaatccgcttacgacgtggccgatatgctcaaacagtactttagagatctaccagagcctctgatgacaaacaagctgtcagagacgttcctccagatctaccagtacgtcccaaaagaccaaaggttacaggcaattaaggccgctatcatgctcttaccagacgaaaatcgagaagtccttcagacactgctgtatttcctgagcgatgtcacagccgctgtcaaggaaaaccagatgacacccaccaacttggctgtctgcttggctccatccttatttcatctcaatactctgaagagagaaaactcaagcccgcgagtgatgcagagaaagcaatccctgggaaagccggaccagaaagatcttaacgagaacttagccgctactcaggggctggcacacatgatcgctgagtgtaagaaactttttcaggttccagaagaaatgagccggtgtcggaactcctatacagagcaagagctgaaacccctcaccctcgaggcactaggtcatttgggtaatgacgattctgcagactatcagcactttctgcaagactgcgtagacggactattcaaggaggttaaggagaaattcaaagggtgggtgagctattcaacctccgaacaggctgaactctcatacaaaaaagtttctgagggacctccccttaggctttggcgcagtgttatagaagtccccgcagtgccggaggaaattcttaagcgcctgctgaaggagcagcatctgtgggatgtggatctcctggactcaaaggttattgagatactcgattcgcagactgagatttaccaatatgtgcagaacagcatggcgccacaccctgcccgagattatgttgtattgcgcacttggcggacaaatctccctaagggtgcttgcgccctattgcttacctccgtcgatcatgatcgagccccagtcgtcggcgtccgtgttaatgtgctgctctctaggtacctcatcgagccgtgcggtcctggaaagagcaagctgacatatatgtgtagggtagaccttcgcggtcacatgccagagtggtacacaaagagcttcggacatctgtgcgcagccgaggttgttaagatccgggatagcttctccaaccaaaacaccgagactaaagacacgaagagcaggtag

SEQ ID NO: 49770 - DNA, 972 bp, Artificial Sequence
  Description of Artificial Sequence: Synthetic coding sequence
atgggttccagggtgagcagagaggatttcgagtgggtgtacaccgaccagccacacgccgatcgcaggcgcgaaattttggctaagtaccctgaaataaagtcccttatgaagccagatcccaacctgatctggatcatcataatgatggtcttgactcagcttggtgcattctatatcgtcaaggacctcgattggaagtgggtgatcttcggggcttacgccttcggttcatgcattaatcatagtatgacgctcgcaatacacgagattgcacacaacgccgcttttggcaactgcaaggcaatgtggaacaggtggtttggaatgttcgccaacctacctattggcataccttacagtatatcatttaagaggtatcatatggaccaccataggtacctgggggctgacggggttgacgtggacatcccaaccgatttcgaggggtggtttttctgtaccgcattccgaaagttcatttgggtcattctgcagccgctgttttacgccttccggcctctgtttatcaatcccaaaccgataacatatcttgaagtaataaatactgtcgcccaggtcacttttgacatactgatttactacttcctagggatcaaatccttggtttacatgttagcggcttctttactgggactgggccttcaccccatctctggccacttcattgccgagcactacatgtttcttaagggtcatgaaacatactcttactatggacctttgaatctgctcactttcaacgtcggctaccataacgaacaccacgatttccctaacatcccgggtaagtctttgccacttgtgcggaaaatcgcagcggaatactacgataatctcccacattataactcatggattaaggtgctctatgacttcgtgatggatgacactatcagcccatattcaaggatgaagcgccaccaaaagggcgagatggtgcttgaatag

SEQ ID NO: 49771 - DNA, 972 bp, Artificial Sequence
  Description of Artificial Sequence: Synthetic coding sequence
atgggtagcagggtatccagagaggacttcgagtgggtgtacacagaccagccccacgcggacagaagaagagagatcctcgccaagtacccagagattaaaagtttgatgaaacctgaccccaacctgatttggatcatcatcatgatggtgctcacgcagctgggagccttctacatcgttaaagacctcgactggaagtgggtcatctttggcgcttatgctttcggatcgtgtatcaatcatagtatgactctggctatacatgaaatcgctcacaacgcagcgttcggtaattgcaaggccatgtggaatcgctggtttggcatgttcgccaacctgccgataggcattccttacagcataagctttaagagatatcatatggaccatcacagatatttgggcgcagatggagtcgacgtcgatatccccactgacttcgaaggctggttcttctgcacagcatttcgtaaatttatctgggtgatcctgcaaccacttttttatgcttttagaccactatttataaatccaaagcccatcacatatttggaggtgatcaatacagtggcacaagtgacctttgatattcttatatactattttttgggcataaaatctcttgtgtatatgctcgctgcgtccctcctgggattaggtttgcaccctatatcaggacattttatagctgagcattacatgttcctgaaaggccatgaaacttactcttactacggtccccttaaccttctgacattcaatgtgggttatcataacgaacatcatgatttccctaacattccaggtaagtcccttcctctggtcaggaaaattgccgcagagtactacgacaacctgccacactacaacagttggatcaaggtgttatacgattttgttatggacgatacaatctccccctacagtaggatgaagagacatcagaagggtgagatggtactggagtag

SEQ ID NO: 49772 - DNA, 786 bp, Artificial Sequence
  Description of Artificial Sequence: Synthetic coding sequence
atggtttcccctcagcttgccaagtaccccgagattaaatcactgatgaaacctgacccgaatctgatctggatcattataatgatggttttgacacagctaggcgcattctatatcgttaaagacctcgactggaaatgggtgatattcggcgcatacgccttcgggtcctgtatcaaccacagtatgacgcttgctattcatgagatcgcccataatgctgccttcggcaactgcaaggcgatgtggaaccgttggtttggaatgtttgcaaacctgccaatcggaataccgtactccatttcattcaagagatatcatatggatcaccaccgataccttggggcagatggggtagatgtggacattccaacagactttgagggttggtttttctgtaccgcttttcgcaaatttatctgggtgatcctgcagccattattctatgcctttcgccctctgtttattaatcccaagccaattacttaccttgaagttatcaatactgtggctcaagttacatttgatatattaatctattatttcctggggatcaagtccctggtctacatgctggcggcaagtttgttggggctcgggcttcaccccatcagcggccactttatagcagagcactacatgtttctgaaaggccacgagacatatagctattacgggcctctcaacttgcttaccttcaacgtgggataccacaatgagcaccatgactttccaaacatccccggaaagtcacttccactcgtacggaagattgcagctgagtag

SEQ ID NO: 49773 - DNA, 1152 bp, Artificial Sequence
  Description of Artificial Sequence: Synthetic coding sequence
atgccatccggttgtcgctgtctgcatctagtgtgcctgttgtgtatactaggtgcccctggtcagccagtcagggcagatgattgttctagccactgcgacctcgcccatggatgctgtgctccggacggcagttgtcggtgtgatcctggatgggagggcctccactgcgaacgatgcgtaagaatgcctgggtgccaacatggtacttgccatcaaccctggcagtgcatttgccatagtggctgggctggcaaattctgcgataaagacgaacatatatgtacaacccagagcccatgccagaatggtgggcagtgcatgtatgatggcggaggagaataccactgtgtctgcctgcccggattccacgggagggactgtgagagaaaagccggaccttgtgaacaggcaggaagtccttgtaggaacggagggcagtgccaggacgaccaggggttcgccctgaattttacttgtcgatgcctcgtcggatttgtgggcgctagatgtgaagtcaacgtcgatgactgtctgatgcgcccttgtgctaacggggctacctgtctggacggtattaatcgcttttcctgtctatgtcccgaggggtttgctgggagattctgtacgattaatttggacgactgtgcctctagaccctgtcaacggggagctcggtgccgcgaccgggtacacgacttcgactgtctgtgcccctctgggtatggcggaaagacttgcgagctcgtgctgccggtgcctgaccccccaacaaccgtggacactcccctgggaccaacgagtgctgttgtagtcccagccacaggtccagcgccacatagtgcgggtgctggccttctccgcatcagcgtgaaagaggttgtgaggagacaagaagctggccttggcgagcctagtctggttgcgttggtcgtattcggcgctctgacagctgcgctagtgctggccaccgtgctcttgacactccgggcttggcgaaggggcgtgtgtccccctggcccttgttgctatccggctccccactacgcacccgcatgccaggatcaggagtgccaagtgtccatgttgcccgcaggattgcccttaccaagagaccttccccctgagcccggaaagacgacagctctgtag

SEQ ID NO: 49774 - DNA, 1134 bp, Artificial Sequence
  Description of Artificial Sequence: Synthetic coding sequence
atgccgagcggatgtcggtgtctgcatctggtctgtctgctctgcattctcggcgcaccaggacagcctgttagggcagacgattgcagtagccattgtgacctggcacatggctgctgtgccccagatggctcttgccgctgcgatcctggatgggagggactgcactgcgagcgatgcgtgaggatgccagggtgccaacatggaacctgtcatcagccctggcaatgtatctgtcactctgggtgggccgacgagcacatttgcacaacacagtccccctgccagaatggaggtcagtgcatgtatgacgggggaggggagtaccactgcgtgtgcctccctggctttcacgggagggactgtgagcgcaaggccggtccctgtgaacaagccggaagcccatgccggaatgggggtcagtgccaggatgaccagggcttcgcattgaactttacgtgtagatgcttggtgggttttgttggggctaggtgcgaagtcaatgttgatgattgcctgatgcgcccatgtgccaacggtgctacttgtttagacgggattaatcgtttctcctgcttgtgccctgaagggtttgcaggtaggttctgtactatcaatctggatgattgtgccagtcggccttgtcagcgaggagccagatgtcgcgaccgggtccacgatttcgattgcctttgtccttcaggatacggcggaaagacctgtgagttagtcctgcccgtgcccgatccacccaccaccgtcgacacacctttaggcccaacttccgccgtcgttgtgcctgccactggcccagccccacattccgctggcgctggccttctacgaatcagcgtcaaggaggtagtcagaagacaagaagcagggttgggcgaaccctcgctggtggctctggtcgtgtttggagcacttacagctgctctcgtcctggccacagttctgctcacattgcgggcatggcggaggggcgtgtgcccacctgggccatgttgctaccctgcccctcactacgcccctgcttgtcaggaccaggagtgccaggtatcaatgctgccagccggactgcccctgccgcgagacttgcccccagagccgggaaagaccactgccctctag

SEQ ID NO: 49775 - DNA, 1152 bp, Artificial Sequence
  Description of Artificial Sequence: Synthetic coding sequence
atgcctagcggatgtcggtgcctgcacctagtttgtctcctgtgcatccttggggctcccggacagcccgtgagggcagacgattgtagttcacactgtgatctagctcacggttgttgcgcgccagacggaagctgtcgttgtgatcctggatgggaagggttgcattgcgaacggtgcgtgaggatgcccggatgtcagcatggcacttgccatcagccctggcagtgcatatgccactccggatgggccggaaaattctgtgacaaggacgagcatatttgcactacacagtctccatgccagaatggcggacagtgtatgtatgacggcggtggcgagtaccactgcgtgtgtctgcccggttttcacggccgagattgcgaacgcaaagcaggcccatgtgaacaggccggtagcccctgtcgcaacggaggccagtgtcaggacgaccaaggcttcgctttgaatttcacctgtcggtgtctggtgggattcgtcggcgctcggtgtgaagtgaatgttgatgattgcctcatgcgaccatgtgctaacggggctacgtgtcttgacggaatcaaccgctttagttgtctgtgcccggagggattcgctggacggttctgcacgattaacctggacgattgcgccagccgaccatgtcagagaggcgctcgatgtcgcgatagagtgcatgacttcgattgtctgtgcccgagtggctacgggggaaagacctgtgagctcgtcctgccagtgcctgacccacccacaacagtcgacacgcccctcggacccacatcggccgttgtcgtgcctgccactggaccagccccacactcagccggtgccggtcttctgcgcattagcgtgaaagaggtggtgagacggcaggaggccggtttgggggagccgagcctggtagcactggttgtttttggagctttaaccgccgctctagtcctggccaccgtactgctgaccctgcgggcttggagacgcggtgtctgtcctcctggaccttgttgttatccagccccacattatgccccagcctgccaagatcaggagtgccaggtgtcaatgctgcccgctgggcttccactaccaagggacttgccccctgagccagggaaaacgacagccctgtag

SEQ ID NO: 49776 - DNA, 405 bp, Artificial Sequence
  Description of Artificial Sequence: Synthetic coding sequence
atgccctccggatgccgttgcctccatcttgtgtgcctcctgtgcatcctaggagcccctggacagcctgtgcgagccgatgattgttcctctcattgcgatctagcccacggatgctgcgccccagacgggtcctgccgttgtgatcctggatgggaagggcttcattgtgagaggtgcgtaagaatgcccggatgccagcacggaacctgccatcagccttggcaatgcatctgccatagcggctgggccggtaagttctgcgacaaggatgagcacatttgtactacacaaagtccttgtcagaacggaggacagtgtatgtatgacggaggtggcgagtatcactgtgtctgcctgcccggatttcatggtcgagattgcgaacggaaggccggaccctag

SEQ ID NO: 49777 - DNA, 1134 bp, Artificial Sequence
  Description of Artificial Sequence: Synthetic coding sequence
atgccgtctggttgtaggtgcctgcacctggtttgcttgctgtgcattcttggggcacccggacagccagtgagggcagacgactgctcatctcactgcgatttagctcatggctgctgtgctccagacggctcctgcagatgtgacccaggctgggagggcctgcattgtgaacggtgtgtgcgtatgccaggctgtcaacacgggacctgccaccaaccttggcagtgtatttgccactccggttgggcagacgaacacatttgcaccacccagtcaccttgccagaatggcggtcagtgcatgtacgacggcggaggagaatatcattgcgtctgcttacccggttttcatggtcgggattgcgaaagaaaagccggtccatgtgagcaggcgggttctccctgtcgaaacggaggccagtgccaggatgaccagggatttgccctgaatttcacctgccgttgcctggttggatttgtgggtgccaggtgcgaagtgaatgtggacgattgtctgatgcggccatgcgccaacggagccacctgccttgacggtattaacagattcagctgtttatgccccgagggctttgccggacgcttctgcactatcaatctggatgactgcgcttctcggccttgccaaaggggagctcgctgtagagatcgggtgcacgatttcgactgcctgtgccctagcggctatggcggaaagacatgcgagctggtactacccgtgcccgatccccctactacagtagacacgcctctgggaccaacatctgcagtggttgtgcccgctaccggacctgccccacattcagctggagccggactcctacgcatcagcgtgaaggaagtggtgcgcaggcaggaagctggactaggcgaacctagtctggtggccctcgtggtttttggcgcactgaccgctgccctcgtactggcgaccgtcttgctgaccttgcgggcttggcgcaggggcgtctgcccaccagggccttgttgctacccggcacctcattacgcccctgcttgtcaggatcaggaatgccaggtaagtatgcttccagctgggctccccctgcccagagacctgccaccagagccaggcaaaaccactgccctatag

SEQ ID NO: 49778 - DNA, 870 bp, Artificial Sequence
  Description of Artificial Sequence: Synthetic coding sequence
taggggtgtcaacacggaacgtgccaccagccttggcagtgcatttgccattctggatgggcagggaaattctgtgataagggatttcacgggcgagactgtgagaggaaggccggtccctgcgagcaagcgggaagcccttgtagaaatggcggtcagtgtcaggacgaccaaggattcgccctgaactttacttgccgttgtctagtgggctttgtgggcgctcggtgcgaggtcaacgtcgacgattgtctgatgcgaccttgtgccaacggcgctacttgtctggatggaattaacaggtttagctgcctatgccctgagggcttcgccggacgattctgcactataaaccttgacgactgcgcttcacgaccgtgtcaaaggggggctaggtgtagagatagggttcacgactttgactgtctctgcccgagtggctacgggggaaaaacatgtgagctagtgctgcccgtccccgaccccccaaccacagttgatacacctcttggccctacctctgctgtagtggtacccgctacaggcccagcccctcatagtgcaggagcaggtttgctcaggatcagcgtcaaggaggtggtgcggagacaggaggctggtttaggggaaccatcactcgttgctctcgtggtattcggcgctctcactgccgcattggtgctagctacggttctgctcaccctgcgggcttggcggagaggcgtgtgtcctcccggtccttgctgttacccagccccacactacgctcccgcttgtcaggatcaggagtgccaagtcagcatgctgcccgctgggttgccgctgccacgagacttgcccccagagcccggtaaaactactgccttgtag

SEQ ID NO: 49779 - DNA, 3441 bp, Artificial Sequence
  Description of Artificial Sequence: Synthetic coding sequence
atgcgcaaaaccgatgtcgatcctctagacgaagtctgttatagggtggtgatgcagctctgcggattgtgggggcaccctgtgttggccgtacgtgtgctttttgagatgaagacagcaaggattaagcctaatgctatcacatatggttattacaacaaggtggtcttagaatccccttggccctctagtacccgttccggtatcttcttatggacaaaggtgagaaatgtggtacggggacttgctcagttccgccagcctctgaagaagacagttcagcgcagccaagttagttccatctccgctctgcagaatgtgaccggtgggagcgatggagatacagtttcccatggaagtgtggattcatctaacgatgcaaataacggcgaacacaccgtcttcgtcagggacttgataaggctcgagagtattgataaccactcttctaccggaggccaatctgatcagggctacgggtctaaagatgaactcatcaaggacgacgctgaaatccacgtgccagaagagcaggccgcacgggaactgattacaaaaaccaaaatgcagacagaggaagtttgtgatgcttcagccattgttgctaagcacagccaaccttcaccagagccacactcaccgacagagcccccagcatggggctcaagcatcgttaaggtgccctccgggatatttgatgtaaactcgagaaagagttccatctccaacgttcttttttcgactcaagatcctgtagaggacgccgtgtttggtgaagcgactaacctgaagaaaaacggcgatcgcggtgagaaacggcagaagcacttcccagaacgcagttgcagcttcagctctgaaagtcgggctggcatgctgctgaagaagtcctcccttgacagtaatagcagcgaaatggctattatgatgggggcagatgcaaagatcttaactgcagccctcacatgtcccaaaacctctctccttcatattgctcgcacacactcgtttgaaaacgtgtcgtgtcacctgcctgattctcggacttgtatgagtgaaagtacttggaatcccgaacacagatcatctccagtaccagagatgctggaagaatctcaggagcttctcgagccagttgtcgatgacgttcctaaaacgaccgccacagtcgatacgtacgaaagtctgctttctgacagcaatagtaaccagtctagagatcttaaaaccgtgtccaaagacctgcggaataagcgcagcagtctgtacggtatcgcgaaagtggtgcaaagagaggacgtggagacaggcctggaccccctctctctactggctacagagtgcacaggaggcaaaactcccgacagcgaagacaaactgttttccccggtgattgcaaggaacctcgctgacgagatcgaatcctatatgaatttgaagtctccgttagggtcaaaatccagcagcatggaacttcatcgagaagaaaaccgagagagtggtatgaccacagcattcatacatgccctggaaaggcgctcttcccttccactcgatcatgggtctcccgcacaggaaaaccccgagtccgaaaagagttcacccgcagtgtcgcgctcaaaaactttcacaggccgtttcaagcaacagacccccagccggactcataaggagcgatccacctcattaagcgcccttgtgcgctctagcccacatggcagcttgggaagcgttgtgaactcattgtcaggcctcaagttagacaacatactgtcaggaccaaagatcgatgtattgaaaagtgggatgaagcaggcagccacagtggccagtaaaatgtgggtggccgttgcttctgcgtattcatactcagatgatgaagaggaaaccaacagggattattccttccccgcaggactggaagaccacatacttggcgagaacatttctcctaatactagcatctctggattggtgccctctgagctgacccagtcaaacacgtccctcggaagctcatccagttccggggacgttggaaaattgcactatccgactggagaggtgcctttccccaggggaatgaagggccaggattttgagaagtccgatcacgggtcgagccagaacacctccatgagctctatttatcagaattgcgccatggaagtgttgatgagttcatgtagccaatgcagagcttgcggggcactggtttacgacgaggagattatggctggttggaccgctgacgatagtaatctcaacaccgcctgcccgttttgcaagagcaactttcttcctctgctgaacatcgaattcaaggacttgagaggctccgctagtttcttcctcaagcccagcacttcgggggacagtctgcagtctgggtctattccactggctaacgaaagtctggagcataaacccgtctcctctctggccgagcccgatctaatcaatttcatggacttcccaaagcataatcagataatcaccgaagaaactggctcagccgtggagccaagtgatgaaattaaacgagcctctggagacgtgcagacaatgaagatatcatccgtgcctaactccctcagtaaaaggaatgtcagtttgacgagatcccatagcgtgggcggtccgctccagaatatcgactttactcagagaccatttcacggaatctccaccgtatccctgcctaactccctccaggaggtcgtagacccactgggcaagcgcccaaatcctcccccagtgtccgtgccgtatttaagccccctggtccttagaaaagaactggagtcactgctcgagaatgaaggagaccaggtcattcataccagcagtttcataaaccaacaccctattatattctggaacctggtgtggtactttaggaggctggacttaccttccaatctgccgggattgattttgacctcagagcactgtaacgagggagtgcagctgccactgagctctttatcccaagattctaagttggtgtacattcagttactctgggacaatatcaatcttcaccaggagcctcgcgagccactgtacgtgagctggcgcaacttcaactcagagaagaaaagtagtttgctgtctgaggagcagcaggaaacctccacactggtcgaaactatcaggcagagcatccagcataacaacgtgctgaagccgattaacttgttaagccagcagatgaaacccggtatgaaaagacagcgatccctttacagagagattctgtttctctcccttgtaagtcttggacgggaaaatatagatatcgaagctttcgacaacgagtatggtattgcctacaacagtctgagctctgaaattttggaacgtctgcaaaagatcgacgcacccccatcagcctctgtggaatggtgtcggaaatgttttggggcacctcttatctag

SEQ ID NO: 49780 - DNA, 2013 bp, Artificial Sequence
  Description of Artificial Sequence: Synthetic coding sequence
atgaacctaaagtcacccctcggctcaaaaagttcctccatggagcttcacagagaggagaaccgagaatccggtatgacgacagccttcattcacgcgctcgaacgacgaagctctttgccactagatcatgggagtccagcacaggagaaccctgagtccgagaagtcttcacccgctgtgtcaagatcgaagacctttaccggccgattcaagcagcagaccccgagtcggacacacaaggagaggtctacaagtctctcagcactggtaagatcttctcctcacggatctctgggcagtgtggtaaatagtctgtcgggcctgaagctagacaatatcctctctggaccaaaaatcgatgtgctcaagagtggcatgaaacaagccgcaaccgtggcttccaagatgtgggtggcggtggcaagtgcctattcctattcagatgatgaagaggaaaccaaccgagactactctttccctgcaggcctggaagaccatattttgggggaaaatatatctccaaatacaagcatttctggactcgtgcctagcgaattaacccagagcaacaccagcttaggatctagctcaagcagcggggacgtgggaaagctgcactatcctaccggcgaggtccctttccctaggggcatgaaaggacaggactttgaaaaaagcgaccacgggtcttctcagaacacttccatgtctagcatctaccagaactgtgccatggaagtactaatgtcctcatgctcccagtgtcgtgcgtgcggggctctggtttatgacgaggagattatggccggatggacagccgacgactctaatctgaacactgcttgtcctttttgtaaatctaattttctgccacttcttaacattgaatttaaagacctacgaggtagcgcttccttcttcctcaagccaagtaccagtggggactcattgcagagtggaagcataccactcgctaatgaatccctagagcataaacccgttagctcactcgctgaacccgatctgattaacttcatggactttccaaagcacaaccagatcatcactgaggagaccggcagcgccgtggaaccttctgacgagatcaagagggcgtctggagacgtgcagaccatgaaaatcagcagtgttccaaacagcttatccaaacgcaacgtgtccctgaccagaagccactcagtcggcggacctctgcagaatattgatttcactcagcgccctttccacggtatcagcacggtcagcctgcccaatagcttgcaggaggtagtggatccactgggcaagcggccaaatccacccccagtttccgtgccctatctcagtcccctggttttgcgcaaggagttggaatctttgctcgaaaacgaaggcgatcaagtgatccacacttccagcttcataaatcagcatcccataatcttctggaatctcgtctggtacttccggaggttggatcttccctcaaatttgccaggtcttattctcacttcggagcactgcaacgaaggcgtgcaactgccactcagctctttgtctcaggacagcaagcttgtgtacatccagttgctctgggacaacattaatctgcaccaggagcctcgtgagcctctatacgtcagctggagaaatttcaactccgagaagaagagctctctgttgagcgaggagcagcaggagaccagtacgctggtagaaacaattaggcagtcaatacagcacaataatgtgttaaagcctatcaatttgttaagtcagcagatgaagccaggcatgaaaaggcaaaggagcctatacagggagattctgttcctctcgctggtgtccctgggcagggagaatatagatatcgaagccttcgacaacgaatatggtatcgcatataacagtctgagctcagagattctcgaaaggctccagaaaatcgatgcccctcctagcgcatctgtcgagtggtgccggaaatgctttggagctcccttgatctag

SEQ ID NO: 49781 - DNA, 777 bp, Artificial Sequence
  Description of Artificial Sequence: Synthetic coding sequence
atgaagcaagcggcaactgttgcctccaagatgtgggtggccgtagctagcgcttattcctatagtgacgatgaggaggaaaccaatagggactacagttttcccgcaggccttgaagatcacatcttgggagagaacatttccccaaatacaagcatcagcgggctggtgccaagcgaactgacccaaagcaatactagcttaggttcttccagttcttctggtgacgtgggtaaattgcattaccccacaggagaagtgccttttccaagaggcatgaagggtcaggattttgaaaagtccgaccacggctccagtcaaaatacctccatgtccagcatctatcagaattgcgccatggaggtcctaatgtcaagctgcagtcagtgcagggcctgtggagctctggtgtacgatgaggagatcatggccggatggaccgccgatgattcaaatctgaataccgcctgccccttttgcaagtcaaattttttgccactgttgaacatagagtttaaggatctgaggggctccgccagcttctttctgaaacctagtacttccggggacagtctgcaaagtggaagtatccccttagcaaacgaatctctagaacataaacctgtgagttccttggctgaacccgacttgattaattttatggactttcctaaacataatcaaataattactgaggaaacagggagtgctgtggaaccacggtatcagagagtccagaggccactttacgttgtgataaacggcgtgcccctgtag

SEQ ID NO: 49782 - DNA, 2376 bp, Artificial Sequence
  Description of Artificial Sequence: Synthetic coding sequence
atgctcctgaagaaaagctctcttgatagtaattcgagtgaaatggcgatcatgatgggcgcagatgcaaaaatattgacagccgctttgacatgcccaaagacctcactgctccacatcgctagaacacactcattcgagaacgttagctgccatctccccgattctaggacatgcatgtccgaatccacctggaacccagaacaccgctcaagtccggtcccagaaatgcttgaggaatcccaggagctgctagagcccgtggtagacgacgtgcccaagaccacagccactgttgatacgtacgaatccctgctgagtgattccaattccaatcagtcgcgagacctcaagactgtttctaaagatctaagaaacaagcggtcttccctctatggaattgccaaagtggtccaaagggaggacgtggagaccggattggatccgctaagcctgctggccacagaatgcactgggggtaagacgcccgactcagaagataagctgtttagtccagtaatagccagaaatctcgctgacgagatcgaatcatatatgaaccttaagtcacccctgggctccaagtcctcttctatggaactccatcgggaggaaaatagagaaagtggtatgacaacagcctttattcacgcattagagcgccgttcttcgttacccctcgaccacggttcacctgctcaagaaaaccctgagagtgagaaatcttcgccagctgttagtaggtctaagactttcaccggcaggttcaaacagcaaaccccatcgaggacccacaaagaacgcagtacctccctcagtgctctcgttcgcagtagcccacacgggtcacttgggtcagtcgtgaattccctgtctggcttaaagcttgacaacatcttgagcgggccaaagattgacgtcctgaaatcggggatgaaacaggccgcaactgtagctagcaagatgtgggtggcagttgccagcgcttactcctactcagacgacgaggaagagactaatagggactactcctttcctgcgggtctcgaagaccacatcctgggcgagaatatttctcctaacaccagcatttcaggcctggtcccgagcgagctaactcagtcaaatacgtccttgggttccagttcttctagtggggatgttgggaaactgcactaccccacaggtgaggtgccctttcctcgcggaatgaagggacaggacttcgagaaatctgaccacgggtcctcacagaacacatccatgtcttccatttaccaaaattgtgccatggaggtcttaatgtcttcatgtagccagtgtagagcatgtggagcactcgtgtacgatgaggaaatcatggcgggatggactgccgacgatagtaacttgaacacagcatgccctttttgtaaaagcaacttcctgccactgttaaacatcgaattcaaagacctgcggggatccgcctctttctttcttaaaccaagcacaagtggtgacagtctccaaagcgggagcattcccctcgccaatgagtccctggaacataagcccgtatccagcctggctgaacctgatcttataaattttatggactttcctaagcacaaccaaataattacagaagaaactggctccgctgtcgagcctagcgacgagatcaagagggccagtggagacgtacagactatgaaaatctcctctgtgccaaattccctttccaagcggaatgtttctcttactcggagccactccgtgggcggacccctgcagaatattgacttcactcagagaccctttcatggaatttctaccgtcagccttcctaactctcttcaggaggtcgtggatcctctggggaagcgtccaaatccccctcctgtgtctgtgccctacctcagtccactggttttacggaaagagctggaaagcttactggagaacgagggcgaccaggtcattcatactagttccttcattaatcagcatccaatcatcttctggaacttggtgtggtacttccgacgtctggacttgcctagcaacttaccaggcctgatccttacttccgaacactgcaatgagggagttcagctccctctgtcatcattgtctcaggacagcaagctggtatacatccagttgctgtgggacaacattaacctgcaccaagaaccccgagagcccttgtacgtcagctggcgtaatttcaactcagagaagaaatccagcctactgtccgaagagcaacaggagacctctacacttgtggagacaatccggcaaagcattcagcacaataacgtgctgaagcctattaacctactgtcccagcagatgaagccgggaatgaagcgccagcggggaatctag

SEQ ID NO: 49783 - DNA, 3441 bp, Artificial Sequence
  Description of Artificial Sequence: Synthetic coding sequence
atgcggaaaaccgacgttgatccgctcgacgaggtatgttatcgagtggtgatgcagctttgtggactgtggggccaccccgtgcttgccgtaagggtattgtttgagatgaaaacagctcgtatcaagcctaatgccattacgtacggatattacaacaaagtggtattagagtcaccatggccctcgtccacccggagcgggatcttcctctggacaaaggtgagaaatgtagtgcggggtttggcccagttccgacagccactcaagaaaactgtgcagaggtcccaggtgagctcaatctcagcactgcagaacgtcactggtggtagtgacggcgataccgtgtctcacgggtccgtggatagcagcaatgacgccaacaacggagaacatactgtgtttgtgcgggatctcattaggttggaatctattgacaaccactcttccactggcggtcaatctgatcagggttacggttcaaaggacgaactgattaaggatgacgccgaaattcatgtacccgaggaacaagccgcacgagaactgattaccaagacaaagatgcagacagaggaagtatgcgatgcaagtgcaatagtcgccaagcacagtcagcccagcccagagccacactcacccacagaacctcctgcttgggggtccagtattgtcaaggtgccgagcggtattttcgacgttaactctcggaagtcctcaatcagtaatgttctatttagcacacaggatcccgtagaggacgctgtatttggcgaagccactaacctgaagaaaaatggggaccgcggtgagaagcggcagaaacattttcctgagcggagctgttccttttcgagcgaaagtagagctggtatgcttctgaaaaagtctagtctcgactcaaactcatcagagatggccatcatgatgggtgcagatgcaaaaattctcacagctgccttaacgtgccccaagacttcacttctgcatatcgctcgcacgcactcctttgagaacgtttcttgccacctgccagatagcagaacatgcatgagtgaaagcacttggaaccctgagcacaggagttccccagtgccagagatgctggaggagtctcaggaactgctggaaccagtcgttgacgacgttcctaaaacaactgcaactgtggacacctacgaaagtctgctgtccgatagcaatagcaatcagagtcgagacctgaaaacagtaagcaaggatctgagaaacaaacggtcctccctgtacggtattgctaaggttgtgcagcgcgaggatgtggaaacaggtttagaccctttatccctacttgctacggaatgtacagggggaaagacgcccgactctgaggataagttgttctcccccgtcattgcgcgtaacctggcagacgagatcgagtcctatatgaatctgaaatcacctctgggttctaaatccagctccatggaactgcatcgcgaagaaaacagggagagcggcatgaccaccgctttcattcacgcactggagcggaggtctagtctacctctggaccacggttcccccgctcaggaaaatccggaatcagagaaaagcagccccgcagtatcccgcagtaaaacatttaccggcaggtttaagcaacagacaccttcaaggacacataaagagaggagtactagcctatctgccttagtccggtctagccctcacggatctctgggcagcgtagtcaattcactgtccggcctgaaactggacaatatcttaagtggtcctaaaatagatgtgttgaaatcgggtatgaagcaagccgctacggtggccagtaagatgtgggtcgcagtcgcgtcagcctacagctacagcgacgatgaagaggagactaatcgagattattcttttcctgcaggtctggaagaccacatattaggagaaaacattagccccaatacttccatttccgggttggtcccttccgagctgactcagagcaacacttcactgggctcttcatccagctccggcgatgttgggaagctgcactatcccaccggagaggtgccatttccaagaggaatgaagggccaggattttgaaaaaagcgaccatggctcctcccaaaacacgagtatgtcttctatctaccagaactgcgctatggaagttcttatgagctcctgctcccagtgcagggcatgcggcgcactggtttacgacgaggaaatcatggcaggctggaccgccgatgactctaatctaaacacggcctgccccttctgcaaaagtaactttctcccgttgcttaatatcgaatttaaggatttgaggggaagcgcctctttcttcctcaagccttcgacctcaggggatagcttgcagagcgggtccattccacttgctaatgagtctctggaacataaacccgtttcctccctcgctgagccggatctgatcaacttcatggatttccctaagcacaaccagatcattaccgaagaaacgggcagcgccgtggagccttccgacgaaatcaagagagcctccggcgatgtccagactatgaagataagctctgtgccaaatagtttatctaaaagaaacgtttccctcactaggtcacactccgttgggggtccgctgcaaaacattgattttacccagaggccgttccacggtatctctacggtctctctaccgaactctctccaggaggtggtggacccattgggaaagaggccaaatccacctccagtgtctgtaccttacttgtctcccctggtgttgcgtaaggagcttgagagcttattagagaacgaaggcgaccaggttatccacacttcttcttttattaatcaacaccctatcatattctggaatctggtttggtatttcaggagattggacctgcccagtaacctccccggtctgattctgacctcagaacactgtaatgaaggggtgcagcttccactatcctctctgtctcaagacagcaagctggtatatatccaattgctatgggataacattaatttacaccaggaaccccgtgaaccactctacgtttcctggagaaactttaattctgagaaaaagtccagtcttctgagcgaagagcagcaggagactagtacattggtcgaaacaattcgccagagcattcaacacaataatgtattgaaacctattaacttactcagccagcagatgaagcctggcatgaaacgccagcggtccctatacagggaaattctatttctgtctctggtatcactgggtagggaaaatatcgatatcgaggcttttgataatgaatacgggattgcctataactcactctcttccgagatactcgaacgcttgcaaaaaattgacgcgcctccatcggcgagcgtcgagtggtgcagaaaatgtttcggtgctccactcatatag

SEQ ID NO: 49784 - DNA, 5022 bp, Artificial Sequence
  Description of Artificial Sequence: Synthetic coding sequence
atgggcgcaactattgaatgctgggaccctgaaacaaagtacccactccccgtgttttccacctttgtcctgacaggctcctccgccaagaaggtgtatggagccgcaatccagttttacgaaccctatagccgtgagttgctctcagaaaaacagttgatgcacctgggcctacttacccctgtagagcgcaagatggtcagtaagtctatcaatacaaacaagtgcatctgcctgctctctcactggcccttcttcgaggcattccggaaatttctgatgtttatttataaactgagcgtttcaggaccgcatcctctgcctattgagaaacatattagccactttatgcagaacataccttttcccagcccccagcggcctagaatcctagttcagctctcggtgcacgatgccctgatactgagccagccggtgtccactcccctgcccctgtcaggcgctaactttagtacactgctcatgaacctaggcccagagaactgtgccacgctgttactcttcgtgcttctcgaaagtaaaatcttgttgcattctctgaggcctgcagtactcaccggtgtagcagaggcggtggttgccatgatctttcccttccaatggcagtgcccttatataccattatgtcctctctcccttgccgctgtgctgtcagctccactcccctttatagtgggtgtagactctcggtatttcgacctgcacgacccaccacaggatgtcgtttgcatagatctggacacaaatatgctgtacgtgtctgacgagaaaaagaacatgaactggaagcagctccctaagaaaccttgtaagaatctgttgagtactcttaagaagctgtaccctcaattatcctcggtacatcagaagactcaggaaggatctgcaatcgatatgacccctatcgaagccgacttttcttggcagaaaaaaatgacccagctcgagatggagatccaagaggcgtttctgcgatttatggcctccatcctgaaaggttaccggacctatttaaggcctattactgaggccccttccaataaggccacagcagcggattcactctttgacagacaaggctttcttaaatctcgggatcgcgcttatgccaagttctatacgctgctttcaaagacgcaaattttcatcagatttatcgaggaatgctcatttgtgtctgataaagatactggcttggccttctttgatgattgcatagaaaagctgttccccgacaaggggactgagaagactgataaggtggatttcgactctgcagaggatactcgattgattgagctggacgactcccaaaagagcgagcataccgtattcatcatgccccctgagccccctccggacgacggtaaggacttgtcccccaagtactcctataagtatttcccgagactggacttaaaattattcgatcgccctcaagagctgaaactctgtttctcccgccatcccactgggaacagtattaccaagagccctcctttaatggctaaacggacaaaacaggaaatcaaaactgcacacaagctcgccaagcgttgctatacaaatcctcctcaatgggcaaaatgcctcttcagccattgctacagcctgtggtttatttgtctgcctgcctacgtgagagtgagccaccccaaagtgcgggcacttcaacaggcctacgatgttctaataaagatgaggaagaccgatgtggacccgctggatgaagtctgttatagggtcgtcatgcagctgtgtggactctggggccatcctgttctggctgtacgggtgctatttgaaatgaaaactgcgcgtataaagccaaacgcgataacttacgggtactataacaaagttgttcttgaatccccctggccaagctctacacgatcaggtatcttcttgtggacgaaagtgcgcaatgtggtgcggggacttgcccaatttagacagcccctgaaaaaaactgttcagagaagtcaggtgagctccattagcggcggtcagtcagatcagggctacggatcaaaggacgagctcatcaaagacgacgctgaaatacacgtccccgaagagcaggcagcacgggaactaatcactaagactaagatgcagaccgaagaggtctgcgatgcttctgcgattgttgccaaacactcacagccatccccggagccccatagccccactgagcccccagcctgggggtcgagcatcgttaaagtcccaagtggcatctttgatgttaactcccgcaaaagctcgacaggctctatatcaaacgttctcttctccacacaggatcccgtcgaggacgccgtctttggcgaggcaaccaacctgaaaaaaaacggagatcgaggtgaaaaaaggcaaaagcacttccccgaacggagctgttctttcagcagtgaaagtcgggcaggaatgttgctgaagaaatccagtctcgattcaaactcttccgagatggcgattatgatgggggctgatgccaaaattctgacagcggctctgacatgccccaaaacaagcctgctgcatattgccagaacgcacagctttgagaacgtcagttgccacttacccgattctcgaacctgtatgtcagagagcacgtggaaccccgaacatcgctcgagtcccgtgcctgagatgctagaggagtcccaagagctcctggagcctgtcgttgacgatgttccaaaaacgaccgcgacagtggatacttatgaaagtctgctgtcggatagtaactctaatcaatctcgcgatctgaagacagtctctaaagatttaagaaataagagatcttccctgtatgggatcgcaaaggtggtccaacgggaggacgtggagacaggactggaccccctgagcctgttggcaaccgaatgcaccggcggaaagacacctgattctgaagataagctgttcagccctgtaatcgcgagaaacctagcagacgagatagagagctatatgaacctcaagagcccactgggctccaagtcctcttctatggagctacatcgagaggaaaatagggaatccggcatgactaccgcttttatccacgctctagagcgcagaagctctcttccactcgatcatggcagtccagcccaggaaaatcccgagtccgagaagtcctcacccgctgtatctcggtccaagacatttactgggcgatttaagcagcagaccccttccaggacacataaagaaaggtccacaagcctaagtgctctggtgaggagcagtcctcatggaagtttgggaagcgtggtgaattctctgtccggattgaagctcgacaatatcctgtcaggcccaaaaattgatgtgttgaagagcggtatgaagcaggctgctactgtggccagtaagatgtgggtcgccgtggcctctgcgtatagttactccgacgacgaggaggagacaaatcgtgattattccttcccagccggactcgaggaccatattctgggggaaaatatttcccccaatacttctatatcaggcctagttccgtcagagcttacccagagcaacacgtctctgggatcatcctccagttctggcgatgtgggcaagctgcactatccaaccggggaggtcccatttcctagaggtatgaaggggcaggattttgagaaatccgaccacggttcttcgcaaaatacgtctatgagctccatctatcagaactgcgccatggaggtgctgatgtcgtcatgctctcagtgtcgcgcttgtggtgctctggtgtacgacgaagagatcatggccggatggaccgccgatgattccaaccttaacacggcctgccccttttgtaagtctaattttctgcccctgctgaatatagagtttaaggaccttagggggtccgcgtcattttttttgaaacctagcacaagtggggactctctgcagtcagggagtatcccactggcgaatgaatccctcgaacataagcccgtctcgtcattggctgagccagacttgattaactttatggacttccccaagcacaaccaaattatcacagaagagactggctccgccgttgagccatcagatgagatcaaacgcgcaagcggcgatgtgcaaaccatgaagatcagctcagtcccaaatagtctgtccaagcgcaatgtgtcattaacacgttcacactctgttggtgggccactgcagaatatcgatttcactcaacgcccttttcatgggatttcaactgtaagtttgcccaattctctgcaggaggtggtcgatccgctcggtaaaaggccgaatcccccaccagtcagtgttccttacctgagcccactggtgctgcgcaaggagctggagtcactgctcgagaatgagggcgaccaggtgattcatacaagctcttttattaatcagcatccgataatcttctggaacctcgtatggtatttccgaagactggacttaccatctaacctccccggacttattcttacctcagagcattgcaatgagggggtgcagctgcccttatcttccctctcccaggattcaaagctagtttacatccagctcctgtgggacaatatcaacctgcaccaagagcccagggaacctctgtatgttagttggaggaacttcaactcggaaaaaaaatcctcactgctgagcgaagagcagcaggagacctcaactttggttgagacaatcagacagagcattcaacacaataatgttctgaaacccataaacctcctgtcccagcaaatgaagcctggcatgaagcggcagcgctccctgtaccgcgaaatcctgttcctctctctggtgagtctaggccgtgagaacatcgacatagaagccttcgataatgagtatgggattgcctataattcattatctagcgagatcctggaacggcttcaaaaaatagacgcgccaccttccgcgtctgtggagtggtgccggaagtgtttcggtgcccctctaatatag

SEQ ID NO: 49785 - DNA, 2376 bp, Artificial Sequence
  Description of Artificial Sequence: Synthetic coding sequence
atgctgctgaagaagagtagtctggatagcaactcttccgagatggctataatgatgggcgctgatgccaaaatattaacggctgccctgacttgccctaagacaagcctcttacacattgcgaggactcattcttttgagaacgttagctgtcacctgcctgacagtcgaacatgcatgtccgaatccacttggaatccggaacacaggtcttcccctgtgcccgagatgctggaagagtcgcaggagttgctcgagccagtggtggatgacgtccccaagacaacagcgactgtggacacctacgagagtctcctgtctgatagtaactcaaaccaaagccgagacctaaagacggtctctaaagacctgaggaacaagagatcaagcctctatggaatcgcaaaggttgtgcaacgcgaggacgtcgagaccggactagaccccctatcactactcgcaaccgagtgtacagggggaaagacccccgatagtgaggataagctcttttctccggtaattgccaggaatttagccgacgagatcgagagttatatgaatctgaaaagccctctgggctcaaaatcaagcagcatggaactgcaccgtgaggagaatagagagtccggaatgacaactgcattcatccacgccctagagcgcaggagttccctccccttggatcatggttctccagcccaagaaaatccggaatctgagaagagtagcccagctgtcagccggagcaagactttcactggacgctttaagcaacagacgccttcccgtacgcataaggaacgaagcacctccctctccgccctcgtgcggtctagtccgcacgggtccttgggaagtgttgtgaactcactatccggactaaagttagacaatatcctgagtggcccaaagatcgatgtactgaagtctgggatgaagcaggccgcaacagtagcctccaagatgtgggtggccgtggcttcagcctacagttatagcgatgatgaggaagagaccaatcgcgactattcattccctgccggacttgaggaccatatcttgggagagaatatcagcccgaatacctcaatcagcggtctcgtaccgagtgagctgacacaatcaaatacttccctgggatccagctctagttctggtgatgtcggcaagctccactatcctactggagaggtccccttcccaaggggaatgaaaggccaagacttcgagaaatcagatcacggaagttctcagaacacttccatgtctagcatttaccagaactgtgccatggaagtgcttatgagtagttgcagccagtgccgagcttgtggcgcactcgtgtacgacgaagagatcatggcaggctggactgccgacgatagcaacctgaataccgcctgccctttctgcaagagcaactttctgcccctgctgaatatcgagtttaaggatctgcggggatctgcatccttcttccttaaacccagcacttctggcgatagcctgcaaagcggatcaatcccactggctaacgagtcattggagcacaaacctgtatccagcttggcagagcccgatctaatcaatttcatggactttcccaagcacaatcagatcattacagaggagaccggtagcgccgtggaaccgtctgatgagatcaagcgcgcatccggagacgtgcaaaccatgaagataagctctgtgcccaacagcctgagtaagcgcaacgtctctctcacgcgaagtcactctgtcgggggtcctctccagaacatagactttacgcagcgccctttccacggaatttctacagtttcactccctaacagcctgcaagaggtagtagatcctttaggtaagaggcctaatcctcctccggtgagtgtgccctacctatctccactggtgttgcgtaaggagctggagtcactgctggagaacgagggggatcaggtaatccatacctcctcatttataaatcaacatcccataattttttggaatcttgtctggtatttcagacggctggatctgcccagcaatctaccgggtcttattctgacttcggaacattgtaacgagggagtccagctgcctctaagtagcctatcccaggatagcaagttggtgtacattcaactgttgtgggacaatattaatcttcatcaggagcccagggagccgctatatgtttcatggaggaactttaattcggaaaagaagtctagcctgctctccgaagaacagcaggaaacatctactttggtggaaactatccggcaatctattcagcacaacaacgttttaaaaccaattaatctcctgtcccagcaaatgaagccaggcatgaaacggcagagaaatatctag

SEQ ID NO: 49786 - DNA, 3012 bp, Artificial Sequence
  Description of Artificial Sequence: Synthetic coding sequence
atgctgaccaccagtggaggtcagagcgaccaagggtatgggtctaaagatgaactgatcaaggatgatgccgaaatccatgtcccggaggagcaggccgctagggagctgatcactaaaaccaaaatgcagaccgaggaggtctgtgatgcttccgccattgtagcgaaacactcgcaaccctccccagagccacactcccctaccgagcccccagcttgggggagttccatcgtaaaagtgcccagtggcatttttgacgtaaactcacgcaaatcaagcaccggctcaatttcgaatgtgctcttttctacccaggaccctgtcgaggacgccgtctttggagaggcgaccaatttaaaaaagaatggagatcgtggagagaagcgccagaagcacttccctgagcgctcatgttctttcagctccgaatctagggctgggatgctcctgaaaaaaagcagtctagactctaactcgtcagaaatggctatcatgatgggtgccgacgctaaaattctgaccgccgcattgacatgtcctaaaacctcgctgctccacattgctcgcacccattcctttgaaaacgtgagctgtcaccttcccgatagtcgtacctgcatgagtgagagtacctggaatcctgaacataggagtagtccagtcccagaaatgctggaagaatcacaggaactgctggagcctgtggtggatgacgttcctaagacaactgccactgtggacacatatgaatccctgttgtctgattcaaattcaaatcagtccagagacctgaagacagtgagtaaggatctgcgtaacaaaaggagttccctctacggcatcgctaaggtcgttcagcgggaggatgttgagactggattagatcccctgagccttctggccaccgagtgcaccggaggcaagacacctgacagtgaagataaattgttttcaccagtgattgcacgtaatctggctgatgagatagagagctacatgaacttaaagtcacctctgggtagcaagtcttctagcatggaactccatcgggaggaaaacagagagagtgggatgacaaccgcttttattcatgccctcgagcgtaggagtagcctgccgcttgaccacggctctccagctcaggagaaccctgagtcagaaaagagtagtcctgccgtgagccggtccaagacttttaccgggaggtttaaacagcagacaccctcgagaacacacaaggagagaagcacaagcctatccgccctcgtgcgatccagcccccatggaagtcttggctctgtggtcaatagcctgtctgggctcaagttagacaacattttaagcggacccaaaatagatgttctcaaaagtgggatgaagcaagccgctactgtggcctctaagatgtgggtagcagtggcctccgcgtattcatattcggatgatgaggaagagaccaatcgcgactacagttttcccgctggcttggaggaccacatacttggcgaaaacatttctcccaacactagtattagtgggctggtgccctctgaactcactcagtccaataccagcttgggtagctctagttcctcaggagacgtagggaagctgcactatcccaccggggaagtgccttttcccagggggatgaagggccaggactttgagaagagcgaccacggttctagtcaaaacacgagtatgagctctatttaccagaattgtgctatggaggttcttatgtcttcctgctcccagtgtcgggcatgtggggctttggtatatgatgaggaaataatggctggatggaccgcggatgattccaacctgaacacggcctgccctttctgcaagagtaattttctgcctctgctgaacatcgagtttaaagatttaaggggcagtgcatccttttttctcaagccaagtaccagcggtgacagtctgcagagcgggtcgataccactcgctaacgaatcgctggaacataaacccgttagtagcctagcagaacccgacctcatcaacttcatggacttccccaagcacaaccagattattacggaagaaacaggttccgccgtcgagcccagtgatgaaatcaagagagcatctggcgacgtgcagaccatgaagatctcttccgtgcctaatagtctaagcaaacgtaatgtctcacttacacggtcacattccgtcgggggacccctccaaaatatagattttacacagcgacctttccacggcatctctaccgttagtcttcccaatagtcttcaagaggtggttgatccacttggtaagcgtccaaatcccccaccggtctctgtaccttatctgagcccccttgtgctgcggaaggagctagagagcttgctggagaatgagggtgaccaggtgattcacacttcgtcatttatcaatcagcatccaattatattctggaatctggtgtggtactttcggaggctggatctcccctcaaatctgccaggactcattctgacaagtgaacactgcaatgagggggtccaattaccactttcttctctgagccaggacagtaagttggtgtatatccagctgctgtgggataacatcaatctgcaccaggagcccagagagccactgtatgtgtcttggcgcaatttcaacagtgagaagaagtcatctctcttgtccgaggaacagcaggaaactagcactctggttgagactatcagacagagcatacagcacaataacgtgctgaaacccatcaatcttttatctcagcaaatgaagcccggtatgaagaggcagcgatcactttatcgcgagattcttttcctgtctctggtgtccctgggacgggaaaacatagacattgaagccttcgacaatgagtatggtatcgcctataactccctgtccagcgagattctagagcgccttcaaaaaatcgacgccccaccaagcgcatcagttgaatggtgtcggaagtgttttggggctcctctgatctag

SEQ ID NO: 49787 - DNA, 3864 bp, Artificial Sequence
  Description of Artificial Sequence: Synthetic coding sequence
atgtcagggggtggcggtggagggggatccgcaccttccagattcgctgactatttcgtcatttgcgggttagataccgaaaccggacttgaacccgacgagctgtccgctttgtgtcaatatattcaagcgagcaaggcgagagatggggcttcccccttcatctcctctaccaccgaaggggagaatttcgagcagacgccacttcgtcggacttttaaaagtaaggtgcttgcgagatacccggaaaacgttgagtggaacccattcgatcaggacgccgtgggcatgttgtgtatgcctaagggactagcttttaaaacccaggctgatccacgggagcctcagttccacgcctttataatcactcgggaagacgggtctcggacatttggatttgccttaacattttacgaggaagtcacgtctaaacaaatctgttcagctatgcagaccctttatcatatgcacaacgccgagtatgacgtgttgcacgcaccaccagccgacgatcgcgaccagagctccatggaagatggggaggacaccccagtcactaagctccagcggtttaactcttacgacatttccagagatacgctctatgtttctaaatgtatctgcttaataacaccgatgtcttttatgaaggcgtgccgatccgtgctggagcagctgcatcaagccgtgaccagtcctcagccacccccactgcctctggaatcctacatatataacgttctgtacgaggtccccctgccacctcccggaaggtccttgaaattctccggcgtctacggcccaataatctgccagcggcctagcacaaatgaacttcccctttttgatttccccgtcaaggaggtttttgagcttctgggcgttgagaacgtgtttcaactgttcacctgcgccctgctggagtttcagatcctgctctacagtcagcactatcagagactgatgaccgttgccgaaactataaccgctctaatgttccccttccagtggcaacatgtgtacgtgccaattcttccagcaagcctgctgcatttcctggatgctcctgtgccctatctgatggggcttcatagcaacggactcgatgacaggagtaagctcgaactcccacaggaagccaatctttgtttcgtcgacatcgacaatcactttatcgaactgcccgaagatcttccacaattccccaacaaattggaatttgttcaggaggtttccgaaattctaatggcgttcggaataccccctgaaggtaacttacactgctccgaatctgccagcaaacttaaaagacttcgggcttcagagcttgtctctgataaacgcaatgggaatatcgctggcagcccactgcattcatatgaactcctgaaagaaaacgaaaccatcgctagacttcaggcgttggttaagagaaccggggtgtcccttgagaagctggaagtgagggaggaccctagctccaataaggatttaaaggtgcaatgcgatgaggaggagctgcgaatctatcaattaaatatccagatccgggaggtgtttgctaaccgatttacgcagatgttcgccgattatgaagttttcgtgatccaaccatcccaggataaggaatcctggttcaccaacagagaacagatgcagaattttgacaaagcctcgtttcttagcgatcaacctgagccctatcttccgtttcttagccgattcctcgagacccagatgtttgccagtttcatagacaacaaaataatgtgccatgatgacgacgataaggaccctgttttgcgggtgtttgattcaagggtggataagattaggctcttaaacgtgcgtactccgaccctcaggacctctatgtaccagaagtgcacaacagtagatgaggctgagaaagctatcgaactccgcctggctaagatagatcacacggctatccacccccatctcctggacatgaaaattgggcaggggaaatacgaaccaggattttttcctaagctccagtcagatgtgctaagcacaggccctgccagtaacaaatggactaaacggaacgcccctgcccaatggcgcaggaaagatcgccagaaacaacacacagaacatctgagactggataacgaccaacgcgagaagtacattcaagaagcaaggaccatggggtcaacaatccggcagcctaaactgagcaatctaagtccttcagttattgcacagacaaactggaagttcgtagagggccttctaaaggaatgtaggaataaaaccaagcggatgctggtcgaaaaaatgggacgagaggcagtggagttgggccatggggaagttaatatcaccggcgtggaggaaaatactctaatagctagtctctgcgaccttctagagcggatttggagccacggactacaagttaaacaagggaagtcagccctttggtcgcatctgctgcactatcaagacaatagacagaggaagcttactagtggtagtctgtcgacctcgggtatccttctcgatagcgaacggagaaaatccgatgcatcaagccttatgcctccgttacgcatctcactgatccaagacatgaggcatatacagaatattggagagatcaaaaccgatgtggggaaggcaagagcctgggttagattatccatggaaaaaaagctgctcagtcggcatttaaagcagcttctatctgaccatgaacttaccaaaaagctgtacaaacggtatgcattccttaggtgtgacgacgagaaggagcaattcctgtaccatctacttagcttcaatgccgtcgactacttttgcttcacaaatgtttttactacaattctaatcccatatcacatcctcattgtaccctctaagaaactgggcggatctatgtttaccgccaatccatggatctgcatcagtggggagctgggcgagacccaaatcatgcagatcccgcgaaatgtgctggaaatgacgtttgaatgtcagaatttgggaaaactgaccacagttcagatcggccacgataactctggactatacgccaagtggctagtagagtacgtgatggttcgaaatgagatcaccggccatacttacaaatttccatgtggcaggtggttaggtaagggcatggacgatggctcattggagcggatactcgtgggagagctgctcacatcgcagccggaggtcgacgagcgcccatgcagaacaccaccgttgcagcagtccccatccgtgatccggaggctcgtgacaatctcccctaacaacaagcctaagctgaacaccggacagatccaggaaagcattggcgaggccgtgaatggcatcgttaaacacttccacaagcccgagaaagagcgcggaagcttgactctgctactctgtggggagtgcggccttgttagtgccctggagcaggcgtttcaacatggatttaaaagccccagactgttcaaaaacgtgtttatctgggatttcctggagaaagcacagacatactatgagacactggaaaagaatgaggtcgtgcccgaggaaaattggcatacacgggctcgaaacttttgccgatttgtgaccgccattaacaatacgccgcgaaacatcggaaaagatggaaagtttcaaatgctggtgtgtctcggggcaagggaccacctcctgcaccactggattgccctactagctgattgccctatcactgctcacatgtatgaagacgttgctctcattaaagatcacactctagttaactctctgatcagggtgctccaaacattacaagagtttaacatcacactggagaccagccttgtcaagggaattgacatttag

SEQ ID NO: 49788 - DNA, 1893 bp, Artificial Sequence
  Description of Artificial Sequence: Synthetic coding sequence
atgaagatcggccagggtaagtacgagcctgggttctttcctaagttacagagcgatgtgttatctaccggacccgcatcgaataaatggaccaaaaggaatgcgccagcgcagtggcgcaggaaggaccggcagaagcagcacactgagcatttgaggctggataatgatcaacgtgaaaaatacattcaggaggcacgtacaatggggtccacaatccgccaacctaagctcagtaaccttagcccttcagtcatcgcccagacaaactggaagtttgtggaggggctgcttaaggaatgtcgaaataagacaaaacgcatgctggtcgaaaaaatgggcagggaagctgtggaattgggtcacggggaggttaatattactggcgttgaagagaataccctgatcgctagtctttgtgacttgcttgagcggatttggagtcacggactccaggtgaagcaggggaaaagtgcattgtggtcacatttactgcactatcaggataaccgacaacgcaagctgacttcagggtccctgtcaacaagcggtatcctgttggatagcgagaggcgaaaaagcgatgcatcgagtcttatgccacctctcagaattagtctgatacaggatatgaggcacatccagaatataggagagatcaaaaccgatgtgggaaaggcccgagcttgggtgcgattgtcaatggaaaaaaagctcttatctaggcacctaaaacaactgctcagtgatcatgaattaaccaagaagctttataaacgatacgcgttcctgaggtgcgacgacgagaaggagcagttcttatatcacttgctctcctttaatgcggttgattatttttgtttcaccaacgtcttcacaaccatcctgatcccctaccacatcctgatcgtcccatctaagaaactaggcggaagcatgttcacagcgaacccctggatttgcatctccggagagttgggagagacccagatcatgcagattccgcgaaatgtgctagaaatgacttttgaatgccagaacctgggtaagctgacaacagtgcaaatcggccatgacaattcaggcctctatgctaagtggctggttgagtacgtcatggtgagaaacgagatcacaggacatacatacaaattcccatgcggcagatggctgggaaaagggatggatgatggctctctggaacggattctagttggggagttattgacatctcagcccgaggtggacgagagaccatgtaggacccctccactccaacagtctccatccgtgatcagacgacttgttacaatctctccgaataacaaaccaaaactaaacacggggcaaattcaggaatccattggagaagccgtgaacgggatcgtgaaacacttccacaaacccgagaaggagcggggaagtcttacactgttgctttgtggggaatgcgggctggtatcagctctcgaacaggctttccaacacggcttcaagagtcccaggctgttcaaaaacgtctttatctgggatttcctggagaaggcccagacatactatgagacattggagaaaaacgaggtggtgccagaggagaattggcacacgcgagccagaaacttttgccgcttcgttaccgccattaacaacacccctcggaacatcggaaaagacggaaagtttcagatgctcgtgtgtttgggggcacgggaccacctgctacaccattggatagccctgcttgccgactgccctattaccgctcacatgtacgaggatgtcgccctaatcaaagaccacactctggtgaactccctcatccgcgtcttgcagacactgcaagagttcaacattacactggaaacttctcttgtgaaaggaattgacatatag

SEQ ID NO: 49789 - DNA, 3726 bp, Artificial Sequence
  Description of Artificial Sequence: Synthetic coding sequence
atgtccggcggtggcggaggcggaggctctgcacccagtaggtttgcagattattttgttatctgtggcctcgacaccgagaccgggctagaacccgatgaactatcggctctttgccagtatatccaggcgagcaaagcaagagatggcgcaagcccattcatttcaagcaccaccgaaggggaaaacttcgagcagactccgctccgccgaaccttcaagagtaaagtcctagcccgatacccagagaatgtggaatggaaccctttcgatcaagatgcagtcggcatgctctgcatgcctaagggcctagcttttaagacacaggccgacccccgagaacctcagttccacgcctttatcataactcgagaggatggcagtagaaccttcgggttcgccttgactttctacgaagaagtcacaagcaagcagatatgttcagctatgcagactctgtaccacatgcacaatgcagaatacgatgtcctgcacgccccacctgcagacgatagggatcagagcagtatggaggatggtgaggacacaccagtgacaaagctgcagcgcttcaattcttacgatatctctcgggacaccctgtacgtctcaaagtgcatttgcttgataacacctatgagttttatgaaagcttgtagatcggtgcttgagcagttgcaccaggcggtgacctccccccagccccctccactccctctggagagctacatctacaatgttctgtatgaggttccgctgccaccgccaggaagatcgctcaaattctccggtgtgtacgggcctatcatctgtcagaggccctctaccaatgagttgcctttgttcgactttcccgtgaaagaggtgttcgagctgcttggcgttgaaaacgtgttccagctgtttacctgtgccttgctagaattccagatcttgctttactctcagcactaccaaaggctgatgactgttgctgaaaccatcaccgcactgatgtttccttttcagtggcaacatgtatatgtgcctatcctgcctgcctcactgctccactttctggacgctccggtcccttacctcatgggcctccactcaaacgggttagacgaccggtcaaaactggaactgccccaagaagcgaacctctgtttcgtggacatcgacaaccattttatcgaactgcccgaagatcttccccaattccctaataagctggagtttgtccaggaggtttctgaaatcttaatggccttcggcatcccacccgaaggaaatttgcattgctccgaatccgctagcaagctgaagaggctacgagccagcgaactggtgtccgacaaaaggaatgggaacattgcaggctctcccctgcactcttacgaactgcttaaggaaaatgaaactattgctagactgcaagccctggttaagcgaaccggagtgtcactggagaaactggaggtgcgcgaagatccttcatcaaataaggatctgaaagtgcaatgcgatgaggaggagttgcgtatttaccaattgaacatccagatccgagaggtgtttgccaaccgatttacacagatgtttgcagattatgaggtcttcgtgatccagcccagtcaagataaagagtcgtggttcaccaatcgcgagcagatgcaaaattttgataaggcttcctttctatctgaccagccagaaccatacctgcctttcttgtcaaggtttctcgaaacacagatgtttgcaagcttcatcgacaacaaaatcatgtgccacgacgatgacgacaaggatccagtcttgcgagtatttgacagcagagtggataaaatccgcttactcaatgtacgcactcccacactgcgcacgagcatgtatcagaagtgtactacggttgacgaggccgagaaagccattgagcttcggctcgccaaaattgatcacaccgccattcatcctcacctcctggacatgaagatcgggcaagggaaatatgagcccggattcttccccaagttgcagagtgatgttctgtcaaccggcccagcatcgaacaaatggactaaaaggaacgccccagctcagtggcggaggaaagatagacagaagcagcatactgagcacctgaggcttgataatgatcagagggaaaaatatatccaagaagccagaaccatgggatccactatccgtcagcctaagctaagtaatctgagcccgtccgttatcgcccaaaccaattggaaattcgttgaggggctactgaaggaatgcagaaacaagacaaaacgcatgctggtagaaaaaatggggagggaggcagtggagttaggtcacggcgaggtgaacataaccggtgtggaggaaaacacactgattgcctcgctgtgtgatctgctcgaaaggatatggtcacatggcttacaggtcaagcaaggcaagtcagccttgtggagccacctgctgcactatcaggacaatcggcagcgtaaattaacttccgggtcattgtccacctcaggtatcttgctggacagtgagaggcgcaaatctgatgcatcctccttgatgccccctctcaggattagcttgattcaggacatgagacatatccagaacattggcgagataaaaactgacgtcgggaaggccagagcatgggtacgtctgtcaatggaaaagaagcttctcagcagacacctgaaacagctgctgagcgatcacgagctcaccaaaaaattgtacaaaagatacgctttcctccggtgtgacgatgaaaaagaacagttcctgtaccatctcctgagtttcaatgccgtggattatttttgcttcactaatgtctttactaccatcttgattccataccatatcctcattgtgcccagtaaaaagcttgggggatccatgtttactgccaatccctggatctgtatctcaggggagctcggcgaaacacaaatcatgcaaatcccaagaaacgtcctggagatgacatttgaatgccagaatctgggcaagctcaccacagtgcagattggacacgataacagtgggctctatgcgaagtggctggtagagtatgtgatggtgagaaatgagataaccggacacacctataagttcccctgtgggcgatggttaggtaagggaatggatgacggttccttggagcgcatactggtcggagagctgttgacgtcacagcctgaggtggatgagaggccatgtcgaactcccccactgcagcagtcaccttcggtgatcagacgcttggtcactatctctccaaataacaaacccaaattgaatactggccagattcaggaaagcattggggaggccgtgaacggtatcgtcaaacatttccataaaccagaaaaggaacgtgggtcacttactctcttgttatgtggggagtgcggcctcgtgagtgccctagagcaggcctttcagcacgggtttaaaagcccccgactgttcaaaaatgtgttcatttgggattttctcgaaaaggcccagacgtactacgagacactggagaaaaacgaagttgtaccagaggaaaactggcacacaagggctcggaacttctgtcgttttgttaccgcgatcaataacacgcccaggaacatcggcaaggatgaaattacatcttacaccacagggcttccatgctggctcacagcccctagcctgcacacttgcatgcgcatgtggcattag

SEQ ID NO: 49790 - DNA, 3930 bp, Artificial Sequence
  Description of Artificial Sequence: Synthetic coding sequence
atgggcactcatcaccacgcccagcttatcttcgtgttcctcgtcgagatgcgttttcatcatgtggatcaggccggacttgaattgctgacgagcagcaacagccccgctagcgccagccgctctgccgagattactgttgtatcccagcacgcccagccgggattcctgtatcagtggttggaggcagatcggcacggtaagtctcagggtgcggctaatactactagcggggaaaattttgatcagtcccccctgcggagaacctttaaatctaaggtcctggcacattacccccaaaacatcgaatggaacccattcgatcaggatgccgttaatatgctgtgcatgccaaagggcctgagcttccgaacacagaccgataataaagatccccaatttcatagtttcatcatcacccgagaggacggtagccgcacttatggcttcgtcttgaccttctacgaagaggtcacctccaagcaaatctgcacagcgatgcagactctgtaccaaatgcacaacgcagagcactattcatccgtgtatgcgtcatcatcttgctccatggactctcttgcatcaagcttggacgagggggacacaaccagtctgttaaaactgcagcggtacaactcttacgacatttcgcgcgatacgctatatgtcagcaagagcatttgcctcatcaccccactgccctttatgcaggcttgcaaaaaattcctgattcaactgtacaaggccgtcacgtcccaacagcccccacctcttccattggaatcctatattcataatattctgtatgaggtgccactcccacctcctggtcggagcctgaagttttacggcgtttatgaacctgttatctgccagcgcccagggccaagtgagcttcccttgagtgactatccactgcgggaagccttcgagctgctgggcctcgaaaatcttgtacaggtctttacatgcgttctgttggagatgcaaatccttctgtactcccaagattaccagcgactgatgacggtggcggaagggatcaccacattattatttcctttccagtggcaacacgtgtacgtgcccattttacctgccagcttgctacatttcctcgatgctcccgtgccctacctcatgggactccagagtaaagagggcactgacaggagcaagctggagctgccccaagaagccaacctgtgttttgtggatatagacaaccatttcatagaattgcccgaagagttcccacagttcccgaacaaggttgacttcatccaggaattgtcagaagttctggtgcaattcggaattcccccagaagggtcactgcattgtagtgagagcacatccaaactgaaaaacatggttctgaaggacctggttaatgataaaaagaacggtaacgtttgtactaataatattagcatgtacgagctcctgaaaggtaacgaaactatagcacgcttgcaggccctagccaaacggacgggagtggctgtggagaagatggacctgtcagcgagcctgggtgagaaggataaggatctcaaactgcactgcgaggaggctgaattgagagattaccagttaaacgtacagctccgcgaagtctttgccaaccgatttactcagatgtttgcagattacgaggcctttgtgattcagactgctcaggatatggaaagttggttgaccaaccgcgagcaaatgcaaaacttcgacaaagccagcttcctgtcagaccagccagagccttatctgccctttctgtccaggttcatcgaaactcagatgttcgcgacttttattgataataagatcatgtctcagtgggaggagaaagatccccttttgagagtgttcgacactcggatcgacaagatcaggctgtacaacgttagggcaccaacgctgaggacgtctatatatcagaagtgcagcacactgaaagaggctgcacagtctatcgagcaacgactgatgaaaatggatcatacagccatacacccgcatctgttggacatgaagatcgggcagggcaagtatgaacagggattcttccccaaactgcagtccgatgttctggccacggggcctacgtccaacaatagatgggtgtcacggtctgccacggctcagaggaggaaggagcggctgagacagcatagtgagcacgtcggactggataatgacctgagggaaaagtacatgcaggaggctaggagtctggggaagaatctgcgacagcccaagctttccgacttgagtccagccgttatagcccagaccaattgtaaatttgtggagggcctattgaaagagtgtaggatgaaaacgaaacggatgctggtagagaagatgggacatgaggcagtagagctggggcacggcgaggccaatattaccggactggaagaaaacactctgattgcctcactatgtgatctcttagaaagaatctggagtcacggcctccaggtgaagcaaggcaaatcagccctgtggtcccacctgatccagttccaggaccgtgaagagaagcaagaacacctcgccgagtccccagtggcactggggccagaacgtcggaagtccgactcgggagtgatgctcccaaccctcagggttagtctcatccaggatatgagacacattcagaatatgtccgaaattaagacagacgtaggacgtgctagggcctggatccgcctgagcctggaaaaaaagctgttatcccagcacctgaaacaactgcttagtaaccagccgctaacaaagaaactgtataagcgatatgccttcctccgttgcgaagaggagcgggaacagttcctgtatcatttgctgtctctcaatgccgtagattatttttgcttcacatccgtgttcaccaccatcatgatcccctatcgctccgtgatcattccaatcaagaagctctctaatgctattatcaccagcaatccttggatctgcgtcagcggcgaacttggagacaccggggtgatgcagatcccaaagaacctgctggaaatgacgttcgagtgtcaaaacctgggcaagctgacaacagtccagatcggtcacgataatagcggcttactggctaagtggctggtggactgcgtcatggtgcgcaacgaaatcacaggccacacataccgctttccttgcggcagatggctcgggaaaggaatcgatgatggcagcctggaaagaatactcattggcgagctgatgaccagcgcgtctgatgaggacctggtcaagcagtgcaggaccccaccacagcaaaaatccccaaccaccgctcgtcgcctgtcaatcacttccctgacaggtaagaataataaacccaatgccggacagatccaggaggggataggcgaagcagtcaataatatcgtcaagcacttccataagccagagaaggaacgtggatcactcacggttctgctatgcggcgagaatggactggtggccgctttggagcaagtctttcaccatgggttcaagagtgccagaatctttcataagaacgtcttcatatgggatttcatcgagaaggtagtcgcgtatttcgaaaccacggaccagatactggacaacgaagacgatgttctcatccagaaatcttcgtgtaagacattttgtcattatgtgaatgcaataaataccgccccacggaacatcgggaaagatggcaagtttcagatactcgtttgtttgggcacacgggacagactgctacctcagtggatcccgctgctcgctgaatgtcctgcaataacacggatgtatgaggagtctgctctgcttcgagacagaatgacagtgaactccctgatcaggatcttgcagacaattcaggactttacaatcgtgctggaggggtctttgattaagggcgtggatgtctag

SEQ ID NO: 49791 - DNA, 2217 bp, Artificial Sequence
  Description of Artificial Sequence: Synthetic coding sequence
atgtcaggttcgtgcgcagcccctggtcctggctccggcagtagtcctgccgcttgtagattcgcacactattttgtgctctgtgggatcgacgctgacagtgggttggaaccagacgagctcgccgtcctgtatcagtggctggaggccgacagacacggcaagagccagggcgctgctaatacaacgtccggggagaatttcgaccagtcccctttgcgccgtactttcaagtctaaggttctggcgcattatcctcagaatatcgaatggaaccctttcgatcaagatgctgtgaacatgctgtgcatgcccaagggcctgtcattcaggactcagaccgacaataaggatcctcagttccacagctttatcataactagggaggatggaagccgcacttacgggtttgtcctaaccttctatgaagaggttacatctaaacagatttgcaccgccatgcagacgctgtatcagatgcacaacgcagaacactactcttcggtgtacgcgtccagctcttgttcgatggatagcctggcttctagcctggacgagggggacactacgagcctcctaaagctccagaggtataactcttacgacatttccagagatactctgtacgtttctaagagcatatgcctgattacccccttgccatttatgcaagcgtgtaagaaatttctgattcaattatacaaagcggtgacatcgcagcaacccccaccactgccgcttgagagttatatccataacattctgtacgaggttccgctccctccaccagggagaagtctcaaattctacggcgtctacgagccagttatttgtcagaggccaggacctagtgaactgccgctcagcgattatcctctgcgtgaggcctttgaacttttaggcctcgagaacctagtccaggtgttcacctgtgtcctcctggaaatgcagattttgctgtactcccaagactaccagcggttaatgaccgtggccgaaggcataacgactttgctgttccctttccagtggcagcatgtgtacgtacccatccttcctgcctctctgctccacttcctcgacgctcctgtgccatacttgatgggcttacagagtaaagaagggactgatagatcaaaattggagctcccgcaggaagccaacctgtgttttgttgacatcgataatcatttcattgagctgcctgaagagttcccccagttccccaacaaagttgattttatccaagaactatccgaagtcctggtgcaattcggaatacctccagaggggagtctacactgtagtgagtcaaccagcaaacttaaaaacatggtgctgaaggatttggtgaacgataagaagaacggcaacgtgtgcactaataacatatctatgtatgagcttctgaaaggcaatgagaccattgctagactccaggccctcgctaaacgtacaggtgtggcggttgaaaagatggacctgagcgcttctctcggggaaaaagacaaagacctgaaactgcactgcgaggaggccgaactgagagactaccagttgaacgtacaactccgcgaggtgttcgcaaatagatttacacagatgttcgccgactacgaggccttcgtaattcagacagcccaggatatggaaagctggctgacaaacagagagcaaatgcagaacttcgacaaggcgagttttctatcagaccagccggaaccatacctgccttttctgagccggtttatcgagacacagatgttcgccaccttcatagataataagataatgtcccagtgggaggaaaaagatccacttctgagagtcttcgatacacgcatcgataagattcgactgtataacgttcgagcgcctaccctccgcacctcgatctaccaaaagtgctcaacacttaaagaggccgcacaaagcatagagcagcggctgatgaagatggaccataccgccattcaccctcatctactggacatgaagatcggccaaggaaagtatgagcagggatttttccctaaactgcagtcagacgtgctcgccacagggccaacatctaataataggtgggtgtctagatccgcaactgctcagagacgcaaggagcggctcaggcaacattccgagcatgttggactcgacaacgaccttcgtgaggtgtgtggcctgccttcctggggcgcttctcaacaggcaccgtag

SEQ ID NO: 49792 - DNA, 3825 bp, Artificial Sequence
  Description of Artificial Sequence: Synthetic coding sequence
atgagcgggtcctgcgcggcacctggtccgggatccggaagcagcccagccgcatgcaggtttgcccactattttgtcttatgtggtattgacgccgacagtggattggagcctgatgagctagctggcgaaaatttcgaccagtcacccctccgcaggacctttaaatccaaggtccttgcccattacccccaaaatatagagtggaatccatttgaccaagacgctgtaaacatgttgtgtatgcccaaaggactgtctttcagaacccagactgacaataaggacccacagttccacagcttcattattacaagggaggatggttcgcgtacatacgggtttgtgttgactttttatgaagaggtcacctcaaaacagatatgcacagccatgcagaccttataccagatgcacaatgccgagcattatagcagcgtctacgcctctagctcttgttctatggactccctggccagtagtctcgatgagggcgacaccacgtccttactcaaattgcagcgctacaacagctatgatatatctagggatacactttatgtgagtaagagtatttgcctaattacgcccctcccttttatgcaagcatgcaagaaatttcttatccagctctacaaagcagtgacatcccaacagccacctcctcttcccctggagagctacattcacaatattttatacgaggtgccactccctcctcccggacggtcactcaagttctacggcgtgtatgagcctgtgatatgccagcgcccaggcccaagcgaactgccgctgtccgattatcctctgcgcgaagcctttgaactccttggtcttgaaaatctcgtgcaggtgttcacatgtgtgttgctcgagatgcagatcctgctctactcccaggactatcagagactaatgaccgtcgcagaagggatcaccacgctattgtttcccttccagtggcagcatgtgtacgtccctatactgccagcctctctgctgcactttcttgatgcccctgtgccttacttaatgggcctgcagtcgaaggaggggactgacagatcaaagctcgaactgccccaggaggccaacctctgttttgtggatattgataatcactttattgaattgcccgaagagtttccccaattccccaacaaagtggattttatccaggaactgtcagaggtcctcgtgcagtttggcattccgccagagggcagtctgcattgctcagagagtacctctaaactgaaaaacatggtgctcaaggaccttgtgaacgacaaaaagaacggaaacgtatgtaccaacaatatctccatgtatgaattacttaaaggcaacgaaacgatcgctcggcttcaggccctcgccaaacgaactggagtggccgtggaaaagatggacttgtctgcgagcttgggtgagaaagacaaggatctaaagctccattgtgaggaggctgaattgcgtgactaccaactgaacgtgcaactgcgtgaagtgtttgctaacaggttcacacagatgttcgccgactatgaggcattcgttatccagacagcacaggatatggaatcctggctgacgaaccgagagcagatgcagaactttgacaaagccagcttcctgagcgaccagccggaaccctacttgcccttcttgtcccggtttatcgaaacccagatgtttgcaactttcattgataacaagatcatgtcccagtgggaggaaaaggatcccttgcttcgggttttcgacacccgcattgataaaatcaggctgtataatgtgcgcgcacccacactaagaacaagcatctaccagaagtgctcgaccctgaaggaggccgctcaatctatcgagcagaggcttatgaagatggatcatacggccatccatcctcaccttctggatatgaagatcggtcagggtaagtatgagcagggcttttttccgaaactgcaatccgatgtgctggcaaccggcccaacatccaataataggtgggttagccggagcgctacagcccagcggagaaaagagcgcctcaggcagcattctgaacatgtcggactcgataatgacttgcgggagaagtatatgcaggaagcacggagcctgggaaagaacctccgacagccaaagctaagcgatctttctcctgccgtgattgcccagacaaattgtaagtttgtggagggccttctgaaggagtgcaggatgaagacaaagcgcatgttggttgaaaaaatgggccacgaggcagtggaattgggacatggcgaagccaatatcaccggactcgaggaaaacaccttgatcgcctctctctgtgaccttctcgagcgaatttggagccacggactacaagttaaacagggcaaatcagccctgtggagccacctgatccagttccaggacagggaagaaaagcaggagcatctggcagagtctccagtggcgctgggaccggagcgcagaaagagcgacagtggcgtcatgctgcccactctccgtgtgtccctgattcaggatatgcggcacatccagaatatgtccgagatcaagacagatgtagggcgagcgagggcttggatccgactgagtctcgagaagaagctcttgtcacagcatctgaaacagcttctgtcaaaccagccactcacgaagaagctctataaaaggtacgcttttcttagatgtgaggaggaacgggaacagttcctctatcacctgctatccttgaacgcagttgactacttctgttttactagcgttttcactacaatcatgatcccctatcggagcgtgatcattccgatcaaaaagctctcaaacgcaatcataacctccaacccatggatatgtgtcagcggagaactcggtgataccggggtgatgcaaattcctaagaatctcctcgagatgacgtttgagtgtcagaacctggggaaattgacgacagtccagatcggacatgacaattccggcctgctagctaaatggttggttgattgcgtcatggttcgaaacgagatcactggccatacttaccggtttccctgcggacggtggctgggtaagggaatcgatgacgggtccctcgaacgcattttgattggcgagttaatgaccagtgcgtctgatgaggacctggttaaacaatgccggacacctcctcagcagaagagcccaaccacggcgagacggctgagtatcacaagcctcacaggcaagaacaacaagccgaatgcaggccaaatccaggagggcatcggggaagctgttaataacatcgtgaagcatttccacaagcctgaaaaggagagaggatccctgacagtgctgttgtgcggggagaacggtctcgtggcggcacttgagcaggtgtttcaccacggcttcaagtctgcacgcatcttccacaaaaatgtttttatttgggacttcattgagaaagtggtagcgtactttgagaccactgatcaaattctggacaatgaagacgatgtgttgattcagaagtcctcatgtaagactttttgtcactacgtcaatgctataaatacagcaccccgaaacatcgggaaagatggtaagtttcagattcttgtgtgtttagggacccgggatcgtctgctcccacagtggatcccccttctggctgagtgcccagcaatcactaggatgtacgaggaatcagcactgcttcgcgacaggatgacggtaaactccctgataagaatcctccagaccatccaggatttcaccattgttctcgaaggcagcctcattaaaggggtcgatgtatag

SEQ ID NO: 49793 - DNA, 3930 bp, Artificial Sequence
  Description of Artificial Sequence: Synthetic coding sequence
atggggacacatcaccatgctcagctcattttcgtctttctcgtggagatgcgtttccaccacgtggatcaggccggtctagagctacttacatcatcaaatagccccgcatccgcttctcgatccgcagaaatcacagtggtctcacagcacgcacagcctgggttcctgtaccagtggctggaggcagatcgacacggaaagtcccagggagcagccaacacaacgtctggggagaacttcgaccagagtcctctcaggcggacatttaagagcaaagtgttagctcactacccgcagaatatcgagtggaatccctttgatcaagatgccgtgaacatgttatgtatgcccaaggggttgtcatttagaacccaaacagataataaggacccccagttccatagcttcatcattactagggaggacggatccaggacctacgggttcgtgttgactttttatgaggaggtgacaagtaaacagatctgtactgcaatgcagacactgtaccagatgcataacgctgagcactatagttccgtgtatgcttccagttcttgctccatggacagccttgcctccagcctggatgagggggacaccacttccctgttgaaactgcagcggtacaactcgtacgacatatcgcgtgatacgttgtacgtttcaaaaagtatttgtctgatcacgccactgccatttatgcaggcatgtaagaaattcctcatccaattgtataaggccgttacgtcccagcagcccccacctctccctttagagtcgtacatccacaacattctctatgaagttcccttgcctccccctggtcggtcattaaagttttatggcgtgtatgagcccgttatttgccaaaggcccggtccatccgaactccccctgagcgattaccctctgagagaggctttcgaactcctaggattggaaaacctcgttcaagtcttcacttgtgtgctactggaaatgcagatccttctctactctcaggactaccagaggctgatgacagtagccgaagggatcacaacgttactctttccttttcagtggcagcatgtttacgtgccaatactacctgcctctctcctgcatttcctggacgcgcctgtgccttatttaatggggttgcaatccaaggagggcaccgaccggagcaagctcgaactcccacaagaagctaacttatgcttcgtggatattgacaaccatttcattgagctccccgaagagtttcctcagtttcccaataaggtggattttattcaggagctgtccgaagttctcgttcagttcggcattccaccggaaggttccctacactgcagcgagagcaccagtaagctcaagaatatggtcctcaaggatctggtaaatgacaaaaaaaacgggaatgtgtgcaccaacaacatttctatgtatgaactgctgaagggaaacgagacaatagcgaggctgcaggctctggcaaagaggacaggggttgcagtcgaaaagatggacctgagcgcttcacttggagaaaaggacaaggacctgaagttgcactgtgaggaagctgaactgcgggattaccagctgaacgtgcagttacgtgaggtgttcgccaaccgctttacccagatgtttgccgattatgaagcctttgtcatacagacggcccaggatatggagtcttggttgacaaaccgggagcagatgcagaattttgataaagcatccttcctgtcggatcaacctgagccttaccttccgttcctgagccggtttatagaaacccagatgttcgcgacgttcatcgacaataaaatcatgtcgcagtgggaagagaaggatcctcttcttagagtgtttgacacccggatcgataaaatcaggctgtataatgtgcgggctcctactttacgcacatcaatctatcagaagtgttcaaccctgaaggaggctgcccaaagcattgagcagaggcttatgaaaatggaccacacggccatacatccgcacctgctggacatgaagattgggcaaggcaagtacgagcaaggcttctttccaaaattgcagtccgatgtgctggccaccgggccaacctcaaataatcggtgggtgagccggtcagccacagcacagcgccgaaaggagagattgagacaacactcggagcatgtcggactcgacaatgacctgcgcgaaaagtatatgcaggaagctcgctccctgggcaagaacctccgccagccaaagctctcagacctctcaccagccgtaatcgcgcagacgaattgcaagttcgttgaaggattgttaaaggagtgccgcatgaagaccaagaggatgctcgtcgaaaagatgggccacgaggctgtggaactgggccacggagaagccaatatcactggactcgaggagaacactttgatcgcaagcctttgcgacttattggagagaatctggtctcatggcctgcaggtaaagcagggcaagagtgccctatggagccatctgatacagtttcaagatagagaggaaaagcaggagcacctcgctgaatcacctgtggcccttggacccgagaggagaaaatctgactccggcgtcatgttgccaacgcttcgggtgtctctgatccaggatatgaggcacatccagaacatgtcggagatcaagacagatgtgggtcgagccagagcctggatcagactgtccctcgagaaaaagctgctgtcgcagcacctgaaacagcttctgtccaaccagccgctcacaaagaagttgtacaagaggtacgctttccttcgatgcgaggaagaaagggagcaattcttgtaccacttgctgagtctgaatgcggtagactatttctgttttacctctgtgttcacgaccattatgattccctatcgcagcgtcatcatcccaatcaagaagcttagcaacgctattatcacctctaatccttggatctgcgtcagtggggaactgggtgacactggcgtgatgcagatcccgaagaacctgctcgagatgacatttgagtgccagaacttgggcaagctgactacagtccaaatcggccacgacaattcagggctcctcgccaaatggctggtggactgcgttatggtcaggaacgagatcactggccacacatataggttcccctgtgggaggtggctgggcaaaggtatcgatgatggctccctggaacggattctgatcggagagctcatgacgtctgcctctgatgaagatctggttaaacagtgccggaccccccctcagcagaagtctccgacaacggccaggagactgtccattactagtttaacagggaagaataacaagcccaacgccggacagatacaagaaggcatcggagaggcagtgaacaacatcgtgaaacactttcataaacctgagaaagagagagggagcctgacagtgctgctatgtggtgaaaatggcctggtggccgctctggaacaagtgtttcaccacggctttaaatcagcacggatctttcacaagaatgttttcatctgggacttcatcgagaaagtcgtcgcgtacttcgagaccactgatcagatcctcgataatgaagatgacgtgctgatccaaaaatcctcctgtaagaccttttgccactatgttaacgccattaataccgcgccacggaatatcgggaaggacggcaagttccaaatcttggtctgcctggggacccgcgatcgtctgctgccccagtggatccctctattggctgaatgtcccgcaatcacaaggatgtatgaggagagcgcattgcttcgggacagaatgaccgtgaacagtctgattcgtatcttacaaacaatccaggatttcaccattgtcctggagggctcactgataaagggcgtggatgtgtag

SEQ ID NO: 49794 - DNA, 399 bp, Artificial Sequence
  Description of Artificial Sequence: Synthetic coding sequence
atgtttctggtgggtctgactgggggaattgcttctgggaaatctagtgtcatccaagtcttccagcaattgggatgcgcggtgatagacgtagatgttatggccaggcacgtcgttcagccaggatatcctgctcaccgaaggatagtcgaggtcttcggaacagaggtcctactggagaacggcgatattaaccgcaaagttctgggcgatctgatcttcaatcagcccgaccggaggcagctcctcaatgcaatcacacaccctgagattcgaaaagaaatgatgaaggagactttcaaatattttctccgtgagcctaggacatcaccgagggggaagaaacatgttccctctgctctcaaagaagcagacagcctgatgcgacgcgatacatag

SEQ ID NO: 49795 - DNA, 696 bp, Artificial Sequence
  Description of Artificial Sequence: Synthetic coding sequence
atgtttctggtgggcttgacaggcggaattgccagcggtaagagctccgttattcaggtgtttcagcagctggggtgcgcagtgattgatgtcgacgtcatggctcggcatgtggtgcagccgggatatccagcacaccgcagaattgtggaagtgttcgggactgaggtgctccttgaaaacggtgatattaacaggaaggttctgggggacctgatctttaaccagcccgacaggagacaattgctgaatgcgattacacatccagagatccggaaagagatgatgaaagaaaccttcaagtattttcttagaggatatcggtatgtcatcttggacattccactgcttttcgagacaaagaaattgttgaaatatatgaagcacaccgtggtggtgtactgtgatcgagatacccagctggctaggctaatgaggcgcaatagcctgaaccggaaagacgccgaggctaggatcaacgcacaactgcctcttaccgacaaggccagaatggcacggcacgtccttgataattccggagagtggagcgtgaccaagcgtcaagtgattctcctccacacagaactggagagatcactggagtaccttccgcttcgatttggggttctcaccggcttagccgctattgcctcacttttgtacctgctcacgcactacctgctgccttacgcttag

SEQ ID NO: 49796 - DNA, 696 bp, Artificial Sequence
  Description of Artificial Sequence: Synthetic coding sequence
atgtttctggtgggcctgactggtggtattgcttcaggtaagtccagcgtcatccaggtgttccagcagttaggatgcgcggttattgatgttgacgtcatggctcggcacgttgtgcaaccaggttacccagctcaccgccgtattgtcgaggtatttggcactgaggtgctcctggaaaatggcgatatcaaccgcaaagtactgggggatctcatcttcaatcagcctgatcgacggcagctcctcaacgccattacccaccctgaaatccgcaaagagatgatgaaggagactttcaagtattttcttcgaggatatagatacgttatattggatataccactgctgttcgaaaccaagaagcttttgaagtacatgaagcataccgtcgtggtatattgtgatcgggacactcagctggcacgtctgatgcgaaggaattcactgaatagaaaggatgcagaggctcgaatcaacgcgcaattgccactaacagacaaggctagaatggcacgacatgtcctcgacaatagtggagaatggagcgtgacaaaacgccaagtgatcttattgcatactgagctggagaggtcactcgagtatttgcctctccgcttcggggtactgacaggcttagctgccattgctagccttttatacctgttaacccattacttgttgccatacgcctag

SEQ ID NO: 49797 - DNA, 756 bp, Artificial Sequence
  Description of Artificial Sequence: Synthetic coding sequence
atgtctgatataggagattggttccggtccattcccgcaattacgcgttactggtttgctgcaaccgtcgcagtccccctcgtgggaaagctgggactgatctcacccgcatacctgtttttatggccagaggccttcttgtacagattccagatttggcgacctatcactgctacgttttactttccagtaggccctggcactggtttcctctaccttgtgaacctttattttttgtatcagtattcaactaggcttgagacgggagcgttcgatgggaggcccgctgactacttatttatgctgttatttaattggatctgtatcgttatcaccggactggccatggatatgcagctgcttatgataccgctgatcatgagtgtcctatatgtgtgggcccagttaaacagggacatgattgtgtctttttggtttggaacgcgtttcaaggcgtgctacctaccatgggtcatactcggcttcaattatattataggaggatctgtcatcaatgagctaatcggaaacttggtgggacacctttatttttttctgatgtttaggtatcccatggacctgggcggacgcaatttcctgagtaccccacaattcctttatcgttggctgcccagcagaagagggggagtttctggctttggtgtcccccctgccagcatgcgccgagctgcggatcagaatggcggaggagggcgacacaattggggccagggcttccgcctgggcgaccaatag

SEQ ID NO: 49798 - DNA, 696 bp, Artificial Sequence
  Description of Artificial Sequence: Synthetic coding sequence
atgtctgatattggtgactggtttagatccattccagctattaccagatactggttcgcggcaaccgtcgcagtaccgttggtcggtaagttgggactgattagtccagcctacctgttcctgtggccagaagcgtttctatatcgatttcagatctggaggccgataactgccactttttacttcccagtgggcccaggcaccggatttctgtatctcgtgaatctatactttctgtaccagtactccactcgcctcgagacaggggcattcgatggaaggccagcagactatttgttcatgctcctttttaactggatatgcatcgtaattaccgggctggccatggatatgcaactgctgatgatccccttgataatgagtgttctatatgtctgggctcagctgaaccgggacatgattgtctctttctggtttggcactagattcaaagcctgttatttaccctgggtgattctggggttcaactatatcattgggggatcttacccgatggaccttggtgggagaaattttctcagcactcctcagttcctgtatcgatggctgcccagccggagaggcggagtgtccggttttggggtgccacctgctagcatgcgacgggctgctgaccagaacgggggaggcggacggcacaattgggggcagggctttcgtctcggagatcagtag

SEQ ID NO: 49799 - DNA, 456 bp, Artificial Sequence
  Description of Artificial Sequence: Synthetic coding sequence
atgagtgacattggtgactggtttagatcaatccccgcaataacaaggtattggtttgctgccacagtggcggtgccccttgtggggaagctgggtctgatctctcctgcatacctctttctgtggcccgaagccttcctctatagatttcaggcgtgctatctcccgtgggtcattctcggcttcaattacataatcggtggatcagtaatcaacgagctgataggcaacctcgtgggccacctttacttttttttgatgtttagataccctatggacttaggcggtcgaaatttcctctctacgccgcagttcctgtataggtggctcccctcacgcagaggaggcgtgtccggattcggggtccctccagcttccatgagacgtgccgctgaccagaatgggggtggtggcagacacaactggggccagggcttcagactgggcgaccaatag

SEQ ID NO: 49800 - DNA, 720 bp, Artificial Sequence
  Description of Artificial Sequence: Synthetic coding sequence
atggcttatcagagcctgaggcttgaatatttacaaatccctccagtcagtagggcatacaccacagcctgtgttttaacaactgccgctgtgcagctggaacttattaccccgtttcaactgtattttaatcctgagttaatttttaagcatttccagatatggcgcctcatcacaaattttctcttttttggccctgtggggttcaactttctgttcaatatgattttcctctacagatattgtcggatgctggaggagggttcatttcgagggcgtacagcagactttgtgttcatgttcctcttcggtgggtttttgatgacactatttgggctattcgtgagtttagtgtttctcgggcaggcatttacgatcatgctcgtatacgtgtggtcccgccgaaatccttacgtgcgaatgaacttcttcggacttctgaactttcaagcaccttttctgccatgggtgctgatggggtttagtctcctacttgggaatagtatcatcgtagacctgctaggcatagccgtcggccatatttactttttcctggaagatgtatttcccaaccagcccggaggaattcggatcctgaagactccgtcaatcctaaaagcaatcttcgacacccctgatgaggaccctaactataatcctctgccagaggaacggccaggtgggttcgcctggggcgagggccaaaggttaggaggatag

SEQ ID NO: 49801 - DNA, 708 bp, Artificial Sequence
  Description of Artificial Sequence: Synthetic coding sequence
atggcatggcaggggctcgccgcagaatttttacaagtgccagcggttacgagggcatataccgcagcatgtgttctaacaactgccgcagtccagctagagctgctgagcccatttcagctttactttaacccccacctggtttttcgtaaatttcaagtctggagactggtgaccaacttcttgtttttcggcccactcggattttcatttttttttaacatgctttttgtgttccgttattgtaggatgcttgaagaaggctcgttccggggaaggactgccgattttgtatttatgttcctgttcggcggagttctcatgacactgctgggccttctaggatccctgttttttctgggccaagctctcatggccatgctggtgtacgtatggtcccgcagatccccccgtgtgcgcgtcaacttttttggactgttgacttttcaagctccatttctgccatgggccctaatgggctttagcctcctgctgggcaacagtattctggtggatttgcttggcatcgctgtgggacacatctactactttctggaagacgtgtttccaaatcagccagggggaaagcggctactgcaaacccccggttttctcaaattattactggatgctccagctgaagaccccaattatttgccattgcctgaagaacaacccggaccacacctgccacctccgcagcaatag

SEQ ID NO: 49802 - DNA, 618 bp, Artificial Sequence
  Description of Artificial Sequence: Synthetic coding sequence
atggcctggcagggcctggccgctgaattcctgcaggttcctgcagtcactagagcctatactgctgcctgcgtcctgaccaccgcagccgtgcagcttgagctgctgagtccatttcagctctattttaaccctcatctcgtgttcagaaagtttcaggtgtggcgcctcgtgaccaactttctcttctttgggcctttaggatttagcttcttttttaatatgctcttcgtgttcaggtattgtcggatgttagaagagggctcttttagaggcaggactgctgacttcgtgttcatgtttctcttcggcggtgtcctcatgaccctcctcggcttgctgggctccctttttttcctgggtcaggcgctcatggcaatgcttgtctatgtctggtcccggagaagcccgcgagtccgcgtcaatttctttgggcttctcaccttccaagcgcctttcttaccttgggcccttatgggattcagcctcttgctgggtaactctatcctagtggacctcctcggcattgccgtcggccacatttattactttctagaagacgtgttccccaaccaacctggtgggaagcgacttctgcagacccccggttttctgtag

SEQ ID NO: 49803 - DNA, 720 bp, Artificial Sequence
  Description of Artificial Sequence: Synthetic coding sequence
atggcgtggcagggactggcagctgaattcctacaggtgccggcagttaccagggcctacaccgctgcgtgcgttctcacaacggcagcagtgcaacttgagcttctgtcgcctttccagctctactttaatccgcacctggtctttcggaagttccaggtgtggaggctggttactaactttctcttcttcggccctttgggattctccttcttttttaatatgctgttcgtgtttaggtattgtcggatgctggaagaagggtcttttcgtggcaggactgctgactttgtatttatgttcttatttggtggagtgcttatgacactgctgggtctcctgggaagtctgttctttttaggacaggcccttatggcaatgcttgtgtatgtgtggagtcgtcggtctccaagggtgagagtgaattttttcggtctcctgacttttcaagcaccattcctgccctgggccctgatgggattcagcctcctcctgggtaatagtatcctagtggacctgttaggaattgccgtggggcatatttattacttccttgaggatgtctttccaaatcagcccggagggaagcggcttcttcagacgcccggattcctggggctccagtcttcgaaagcccctgccggttcaagtctgaccatatggacgcagcagtcccaaggcggaccaggtacagctggagagcttgccgcacctagttag

SEQ ID NO: 49804 - DNA, 2838 bp, Artificial Sequence
  Description of Artificial Sequence: Synthetic coding sequence
atggcagagggtcagggcggaggcggtcagaggtgggactgggccggaggcggacgtgctgccgaggaggaggtggtgcgcagaagatgccgccgtggggaagaagcccaggtggcccagccctggcctgaggggtccagaggtaccgcagcaggtccgcctgttgaggagagattcaggcaattacacctgcgaaaacaggttagctacaggaaggctatcacaaagtctggcctacagcacctggctcctcctccaccaactcctggcgctccctgtagcgagagcgaacgtcagattcgctccacagtcgactggagtgaatcagccacttacggggagcacatctggtttgagacaaatgtgagtggggatttctgttatgtaggagagcagtactgcgtggcacgaatgcttaaatctgtcagtcgacgcaaatgtgcagcctgtaaaatcgttgtgcatacaccttgcatcgagcagttagagaaaataaatttccgctgcaagcccagttttagagagtctggttccaggaacgtacgggaacctacctttgtccgccaccattgggtgcatcgcagaagacaggatggaaagtgccggcactgtggtaaaggattccagcagaaatttacctttcattctaaagagatcgtcgcaatttcttgtagctggtgcaagcaggcgtatcatagtaaagtcagctgtttcatgctacagcaaatcgaggaaccctgttccctgggagtgcatgctgctgtggtcatcccccctacatggattcttagggcaagaagaccacagaacaccctcaaggcctcaaagaagaagaagagggcctcatttaagcgtaagagcagcaagaaagggcctgaagaaggacgctggcggccatttatcatccggcctactccttcgcctctgatgaaaccactacttgtcttcgtgaatcccaaaagtggcggaaaccaaggggctaagatcatccagtccttcctgtggtacctcaatccgaggcaggtctttgacctgagtcaaggaggtccaaaagaggccttagagatgtacagaaaggtgcacaacctgaggatcctcgcgtgcggaggggatgggaccgttggttggatcctctctaccctggaccaacttcgcttgaaaccacctccccctgtcgccatcttgccactcggtacaggcaacgatttggccaggacacttaattggggcggaggatacacagacgaacctgtctccaagatactctcccatgtggaagaaggcaacgttgtgcagttagacagatgggacttgcacgctgaaccaaatccagaagcaggaccagaagatagggacgagggggcaacagatcggctgccactcgatgtgttcaacaattacttcagtctcggcttcgacgcccacgtcaccttggaatttcacgaatctagagaggcaaacccagaaaagtttaatagtaggtttcgtaataagatgttttacgctggtaccgcatttagcgactttctgatgggctctagcaaagatctggccaaacacattcgtgtggtgtgtgatggaatggatctgacacctaagattcaggaccttaaaccacagtgtgtagtgttcttgaatattccacgctactgcgcgggtacgatgccctggggtcacccaggggagcaccacgattttgagccacagagacatgacgacggatacctcgaggtgatagggtttaccatgacaagtctggccgctctgcaggtgggagggcacggggagcgattgacacaatgtcgtgaggtggtattaaccaccagcaaggccatccccgtccaggtcgatggcgaaccctgtaagttagcagcctcaaggattaggatcgctcttcgaaaccaggcaacaatggtacaaaaggccaagaggcggtcggcggcaccactccacagcgaccagcagcctgtaccggagcagttgcgaattcaagtgtcaagggtttcgatgcacgattatgaagctctgcattatgacaaagagcagttaaaggaggcatccgttcccctggggactgtcgtggtaccaggagacagcgatctggagttatgcagggcccatatagaacggttgcaacaggaacccgacggagcaggggctaagtctccaacctgtcaaaaactatccccaaagtggtgcttcctggatgccactaccgccagtagattttaccgcatagacagagcccaggagcacctgaattatgtgaccgagatcgcacaagatgaaatatatattttggatcctgagttactgggggctagtgctcggcctgatttacctacccccacttcaccattacctaccagcccctgcagccctacaccgaggtccctgcagggcgatgcagctccacctcagggtgaggaacttattgaggctgctaagagaaatgacttctgtaagttgcaggagctgcacagggcaggtggcgatcttatgcatagggatgaacagagcaggaccctgctgcatcacgccgtgagcaccggatctaaggacgtggtccgatatctccttgaccatgctccaccagagatattggatgcggttgaagaaaacggggagacatgcctgcaccaagcagccgcacttgggcagcgaaccatctgtcactatatcgtcgaggctggcgctagtctcatgaagacagaccagcaaggcgacacccccaggcagcgagctgagaaggcacaggatacggaactcgctgcttatctcgagaatagacagcactaccagatgatccaacgggaggaccaggaaaccgctgtatag

SEQ ID NO: 49805 - DNA, 2805 bp, Artificial Sequence
  Description of Artificial Sequence: Synthetic coding sequence
atggagccgagagacggctcaccggaagccaggtctagcgacagcgagtcagcatccgcgagttcttctggctctgaacgcgacgctgggcctgagcctgataaagctcccagaagactcaacaagcggagattccctggactgcggctcttcggccatcggaaagctattactaagtccggcttgcaacacttagctcccccaccccctacacctggcgcaccctgtagcgagagcgagcgccaaattagatctaccgtcgattggtctgaatctgctacatatggagaacatatctggttcgaaactaacgtgagtggggatttttgttacgtgggtgaacagtattgcgttgcaagaatgctgcagaagagtgtttctcgcaggaaatgcgccgcatgtaagatcgtcgttcacaccccctgcattgaacagctcgagaaaatcaacttcaggtgtaaaccatccttcagagagtcaggtagccgaaacgtgcgcgagcccacattcgtcagacaccactgggttcaccgcaggcggcaggatgggaagtgtcggcactgcggaaagggcttccagcaaaagttcacattccactcaaaggagattgtggccattagctgcagctggtgcaaacaggcctatcactccaaagttagctgctttatgttgcaacagatagaggagccatgcagcctcggcgtgcacgcagccgtcgtaatcccccctacatggattttgcgggctaggagacctcaaaacaccctgaaggcctccaaaaaaaaaaagagggcctcttttaaaagaaaatccagtaagaaaggcccagaggagggacggtggagaccttttattatccgcccaaccccctcccctttgatgaaaccactgctcgtcttcgttaatcccaaaagcggaggcaaccagggagctaaaatcatccagtccttcctgtggtatctcaaccctcggcaggtgttcgatctgtcccaaggcggacccaaggaggctttagagatgtacagaaaggtgcataacttacggatcctggcttgtgggggtgacggtaccgtcggatggatactgtcaaccctcgatcagttgcgcctgaagcctccaccgcctgtggctatcctgcccctgggaactggaaatgatctcgcaaggaccctgaattggggagggggatacacagacgaaccggtttcaaagatcctgagccatgtagaggagggaaacgtcgtccagctggacaggtgggatctgcatgccgagcccaatcctgaagctggccctgaggaccgggatgaaggggctactgatcgcttgcctttagacgtcttcaacaattacttctctctggggttcgatgctcacgtcactctggaatttcatgagtctagagaggccaaccctgagaagttcaattctagattccgcaacaagatgttctacgcgggtactgccttctctgattttctcatgggaagttccaaggatctcgcaaagcatatccgcgtggtgtgtgacggaatggatttgacccccaaaattcaggatctgaagccacagtgtgtagtgtttctgaatatcccacgatactgcgctggaacaatgccttggggccaccccggagagcaccacgactttgagccacagaggcacgatgacggctacctagaggtcatcggcttcacaatgacaagccttgcggctttgcaggtagggggtcatggggaaaggctcacccagtgtagggaagtggtattaacgacgagcaaggccattccagtgcaggttgatggggagccatgcaaacttgcagcttctaggatcaggattgccctgagaaatcaggccactatggtccaaaaggccaaacgccgaagcgcagctcccctccactcggatcagcagcccgtcccagagcagctccggatacaggtgtcgcgcgtgagcatgcatgactatgaggctctccattatgataaggaacagttgaaggaggcatccgtgcccttaggaacggtcgtggttcccggtgacagtgatctcgaattgtgtcgtgcccacattgaaagactgcagcaggagcccgatggtgccggtgccaagagccctacctgtcagaagctgtccccaaagtggtgtttcctagatgcgaccactgcttcacgcttttataggatcgatagagcccaggaacacctcaattatgtgacagagatcgcccaggatgagatttacatcctggacccagaacttctgggtgctagcgcaaggccagatctccccacccctacctcgcctctgccaacctctccatgctcccctactccccgatcccttcagggagacgctgctccaccccagggtgaagaactgattgaggctgctaagcgaaacgatttctgtaaattgcaagagctgcacagagccggtggcgatctcatgcatagagatgaacaatctcggaccctgcttcaccacgccgtctccaccggaagcaaggacgtggtcagatacttgttagatcacgcccctccagagattctggatgccgtagaggagaatccctgcagcccctcaggagaaacatgtctgcatcaggccgcagctctgggccaacgcaccatatgtcactatattgtcgaagctggggcaagcttgatgaaaactgaccagcaaggcgacacaccccgacagcgggctgagaaggctcaggataccgagttagccgcttacctggagaatcgtcagcactatcagatgatccagagggaggaccaagaaacagctgtatag

SEQ ID NO: 49806 - DNA, 3495 bp, Artificial Sequence
  Description of Artificial Sequence: Synthetic coding sequence
atggcgggtgccggtggacagcaccaccccccaggcgcagccggaggtgcggcagctggagctggagccgcagtaacctctgccgcagcgtccgccggacccggagaggatagtagtgattctgaagcggagcaagaaggaccacagaagctgattaggaaggtatctaccagcgggcaaatccgcacaaaaacctccatcaaagaaggacagctactgaaacaaacctcttcctttcagaggtggaaaaagcgctattttaaactccgtgggaggaccctctactacgccaaggattcaaagagtctcatattcgacgaagttgatctttcagatgcatccgtagcggaagcctcgactaaaaatgctaataattcgttcacaattataactccatttagaagactcatgctctgtgctgagaaccggaaggagatggaagactggattagttccctcaagagcgtacagacgagggagccttatgaagtagcccaattcaacgtggaacatttttccggaatgcacaattggtacgcgtgttcacacgcccgaccaaccttctgcaatgtgtgtagagagtccctgagcggagtgacatcccatggcttatcgtgcgaggtgtgcaagtttaaggcccacaagcgctgtgcagtacgcgctacaaacaactgtaagtggacgactctggcaagtattggcaaagacatcatcgaggatgaagatggcgtggctatgccccatcaatggcttgaggggaacttgcccgtctctgctaaatgcgcggtgtgtgacaagacttgtggatcagtgcttcgcctgcaagactggaagtgtctttggtgtaagacaatggtgcacaccgcctgcaaagatctttatcatccaatctgccctctaggccaatgtaaagttagcattatccctccaattgccctaaatagcaccgatagcgacggcttctgtcgggctacattttccttctgtgtgagccccttattggtgttcgtgaattcaaaatctggtgataatcaaggtgttaaatttctcaggaggtttaaacaattactcaacccagcgcaagtattcgacctgatgaacggcggaccccatctaggcctgagactgtttcaaaagtttgataactttcgcattctggtgtgcggaggagacggatccgtgggctgggtgctatccgagattgacaaacttaacctaaataaacagtgccagttaggagttcttcctctggggaccggaaatgacctcgcgcgagtgctggggtggggcggatcatatgatgacgatacccagctaccacagattctggagaaactcgaacgcgcaagcaccaagatgttagaccggtggagcattatgacatacgaactaaagcttccacccaaggcgagtctcctccctggaccccctgaggccagtgaagaattttacatgacaatttatgaggactcagtcgcgacacatctgaccaagatcctgaacagcgacgagcatgcggtagtgatctcctcagccaagacgctctgtgagacagtcaaagactttgtggcaaaagtagaaaagacctatgataaaaccctagagaacgctgtcgtcgccgacgccgtagcctcaaaatgctctgtgttgaatgaaaaactggaacagctgctgcaggccttacacacagactctcaggcggctcccgtgttaccaggactgtcacctctaatcgtcgaggaagacgccgtggagtcatcctctgaggaatcgcttggcgaatccaaggaacaactgggagatgatgtaaccaagccttcatcccagaaagccgtaaaacctagagagatcatgctgagagcaaactccctgaagaaagcggtccggcaggtcatcgaggaggccggaaaggtcatggacgacccgacagtgcacccttgtgaaccagctaaccaatcatccgattacgacagcactgagacagacgagtctaaagaagaggctaaggacgacggagccaaagaatcaataacagtaaaaacagctcctcgatccccggacgcgcgagcctcttatgggcacagccagacagactccgtgcccggtcctgcagtcgccgcaagcaaggagaatctgcctgtcctaaatactcgcatcatttgtccaggactgcgggcaggactggcagcatcaattgcaggtagcagtattattaataagatgttactggcgaacattgaccccttcggggctaccccctttatcgaccctgatctggattccgtggacggttacagtgaaaaatgcgtcatgaacaattacttcgggataggcctcgatgccaaaatctccctggagttcaacaataagcgcgaggagcaccccgagaaatgcagaagtaggaccaagaatctgatgtggtacggggtgcttgggactagggaactccttcagagatcatacaagaatcttgagcaaagagtgcagttggagtgcgatggccaatacattccgttgccctctcttcagggcattgccgttctgaacattccaagctacgctgggggaacaaacttttggggaggtactaaggaagacgacatcttcgccgcacctagtttcgatgataagattctggaagttgtggcaatctttgatagcatgcagatggctgtgagccgggtaatcaaactgcaacaccatcggattgcccagtgccggacggtgaagatcacaattttcggagacgaaggggtgcctgtccaggtggacggcgaggcatgggtgcagccacccggaatcatcaagatcgtccataaaaatagagcccaaatgttaactagagacagggcatttgagtcgaccctgaaaagctgggaggacaaacagaagtgcgactcaggaaagcccgttttaagaacccacctgtatattcaccatgctattgacttagctactgaagaagtttctcaaatgcagctgtgttcacaggctgcggaggaactgatcaccagaatatgtgatgccgctacaatccattgtctgctggagcaggagctggcccatgccgtgaatgcttgcagtcacgctctgaacaaagcgaaccccagatgcccagaatcgttaacgcgggacacagccacagaaatcgcaattaacgtcaaagcactctacaacgagacagagtccctgctcgtaggcagggtgccgttgcaactggagtccccacatgaagagcgggtctctaacgcattgcatagcgttgaggtggaactgcagaagctgactgaaattccgtggctgtattacatcctgcaccccaacgaggatgaggagcccccaatggattgtaccaaaaggaataaccgaagcaccgttttccggatcgtgcctaagtttaagaaagaaaaagtgcaaaaacagaagaccagcagccagccaggttctggagacactgaaagcggatcatgtgaggccaattctccaggcaactag

SEQ ID NO: 49807 - DNA, 3663 bp, Artificial Sequence
  Description of Artificial Sequence: Synthetic coding sequence
atggctggcgctgggggtcagcatcatcctccgggtgccgctgggggtgcagcagctggtgccggtgccgcagtcacgagcgctgcagcttcagccggtccaggtgaggatagctcagattctgaggcagaacaagaagggccacagaaattgatccgcaaggtgtcaacaagcgggcagattcggacaaaaactagcattaaagaaggtcagctcctcaaacagaccagcagcttccagcggtggaaaaaacggtatttcaaattaaggggtcggactctctactacgccaaagactctaagtcactgatatttgacgaggtggacctgagcgacgcatccgttgctgaggcaagtacaaaaaatgctaacaactcttttaccattatcaccccattcagacggctgatgttgtgtgccgagaaccgcaaagagatggaagactggatctcctctctgaagtccgttcagacgcgcgagccctatgaggtggcgcaatttaatgttgagcacttctccggcatgcacaactggtatgcatgttcacacgcgagacccaccttctgtaatgtctgtcgggagagcctgagcggagtgacgagccatggactgtcttgtgaagtgtgcaaattcaaagcacacaagcgatgcgccgtccgggctacaaataattgcaaatggacgaccctggcatccattggtaaggacatcatagaggacgaggacggcgtggccatgccacatcagtggctcgaggggaacctgccagtgtcggcaaaatgtgctgtctgtgacaagacctgcggatccgtccttagactgcaggattggaagtgcctgtggtgcaagactatggtccatacagcatgtaaggatctctatcatcccatctgccctctggggcagtgcaaagtatctatcataccacccattgccctcaacagtacagactcggatgggttttgccgagcaacattttcattctgcgtgtctcctctgctggtcttcgttaacagcaaatctggtgacaatcagggagttaaatttctccgacggttcaagcagctgctaaatccagcccaggtgttcgatctcatgaacggtggaccacacctcggcctgaggctctttcagaagttcgacaattttcgcatcctcgtgtgcggtggtgacggatcagtgggttgggtgctctccgaaatcgacaaactgaatctgaacaaacagtgtcagctcggggtcctgccactggggacaggcaacgatctggccagggtgttgggatggggcggatcatacgatgacgatacccagttacctcagatccttgagaagctcgagcgtgctagcactaagatgctggataggtggtccatcatgacctacgaactgaagcttcctcctaaggcttctttattgccgggtcccccagaagccagcgaggaattctacatgaccatctacgaagattcagtagccacacacttaactaagatcctcaattctgacgaacatgctgtagtgattagctctgcaaaaaccctctgtgaaactgtaaaggactttgtggccaaagttgagaagacctatgataagactctcgaaaacgccgttgtggcggacgccgtggccagtaaatgtagcgttctgaatgaaaaattggagcagttactccaggccttacacacggattcccaggccgcacccgtgctgcccggactcagtccattaatcgtggaagaggacgccgtggagtccagctccgaagagtctctgggagaatcaaaggagcaactcggggacgatgtcacaaaaccatcgagccaaaaggctgtgaagccacgggagattatgttacgggctaactcgctcaaaaaagctgttagacaggtcatagaggaagctggtaaagtcatggatgacccaacagtccacccttgtgaaccagctaatcaatccagtgattacgattctacagagactgatgagtctaaggaggaggccaaagatgatggagccaaagagtccataacagtcaagaccgcccctagaagccctgacgcgagggcttcatatggccactcgcagacggactcggtaccaggacctgccgtggctgcaagtaaggaaaacctgcccgtgctgaataccagaatcatttgtcctgggctaagggcaggcctcgccgcttcaatagcaggctcttccataatcaacaaaatgctgttggccaatattgacccatttggagctacacctttcattgacccagacctggatagtgtggacggatattccgaaaaatgcgttatgaacaattatttcggaatcggcttggacgctaaaattagccttgaattcaataataagcgggaggagcatcctgagaagtgccgctcacggactaaaaatctgatgtggtatggcgtgttggggaccagagaactcctccagagaagttacaaaaatctggagcagcgggtgcagctggagtgcgatggacagtacatcccactgccttccctgcagggtattgcagtgctgaatatcccctcatatgcgggaggaaccaatttctggggagggactaaggaggatgatatcttcgccgcaccctcatttgacgacaagatcttggaggttgtagccatatttgatagtatgcaaatggcagtatctcgtgtgatcaagttgcagcatcataggatagctcagtgcagaacagtgaaaatcactatctttggcgacgagggcgtgccggttcaggtcgacggcgaagcctgggtccagccccctggcatcattaagattgtgcacaaaaacagggcccaaatgctgacgagggatagggcttttgagtccaccctgaagagctgggaagataagcagaaatgtgactctggaaaaccggtactgcggactcatctctacatacaccacgctatagacctcgccaccgaagaggtgtcccagatgcagttatgttcccaggccgcagaggagctcataacccggatctgtgatgccgcaaccatccattgtctgttggagcaggaactggcacatgcggtgaacgcttgctcacatgccctgaacaaggctaacccgagatgccccgaatcattaacacgcgacacagctactgagattgccatcaatgttaaagcgctgtataatgagaccgagagcttgttggttgggcgagtacctctgcaactcgaatctccccacgaagaacgcgtatctaatgcactccactctgtggaggtggagctccagaagctcacagagattccctggttatactatatcctccatccaaatgaagacgaagaaccgccaatggactgtacgaagcggaataaccgttccacagtgttccgcatcgtccccaaatttaagaaggaaaaggtgcagaaacagaagacatcttctcaacctgtgcagaaatggggtacagaagaagtcgcagcgtggctcgacttactcaaccttggcgagtataaagacatctttatcaggcacgatatcaggggggcagagctattacaccttgaacgcagagatctcaaggatctaggcattccaaaggttggacatgtgaagaggatcctccaagggattaaagaactgggcagatccacaccccaatcggaagtctag

SEQ ID NO: 49808 - DNA, 3303 bp, Artificial Sequence
  Description of Artificial Sequence: Synthetic coding sequence
atgctgtgcgcagagaataggaaggagatggaagattggatcagcagccttaagtccgtgcagaccagggagccatatgaagttgctcagttcaatgtcgagcacttctctggtatgcacaactggtacgcctgttctcatgcaaggccaactttttgcaacgtgtgccgggagtctctctctggagtcacaagccacggcttatcctgtgaggtgtgcaaatttaaagcccataaacggtgcgcggttcgcgctaccaataattgcaagtggacgacattagccagtatcggcaaagacatcatcgaagatgaggatggtgtggccatgccccatcaatggctagaaggaaatctaccagtctctgccaagtgcgcagtgtgcgataaaacctgcggtagtgtgttgagactccaggactggaagtgtctctggtgcaaaacgatggtccataccgcctgtaaagatctttatcaccccatttgcccattaggccagtgtaaagtcagcatcatcccacccatcgctctcaactctaccgactcggacggtttttgtagagcgaccttcagcttttgcgtgtctccactgttggtttttgtgaactccaagtcgggtgataatcaaggggtaaagtttctgcggagattcaagcagctgctgaaccccgcacaggtgttcgacttgatgaacggcggtcctcacctcgggctcaggctgtttcagaagttcgataactttaggatattggtgtgcggcggtgacggaagcgtggggtgggttttgagtgagatagataaactgaacttaaataagcagtgccaactgggggtactaccattgggtaccggcaacgacctggcaagagtgctgggctgggggggaagttacgatgacgacacccagctgccccagatcctggaaaaattggaaagggcgtctactaagatgctggacaggtggagcatcatgacctatgagctgaaattaccccctaaggcgtcattgctcccgggaccgcctgaagcctccgaggaattctacatgacaatctacgaagactccgtggccacccatttaaccaaaatcttgaattccgacgagcacgccgtggtcatcagttcggcaaagaccctgtgcgaaaccgtaaaagattttgtggcgaaagtggagaaaacatatgataagactctggagaatgctgttgtggcagatgccgtagccagtaaatgcagcgtattaaatgaaaaattagagcagctactgcaggcgctgcacactgactcacaggccgcacctgtacttccgggactaagccccttgatagtggaggaggacgctgtggagtccagctcagaagagtcactcggggagagcaaggaacagcttggcgacgacgtgaccaaaccctcctcacagaaggcggtcaagcccagggaaatcatgctaagagcgaactcccttaagaaggccgttcgccaagtcattgaggaggccggaaaggttatggacgatccaacagtgcatccctgtgagcccgctaaccagtctagcgattacgatagtacagagacggacgaaagtaaagaagaggcaaaggacgacggcgctaaggaaagtatcaccgtgaaaactgcacccagatcaccagacgcacgtgcctcttatggccatagccagactgacagcgttcctggacctgcggtggccgcttcaaaagaaaatctgcccgtcctgaacacgaggattatatgccctggcctccgggctggactggccgcatctatagccggttccagcatcataaataagatgctgctggccaatattgatccattcggcgcaaccccttttatagaccccgacctggacagcgtggacggttacagcgaaaaatgcgtgatgaataattacttcggcatcggtctggatgccaaaatttcattagaattcaataataaacgcgaagagcaccccgaaaaatgtcgcagtcggactaaaaatctgatgtggtatggcgtgctcgggactagagagttgctccagcggtcttacaagaacctggagcagcgagtgcagctcgagtgcgacggtcagtatattccactgccttcattacaaggcatcgccgtgttgaacatcccatcgtacgcaggagggaccaacttttggggcggtaccaaagaagacgatatcttcgccgcacctagctttgacgacaagattttggaagtcgttgctatattcgacagcatgcagatggcggtctctcgggtgattaagctccagcaccacaggattgcccagtgcagaactgtcaagataactatttttggcgacgagggcgtgcctgtacaggtggatggggaggcatgggtgcagccaccgggtataatcaagatagtccacaagaaccgggcacaaatgctgacacgcgatagagcctttgagtctacactgaaaagttgggaggacaagcagaaatgcgacagtgggaagccagtcctgcgtacccacctctacatccatcatgcaatagatctggctactgaggaggtcagtcagatgcagctgtgttctcaggcggctgaagagctcatcactagaatctgtgacgcagctacaattcactgtctactggagcaggaactcgcccacgccgtcaatgcatgctcgcacgccctcaataaagccaatccaaggtgtcctgagagcctgactagggataccgctacggaaatcgccatcaatgttaaagctctatacaatgagacagagtctcttttggttggccgagttcccctccagctcgaatcccctcacgaggagcgagtgagtaacgctttacatagtgtggaggtggagctccaaaagcttacagagatcccctggctttattatatcctgcatccaaatgaggacgaggagccacccatggactgcacgaagagaaataacaggtccactgtgttcagaattgttccaaaatttaagaaggaaaaggtgcagaagcagaagacctcatcccagccggttcaaaagtggggaaccgaggaggtcgctgcctggttggaccttctgaacctcggagaatacaaagatatttttatcagacacgacatcagaggcgcagaattgctgcatttggaacggcgagatctcaagaacacagtgggggaaaagcgggacaccaaagagaatggcaaacatatggatttgggaatccccaaggtcggacacgtcaaaagaatcctgcagggtatcaaagaactgggaaggagtactccacagtcagaagtctag

SEQ ID NO: 49809 - DNA, 3255 bp, Artificial Sequence
  Description of Artificial Sequence: Synthetic coding sequence
atgctttgcgctgaaaaccgcaaagagatggaggactggattagcagtctgaaaagtgtacagaccagggaaccatatgaagtagcgcaattcaatgtcgagcactttagcgggatgcacaattggtatgcctgttctcatgcacgtcccactttctgcaacgtgtgccgagaatcattgtccggtgtaacttcacacggtctatcgtgcgaagtgtgtaagtttaaagctcacaagcgctgcgctgtgcgggcaactaacaactgcaagtggactacactggcatccattggcaaagatatcatcgaggatgaggatggtgttgccatgcctcaccagtggctggagggtaatctgccggtctccgccaagtgcgctgtgtgcgacaaaacctgcggctcagtcctacggttacaagactggaagtgcctgtggtgcaagacgatggtacacactgcatgcaaagacttgtaccatcccatttgccctctgggacaatgcaaggtgtctataatccctccgattgccctcaactctaccgatagcgacgggttttgccgcgctaccttttctttttgcgtatcccccctactcgtgttcgtcaatagcaagagcggcgataatcagggcgtgaagtttctccggagattcaagcaacttctcaaccctgcacaggtgtttgatctgatgaacgggggtccacatcttggcctgaggctgttccaaaagttcgacaatttcagaatcttggtctgcgggggtgatggcagcgtggggtgggtgctgagcgaaattgataagctgaacctgaataagcagtgtcaactaggggtgctgccactaggcaccgggaacgatctggccagggtactcggctggggagggagctacgacgatgacacacagttaccccagatcctagaaaagctggagcgcgcttcaactaagatgctggaccggtggagcatcatgacttatgagctgaagttgcctcccaaggcctctctgctgcctggtccccctgaggcatccgaggagttctacatgactatttatgaggacagcgtcgccacccacttgactaaaatacttaacagtgatgagcacgctgtcgtgatcagctcagctaaaaccttatgtgagaccgtcaaggactttgtagccaaagtggagaaaacatacgacaagaccctagagaacgcggtagtagcggacgccgtggcgtccaagtgctctgtgctgaacgaaaagctcgaacaattactccaggccctgcataccgacagccaggccgctcctgtcctgcctggcttgagtcccctgatagtggaggaagatgccgtggagtcttcatcagaagagtcactgggcgagtcaaaagagcagctgggcgatgacgtgaccaaaccgtcatcacagaaggcagtaaaaccaagagaaattatgctgcgggcaaatagtctcaagaaagctgtgaggcaggtgattgaagaggccggtaaggtcatggacgatccaaccgtacacccttgtgaacccgctaatcaatcatcagattatgattccactgaaaccgatgagagtaaagaagaagcgaaagatgatggcgcaaaggagtctattaccgtaaagactgctcccagatcccctgatgcccgtgctagttacgggcactcacaaacggattcagtcccaggcccagctgttgcagccagcaaggagaacctgccagtcctgaatacaagaatcatctgcccgggtctccgcgctggtctggctgcctcaatcgcagggtcctctattattaataagatgctattggcaaacattgaccccttcggcgctacccctttcatagatcctgatttggacagcgtagatgggtactcagaaaagtgcgttatgaacaattacttcgggatcgggctggacgccaaaatctctctcgagttcaacaataagcgggaagagcatcccgaaaaatgccgttcaagaacaaagaacctcatgtggtacggggttctcggcaccagggaattgctgcagcggagctacaagaacctggagcagagagtccaactcgaatgcgatggccaatatattcccctgccgtccctgcagggcatcgctgtgttgaacataccaagctacgcaggcggtactaatttctggggcggaactaaagaggatgacatctttgccgcaccttcatttgacgataagatccttgaggtggtcgcgatattcgattctatgcagatggccgtcagccgggtgatcaaactgcagcaccacagaatcgcacaatgcagaacagtgaagataacaatttttggcgacgagggggtgcccgtgcaggttgacggggaagcgtgggtgcaaccccctggtattataaagattgttcacaaaaatcgggctcagatgcttaccagagatcgggcttttgagtctacccttaaatcctgggaagacaagcagaagtgcgactccggaaaacccgtgttgcgcacacacctatacattcaccacgccattgacttggccaccgaggaggtgagccagatgcagctgtgctctcaggcggctgaagaattaatcacccggatctgcgacgctgccaccatacattgtcttctagagcaggaactcgcccacgcagtgaatgcctgcagtcacgcccttaataaggccaaccctcgctgcccagagtctcttacacgggataccgcaacagaaatcgccatcaatgtgaaagccctgtacaacgagacagagtctctgctggtgggccgagtcccgctgcagctagaatctccacacgaggagagggtgtccaatgcgctgcattctgtggaggttgaactgcagaaactgaccgagattccgtggctctactatatcctgcacccaaatgaggatgaggagcctcccatggattgcactaagcggaacaatcgttcaactgtgttcagaattgtccccaagttcaaaaaggagaaggttcagaagcaaaaaacaagcagtcagccggtccagaaatgggggactgaagaagtcgctgcctggctagaccttctgaacctgggtgagtacaaggacatctttatccgacacgacattaggggggcagagctcctgcacctcgaaagacgtgacctgaaggatctgggaatccctaaagtcgggcatgtgaaacgaatacttcaaggtattaaagagctcggacgttctacgccccagtctgaggtgtag

SEQ ID NO: 49810 - DNA, 2760 bp, Artificial Sequence
  Description of Artificial Sequence: Synthetic coding sequence
atgtggaacatctcacagggctgtaccacgggaacccctgcgccaacgcccgacccaccaagcgttacctgcgcagaacgggtgttcctcgaatcaccacctatggcctgcccagccaaggtccacactgcctgcaaggatctgtatcatcccatctgcccgctgggtcagtgtaaagtgtcaatcattcccccaatcgccttgaactctaccgatagcgatggcttctgccgtgctacattcagtttctgcgtgtccccattattagtgttcgtgaatagcaagagcggcgataaccagggggtaaagttcctgagacgattcaagcaactgctgaatcctgcacaggtcttcgacctgatgaacggaggtccacatcttggcctcagactgttccagaaatttgacaacttccgtatcctggtgtgcggcggagatgggtctgtcggatgggtgctgtccgagatcgataaactgaatctgaacaagcagtgtcaactgggcgtcctgcctctaggaacaggcaacgatctggctagagttctggggtggggcggatcatacgatgacgatacccagttgccacagatcctggagaaactagagagggcaagcaccaaaatgctggatcgttggagcataatgacttacgaattaaaactgcccccaaaagcgtcactactgcccggacctcccgaggctagtgaagaattctatatgaccatttacgaagactcggtggcaactcacctgacgaaaattttgaactctgatgagcatgctgtcgtgatcagctcagcaaaaaccttgtgcgagactgtgaaggatttcgtggctaaggtggaaaaaacgtacgacaagaccctcgaaaatgcagttgtcgcagacgccgtagccagcaaatgcagcgtgctcaacgaaaagcttgagcagctactccaagcactgcacaccgactctcaagccgcaccggttctgcccggtctctctccattgattgtcgaggaagacgccgtagaaagcagctctgaggagagtctcggcgagtcaaaagagcagctaggagatgatgtgacaaaacctagtagtcagaaggcagttaagccacgggagattatgctgcgggctaactccttaaagaaggccgtgcgacaagtgatcgaagaagcagggaaggtaatggatgatcccacagtccacccatgtgagcctgccaaccagagcagcgattacgattcgaccgagaccgatgaatcgaaagaagaggctaaagacgacggggcaaaggagtccatcacagtaaaaacagcgccacgcagccctgatgctcgcgcatcatatgggcattcacagactgactcggttccgggaccggctgttgccgcttccaaggaaaacttacctgtactcaacacacggatcatctgtccaggacttagggccggacttgctgcatccattgccggatcatccatcatcaacaagatgctgctcgccaacatcgatcctttcggcgcaacgcctttcatcgatcccgacctcgatagcgtcgacgggtacagcgagaagtgtgtaatgaacaactacttcggcatcggactggatgcaaaaatcagcctggagttcaacaacaagagggaggaacaccccgaaaagtgcagatcaagaacgaaaaacctcatgtggtacggtgttcttggtacccgggaactgctgcagcgaagttataagaaccttgagcagagagtgcaattggagtgcgatgggcaatacatccccctgccgtccctgcagggtatagccgtcctcaacattcccagctacgccggaggaaccaacttctggggcggaacgaaggaggacgatatttttgccgcacccagttttgatgacaagattctggaggtagtagcaatcttcgactcaatgcagatggcagtctcaagagtgatcaaactgcaacaccataggattgcccagtgtcggactgttaaaatcaccatatttggagatgaaggtgtccctgtgcaggtggacggggaagcttgggtgcagccacctggaattataaaaatcgtccacaaaaatagggcacagatgctgactcgagatagagctttcgaatccaccctgaaatcctgggaagataaacaaaagtgcgactcaggcaagcccgtgctgcgcacacacctctatattcatcatgctatcgacctcgccaccgaagaagtcagtcagatgcaactgtgcagccaggctgctgaggaactgattacaagaatatgtgatgccgctactatccactgcttacttgagcaagagctggctcacgcagtaaatgcttgttctcacgccctgaataaggccaaccctcgctgccccgaatcactgacgagggataccgccaccgagatcgcaataaacgtaaaagcgctctacaatgaaaccgagagtctcctggtgggaagggtgccactccagcttgaaagcccacacgaagagcgagtgtccaatgctctgcactccgtcgaagtggagctgcagaagctgactgagattccgtggctctattacattttacaccctaacgaggacgaggaaccacctatggactgcactaagcgcaacaatcgctctaccgtgttcagaatcgtgccaaagtttaagaaagagaaggttcaaaagcagaaaactagctcccagcctggctcaggagatacggaaagcgggtcttgtgaggctaattctcctgggaactag

SEQ ID NO: 49811 - DNA, 3495 bp, Artificial Sequence
  Description of Artificial Sequence: Synthetic coding sequence
atggctggtgcaggcggacagcatcatccgccaggagcagcaggcggtgctgctgccggtgctggagccgctgtaacctctgccgctgctagcgctggccctggagaggattcgagtgatagtgaagcagagcaagaaggacctcagaagctgatccgcaaagtttccacaagtgggcaaattcgcacaaagacatccatcaaagaaggccagctactcaagcaaacgtcatcttttcaacggtggaagaagaggtacttcaagctcagaggccgaacactgtattatgctaaggacagcaagagcttaatctttgacgaggttgaccttagcgacgcaagcgtcgccgaggccagtacaaaaaacgcgaataattcattcaccataattacacccttccgacgcttaatgctttgtgcagagaataggaaagagatggaagactggataagctcgcttaagtccgtccagacacgggagccttatgaggtcgcccagttcaatgtcgagcactttagcggtatgcataattggtacgcatgttcgcacgcacgccctaccttttgcaacgtgtgtcgcgagtccctgtccggtgtgacgagccacggcctgagctgtgaagtgtgtaaatttaaggcacataaaaggtgcgcagtcagagcaacgaacaactgtaagtggaccacactcgcatctatcggaaaggatataatcgaggatgaagacggtgtggcaatgcctcatcagtggcttgagggtaaccttcccgtctctgccaaatgtgccgtctgtgataaaacatgtggctcagtcctgagactgcaggattggaaatgcctatggtgtaagaccatggtgcacaccgcctgcaaggatctctatcaccccatttgtcccctcggacagtgcaaggtctccattattccccctattgctctgaattccaccgattcggacggtttttgtcgcgcaacattcagcttttgcgtatccccacttctggtattcgtaaatagcaagagcggagacaaccagggggtcaaattccttaggaggtttaaacagcttttgaacccagcccaggtgtttgatttaatgaacggcggaccacatttaggtctcaggttgttccaaaagtttgataactttcggatcctagtctgcgggggtgatggctcagttgggtgggtgctctctgagatagacaagctcaatctgaataagcagtgccaactgggcgttctgcccctgggaacaggaaacgatctcgccagagtgctgggatgggggggttcctacgacgacgatacgcagcttccccaaatattggaaaagctggaaagagcatccacaaaaatgctcgatcgctggtcaattatgacatatgagctcaaattgccacctaaagcttcactgctccccggtcctcctgaagcgagcgaagaattctatatgaccatttatgaggacagcgtcgccacccatctgaccaagatactgaattccgatgaacacgcggtggtgataagttccgctaaaactttgtgcgaaaccgtcaaagacttcgtagccaaggtggagaagacatacgacaaaaccctggaaaacgcagtagtcgccgatgctgtggcaagcaagtgctcagtgctcaatgaaaagctggagcagctattacaggctctacatactgactcccaggcagcccctgtgctccccggtctcagcccactgatcgtcgaagaggatgccgtggagagcagcagcgaggagtcactcggagaatctaaggagcagctgggggacgacgtcacaaagccgtcaagtcagaaagctgtcaaaccacgcgagattatgctcagggccaacagcctgaaaaaggcagtgaggcaagtgatcgaggaggctggaaaggtaatggacgatccgacagtacacccctgtgagccggctaaccagtcaagcgactatgacagcacagagacggacgagagcaaggaggaggctaaggacgatggggctaaagagtcaattacagtcaaaaccgcccctagatcccccgatgccagagcaagctatggacatagtcagaccgactctgtacccggacctgccgtcgccgcaagcaaagaaaacttaccggtactcaatacgaggatcatctgtccgggtcttagggcgggtctcgcagcaagtattgcaggcagctctattattaacaagatgctgcttgcaaatattgatcctttcggagctaccccttttatcgaccccgatctggactctgtagacggatattccgagaaatgtgtgatgaacaattacttcggtatcggactggatgcgaaaatctcactggagttcaataacaagcgcgaagaacatccagagaaatgcagaagccgcaccaagaatttgatgtggtacggtgtccttggcacgcgagagttgttacagcgcagttacaagaacctggagcagagggtccagttggagtgcgacgggcagtatattcccctgccgtcattgcagggcatcgccgtccttaacatccctagctacgctggagggacaaacttctgggggggtacgaaggaggatgacatttttgctgcgccatcattcgacgataaaatcctggaggttgtggcgatttttgatagcatgcagatggccgtgagcagggttataaagctgcagcatcacagaattgcacagtgcagaactgtcaagattaccattttcggcgacgagggtgtgccagtccaggtcgatggggaagcctgggtgcagccacctggaattatcaagatcgtgcataagaatcgcgcacagatgcttacgagagatcgcgctttcgagagtactttaaagagctgggaggacaagcagaaatgcgactccggaaaaccggtgctgcgcacccacctgtacatccaccacgcaattgacctcgccaccgaagaagtgtcgcagatgcagctttgtagccaggctgccgaggagcttattaccagaatctgcgatgccgcaaccattcactgtctgcttgagcaggagttagcccacgcagtgaatgcctgttcacacgccttgaacaaggctaatcctagatgcccggagtctctgacacgggacactgccactgaaattgctattaatgtcaaggcgctgtacaacgaaacagagagcctgctggtggggagggtgccactccagttagaatcaccacatgaggagcgtgtaagcaatgcccttcactctgtggaggtggagctccagaagctgaccgagatcccctggctgtactacatactccaccccaatgaggatgaggagccgccaatggactgcactaaacggaacaatcggagcacagtcttcagaatcgttccaaagttcaagaaagaaaaggtccaaaaacagaaaacgtcctcccaacccggaagtggcgatactgaatcaggctcatgtgaagctaactctccaggcaattag

SEQ ID NO: 49812 - DNA, 2721 bp, Artificial Sequence
  Description of Artificial Sequence: Synthetic coding sequence
atggaacccagggatgggagccccgaggctaggtctagcgattcagagtcggcgtccgcatcaagttccggctctgagcgtgacgcaggccctgaacccgataaagccccacgccgtctgaacaagcgaagattccctgggctacgcctcttcggccatcggaaggccatcactaagtccggactgcagcacttagcaccccctccgccaacaccaggtgctccctgttctgaatctgaacggcaaatacgatcaactgtggactggtcagagtccgcgacctacggcgagcacatctggttcgagacgaacgtcagcggagatttctgctacgttggggagcagtactgcgtggccaggatgctgcaaaagtccgtgtcacgtaggaaatgcgccgcttgcaagatcgtggtgcacacaccgtgtattgaacagttagagaagataaactttaggtgcaagccgtctttccgggagtctggaagtaggaacgttcgcgaggggttccagcaaaagttcactttccatagcaaggaaatagtggcaatctcatgctcatggtgcaagcaagcgtatcatagcaaagtgagttgttttatgctgcaacagattgaagagccttgtagtctaggtgtgcacgctgccgtcgtgataccaccaacttggatcctgcgcgctcgcaggcctcagaacactctgaaggcaagtaaaaagaagaagagggctagtttcaaaaggaaaagcagcaagaaagggccagaagaaggcaggtggcgcccatttatcatacgaccaacgcccagccccctgatgaagcccctcctggtattcgtgaaccccaaatccggaggcaaccaaggggctaaaattattcagtcattcctctggtatctcaaccctcgacaagtgtttgacctgtcacaaggaggacccaaagaggctctggagatgtacaggaaggtgcacaacctccgcattttggcatgcggtggagacggcacagttggttggatccttagcacgctggatcagctaagacttaagcctcccccacctgtggccatcctccccctcggcacagggaacgatcttgccagaaccctgaactggggcggtggttacacagacgagcctgtctctaagatactctcacacgtggaggaaggcaacgtggtgcaattagacagatgggatctgcacgccgaaccaaatcccgaggcgggacccgaggatcgggatgagggagccactgataggctgccactcgatgtgtttaataactacttctcgctgggcttcgacgcacacgtaacgttagagtttcacgaaagtcgcgaagctaacccagaaaaatttaattctcgattccggaacaaaatgttttacgctggcaccgcattcagtgatttcttgatgggttcatcgaaagacttggccaaacacattcgcgtggtctgcgatggaatggacctcacccccaaaatccaagacctcaagccccagtgtgtagtcttcctaaatatccctcggtactgcgcaggtacgatgccctggggccatcccggtgagcatcacgactttgaaccacagcggcatgacgacggctacttggaggttattggtttcacaatgactagcttggccgctctgcaggtggggggacatggcgaaagactgacccaatgcagggaagtggtgttgaccaccagcaaagcgattccagtccaggtcgatggagaaccctgtaaattagccgcatcgcgcatcagaattgccctgcggaatcaggcaacaatggtccagaaagccaaaagacgatcagcagcacctcttcacagcgaccagcagccagtccctgagcagctgcgcatccaagtgagccgcgtttcaatgcacgattacgaagctctccactacgacaaggaacagctgaaggaggccagcgtgccactcgggacagtcgtcgtgcccggtgactccgatctggagttatgccgagctcacattgaacgcctgcagcaagagcccgacggagctggagcaaagagccctacttgccagaagctgagccccaaatggtgcttcctggacgctacgactgctagcagattctaccgtatcgatcgcgcacaagagcatttgaactacgtaaccgagatcgcccaggacgagatttatatactagaccctgagctgcttggagcgtctgcgaggcccgacctgcccactccgacttctccactgccaactagtccttgttctcccacccccaggtctctccagggcgatgccgcaccccctcagggcgaagagctcattgaagctgccaagaggaatgacttctgcaaactgcaggagttacacagggctggtggagacctgatgcaccgagatgagcagagccgtacactcctccaccacgccgtaagtacaggatccaaggatgttgtaagatatctgttagaccatgcacccccagagattctcgatgctgtggaagagaacggagagacctgcctacatcaggctgccgctctgggacaacgtaccatatgccactatatcgtggaagccggtgccagcctcatgaagacagaccaacagggagataccccaaggcagcgcgcagagaaagcccaagacacagagcttgctgcgtacctggagaaccggcagcattaccagatgatacaacgagaagatcaggaaacggcagtgtag

SEQ ID NO: 49813 - DNA, 2688 bp, Artificial Sequence
  Description of Artificial Sequence: Synthetic coding sequence
atgtggcggtatagaagttgggacgtgccacagattccctccgaggcacctcagactcagaaggctattaccaagagtggtcttcaacatctagcccctccccctccgacccctggagccccttgctccgaaagcgaacggcagattcgcagtacagtggactggtccgagtctgccacatatggggagcacatttggtttgaaaccaatgtaagcggtgacttttgctacgtgggagaacaatactgtgttgccagaatgttgcagaagtctgtgagtcgtcgcaagtgtgctgcctgcaagattgttgtgcacacgccctgcattgagcagctggaaaaaatcaacttcagatgcaagccctcgtttcgcgagagcgggagcaggaatgtccgagagccaacgttcgtaaggcaccattgggtccatcgtcgtaggcaggatggtaaatgtaggcattgtggaaaggggtttcagcaaaaatttaccttccatagtaaggagattgttgccatcagttgcagctggtgcaagcaggcctaccactctaaggtctcatgctttatgctccagcagatcgaagagccctgctctctgggcgttcacgcagctgtggtaataccaccaacctggatccttagagctcgtagaccgcagaatactctgaaggcgagcaaaaagaaaaaacgggcaagctttaagcggaaaagcagcaaaaagggcccagaggaggggagatggagacccttcatcattaggcctacaccctcccctttaatgaaacctctgttggtttttgtgaacccaaaatcaggtggaaaccagggcgcaaaaatcatccagtcttttttatggtatttgaacccacgccaggtgttcgatctttcccaaggagggcctaaagaagccctcgaaatgtaccggaaagtacataacctgagaatccttgcttgtggcggtgacgggaccgtcggttggattctgtctaccctggatcagctacggctcaaaccacctcctccggttgcaatcctgccgctgggtaccggcaatgatcttgccagaactctgaactggggaggcggatacactgacgagccagtttcaaaaatcctgagtcatgtagaagaaggtaatgtggtacagctcgatagatgggacctgcatgcagaacctaacccagaagccggacccgaggatcgggacgagggggcaactgataggctgcccctggatgtgttcaataactacttctctctcggtttcgatgcacacgtcaccttggagttccacgagtccagggaggccaaccccgagaagttcaattcaaggtttcgcaacaagatgttctacgctggaaccgcttttagcgacttcctgatgggctcttctaaggaccttgccaagcacatacgagtggtgtgcgatggcatggatctcacaccaaagattcaggacttgaaaccacagtgcgtggtgtttcttaacatcccacggtattgtgcgggtacgatgccttggggccaccccggagaacatcacgacttcgagccacagagacatgacgacggttatctagaggtcattgggttcactatgacctctctggccgcactgcaggtgggaggtcacggcgaacgattgactcaatgccgcgaagtggttctaaccacttccaaagccattccagttcaggtggacggagaaccatgcaagctggccgctagccggatccgcatcgccctacgcaatcaagctaccatggttcagaaagccaagcgcaggagcgcagcgcctcttcacagcgaccaacagcctgtccctgagcaactccggatccaggtttctcgcgtttctatgcatgactatgaggcattgcactacgataaggagcagctgaaggaagcaagtgtgcctctgggcacagtcgtggtgccaggtgacagcgacctggagctgtgcagggctcacattgaaagactgcagcaggaacctgacggggctggcgcaaagtccccgacctgccaaaagctctcgccgaaatggtgtttcttggatgccactacggccagcagattctacagaatcgatcgtgcgcaggaacacctgaactacgtcacagaaattgctcaggacgaaatctacatactagaccccgaactgctcggagcctccgccaggcctgacttacccacaccaacatctccactgcctacatctccatgttcacccaccccccgttccctacaaggtgacgcagctccccctcagggagaagaactcattgaagccgcaaagcggaacgacttctgcaagctgcaggagctacacagggcagggggtgacctgatgcaccgggacgaacagtcccgaaccctacttcaccacgccgtgtccaccgggtccaaagatgtagttagatatcttctggatcacgctcctccagaaatcctcgacgcggtagaagaaaacggtgagacctgtctgcatcaggccgcagcacttggccagcgtacaatttgtcactatatcgttgaggcaggcgctagcctgatgaaaactgatcagcagggcgatacccctcgtcagcgagcagagaaggctcaagatactgagctagctgcttatctcgaaaacaggcagcactatcagatgatacagagggaagatcaggaaactgccgtatag

SEQ ID NO: 49814 - DNA, 2790 bp, Artificial Sequence
  Description of Artificial Sequence: Synthetic coding sequence
atggagccgcgagacggatcccccgaagccagatcttcagactctgagtcagcatctgcttcttctagcggctcggagagagacgctgggccagaaccagacaaagctcctaggcgcttgaataaacggagattcccaggcctgcggctctttggccatagaaaagcgatcactaagagcggattacagcatttggctccaccgcctcctacccccggagccccatgtagcgagagcgagaggcagatccggtctaccgtggattggagcgagtctgcgacatatggggagcatatatggtttgagactaatgtaagcggtgacttttgttacgttggtgaacagtactgtgttgccagaatgttacagaagtccgtcagcagacggaaatgtgccgcttgtaagatcgtcgtccatacgccctgtatcgaacaactagaaaaaataaattttagatgtaagccttcgttcagggagtctggctctaggaacgtcagggaacctactttcgtccgtcatcattgggtgcatcgaagaaggcaggacgggaagtgccggcactgcgggaagggcttccagcagaagtttacgtttcactctaaggaaatcgtggcaataagctgtagctggtgtaagcaggcgtatcacagcaaggtgagttgcttcatgctacagcagatcgaagagccctgctcactgggtgtccatgcggctgtggtgataccaccaacctggatcctccgtgcgagaagacctcagaatacccttaaggcttcaaagaagaaaaagcgtgccagctttaagaggaaatcctcaaagaaagggcctgaggagggccgatggagaccttttatcatccggccaaccccatcccccctgatgaagccactgctggtcttcgttaaccctaagtccgggggaaatcaaggcgctaagatcattcagagctttctctggtatctcaacccccgtcaagtgtttgacctgagccaggggggtccaaaagaggctttggaaatgtacagaaaggtccataacttaaggattctcgcctgtggaggggatggaactgtgggctggattctgtctactctggatcaattgagactgaaaccaccacccccagtggccattctcccccttgggactggaaatgatcttgccaggaccttgaattgggggggtggatacactgacgagcccgttagcaaaatactgagccacgtggaggaaggtaacgtagtgcaattggatcggtgggacctgcacgctgagccaaaccccgaggctgggcctgaagaccgagacgagggggctacggatagactgcctctagatgtgttcaacaattatttcagcctcggatttgatgctcatgttaccctagagtttcacgaatcacgggaggctaatccggaaaagttcaatagccgcttcaggaataaaatgttctacgcaggaaccgccttctcagatttcctcatgggaagtagcaaggacttagccaagcatattcgcgttgtctgcgacgggatggacctgacccccaaaatccaggatctgaagcctcagtgcgtggtgttccttaatattccgagatattgtgcagggacaatgccctggggccaccctggggaacatcacgattttgagccacaacgccacgatgacggttatttggaggttattggttttacgatgacctcactcgccgctctccaggttggcggtcatggagagaggctgacccaatgccgcgaggtggtgctgacaacgtcaaaagccatccccgtacaggtagacggcgagccctgtaagctggcggcttcaaggatccgtattgccttaaggaatcaggcaactatggtccaaaaggccaaaagacgatctgcagctcccctgcactccgatcagcagcccgttcctgagcagctgagaattcaggtgtcccgggtctccatgcatgattacgaagccctgcattacgacaaggagcagctcaaggaggcaagcgtgccgctgggcactgttgtcgtacccggagattccgacttggagctttgtagggcccatattgagagattgcagcaggagccagacggtgctggcgctaaatcccctacttgccagaagctctctccaaaatggtgcttcttagatgctacaactgcatcccggttctataggattgatagggcacaagaacatctgaattatgtcacagagatcgctcaggacgaaatttacatcttagatccagaactgcttggcgcatctgcccgaccagatctgccaacccccacttcccccctcccaacttccccttgctctccaacccccagaagcctgcaaggcgacgccgctccaccacagggggaggagctcatagaggcagcgaagagaaacgatttttgcaagctgcaggaattacaccgggctgggggtgaccttatgcatagggatgagcagtcgaggactttgttgcaccatgcagtgagtaccggcagcaaggacgtggttcgatacctgcttgaccacgcccctcctgagatcctggatgccgtggaggaaaacggcgaaacctgcctgcaccaagctgcggctctgggtcagagaactatatgccactacatcgtggaggccggtgcctcattgatgaaaaccgaccagcagggcgatacacctcgacaaagagctgaaaaggctcaagatacagagttagccgcataccttgagaatcgccagcactaccagatgatacaacgcgaagaccaggagacagcagtctag

SEQ ID NO: 49815 - DNA, 3354 bp, Artificial Sequence
  Description of Artificial Sequence: Synthetic coding sequence
atggaaactttctttcgcagacacttccggggaaaggtgcctgggcctggcgaagggcaacagcgcccatccagtgtcggtctgccaactggaaaggccaggagacgatctccagcaggacaggcatcttcctcgcttgctcagaggcggaggagctctgcccagcttcaggggtgtctgttatcctgtggcgtgagggcccagggcagcagccggaggcgaagttccactgtacctcccagttgcaacccaagatttatcgttgataaagtgctcacacctcagccaaccactgttggagctcaattgctgggcgcacctctgctcttaactggtttggtggggatgaacgaggaagagggagtacaagaagatgtggtagccgaggcctctagcgccatccagcctgggactaaaacaccaggacccccacccccaagaggcgcacaacctctacttcctctccctcggtacctcagacgagcgtctagccatttgcttccagccgacgctgtctatgaccacgcactgtggggccttcacggctattacagacgcctgtcacaacgccgacctagtggtcagcaccccggacccggtgggagaagggcttcaggtacaactgcgggtaccatgctgccaaccagggtcaggcctctttcacgtagaaggcaggttgctctccgccgaaaagctgccggaccccaagcatggtccgcgctgttagctaaagccattaccaagtccgggctgcagcacctcgcacctcccccacctaccccaggcgcaccatgttccgagagtgagcgccagatacggtcaacagtagattggagtgagagcgcaacatatggggagcacatatggtttgagacaaacgtctctggggatttctgctatgtcggggagcagtactgcgtcgcacgcatgctcaaaagcgtgagtagacgcaaatgtgctgcctgtaagatcgtggtgcatactccatgcattgaacagctggagaagatcaacttcaggtgcaaaccttcctttcgggaaagtgggtcacggaacgtgcgagagccgactttcgtcaggcaccactgggttcacaggaggaggcaggatgggaagtgtcggcattgcggcaagggctttcagcagaagttcacattccacagtaaagaaatagtggcgatctcctgttcgtggtgtaagcaggcctaccactccaaggtgagctgttttatgcttcagcagattgaagaaccctgctcactgggggtccacgccgcagtagtaattccccctacatggatactccgggcacgccgaccccagaatacactcaaggcctctaaaaaaaagaaaagggcctcattcaaaagaaaatcttctaagaagggcccagaggaagggagatggaggccatttattattcggcctaccccaagtcctctcatgaaacccctgctggtctttgtaaatcctaagtcagggggaaatcagggcgcaaagatcattcagtccttcctgtggtatttgaaccccagacaagtatttgacctcagccaggggggaccaaaggaagctctggagatgtataggaaggtccacaacctgcggatccttgcctgcggaggggatgggactgtcggctggattctcagcaccctcgaccagctgaggcttaagccacccccacctgtggcaattctgcctctcgggaccggcaacgacctggcaaggactttaaactgggggggaggctacacagatgagcctgtgagtaagattttatcgcacgtggaagagggaaatgttgttcagctcgaccgttgggatcttcacgccgagcctaatcccgaggccggtcccgaggatcgcgatgagggagctaccgatagattgcctctggacgtgttcaataactatttttccttagggttcgacgcccacgtgaccttggaattccacgagtcacgcgaagccaaccctgagaagttcaattctcgctttcgtaataagatgttttacgccggaactgctttctccgacttcctgatgggctccagtaaagatctagctaagcacatcagggtggtctgtgatgggatggacctcacgcccaaaatccaggatctcaaacctcagtgcgtcgtgtttctaaatattcctcggtactgtgctggaaccatgccatggggccaccctggggaacatcatgacttcgaaccgcagcggcacgacgacggatacttagaagtgattggcttcacaatgacctctctcgccgctttgcaagtgggcggtcatggggagaggttgacgcagtgcagagaggtcgtcctgacgacatctaaagcgatccctgtgcaggtagacggtgaaccatgtaagctcgccgcaagccgaattcggatcgccttacgtaatcaagcaaccatggtgcagaaggccaaacgacggagcgccgctcccttacattctgatcagcagccagttccagaacagcttagaatccaggtgagtagagtgagtatgcacgattacgaagccctacattatgacaaagagcagctcaaagaagcatccgttcccctagggaccgttgtggtgcccggagacagcgatttagagctctgtagagcccacatcgagcggttgcagcaggagccggatggagctggcgcaaaatctcccacttgccaaaaactgagtcccaaatggtgtttcctcgacgccaccacagctagtagattttatcggatcgaccgggctcaggagcatttaaattacgtcacggagattgcccaagatgaaatatacatcctggatccagaactgttgggcgcttccgctaggccagacctgcccacccctacctctccccttcctacctccccgtgctcacccacgcccagatcccttcaaggagacgcggctcctcctcaaggggaagagctaatcgaggccgcaaagcgaaacgatttttgcaagctgcaggagctccatcgtgcaggcggtgatctgatgcacagagacgaacagtcccggacacttcttcaccacgctgtgtctaccggtagtaaagatgtggtgaggtacctgctggaccatgcccctcccgagatcctggacgccgtcgaggaaaatggcgagacttgtttgcatcaggccgctgccctgggtcaaaggacgatttgccattacattgtggaggctggagcttcgctgatgaagacggaccagcagggtgacacacctcggcaacgcgctgaaaaggcccaggacaccgagttagcagcatatctggagaacaggcagcactaccagatgatccagagagaggatcaggagactgcagtgtag

SEQ ID NO: 49816 - DNA, 2787 bp, Artificial Sequence
  Description of Artificial Sequence: Synthetic coding sequence
atggagccgagggatggttcccctgaggctcgatccagtgactccgaatctgcttccgcgtcttcatccgggtccgaacgggatgccggtcccgagcctgacaaagcacctaggcgccttaataaacgtaggtttcccggtctgcgcctctttggacaccgaaaggccattaccaaaagtggccttcagcatctggcaccgcctcctcccactcccggagctccatgttctgaatcagaacgacagatccgttccacagttgattggagtgagagcgcgacctacggtgagcacatttggtttgaaactaatgtctctggtgatttttgttacgtgggagagcagtattgtgtggcccgaatgctaaagtcagtctccaggcggaaatgtgcagcatgcaaaatcgtagtccacaccccctgcattgaacagctggagaaaataaatttccgctgtaagccgagtttccgcgaatctggctcacggaacgtgcgcgagcctacttttgttcggcaccactgggttcatcgcagaaggcaagacggcaagtgccgccactgcggaaagggtttccagcaaaaattcaccttccacagtaaggagatcgtagcgatttcttgctcttggtgtaagcaggcctaccattccaaagtgagctgctttatgctccagcagatcgaggagccatgttcgttaggggtacatgcagccgtagttatcccccctacttggattcttcgagcaaggcggccacagaacaccctgaaagccagcaagaagaagaaaagagcctcattcaaaaggaaatctagcaagaaaggtcctgaggaaggtcgctggcggccttttatcattagacccacaccatccccactgatgaagcctcttctcgtgtttgtaaatcccaagtccggaggaaatcagggcgctaagattattcaatcctttctgtggtacctaaaccccagacaggtctttgatctctcccaaggtgggcctaaagaggccctggagatgtacaggaaagtccacaacttgagaatattggcatgcggaggagacggtaccgtaggatggatacttagcacactcgaccagctcagactcaaaccgcctcccccagtggccattctgcctctagggacaggtaatgacctggccaggacattgaactggggcggtgggtataccgacgagcccgtgtcaaagattctttcccacgtggaggagggcaatgtagtccagctcgacaggtgggacttgcacgcagagcccaaccctgaagccggtcctgaggatagggacgaaggagctaccgaccgactgccgctagatgtgttcaataattacttttcacttggattcgatgctcacgtcactctggaattccacgagagtcgagaggctaatcccgagaagttcaattccaggttccgcaataaaatgttttatgccggaaccgccttctctgatttcctcatgggaagttctaaggacctggcaaaacacatcagagtcgtctgtgacggaatggacctgactccaaagattcaagatctgaagcctcagtgcgtggtcttccttaacattcccagatattgcgcaggtacaatgccctggggccaccctggagaacaccacgactttgaaccccagcgtcacgacgacggctatctggaggttatcgggtttaccatgacctccctcgccgcacttcaagtaggcggtcacggtgagaggcttacccagtgcagggaggtggtgttgaccacgagcaaagccattcccgttcaagtggatggcgaaccttgcaagctggccgcatcacggattcgaattgcgctgagaaaccaggctacaatggtgcagaaagcgaaacgcaggtccgcggctcctctgcatagcgaccagcagccagtccccgagcagttgaggatccaagtgtctcgcgtatccatgcacgactacgaagcgctgcactacgacaaggagcagcttaaagaggcgagtgtccccctcgggaccgtagtagtacctggtgacagtgatctggagttatgtcgtgcacacatcgagcgactgcagcaggaaccagatggagcaggggctaaatccccaacttgtcagaagctgagtccaaagtggtgctttctggatgccacaaccgcaagcaggttttatagaatcgatagggctcaggagcacctgaactatgtgacagagatcgcccaggatgagatctatatattggatccagaactattgggagcctccgctcgccctgacttgcctacccctacttctcccctgcctacttctccatgtagcccgacaccacgctctctgcagggagatgccgctccaccccagggggaagagctcatagaggccgctaaaaggaacgacttttgtaagctgcaagagctccatcgggctggtggggacctgatgcacagagacgagcagagccggactctcttacatcacgctgtgtccactggaagtaaagatgtggttagatatctcctggatcatgcccctcccgaaattttggacgctgttgaagagaatggagaaacatgcctgcaccaggcagctgcactgggccagagaaccatttgccactacatcgtggaggcaggagcttccctgatgaagacagatcagcagggcgacacaccaaggcagcgcgctgagaaagctcaggacactgaactggctgcctacctggaaaacaggcaacattaccagatgattcagagagaagaccaagagactgctgtatag

SEQ ID NO: 49817 - DNA, 846 bp, Artificial Sequence
  Description of Artificial Sequence: Synthetic coding sequence
atggagcctcgagacggttcccccgaggccaggagcagcgattcagagtccgctagtgcctctagctctggctctgagcgggacgctggaccagagcctgataaagcacccagacgcttaaacaagaggaggtttccagggctcaggctcttcgggcacagcaagtcaaagagtcccacttgtcaaaaactttcccctaagtggtgcttcctcgatgctaccacagcttcccgcttttatcggatcgaccgggctcaagagcatctcaattacgtcactgagatcgcccaagatgaaatttacatcttggaccccgagctgctcggggcttcggctcggccagacctccccacaccaacctctccacttccaactagcccttgtagtccgacacccaggagcctgcagggtgatgctgcaccccctcagggagaagagctcatagaagccgctaaaagaaatgatttttgcaagctacaggagttgcaccgagcgggaggggacttaatgcaccgggacgagcaatctcgcaccctcttgcatcatgccgtgtccacagggtcaaaggacgttgtgcggtatctcctggaccacgcgccaccggagatcctggatgcggtggaagaaaatggagagacctgtctgcatcaggcggcagcccttggtcagagaactatttgccactatatcgtggaggctggcgcaagccttatgaagacggaccagcaaggcgatactccacggcagagggccgaaaaagcgcaagataccgaactggctgcttatctggaaaatcgtcagcattaccagatgatccagagggaggaccaggaaaccgccgtctag

SEQ ID NO: 49818 - DNA, 1014 bp, Artificial Sequence
  Description of Artificial Sequence: Synthetic coding sequence
atggcttttttttcccgccttaatcttcaggagggtctccagacattcttcgtgttacaatggattccagtttacatcttcttgggagctattcccatcctcttgatcccatactttctgttgttttctaagttctggccccttgccgtgttgtccttggcttggttgacgtacgattggaatacacactcccaaggcggaaggcgctcagcgtgggtgcgcaactggaccctgtggaaatacttcaggaattacttccctgttaaactggtcaagacacacgacctcagtcctaaacataattacatcatcgccaatcaccctcacggcatcttgtcattcggagtgtttattaacttcgccaccgaggcgaccggtatcgcaaggatctttccttccatcactcctttcgtgggcaccctcgagaggatattttggatccctattgtcagagagtatgttatgagtatgggcgtttgccctgtatcttcaagtgcattaaagtatctgctcacccagaagggatcaggaaatgccgtcgtgattgtcgttgggggagctgctgaggctttgctgtgcaggcctggcgcttcaacccttttcctgaagcagcggaagggtttcgttaaaatggccctccagaccggggcttatctagtgccatcatacagttttggggaaaacgaagtgttcaatcaagagaccttccctgagggtacttggctcaggctcttccagaagacctttcaggacactttcaagaagattttgggtcttaatttttgcaccttccacggacgtggattcacccgtgggagctggggcttcctgcccttcaaccggccaattaccaccgtggttggagagccgttaccaatccctcggatcaagcgccctaatcaaaaaacagttgataaataccacgcactgtacatttcggcacttagaaagttgttcgaccaacacaaggttgaatacggtcttcccgaaacgcaggagctcaccataacttag

SEQ ID NO: 49819 - DNA, 267 bp, Artificial Sequence
  Description of Artificial Sequence: Synthetic coding sequence
atgcccgcattcgctgaattcgagaaagccgctgaggaggttcgtcatcttaagacaaaaccatctgatgaggaaatgctgtttatctatggtcactacaaacaggcaacagtaggagatattaatactgagcgccctggaatgctggactttacagggaaggccaaatgggacgcctggaacgagctgaaggggaccagcaaagaggatgctatgaaagcgtacattaacaaagtggaggagctgaagaagaagtacggaatctag

SEQ ID NO: 49820 - DNA, 315 bp, Artificial Sequence
  Description of Artificial Sequence: Synthetic coding sequence
atgtggggggacctttggctgcttcccccagcgtctgccaacccaggcacaggcacagaggctgagtttgagaaggcagcggaggaagttaggcatcttaaaacaaaaccttccgatgaagagatgctattcatctacggccattacaagcaagctactgtgggcgatattaacaccgaaaggcccggaatgttagattttactgggaaggcgaagtgggacgcttggaatgaactcaaggggacctcgaaagaagacgctatgaaggcatatattaataaggtggaggagctgaagaaaaaatacggcatctag

SEQ ID NO: 49821 - DNA, 264 bp, Artificial Sequence
  Description of Artificial Sequence: Synthetic coding sequence
atgagccaggctgagtttgagaaagccgcagaggaggtcagacatctgaagacaaagccgagcgatgaagaaatgctgtttatctatggccattataaacaggctacggtcggcgacatcaataccgagagacccggaatgctcgatttcaccggcaaggcgaaatgggatgcgtggaatgaattgaaggggacctccaaagaggacgccatgaaagcatacattaacaaggtcgaggaactcaaaaagaaatatgggatttag

SEQ ID NO: 49822 - DNA, 315 bp, Artificial Sequence
  Description of Artificial Sequence: Synthetic coding sequence
atgtggggcgacctatggctgttgcctcccgctagcgccaatccaggcaccgggaccgaggctgaattcgagaaggctgcagaagaggtgcgacacctgaaaacaaaacctagcgacgaggaaatgttattcatatacggccactacaagcaggctactgttggggacataaatactgagcggcctggtatgctggactttactggcaaggcaaaatgggatgcatggaatgaactgaaaggcaccagcaaggaagacgccatgaaagcctatataaacaaagtggaggagcttaaaaaaaaatacggcatctag

SEQ ID NO: 49823 - DNA, 390 bp, Artificial Sequence
  Description of Artificial Sequence: Synthetic coding sequence
atgagccagcatcgagctggcaggaggggcggtgttggtaaacgtggcgttcggggaagggagctgggcggacagggtaaatatggcgctgggtgctcagaatgcggcactcggaggattgccgctaggggagaggcggagttcgagaaagctgccgaggaagtgagacacctcaaaacaaagccatccgatgaagaaatgctgtttatctatggacattataaacaggcaactgtcggggatatcaacacagagcgtcccggaatgttggactttaccggcaaggccaaatgggacgcctggaatgagctgaaggggacatctaaagaggacgccatgaaagcgtacatcaataaggttgaggagcttaagaagaagtatggaatttag

SEQ ID NO: 49824 - DNA, 315 bp, Artificial Sequence
  Description of Artificial Sequence: Synthetic coding sequence
atgtggggggatctttggctcctaccacccgcatcagcaaacccagggacaggtacggaggccgagttcgagaaggcagccgaagaggtgcgtcacctaaagaccaagccaagcgacgaggagatgctgttcatctacgggcactataaacaagctacggtcggtgatattaatacagaacgacctggaatgctggacttcacgggaaaagccaagtgggatgcctggaacgaactcaaaggcactagtaaagaagacgcaatgaaggcatacattaataaagtcgaggagcttaaaaaaaaatacggaatctag

SEQ ID NO: 49825 - DNA, 447 bp, Artificial Sequence
  Description of Artificial Sequence: Synthetic coding sequence
atggaaagatggggaaagggactgcatggcttggaggagcggggtgacagtgtgccaattcctaagcaccgggctggtcgacggggaggagtgggcaaacgaggcgtcagaggccgtgaactgggaggacaaggcaaatatggggctggttgtagtgaatgcggaacgcgtcgcatcgcggcaaggggggaggcggagttcgagaaagccgctgaagaggtgcgccacctaaagacaaaaccgtcagacgaagaaatgctatttatttacggacactacaagcaggcaaccgtcggcgacattaataccgagaggcccggaatgctggactttacaggcaaggccaaatgggacgcttggaatgagctgaaagggacctccaaggaggatgcaatgaaggcatatatcaataaggtggaggaactgaagaaaaaatatgggatttag

SEQ ID NO: 49826 - DNA, 564 bp, Artificial Sequence
  Description of Artificial Sequence: Synthetic coding sequence
atgtttctgctcctgaattgcattgtggcagtctcgcagaatatggggatcggaaaaaatggcgacctccccagaccccctcttaggaatgaattccgctatttccagcgcatgacaacaacctcctctgtggaaggcaaacagaaccttgttataatgggcagaaaaacttggttcagcattccagaaaagaatcggccactaaaagacaggatcaatctggtgctctcacgggaattgaaagaaccaccccagggggcacactttctagcccgtagcttggatgacgccctaaagctgaccgagcggccagagctcgctaataaggtggacatgatttggatcgtgggtggatcttcagtctataaagaagccatgaatcatcttggtcatcttaagctgtttgttacccgaataatgcaggatttcgagtccgatacatttttcagtgaaattgatctggagaaatacaaactgttgcccgagtatcctggagtccttagcgatgtgcaggaaggtaaacacattaagtacaaattcgaggtgtgcgagaaggacgactag

SEQ ID NO: 49827 - DNA, 564 bp, Artificial Sequence
  Description of Artificial Sequence: Synthetic coding sequence
atgtttttacttctcaactgcatcgtagcagtgtcccagaacatgggcatcgggaagaacggagatctccccagacctcctctgagaaatgaatttcgctattttcagcgcatgaccacaaccagctccgtggagggcaagcagaacctagtgattatgggaagaaaaacttggttttccataccagaaaagaatcgccctcttaaggatcggataaacctggtcctcagccgtgaacttaaggaaccgcctcaaggcgcacacttcctggcacggagtctggacgacgctctcaaacttaccgaacgccctgagctagccaacaaagtcgacatgatctggatcgtgggagggagttccgtgtataaggaagcaatgaaccatttggggcaccttaaactcttcgtgacacgaataatgcaggactttgaaagcgacacctttttttcagagatcgacctggagaaatacaagctgttgcccgagtacccaggggttctcagcgacgtacaggaaggaaagcacatcaagtataaatttgaggtgtgcgaaaaggacgactag

SEQ ID NO: 49828 - DNA, 564 bp, Artificial Sequence
  Description of Artificial Sequence: Synthetic coding sequence
atgttccttttactgaactgcatagtggcggtctcccagaatatgggaataggcaaaaatggtgacttgccacgcccaccgttgaggaacgaattccggtattttcagcgcatgactactacaagttctgtagaaggtaaacaaaaccttgttatcatggggagaaagacctggttcagcattccagaaaagaatcggccattgaaggaccgcatcaatcttgtgctgtctcgtgagttgaaagagccacctcagggcgctcattttttggctcgtagccttgacgatgcactcaaactgacggagcggccagagcttgctaataaagtggacatgatctggatcgtggggggttcttccgtatataaggaggccatgaatcatttaggccacctgaaattgtttgtcaccagaattatgcaggatttcgaatccgacactttcttcagtgaaattgatctcgagaagtacaaactcctccctgaataccccggagtgttgagcgatgtacaggaggggaaacacattaaatacaaattcgaggtgtgcgaaaaggacgattag

SEQ ID NO: 49829 - DNA, 345 bp, Artificial Sequence
  Description of Artificial Sequence: Synthetic coding sequence
atgttcctgcttctgaattgcatcgtagccgtcagccagaatatgggcatcggaaagaatggcgatctcccgaggcctccactgcggaacgagtttcgctactttcaacgaatgaccaccactagcagtgtggagggtaaacaaaacttagtcattatgggtcgcaagacttggtttagcatccccgaaaagaataggcccctgaaggacagaattaacttggtactgtcccgcgagttgaaggagccacctcaaggtgcccactttttagcccgttcactggacgacgccctgaaactgaccgaaagaccagaactggctaataaagtggacatgatttggtag

SEQ ID NO: 49830 - DNA, 597 bp, Artificial Sequence
  Description of Artificial Sequence: Synthetic coding sequence
atgcccgagcagtccaatgactatcgtgtcgtggttttcggtgccggaggtgttgggaaaagctcactggtcttacggttcgtgaaaggtacattccgcgatacctatatccctacaatcgaggacacatatcgtcaagtgatatcatgcgataaaagtgtttgcaccttgcagattactgacacgacaggaagtcatcaattcccagccatgcagcgcctgtccataagtaagggacatgctttcattctggtttttagcgtgacctctaagcaatcattagaagagttaggtcctatttacaaattgatagtgcagatcaaaggcagcgtcgaggatatccctgtcatgttagtcggcaataagtgcgatgaaactcagcgggaggtcgacaccagggaggcccaggctgtcgcccaggagtggaagtgcgcatttatggaaactagtgcaaaaatgaattacaacgttaaggaactgttccaagaacttttaacactcgagactcggagaaatatgtcactgaatattgacggaaaacgtagcggcaagcagaagcgcaccgacagagtgaagggcaagtgtaccctgatgtag

SEQ ID NO: 49831 - DNA, 600 bp, Artificial Sequence
  Description of Artificial Sequence: Synthetic coding sequence
atgcctgagcagtctaatgattaccgtgtggctgtgttcggtgccggtggtgtcggaaaatcttcactggtgcttcggttcgttaagggcactttccgggagtcttacatccccactgtcgaagacacatatagacaggtgattagctgtgacaagtctatctgcacactgcaaattactgacactacagggtcacatcaattcccagccatgcagcggctctctatcagtaaggggcacgcttttatccttgtttatagcattacctcaagacagtcactagaggagcttaaacccatatatgagcagatctgcgaaatcaagggtgacgtggaatccattccgattatgctggtgggcaataaatgtgacgagtcaccttcacgagaagtgcagagcagtgaagctgaggctctggctcgcacatggaagtgcgcttttatggaaacgagtgccaagctcaaccacaatgtgaaagaattgttccaggagttgttgaacttggaaaagaggcggaccgtctccctgcagatcgatggcaaaaagtccaagcagcagaagagaaaggagaagttaaaaggtaagtgtgtgattatgtag

SEQ ID NO: 49832 - DNA, 690 bp, Artificial Sequence
  Description of Artificial Sequence: Synthetic coding sequence
atgggaaacgccagcttcggctccaaggagcagaagctgctgaaaaggctccggctcctgcccgcactcctcattctgcgcgcttttaaaccccacaggaagatcagggactacagagtcgtcgtcgtgggaacggccggtgtcggcaagagcacactgcttcacaagtgggcgtccggcaattttagacacgaatacctgcccaccatcgaaaacacctattgccagcttctgggatgttcccatggagttctgagcctgcacattaccgattccaaaagtggcgatggcaatagggcactccagcgccacgtaattgcacgagggcatgccttcgtcttagtttatagcgtcaccaaaaaagagacactggaagagctgaaggctttctacgagctcatctgcaaaattaagggcaacaacctgcacaagttccctatcgtgctggtgggcaataaaagcgacgatacacatcgcgaggtggctttgaacgatggggcaacttgcgccatggagtggaactgcgcattcatggaaatttcggcaaagactgacgttaatgtccaggagctgtttcacatgctgctgaattacaagaagaaacctactacgggactgcaggaacccgagaagaaaagccagatgcctaatactactgaaaagctcctggataaatgcatcatcatgtag

SEQ ID NO: 49833 - DNA, 690 bp, Artificial Sequence
  Description of Artificial Sequence: Synthetic coding sequence
atgggtaacgcctcctttggctcaaaagaacagaagctgctgaaacggctgcgactactgccagcactgctgattctccgggcttttaagccccatagaaagatacgggactaccgagtggtcgttgttgggaccgccggagtaggcaaatccaccctgttacataaatgggcatcaggcaacttccggcacgagtatctgcccaccattgagaatacatattgtcagctgctaggatgttctcacggagttttgtccttgcatattacagacagtaagagtggcgatgggaaccgggcactgcagcgtcacgtcattgcccgaggacacgcattcgtgcttgtttactcagtcactaaaaaggagaccctcgaggagctgaaagcattttatgaactaatctgcaagattaaagggaacaacctgcacaaattccctattgtcttggtcggcaataagtccgacgatacccacagagaagtagctctgaacgatggtgccacatgtgctatggaatggaattgcgccttcatggaaatatccgctaagactgatgtcaacgtgcaggagctgtttcatatgctccttaattataagaagaaacccactactggcctacaggagccagagaaaaaaagccagatgcctaacacaaccgaaaagttgctcgataagtgcattattatgtag

SEQ ID NO: 49834 - DNA, 501 bp, Artificial Sequence
  Description of Artificial Sequence: Synthetic coding sequence
atgggcccagaagctttgtcctctctgctcctgctgctcttagtggccagcggcgacgctgacatgaaaggccattttgaccccgctaagtgccggtacgccctggggatgcaggatcgtacaataccagacagcgatatttccgcaagctcttcttggagtgatagcacagccgctcgccacagtaggctggaatccagcgacggcgacggagcctggtgccccgcaggtagcgtgtttcctaaagaggaggagtatctgcaggttgaccttcaacggctgcatctagtagcactggtgggaacccaaggccgacatgcagggggactcggaaaggagttttcgcggagttaccgccttaggtactccagagacggtagacgatggatgggttggaaagaccgttggggacaggaagtgatctccgggaatgaggatccagaaggggtggtgctcaaagacctcgggcctcccatggtcgccagattggtgcgattctag

SEQ ID NO: 49835 - DNA, 420 bp, Artificial Sequence
  Description of Artificial Sequence: Synthetic coding sequence
atgggacctgaagccttatcctcactcctgcttctcctcctggtggcgagcggtgatgccgatatgaaaggacattttgatcctgctaagtgccgttacgccttaggaatgcaggatagaactattcctgattcagatatcagtgcctcttcttcctggtctgatagcaccgctgcaaggcattcccggctggaatcaagcgatggggacggtgcgtggtgtcccgctggatccgtcttcccgaaggaagaggagtatctccaggtagacctacagcggctgcatcttgttgctttggttgggacacagggaagacacgctggcggtctaggaaaggaattctctagaagctaccggctcagatactctagagacggcaggcgttggatgggatggaaggacagatgggggcaggaatag

SEQ ID NO: 49836 - DNA, 756 bp, Artificial Sequence
  Description of Artificial Sequence: Synthetic coding sequence
atgggaccggaggccctcagctccctgctgctgctgcttttggtggcaagtggggacgctgatatgaagggtcactttgaccccgcaaaatgccgctacgctcttgggatgcaggaccggactatccctgatagtgacatatctgcctcaagctcctggtcagacagtacagctgcacgtcactctagactcgagagctccgatggtgatggcgcttggtgccccgcagggtcggtgttcccgaaagaggaagagtaccttcaagttgacctgcagcggttgcacctcgtggcgctcgtaggaactcaggggcgtcatgccggaggcctggggaaggagttttctcgctcttaccggctgcgctacagtcgggacgggagacgatggatggggtggaaggatagatgggggcaggaagttatatccggtaacgaagatccagaaggggtcgttttaaaagacctgggaccccctatggtcgctcgtctcgtgcgcttctaccctagagccgatagggtgatgtccgtgtgtcttagagtagagctgtacggatgtctatggagggacggcctgctgtcttacaccgcccctgtaggtcagaccatgtacttgtcagaagctgtgtatctgaacgatagtacatacgatgggcacactgtcggcggtttgcagtacggagggctggggcagctggcagacggcgtggtggggcttgatgactttcggaagagtcaggagttgcgtgtttggccttag

SEQ ID NO: 49837 - DNA, 420 bp, Artificial Sequence
  Description of Artificial Sequence: Synthetic coding sequence
atggggccagaagcactgtcaagcctgctgcttctgcttctggtagcctctggagatgccgatatgaagggacactttgacccggcaaagtgtcgctacgccctgggcatgcaggacagaacgattcctgatagtgatatcagtgccagctcttcctggagcgatagcaccgctgccaggcattctagactcgaaagttccgacggcgatggcgcttggtgcccagcgggatccgtgtttccgaaagaggaggaatatctgcaggttgacttacaaagactacatttagtggcattggtgggcacacaaggtcggcatgctggagggctgggaaaggaattctccaggagttacagactacggtattcccgtgatggccgaaggtggatgggatggaaggatagatgggggcaggaatag

SEQ ID NO: 49838 - DNA, 756 bp, Artificial Sequence
  Description of Artificial Sequence: Synthetic coding sequence
atgggccctgaggcgctaagctctcttttgttgctgttgctggtggccagcggcgacgctgatatgaaaggccacttcgatcctgccaagtgtcgctacgcattgggaatgcaggacagaacaatcccagacagtgacatcagcgctagtagctcttggtcggattccactgccgcacgccacagcagactcgagtcctccgacggggacggagcatggtgccccgctggctcggtgtttcctaaggaggaagagtacctacaagtcgatctgcagaggctccacctcgtggctctcgttggaacacaagggcgacatgccggtggtttaggtaaggaattctcccgctcctatagacttcgttactcgcgagacggtcgtcgctggatgggttggaaagacaggtgggggcaggaggtgatcagtggcaatgaagacccagagggtgtggtcctaaaggatctgggcccacctatggtggccagactggtgcgcttttatccacgggcagatcgcgttatgagcgtgtgtctgcgggtggaattgtacggctgtctgtggagagacggtcttctgagctatactgctcccgtgggccagacaatgtatctgtccgaggctgtctatctgaacgacagcacttatgatggacatacggttgggggactgcagtatggaggattgggccagcttgcagacggggtcgtgggtctcgacgatttccgcaagagtcaggagctgcgcgtatggccttag

SEQ ID NO: 49839 - DNA, 420 bp, Artificial Sequence
  Description of Artificial Sequence: Synthetic coding sequence
atggggcctgaggcactgtcatcactgctcctcctcctgctagtggcgtccggtgacgcagacatgaaaggacactttgatccagccaaatgccggtacgctctgggaatgcaagacaggacaataccagacagtgatatttcagcgtcaagcagttggtccgatagcacggccgctaggcacagcaggttggaaagttccgatggggatggtgcgtggtgccctgcgggaagtgtgtttcccaaggaagaggaatacctgcaggtggatctgcaaaggctccatctcgtggccctggtgggtactcagggacgtcacgcagggggtcttgggaaggaatttagcagaagctaccgattaagatactctcgggatgggcgtcgctggatgggctggaaggatcgatgggggcaggaatag

SEQ ID NO: 49840 - DNA, 756 bp, Artificial Sequence
  Description of Artificial Sequence: Synthetic coding sequence
atgggccctgaggcgctatctagtctgctgctgctcctgctcgttgcctccggcgatgcggacatgaagggccacttcgatccagctaaatgccggtacgccctgggcatgcaggacagaaccattcctgacagcgacatctccgctagtagtagctggagtgattctacagctgctcgccattcaagacttgagagcagcgacggcgatggcgcttggtgcccagctggcagtgtgttccctaaagaggaagaatacctgcaggtagatctgcagcgacttcacctcgtggctctggtcggtacacagggacgacatgccggaggcctgggtaaggagttctctagatcctacaggctgagatacagcagggacggaaggcgatggatgggatggaaggacagatgggggcaggaagtgatatccggcaatgaagaccccgagggcgtggtgctgaaggacctgggcccacccatggtggctaggctggtgcggttctaccccagagcagatcgcgtgatgagcgtatgtctccgcgtcgagctttacggctgcctatggcgggatggactgctgagctacaccgcacctgtcgggcagaccatgtacctatctgaggccgtgtacctgaacgattccacctatgacggacacactgtaggaggcctccagtacggcggactgggccagctggctgatggcgttgtgggtctagatgacttccgcaagagccaagagcttcgcgtttggccttag

SEQ ID NO: 49841 - DNA, 756 bp, Artificial Sequence
  Description of Artificial Sequence: Synthetic coding sequence
atgggaccagaggccctgtcctctctgttactattgctgcttgtggcctccggggatgccgatatgaaaggccactttgatccagctaagtgtcgttacgctcttggtatgcaggatcggaccataccagacagcgatatctctgcctcatcatcatggtccgacagcacagcagcgcgtcattcacgccttgaaagcagtgacggcgatggagcttggtgtcctgccggtagcgtttttcctaaagaagaagagtacctgcaagtggatctgcagcgcctgcatctcgtggctctagtagggacacagggcaggcacgccggtggcctgggcaaagaattcagtcggtcttaccgcctcaggtattcacgggacggtaggcggtggatgggctggaaggacagatggggacaggaagtcatatcaggtaatgaggatcccgaaggagtggtactaaaggacctgggaccccctatggttgctcgacttgtcagattctacccaagagctgatagggtcatgagtgtgtgtctgcgcgtcgagctgtacgggtgcctttggagggatgggttgctgagctacaccgcccctgtcgggcagaccatgtatctgtccgaagccgtgtacctgaacgattcaacgtacgacggacacactgtcgggggtcttcaatacggcggattgggccagctggccgacggagttgtgggcctggacgacttccgcaagtcccaggaactcagagtgtggccatag

SEQ ID NO: 49842 - DNA, 420 bp, Artificial Sequence
  Description of Artificial Sequence: Synthetic coding sequence
atgggacctgaagctctctcgagtcttctgctgctgctactggtcgcctcaggcgatgccgacatgaaaggccatttcgatccagctaagtgtcggtatgccttgggcatgcaggatagaactattcccgattcagatatttccgcaagcagtagctggtcggacagcacggccgctcggcatagccgcctggaaagtagcgatggtgatggcgcttggtgtccagccggaagcgtattccccaaagaagaagaatatctgcaagtagacctccagcgcctgcacctggtggccctagtaggcacccagggcagacatgctggtggcctcggcaaggagtttagtagatcttaccggctcagatattcgagagacggccgacgctggatgggctggaaggaccgatggggacaggagtag

SEQ ID NO: 49843 - DNA, 192 bp, Artificial Sequence
  Description of Artificial Sequence: Synthetic coding sequence
atgggtccggaggcactgtccagcttgctcctcctattactcgtcgctagcggcgatgccgacatgaaggggcacttcgatccagcaaaatgtcgctacgccttgggaatgcaagaccggacgatccccgactcagatatatccgcctctagctcctggtcggactccaccgctgcgcgacacagcaggtag

SEQ ID NO: 49844 - DNA, 756 bp, Artificial Sequence
  Description of Artificial Sequence: Synthetic coding sequence
atggggcctgaggctctgtcctccctgctcttactgctcctagtagcgtctggggacgctgatatgaaaggccactttgacccagccaagtgtagatatgccttaggtatgcaggatagaactatacccgatagcgacatttccgcaagtagtagttggtcggactcgacggccgctcgccattcccgtcttgaatctagtgacggcgacggtgcttggtgtcctgctggctctgttttccccaaggaagaggaatatctccaggttgatcttcagaggctgcacctagtggccctagttggaacacaaggcaggcacgctggtgggctgggaaaggaattctcaagatcctacaggctgcgttactcccgggacggcagacggtggatggggtggaaggaccggtggggccaggaggttataagtgggaatgaagaccccgagggcgtagttttaaaggatctcggcccaccaatggttgctcggctggtgcgattttaccctagggcagatcgtgtaatgtctgtctgtcttagagtggaactgtacggatgcctatggcgggatggactgctctcttacaccgccccagtcggtcagacaatgtatcttagcgaggcagtataccttaacgactctacatatgatggccacaccgtcggtgggctgcagtatggcggtctggggcagctggccgacggcgtggtgggactggacgactttaggaagagtcaggagcttcgcgtgtggccctag

SEQ ID NO: 49845 - DNA, 420 bp, Artificial Sequence
  Description of Artificial Sequence: Synthetic coding sequence
atggggccagaagccctgtccagcctgctgttgctgctgttggtcgcttcaggcgacgccgacatgaaaggacatttcgatccagcaaaatgcaggtatgcactgggcatgcaggataggactatacccgactcagatattagcgcatcctcatcatggagcgactccacagcagccaggcatagtcggcttgagagctcagacggtgatggtgcctggtgtcccgcagggagcgtgtttccaaaagaggaggaatatctgcaggttgacctgcaacggctgcatttggtggccctggtgggcactcagggcagacatgccggaggtctgggtaaggagttcagcaggagctataggttgaggtacagccgcgacggccgacggtggatggggtggaaggaccgctgggggcaggaatag

SEQ ID NO: 49846 - DNA, 420 bp, Artificial Sequence
  Description of Artificial Sequence: Synthetic coding sequence
atgggacctgaagccctttcttcactactgctcctgctgttggtcgcaagtggggacgccgacatgaagggtcatttcgatccagccaagtgtcgctacgcccttggcatgcaggatagaacgatcccggacagcgacatcagtgctagttcgagctggtccgactctacagccgctagacactcccggctggaatcaagtgacggcgatggcgcttggtgtccagccggttctgtcttcccaaaggaagaagaatacctccaggtggatcttcagcgactacacctcgtggccctcgtgggcacccagggtcgccacgcaggtggcctcggaaaggaattctcccggtcttataggttaagatactctagggatggcagaaggtggatgggctggaaggacaggtgggggcaagagtag

SEQ ID NO: 49847 - DNA, 192 bp, Artificial Sequence
  Description of Artificial Sequence: Synthetic coding sequence
atgggcccagaagctctgagctcactgctgctcctgttgctggtggcctccggagacgcggatatgaaaggccatttcgatccagcgaaatgtagatatgcgctgggcatgcaggacaggacaatcccagacagcgatatctccgcctcctcctcctggagtgactcaacagcagccaggcacagcaggtag

SEQ ID NO: 49848 - DNA, 630 bp, Artificial Sequence
  Description of Artificial Sequence: Synthetic coding sequence
atgggcccagaagccctgtcttccctgctccttctcctgcttgtggccagcggagatgccgacatgaaaggccatttcgatcctgccaaatgtcggtatgctcttggcatgcaggataggacaatacccgactctgatatttcagccagcagctcttggtcagattcaaccgctgctcggcatagtcgcctcgagtcctccgacggtgatggcgcttggtgccctgccggatcggtttttccaaaggaagaagagtatctgcaagtggatctgcagagactgcacctggtggccctagtgggcacgcaggggagacatgccggaggcttaggcaaagagttcagtagatcttacaggctgcgctacagccgcgatgggcgtcgctggatgggttggaaagaccgctggggccaggaggtcatctccggcaacgaggatcccgagggagtggtgctcaaggacttaggccctcccatggtggcccgacttgtccgtttctatcctcgagctgatagggttatgagtgtttgcctcagggtggaactctatggttgtctttggagagatggactactcagctatacagcacccgtaggccagacaatgtacctttccgaagccgtctactag

SEQ ID NO: 49849 - DNA, 420 bp, Artificial Sequence
  Description of Artificial Sequence: Synthetic coding sequence
atgggacctgaggctttgtcttccttactgttactgctgttggtagcctcaggggacgccgacatgaagggacactttgacccagcgaagtgtcgttatgcactgggcatgcaggaccggacgattcccgacagcgacattagcgcgagctcaagttggagcgactccactgctgcacgccattctcgcctcgaatcttccgatggcgatggggcatggtgcccggcagggagcgtgtttcccaaggaagaggagtatctgcaggttgacctgcagaggctccacctggtggctttagtgggcactcagggaagacacgcgggaggactgggtaaggaatttagcaggtcatacagactgcgctacagcagagacgggaggagatggatgggctggaaggatcgatggggacaggaatag

SEQ ID NO: 49850 - DNA, 420 bp, Artificial Sequence
  Description of Artificial Sequence: Synthetic coding sequence
atggggcctgaggccctatcatccctgctgctgctgctgctcgtcgcctctggtgatgccgacatgaagggacatttcgatcctgcaaaatgccgatacgccttaggaatgcaggatagaactataccagactcagatatttctgcgagttcctcctggagcgactcaaccgctgcacggcactctagacttgaaagctctgacggggacggggcttggtgcccagctggatcagtgttcccaaaggaggaggagtacctgcaggtcgaccttcagcggctccacctggtggcactggtgggtacccagggacgccacgccggaggactgggtaaggagtttagcagatcctatcgactccggtatagtagagatggtcgacgctggatgggttggaaggataggtgggggcaagagtag

SEQ ID NO: 49851 - DNA, 420 bp, Artificial Sequence
  Description of Artificial Sequence: Synthetic coding sequence
atggggccagaggccctcagctccctgctccttttgctactcgtggcctccggagatgctgatatgaaaggtcattttgaccctgctaaatgcaggtacgctctgggtatgcaagaccggacaatacctgattcagacattagcgcctcctcttcttggtccgatagcacagccgcacggcacagtagattggagtcatcagatggtgacggagcctggtgtcccgctggaagcgtttttccaaaagaggaggagtacctccaggtggatttgcagcgtctgcacctggtagctctggtggggacccagggccgacacgccggtggcctcggcaaggagttctctaggagttatcggctgcggtactcccgggatggcaggagatggatgggttggaaagacaggtggggccaggaatag

SEQ ID NO: 49852 - DNA, 144 bp, Artificial Sequence
  Description of Artificial Sequence: Synthetic coding sequence
tccgaggctgtgtatttgaacgattctacctacgatggccatactgttggtggacttcagtacggaggcctcggtcaactggccgatggcgtggtcgggctggatgattttaggaagagccaagaactgagggtttggccgtag

SEQ ID NO: 49853 - DNA, 444 bp, Artificial Sequence
  Description of Artificial Sequence: Synthetic coding sequence
atgggacccgaagcactcagtagcttactgctgctcctcctggtggcttcaggggatgccgacatgaagggtcacttcgatccagccaagtgcaggtacgctttgggcatgcaggatcgcacaatccctgacagcgacatctccgcctcctcttcgtggtcagactctacggctgccaggcactctcgactggagagttccgacggagatggcgcttggtgtcctgcagggagcgtgttcccaaaggaggaagagtatttacaggtggatctacagcggctgcatctcgtggccttggtcggcacccagggacggcacgcaggtggcttaggtaaggagttctctcggagctaccgcctccgatactcccgggacggtagacgctggatggggtggaaagatcgctggggacaagaggtaatttctggtaatgaagatccatag

SEQ ID NO: 49854 - DNA, 420 bp, Artificial Sequence
  Description of Artificial Sequence: Synthetic coding sequence
atgggacccgaagcgttaagcagtctacttcttctccttctagtggcttctggcgacgctgacatgaaaggacactttgaccctgcaaaatgccggtatgcccttggcatgcaggaccgaacaattcccgatagtgatatttccgcctcatcctcctggtccgactccactgctgctcgtcatagcagacttgagagtagtgacggtgacggtgcatggtgcccggctggcagcgtgtttcccaaggaagaggaatatctgcaggtcgatctgcagcggttgcacctagtggctctggtaggtacacaggggagacatgcaggaggtctcggcaaagaattctcacggagctaccggctgaggtattctcgggacgggagacgctggatgggctggaaggataggtgggggcaggagtag

SEQ ID NO: 49855 - DNA, 756 bp, Artificial Sequence
  Description of Artificial Sequence: Synthetic coding sequence
atgccacacctagcaagtctgtttacggccagctccagatgctgcccgcatcctctgcggcctgaaggcagcggagcgatgggcccagaagcactcagctctctcctacttctgttgctggtggcatctggggacgccgatatgaagggccatttcgaccctgcaaagtgtaggtatgcactggggatgcaggataggaccattcctgatagtgacatcagtgcttcgagctcctggtctgacagtaccgccgctcgccacagccggctcgaaagttccgatggcgacggtgcatggtgtccagccggttcggtctttccaaaggaggaagaatacctgcaggtggatttgcagcgattacacctggtggctctggttggaacccagggccgacacgccggtggactgggcaaggaattctcaaggagctaccgtctcagatactcccgggatggcagaaggtggatggggtggaaggacaggtggggacaggaagtaatttctggcaacgaggaccccgaaggggttgtcctcaaggatcttggccctcctatggtcgcacggctcgtgcggttctacccgagggcggaccgcgtgatgagcgtgtgcctccgggtggagttatatggctgtctctggcgcggtgagtggttgtcctttctcggaatttgctttctgagcaggggactcgagggaggagagtgcggagagtgggcttcacgtattccctcacccgctggtaagctttcattgtag

SEQ ID NO: 49856 - DNA, 1620 bp, Artificial Sequence
  Description of Artificial Sequence: Synthetic coding sequence
atggtacctggcgctcgcggtggtggggcactagcacgcgctgccggacggggacttctggcactgctgctcgccgttagcgctcccctgcgattacaagccgaagaactcggcgatggatgcgggcacctggtaacctaccaggactccgggacgatgacatccaagaattaccctgggacgtacccaaatcacactgtctgtgagaaaacgatcaccgtgccaaagggaaaaaggttgattttgcggctaggagatctggacattgagagtcagacctgtgcctctgattacctccttttcaccagttcctctgaccaatatggaccatactgtggctcaatgactgtccccaaggagctcttgctgaacaccagtgaggtcacagtgagattcgagagtggttcacatattagcgggaggggtttcctgctcacctatgcttctagcgaccaccccgatctgattacttgcctggagcgggcttcccactatcttaagaccgagtactctaaattttgcccggcaggatgtagagacgtcgctggagacatcagtgggaacatggttgatggataccgtgacacttccctcctgtgtaaggcagcaatccatgcaggaatcatcgccgatgagctcggaggacagattagcgttctgcagaggaaaggaatttcacgatatgaggggatcctcgccaatggagtcctgtctcgcgacggttctttgtctgacaaacggttcctgttcacatctaacggatgcagcagatccctgagctttgagcccgacggccagatccgggcaagcagctcttggcagtcagtaaatgagtcaggagatcaggtccattggtctcccggtcaggcacgcttgcaggaccaaggcccttcctgggcaagtggtgactcctccaataatcataagcctcgggagtggctagagatagatctgggggagaagaaaaagattactggcattcgtacaaccggctctacgcagagtaacttcaacttctatgtcaaatcttttgttatgaacttcaagaataacaacagtaaatggaagacatataagggcatagttaataacgaggagaaggttttccaaggaaatagtaactttagagatccagtccagaacaacttcattcctccaatcgtggcaagatacgtgcgcgtggtcccacaaacctggcaccaacgcatagctctaaaagtggagctgattgggtgccagatcacccaggggaatgatagtctcgtatggaggaaaacttctcaaagcacatctgtcagcaccaaaaaagaagacgagacaatcaccaggcccatccccagcgaagaaacaagcactggaatcaacatcacaaccgtcgccattccgttagtgctgttggtggttctggtgttcgccggaatgggcatattcgccgcattcagaaaaaagaaaaagaaagggtctccttacggctccgcagaagcccagaagacagactgctggaaacagattaagtatccattcgctaggcatcagagcgccgaattcacaatctcttatgacaacgagaaagaaatgacgcagaagctcgatctaataaccagcgacatggcaggctag

SEQ ID NO: 49857 - DNA, 2148 bp, Artificial Sequence
  Description of Artificial Sequence: Synthetic coding sequence
atggtgcccggagctcggggaggaggcgcattagccagggctgccggtcgtggccttctggccctgctgctagccgtatcagctcctctacggctgcaggccgaagagttaggcgatggctgtggccaccttgttacatatcaggattctggtacgatgacaagtaagaattaccccggaacctaccccaatcataccgtgtgcgagaagacaattacggtacctaagggaaagagacttattttgaggctgggagaccttgacatcgagagccaaacgtgtgcaagcgactatctgctattcacaagctcttcagatcagtatggaccctactgcggtagcatgacagttccaaaagagctgttgctgaacacaagtgaagtcactgttagattcgagtccggcagccatatctccgggaggggattccttctgacttacgcctccagtgaccatcctgacctcatcacctgtctagaacgggcatcacattaccttaagactgagtattccaagttttgtcctgctggctgccgagatgtggctggagatatttcaggaaatatggttgacggctacagggatacttcattgctgtgtaaggccgctatacatgctggtatcatcgcggacgaactgggagggcaaataagtgtgttacagagaaaggggatttcgcggtacgaagggattctggcaaacggggtcttgagtagggatgggtctctttccgataaacgctttctgttcactagcaatgggtgctcaagaagcctaagttttgagcccgatggccagataagggccagcagttcgtggcagagcgtgaatgagagcggagatcaagtacactggagtccgggtcaggcccgattacaggatcagggaccctcctgggccagcggcgattcctctaacaatcataagcccagggaatggttagaaatcgatctcggcgagaagaagaagatcaccggaattcgcactacagggagtacacagagtaattttaatttctatgttaagtcctttgtaatgaacttcaagaacaacaactccaaatggaagacttacaaggggattgtgaataatgaagagaaggtatttcaagggaattctaactttagggatcctgttcagaacaacttcattcccccaatcgtcgcgaggtatgttagagtggttcctcagacctggcaccaacggatcgctctaaaggtggagttgattggatgccagatcacgcagggtaatgattctctggtctggaggaaaacctcacagagcacctctgtgagtacaaaaaaggaggatgagaccatcacacgcccaattccgagtgaggagacctcaacaggtataaacataactaccgtggctatccccctggtgctgttagtggtgttggtctttgccggtatgggcatctttgccgctttcaggaaaaagaaaaagaaaggctccccttacgggtctgcggaggcacaaaagaccgattgttggaaacaaatcaaatacccatttgctcgacaccagtcagcagaattcaccatatcttatgacaatgagaaggagatgacgcagaagctagacctgataacctcggatatggctgactatcagcaaccactaatgatcggaaccggaaccgttactaggaagggatctacctttcggcctatggataccgatgctgaagaggccggagtgtcgaccgacgccggaggccactacgattgcccacaaagggcagggaggcacgaatatgccctccctctagctccccctgagcctgagtacgcaacacccattgtcgagcgacacgttttacgggcacacaccttctccgcgcaaagcggatacagagtcccgggacctcaaccagggcacaagcattccctttctagcggcggattctcgccagtagccggtgtcggcgcacaagacggcgattaccaacgcccacattccgctcagcctgccgatagagggtatgatcgacccaaagccgtatccgctctggcaacagagtctggacatccggactcccagaagccaccgactcatcccggaacctccgacagttattcggctcccagagattgtttgacacctctgaaccagacagccatgactgcacttctttag

SEQ ID NO: 49858 - DNA, 1551 bp, Artificial Sequence
  Description of Artificial Sequence: Synthetic coding sequence
atggtcccgggtgcaagggggggaggggctctggctagagccgctggaagaggccttctggcactgctgctggccgtgagcgctcccctgaggcttcaagccgaggagctgggggacgggtgcggtcatcttgttacatatcaagattctggcacgatgacaagcaaaaattatccaggtacttatcctaaccatacagtgtgcgagaaaaccattacagtgcccaaggggaagcgattgatacttagactgggcgatcttgatatcgagagtcagacttgcgccagtgattatcttctgttcacgagttctagcgatcagtatggcccttactgcggttcaatgacagtaccaaaggagctgctgttgaatacctctgaggtaacagtgagatttgaaagtgggtcacatatttcaggcagaggctttctgttgacatacgctagtagcgaccatcccgatctgatcacatgcctggaaagggccagtcactacttgaagactgagtactctaaattttgcccggcaggttgcagagacgtcgccggagacatcagcggcaacatggtggatggctaccgggatactagcctgttatgcaaggctgccattcacgctggtatcattgccgacgagctgggcggtcagatatctgtcctgcagcggaaggggataagcagatacgaaggcatcctcgctaacggcgtgctgtctcgcgatgggtccctctcagataagagattcctgttcacatctaacggcatcaatattacaacagtcgctatccctctggtactgctagtggtgctcgtgttcgcaggaatgggaattttcgctgcgttccgaaaaaaaaagaaaaagggctctccatatggatccgccgaggcgcagaaaactgattgctggaagcagataaaatacccttttgccaggcaccagtccgcggaattcactatcagctacgataacgagaaagaaatgacccaaaagcttgaccttatcacatcagacatggctgattaccagcaacctcttatgatagggacagggaccgtaacacgtaaaggcagtaccttcagaccaatggacacagacgccgaggaagctggagtgtccactgatgccggaggtcactacgactgtcctcagcgcgcaggtcggcatgagtacgctcttcccctggcaccaccggaaccagagtacgctactccaatcgtggagcgacatgtcctaagggctcacacattctctgcccagtctggctatcgcgtcccagggcctcagccgggacataaacacagccttagctcaggagggttcagccctgtcgcaggggtgggagctcaggacggggactaccagcgtcctcattctgcacaacccgcagatcggggatatgaccgccctaaagctgtgagcgctctggctacagaaagcggacatccagattcacagaagccgcctacccaccctggcacttccgactcctactccgccccacgagactgtcttacacccctgaaccagaccgccatgactgccctgctgtag

SEQ ID NO: 49859 - DNA, 618 bp, Artificial Sequence
  Description of Artificial Sequence: Synthetic coding sequence
atgaactttaaaaataataactcaaagtggaagacctataaggggatagtaaataatgaggagaaagtgttccaaggaaatagtaatttcagggacccggtgcagaacaattttataccccctattgtggcaagatacgtgagagtggtgccacagacctggcatcagcggatcgctctcaaagtcgagctgattgggtgtcagatcacccagggcaatgactccctggtgtggagaaagacctcccagtctacaagtgtgagcacaaagaaggaggacgagaccatcacaaggcccatcccttcagaagagacttccaccggcatcaacattaccactgtggccatcccacttgtgctgctggtggtcctggtattcgcgggaatgggcatcttcgcagcatttagaaaaaagaagaagaaagggtctccgtatggctccgcagaggcccaaaagacggactgctggaagcagatcaagtatccgttcgcccgtcaccagtcagccgagtttacaattagttatgacaatgagaaagaaatgacccagaaactggatttgatcacgtcagacatggcagccagccctgagccagtttcagaacctctacctccctag

SEQ ID NO: 49860 - DNA, 2328 bp, Artificial Sequence
  Description of Artificial Sequence: Synthetic coding sequence
atggctagtagagcagtggtgcgagccagaagatgtcctcagtgtcctcaagtgcgggcagcggctgcagccccagcatgggcagctcttccgctgtccagatccttgcccccatgttcgaattctagtagttttagtatgccactctttctgctgctgttactcgtcctcctgcttctattggaggatgcaggggctcagcagggggatggctgtggacatacagttcttggccctgagagcgggaccctgacttcaattaactacccacagacctaccccaacagtactgtgtgtgagtgggagatacgcgtcaagatgggcgagagagtccgaataaaattcggggacttcgacatcgaggactctgatagctgccactttaactatctacgcatctacaatggaataggagtctcgcgcaccgagattggtaagtattgcggcctggggctccaaatgaatcacagcatcgagtcaaagggaaacgaaatcacgctcctctttatgagcggaattcatgtgtcaggtcgcggtttcctggcctcatactcagtcatagataaacaggatctgataacctgtctggatacggcttcaaactttctggagcccgagttttctaaatactgtccagcagggtgcctcttgccctttgctgagatctccggaacgatcccacatgggtatcgcgactcgagcccactgtgcatggcgggtgtgcacgctggcgtggtcagcaacacactgggaggccagatcagtgtggtgatttccaaggggattccctattacgagtcatcattagccaacaatgtgacctcggtcgtgggccacctctccacttctctcttcacctttaagacctcaggctgctatggtaccctggggatggaaagcggagtcatcgctgacccccagataacagcttcatcagttctcgagtggaccgatcacaccggacaagagaactcctggaagccaaaaaaagcacggctgaagaagccaggtcctccatgggccgctttcgctaccgatgagtatcagtggttgcagattgacctgaataaggaaaagaagatcacagggattatcacaactggatcgaccatggttgagcacaattattacgtatcagcatatcgtatcctgtactccgacgacggccagaaatggacagtctaccgagagccgggagttgaacaagacaagatcttccagggaaataaagattatcaccaagacgtgaggaataattttttgccgccaatcattgccaggttcatccgggtgaatcctacccaatggcagcagaagattgccatgaagatggaacttctcggctgtcagttcatcccaaagggccgacccccaaagctcacccagccacctcccccacggaacagcaatgacctcaagaacactactgcgccacctaagatcgcgaagggcagggctcctaaattcacacaacctctgcaaccaagatcatcaaacgaatttccggcacagacagagcaaacaactgccagccccgacatacgcaacactactgtgactcccaacgtcaccaaagatgtcgcgctggccgcagttttagtacccgtcctcgtgatggtgctgacaacattgatcttaattctggtatgcgcttggcactggaggaatcggaaaaagaagacagagggcacatatgacctgccctattgggatcgagcaggctggtggaaaggaatgaagcagtttctgcccgcaaaggctgtggaccatgaagagacaccggtgcgttattcttcatcagaggtaaatcatcttagccctagagaagtcactacggtcttgcaggctgactccgcagaatacgcacagcccctagtgggaggaatagtgggtactctgcaccaacgatcgacctttaaaccagaggagggaaaagaagcaggatatgcggatttggatccatataattcccccggtcaagaggtgtatcatgcctacgcggaacctcttccgattaccggtcccgagtacgcaacccccatcatcatggatatgtctgggcaccccactaccagcgtgggtcaaccttccacctcaaccttcaaggccaccggaaaccagcccccaccactagtgggtacatataatacccttctgtctaggactgattcgtgttcttcggctcaggcgcaatatgatacccccaaggccggaaaacctgggttacccgcacccgatgaattagtttatcaagtcccccagagcactcaggaggtgtccggcgcaggacgggacggggagtgcgatgtgtttaaggagatcttgtag

SEQ ID NO: 49861 - DNA, 2370 bp, Artificial Sequence
  Description of Artificial Sequence: Synthetic coding sequence
atggcctctcgagccgttgtaagggctaggaggtgcccacagtgcccgcaagtacgggcagctgccgcagctccagcatgggctgccctgccattatctagaagccttcctccttgctccaacagttcgtccttctctatgcctctcttcctgctccttctgctagtccttttgctgcttctcgaggacgcaggggcacagcagggagacgggtgcggccatacggtactaggtcccgaatctgggaccctcacttctattaactacccacagacatatcctaactcaacggtgtgtgaatgggaaatccgagtgaagatgggtgaacgtgttagaattaagttcggtgacttcgatatcgaagattcggactcatgtcatttcaactatctgcgtatctacaatggaattggcgtgtcacgtactgagatcgggaagtactgtggcctgggattgcaaatgaatcacagcatcgagtccaaaggcaacgagatcaccctgctgttcatgtctggcatacacgtgtctggtagggggtttttggcatcctattccgtcattgataaacaggacttaattacctgcctcgacaccgccagcaacttcctcgagcccgaattcagcaaatactgccccgctgggtgtctgctaccttttgccgagattagcggcacgattccacatggctatagagacagtagccccctctgcatggccggagtccacgccggagtggtgtccaacaccttgggtggccaaattagtgtggtgatctctaaaggaatcccgtactacgagtctagcctcgccaacaatgtgacttccgttgtcggacacttgagcacttccttgttcactttcaagactagtggatgctatggtacacttgggatggagtccggggtgatcgccgacccgcagattaccgcaagctcagtcttagaatggacggatcataccggtcaggagaactcttggaaaccgaaaaaggcgcgtctgaagaaacctggacccccatgggctgcgtttgccacagacgagtaccagtggctgcagatcgacctgaacaaggagaagaaaattacaggcatcatcactaccggctccacaatggtggagcacaattactacgtttccgcctatcgaatcttgtactctgacgacgggcagaagtggacagtgtacagagaacccggagtcgaacaggacaaaatctttcaggggaataaagactatcatcaggatgtgcggaataattttctgccgccaatcatcgcccgttttatcagagtgaacccaacccagtggcaacaaaagattgctatgaaaatggagcttctgggctgtcagttcatacctaaagggaggcccccaaagctgacacaaccacccccacccaggaattctaatgatctgaagaataccacagctccgcctaagattgcaaaaggccgtgcaccaaaatttactcagcctttacagccccgttccagcaacgagtttccagcacagactgagcagacaacagcctctccggatattcgtaatacaacagtcacacccaatgtcacgaaggatgtggccttggctgccgtcctggttccagtgttggtgatggtcctcaccacactcatcttgatactggtgtgtgcttggcactggagaaatcgtaagaaaaaaacagaaggtacttacgacctcccatattgggacagggcaggcttttacctcatggtgtcattggcgtgccggcataatgagggttggtggaaaggcatgaagcagtttctacctgccaaagccgtggatcacgaggagactcccgtcaggtacagctcttccgaggtgaaccacctctcaccgcgagaggttaccacagtgttacaggctgattccgcggagtatgcccaacccctggtaggcggaatagttggcactcttcaccagcgttcaacctttaagcccgaggagggcaaggaggctgggtatgctgacttggacccatacaactccccgggacaggaagtctatcatgcctacgccgagcctctccccattacagggccagagtatgccacgccgatcattatggatatgtccggccatccaacaacctccgtgggtcagccttctactagcaccttcaaagctacaggcaaccagcctcctccactagtgggcacttacaacaccctcctgtcccggactgactcgtgcagctccgctcaggcacagtacgacacaccgaaagccggtaaacccggactgcctgcacctgatgagcttgtttatcaggtaccccagagcacccaggaagtgtctggggcagggagagacggagagtgcgacgtgttcaaagaaattttatag

SEQ ID NO: 49862 - DNA, 1140 bp, Artificial Sequence
  Description of Artificial Sequence: Synthetic coding sequence
atgccgctgtttttactgttgttgttggtgctactgctgttgctcgaagatgcgggagcccagcagggggatggatgcgggcatactgtacttggacccgagtctggcacactgacctccattaactatccacagacctaccccaactctacagtatgcgaatgggaaattagggtgaagatgggtgagagggtgagaataaagttcggagactttgacattgaggacagcgactcttgtcactttaactatttgcgcatatacaacggcattggggtgagtcggacagagattggaaagtactgcggcttggggttgcagatgaaccactctatcgagagcaaggggaatgagatcaccttattgttcatgtctggcattcacgtatcagggagaggcttcctcgcgagttatagcgtgatcgataagcagggaagcaattacttatttggacactgcatacagttttggaaccttagtagcggcaaatactgtcccgcagggtgcctcttgccttttgcggaaatcagcgggactattccccatggctatcgggactcgagcccactgtgcatggctggcgtacacgccggtgtagtgtccaacaccctgggaggacagattagtgtcgtgatcagcaagggtatcccgtattatgagtcctcattggccaacaacgtgacttctgtagtgtcagtatcgctgctcatggtgtttatcctgtttttcgtgtctgggtgctacggcaccctgggtatggaaagcggcgatcgcggatcttctaataattcaatagtgttggaatggacagatcacactggtcaagagaattcttggaagcctaagaaacaggcggaaaaaacctggactgccctgggatttgcaactgatgagtatcagtggctgcaaatcgatctgaacaaggaaaagaaaatcacgggaattattacaacaggaagtactatggttactatcacgatgtgcctgccaaccgaatcatgcacagtgatgatgggaagaaatgggctgtgcacagaatctttggttgaacaggacaaaatatttcaaggaaataaggattatcaccaggatgtgagaaataatttcctacctccaatcatcgcacggtttattaggtag

SEQ ID NO: 49863 - DNA, 1884 bp, Artificial Sequence
  Description of Artificial Sequence: Synthetic coding sequence
atgaatcttatttttcataaagacattctgttcggcatccctgctaacaaggtacctcaggacgaatggactgggtatacccctagagggaaggatgatgaaattccctgccgacgcatgcgtagtggttcgtacattaaggcgatgggagatgaggattcaggggacagcgacacttcaccaaaaccgtcacccaaggtggcggctagacgtgaatcatacctaaaagcaacacagccatccttgaccgaactcactactctcaagatttctaacgagcactcacctaaacttcagattaggtctcatagctatctccgcgctgtgagtgaggtgagcattaacaggagtctggacagcttggaccctgccggattgctgacttcccctaaattccggtcccgaaacgaatcatacatgcgagccatgagtactattagccaagtgtcagaaatggaggtgaacggacaattcgaatcggtttgcgaatcagtgttcagtgagctggagagccaggcagttgaggcactcgatctgcctatgcccggatgctttcgaatgcgctcacattcctacgtgcgggctatcgagaaggggtgttcccaggacgacgaatgtgtcagtctacgttcgagctccccgcctcggactactacaactgttcgcactatccagtctagtacggttagctcctgcataactacatacaagaagactccaccacctgttcctcctcgcactacaacaaagcccttcatcagcataacagcccagagcagtacggaaagtgcccaggatgcctacatggacggacagggtcagcgcggagatatcatcagccaaagcgggttgagcaattctaccgagtctcttgactcaatgaaggcactgactgcagccatcgaggcggcaaacgcgcagatccacggacccgcaagtcagcacatgggtaacaatacagccaccgtgacaaccaccacaactattgctacggtcaccactgaggacaggaaaaaggatcattttaaaaagaaccggtgcctgagtatcggaatccaggttgacgacgccgaggagcccgacaaaacaggcgaaaataaagcccctagcaaattccagagcgtcggagtccaggtggaggaagaaaaatgctttcggaggtttactcgaagcaacagcgtgaccacagccgtgcaggccgacctcgattttcacgataatttagaaaattctctggaaagcattgaggataatagctgtcccggtcccatggccagacagttttcacgggatgcctccacaagtaccgtgagtatacagggctcagggaaccactatcacgcatgtgccgctgacgacgattttgacacggatttcgacccatcaatactccccccacctgacccatggattgattccattactgaggaccctcttgaagccgtgcagcgcagcgtctgtcacagggatgggcactggtttctgaaactgcttcaggccgaacgcgatcggatggaaggctggtgtcagcagatggagcgcgaagaacgggagaacaacttacctgaggatatcttagggaagatcagaacagccgtgggctctgcacaactgcttatggcacagaaattctaccagttccgcgaattatgcgaagagaaccttaatcccaatgcacatccaagaccaacatctcaggatctcgccggattttgggatatgttgcaactgagcattgaaaacatttccatgaaattcgatgagttgcaccagctcaaagctaataactggaaacagatggaccccctggataagaaagtagaacagtgcagattctgcatggtacatctgaaaacctgtacaaataccggccagagtaagtag

SEQ ID NO: 49864 - DNA, 2082 bp, Artificial Sequence
  Description of Artificial Sequence: Synthetic coding sequence
atgatcgacctgtttaaggcagagtgggtatctagcgtgtgtgtacaggtgtccaggaatgggagaacggatcaggttcctcaagatgaatggactgggtacacacctaggggcaaagacgatgagataccttgtaggcggatgaggtctggtagttacattaaggctatgggggatgaggacagcggtgactcagacacgtcacctaagccaagtccgaaagtggcagcccgaagagaaagttatctcaaagcaacccagcccagcctgacagagctcaccaccttgaaaataagtaatgaacactcccctaaactccagattcgatcccattcctacctgagagcggtcagtgaggtgagcattaatcggtcgctggactccctagatccagcaggtctactgacttcacctaagtttagaagtcggaacgagtcctacatgagggccatgagtactatctctcaggttagtgaaatggaggtaaatgggcagtttgagagtgtgtgtgagtccgtgttctctgagctggaatctcaggctgtggaggccttagatctgcctatgcccggatgttttagaatgagatctcactcctatgtccgcgctatcgagaaaggttgctctcaggacgacgagtgtgtctccctgcggtcctcctctcctcctcggactactacgactgtcaggacaatccaaagttccaccggagtcatcaaactctctagtgccgtggaggtatcctcctgtatcactacatataagaaaaccccccctcctgttcctcctcggactactacaaagcctttcatttcaattactgcacaaagctctaccgaatctgctcaggatgcctatatggacggccaaggacagagaggagacattatttctcagtctgggctgtcaaatagtactgagagtttagactctatgaaagccttgacggctgccatagaggccgctaacgcccagatccacggaccagcttcccaacatatgggtaacaatacagcgacagtgacaacaaccacgacaatcgctacagtcactacagaggatcgcaagaaggaccattttaagaagaatcgctgcctctctatcgggatccaggtcgatgatgccgaggagcctgacaaaaccggcgagaataaggcccctagtaaatttcagagtgttggggtgcaggtggaggaggagaaatgtttccgcaggttcacgagatccaactcagtgacaacagcagtgcaggcagacctcgatttccacgataacctggagaattccctagaatctatcgaggacaactcctgcccaggtccgatggctcggcagttttctcgggatgcctccacctctacggtgtccattcagggctccgggaaccactatcacgcatgtgctgccgacgacgatttcgacacagatttcgatcccagcatcctgccgcctcctgacccgtggattgattccattaccgaggacccactcgaagcagtgcagaggagcgtgtgccacagagacggccactggttcctcaagctcctccaagcagaacgggacagaatggagggctggtgccagcagatggaaagagaggagagagaaaataacttgccagaggacatcctggggaaaattcgaacagcagtgggttccgcacagctgctcatggcacagaaattttaccagtttagggagctgtgcgaggagaatttaaatcccaacgctcatccccgtccaacttcccaagatctggctggcttctgggatatgctgcaattaagcattgagaatatcagcatgaaattcgacgaactgcaccagctgaaagccaataattggaagcaaatggatcccctggacaaaaaggaaagacgcgcaccacctcctgtgccaaaaaagcctgccaagggaccagctccattgatccgggagagatcattagaaagctcgcaaagacaagaggcaaggaaacgcctcatggccgctaaacgcgcagcatctgttcgccagaactcggcaacagaaagtgccgaatctattgaaatctatatccctgaggcccagacacgtctctag

SEQ ID NO: 49865 - DNA, 2052 bp, Artificial Sequence
  Description of Artificial Sequence: Synthetic coding sequence
atgatagatctgttcaaggccgaatgggtaagctcggtctgcgtccaggtgtcccgtaatggcagaacagaccaggtgccgcaagatgagtggaccgggtacacacccagaggtaaggatgacgaaatcccttgcaggcgtatgagatccggatcctacattaaagctatgggtgacgaggactctggtgatagcgacactagcccaaagccctcccccaaagtggccgcacggcgtgaaagctatctgaaagctacccagcctagccttacagagcttaccacactgaaaatttctaacgagcactcccctaagctacaaattcgctctcacagctatctgagagccgtgagcgaggtgagcattaaccgctcactggatagccttgaccccgcagggctgctgactagccctaaattccgcagcagaaacgaatcctatatgcgcgctatgtctactataagtcaagtttctgaaatggaggtgaatggccagtttgagagtgtgtgcgagtctgtgttttccgagcttgagagccaggccgtcgaggcccttgacctgccgatgcctggatgttttcgcatgcgctcccactcctacgtacgggcaatcgagaagggctgttcccaggacgatgaatgtgtatccctgaggagttcatcccccccacgaaccaccactacagtgagaacaatccagagttcaacagtctcttcttgtattaccacatacaaaaagactcccccacccgttccgcctcgtaccacaacgaaaccttttatatcaatcaccgcacagagttccaccgaaagtgcgcaggatgcctacatggacggacagggccagaggggcgacataatcagccagagcgggctctcaaacagcactgagtctctggactctatgaaagccttaactgccgctatcgaagctgctaatgcccagatccatggacccgcatctcaacatatgggtaataacactgcaaccgtaaccaccactaccactattgcgacagtaaccacagaagatagaaagaaggaccacttcaaaaaaaaccgatgcctgtctatcggcattcaggtggatgacgcagaggagccagataagaccggtgagaacaaagccccaagcaagttccaaagcgtaggcgttcaagtcgaagaagagaagtgttttagacggtttactaggagcaattcggttactactgccgtccaggcagatctggattttcacgataaccttgaaaacagcttagagtccattgaggataacagttgcccaggtcccatggctaggcagttctcgcgagacgctagtacctccactgtgtccatccaggggtctggaaaccattatcacgcctgcgccgcagatgatgacttcgacacagatttcgatccttccatcctcccccctcccgacccatggatcgattccataaccgaagaccccttagaggccgttcaacgatcagtctgccatcgggatggccattggtttctgaagcttctgcaggcagagcgggacaggatggaggggtggtgtcagcagatggaacgggaagagcgcgagaataacctgcctgaagacattttgggcaagatccgaactgccgtcggctctgcacagttactcatggcacagaaattctatcagttccgtgagctgtgcgaggagaatctcaatcccaatgcccaccccagacccaccagtcaggacttggccggattctgggacatgctccagttatccattgaaaatatttctatgaagttcgacgagctccatcagcttaaggccaacaattggaagcaaatggaccctctagacaaaaaggaacgtagggcaccccctcctgttcccaagaagccagctaagggacctgcccctctcatcagggagaggagcctcgagtcctcacagcgacaggaggcacgcaaaagactgatggccgctaagcgagctgccagtgtgcgccagaattcagccacagagagcgccgaatctatcgaaatttatattccagaggcacagaccaggctgtag

SEQ ID NO: 49866 - DNA, 2790 bp, Artificial Sequence
  Description of Artificial Sequence: Synthetic coding sequence
atgaaaggattgagtggctcaagatctcatcaccacggcgtcacttgtgattccgcgtgcgacagcctgtcccaccactccgaccgcaaaccatacctgctgtcccctgtagaacatcaccccgcagatcacccttattacacccagagaaacagcttccaggccgaatgcgtcggcccattcagtgatcctctggccagctcaacttttccccgtcgccactatacttctcagcaagagctgaaagacgaatgcgccctggtgccacgaacactcgcgactaaggcgaatagaatccccgcaaacttgttggaccagttcgagagacaactgcccctgtcccgggatggttaccacacgctccagtataaaaggaccgcagtggagcatcggtccgattctcccggtagaattaggcatctcgtgcatagcgtgcaaaagctgtttaccaaatctcactcgttggagggccctagtaagggaagtgtcaacggtggcaaggcatctcctgacgaagcacaggcagccaggtacggcaagcggagcaagtcaaaagagcgccgagccgaaccaaaggcacggcctagcaccagtccgggatggtggagctccgatgacaatctcgatggcgatatgtgcatctatcacgctccgagcggcgtgatgacaatgggaaggtgccctgatcgctccgcttctcagtatttcctcgaggcctataacaccatcagtgaacaggccgtgaaagcctctcgatcgaacaacgatgtgaaatgttcgacttgcgccaacctgccagtgagccttgatacaccactgcttaagaagtctgcctggtctagtaccttgacagtctcaagggctcgcgaggtttaccagaaggccagcgtgaacatggatcaggccatggtcaaatcggaatcatgtcagcaagaaaggagttgccaatatctgcaggtgcctcaagacgagtggaccggatacacacctagaggcaaggacgacgagataccttgccgccgaatgcggtcgggctcatatattaaagcaatgggggatgaggattcaggcgactcggacacgtcgcctaagccttcccccaaagtagccgctcgccgagagagctacctgaaagcaacccagccatccctgaccgaattgacaacactcaagatcagcaatgaacactctccgaagctgcagatccgcagccattcctatttacgtgccgtgagcgaggtttctattaacaggtccctagactctctggatcctgcgggacttctgaccagccccaaatttcgctctaggaacgagagctatatgagagccatgtccacaatatcgcaggtctctgagatggaagtcaatggacaattcgagtctgtgtgtgagagcgtctttagcgaacttgagtctcaggccgttgaagctctggacctcccaatgccaggctgctttagaatgaggtcccattcttacgtgagagccatagagaaagggtgttcacaagacgacgaatgtgtgagtttaaggtcctcttccccccctaggacaacaaccaccgtgagaactatccagtcctcaaccgtcagtagctgcatcactacttataaaaaaactcctcctcccgtgcctccccgaactaccaccaagcctttcatctcaattaccgcgcaaagttccacagaatcggcacaggatgcatacatggatgggcaaggccagaggggggatataatctctcagtcaggactgagcaattccactgagtcactcgacagtatgaaagccctgactgccgcaatagaggccgctaacgcacaaatccatggacccgcttcacagcacatgggaaataacaccgcaacggtgaccactaccactaccatagcaactgtgaccaccgaagatcggaagaaagatcatttcaaaaagaataggtgcctgtccatcgggatacaggttgacgacgcagaggagccggataagaccggcgaaaataaggcaccatcgaaatttcagagcgttggggtgcaagtggaggaggagaagtgttttaggcggttcactcgaagtaacagcgtgactaccgctgtccaagcagacctggacttccatgataatctggagaattccctcgaaagtatagaagacaatagctgtccaggccctatggcacggcagttttctcgggacgccagcacaagcaccgtctccattcagggatctgggaaccactatcacgcttgcgccgcagacgacgatttcgatacagactttgacccctccatcctgcctccccctgacccttggatagactccataacagaagatcccttagaggcggtacagagatcagtgtgccaccgggacgggcactggttcctcaaacttcttcaagctgaacgggaccgaatggagggatggtgtcagcagatggagcgtgaggagcgggagaataatttaccagaggacatattggggaagatccgcactgcagtgggatccgcccagttgcttatggcccaaaaattttaccaattccgagagttgtgcgaggaaaacctgaatcccaatgcacaccccaggcctacgagtcaggatctcgccggattttgggatatgctgcagctgagcattgaaaatatttcgatgaagttcgatgaactgcatcagctgaaggccaacaactggaaacagatggaccctcttgataaaaaagttgagcagtgcagattctgtatggtacacctgaagacctgtactaataccggacagtcaaagtag

SEQ ID NO: 49867 - DNA, 2934 bp, Artificial Sequence
  Description of Artificial Sequence: Synthetic coding sequence
atgaagggactgtctggcagccgaagccaccaccacggggtcacctgcgatagtgcttgcgattccctgtcccaccactccgatcggaagccctacctgttatcaccagtggagcatcaccccgctgaccacccgtactacacccagcgcaacagctttcaggccgaatgcgtgggtcctttttcggatcctctagccagtagcacgtttccaaggagacactatactagtcagcaggagctgaaggatgagtgtgctctcgttccacgtacactcgccaccaaggcaaaccggatccctgcaaacttgctggatcagttcgagcggcagcttcccctttctcgcgatggctaccacacactgcagtacaagaggacggccgtggaacaccggagtgactccccgggtagaatccggcaccttgtgcattctgtgcagaagttatttacaaaatctcattctctggaggggccaagcaaaggatcagttaatggcggaaaagctagccccgacgaggctcaggccgctcgctacgggaaacggtccaaatctaaagaacgtagagccgagcctaaagcgagaccaagtaccagcccaggttggtggagttcggatgataatctggacggtgatatgtgcatctaccacgcgccttctggtgtaatgacaatggggaggtgccctgaccggagcgcgagccagtacttcttagaggcctataacactatttccgagcaggctgtcaaagccagtcggtccaataatgacgtgaagtgcagcacctgtgcaaatctccccgttagcctggacacccctctgctcaagaaatccgcgtggagtagcacccttaccgtgtcccgcgctagggaagtttaccaaaaagcgtctgtgaatatggatcaggcaatggttaaaagcgaaagctgtcagcaggagcgttcctgccaatacttgcaggttccccaggatgagtggacaggctatactccgcgtggaaaggatgacgagattccgtgtagaagaatgcgctcaggatcatatattaaggccatgggagatgaagatagcggcgactccgacacctctcccaagcctagcccaaaagtggctgcgagaagggaatcgtacctcaaggctacacagccttctctgacagagctcactaccctgaagattagcaacgaacatagccccaaactgcagattaggagccacagctaccttagggctgtgtcagaagtgagcataaaccgctcattggactctctggacccagctgggcttctcacgagtcccaagttccgcagccggaatgaaagttacatgcgtgccatgagtacaattagccaggtgtcagagatggaggtgaacggccaattcgaatctgtgtgtgaaagcgtgttctctgagctggagtcccaagcggttgaggctctggatctgcctatgccaggctgtttccgaatgaggtcccactcctacgtaagagcaatcgagaagggatgctcacaggatgatgagtgcgtgtcccttagatcctctagcccaccacgcaccacaacaactgtgaggacaatacagtctagcactgtgtcgtcctgcattacgacatacaagaagactcctccgcctgtgcccccacgcacgacaacaaaaccctttatttccatcacagcccagtcgtcaacagaaagcgcccaggatgcatacatggatggccaggggcagaggggcgacatcatttcacaatctggactcagcaactctactgaaagtttggattccatgaaggccctgacggcagccatcgaagccgcaaatgctcagattcatgggccagcaagtcagcacatgggcaacaataccgctactgtgacgaccacaacaactatagctacagttactacggaggaccgtaagaaagaccattttaaaaaaaataggtgtctcagtattgggattcaagttgacgacgctgaagagcccgacaaaactggagagaacaaggccccatcaaagttccagagcgtgggagtgcaggtggaagaggagaagtgttttcggagattcacacgcagtaattctgttactaccgccgtgcaggcagacctcgattttcatgacaacctggagaatagccttgagtccatagaagacaacagctgccccggacctatggcaagacagttttcacgagacgccagcacatctaccgtgagtattcaggggagtggcaaccattaccatgcttgcgcagctgatgacgattttgacactgattttgatccgtcaattctgccgccaccagacccttggattgacagtattacagaggacccgttggaggccgtccagcgcagcgtatgccatcgcgatggccactggtttctcaagctcctgcaggctgaacgggatcggatggaaggctggtgccagcagatggaacgtgaagagcgagagaacaacctgcctgaggatatcttggggaaaattcgcaccgccgtcgggtcagcccaacttttgatggcccagaaattctaccagttccgcgagctgtgcgaagaaaacctgaatcccaatgctcacccccgaccgacatctcaggacttagctggcttctgggacatgcttcagttatcaatagagaatatcagtatgaagttcgacgagctgcatcagctcaaggctaataattggaagcagatggatcctctggataagaaagagcgcagagctcccccacccgtgcctaagaaacccgcaaaaggcccagcaccacttatccgggagagaagtctggaaagttctcagcgccaggaagcccgaaagagactgatggctgcgaagcgcgctgcctccgtgcgccaaaactccgctacagagtcggccgagagtatcgagatctatatccctgaggcacagacccggctctag

SEQ ID NO: 49868 - DNA, 2028 bp, Artificial Sequence
  Description of Artificial Sequence: Synthetic coding sequence
atgaaccttatatttcataaagatattttgttcgggattccagccaacaaagtacctcaggacgaatggactgggtatactccacgtggcaaagatgacgagatcccatgccgcaggatgcgatctggatcctacataaaagctatgggcgacgaagacagtggagattccgacacatcgcctaaacctagccctaaggtggccgctcggagggaatcgtacctgaaggctacacagccgtccttgacagagctcacaacactgaaaattagtaatgagcactctcccaagctgcagatccggtcgcattcatacctgcgggcagtgtccgaagtttcgattaatcgaagcctggatagcttagatccagccggactgctcacctcccccaagtttagatcccggaacgagagctacatgcgggcaatgagcacgatctcccaggtgtccgagatggaagttaacgggcagttcgagtctgtgtgtgagagcgtgttttccgagttggagtctcaagcggtcgaggcgctggacctgcccatgcctggttgcttccggatgcgaagccattcctatgtgcgtgccatagaaaaagggtgctcacaggatgatgagtgtgttagcctgagatcatcctcaccaccaagaaccaccactaccgtgcgtactattcaatcttctactgtgagttcttgcatcaccacctacaaaaagacacctccacccgtgccacccaggacaaccactaaaccatttatatcgataactgcacagtcatctacagaaagcgcccaggacgcgtatatggatggccaggggcaacggggagacatcatttcccaaagtggattgagtaacagtactgaatccctagattccatgaaggctctgaccgctgctatcgaagccgctaatgcgcagatccacggccctgctagtcagcacatgggaaataatactgctacagtgaccacaacaactactattgctacagtgaccaccgaggaccgaaaaaaagaccattttaagaagaaccgctgcctgtctatagggatccaagtggatgatgctgaagaaccagataaaacgggggagaacaaggctccttctaagtttcagtcggtcggagtgcaagtagaggaagaaaagtgcttccgcaggtttaccagatccaactccgtgaccacagccgtgcaggcagatctcgactttcacgataatctcgagaatagtttggagagtattgaggataattcatgtcccggtcctatggcaagacagttctctcgcgacgcctctaccagcacagtgtccatccaaggtagcgggaatcactaccacgcatgtgctgcagatgatgacttcgacacagactttgacccgtcaattctgcctcctccggacccatggattgatagtatcacagaggatcctcttgaagccgtacaacgctctgtctgccaccgggacggccactggtttctcaagctgctgcaagcagaacgtgaccgcatggagggatggtgtcaacagatggaaagagaggagagagagaacaacttgccggaggacattttgggaaaaatcagaaccgcggtggggtcagcccagcttctgatggcccagaagttttatcaatttagagaactgtgcgaagaaaatctaaatcctaacgctcaccctcggcctaccagtcaagacctggctggcttttgggatatgttgcagctcagcattgagaatatctcaatgaaatttgacgagctgcaccaattaaaggctaacaattggaagcagatggatccccttgacaagaaggagaggagagcacctcctcccgtgcctaagaaacccgctaaaggaccagcccctttgatccgtgagaggtccttagagtcttctcagaggcaggaagcgaggaaaaggctcatggccgctaaacgggctgcctccgtccggcagaattctgctacagaaagtgccgagtccattgagatctacattccagaggcccagacacgcctgtag

SEQ ID NO: 49869 - DNA, 2790 bp, Artificial Sequence
  Description of Artificial Sequence: Synthetic coding sequence
atgaagggcctgtcagggtcacgaagccatcaccacggggtgacttgtgatagcgcgtgcgattccctcagtcatcattcggacaggaagccttatcttctcagtccagttgagcaccaccctgccgaccatccttactacacccagcgcaactctttccaggcagaatgcgttgggccatttagtgatcctctggccagtagtacgttccccagaagacactacacaagtcagcaggagctgaaagacgagtgcgcgctggtgcccagaacactggccaccaaggcgaatcgaattcccgcaaatctgcttgatcagtttgagcgacagctcccgttatcccgggatgggtaccatacccttcaatataagaggactgcagtcgaacacaggtccgactcccctggtcggataagacacctggtccactcagtgcagaaacttttcacgaagtctcattctttggagggaccgtcaaaggggtcagtgaatggcggaaaggcctcccccgatgaagctcaggcagcccgatatggaaagaggtcgaaatcaaaagagcgcagagctgagcccaaggctagacctagtacctctccaggctggtggtcgtcagacgataatctcgacggagacatgtgcatctatcacgcaccctcaggtgtcatgaccatggggcgatgcccagaccggtctgccagccagtattttctggaggcttacaacacaattagtgaacaggcggtcaaagcttcacggtctaacaacgacgtaaaatgtagtacgtgtgcaaacctgcccgtgagcctggatacacctctcttaaaaaagagcgcttggtcatccactttgaccgtgtcccgcgcacgcgaagtgtaccagaaagcttcagtgaatatggatcaggctatggtcaaatctgaatcgtgtcagcaggaaaggtcctgccagtacttacaggtgcctcaagacgagtggacagggtacactcccagaggcaaggatgacgagattccttgcagacgaatgaggagcggcagctatatcaaggcaatgggtgacgaagactccggcgacagcgacacatcacccaagcctagtcccaaagtagccgctcgcagagagagctacctcaaggccacgcagccgtccctgactgagctgaccacgttgaaaatcagcaatgaacacagccctaagctgcaaatcaggagccacagttatcttcgagccgtgagtgaagtgagtatcaacagatctctggattcccttgatccagcaggtctgcttacttctcctaaatttagaagtcggaatgagtcgtatatgcgagccatgtctactatttcccaggtgtccgaaatggaagtcaatgggcagttcgaaagtgtatgcgagagcgtattcagtgagttggagtctcaggccgtggaagcattggatctacctatgccaggctgctttaggatgcggagccactcctacgtcagagcgattgaaaaaggatgctcacaggatgatgaatgtgtgtcactccgctcatcttcgccaccgaggaccactaccaccgtacgcactatccaatccagtactgtgagttcctgtatcacaacctacaagaaaaccccaccacccgtgcccccacgcaccacgactaaaccgtttatatctattaccgctcagtcgagtacagaatcagcacaagacgcgtacatggatgggcaagggcagagaggagatatcatctcacagtctgggctgagcaattcaacggagtctcttgacagcatgaaagctttgacagctgctatcgaggccgctaatgcccagatccacgggcctgcgtcccagcacatgggtaacaacacagcaaccgttaccaccaccaccacaattgcaacagtcacaaccgaggatagaaaaaaggatcacttcaaaaaaaacagatgcctgagtatcggtatacaggtcgacgacgctgaagagccagacaagacaggggaaaacaaggctccaagtaagtttcagagtgtgggggtacaggttgaggaggagaaatgctttcgcagattcacaagatctaactcggtaactacggctgtgcaggcagatctggatttccacgacaacctcgaaaattccctggaaagcatcgaagataactcatgcccagggccaatggccaggcagttttcacgggatgcatctacatccactgtcagcatacagggaagtggtaaccactatcacgcctgtgctgccgacgacgatttcgatacagactttgatccctctatcctgcctccaccagatccttggatcgactcaatcacagaagacccactcgaggcggtgcagagatccgtgtgccaccgtgacggtcattggtttttgaaactcctgcaagccgaacgcgacagaatggagggatggtgtcagcagatggagcgggaggaaagagagaacaatctgcctgaagacatccttggcaaaatccgtacagcagtgggttccgcacagctgctgatggcccagaaattttaccagttccgggagttgtgtgaagagaatttgaaccccaatgcccatcccagaccaacatcgcaagacctagccggtttttgggacatgctccagctcagcattgagaacatctctatgaaattcgacgagttacaccagctgaaggcaaacaattggaagcagatggatcccctggacaaaaaagtggaacaatgtcggttctgcatggtgcatctgaagacatgcactaacacggggcagtccaaatag

SEQ ID NO: 49870 - DNA, 1986 bp, Artificial Sequence
  Description of Artificial Sequence: Synthetic coding sequence
atggaccttaaaacactgaaactgttcaattcacagctgcgctgcggttggcttttgtacatttggaacaaggccttcatggctcacctgcgcgtcccccaggatgagtggactggttatacgccaagggggaaagatgatgagattccttgtaggcggatgcgcagcggttcatacattaaagcaatgggggatgaagacagtggcgacagcgacactagtcctaagccctcccccaaagtggccgctcgcagggagagctatctgaaggctacacagcctagtctaaccgagttaactacactgaagattagtaacgagcactctcccaagctgcagatccggagccattcctacctgagggcagtgtctgaggtgtcaattaatagaagcctagatagcctggatcctgccggattgctgacatcccccaagttccgcagtcggaacgagagctatatgcgcgctatgtccacgatctcacaggtgtccgagatggaagtgaatggccagtttgagtccgtgtgcgagtccgtgttttcagaattagagagtcaggcagtggaggctctggacctgccaatgcctgggtgctttcgtatgaggagccactcatatgtgagagcgatcgagaaggggtgctcacaggacgatgagtgcgtaagtctgcgatcttcctcaccccctaggaccaccactaccgttaggacaatacagtcatcaaccgcacagtcaagcaccgaatccgcccaggacgcttacatggacgggcagggccaacgaggcgatataattagccagtctgggctgtctaacagtacagagagccttgattctatgaaagccctgacagccgctatcgaagcagctaatgcacagatccacggtcctgcatcgcagcacatgggtaataatacagctaccgtgacaaccactactacaattgccacagtgactaccgaagaccgcaaaaaagatcatttcaaaaagaaccgttgcctgtccattggtattcaggtagacgacgccgaggagccagataaaaccggtgagaataaggctccatctaagttccagagcgtcggggtgcaagtggaggaggagaagtgttttcgtcggtttacaagatccaacagcgtgacaaccgctgtccaggcggatctggattttcacgataaccttgagaactccctggaaagtatcgaagataatagctgtcccggaccgatggcacgacagttttcccgcgatgcgtctacctcgaccgtctctatccagggttcaggaaaccactaccatgcctgcgctgccgacgacgacttcgataccgatttcgatccttcaatactgcctcctccagacccatggatagactcaatcacagaagatcccctggaggctgttcagcgctctgtttgccacagagacggccactggttcctgaaactgttgcaggctgaaagagaccgaatggaagggtggtgccagcagatggagcgagaggaacgagagaacaatttacccgaagacattctggggaaaatcagaactgctgtggggtccgcccagctgctgatggcacagaagttttaccagttcagggaactgtgcgaagaaaacctcaaccctaatgcccaccccagaccaactagccaggatctggcaggattctgggacatgttgcagctgtccattgagaacattagcatgaagtttgacgaactgcaccagttgaaggccaataattggaaacagatggatcccctcgacaaaaaagaacgcagggccccacctcctgtgcccaagaagccggctaagggaccggctccactgatcagagaacgttccttggaatcctcccagagacaggaggccagaaagcgtttgatggcagcaaaacgcgctgcctctgtgcggcaaaacagtgccacagaaagcgcagagtctatagaaatttatattccagaagcccagaccagactctag

SEQ ID NO: 49871 - DNA, 2058 bp, Artificial Sequence
  Description of Artificial Sequence: Synthetic coding sequence
atgaatcttatctttcataaggacatcttgttcgggatacctgctaataaggtcccacaggacgagtggactggatacacacctagaggcaaagacgatgagattccttgtcgacgaatgaggtccggatcttacattaaggctatgggcgatgaggactcgggtgactccgacaccagtcccaaaccgtctccaaaagtcgctgccagaagagaatcctatttgaaagcgacacagccttctctgactgaactgacaacactcaaaataagcaacgagcactctccaaaactccagattcgctcacactcatacctcagggctgtgagtgaagtgagtatcaataggtctctggactccctggaccctgctggccttttaaccagcccaaagtttcgcagccgtaacgaaagctatatgcgcgcaatgtccacaatcagccaggtgagcgaaatggaggtgaatggccagtttgaatccgtgtgtgagtccgtgtttagtgaacttgaaagccaggccgttgaagccttagacctgcccatgcccggatgcttcagaatgcgtagccactcctatgtaagagcaatcgaaaaaggttgttcacaggacgatgagtgtgtgtctttacggtccagcagcccacccagaaccacaaccaccgtgcgcaccattcagagctcaacgggcgtcattaagctctccagcgccgtcgaggtctctagctgtataacaacctataaaaaaacacccccacccgtgcctccacgtaccacgaccaaaccgtttatcagtatcacagcccagtcctctactgagagtgcccaggatgcctatatggatgggcaaggtcagaggggtgacatcattagtcagagcggcctgagcaattctacagaaagcctcgattcgatgaaggccttgactgctgcaatagaagcggcaaatgcccaaatccacggacccgctagccaacacatggggaacaacaccgccactgttaccaccaccaccacaatcgccactgtgacaacagaggacagaaaaaaagaccatttcaaaaagaatagatgcctaagcatcggcatccaggtggacgacgctgaggagccggacaaaactggagaaaacaaggcaccaagtaaatttcagtctgtgggcgtgcaagtcgaggaagagaaatgttttcgcagatttacacgaagcaacagcgtgactacagcggttcaggctgacctagacttccatgataatcttgagaacagtctcgagagcatcgaggacaactcctgtcccggacctatggccagacagttctcacgcgacgcgtcaacctctacagtgagcatccagggctctggcaaccattaccacgcgtgcgcagctgacgatgacttcgacactgatttcgacccatctatcctccctcccccagatccttggatcgatagtatcacagaagaccctcttgaagcagtccagcgctccgtgtgccaccgggacgggcattggttcctgaaactgctccaggctgaacgtgatagaatggagggttggtgccaacagatggagagagaggagagagaaaacaatctgcccgaagacattctcggaaagatccgcacagcagtagggagtgcacagctcctgatggctcaaaaattctaccaattccgagagctctgcgaggaaaacctaaatcccaatgcacacccacggcctaccagtcaagatctggcaggattttgggatatgttgcagctgtcaatcgagaacatcagcatgaagttcgatgaactccatcaactcaaagccaataattggaagcagatggaccccttggataaaaaggaacggagggcccctccccctgtccctaaaaagccagctaaaggcccagcgcctcttatccgtgagcggagccttgagagcagccaacggcaagaggcacggaagcgactgatggccgctaagcgggcagcatctgtgcgccagaactctgctacggaatctgcggagtccattgaaatctatattccagaagcacagaccaggctgtag

SEQ ID NO: 49872 - DNA, 2196 bp, Artificial Sequence
  Description of Artificial Sequence: Synthetic coding sequence
atgggtagtgaaaaggactcggagtcccctcggtctacctctctccatgccgctgctcctgaccccaagtgtcgaagcggaggtcgcagacgacgactgactctgcatagcgttttctctgcttccgccaggggcaggcgagcgcgtgcaaaaccgcaggcggaaccaccacctcctgccgctcagcccccaccagcacccgctcctgctgccgctcagggtccaccgccagaagctctccccgctgaacccgctgccgaggcagaagccgaagcagcagcggctgccgctgagccagggttcgatgacgaggaggcggctgagggcggtgggccaggcgcagaagaagttgagtgtcccctctgtctagtacgtctgccgcctgagcgcgcacccaggctgctttcttgcccccatcgatcatgcagagattgcctgaggcactacctgaggctcgagatcagcgagagcagagtgcctattagctgtccagagtgcagcgagcgcctgaacccacacgatatccggctcctgctggccgaccctccactgatgcacaagtacgaggagtttatgctgagacggtatctggcctctgacccggattgcagatggtgccctgcgcctgactgcggatacgcggtaatagcctacggttgcgcttcatgtccgaaactgacctgtgaacgcgaagggtgtcagacagagttctgctaccactgcaagcaaatctggcaccccaatcagacctgtgacatggcgagacagcagagggcccagactcttcgcgttcggacaaaacacaccagtggtctgtcttatgggcaggagagcggacccgatgatatcaagccgtgcccaagatgctctgcatatatcattaagatgaacgacggaagttgtaaccacatgacctgcgctgtatgtggatgcgagttctgctggctgtgtatgaaggaaatctccgatctccactatctgtctccctccggttgcacattttggggcaagaagccttggtccagaaagaagaagattctgtggcaactcggcactctaattggcgctcccgtgggtattagcttgatcgctggcatagcgattccggctatggtgatagggattccagtatatgtgggcaggaagattcactcacgctatgagggcagaaagacgtccaagcacaaaaggaacctggcaatcaccggcggagtaacactcagcgtaattgcctcgccagtaattgccgctgtcagtgtcgggattggggtgccaatcatgctggcctacgtatatggagtggttccaatatcactgtgcagagggggaggctgtggcgtgtcgacggctaacggtaaaggtgtgaagatcgagttcgatgaggacgacggtccaatcaccgtagccgacgcgtggcgcgctttgaagaacccctctataggagagtcttctattgagggtctaacaagcgttctgagcacatctggaagtccaaccgatggactgtccgtcatgcagggtccttacagtgaaacggcgagctttgccgctctctctggaggtacattgagtggcggtatattgtcttctgggaaggggaagtacagccggctggaagttcaagccgatgtgcagaaggagatattcccaaaggatacagcaagcctcggagcaatatctgacaacgcctcaacaagagccatggccggatctataatttctagctacaatccacaggatcgagaatgcaacaacatggaaatacaggtagacatcgaggcgaaaccttctcactatcagctggtctcaggctcttccaccgaagatagcctgcatgtgcacgcgcagatggcagaaaatgaagaggagggatctgggggaggcggaagcgaagaagatcccccttgcaggcatcagtcctgcgagcagaaagactgcctggcatcgaaaccctgggatatttccttggcccaaccagaaagcatcaggagcgatctcgagtccagcgatgcccagtcggacgacgtgccagacatcacttccgacgagtgcgggagtccacgttcacacaccgctgcatgtcccagcacccccagggctcaaggcgctccttccccctccgcgcacatgaacttatccgccttagccgaaggccagaccgtcctaaagcccgagggcggagaagcaagagtgtag

SEQ ID NO: 49873 - DNA, 2940 bp, Artificial Sequence
  Description of Artificial Sequence: Synthetic coding sequence
atgcgtggctaccacggagatcgcggttcccaccccagacctgccagatttgccgaccagcagcacatggacgttggacccgctgccagagccccttatctgctgggtagccgggaagcttttagcactgaaccccgattctgcgcacctcgcgcaggcttggggcatatatcccccgaaggacccctcagtttgagcgaaggaccctccgtgggcccagagggaggccctgccggagccggagtgggaggtggctctagcacctttccgcgaatgtaccccggtcagggaccttttgacacttgtgaggactgcgtcggacacccccaggggaagggtgcccctcgactaccaccgactctgctagaccagttcgagaagcagctccccgtacagcaggacggtttccacacactgccatatcagagagggcctgccggagctggtcccggtcccgctcctggcacgggaacagcacctgagcctcggagtgagagcccatcccgcatacgacacctggtacatagtgtccagaagctcttcgccaagtcccatagtctggaggcaccaggcaagcgtgactacaacgggcctaaagctgagggaagaggtggatccggcggagacagttatccgggacctgggtccggtggcccacatacttctcatcatcatcaccaccaccatcaccatcatcatcatcagagccggcatggaaagaggtctaaaagcaaagaccgcaaaggtgacggcaggcaccaagcaaaaagtaccggttggtggtcctccgatgacaacctggattccgactcaggattcctggcagggggtcggccacccggtgagccgggaggacccttttgcctggaggggccagacggttcataccgtgacctgagtttcaagggcaggagcgggggatcagagggaagatgcctggcttgtacaggcatgtccatgagcctcgacggtcaaagcgtcaaacgcagcgcctggcataccatgatggtgtcccaggggagagacggatacccaggcgctggccctgggaagggcctgctcgggcctgagacaaaggcaaaagcccgaacttaccactatttacaggtgccacaggacgattggggaggctacccaaccggtgggaaggatggtgagatcccctgccggagaatgcgaagcggaagttatataaaagccatgggcgacgaagagtccggtgactcggatggatctccaaagaccagcccaaaagccgtagctcgccgtttcacgactcggcgttccagcagtgtggaccaggccagaatcaactgttgcgtcccaccaagaatccatccaaggagctctatcccgggatactcccggagcctgaccactggacagctatcggacgagctgaaccagcagttagaggcggtgtgcggcagcgtctttggcgagctcgaaagtcaagccgtggacgcactagacctgccgggatgcttccggatgcgctcccatagttatctgagagctatccaggctggctgctctcaggatgacgactgtctgccgctgctggccacacctgccgctgtcagtggtaggccaggatcatcatttaacttccgtaaggcaccaccccctattccccctgggtcacaggcacctccccgaatttccataactgcgcagtcatccacagactcggcccacgagtctttcacagccgctgagggtcctgccaggagatgctctagtgctgacggcctggacgggcctgccatgggggctcgtaccttggagctcgcccctgtccctccacgtgcaagtcccaagccgcctacccttatcatcaaaaccattccgggtcgagaagagttgcggtccctggctagacagcgcaagtggcgaccctcaatcggcgttcaggtcgaaacgattagcgactccgataccgagaacaggtctcgcagggaattccactctatcggcgtgcaggttgaagaagataaaaggagggcaagattcaagagaagtaactcagtgaccgctggggtgcaggcagacctggagttagagggccttgcgggactggcgacagtggctaccgaagataaagctctccagttcggaagatcattccagcgccatgcttcagaaccccagcctggcccaagggcacccacttattctgtgtttcgcactgtgcacactcaaggccagtgggcttaccgcgaggggtaccctcttccttatgaaccccctgccacagacggcagtcccggtcctgcccctgcccctaccccgggaccgggagccggtcgtagggattcctggatcgaacggggttctaggtcccttcccgacagcgggagggccagcccatgcccgagggatggagaatggtttataaaaatgctaagagcagaagtagagaagctggaacactggtgccagcagatggagagagaggcagaggattatgagctccccgaggagatcctcgagaagattagaagcgcggtcggtagcacacagctgttattatcccagaaggtacaacagtttttccggctgtgccaacagagtatggatcccaccgccttccccgtgcctaccttccaggatctggcaggattctgggatcttcttcagctgagtatcgaggacgtgactttaaagttcctggaactgcagcaactcaaggcaaatagctggaaactcctggagcctaaagaagagaaaaaagtgccacctcccatcccaaaaaaacccctgcgtggtaggggcgtccctgtaaaggagagatccttagacagcgtcgatagacagaggcaagaggccagaaaacggttgctagctgccaaacgggcagcctcattcagacactccagtgcaaccgaatcagccgactccatcgaaatctatattcctgaggctcagactcgcctatag

SEQ ID NO: 49874 - DNA, 798 bp, Artificial Sequence
  Description of Artificial Sequence: Synthetic coding sequence
atgtctatgtcactggatggccagagtgttaaaagatctgcctggcacaccatgatggtgagccagggccgtgacggataccctggtgccggacccggaaagggcctcttagggccagagacgaaagccaaggctcgaacctatcactatctgcaggttccacaggatgattgggggggataccccaccgggggaaaggatggagagattccgtgcaggagaatgcggtctggctcctatattaaagcaatgggcgacgaggagtcaggcgactcagacggttctcccaaaacgagccctaaggcagtcgccagacggtttacgacacgtaggtcttcctcagtggaccaggctagaattaattgctgtgtgccccctagaatccatcctcggtctagcatcccaggatattctagatcattgaccactggtcaactgtcagatgagttaaaccagcaaatggagagagaggccgaggattacgagctgccagaggagattcttgagaaaatccgcagtgcagtcggtagtactcagctgctgttatcccaaaaggtgcagcagttttttcgcctatgccagcagagtatggacccaaccgccttcccagtgccaacatttcaagatctcgctggcttttgggatctgctgcagctctctattgaagacgtgaccttaaaatttctcgaactgcagcaattgaaagctaatagctggaagctactggaacctaaggaggaaaaaaaggtgcctccgccaataccaacccgaccacccggtccttcccactcacggtag

SEQ ID NO: 49875 - DNA, 2211 bp, Artificial Sequence
  Description of Artificial Sequence: Synthetic coding sequence
atggctggatcatcaacagggggagggggtgttggcgaaaccaaggtcatctatcacctcgacgaagaagagactccctatctcgtgaagatacctgtgcctgcggagagaataacacttggtgactttaagtccgttctccagagacccgcaggggctaaatatttcttcaaaagtatggatcaggacttcggggtggtgaaagaggagatctccgacgacaatgctagactgccctgctttaatgggcgtgtggtatcctggctagtttccagtgacaaccctcagcccgagatggcacccccagtccatgagccaagggcagaacttgccccaccggctccccctctgccccctttgcctcccgaaagaacgtcaggcatcggtgattccaggccccctagctttcaccccaatgttagctcatcacacgagaatctggaacccgaaaccgagaccgaaagcgtggtgagtcttcggagagaacggcctaggagaagggactcttctgagcacggggctggtggacatcggaccggcggaccgagtcgcctagagcggcatctggccggttacgagagctctagcactctaatgacttccgaactggagtcgacctccctgggggattcagacgaggaggacacaatgagcagattctcgagctcaactgagcagagcagcgctagccgactgctgaaaaggcatcgtaggcgaagaaagcagcggcctccgaggctcgaacgtacctcctccttcagcagcgtcaccgacagtaccatgagcctcaatattatcactgtgacactgaacatggagaaatacaacttcctcggcatttccattgtgggccagagcaacgagcgcggtgacggcggaatttacatcggtagcatcatgaaagggggtgctgtggccgctgacgggagaattgaacctggtgatatgctgttgcaagtgaatgatatgaatttcgagaatatgtctaatgacgacgctgtccgagtgctccgcgacatcgtccacaagccaggaccgatagttctcaccgtcgccaaatgctgggatccatctccacaggcttactttaccctgccaagaaatgagccgattcagccaatcgatcccgctgcgtgggtttcccacagtgcggcattaacaggaacctttcccgcttatcccggtagttcttccatgtctacgatcacctctggatcatccctccctgatgggtgcgaggggagaggtctcagcgtacacactgacatggcctccgttactaaagctatggccgcacccgaatctggcctcgaggtccgagatcgcatgtggctgaagattaccataccgaatgctttccttggtagcgacgtggtggactggctgtaccaccatgtcgagggtttcccggaacgcagggaagctcgaaagtacgcaagtggtctcctcaaggcaggcctcatcagacacactgtgaacaaaatcacttttagtgagcagtgctattacgtcttcggtgatctgagcgggggttgtgaatcctacctggtgaacctctcactgaacgacaacgatggatcatctggcgcttcagaccaggacacactcgcccctctaccaggagccaccccctggcctctattgcccaccttcagctatcagtatcctgcgcctcacccctattccccacagccgcctccataccacgaactgagcagttacacctacgggggaggttcggcttcatctcagcatagcgagggcagtcgcagctctggttcaaccaggagcgatggcggagccggacgcacagggaggccagaagagagggcacccgagtccaaatcaggctctggcagcgagagtgagccatcctcccgcggagggagcttgcgcagggggggagaggcaagcgggacttctgacggaggcccacctccctcacggggatctaccggaggggctcctaatttgagagcacacccaggcctgcacccgtacggccctccccctggcatggcgttgccctataacccaatgatggttgtcatgatgcccccaccccctccaccagtgccacctgccgtgcagccccctggtgcccctcccgtacgcgacctgggcagtgtgccccctgagctgacagcctctcgccagagttttcacatggctatgggcaatccctccgagttcttcgtagacgttatgtag

SEQ ID NO: 49876 - DNA, 4575 bp, Artificial Sequence
  Description of Artificial Sequence: Synthetic coding sequence
atggccatgagtaacggtaacaacgatttcgtggtgctgtcaaactccagtattgccacaagtgctgctaacccatcaccactgaccccatgcgacggcgaccatgcagctcaacagctgactcccaaagaagcgacacgaaccaaggtaagccctaatggttgtctccaactcaacggcacagtgaaatctagttttctgccactggacaatcagcgcatgccacaaatgctcccacagtgttgtcacccttgtccatatcatcacccactaacatcgcattcctcgcaccaagagtgccacccagaggccggtcctgcagcccctagcgctctggcaagttgttgcatgcagccccattccgagtattcagcgagtttgtgccccaaccattctcctgtatatcagaccacatgctgcctgcagcccagcccatcgttttgccttcaccacccatggcctgaccattttcagcaccaaccggtccaacagcatatagctaacatacgacccagccggcctttcaagctccccaaaagttacgccgctctgattgctgactggcccgtcgtggtgctcggtatgtgtaccatgttcatagtggtgtgcgcacttgtaggcgtcttggtacccgaacttcctgatttcagcgatccactactaggattcgagccaagaggaaccgcgatcggccagcgccttgttacttggaacaacatggttaagaataccgggtataaggctactctggccaattatcccttcaagtacgctgacgaacaggcaaaatctcatagagacgatcggtggtccgatgatcattacgagagagaaaaaagggaggtggattggaattttcataaggattctttcttctgcgacgtgccctcagaccgttactcaagggtggtgttcacctccagcggaggagaaaccctgtggaacctgcccgctatcaaatccatgtgcaatgtcgacaactctagaatccgaagccacccacagttcggtgatctctgtcagcggactacagcggcatcctgttgtccttcctggacactcggaaactacatcgcaatactgaacaaccgtagttcttgccaaaaaatcgtggagagggacgtctcacatacccttaagctgttaaggacatgtgcgaagcactatcagaatgggacattaggaccagactgctgggacatggccgctcgccgtaaagaccaacttaagtgtacaaacgtgcccaggaagtgtacaaaatacaacgctgtttatcagattttacattatctcgtggacaaggactttatgacacccaaaacggcagactatgccactcccgcattgaagtactctatgctgttctcccccaccgagaagggggaaagtatgatgaacatttacttggataacttcgagaattggaattccagtgacggcgttacgactataacgggaatagagtttggaataaagcacagtctgtttcaggattatttgctgatggataccgtgtatccagcgatcgccattgtcattgtgctgctcgtaatgtgcgtgtataccaaaagcatgtttattacactgatgaccatgtttgccatcatctcttccctgatcgtgtcctactttctgtatcgcgttgtattccacttcgaattctttcccttcatgaatctaaccgcgctcatcatcttggttggtattggcgctgacgatgctttcgtactttgtgatgtctggaactacacaaagtttgacaaacctcatgccgagaccagcgagacagtgagcattacacttcagcacgccgctctgtccatgttcgttacctcattcaccacagccgctgccttttacgctaactacgtttcaaatatcacagccatcaggtgtttcggagtatacgccggaacagctattctcgttaattacgttctcatggtgacatggctcccggcagtcgtcgtgctccatgagcggtatctcctaaacattttcacctgttttaaaaagccccagcagcagatatatgataacaagagttgttggaccgtcgcctgtcagaaatgccacaaggttctgttcgccataagtgaagcttcacgcatcttcttcgagaaggttctgccatgtattgttatcaagttccggtacctgtggctcttttggtttctcgccttgactgtgggcggagcctatatcgtgtgcataaaccccaaaatgaagctcccatcattagaactgtctgaattccaggtgtttcgctcttcccatcctttcgaacgatacgatgcagagtacaaaaagctgtttatgtttgaaagagtgcatcacggagaggaactgcacatgcccatcaccgtcatctggggagtatctccagaagataatgggaaccccctgaaccctaagtcaaagggaaaactgacgctcgatagctccttcaacatcgcctcacccgcaagtcaggcctggattctccacttttgtcagaagctgagaaaccagaccttcttctatcagacagacgagcaggactttaccagctgcttcattgagactttcaagcaatggatggagaaccaggattgtgatgaaccggcactgtacccctgttgttcacattggtcattcccctataaacaagagatcttcgagttgtgcattaagcgcgctatcatggaactcgagagatccactgggtaccacctggattccaaaacccccggtccccgttttgatattaacgacaccattagggctgtcgtgctcgaattccagtccacctacttatttactcttgcctacgaaaagatgcaccaattttacaaagaggtggactcatggatcagcagcgagctcagctccgcccctgaaggactctcaaacggctggttcgtttctaatctcgaattttacgatctgcaggattctctgtcagatgggactttaattgcgatggggctgagcgtggccgttgcattcagcgtgatgctcctcactacttggaatatcattattagtttgtacgccatcatttctattgccggaacgattttcgtgactgttgggagtttggtcctgctgggatgggaactgaacgtcctggaatctgtcaccatctctgtcgctgtgggactgagcgtagattttgcggtccactacggggtcgcttacagactggcccctgacccagatcgcgagggaaaagtcatcttctcactaagtcgagtggggtcggctatggcgatggctgcactcactacgttcgtcgccggagcgatgatgatgccgtccactgtgttagcttatacacagctaggcactttcatgatgttgattatgtgcatctcttgggcatttgccaccttcttcttccagtgcatgtgtcgatgtctgggacctcaggggacctgtgggcagattccactgcccaaaaaattacagtgctcagctttctcacacgctctgtctacgtctcccagcgataaaggccaatccaaaacccacacgattaacgcctatcacctcgacccaaggggcccaaagtcggagctggaacatgaattctacgagctcgaaccgctggccagccacagctgtaccgcacctgagaagacgacctacgaggagacacacatatgctctgagttcttcaatagccaggccaagaacctaggtatgcccgtgcacgccgcttataattccgaattatcaaagagcacagagagtgatgcagggtctgcccttctacagccaccgcttgaacagcatactgtatgtcacttcttttcccttaatcagaggtgctcatgtcctgacgcctacaagcatttgaactatggccctcacagctgccaacagatgggagattgtctgtgccatcagtgttctccaacgacaagcagctttgttcagatacaaaacggggtcgcgcctttgaaggctactcaccaagcggtggagggatttgtgcaccctattacacatatccatcactgtccctgcctacaagggagggttaagccggcaggaatgcagaactcgttgcccaggaattttttcttacatcctgtccagcacatccaggcgcaggaaaaaatcggcaagactaatgtccactctttgcagaggagcatcgaagagcatcttcccaagatggctgagccatcatcattcgtgtgcaggtccacagggtcacttctgaagacctgttgtgatccagagaacaagcagcgcgagctgtgtaaaaaccgagacgtaagcaatctagaatcttccggcggtaccgaaaataaggcgggaggaaaagttgagttatcactctcccaaacagatgcaagcgtcaacagcgagcacttcaatcagaatgaacctaaggtgctgtttaaccatcttatgggcgaagcagggtgccggagttgtccaaataacagccagtcctgcggcagaattgtacgtgtgaagtgcaactcagtcgattgccaaatgccgaacatggaggccaacgtgcccgcagtgctaactcactcagagttgtccggcgaatctctgctgataaaaactctgtag

SEQ ID NO: 49877 - DNA, 555 bp, Artificial Sequence
  Description of Artificial Sequence: Synthetic coding sequence
atggcaatgagtaatggcaacaacgattttgtggtgctgtccaattcctctatagcaacttccgccgcaaatccatcccctctgacaccttgcgacggcgatcacgccgctcaacagctgacacccaaggaggccacccggaccaaagtgagcccaaatggatgtctgcagttaaatggcactgtcaagagttcatttcttcctttagataaccagcgtatgcctcagatgctgccgcagtgttgccatccatgtccctaccaccatcctcttaccagccactcgtcacatcaggagtgtcaccctgaggcaggtcctgccgcacccagcgccttagcttcctgctgtatgcagccacacagtgaatacagcgcctctttatgtccaaaccactccccagtgtaccagaccacatgctgtctgcagcctagcccgagcttctgcctccaccacccctggcccgaccactttcagcaccaacctgtccagcagcacatcgctaacatccggttcactcggaaaactaagtgcgcatcatggctgttacagatgtag

SEQ ID NO: 49878 - DNA, 4206 bp, Artificial Sequence
  Description of Artificial Sequence: Synthetic coding sequence
atggatggagatagtagtagctctagtgggggaagcggccctgctcccggaccgggtcctgaaggtgaacaaagaccagaaggcgagccgcttgcccctgacggcggttcacccgattccactcagaccaaggccgtaccacctgaggcgtccccagaacgcagctgttccctgcactcctgcccactcgaagatcccagcagttcctccggccctcctcccacaactagtaccttgcagccagtgggtccatccagccccctagctcctgcacatttcacctacccgagggctcttcaggagtatcagggcggatcctcattacccggtctcggcgatagagccgctctctgtagtcacgggtcaagcctctctccctcccccgctcccagtcaacgcgacggtacatggaagcctccagctgtacagcatcatgtggtgtccgtgcggcaggagcgtgcttttcagatgccaaagtcctactcacagctgatcgcagagtggcctgtggctgttctcatgctctgcctggcagtgatctttctgtgcactctcgctggactccttggggctcgattgcccgacttctccaagcctcttctgggatttgagcctagagatactgacataggtagtaagctcgtggtgtggagagcccttcaggccctcactggccctaggaaactattattcctgagcccagatctcgagttgaatagtagcagcagccacaatacattaaggcctgcaccgaggggctccgcccaagagtccgcagtgaggccaagaagaatggtggaaccactggaagaccggcgacaggagaatttcttttgtggaccccctgagaaaagctatgcgaagttggtattcatgtccacatctagcggttccctttggaatctccacgcaatccattcgatgtgcagaatggaacaggaccaaatcaggtctcacacctcatttggagcactctgccagaggactgctgctaaccagtgttgcccttcctggtccctcgggaactaccttgccgttctctcaaacaggtccagttgtctggatacgacccaagccgacgccgctcggacgctcgccctactccgcacatgcgctctttattaccacagcggagccttagtgccctcatgcttaggcccaggccagaacaaaagtcccagatgtgctcaggtcccaacgaaatgttcacagtccagtgcgatctatcaactcttgcattttctactcgatagggactttctgagcccacagaccacagactaccaagtacctagtcttaaatactccttgctgttcctccccacgcccaagggagcatctctcatggatatctatctggacaggctggctactccttggggcctggctgacaactacacaagtgtgacggggatggacctggggctgaagcaggagttgctgagacactttctcgtgcaggacacagtgtatccactcctggcgctggtggctatttttttcgggatggctctctatcttaggagtttatttctgaccctcatggtgctactcggcgtcctgggctccttgctcgtggccttttttctgtaccaagtagcctttagaatggcttattttccattcgtcaacttggcagcactcctgctgctcagttctgtgtgcgccaaccacacgctcatattttttgacttgtggcggttatcgaaatctcaacttccatctggcggattagctcaacgcgtggggaggacgatgcaccactttggatacctccttttggtaagtggcctgacaaccagcgctgccttctacgcctcgtacttgagcaggcttcctgcggttcgttgtttggccctctttatgggcaccgctgtgttggtgcatcttgccctgacactcgtctggctgcctgctagcgctgtgcttcacgagagatatctggccagaggttgtgcacggcgagccagaggccgatgggaaggtagcgctccgagacggctgctgttggcattacaccgccgacttcggggattacgaagagccgcagctggaacctctaggctcctgtttcaaaggctgttaccatgtggcgtaatcaagtttcggtatatctggatatgctggtttgccgctcttgccgctgggggagcatacattgccggtgtgagccccaggttgcgcttaccaacgttgcccccaccaggagggcaggtgttccgccctagccaccctttcgagcgttttgacgcagagtataggcagctctttcttttcgagcagctgccacagggagaggggggacatatgccagttgtgttggtctggggagtgcttcccgtggacacaggcgatccactagaccctcgcagcaattcctctctggtcagggatccagcattctcagcgtccggcccagaggctcaaaggtggttgttagcgctctgccatagggcacggaatcagtcctttttcgatactctccaagagggatggccaacactctgtttcgttgaaactcttcaacggtggatggagagcccctcgtgtgcacgacttggcccagatctgtgttgtggccacagcgattttccatgggcaccacagtttttcctgcattgtctcaagatgatggcactagaacagggtcccgatgggacacaggacctgggtctgcggtttgacgctcacggttctctagcggcactggtcctgcaatttcagacaaactttcggaattcaccagattacaaccaaacgcaactattctacaatgaggtttcccactggctcgcagctgaattaggaatggcccctcccggacttcggcgaggttggttcacatcccgattggaactttattcactgcagcattctttgtcaactgagccagctgtggtgttgggacttgcgctcgccctggcatttgctactctcttacttggcacatggaacgttcccctttccttgttttccgtggcagctgtcgctggtactgtgcttttgaccgtcggactgctcgtgctcctggaatggcagctgaatactgcggaagccctgtttcttagcgcgtcagtaggactctccgtagatttcaccgttaactactgcatttcgtaccatctctgcccccaccctgatcgtctgagcagagtggccttctcactccgtcagacgtcttgcgcaacggccgttggcgctgctgcgttatttgcagccggagtgctcatgctcccggcaactgtactcttgtaccgcaaacttggtatcatattaatgatggtaaagtgtgtgtcgtgtggctttgcgtccttcttttttcagtctttgtgttgtttcttcggtcctgaaaaaaattgcgggcagattttgtggccatgcgctcaccttccttgggacgctggaacaggggacccagggggtgagaaggcaggccgaccacgtcctgggtccgtggggggtatgcctgggagttgcagtgaacagtacgaactgcagccccttgcgaggcgtcgtagccccagtttcgacacgtccaccgccacttccaaactctctcaccggccatccgtgctgtctgaggacttacagctccatgatgggccttgttgtagcaggccccctccagcacccgctagtccaagggaactcctgctcgatcaccaggccgttttttctcagtgcccagccctgcaaaccagctctccatacaagcaagctgggccttccccgaagaccagagcaaggcaggacagtcagggagaagaagccgaacctctgcctgcgagtcccgaagcacccgctcacagtcccaaagctaaagcggcagaccccccagatgggttctgctcatcagccagcacattagaggggctgtccgtgtcagatgagacatgtttgtccacaagtgagccaagcgcgagggtgcccgactctgtaggcgtgagtcccgacgacctggacgacaccggccagccggtgcttgagagagggcaactgaatgggaaacgtgacacactgtggttggctctacgtgagacggtatacgaccccagcctccccgcttctcaccacagcagtttgtcctggaaaggtaggggtggaccaggcgatggctcccccgtggttttgcccaactcacagcccgatttgcccgacgtttggctgcgccgtccttccactcatacaagcgggtactccagctag

SEQ ID NO: 49879 - DNA, 1416 bp, Artificial Sequence
  Description of Artificial Sequence: Synthetic coding sequence
atgggcggaacccaggttaagtgcctgaccagcccctcccccatccattcggccaagtctgagtccattattacacagtctgaggaaaaagccgacttcgtgatcattcctgcggagggcatcgaaaacagaacggaaggaaccgatagccctctgagccgcgattggcgccctgggcctgggacatacctggaaactagctgggaggaacagctgctggagcagcaagagtatctagagaaggaaatggaggaggccaagaagatgatctccggacttcaggctctcctcctgaatggcagcctaccggaggatgagcaggagcggcctttggcactctgtgaacccggagtgaatccagaagaacagttgataattatccagtccagactcgatcaaagtatggaggaaaaccaggacctcaaaaaggaactgctaaagtgtaaacaagaggcgaggaacctgcaggggatcaaagatgccctgcagcaaagattaacgcagcaagacacatccgtgctccagctgaagcaggagctcctgagggccaacatggataaggatgaactccacaatcagaacgttgacctgcaacggaaacttgatgagcggaacagactattgggcgaatacaagaaagagctcggacaaaaggacaggctgttgcaacagcatcaggcgaaactcgaggaagcactgcgaaaactgtccgacgtgagttaccatcaggtcgacctcgagagggaactggagcataaagacgtgctcttggctcactgtatgaagcgtgaagcagacgaggcaaccaattataattcccacaacagccaatctaatggctttcttcttccaacggccggtaagggggcaacatctgtttctaacagggggaccagcgacctgcagctcgtgcgagacgccctccgtagtctgcgaaattccttttccggacatgacccacagcaccacaccatcgatagtctggagcaggggatcagttccctcatggagcggttgcacgtgatggagacacaaaaaaaacaggaaagaaaggtccgtgttaagagccccagaactcaggtgggaagcgagtatagggagtcttggccccctaactccaagctcccacacagtcagagttcaccaacagtgtcgagcacatgcacaaaagtgttgtatttcaccgaccggtcccttacccctttcatggtgaatatccccaagaggctcgaagaggtcacactgaaagactttaaagctgcaatcgaccgtgagggaaaccaccgttaccattttaaagccttggatccagagtttggaacagtcaaggaagaaatttttcacgatgacgatgctatccctggatgggaaggtaaaatcgttgcctgggtggaggaagaccacggtgagaactag

SEQ ID NO: 49880 - DNA, 2049 bp, Artificial Sequence
  Description of Artificial Sequence: Synthetic coding sequence
atgctggcatgcctgacacgcggaaatctattggacgttctccaagaaggcttcaacgagcaacagctccaggcttatgtggcctgggtgaatgcccaactcaagaaacgtcccgctgttaaaccagtccaggatctgaggcaagacttgcgagatggggtgattctcgcctatctcatcgaaatcgtggctggagaaaagctgtcaggagtccagttaagcccaggaaatcagcaagagatgaagaataatgtggagaaggttttgcagtttgtggcctcaaagaagattcgtatgcatcagacttccgctaaggacatcgtggacggcaatctcaagagcatcatgcgcctggtgttagccctcgccgctcacttcaagccaggttctagccggacagttaatcaggggcgtgattccagggctccattgcagagtcacagacctcattgcgctacggccgtggcccagggcgctgcagctgctctcgctgatgtttgccatgatatgtctagatctggccgtgatgtgttcagatatcggcagagaaactccagtatggacgaggaaatcgagaatccatactggtccgtccgcgctctcgtgcaacagtatgaagggcagcagcggagccctagcgaatcctcctgctcctctctgaccagcccctcaccaattcattctgcaaagtcggagtcgatcatcacccagagcgaagaaaaggcggatttcgtgattattcctgctgaaggtatcgaaaacaggacagagggtactgactcccctctgtcccgggactggaggcctggcccaggtacctatctggaaaccagctgggaggaacaacttctcgagcaacaggagtacctcgaaaaagagatggaggaagccaagaaaatgatttctggactccaggcgctacttttgaacggcagccttcccgaagatgagcaggagcggcctctcgccctttgcgagccaggcgtcaacccagaagagcaactcattatcatacagagtcggctggatcagtccatggaagagaatcaggatttgaagaaggagctgcttaagtgtaaacaggaggcgcgaaatttacagggcatcaaggacgcgttacagcaacggttgactcagcaggatacgtctgtgcttcagctgaagcaggaactgctgcgcgctaatatggacaaagacgaactccacaatcaaaatgtcgacctgcagaggaaactggacgagcgcaatcgtctgcttggcgagtacaagaaggagctgggccaaaaggatcggctacttcagcaacaccaggccaaattagaggaagcactgcgcaagctgtcagacgtatcttatcatcaggtggatcttgagcgggagctcgaacacaaggacgtgctcctggcccactgcatgaaaagggaggctgatgaggccacaaactacaatagccacaattcacagtccaatggctttctgcttcccacggctggcaaaggcgcaactagcgtgtccaatcggggaacctccgatctccagttggtgagggacgctctgcggtctttgaggaactcctttagcggccatgacccccagcatcacaccattgactcactcgaacagggaatttcttccctgatggagcgcctgcacgttatggaaactcagaaaaagcaggaacgaaaggtgcgcgtcaagagcccaagaactcaggtgggctccgagtatcgagagtcatggcccccaaattctaaattgcctcactcgcaaagtagcccaacagtttcatccacctgtacaaaggtgttatatttcactgacaggtctctgactccattcatggttaatattcccaagaggctggaagaggttaccctgaaggactttaaagcagctatcgatcgggaggggaaccataggtaccattttaaagctcttgaccccgaattcggcacagtcaaggaggaaattttccacgacgacgatgccatccccggatgggaaggaaaaatagttgcttgggtggaggaagaccacggagaaaattag

SEQ ID NO: 49881 - DNA, 660 bp, Artificial Sequence
  Description of Artificial Sequence: Synthetic coding sequence
atgctcgcctgcctcacccgaggcaatctgcttgatgtgttacaggaaggattcaacgagcaacagcttcaagcctacgtggcctgggtaaacgcacaactcaaaaagaggccggcagtcaaacctgtgcaggatctgagacaagatttacgggacggcgtaatcctggcttatctcatcgagatcgtcgcgggagagaaactctcaggtgtgcagctgtctcccggaaaccagcaggagatgaaaaacaacgtggagaaggtgctgcagttcgttgcttcgaagaaaattcggatgcatcagacgagcgccaaagacatagtggatggcaatctgaagtctataatgcgcttagttctggccctagcggctcattttaaaccaggctcttcccgcaccgtcaatcagggcagggactcccgagccccactgcagagccaccgacctcactgcgcaactgccgtggcgcaaggggctgctgcagcactggccgacgtttgtcacgatatgtcacgctcgggacgtgacgtttttcgttaccggcaaaggaattcaagcatggatgaggagatagaaaatccatattggtccgtccgggcattggtacagcaatacgagggccagcagaggagtcccagcgagtcttcctgcagtcgctag

SEQ ID NO: 49882 - DNA, 1140 bp, Artificial Sequence
  Description of Artificial Sequence: Synthetic coding sequence
atggagggcaaccgggacgaggccgaaaagtgcgtagagattgcccgtgaagccctgaacgcaggaaatcgggagaaggctcagcgcttcttgcagaaggctgagaaattgtaccctctacccagcgcccgagcactgctggagatcattatgaaaaatggcagcacagctggtaactccccccactgtcggaagccttcagggtcaggtgaccagagcaagcccaactgtacaaaggacagtacatcgggatctggcgaggggggtaagggttataccaaagaccaagttgacggggttctatccattaacaaatgcaagaactactatgaggtacttggagtaaccaaggatgctggcgacgaagacctcaagaaggcttacaggaagttggccctgaaatttcatcccgacaaaaatcacgcccctggggcaaccgatgccttcaaaaagatagggaatgcatacgctgtattgtcaaaccctgaaaagcggaaacagtatgacctgactggaaatgaagaacaggcgtgcaaccatcagaataacggtcgcttcaacttccaccgaggatgcgaggccgacataacacccgaagatctgtttaatatcttctttgggggagggtttcccagcgggagtgtccactctttctcaaacggacgtgccggatacagccagcaacatcagcatcggcactctggccacgaacgcgaagaagagcgaggggacggcggtttcagcgttttcattcaactcatgcctattattgttttgatcttagtgtcgttgctaagtcaattaatggtctcgaatcccccttattccctctaccctcgctctgggacgggacagacaattaaaatgcagaccgaaaacctcggcgtcgtgtactatgtcaataaggatttcaaaaatgaatacaagggcatgctgctccagaaagtggaaaagagcgtcgaagaagactacgtgactaacataagaaataactgctggaaggaaagacagcaaaagaccgacatgcagtatgcggcaaaggtgtatcgggatgaccgcctccggaggaaggctgacgctctgtctatggataactgcaaggagcttgaaagacttacttccctatataaaggtggttag

SEQ ID NO: 49883 - DNA, 1014 bp, Artificial Sequence
  Description of Artificial Sequence: Synthetic coding sequence
atgggcaaagactattactgtatcctggggatagaaaagggcgcaagtgacgaggacattaagaaagcctacaggaagcaggccctgaaatttcacccagacaagaataaaagcccccaggccgaagagaaatttaaggaagtggctgaggcatatgaagtccttagcgatcccaaaaaacgggagatctacgatcaatttggtgaggaaggcctgaaggggggagctgggggaacagacgggcagggcggtacctttcgttacaccttccacggcgaccctcacgcaacatttgctgcgtttttcggcggatcaaaccccttcgaaatcttctttgggagaagaatgggtggagggagggatagcgaggagatggaaatagacggggacccattcagtgctttcggtttctctatgaatggatacccaagggaccgtaactccgtgggcccttcaagattgaagcaggatcccccagtaattcacgagcttcgggtgagccttgaagaaatctacagcggttgcaccaaaaggatgaaaatctccagaaagcgactgaatgccgatggtcggagctatcgcagcgaggataaaatacttacaatcgaaattaagaaaggttggaaagaaggcaccaagatcacatttccgagggagggtgatgagaccccaaatagtattcccgctgatattgtctttattatcaaagataaagaccatcccaagtttaagagggatggatccaacatcatctatactgccaaaatttccttacgggaggccctttgtgggtgttcaattaatgtgcccaccctggatggcaggaacatccccatgtctgttaatgacattgtgaagccagggatgaggagacgcataatcggctatggcctgccctttccaaaaaatcctgatcagagaggtgacctgttgattgaattcgaggtatcatttccagatactatctcctcctcgagcaaggaggtgctgaggaagcatctgccagccagctag

SEQ ID NO: 49884 - DNA, 519 bp, Artificial Sequence
  Description of Artificial Sequence: Synthetic coding sequence
atgggcaaagattactattgtatcttggggatcgagaagggggcttcagacgaagacatcaagaaggcataccggaaacaagcccttaagtttcacccggataaaaacaagtctccgcaggcggaagaaaaattcaaagaagtggccgaggcatacgaagtactttcagacccaaagaagagagagatctacgatcagttcggcgaagagggccttaagggaggggctggaggaacggacggacagggcggaaccttccgctacaccttccacggagacccgcacgctaccttcgccgcattttttggtgggagtaatccttttgagatctttttcgggaggagaatgggcggtggtagggattccgaagagatggagatagacggcgatcccttctctgccttcgggttctccatgaacgggtacccgcgtgatagaaattcagttggcccttcaaggcttaagcaggaccccccagtgattcacgagctcagggtgtccctggaggaaatttattag

SEQ ID NO: 49885 - DNA, 1083 bp, Artificial Sequence
  Description of Artificial Sequence: Synthetic coding sequence
atgggtgccccactcctgtcaccagggtggggagctggtgccgcaggtagacggtggtggatgctgctggcccctctccttcctgccctccttcttgtgcggccagcaggcgcactggtcgaagggctctattgtggtactagagattgctacgaggtgctgggagtgtcccgatctgccggaaaggctgagatagccagagcttaccgacagctggcaagaagatatcatcccgaccggtatcgccctcagccaggagatgaagggccaggacgaactccgcagtcagccgaagaggcctttctcctcgttgcaaccgcttacgagactctgaaggatgaggagacccggaaggactacgactacatgctggatcatcccgaggaatactattcccattactaccactattacagcagacggctggcaccaaaggtggatgtgcgggtggtcatcctagtcagcgtgtgcgcaatttccgtgtttcaattcttctcttggtggaattcctacaacaaagctatctcatatctcgcaacggtgccaaaatatcgcatccaggccacggaaatcgcaaagcaacagggactgctaaagaaggccaaggagaagggcaagaataaaaagtctaaggaggagatccgagatgaggaggagaatatcattaagaatattatcaagagtaagattgatatcaaaggagggtaccagaaacctcagatttgcgatctgctgctgttccagataattctagcaccatttcacctgtgttcctacattgtttggtattgccgctggatctacaacttcaacattaaaggaaaggagtatggcgaggaggagaggctctacatcatcagaaagagtatgaagatgagcaaaagtcagtttgattcactggaagaccaccagaaggagacctttctgaagcgtgagctatggatcaaagagaattacgaagtgtacaagcaagaacaggaggaggagctgaaaaaaaaactcgccaacgacccacgatggaaacgctatcggagatggatgaagaatgaaggcccagggcgactgaccttcgttgacgactag

SEQ ID NO: 49886 - DNA, 462 bp, Artificial Sequence
  Description of Artificial Sequence: Synthetic coding sequence
atgggagcccctctgctgtctcctggctggggggcaggagcggctggccgtcgttggtggatgcttctggccccactcttgcccgctctgcttctagtgcgtcccgctggcgcactggttgaaggactctactgtgggactcgtgattgttacgaggttctcggggtaagtcgatcagctggaaaggcagagatcgctagagcctataggcaacttgcgcgacgttaccaccccgaccggtaccggcctcagcccggtgatgagggtcctggccgaactcctcagagcgccgaggaggccttcctcctggtagctaccgcttatgaaaccctcaaagtctcgcaagctgcggctgagctgcagcagtactgtatgcagaatgcctgtaaagacgcacttctagtaggtgtgccagctgggagcaaccccttcagagagccgcgatcgtgcgcattgctttag

SEQ ID NO: 49887 - DNA, 330 bp, Artificial Sequence
  Description of Artificial Sequence: Synthetic coding sequence
atgactgcaccttgctctcagcctgcccagttgcctggcaggaggcagttgggcctagtgccctttcctccacctccgcctcgcacaccactcctatggctcctgctcctcttactagccgctgttgctcctgcccgtgggtgggagtcgggcgatctcgagctgtttgacctggtcgaggaggtgcagctgaacttttaccagttcctgggtgtgcagcaggacgccagctctgcagatattagaaaggcgtatcggaagctgagtctcacgcttcaccccgataagaacaaggacgagaacgccgagacacagttcaggcaagtttag

SEQ ID NO: 49888 - DNA, 1665 bp, Artificial Sequence
  Description of Artificial Sequence: Synthetic coding sequence
atgactgcgccttgcagccagcccgcacaactgcctggtcggcgacagctgggacttgtgcccttcccccctccgccacccagaacaccccttttgtggctgctacttttgctactcgccgctgtggccccagcacgaggatgggaatccggtgacctggagctattcgacctggtagaagaggtgcagttgaacttctaccagttcttgggcgtgcagcaggacgcctccagtgctgacatccgcaaagcgtaccgcaagctgtctctgactctgcaccctgacaagaataaggatgagaacgccgagacccagttcaggcaactggtagctatctatgaagtgttgaaggacgatgagagacgacaacgttacgacgacattctcataaatgggcttcctgactggagacagcctgtattctactacagacgcgtgagaaagatgtctaacgcggagctggctcttctactttttattattttgactgtgggccactacgctgtggtttggtctatttaccttgagaaacaattggatgagctgcttagtcggaagaagagggaaaagaagaagaaaaccggatctaaatccgtcgatgtcagtaagttgggcgcatcggagaaaaatgaaaggctgcttatgaagccccagtggcacgacctgctgccatgcaaactgggcatatggttttgcttgacactcaaggccctgccccacctcatccaagatgccggtcagttttatgcaaagtacaaagaaaccaggttaaaagagaaggaggacgccttgacacggactgagctcgagactttgcagaagcagaaaaaagtcaaaaaacccaagcccgagttccccgtgtacactccccttgaaaccacctacattcagagctacgaccacggtactagcatcgaagagattgaagagcagatggacgactggttggagaaccgcaatcgaacccagaagaaacaggccccagaatggacagaggaggatctgtcgcagctgaccaggtctatggtcaagttcccaggaggcacacccggaagatgggaaaagatcgcacatgagcttgggaggtccgtcactgacgtgaccacaaaagctaagcagcttaaggactcagtcacttgctcgccaggtatggtccgtctgtcagagctgaagagcaccgtgcagaatagccggcctattaagaccgcaaccactttacctgacgatatgattacacagcgggaagacgccgagggggttgccgctgaggaggagcaggagggcgattctggcgaacaggagaccggtgccactgatgctcggcctcggaggcggaaacccgcacgactgttggaggccacagccaaacccgagccggaggaaaagagtagagctaagcggcagaaggactttgacatcgcagagcaaaacgagtctagcgatgaggagagcctgcggaaggagagggccagatctgcagaagaaccttggacacagaatcagcagaagctgttggaactcgccctccagcagtacccccgtggctcctccgaccggtgggataagatagctagatgcgttccatcaaaatctaaagaagactgtatcgcgcgatacaagctgctggtcgagcttgtacagaagaaaaagcaagcaaaaagttag

SEQ ID NO: 49889 - DNA, 351 bp, Artificial Sequence
  Description of Artificial Sequence: Synthetic coding sequence
taaggacgacgtcaactgggactagtgccttttccccctcccccaccacggacacccctcttgtggctcctcttgctgctgttggctgccgtagcgccagccagaggatgggagagcggtgacctggaactgtttgatcttgtagaagaggtccagctcaacttctaccagttcctgggagtccagcaggacgcaagttctgctgatatccgcaaggcatatagaaaattgtctctgactctgcatcccgacaagaataaggacgagaacgccgagacgcagttccggcagctggtggccatttacgaggtgttgaaggacgatgagcgcagacagcgcatgaattattag

SEQ ID NO: 49890 - DNA, 1524 bp, Artificial Sequence
  Description of Artificial Sequence: Synthetic coding sequence
atggccacggcgttgtcagaagaggaactcgataacgaggattactacagcctgctcaacgtccggagggaagcttcctcggaggagttgaaggctgcttataggcgactgtgtatgctgtaccatccagataagcacagggatcccgagctcaagtcccaggccgagcggctgtttaacctagtgcatcaggcctacgaagtcttaagtgaccctcagacccgagctatttacgacatatatggcaagagagggctcgagatggagggttgggaggtagtggagaggagacggactccagctgagattagagaggaatttgaaaggttacaacgcgaaagagaggaacgcaggctgcaacaacgcaccaacccgaaggggactataagtgtaggtgtggacgccaccgatctttttgatcgctacgatgaagagtatgaggacgtctccggcagcagttttccccagattgagattaataagatgcacatcagccagtcaatcgaggccccacttacagctaccgacaccgctatactgagtggctcattgtcaacccaaaacggaaacggtggtgggtctatcaatttcgctctcaggcgggtgacgtcagccaaggggtggggtgagctggagtttggcgcaggggacctgcagggtcccctctttggattgaagctgttccggaacctgaccccccgttgctttgttacgactaactgtgctctccagttctcttcccgcggtatacgacccggacttacgacggtcctcgccaggaatttagacaagaatacagtggggtacctgcagtggcgctgggggatacagagcgccatgaatacgtccatagtccgggacactaagacgagtcacttcaccgttgcgctccagctcgggattccacacagttttgctcttatatcttatcagcacaagtttcaggacgatgaccaaactcgagttaagggcagtcttaaagcagggttttttggaactgtggtggaatatggggctgaacgcaaaatttcacggcactctgtacttggcgctgccgtttctgtaggtgtgccgcagggcgtgtcactgaaggtgaaagaactggaaaagcagagagagtctgctgctactgacgtactgcaaaagaaacaggaggccgagagcgccgttaggctaatgcaggaaagcgtgcggaggatcatcgaagccgaagaatctcgcatgggattaatcattgttaatgcctggtacggaaaatttgtgaatgataagagtaggaagtctgagaaagtcaaggtgatcgacgtcaccgttcctttgcagtgtctggtaaaagattctaagctgattcttacagaagcatcgaaggcaggcttgccaggattttacgacccttgtgtcggggaggaaaaaaatctgaaggtcctgtatcagttcaggggcgtcctacaccaggtcatggtgctcgactctgaagccctaagaatacctaaacaaagtcatcggatcgacacagacggctag

SEQ ID NO: 49891 - DNA, 957 bp, Artificial Sequence
  Description of Artificial Sequence: Synthetic coding sequence
atgttgtaccaccccgataaacaccgtgatccagaactcaagtctcaagcagaacgcctgttcaatctggtacatcaggcttacgaggtactgtctgacccgcagaccagggccatatacgatatctacgggaaacggggactggagatggaggggtgggaggtcgtggagcggaggcggacccccgcagagattagagaagagtttgagcggctgcagcgcgaacgcgaagaacgtagactccagcaacgaacaaaccctaagggcacaatctcggtgggcgtagatgccacggatctgttcgaccgttacgacgaggaatatgaagacgtgtccgggtcttcatttccccagattgagattaataaaatgcacatttctcaatcaattgaggcacccctgacagccaccgacaccgctatactgtctggcagtcttagtacgcagaacggcaacggaggcggaagtattaatttcgcgctaagacgcgttacgagtgcaaaaggttggggtgaactggaatttggagcgggagatttgcagggaccactctttgggctcaaattattcagaaacttgaccccaaggtgcttcgtgaccacaaactgcgccctgcagttcagctcgagaggtatcagacccggactgaccacagtcctggcccgtaacctggacaagaacacggttggttatttgcaatggcactgttcttcaccgctgctccaagtgcagcggcctcatagaaacacgcgcgcatgtgctcctgagccttcatttagacccttcctacacgtgccaacctgggacgccgagtgttctggcgctcgcacaccatccaccgcctggacaagcgcggcagtgaagctccgagaggcctgtctgagcggtcccggttcgggcagccaccagttgttgcttttaacaccaagaagtaaaaggagaacaggcggagggtag

SEQ ID NO: 49892 - DNA, 1410 bp, Artificial Sequence
  Description of Artificial Sequence: Synthetic coding sequence
atgaaggttgtggagcgcaggcggacaccagctgaaattcgggaggagttcgaacggcttcagcgcgagcgggaggagcggaggctgcagcagcggactaatcccaagggaactatttcagtcggcgttgatgctaccgaccttttcgaccgctacgacgaagagtacgaagatgtctctggctcctctttcccccagatcgaaattaacaagatgcatatctcacagagcatcgaagccccactgactgcgacagacacggctattctctctgggagcctgtctacacaaaacggaaacgggggagggtctatcaacttcgcgcttcgcagggtaacatcggccaaagggtggggcgagttggaatttggcgctggggacctgcagggtccactgttcgggctaaaactgtttcgcaacctcactcccagatgctttgtgacaacgaattgtgcactccagttcagtagccgaggcatcagacctggcttaaccacggtgctggctcggaacctggacaaaaatacggtgggctacttgcagtggcgttggggaatccagagtgccatgaacacgtctattgtgagggacacaaagacttcacattttacagtagctctgcagcttggtatcccccatagctttgccctcatttcctaccaacataaattccaagacgatgatcagacccgcgtgaaaggtagcctgaaggctggcttctttgggaccgtggtggaatacggcgctgagcgtaagattagtcggcattctgttctaggagctgccgtgtccgtgggtgtgcctcaaggcgtgtcactcaaagttaaactcaatagggctagccaaacttactttttcccgatccatctaacagatcagttattgccgagcgccatgttttacgcaactgtgggacctctggttgtctatttcgcgatgcatcgcctgataattaagccttatctgagggcgcaaaaggaaaaagaactggagaaacagcgggaatccgccgcaaccgatgtccttcagaaaaaacaagaggcagagtcagcggtcagactgatgcaggagagcgtccgtcgcattattgaagcagaagaaagccggatgggcctgattatcgtaaacgcctggtacggtaagtttgtcaatgacaaaagcagaaagagtgaaaaggtgaaagtgatcgatgttacggttccactgcaatgtctggtaaaggattccaaactcattcttacagaggcttctaaggccggactgcccggattttatgacccatgcgtgggggaggagaaaaatctcaaagtgctctaccagtttcgcggagtcttgcatcaagtaatggtgctggattccgaggcacttagaatacccaaacagtcccaccgcattgataccgatggctag

SEQ ID NO: 49893 - DNA, 1680 bp, Artificial Sequence
  Description of Artificial Sequence: Synthetic coding sequence
atggctacagccctctccgaggaagagctagataatgaagattattatagtttactgaacgtgaggcgggaagcatcttctgaggagctgaaggcggcataccggcgactctgtatgctgtaccaccccgacaagcatcgcgaccccgaactgaaaagccaggctgagcgactgtttaatttggtgcatcaggcttacgaggtgctgagtgaccctcagacacgagccatctatgatatttatggcaagaggggtctggagatggaagggtgggaggtggtggaacgccgtcggactcccgcagaaatcagagaagagtttgagcgactccagagagagcgggaggaacgccgattgcagcagcgcacaaaccctaaggggacgatcagcgtgggcgttgatgctacagatcttttcgacagatatgacgaagagtacgaggatgtgtcgggatcgagtttccctcaaattgaaataaacaagatgcatatctcacagtccatcgaggctcccctcaccgcaacagatacagccatcctgtctggaagcctgagtacccagaatggaaatggcggaggctccattaacttcgccttgcgacgagtgacctctgccaaaggttggggtgagttggagtttggtgccggagatttgcagggaccactcttcggactcaagctgttccgaaacctgacgcctaggtgtttcgtgaccacgaattgcgctctgcagtttagttcacggggaattaggcccggactaactaccgttctagctagaaacctagacaagaacacggtaggctacttgcaatggcggtggggaatacagtccgctatgaacacctcaatcgttcgggataccaaaacctcacacttcaccgtggccctgcagctgggaattcctcacagcttcgctctgatttcgtaccagcataaattccaggatgatgatcagacgagagttaaaggctctctgaaggcaggctttttcggaacggtggttgaatacggcgctgaacggaagatcagccgccacagcgtgctcggggctgccgtgagcgtgggagtcccccaaggggtgtcactgaaagtgaaactcaacagggcttcccagacttatttcttcccaattcacctgactgatcagctattgccgagcgctatgttctacgcaactgtgggcccactggttgtgtacttcgcaatgcaccgcctgatcatcaaaccctatctgcgcgcacagaaggagaaggagctggaaaaacagagggagtcggctgctaccgacgtgctccagaaaaagcaggaggccgaatccgctgtcaggctgatgcaggagtccgtgagacggatcatcgaggccgaagaatctcggatgggacttattatcgtcaatgcctggtacggaaagttcgtgaacgataaatcgaggaaatccgagaaggtcaaagtaatcgatgtgactgtgccacttcagtgccttgtcaaagactcaaaactgatcctcacagaagctagcaaagctggactgcccggattttacgacccctgcgtcggggaagagaaaaaccttaaagtgctgtatcaattccgaggcgtgttacatcaggtgatggtcttggactccgaagcccttagaatccccaagcaatcccacagaatcgacaccgacggttag

SEQ ID NO: 49894 - DNA, 975 bp, Artificial Sequence
  Description of Artificial Sequence: Synthetic coding sequence
atggcgacagccctgtccgaagaagaacttgacaacgaagattattattctcttctcaatgtacgcagagaggcaagttctgaagagctgaaggcagcttatagacggttgtgcatgctttaccacccggataagcaccgcgatcccgaactgaagtctcaagccgaaagacttttcaacttagtacaccaggcatatgaagtcttgagtgatcctcagacacgagccatctatgatatatacggcaagagaggacttgagatggaaggctgggaggtcgtggagcggaggaggactcctgcggagattagagaagagtttgaaaggcttcaacgcgaacgtgaagagcggcgtttgcaacaacgcaccaatcccaaaggtacaatctcagtgggagtcgacgcaaccgatctgttcgatcgctacgacgaggagtatgaagatgtgtctggctctagctttccacaaatcgaaatcaacaagatgcatatctcccagtcaatcgaagccccactgacagcaaccgatactgctatactctccggctcattgagcacccagaatggaaatgggggtggctctatcaacttcgcattgcggagagtgacatctgcgaaaggctggggtgagcggatgacagattgcctcataatcggactgatagatatatgccagaggtgctcacctcaacccgctagtgcgtcatgtcgcctgtgttgctgtcacgtaactctgttagaattatatataccagtgccttcacgcacaaccgcagtcagctccttccctatttgctttgtgacaacaaattgcgcgcttcaattttccagcagagggattagaccgggacttaccacagtgctggcccgaaatctggacaaaaacacagtggggtatttacagtggcgctgggggattcagagcgccatgaacacctctatcgtgagagatacgaaaactagtcatttcacctag

SEQ ID NO: 49895 - DNA, 999 bp, Artificial Sequence
  Description of Artificial Sequence: Synthetic coding sequence
gcctccagtgaggagctgaaggcggcatacaggaggttgtgcatgctgtaccatcccgataagcaccgggatccagagttgaagtctcaggcagagcggctgttcaatctggttcatcaggcgtacgaggtgctgtcagaccctcaaacccgcgctatctacgacatttatggaaaaagggggctggaaatggagggatgggaggttgtagaacggaggaggacaccagccgaaatccgtgaggaattcgagcgcctgcagagagagcgggaggagcgacgcctgcaacaaaggacaaatccaaaggggactattagtgtgggagtcgatgcgactgacctgttcgaccgttatgatgaggaatatgaagatgtgtctgggagctcgttcccccagattgagataaacaagatgcatatctcccaatctatagaggcccctctgaccgcaaccgacacggcgatcttatccgggtctctttccacacagaacggaaacggcggaggttcaatcaactttgcactgcgtagagtaactagtgctaagggctggggcgagttggaattcggggctggtgaccttcaggggcctttgttcggactcaaactcttccgcaatctcaccccaagatgtttcgtcactacaaattgtgccctccagttctccagccggggtatacggcctgggttgactactgtcctagcccgtaacttggataaaaacaccgttggatatctccagtggcattgcagtagtcctctactgcaggtgcagcgaccacataggaataccagggcctgcgcccctgagccctcgttccgacccttcctacatgtgcctacatgggatgcggagtgctcaggagctcgcaccccgtctacagcttggacctcagccgctgtgaagctgcgcgaagcctgcctcagtggtcctggcagtggatctcaccaactactgctgcttacaccaagaagtaagcgccgtacggggggagggtag

SEQ ID NO: 49896 - DNA, 1566 bp, Artificial Sequence
  Description of Artificial Sequence: Synthetic coding sequence
atgttgtaccacccagataaacaccgggaccctgagctcaaaagccaagcagagcgactttttaatctcgtgcatcaggcatacgaagtcctgagcgacccccagacccgagccatctacgacatttacggcaagaggggactcgaaatggagggttgggaggtggttgaaaggagaaggacgccagcagagattagggaggagttcgaacggttgcagagggagagggaggagcgcaggcttcagcagcgcacgaatcctaagggaacgatcagcgtgggagttgacgcaactgatctttttgaccgctatgacgaggagtacgaggacgtatctggctccagttttccacagatagaaattaataagatgcacatttcccaaagtattgaagccccattgaccgctaccgacaccgcaattctatccgggtccctttctacgcaaaatgggaacgggggaggttccatcaactttgccctccggagagtgacatcagccaagggctggggtgaacttgagttcggagcaggtgatctacaaggccctctatttggacttaagcttttccggaatttgacaccaaggtgtttcgtcaccaccaactgtgcactgcagttctcctcacgtgggatccggcctggtttaaccaccgtcttggcccgaaacctcgacaaaaatacagtcggatatctgcagtggagatggggcatacagtcagccatgaatactagcatcgtgcgggacaccaagacaagtcactttacagtcgcactccagttggggatcccccactccttcgcccttatcagttaccagcataagttccaggatgatgatcagacaagagtcaaggggagtcttaaagccggattcttcgggaccgttgtggaatatggagcagagcggaaaatctctaggcacagcgtcctcggggctgcggtcagtgtgggggtccctcaaggggtgtccctgaaggtcaagctgaatagggcatcccagacctattttttccctattcatctgactgaccagctgctcccctctgccatgttttacgctaccgtaggcccattggtggtgtattttgccatgcaccggcttatcatcaagccttatcttcgggcacagaaggaaaaagagttggaaaagcaacgagagagcgccgcaacggacgtcctccagaagaaacaggaagctgagtcagctgtgcgcctcatgcaggaatccgtgcgcagaatcatagaagcagaggagtcaagaatgggattgatcatagtaaacgcctggtatggtaaattcgtcaacgacaagtctaggaagtcagaaaaagtcaaggtgatcgacgtgaccgttccactgcagtgcctagtaaaagattcaaaactcattcttaccgaggcgagtaaggcagggctacccggtttctatgacccctgcgttggggaagaaaagaatctcaaggtgctttatcagtttagaggagttctgcaccaggtgatggtgctagactcagaggcactgcgaatccctaaacagtcacaccgaatcgacaccgacgggtag

SEQ ID NO: 49897 - DNA, 2109 bp, Artificial Sequence
  Description of Artificial Sequence: Synthetic coding sequence
atggcccagaagcacccaggggagagaggcttgtacggcgcacatcactccgggggagcttctctgcggaccctgggtccatctgtcgaccccgagattcccagcttctcgggcctcagagatagcgccggaaccgcacccaacggcacgcgttgcctgacggagcattctggccctaagcatacacaacaccccaatcctgctcactggctggaccctagtcatgggcctcctgggggaccaggaccccctcgggacgcggaagatccagatcaatctgaaacttcaagcgaagaggaaagcggcgtggaccaggaactcagcaaagaaaatgagactgggaatcagaaggacggcaattctttcctgagtattcccagcgcatgtaattgtcagggtacgcctggaatccccgaggggccttatagtgagggagggaatggtagctccagcaacttctgtcaccactgcacaagtcccgctctgggagaggatgaactggaagaggaatatgacgacgaggagtcgctgaaattcccttcggacttctcgagagtgagttcagggaagaagccccctagccgcagacagcgtcacaggttcccaaccaaagaagacaccagagaggggggtagaagggatcccaggagtcctggtagacacagactaggtcgcaagagatcccaggcggacaaaaggaagggactcggcctctggggggctgaggaactgtgtcagctcgggcaagcgggtttttggtggcttattgagctgctggttctcgtcggggaatatgtcgaaacgtgcggtcaccttatctacgcctgtcgccagttaaaaagcagcgacctcgacctgttcagggtgtggatgggcgtttggactggtcggctaggaggatgggcacaggttatgtttcaattcttatcacagggtttctattgcggtgtggggttgttcactcggtttctgaagctgcttggagcattgctgctgctggcccttgccttgttcctcgggttcctacagctgggttggcggttcctggtgggcctgggcgatcgcctggggtggagagacaaagctacctggcttttcagttggctggactccccagccctgcagagatgcctcacgctgctgagagatagcaggccctggcagcgcctcgtgcgcatcgtgcagtgggggtggctggaattaccttgggttaaacaaaacataaaccgccaggggaacgcgcctgttgcatctggcaggtattgccaacccgaggaagaagtggcaagactcttgactatggctggggtgcccgaggacgagctaaacccatttcatgtcttgggagtggaggccaccgcgagcgacgtggaacttaaaaaagcttatcggcagctcgccgtaatggtgcatccagataaaaatcaccatcctagagccgaggaggcctttaaggtgttgagggccgcttgggacatcgtctccaacgctgagaagcgcaaggaatatgaaatgaagcggatggcagaaaatgagttgagtagatcggtcaacgaattcctaagcaaactccaggacgaccttaaagaggccatgaataccatgatgtgttcaaggtgtcaaggcaaacataggagatttgaaatggacagggagcctaagagcgcgaggtattgtgccgaatgtaaccgcttgcacccggctgaggagggcgacttttgggcagagtcatccatgctcggactcaagattacatacttcgccctcatggacggaaaggtgtatgatataactgagtgggcaggctgtcagcgggttgggatctctccggacacacatagggtgccctatcacatttctttcggatctcggattccagggactcgcggacggcaacgggcaacacccgacgctcctcccgcagacttgcaggacttcctgagccgaatctttcaggtgccgccaggccaaatgcctaacgggaatttctttgcggcaccgcagccggctccgggtgccgctgccgcaagcaagcccaactcaactgtgcccaaaggcgaggccaaacctaaacgacgtaagaaggtgcggagacccttccagagatag

SEQ ID NO: 49898 - DNA, 2109 bp, Artificial Sequence
  Description of Artificial Sequence: Synthetic coding sequence
atggcccaaaagcaccccggagagcgcggtttatatggcgctcatcactctggcggtgcttccctgcgcacattgggaccaagcgtggacccagaaatcccgagtttttctggtctgcgcgactctgcaggaaccgcccctaacggaacacgctgtctcactgagcattccggacctaagcacacacagcaccccaaccctgctcactggctagaccccagtcacggtcctcctgggggacctgggcctcctagggacgccgaggatccagatcagagcgagactagttctgaagaggagtcaggggtggaccaggagttaagcaaagaaaacgagacaggcaaccagaaggacgggaattcctttctcagcatccccagcgcttgcaactgtcaggggacaccaggtatcccggaggggccttatagcgagggagggaatgggtctagttcaaacttctgccaccactgcacatcccctgctttgggggaggacgagctggaggaggagtatgacgacgaagagtctctgaagttcccatcagacttctcccgggtgtccagcggaaaaaagccccctagtcgcaggcagcgccatagatttcccaccaaagaggacaccagggaagggggacgaagggaccccaggtcccccggtaggcaccgcctgggacgaaaaagatcccaggcggacaagaggaaggggctgggactgtggggcgctgaggagctctgccaactcggtcaagctggattctggtggctgatagagctgctcgtcctggtgggcgaatacgtagagacttgcgggcacctgatctacgcttgtcgtcaactgaagtcctccgacctcgatctatttagggtgtggatgggggtgtggactggcagactgggaggctgggcacaagttatgttccagtttctttctcagggattctattgcggagttgggttattcactcggtttctcaagctgctcggcgctctgctactgctggctcttgctctgtttttgggattcctacagctggggtggagattcctggtcggtctgggggataggctcggttggagggacaaagcaacatggttatttagctggctggacagccccgcactgcagcgttgcttaacactgctgcgcgatagccgtccctggcagcgtttggtgcggattgtccagtggggctggctggaactcccgtgggtcaaacagaacattaaccggcaggggaatgcaccggtggccagcggacggtactgccagccggaggaagaggttgctcgactcctgaccatggccggagtgccagaggacgagctcaacccatttcacgtactgggagttgaagcaacagcgtccgatgtcgagcttaagaaggcgtatagacagctggccgtgatggtgcatccagataaaaatcatcatccacgggcagaggaggcgtttaaggtgcttagggccgcatgggatattgtgtccaacgcagagaaacggaaagagtacgaaatgaagagaatggccgaaaatgagctctcccggtccgtgaacgagttcctcagcaagcttcaggacgacctgaaagaggcaatgaataccatgatgtgttctcggtgtcaaggtaagcacaggcggtttgagatggatagggagccgaaaagcgcccgatactgtgctgagtgcaatcggctgcatcccgctgaggagggggatttctgggcggaaagctcaatgttaggtttaaagattacgtatttcgcactcatggatggaaaggtctacgacataaccgagtgggctgggtgtcaacgggtgggaatctcgccggacacgcatcgggtgccatatcacatctcctttgggtctagaattccaggaacacgtggtaggcagcgcgctactccggacgcccctcccgctgacctgcaagacttcctgtctagaatattccaagtgccacccggacagatgcccaatggtaatttcttcgctgcccctcagcccgcaccaggggcagccgctgccagcaaaccgaacagcactgtccctaaaggggaggctaaaccaaagcggaggaaaaaagtcagacgaccgttccagagatag

SEQ ID NO: 49899 - DNA, 2109 bp, Artificial Sequence
  Description of Artificial Sequence: Synthetic coding sequence
atggcccagaagcaccccggtgaacgtggcttatatggcgctcatcatagtggcggagcttcattgcgaaccctcggcccatcagtggatccggaaattccatcattttctggcctgcgagattccgctggaaccgcaccaaacgggacacgatgcctgacagagcattcaggacctaagcacacacagcaccctaaccccgcacactggctggacccctcgcatgggcctcctggcggacccggacctcccagagacgccgaggatcccgatcagagtgaaacctcaagcgaagaagaatctggggtggaccaggaactaagtaaggagaacgaaactggtaaccagaaagacggaaactcttttctttcaattccgtcggcatgtaattgccagggaactccgggaatcccagaagggccttacagcgaggggggaaacgggagttccagtaacttttgtcaccactgcacctctccagctcttggtgaggacgaactggaagaggagtacgatgatgaggagagtctgaagtttccttctgacttcagtcgtgtcagcagtggcaagaagccaccttctcgcaggcagagacataggttccccacgaaggaagacacaagggaggggggacgaagggatccacggtctcccggaaggcacaggttggggagaaagcgctcacaagcagataagagaaaaggcctgggtttgtggggggctgaagaactctgtcagctgggacaggccggtttttggtggcttattgagctgcttgtgctcgtgggggaatacgtcgagacctgcggacatttgatatacgcctgcagacagctgaaatcctcagacctcgacctgttcagggtgtggatgggagtctggaccgggaggcttgggggatgggcccaggtaatgttccagttcctatctcaggggttctactgcggggtgggcctctttacccgcttcttgaagctgttgggtgcgctcctcctgcttgccctggccctctttctgggattcctgcagttggggtggcgcttcctggtgggtctgggcgataggctgggttggcgcgacaaagccacctggttattttcctggctagattcccctgccttgcagcgttgcctgaccctcctgagagacagtcgcccatggcaacgactggtgagaattgtccagtggggctggctggagctcccgtgggttaaacagaacataaatcgacagggtaatgctcccgttgcatctggtaggtattgtcagccggaggaggaagtcgctcgcctgctcactatggcgggtgtccctgaggacgagctcaatccattccacgttcttggagtagaagcaacagcctccgacgtggaacttaagaaggcctataggcagctagccgtcatggtgcatcctgacaagaaccatcacccccgtgctgaagaggcattcaaagtgctccgagccgcatgggatatcgtttcaaatgctgaaaagcggaaggaatacgagatgaagaggatggctgagaacgaactctcaaggtccgttaacgagtttctcagcaaattgcaggacgacctgaaggaagcaatgaacactatgatgtgctcaaggtgtcaaggcaagcacagacgctttgagatggatagagagcccaagtcagcgcgttactgcgctgaatgcaatcgtttacaccccgcagaggaaggcgacttttgggccgagtcaagcatgctcggtctgaagatcacctactttgcactcatggatggcaaggtatacgatatcacagagtgggcagggtgtcagcgagtgggcatctcacctgatacccatagggtgccgtaccatatcagctttgggagtaggattcccggaacgaggggacggcagcgcgctacacctgatgccccaccagctgatctgcaggatttcctgtcacgcatttttcaggtgccaccaggtcagatgcccaacggaaacttttttgctgccccacaacccgctcccggagcagccgcagcaagtaagccaaactctaccgtgcccaagggtgaggcgaagccaaagcggaggaaaaaagtgcggaggcccttccagcgatag

SEQ ID NO: 49900 - DNA, 1239 bp, Artificial Sequence
  Description of Artificial Sequence: Synthetic coding sequence
atgggggtgtggaccggcagattaggtggctgggcacaggtcatgtttcaattcctgtcccaagggttctactgtggggttgggctctttactagattcctcaaattgctgggagcactccttctcctcgccttagccctctttttggggtttttgcagctcgggtggcgctttctggtgggcttgggtgatagactggggtggagagacaaggctacatggctgttttcttggctagattcaccagcacttcagcgctgtttaactttactgcgagattcacgcccatggcagcgactggttagaatcgtccaatggggatggctagagctcccatgggtaaaacagaacattaatcggcagggcaatgctcccgtggctagcggccgatactgccaacctgaagaagaagtggccaggctgctcaccatggctggagtgcctgaggacgagcttaatccttttcatgtcttgggagtggaagccaccgcctcagatgtggagctgaagaaggcctaccgtcagctcgcggttatggtgcatccggataagaaccaccaccccagggctgaggaggcattcaaggtgcttcgagccgcatgggatatagtgagtaacgccgaaaagaggaaagagtatgagatgaaaaggatggccgagaatgagctttccagaagcgtcaatgaatttctgagcaagttgcaggacgatctgaaagaggctatgaataccatgatgtgctcccgctgccagggcaaacaccgacgttttgagatggaccgagagcccaaatccgcccgatactgcgctgagtgcaatcgtttgcacccagccgaagagggcgacttctgggccgagtcctcgatgctgggattgaaaattacttactttgctcttatggatggtaaggtttatgacattacagagtgggctggttgtcagagggttgggatcagccctgatacacatcgggtaccttaccatatctccttcggatcccgaatcccaggcaccagaggacgccaaagagctactccagatgcccctcccgcagatctacaagacttcttatctaggattttccaggtgcctcctggccaaatgcccaatggaaatttcttcgccgctccccagccggcacctggcgcagccgcagcatctaaacccaactcaactgtgcctaaaggggaggctaaaccaaagcgacggaagaaggtgcggaggcccttccagaggtag

SEQ ID NO: 49901 - DNA, 576 bp, Artificial Sequence
  Description of Artificial Sequence: Synthetic coding sequence
agaaagcggatggccgagaatgagctctcccgctcggtcaacgagtttctttccaaactgcaggacgacctgaaagaggcaatgaacacaatgatgtgttcccggtgtcagggcaaacaccgcagattcgaaatggacagggaacctaagtccgctagatactgtgccgagtgcaatcggctgcatcccgcagaggagggggacttctgggctgagagttctatgctgggcctgaagattacatacttcgccctgatggatggcaaggtctacgatattactgagtgggctgggtgtcagcgggttggaatttccccagatacgcacagggtcccttaccatatatcattcggtagtaggatacccggtacgcggggaaggcagcgcgctacaccagacgcccctccggcagatctgcaggacttcctgagcagaatttttcaagtccctccagggcagatgccaatgggtacttccctgcagcttttgagcctgccactcgagcctcttcagccgctcagccctactgctcagtatcccagagagaagccaaacctgtctgggggaagaaagtag

SEQ ID NO: 49902 - DNA, 240 bp, Artificial Sequence
  Description of Artificial Sequence: Synthetic coding sequence
atggcacaaaagcaccccggagagcggggactctatggggctcatcacagtggtggcgcatcgctgaggacactggggccttcagttgatccagagataccctcattcagcggcttgcgcgacagcgctggcacagccccaaatgggacccgctgtctgacagaacattctgggccaaagcatacccagcaccctaaccctgctcattggctggatcccagtcatggaccccctggctag

SEQ ID NO: 49903 - DNA, 456 bp, Artificial Sequence
  Description of Artificial Sequence: Synthetic coding sequence
atggctcagaaacacccaggtgagagaggcctttacggtgcccaccattccggtggcgcatctcttagaacattgggcccttccgttgacccagagatcccatcattctcagggttgcgcgattccgcgggaaccgctccaaacggaacacgatgtctcacagagcactccggcccaaagcacacccaacaccccaatccggctcactggctggacccgtctcatggcccacctggcggaccaggacccccacgagacgcagaggacccggaccagtcggaaacaagctcagaggaggagtccggcgtcgatcaagagctcagtaaggagaatgaaaccggcaatcagaaagacggcaactcctttctatctattccctccgcttgcaattgccaggggacccctgggattcccgagggcccatattcagaaggaggcaacggctctagtagttag

SEQ ID NO: 49904 - DNA, 453 bp, Artificial Sequence
  Description of Artificial Sequence: Synthetic coding sequence
atggcggcaaggggcgtaatcgccccagtgggggaaagtctgcgatacgctgagtatcttcaaccttccgctaagcgcccagacgcagacgtcgaccagcagaggctggttcgctcgctcattgcagttggtctgggcgtggcagccttagcctttgccggacggtacgcctttcggatttggaagcctctggagcaagttatcacggaaactgccaaaaagattagtacgccaagctttagcagttactacaaaggcggatttgaacaaaaaatgtcgcgacgcgaagctggactgatcctgggtgtctctccatctgcagggaaggcaaaaattagaactgctcacagacgggtgatgatccttaaccaccctgataaagggggatctccttatgtcgccgctaagatcaacgaagccaaagacctgcttgagactacgacaaagcattag

SEQ ID NO: 49905 - DNA, 1788 bp, Artificial Sequence
  Description of Artificial Sequence: Synthetic coding sequence
atggaggtgcggaagctgtctatctcctggcagttcctgatcgttctagtcctgatcctgcagatcttgtctgctctcgactttgatccttaccgtgtgcttggggtttctaggacggctagccaggccgacatcaagaaagcttacaaaaagttggctcgtgagtggcatccagataaaaataaagacccaggggcagaagataagtttattcagatttccaaggcctatgaaattctgtccaacgaggaaaagcgcagtaactacgaccagtatggggatgccggtgaaaaccagggctaccaaaaacagcagcaacagagggagtaccggttccgccattttcacgagaatttctatttcgacgaatcttttttccactttccttttaattccgaacggagggactccatcgacgagaagtatctcttgcacttctctcactatgtgaacgaggtcgttccagattccttcaaaaaaccttatcttataaaaatcacatcagattggtgttttagttgcattcacattgaaccggtatggaaggaagtcatccaagaattggaggaactcggagtcggaatcggcgtggtccacgctggatatgagcggcgactcgcgcatcatctgggggctcatagtactccctctatcctgggaatcataaacggaaaaatcagcttttttcataatgctgtagttagggaaaacctgaggcagtttgtggagtctctgctacccggtaaccttgttgagaaagttaccaataaaaattatgtgcgctttctgagtggatggcaacaggaaaataaacctcatgtgctattattcgaccagacacctatagtccccctgctgtataagctgacagccttcgcctacaaggattatctaagctttggttatgtgtacgtgggacttcgcggaacagaggagatgacaaggcgctacaatatcaatatctacgcccctactcttttggttttcaaggaacacatcaataggccagctgatgtgatccaggctaggggcatgaagaagcagattattgatgattttattacacgaaataaatatcttttggccgctaggctcacatcccaaaagctcttccacgaactctgtcctgtgaagcgcagccacagacaacgcaagtactgcgttgtgctgctgacagcagaaaccaccaaactgtcaaaacctttcgaagccttcctgtcatttgccctggctaacacacaagatactgtaagatttgtccatgtgtactccaaccgacagcaggagtttgccgacacattgctacccgacagtgaagcatttcaagggaagtctgcagtctctatcctggagaggaggaacaccgctggccgtgtagtttataagaccctggaagatccctggatcggaagcgagagcgataagtttattctcctggggtatctagatcagttgagaaaagatcctgctctgctttcgagcgaagccgtgttgcccgatctcacggacgaattggcccctgttttcttgctgaggtggttctactcggcatctgattatatatctgactgctgggactcaatcttccacaataactggcgggagatgatgccactgttgtcattgatctttagcgccctcttcatcttgtttggaacagtaattgtccaagcgttttcggattcaaacgacgagcgggaatcttcacctccggagaaggaggaagcacaagagaagaccggcaaaaccgaacctagcttcacgaaagaaaatagccgtttcctctag

SEQ ID NO: 49906 - DNA, 2349 bp, Artificial Sequence
  Description of Artificial Sequence: Synthetic coding sequence
atggaggtgcgaaaactgtcaatcagctggcagtttctgatcgtccttgtcctcattctccagattctttctgccctcgattttgatccatatagagttctcggagtcagccgaaccgcgagccaggcagatatcaagaaggcctataagaaactagctagagagtggcaccccgataaaaacaaggaccccggagccgaagacaagttcatacagatcagcaaagcctatgagattcttagtaacgaagaaaagaggtcaaactacgaccaatatggagacgccggtgagaatcaggggtaccaaaaacagcagcagcagagggaatatcgctttcgccactttcacgagaatttctatttcgatgagtccttctttcacttcccctttaattcggagaggcgcgactcgatcgacgaaaagtacctactgcacttttcccattacgtgaatgaggtcgttcccgactcttttaagaaaccttatctaataaaaatcacatccgactggtgtttcagctgcatccatatagagcctgtatggaaagaggtcatccaggagttggaagagctcggggtgggaatcggtgtcgtgcacgccggatatgaaaggagactggcccatcacctgggcgcacatagcacgccatcaattctgggcattattaatggtaagatcagtttctttcacaacgctgtggtacgcgaaaacctgcggcaatttgtggagtctctgctgcctgggaatctagtagagaaagtcaccaacaagaactatgttagattcttgagcggatggcagcaggagaataagccccacgtattgctcttcgatcagaccccgatcgtcccactcctgtataaactgaccgcttttgcttataaagactacctgtctttcgggtatgtgtacgtcgggctacgcggtacagaggagatgaccaggcggtataatatcaatatctacgcccctactttgctagtgttcaaagaacatattaaccggccagccgacgtaatccaagccagaggaatgaagaaacagatcatagatgatttcattactcgtaacaagtacctcctggccgcaagattgacctctcagaaactgtttcatgagctttgccctgtgaagcggtcccatcgccagaggaagtattgtgtggtactgctcacagcagagactacgaagctgtccaaaccctttgaagcttttttgtccttcgctctggctaatacacaggataccgtaagatttgtgcacgtgtacagcaatagacaacaagagttcgccgatactctgctgcccgatagtgaggcttttcagggaaagagcgccgtgagcatactcgagcgcagaaataccgccggaagagttgtctacaagacactcgaagacccatggattgggtcagaatctgataagtttattctgctagggtaccttgatcagcttcgcaaagacccggctttactgtccagtgaggcagtactgccagacctgactgatgagctcgctcctgtttttctactgagatggttttacagcgcctctgattatatctctgattgttgggactccatattccataataactggcgggagatgatgcctctgctgagcctgattttttccgccctgttcatcctcttcgggacagtgattgttcaggcatttagtgattccaacgatgagagggagagttcaccccctgaaaaggaagaggctcaagagaaaacagggaagacggagccctcctttaccaaagagaattcctcgaagattcccaagaagggtttcgtggaagtgactgaactaaccgatgtcacttacacctctaacctggttcggctcagaccaggacatatgaacgtggtgctgatcctgtcaaactcaacaaagacctccctgctgcagaaatttgcccttgaagtgtatacttttacaggttcgtcttgcctgcatttttcttttctgtctttggataaacacagggagtggttagagtatttgctcgagtttgcccaggatgccgcaccaatccccaaccagtacgacaagcactttatggaaagagattacaccgggtatgtcctcgccctaaacggccacaagaaatatttttgtctcttcaaaccacagaaaacggtggaagaagaagaagcgatcggaagttgtagcgacgttgactcatccctctatctgggagaatctaggggaaagccttcctgcggcttgggttcccgacctattaagggcaaactcagcaagcttagtctgtggatggaacgactgttagagggaagcttgcagaggttctacattccaagttggcctgagctggattag

SEQ ID NO: 49907 - DNA, 1968 bp, Artificial Sequence
  Description of Artificial Sequence: Synthetic coding sequence
atggaagtaaggaaactcagtatttcttggcagttcttgatagtgttggtgctgatccttcaaatactttcagccctggacttcgatccatacagggtcctgggggtgtcacgcactgcttctcaggctgacattaaaaaggcatataaaaagctggccagagaatggcacccagataaaaataaagacccgggagccgaagataagtttatacaaatcagcaaagcatacgagattctctcgaacgaggagaaacggtcaaactacgaccagtatggcgatgccggagagaaccagggatatcaaaaacagcaacaacagcgggaatacagattccgacactttcacgaaaacttttacttcgatgaaagcttttttcactttccctttaacagcgaacggagggattccatcgacgagaagtacttgctgcatttttcccactatgtcaacgaggttgttcctgatagtttcaaaaaaccctacctaattaaaatcacctcagactggtgcttctcatgtattcatatagaaccagtctggaaggaagtgattcaggaattggaggaactgggagttggaatcggagtggtccatgctgggtacgagcgccgacttgctcatcacctgggcgctcacagcactccatcgattctggggattatcaatggaaaaatcagtttctttcacaatgcagtggtacgcgagaacctgcggcaatttgtggaatccctgttgccgggtaatctggtggaaaaggtgacaaataagaactatgtgaggtttctgtccgggtggcagcaagagaacaagccccacgttctcctatttgatcagacaccaatcgtgccactgctctataagttaacagccttcgcttataaagactatttgtccttcggttatgtttatgtcgggctgcgcggaacagaggagatgaccaggagatacaatatcaatatttacgcacccactctcctggttttcaaagaacatataaatcgccctgctgacgtcatacaggctcgtgggatgaaaaaacagatcattgacgactttattacccgcaacaagtacctgctcgccgcacggctgacctcccagaaactgttccatgaactgtgccccgtcaagagatctcaccgacagcgcaagtactgtgtggttctacttacagctgagaccaccaagctgtctaagccatttgaagcctttctcagcttcgcactggccaatacgcaggacacggtacggtttgtgcatgtgtattcaaatcgccagcaggagttcgctgacacattgttacccgattccgaagcctttcaaggaaaatctgccgtgtctatactcgagaggcgcaatacagctggacgtgtggtctacaaaaccctggaggatccctggattggatcagagagcgacaaattcatcctgctcggctatcttgaccagcttcgaaaagaccctgccttgctgtcttcggaagccgtgctgccggacctgaccgatgagctggcccctgtgtttctgcttcgctggttctactccgccagtgactacatctccgactgctgggactccatttttcacaacaactggagagagatgatgcctctgctctcattgatcttcagcgccctgttcattctttttggaacagttattgtgcaggctttttcagattccaacgatgagcgcgagtctagcccccctgagaaagaggaagcgcaggagaaaaccggcaagactgaaccctcatttaccaaagaaaattcatccaaaatacccaagaaagggtttgtcgaggtgactgagctgacggacgtgacatacacatcaaacttagtgcggttgcggccaggccatatgaacgtggtcttaatcttaagcaattcaactaaaacgtccctgctgcaaaaatttgctttggaggtctacacctttaccggcaagatcataagatggtag

SEQ ID NO: 49908 - DNA, 1788 bp, Artificial Sequence
  Description of Artificial Sequence: Synthetic coding sequence
atggaggtgagaaaactctcaatttcatggcagtttctgatcgttctggttctgattctgcaaatactgagtgctctggacttcgacccctatagagtgctgggcgtgtcaagaaccgcctcccaggctgacatcaagaaggcctacaaaaaactggcccgagaatggcatccagacaaaaacaaggacccgggtgccgaagacaaattcatccagatctctaaggcgtacgaaatcctcagcaatgaggaaaaacgctcaaattacgaccagtatggtgacgcaggcgagaatcaagggtaccagaaacagcagcagcagcgcgaatataggtttcgtcattttcacgaaaacttttactttgatgagtcttttttccacttcccatttaacagcgagagaagggatagcatcgacgagaaatacctactgcatttctcacactacgtgaacgaggtggtgccggatagttttaaaaagccctatctgattaaaatcacctctgactggtgcttctcgtgtatccatatagagcctgtgtggaaggaggtgattcaggagctcgaagaactgggggttgggatcggagttgtccatgccggatatgagcgcaggctggcccaccacctcggcgcacatagcacaccttcaattctgggcattattaatggtaagattagtttctttcacaacgcagtcgtcagagagaatctccgccagtttgtcgagtcactgctcccgggaaatttggtcgagaaggtgactaacaagaactacgttagattcctgtccggctggcagcaggaaaataaaccccatgtgctgctgttcgatcagaccccaatagtgccgctgctgtataagcttactgcattcgcctacaaggattacctctctttcggctacgtctacgtcggcctcaggggaaccgaagaaatgactcgaagatataacatcaacatctatgccccaacactgctcgttttcaaggaacacatcaatcgtcctgccgatgtgatccaagccagggggatgaagaagcagataatagacgatttcataacaaggaacaaatatttgctggcagcccgtctgacttcccagaagctgtttcacgagctttgtccagttaagcgaagccaccggcagcgcaagtattgcgtggtgcttctcacggcagagaccactaagttgtccaaaccattcgaggcttttctgtcttttgccctcgccaacacgcaggacaccgttaggttcgtgcatgtatactctaatcgccagcaggaatttgctgatactttgctgcccgactcagaagctttccaaggcaagtcagccgttagcatcctcgagaggaggaatacagcagggcgtgtggtctacaagactctcgaggatccttggatcgggtccgaaagcgataagttcattctcttgggctatctcgaccagctgcgaaaggatcccgctctgctgtcatctgaggccgtcctgccagatttaaccgatgagctcgctccggtctttctactccggtggttctacagcgcctctgattatatcagcgattgctgggactctatcttccacaataattggagggaaatgatgccactgttgagcctgatattttcggcccttttcattctttttgggactgtcatcgtacaagcattttcggactcaaatgacgaacgagaaagctcacccccagagaaggaggaagcccaggaaaaaactggaaagacagaaccgagttttaccaaggaaaattccagattcttatag

SEQ ID NO: 49909 - DNA, 1077 bp, Artificial Sequence
  Description of Artificial Sequence: Synthetic coding sequence
atggctgcgacattggggagtggggaacgctggactgaggcctacatcgatgccgttcgcaggaacaaataccccgaggatacacccccagaaagccatgatccctgcggctgctgcaattgcatgaaggcgcagaaggagaagaagtcagaaaatgagtggactcagactcggcagggggagggaaacagcacctacagtgaggagcagttgctgggagtgcagagaatcaagaagtgtcgcaattattatgaaatcttgggggtgtcacgcgatgccagcgatgaagagctcaaaaaggcctaccgaaagctggctttgaagtttcaccccgacaaaaattgcgcgcctggggctaccgatgcatttaaagcaatagggaatgcattcgccgtactgtctaatcccgacaagagattgcggtacgacgagtacggtgacgagcaagtgactttcacagcgccacgagcacggccttacaattactaccgcgactttgaagctgatattaccccagaggagctctttaatgtgttctttggcggacatttcccgacgggcaacatccatatgttctcaaatgttacagatgacacctactactaccgcaggcgtcacaggcacgagcggacccagactcagaaggaagaagaggaagagaaaccacaaacaacctactccgcctttattcagcttctgccggtgctggtcatagttataatctctgtcataacccaactgcttgccacgaacccaccctacagcctattctataagagtacgttggggtatactataagcagggagacccaaaacctgcaagtaccatatttcgtggacaagaactttgataaggcctaccgcggtgcgtctctgcacgaccttgaaaaaaccatcgagaaagattacatcgattacatccaaacgagctgttggaaggagaagcagcagaagtcagaactgaccaatttggccggactgtacagagacgaaaggctgaagcagaaggcagagagcttgaaactcgagaactgcgagaagctcagtaagttgataggcctgaggcggggaggctag

SEQ ID NO: 49910 - DNA, 78 bp, Artificial Sequence
  Description of Artificial Sequence: Synthetic coding sequence
atggccgctacgctcgggtcaggcgagcgatggactgaggcatacatagatgctgtgcggcgtaacaagtacccatag

SEQ ID NO: 49911 - DNA, 522 bp, Artificial Sequence
  Description of Artificial Sequence: Synthetic coding sequence
atggccgctacattggggtcaggagagcgatggacagaggcatatatagatgcagttagaaggaacaagtatcccgaagacacaccacctgaaagccatgacccatgtgggtgctgtaactgcatgaaggcgcaaaaggagaaaaagagcgagaacgagtggacccagacacgacagggcgaaggtaactcaacttacagcgaagagcagttactgggtgtccagcgaataaagaaatgccgcaattactatgagatcctgggggtgtctagagatgctagcgacgaggaactcaagaaggcttatcggaaactggcattgaaattccaccctgataaaaattgcgcccctggagccaccgacgcatttaaagcgatcggcaacgccttcgcggttcttagtaatccagacaagcgcctccgctatgatgagtacggcgacgagcaggtgacgtttacagcaccacgcgcacgcccatacaattactaccgagacttcgaagccgacattacacccgagtag

SEQ ID NO: 49912 - DNA, 546 bp, Artificial Sequence
  Description of Artificial Sequence: Synthetic coding sequence
atggccgcaaccctgggtagtggggaaagatggacggaggcttacatagacgccgtacgccgtaataagtacccagaggatacaccacctgagagtcacgacccctgcggctgttgcaattgtatgaaagcccagaaggagaaaaaatctgagaacgagtggactcaaacacgacaaggggagggcaattctacctactcagaggagcagctgttaggagtgcagagaatcaagaagtgccgaaattactatgagatactgggggtgtcccgtgatgctagcgacgaggagctgaaaaaggcataccgcaagttggcccttaagtttcaccctgataagaattgcgccccaggagccacagacgctttcaaggccatcgggaacgctttcgccgtgttgtccaacccagataaacgcctccgatacgacgaatacggtgatgagcaggtcacctttacggcaccacgtgctcggccatacaactactacagagattttgaagcggacattactcctgaagagctgttcaacgtcttcttcggttag

SEQ ID NO: 49913 - DNA, 1026 bp, Artificial Sequence
  Description of Artificial Sequence: Synthetic coding sequence
atggccaaaggcttactcgtcacatatgcgctgtgggctgttgggggtcccgcaggcctgcatcatctgtacctgggccgtgactctcacgccctcctttggatgcttacgcttggaggcggaggcctgggttggctgtgggagttctggaagcttccaagcttcgttgctcaggccaatcgagcccaaggacagagacaaagcccaagaggcgtgacaccccctctaagtccaattcggttcgctgcgcaagttatcgtgggaatttattttgggctcgtcgccctgataagcctcagctccatggttaatttctacatcgttgccctgcctttggccgtgggcctgggagtgctactcgtggcagcggttggtaatcagacatctgattttaagaatacactcgggagcgcctttctaacgagccctattttttatggtcgacccatagcaattttaccaatttcagtggcagcctccattacagctcagcgccatagacgatacaaagccctggtggcatctgagccgcttagtgtgaggctctatcgacttgggttggcataccttgcctttactgggccattggcatactcggcactgtgcaataccgctgcaaccctgagctacgtcgccgaaacgttcggcagctttttaaactggttcagttttttcccgcttcttggaaggctgatggaatttgtgctgttacttccataccgtatttggcgcctgctgatgggcgaaacagggttcaattcgtcgtgttttcaggagtgggccaagctgtacgaattcgtccattccttccaggacgaaaagaggcaattggcctaccaggtcttgggcctgtcggaaggggctacaaatgaggaaattcatcgatcgtaccaagagctggttaaggtgtggcatcctgaccacaacctggatcagaccgaggaggcgcagaggcacttccttgagattcaggctgcttatgaggttttatctcaacctcgtaagccttggggatctcggagatag

SEQ ID NO: 49914 - DNA, 1026 bp, Artificial Sequence
  Description of Artificial Sequence: Synthetic coding sequence
atggccaaaggcctactggttacctacgctctgtgggccgtcggaggacctgctgggctgcatcacttgtatttggggagagattcacatgccctgctctggatgctgacactaggcggagggggactgggatggctatgggagttctggaagttgccatcattcgtcgcgcaggccaatagggcccagggtcaacgccagtcacctcggggtgtaaccccacccctcagtcctatccgcttcgcagcgcaggtaatcgtggggatctactttggattggttgccctaatttctttgtctagtatggtgaacttctacattgtggccctgcccctcgccgtgggactgggagtcctactcgtcgcagctgtcggaaatcagacttcggattttaagaacactttggggtcagctttcctcactagtcccattttctatggtagaccgatagcaattttacctatctccgtagcagcaagcataacagctcagaggcatcggcgttataaagcactggtcgccagcgagcccctgtctgtgaggttatacaggctggggctggcctatctggcttttacaggtcccctggcttactccgcactgtgcaataccgccgcaacactgtcttacgtggccgagacatttggctcatttcttaattggttcagcttctttcccctgcttggtagactcatggaatttgtgctgttgctgccttacaggatctggcgactgctcatgggggagaccggattcaacagtagctgcttccaagagtgggctaaactctacgagtttgtccattcttttcaggatgaaaaaagacagctcgcttatcaggtgctgggtctttctgagggagcgacgaatgaggagatacatcggagttaccaggaactcgttaaagtgtggcatccggatcacaatctggaccagaccgaggaggcacagcgacactttctcgaaattcaggctgcatacgaagtgctgagccaacccaggaaaccttggggatccaggagatag

SEQ ID NO: 49915 - DNA, 681 bp, Artificial Sequence
  Description of Artificial Sequence: Synthetic coding sequence
atggcggctatgagatggcggtggtggcagcgcctgttaccgtggcgactgctgcaggccagggggttcccccaaaactctgcacctagtctggggcttggtgcacgtacctattcccagggggattgcagctacagccggactgctctatacgatctgttaggggtgccatcaaccgccactcaggcccagatcaaggcagcatactaccgacaatgttttttgtaccaccctgaccggaactctggaagtgctgaggcagcagagcgctttaccagaatatcccaggcttacgtcgtgctgggaagtgccactctccgcagaaagtatgatagagggctgctgtcagatgaagatctgcggggaccaggcgtgcgccctagccgcacccccgctcccgaccctgggtctcccagaaccccacccccaactagtcgcacgcacgatgggagcagggcctcacccggagctaaccgcacgatgttcaatttcgacgccttttatcaggcccactatggagaacagctcgagcgtgagaggcgcctgagggcccgtagggaggccttgaggaaaaggcaagaataccggtccatgaaagggctgcgatgggaagatacccgcgatactgctgcgatctttctgatcttcagtatctttattatcatcggcttctacatttag

SEQ ID NO: 49916 - DNA, 522 bp, Artificial Sequence
  Description of Artificial Sequence: Synthetic coding sequence
atgcgctggcggtggtggcagagactgcttccctggaggttgctgcaagcacgcggtttcccgcagaatagtgcaccttccctgggactgggcgctcgcacctattcccagggagactgtagctattcccgcacagccctctacgacctcttgggcgtgcctagtacagcgacgcaggctcagataaaggccgcttattaccgccagtgcttcctgtaccatcctgataggaattccggtagtgctgaagccgctgagaggttcactcgtatttctcaagcatacgtggtcctgggatccgcgaccctgcgcaggaaatatgacagaggcctgttatcagacgaggacctccgcggacctggggttcggccttctcggacacctgcacctgatcctgggagccctcgcactccaccccctaccagccgtagtatgaaaggcctgagatgggaagataccagagataccgctgctattttcctcatttttagtattttcatcattatcggcttttatatctag

SEQ ID NO: 49917 - DNA, 726 bp, Artificial Sequence
  Description of Artificial Sequence: Synthetic coding sequence
atgccccctctgctccctctgaggttatgtcgactgtggcccagaaacccacctagcaggcttttgggggctgcggcaggccaaagatcgaggccctctacgtactacgaactgctgggggtgcatcctggggcttccactgaggaagtgaagcgcgcatttttttctaagtccaaagaactccaccctgaccgggatcctgggaatccaagccttcatagtcgtttcgttgaattgtctgaggcctacagagttctctctcgtgaacaaagccgcaggtcctatgatgaccagcttcgatctggatctccgccaaagtccccgagaaccactgtccatgacaaatcagcccatcaaacgcactcctcatggacccccccaaacgctcagtattggtcacagtttcacagcgtacgccctcaaggtcctcagctgaggcagcagcagcacaaacagaataagcaggtacttggctactgcctgctgctgatgcttgctggtatgggattacattacattgccttcagaaaagtcaaacagatgcacctgaacttcatggacgagaaagatagaattattactgccttctataatgaggctcgcgctagagcacgagcgaaccgtgggatccttcagcaagagcggcagagacttggccaaaggcaacccccaccatctgagcctacacagggcccagaaatcgtacctagaggtgccggtccctag

SEQ ID NO: 49918 - DNA, 537 bp, Artificial Sequence
  Description of Artificial Sequence: Synthetic coding sequence
atgctgcggaccgctcttcggggtgcccctcggctgctatctagggttcaaccacgcgctccctgtctgcggaggttgtggggaagaggagctcgccctgaggtggcgggacggagaagggcctgggcctgggggtggagacgcagctcaagcgaacaggggccaggacctgctgccgcattgggtagagtggaagctgcccactaccagctggtttatacctgtaaggtgtgcgggacccggtcctccaaaagaatctctaaactagcctaccatcagggggtggtgatcgtgacttgccctgggtgtcagaaccaccacataattgcagataatctgggctggttttctgatctgaatggtaaacgtaacatcgaggagatattgactgccagaggtgagcaagtccaccgtgttgctggagagggagctttggagttggtgctggaggcagccggtgctccaacctccaccgcagcacccgaagccggagaggacgaagggccaccctctcctggcaagacggaaccctcttag

SEQ ID NO: 49919 - DNA, 1617 bp, Artificial Sequence
  Description of Artificial Sequence: Synthetic coding sequence
atgacacgcgaatgtccttcaccagcgcctgggccaggggctcccctctccggatcagtgttggcagaggccgcagtggtcttcgccgtcgtcctgtctatccacgccacggtgtgggatcgatattcttggtgtgctgtcgccttagcagtgcaagcattttatgttcagtacaaatgggatcgtctgctgcagcaagggtcagctgtatttcagttccggatgagtgcaaactcagggttattgccagcttctatggtgatgcccctgttaggattggttatgaaagaacgctgccaaactgccggtaaccccttcttcgagaggtttggcatagtcgtggccgctacaggcatggctgtcgccctcttcagctccgtcctggccttggggatcactagaccagtgccaacgaatacctgcgtcattctgggactagctggcggtgtgatcatctacatcatgaaacacagcctctcagtaggcgaggtcatcgaggttctcgaagtactcctaatttttgtatacctgaacatgattcttctgtatctcctgccgcgatgctttacgcctggggaagctctgctggtcctgggagggatttcttttgtcctgaatcagctgattaagcgttctcttactctggttgagagtcagggagatcctgtcgacttctttctcctggttgtggtggtagggatggtccttatggggatcttcttctccactttgtttgtgtttatggatagcgggacgtgggcttcatccatcttttttcatttaatgacatgcgtactgtccttgggcgtggtgctgccatggctgcaccgcctgattcgtcgcaatcccctcctctggctgttacagttcctgtttcagacagatacgcgtatatatctgcttgcgtactggtccctgctggctacactggcatgtttggtggtcctgtaccaaaacgctaaacgcagttcttccgaaagcaaaaaacatcaagcacctaccatagccagaaagtactttcacctcattgtcgtggctacctatatcccaggcatcattttcgacagacccctcctgtacgtggccgctactgtttgtctcgcagtgtttatctttctggaatacgttaggtattttaggataaaaccactgggccataccctgcgctcttttctgtcactgttccttgacgagagggacagcggccctctcatcctgacccatatttatctgcttctggggatgtctctccctatctggctgatcccacggccttgtacccaaaaaggatctctgggtggtgctcgcgctctggttccttacgccggagtgcttgcagtaggtgtgggcgataccgtagcctccattttcggctcgacaatgggtgaaatcagatggcccggtaccaagaagacctttgaggggactatgaccagtattttcgcccagataatcagcgtggctctgattcttatctttgattccggggtcgatttgaattacagttatgcatggattctgggctcaatctcgactgttagcctgttagaagcatatacaacccagattgacaaccttctgctgccgctctacctgcttatcttgctcatggcctag

SEQ ID NO: 49920 - DNA, 801 bp, Artificial Sequence
  Description of Artificial Sequence: Synthetic coding sequence
atgacaagggagtgcccgtctcctgcccctggaccaggtgctcccttatcgggttctgtgctggctgaagctgccgtggtcttcgcggttgtactgtctatccacgcgaccgtgtgggacagatacagttggtgcgccgtcgccctcgcagtgcaagctttctacgtccagtataaatgggaccggctgctgcagcagggctctgccgttttccaattcaggatgagcgctaattcaggcttactacccgcaagtatggttatgcctctgctaggactcgtgatgaaagaaagatgtcaaactgcaggaaatccttttttcgaaaggttcggaattgtcgttgccgctaccggtatggccgtggcgcttttcagttcagtacttgctctaggcattacacggccagttcctaccaatacatgtgtgattttgggcctggctgggggagttattatctatattatgaagcactccctgtccgtaggggaggttatagaagtcttagaagtgctgctcatctttgtgtatctgaatatgatcctactgtacttgctccctcgttgctttacgcccggagaggccttgcttgtcttgggaggaatttcatttgtcttgaaccaactgattaagcgcagtctgacgctggtcgagagtcagggggatccagtcgattttttcttactggtcgtggtggtgggcatggtactcatgggaatctttttcagcacattattcgtatttatggacagtgggacgcgcccaccgccaagccctgaaagcataagcacatccctgtggtag

SEQ ID NO: 49921 - DNA, 717 bp, Artificial Sequence
  Description of Artificial Sequence: Synthetic coding sequence
atggccgcagacggccagtgcagcctccctgcgtcctggcgccctgtcactctgacccatgtggaatatccagcaggggatctctcaggacacctgcttgcttacctctctctgtcccctgtgttcgtgatagtcggattcgttaccctgatcattttcaaaagggagcttcatacaatatcttttctggggggtttagccctgaatgagggggtgaactggcttataaaaaacgtgattcaggagcccagaccctgtggaggcccacacacggcggtcgggactaaatatggcatgccctcctcgcactctcaatttatgtggttcttctcggtttatagtttcctctttctgtacctgcgcatgcatcagaccaacaatgcacggtttttggacctcctctggaggcacgtgctgtctctgggtttgctggcagtggcgttccttgtctcctactcacgcgtgtacttgttgtaccatacctggtcccaggtcttatacggcggtattgcaggtgggctgatggctatagcatggttcatctttactcaagaagtacttaccccattgtttccaaggatagcagcttggcctgtgtcggagttttttcttatcagagacacctcccttatccccaatgtcctatggtttgagtatacggtgacaagagctgaagctagaaacagacagcgcaaattagggacgaagctgcagtag

SEQ ID NO: 49922 - DNA, 588 bp, Artificial Sequence
  Description of Artificial Sequence: Synthetic coding sequence
atggccgcagacggccagtgctccctccccgcttcttggaggcccgttaccctgactcacgttgaatatcccgcaggcgacctctcaggtcatttgcttgcgtatctttctctgtcccctgtctttgttatcgtgggcttcgtcaccctgatcatcttcaaacgagaactgcacacaataagcttcctcggcggacttgcactcaacgagggagtgaattggctcatcaagaacgttatccaggaacctcgtccatgtggtggcccacacaccgcggtggggacaaaatacgggatgccctcctcccatagccagttcatgtggtttttttctgtctattctttcctctttctatacctgcgtatgcaccagacaaataacgctcggtttctcgacctgctctggcggcacgtgctcagtcttggtctcctggctgtggccttcctggttagctactcccgccctgttagcgaatttttcctaatccgcgatactagcctgatccccaacgtactttggttcgaatacacagtcacaagagccgaagccaggaacagacagcgtaaattaggaactaagttgcagtag

SEQ ID NO: 49923 - DNA, 294 bp, Artificial Sequence
  Description of Artificial Sequence: Synthetic coding sequence
atgccgtctagccactcacagttcatgtggttcttctccgtctactccttcctgtttctatacttgagaatgcaccagacaaataacgcaagatttttggatctgttgtggcggcatgtgctgtctcttggactcctggcggtagcttttctggtgagctacagcaggccagtgagcgagttttttttaattcgagacacttctctgattcccaatgtgttgtggttcgagtatacggttactcgagccgaagctcggaaccgacagcgtaagctcgggaccaagctgcagtag

SEQ ID NO: 49924 - DNA, 1227 bp, Artificial Sequence
  Description of Artificial Sequence: Synthetic coding sequence
atgtgggctttttccgaactgcctatgccattgttgatcaaccttattgtaagcctgctcggctttgtcgccactgtaaccctgatcccagcattccgcggacatttcatcgccgcacgcttgtgtggacaggatctgaacaagacctcgagacagcaaatccccgagtcccagggggtcatctctggtgctgtcttcctgatcattcttttttgctttatccctttccctttcctcaattgcttcgtgaaagagcagtgtaaagcatttccacatcacgagttcgtagccttaattggagcactgcttgccatttgttgcatgattttcctgggcttcgcagatgacgtcttaaatcttcggtggagacacaagctgttgctgcctacagctgccagcctccctttgttgatggtgtattttaccaattttggcaatactacaatagttgtccccaaaccattccgaccaatcctcgggcttcatcttgacctcggcatattgtactacgtctacatgggcctattggcggtcttttgtaccaatgcaataaacattctggccggaatcaatggattggaggccggacagtccttggttattagtgcctctataattgtgtttaacttagtagagttggagggcgattgcagagacgatcacgttttcagcttgtacttcatgattcctttcttcttcactacactcggactgctttaccacaactggtatcccagtcgggtttttgtgggcgacacattttgctatttcgctggaatgacgtttgctgtggtgggtatcctgggacacttcagcaaaactatgctgctgttctttatgccacaggtctttaatttcctatatagcctgccccaactgcttcatatcataccttgtccccgtcacagaatccccaggctgaacattaagacaggaaaactggagatgtcttattccaagttcaaaaccaagtcactctccttcctgggcacgtttattttgaaggtggccgagtccctgcaattggtgactgtccatcaaagcgagaccgaggacggggagttcacggagtgcaataatatgacactcatcaacctgctcctgaaggtcctgggacccatccacgagcggaacttgacactactcctgctactcttacagattttgggcagtgctatcacgttctcgatacgatatcagttagtgagattgttttatgatgtgtag

SEQ ID NO: 49925 - DNA, 1227 bp, Artificial Sequence
  Description of Artificial Sequence: Synthetic coding sequence
atgtgggcattttcagagttgccaatgcctctgctgattaatctaatcgtatcattactgggatttgttgctacagtcaccctgattcctgcattccggggtcacttcatagcggctcggctgtgcggtcaagatttaaataagacttcccgacagcaaatcccagaatcccagggagtcatttccggagctgtgtttcttatcatcctattttgttttatcccattccctttcctaaactgcttcgttaaagagcagtgtaaagcttttccgcatcacgaattcgtggctctcatcggcgcactgctggccatttgctgcatgatcttcctgggctttgccgacgacgtgctgaacctgcggtggaggcacaagctgctcctcccaactgctgcatccttgccactcctcatggtctatttcactaatttcggaaacactactatcgttgttcctaagccttttcgtccaattctgggcctccatctggatcttggcatcttatactatgtttacatgggactgctcgccgtcttctgcaccaacgctatcaatatcctagctggtattaatgggctggaggccggtcaatccttagtcataagtgcctccatcatcgtgtttaatctggtcgagttggagggggattgccgggatgaccacgtttttagcttatactttatgattccattcttctttacaaccttaggcttactgtaccataactggtaccctagtcgggtatttgtgggtgataccttctgttactttgccggaatgacatttgcagtggttggaattctggggcactttagtaaaacaatgctgttattcttcatgccacaggtcttcaatttcctctattctctgcctcagttgctgcacatcattccctgtcctcgtcatcgaatcccccgactcaatattaaaactggcaagctggaaatgtcctactcaaaatttaaaaccaaatctctcagctttctcgggaccttcatcctgaaggtggccgaatccctgcagctggttaccgtccaccagtctgagaccgaagacggagagtttaccgaatgtaataatatgactctaataaatctgttgctgaaggtgctgggtcccattcacgagaggaatctgactcttttgctgctgctgttgcagattctgggttcagcaatcaccttcagcattcgctaccagctggtgcggctgttttatgatgtgtag

SEQ ID NO: 49926 - DNA, 984 bp, Artificial Sequence
  Description of Artificial Sequence: Synthetic coding sequence
atgatttttctggggtttgcagacgatgtcttgaacctgagatggaggcataagctgcttttgccaaccgctgccagcctccctttgcttatggtgtacttcaccaacttcggaaatacaacgattgttgtccccaaacctttccgccctatcctggggctccacctcgacttgggcattctatactatgtgtatatgggactgctggccgtgttctgcacaaatgccatcaacattctggccggtatcaacgggttggaggccggacaatcccttgtgatatctgctagtattatcgtatttaacctggtggaactcgagggtgactgtagagatgatcatgtcttctctttgtattttatgatcccgttcttttttaccacgttagggcttttgtatcacaactggtaccctagcagagtcttcgttggggacaccttctgttatttcgccggaatgacttttgccgttgtgggcatcttgggtcattttagtaagacaatgcttctgtttttcatgcctcaggtcttcaattttctgtattctttgccgcaactcctgcacatcataccttgcccacggcacagaattcctaggctgaacattaaaacaggtaaattagagatgtcttactcaaaattcaaaactaagtctttgtcttttcttggcacatttatccttaaagttgccgaaagccttcagctcgtgacggtgcatcaatctgagacggaagatggcgagtttaccgagtgcaataatatgactctgataaaccttctcctgaaagtgctcggccctattcatgaaagaaatcttacgttactgttgctcctcctgcaagtgagaatgggcatcgagttcatccctccttgtcttcctttttgcgtgatcctgacacctgtccatttctcactgcagatattaggcagtgcgattaccttttctattcggtatcagctagtccggctgttctacgacgtttag

SEQ ID NO: 49927 - DNA, 255 bp, Artificial Sequence
  Description of Artificial Sequence: Synthetic coding sequence
atggcaaccggcacggaccaagtggttggccttggtcttgttgccgtatctcttataatttttacatattacaccgcttgggttattttgctgcctttcatagattcccagcacgtgatccataagtactttctgccacgcgcttatgcggttgccatcccactcgctgccggtcttctcctactgctgttcgtaggtctcttcatatcttacgttatgctgaaaacaaaaagggtgactaagaaggctcaatag

SEQ ID NO: 49928 - DNA, 393 bp, Artificial Sequence
  Description of Artificial Sequence: Synthetic coding sequence
atggctactggaactgaccaggttgtggggctgggcctagttgccgtaagcctgatcatcttcacgtattacactgcctgggtaatcctgctcccatttattgactcacagcacgtgatacacaagtatttcctgccaagagcttacgctgtggctatccctctggccgcaggactgctgctgctcctgtttgtggggaaatcttccccccctccgttagatccaggccaaggtttcggaaagacgccccctctgaacatgctcccacacttcgggggtgcgggaagttgtcttccgagaacccacccctggggttttccagtgcaccctagccgcctgccagtgagtaacctttgggtgagttggtgccctagactcttcggcctccaatag

SEQ ID NO: 49929 - DNA, 7110 bp, Artificial Sequence
  Description of Artificial Sequence: Synthetic coding sequence
atgaacaccgaagagctcgagctgctaagcgattccaaatatcggaactacgtggcagcgattgataaggctctgaagaactttgagtatagttcggagtgggctgacttaatctcagcactcggaaagctgaataaggtgctgcagaacaacgctaaataccaagttgtccccaagaaactaactatcggcaaaaggctggctcagtgtctgcaccctgcccttcccggaggcgtccatagaaaggctctggagacatacgaaatcatcttcaaaatcatcggccctaagaggctggctaaggacctctttctctatagctctggcctgtttccacttctggctaacgcagcaatgtcagtcaagccaacattgctgtctctatacgagatctactacctccctttaggcaaaactctgaaaccaggactccagggcctgttaactggcatcctgccgggtcttgaggaaggctccgaatactatgagcgcacgaatatgctgctggagaaggttgccgctgccgtggaccagagtgcattctatagcgcactgtggggctctttgttgacctctcccgcagttaggctaccagggattacttatgtcctcgctcacctgaaccgcaagctaagtatggaagaccagttatatatcatcgggagtgatattgaactgatggtagaagcggtcagtacatccgtacaagacagttccgtcctggtgcagcgttcaacactggacctcatcctgttttgtttcccattccacatgagccaggccactagacccgacatgatccggattctctctgctgctctgcatgtagttctgcggcgtgacatgtccctgaaccgaagactctacgcctggctgttgggcccaaggtccacacgccactccaatcccgaggagcatgcaacatactactttaccacttttagcaaggaacttcttgtgcaggccatggtgggtattctgcaggtgaacggattcggggaagagaatactctcatgcaagacctcaaaccatttagaattctgatttcacttctcgataagcccgaactgggcccagtgatcctggaggatgtgctcatagaggtgtttcgcaccctctattcccagtgtaaggccgaattggacctgcagactgagcccccattttctaaggatcacgcccagctcagctctaagctgagggaaaacaaaaagacggcggaactgatcaagacggccaatctgctcttcaattctttcgagccatactacatgtgggattacgtggcacgctggttcgaagaatgttgccggagaacccttcatgtgagactgcagattggaccaggcgatagcaatgattcatccgagctgcagctgaccaacttctgtctgcttgtggacttcttgcttgatattgtgtcacttgaaacttacatcgagatacagactgaacatctgcctcaacttttgctgcgcatgatcagcgccctaactagtcatttacagactcttcacctttctgagctgaccgactcactgcggttatgtagcaaaatcctgtcaaaagtgcagccccctctgctcagtgcatcaacggggggtgtgcttcaattcccaagcggtcagaacaactccgtgaaggagtgggaagataaaaaggtatcatcggtatcgcacgagaaccctaccgaggtcttcgaggacggagagaatccgccaagcagcaggtcaagcgaaagtgggtttacagagtttatccaatatcaagctgaccggacagacgatatcgaccgggagctgtccgagggccaaggagccgcagccatcccaatcgggtccacgtcctctgagaccgaaactgcttccactgtggggagtgaggagaccatcatccagacccctagtgtcgttacccaaggcaccgctacccgatctagaaagaccgctcagaaaactgccatgcagtgttgccttgagtatgtccaacagttcctcactagattaattaacctgtatatcatacagaataactctttcagccagtccctcgctaccgagcaccagggtgatctgggcagggaacagggggagaccagcaaatgggaccgcaacagccagggggatgtaaaggagaagaacattagtaaacagaaaacctctaaagagtatttgtctgcattcctagctgcttgtcagttatttcttgaatgttcttcattcccggtgtacatcgctgaaggtaatcatacctctgaactcaggagcgaaaagctggaaaccgactgtgagcatgtgcaacctccccaatggctgcagacgctgatgaacgcttgttctcaagcgtcggatttttcagtgcagtctgtcgccattagtctcgtgatggacctggtcggactgactcaatctgttgctatggtgacaggggagaacatcaacagcgtcgaacctgctcagcccttatcccccaatcagggtcgggtcgcggtggttatccggcctcctctgactcaggggaatctgcgatacatcgcagagaagaccgagttcttcaagcatgtagcactcactctttgggaccagctgggtgacggcaccccccagcaccaccagaagagcgtcgaacttttttatcaattgcacaacctagttccttctagtagcatttgtgaggatgtgatttcgcaacaacttacacacaaagataaaaagattcggatggaggcccacgccaagtttgcagttctgtggcacctaacaagggatctgcacatcaataagagcagctcattcgttcgcagtttcgatcgaagtttgttcattatgctcgactcacttaactctttagatgggagcacctcatccgtgggccaagcctggctcaatcaagtgttgcagaggcacgatattgcacgcgtgctcgaacctctgctcctgctgcttctgcatcctaagacgcagcgggtgtccgtgcaacgggtacaggctgagaggtactggaataagtccccctgttatcctggcgaggagtcagacaagcactttatgcagaatttcgcttgttcaaatgtgtcccaggtacagctgatcacgtcaaaggggaacggcgagaagcccctgactatggatgaaatcgagaatttctcactgacggtgaatcccttgagcgatcgtctctccctgctctccacctctagtgagacaattcccatggtagtgtccgacttcgaccttcccgatcagcaaattgaaattttgcagtcgtctgactccggatgcagccagtccagtgcaggcgataatttaagctatgaagttgaccccgagacagtaaacgctcaggaggactctcagatgccgaaggaatcttctcctgatgacgacgtgcaacaggtggtgtttgacttaatctgtaaggtagtgagcggattggaagtagaaagtgcctcagtcactagccagctcgagatagaggcaatgccccctaagtgttcagacatcgaccccgatgaagaaactatcaagatcgaggatgattccatccagcagtcacagaacgccttactgagcaatgagtcaagtcagtttctgtccgtctccgctgaaggtggccacgaatgtgtcgcaaacggtattagtcgaaacagctcgagtccctgtatctccggaacaacccacacactgcatgatagttctgtcgcctcaattgagaccaagtctcggcagcgttctcatagcagcattcagttcagctttaaggagaaactgagcgaaaaggtgagcgagaaggaaaccatcgtgaaggagtctggtaaacagcctggagctaaacccaaggtgaaactggctcgcaagaaggatgacgacaagaagaaatcgagcaatgaaaagctgaagcaaacgtcagtcttcttcagtgatggtttagacctcgagaactggtatagttgcggtgagggcgacataagtgaaatcgagtccgacatgggctcacccggaagcagaaagtcccctaacttcaatatccatcccctgtatcagcatgttctgctttacctgcaactttacgacagttcacgaaccctgtacgcgttcagcgcaatcaaggctatcctgaagaccaaccctatagctttcgtaaatgccattagcacaacatcagtgaacaatgcttacaccccgcaactgtccctgcttcagaatctcctggccagacaccggatttctgtcatgggaaaggacttctattctcatattcctgtggactccaaccataattttagatcctcaatgtacattgaaatactgatatccttgtgcctgtattatatgcgaagccattatcccacacatgtgaaagtcactgcacaggacttgattggaaatcggaatatgcagatgatgagcatagaaatactgacccttttgttcacagaactggcaaaggttattgagtctagtgcgaagggcttcccgtcgttcatatctgatatgctgtccaaatgcaaagtccaaaaggtgatccttcattgtcttctgtcctccatcttctcggcccaaaaatggcactcggagaagatggctggcaagaatttggtagcagttgaggagggattcagtgaggatagtcttattaatttttccgaagacgagttcgacaatggcagcacactacagtcgcagctgctcaaagtgctgcaacgcctgatcgtgctggagcatcgcgtgatgaccatccctgaggagaacgagacagggtttgatttcgtggttagcgatctggagcacatctcaccacaccagcctatgacctccttacagtacctgcatgcccaacccattacttgtcaggggatgtttctgtgcgcagtcattcgcgctctgcatcagcattgcgcctgcaagatgcatcctcaatggatagggctcattacaagcaccttaccatacatgggcaaagtcttgcaaagagtagtggtgtccgtgacactgcagctgtgccgcaacctagataacctcattcagcaatataagtatgagacaggtctttccgactcaagaccgctttggatggcgtccataattccccctgacatgatcctgaccctgttggaaggaatcactgccatcattcattattgcctcttggacccaaccacccagtaccaccagctcctggtctccgtagatcagaagcatctctttgaagcgagatcgggaattctctcgatcttgcacatgatcatgtcatctgtcacactcctttggagcattctgcaccaggctgactcctctgagaagatgacaatcgcagcctccgcctctctcaccacaatcaatttgggcgcaactaaaaatctgcgccagcagattttggaactgctgggcccaatttccatgaatcatggggtgcatttcatggccgcaatcgcatttgtgtggaatgagcggagacaaaataaaactacaaccagaaccaaggtcatacccgcagctagtgaggagcagctcctgctggtggagcttgtgagatctatctccgtgatgcgcgctgagacagttattcaaacagtgaaggaagttttgaagcagcctcctgccattgcaaaggataaaaaacacctctctcttgaggtctgtatgttgcagtttttttatgcctatatacagagggttctgaacgagttcatcatgaagaatccatcattggaaaacaagaaagatcagcgagatctgcaggatgttactcacaaaattgttgacgccatcggagcaatagccggatctagcctggagcagacaacttggttgcgtcggaatcttgaggttaagccatcgcccaaaatcatggtggatggaacaaatcttgaaagcgacgttgagggaatcctggtgaaacatctcgggctcctgtccgttctggcgcatctgctggatatggtgttttatagcgacgagaaagagcgggtaatacctctcctggtgaacataatgcattatgtggttccctacctgagaaaccacagtgctcataacgcccctagctacagggcctgcgtccagttgctaagtagcctgtctgggtatcaatacactcgccgagcctggaagaaggaggctttcgatctctttatggatccgtcattttttcagatggatgctagttgcgtgaaccattggagagccatcatggataacttgatgacgcacgacaagacaacattcagggacctcatgactagggtggccgtggcacagtcctcttccttgaacctttttgccaacagggatgtcgaattagaacagagggccatgctgttaaaaagactggcgtttgctatctttagcagcgagatcgatcagtaccagaaatacctgccagatatccaaggcatccccgtttctaaatgggtgcagcttctgacggcgctttccccagcttatcgaactagcgggcctagcgtagccggactagagactacttacactggaggtaatggcttcagcacgagttataattcacagcggtggttaaatctttacttatcggcttgcaagtttttggacctggccctggccctgccatcagagaatctgccgcagttccagatgtaccgatgggccttcatccctgaggcatcagatgattctggactggaggtacgtcggcagggcatccatcagcgagagtttaagccctacgtcgtacggctagcgaagctactaagaaagcgcgctaaagataaggaggaggatttcaaaactgtcattctcgagggtttagagatggctaaacatcaaaagaatccagaagaggacaattctggaagaactctaggctgggaacctggacatctgctgctgaccatctgtaccgtgaggtccatggaacaactgctgccctttttcaatgtgctctcccaggtgtttaactccaaggtgacatcccgctgtggcggacacagcgggtcacccatactgtactccaatgcgtttccaaataaagacatgaagttggagaatcataaaccctgttcatccaaggcccgtcaaaaaattgaagagatggtagagaaagacttcttggagggcatgattaagacctac

SEQ ID NO: 49930 - DNA, 7397 bp, Artificial Sequence
  Description of Artificial Sequence: Synthetic coding sequence
atgaacaccgaggagttagagcttctgagcgacagtaagtacagaaattatgtggccgctatcgacaaggctcttaagaactttgagtatagcagcgagtgggctgatctgatttctgcgctgggcaaacttaataaagtgcttcagaacaacgctaaatatcaggtcgtgcccaaaaagctgactatcggaaagagacttgcccaatgtttgcacccagcccttccaggcggtgtgcaccggaaggcgctggaaacttacgagatcatttttaagatcatcggacctaagcgactggccaaagacctcttcctctactcttctgggttgttccctttgctggctaatgcggcaatgtcagttaagcccacccttctttccttatacgaaatctattacttaccattgggaaagacactaaaacccggactgcaaggcttgctgaccggcatccttccgggactggaagaagggagcgagtactacgagcgtactaatatgctgctggagaaggttgcagcagccgtggaccagtccgccttctacagtgcactttggggctccctgctgacctcacctgccgttcggctcccgggaatcacatacgtattggcacacctgaataggaaactgtcaatggaggaccaactctatataattgggagcgacattgaactgatggtggaagctgtgagtacctccgtccaagacagtagcgttttagtccagaggtcgaccctcgatttaatccttttctgttttccttttcatatgtcccaggccacaagacctgatatgatcaggatcctgtcggcagcactacacgtcgtgctgcgcagagacatgtcgttgaataggcggctatatgcctggttactaggctttgacaacaacggggctatcattgggcctcgaagcacacgccatagtaacccagaggagcacgcaacttactactttaccacttttagcaaggaactgctggtacaggctatggtaggcatattgcaggtgaacgggtttggggaagaaaatacccttatgcaggacctcaaaccatttcgtattttgatctccctcctggataaacccgagctaggacccgtgatcctggaagatgtgctcatcgaggtttttcgcactctgtacagccagtgcaaagccgagctcgatctacagaccgaaccccctttcagcaaggatcacgcccagctgtctagtaaacttagggaaaacaaaaaaactgctgagctgattaaaaccgcaaacctcctgtttaatagtttcgaaccgtactacatgtgggactatgtcgcaaggtggtttgaagaatgctgtcgacgcaccctccacgttcgcctccagatcggccctggcgacagtaatgattccagcgaactgcagctcacaaatttttgtcttctggtggatttcctgctggacatagtctccttgccgacccggtcaatgcgcgtcctctgtcaggagacctacattgagattcagacggagcacctgccccagctcctcctgagaatgatctccgccttaacctcccaccttcagactttacatttgtccgagctcaccgattcattgcgtctttgctcaaaaattctcagtaaagtgcagccccctctactgagcgcgtccacgggcggagtcctccaattcccatctgggcagaacaattcagtcaaggagtgggaagataagaaagtgtcatcagtgtctcacgagaaccccactgaggtattcgaggatggagaaaaccctccatctagtaggagctctgaatctgggttcacagagttcattcagtaccaggctgataggactgatgacatcgaccgggaactttccgaggggcaaggagctgcggctatccctataggctcgacatccagcgaaaccgagacagcgtcaacagtcggcagtgaggagaccattattcagaccccatctgtcgtgacccaggggaccgccacccggagtaggaagactgcccaaaaaacagcaatgcagtgctgtctggaatacgtgcagcagtttctcactagattaattaatctctacatcatccaaaataattctttttcacagagcttggccactgagcaccagggcgatctgggcagggaacaaggcgagactagcaagtgggaccgcaattcccagggtgatgtgaaagagaagaacatatccaagcaaaaaacgtctaaggaatatctcagtgcctttctggcggcatgtcaactctttctggagtgttcttcattcccagtctatatcgctgaggggaatcacaccagcgagctaagaagcgaaaagctggagacagactgtgaacacgtccagcccccacagtggctgcagactctgatgaacgcctgttcccaggccagcgacttttccgtccagtccgtggccatttccctggtcatggatctagtcggtctcacacagagcgtggcaatggtaacaggggagaatattaactcagtagaacccgcacaacccctctcaccaaatcagggtcgtgtcgccgtcgtgatcaggcctccacttacccaaggcaatttgcgctacattgccgaaaaaactgaattcttcaagcacgttgcgctgactctgtgggatcaattaggcgacgggactccccagcatcaccagaagtccgtagaactattttatcagctgcacaacctagttccgagttcttccatctgtgaggatgtgattagtcagcagctgacgcacaaagataaaaaaatcaggatggaagcccatgctaaatttgcagtcctttggcatcttacaagagatctgcacataaataagagctcctcgttcgtcagatcatttgaccgtagtctctttatcatgctagactccctgaatagcttggacggatccaccagctctgtcgggcaggcctggttaaaccaggtgctccagcggcacgatatcgcgagggtgctagagccccttttgctgttgcttctccaccctaaaacccagcgcgtcagcgtccagagggtgcaggctgaacgctactggaacaagtccccctgctacccaggtgaggaaagcgataagcatttcatgcaaaattttgcttgctctaatgttagccaagtgcagttaatcacatctaagggcaacggggaaaagccactgaccatggatgagatagaaaacttttcccttacagttaaccccttatcagaccgcctatcactgctaagtaccagcagtgagaccattcctatggtggtttcagactttgacctgccagaccagcagattgaaattctgcaatccagcgacagtgggtgctcccagagctccgctggtgacaacttgtcttatgaggtcgaccctgagacggtgaacgcacaggaagattctcaaatgccgaaggagtcttctccagacgacgatgtgcagcaggtcgtgtttgatttgatctgtaaggtggtcagcgggctggaggtggagagcgcatctgtgacaagccaattagagatcgaggctatgcctccaaagtgcagtgacatcgaccctgatgaggaaacaattaagatcgaagatgacagcattcagcagtctcaaaatgccctccttagcaatgaaagcagccaatttctctcggtgagcgccgagggagggcacgagtgcgtggccaacggcattagccgtaacagttcatccccatgcatctccggaaccacacacacgttacacgactcctccgttgctagcattgaaacaaagtcacgccagagatcccatagcagtatccagtttagctttaaagaaaagcttagtgaaaaggtttcagaaaaggagaccatcgttaaagagtcaggaaagcagcctggagcaaagcccaaggtgaagttggccagaaaaaaggacgacgacaaaaagaagtcttcgaacgagaagctgaaacaaactagtgtatttttttcagatggtcttgatttagaaaactggtactcctgtggggagggggacatctccgaaatcgaaagcgatatgggctctccaggctctagaaaatccccaaactttaacatccacccgttgtaccagcatgtgctactctatctgcaattgtatgattcgagccggaccctgtatgcctttagcgcaatcaaagctattctgaagaccaacccaatcgccttcgtgaacgcaatcagcaccacgtcagtgaacaacgcctatacccctcagttaagcttgttgcaaaaccttctggctaggcaccgcatcagcgtgatgggtaaagatttctactcgcatatccctgtcgactccaatcataactttagaagctctatgtacatcgagattcttatttctttgtgcctgtactatatgcggagtcattatcccacccacgtgaaggtcaccgctcaggacctgattggaaaccgaaatatgcagatgatgtctatcgaaatactgaccctactgtttacggagttggccaaggtaatcgagtctagcgccaaagggtttccatctttcatttcggacatgctatcaaagtgcaaggtacagaaagtcatcttacactgtctcctgagctccatcttctcagcacaaaagtggcactcagaaaagatggctggtaaaaacttggtggccgtcgaagaaggatttagcgaggactccctcatcaattttagtgaggacgagtttgataacggaagtaccttgcagtcccagctgttgaaagttctgcagcgcctgattgttctcgagcatagagtcatgaccattccggaagaaaatgagacgggatttgattttgtggttagcgacctggagcacatctctccccatcagcccatgacatcccttcaatacctccacgcccaacccatcacatgtcaagggatgtttctatgcgcagtgatcagggcactgcaccaacattgtgcatgcaaaatgcacccacagtggatcggactcattaccagcaccctgccttatatgggcaaggtgctccaaagagtagtggtgtccgtgaccctccagctttgtcggaacctggacaacctgatccaacagtacaaatacgaaacaggtctgtcagacagtcgtcccctttggatggctagtattatccccccagatatgatcctgactctcctggagggaattaccgctatcatccactactgtctgttagacccaaccactcagtaccaccagcttttggtgtctgtggatcagaaacacttgttcgaagcccgatccgggattctgagcattttgcacatgattatgtcttcagtgactctgctgtggtctattctgcatcaggccgactcgagcgagaagatgaccatagccgcaagtgcatctctgaccactatcaatctgggagccactaaaaatttgagacagcagatactggagctgttggggccaatatccatgaaccacggcgttcacttcatggctgcgatcgcctttgtgtggaatgaacggcgacaaaacaagaccacaacaagaacaaaggtcatccctgcggcaagcgaagagcagctgctgctggtggagcttgtgagatcaatctccgttatgcgggctgaaaccgttattcagaccgtgaaagaagtcctaaagcagccgccagctatagctaaggataagaaacacctatctctggaggtctgtatgttacagtttttctacgcatatatccagagaataccagtcccgaatctagtggactcttgggcgagtcttctgattcttctgaaagacagtattcagctgtctttacctgcaccaggccaattcttgatattgggggtccttaatgagtttattatgaagaacccgagcctggaaaacaagaaagaccagcgcgatttacaggatgtgactcacaagattgtggatgctattggcgctatcgctggctcttccctggaacagacaacatggctgaggagaaacttggaggtcaaacctagcccgaaaatcatggtggatggtacaaaccttgaaagcgacgtggaggacatgctctctcccgctatggaaaccgccaacatcacgccttccgtgtactctgtgcacgcgctgacactcttaagtgaggtgctggctcatcttcttgacatggtgttctattcagatgagaaggaacgcgtaatccctttgttagttaatataatgcactacgtagtgccctacctgcggaaccattccgcgcataacgcaccttcctaccgggcttgcgtgcagttgctgtcttccctatcaggataccagtacactcgcagggcctggaagaaggaggccttcgatctgtttatggaccccagcttctttcagatggacgcctcctgtgttaaccactggagagccatcatggacaatttgatgacacacgacaagacaacattcagagacctaatgacacgcgtcgcagttgcacagtcaagttcactcaatttgtttgcaaatcgtgacgtagagctggagcaaagggccatgctcctcaagcgcctggccttcgctatcttttccagcgagatcgatcagtatcaaaaatacctcccagacattcaggagaggctagtggaaagtctaaggctgccacaagtgccaactttgcattcacaggtcttcctcttcttccgagtgctgctgctgcgtatgagccctcaacatttgaccagcctatggcccacaatgattacagaactggtacaggtctttctgcttatggaacaagagctgaccgccgacgaggatattagcagaacctcaggccctagcgtcgctggactagagacgacctataccggaggtaacggattctccacctcctacaattcacagagatggctgaacctgtaccttagcgcctgtaagtttctagacctcgcgctggccctgccaagcgagaatctgccacagtttcagatgtaccgatgggcgtttattcccgaagcaagcgatgactccgggctggaagtccgcagacagggcatccatcagagagagttcaagccatacgtagtgcggctggctaaactgcttcggaagcgggcaaagaagaatcccgaggaggacaattcaggtcgaactctgggctgggagcccggacacttgcttctgaccatctgtacagtccgctcaatggagcagctcctcccgttcttcaatgtgctatcacaggtgtttaattccaaggtgaccagccgatgtgggggacactcagggtcccctattctgtattcaaacgccttccctaacaaggatatgaaactcgagaaccacaagccgtgcagctcaaaggcacgtcagaaaatagaagaaatggttgagaaggactttctcgaaggaatgattaaaacata

SEQ ID NO: 49931 - DNA, 7109 bp, Artificial Sequence
  Description of Artificial Sequence: Synthetic coding sequence
atgaacacagaagaactcgagcttctttccgactcaaaataccgcaattatgtcgcggctatcgacaaggccctcaagaatttcgaatatagctccgaatgggccgacctgattagcgcattagggaaattgaacaaggtgctgcagaataacgcgaaataccaggtggtgcctaaaaagttgacgatcggcaagcggcttgcgcagtgcttacatcctgctcttcccggaggagtgcacagaaaagccctggaaacttatgagataatattcaaaattatcggcccaaaaagattggccaaggacttgtttctatactcatcagggctctttccacttcttgctaacgctgctatgtctgtcaaacctacccttctgtcattatacgagatttattacttgccgctgggcaaaacactgaaacccggacttcagggccttctgacagggattctgcccggattggaagagggctcagagtattacgaacgaaccaatatgctcctggagaaagtcgccgcagcagtagatcagagtgctttctactccgccttgtggggtagtctgcttacctctccagccgtgcggttacccggtataacatatgtactggctcatctgaaccgcaaacttagcatggaggatcagctgtacattatcggttcagatattgagttgatggtggaggccgtgtctactagcgtacaggacagctccgtcctggtgcagcgatcaaccctggacctgatactcttctgcttccccttccatatgtcccaggccacgcgtccagatatgatccggatattgtcggcggctttacacgtggttctgcgaagagatatgagcttgaacagaagactttatgcctggctgctaggcccacgatctaccaggcactctaatcccgaggagcatgcaacctattatttcaccaccttctctaaggaactcctggtccaagccatggtcgggatactacaggtcaacggattcggggaagaaaacaccctcatgcaagatctgaagccgtttcggatccttataagtttgctggataagccagaacttgggcctgtgatcctggaagacgtactgatcgaagtatttcggaccctgtatagtcagtgtaaggccgaactggacctccaaacagaaccccctttctctaaggaccatgcccagctctcctctaaacttagggagaataagaagacagcagaattaatcaaaacagccaatctgcttttcaatagtttcgagccttactacatgtgggactacgtggcaaggtggtttgaggagtgctgcaggcgcacactgcatgtgcggctgcagattggtccaggtgactctaacgacagttccgaactccagctcacgaacttttgtttgctcgtggacttcttgctcgacattgtgagcctggagacttatattgaaatacagacagagcatctcccccaattgctcctgcggatgatttccgccctgacgagtcatctgcagaccctgcacctgtccgagctgacagacagtcttaggctttgttcaaaaatattgagtaaggtacagccgcctctcctgtccgcgtcgactgggggagtgttacaattcccgagtggacagaacaatagtgtcaaggagtgggaagataagaaagtttcgtccgtaagtcatgaaaatcctaccgaggtgtttgaagacggcgaaaaccctccctcaagcagaagcagcgagtctggatttactgagtttatacagtatcaagccgaccggacagacgatatcgaccgcgaactctcagagggacaaggggcagcggctataccgatcgggagcacttcgtccgaaacagagactgcatccacagtggggtccgaagagacaataatccagaccccatccgtggtgacccagggtaccgctaccagatcacgcaagaccgcccagaaaaccgctatgcagtgttgcctggagtatgttcagcagtttcttacccgcctgattaacctgtacatcattcaaaacaatagcttctcccagagcttggcaaccgagcaccagggtgacctgggacgcgaacagggggaaacgtcaaagtgggaccgcaatagccagggtgacgtgaaggagaaaaacattagcaagcagaaaacaagcaaagagtatctttctgctttcctcgcggcatgccagctgtttctggagtgttctagctttccagtgtacatcgcagagggtaaccacacgtccgagttaaggtcggaaaagttagaaactgactgcgaacatgtgcagcctccccagtggctccagaccttaatgaacgcctgttcccaagcttctgactttagtgtacagtccgtggccatctccctggtcatggatctagtgggactcacccagagcgtggccatggtcactggggaaaatatcaatagtgtggagccagctcagcccctcagccccaatcaggggagagtggccgtggtgatcaggcccccattaacacaaggcaacctgcgctatattgcagagaaaacggagttcttcaagcatgtggctctcacactgtgggaccagttaggtgatggcaccccccaacaccaccaaaaatctgtggagctattctaccagctgcacaatttagtgccgtcaagctctatttgcgaagatgtcatttcccaacaactgacacacaaagacaagaagatccgcatggaggcccatgctaaattcgcggtcctgtggcatctgacccgagacctgcatattaataaaagcagttcattcgtgcgctccttcgaccgcagcttgtttattatgcttgattcattaaacagtctggacggctctacgtcatcagtggggcaagcttggttgaatcaagtgttgcagaggcacgacattgcgagggtgctggagccactactgctgctgctgcttcacccaaagacccagcgcgtgagtgttcagagggtccaagctgagcgttattggaataagtctccatgttatcccggtgaggaatcagataaacactttatgcagaattttgcgtgctccaacgttagccaggtgcagttaatcaccagcaagggtaacggggaaaagccgcttaccatggacgaaatcgagaatttttcactgaccgtgaatccgctaagcgatcgcttaagtttactgagcacaagctccgaaaccattccaatggtcgtctctgacttcgatctgcctgatcagcagatcgagatattgcaatcctctgacagcggatgctctcagtcgagcgccggtgacaacttgagctatgaggtggatcccgaaaccgtcaatgctcaggaggatagccaaatgccaaaggagagctcacccgatgacgatgtgcagcaagtggtgtttgacctgatatgcaaagttgtttcagggcttgaagtggaatctgcttccgtcacatcacagttagaaatagaagcaatgcctcctaagtgcagcgatatcgaccccgatgaagaaacgattaagatcgaggatgactctatccagcaatcacagaacgcgttgttatcgaacgagtcgtctcagtttctgagcgtatctgcagagggcggacacgaatgtgtggcgaatggcatatcaagaaatagttcatccccatgtatctccgggaccacacacaccctccacgattctagcgtggctagtatcgagactaagtcacggcagcgcagccactcttctattcagttctcatttaaagaaaaactaagtgagaaggtgtctgagaaagaaaccatcgtaaaagagagtggcaagcagccgggtgccaaacccaaagtgaagctggcccgaaaaaaggatgacgataaaaaaaagtcgagtaacgaaaaactcaagcaaacatccgtgttctttagcgacggactggaccttgagaactggtattcctgcggcgagggggatatcagcgagattgagagcgatatgggatcccccggaagcagaaaatcccctaacttcaacatccatcccctgtatcagcacgttctgctgtatctgcaactatatgattcttcccgaaccctgtatgcgttttccgcgatcaaggcaatcctcaagactaaccccattgcctttgtcaacgcgatcagcacaacgtctgtgaataacgcttatactccccagcttagcctgctccagaacctccttgctaggcaccgaatctccgtaatggggaaagacttttattctcacattccagtcgattctaatcacaactttcgttcttcaatgtatatcgaaatcctcattagcctatgtttgtactatatgagatcccactatccaacgcatgtgaaggtgaccgcccaggatcttattggaaatagaaatatgcaaatgatgtcaattgagatactgacgctgctcttcactgagttagctaaagtaatcgagtcatcagctaaaggctttcccagttttatatcagatatgctgtcaaagtgcaaagttcagaaagttatactacactgcctgctatcttccattttttccgctcaaaagtggcattcagagaagatggccggtaaaaatctcgtagccgtggaggagggtttttctgaagattcactaataaactttagtgaggacgaatttgacaacggaagcacgcttcagtctcaactgctaaaggtgttacagcggctgattgttctggagcacagagtcatgactataccagaggaaaatgaaaccggctttgactttgtggtgagcgacctcgaacatatttcgccacatcagcccatgacgtcgcttcagtatctgcacgcacaaccaatcacctgccaggggatgttcctttgcgctgtgattcgggcactccaccagcattgtgcttgcaagatgcacccacagtggattggattgatcacctctaccctaccttacatggggaaggtgctccagagagtggtggttagcgtaacacttcagctatgtagaaatctggataacctgattcagcagtataagtacgagactggtctgtccgactcgcgaccactttggatggcctccattatcccaccggacatgatcctgacgctcctggagggtattacagctatcatccactactgtttattggatccgacgacacagtatcaccaacttttagtctctgtcgaccagaagcatctcttcgaggccagatcaggcatactctccattttgcatatgatcatgtcttctgtgactctgctttggagcatcctgcaccaggctgattcaagcgagaaaatgaccatagctgcttcagcctctctgactaccatcaacctgggcgcaacaaagaatttacggcagcagattctagaacttttaggtcccataagtatgaaccacggtgttcacttcatggcagccattgccttcgtatggaatgagagaagacaaaataaaacaactaccaggacaaaagtgattcctgccgcttctgaagaacaattgcttctcgttgagctggtgcgcagcatctcagttatgagggcagagacagtgatccaaacagtgaaagaggtgctgaagcagcccccagctattgcaaaggacaagaagcatttgagccttgaagtgtgcatgcttcagttcttctatgcctatatacagagggtgcttaatgaatttatcatgaagaacccgagtctagagaataagaaggatcagcgcgatctgcaagacgtgacacataagatcgtcgacgcaatcggcgctattgctggcagcagcctcgagcagaccacctggctccgaaggaacttggaggttaaaccatcccctaagataatggtggacggcaccaacctcgaatccgatgtcgaggggatcttagtaaaacaccttggtttacttagtgtgttggctcacctgcttgatatggtattttatagcgacgagaaggagcgagtcatccctctgctggtcaacatcatgcactacgtggtaccttacctgaggaatcactccgcccataatgctccaagctaccgcgcttgcgtgcagcttctttcgtccttaagtggataccagtacacacggagggcttggaagaaagaggcattcgatcttttcatggacccctctttcttccagatggacgcaagctgtgtgaaccattggcgggctatcatggacaacttaatgacacatgacaagacaactttccgtgacctgatgacccgagtcgccgtggctcaatccagcagccttaatctgttcgcaaaccgtgatgtggaactcgagcaacgagcaatgttgctaaagaggcttgcgttcgctatattctccagcgagattgatcagtaccagaagtacttgcccgatattcagggcatcccagtcagcaaatgggtgcaattgctgaccgctctgagtcctgcgtatcggaccagcggcccaagcgtagccggtctcgagacaacttacactggtgggaatgggttctctacatcttacaactcccaacgctggttgaatctgtatctgtcagcctgtaagttcctcgacttagcactcgctctgcctagcgaaaacttgccacaatttcagatgtatcgatgggcttttattccagaggcctccgatgactccgggctggaggttcggaggcaggggatccaccagcgcgagtttaagccctatgtagttagattggcaaaactgctgagaaagcgcgctaaggacaaagaggaggatttcaagacagttattcttgagggcctcgaaatggccaagcaccagaagaaccccgaagaggataatagcggacgaactctggggtgggagcctggacatctgctgttgaccatctgcacagtgcgctcaatggaacagctccttccctttttcaacgtcctctcacaagtgtttaactcaaaagtcacatcccgttgtgggggacattcagggtctcctattctttactcgaatgcattcccgaacaaagacatgaagctagagaaccataagccttgcagcagtaaagctcggcagaaaatagaggaaatggtggaaaaggactttcttgaaggcatgataaagaccta

SEQ ID NO: 49932 - DNA, 690 bp, Artificial Sequence
  Description of Artificial Sequence: Synthetic coding sequence
atgaacactgaggaattagagctgctgagcgacagcaaataccggaactacgtggccgcaattgacaaagccctgaaaaattttgaatattccagcgaatgggccgacctgattagcgcactcggaaagcttaataaggtgctgcaaaataatgctaagtaccaggtggtgccaaaaaagctcactatcggtaagcgactggcccaatgccttcacccggcactcccgggaggcgtgcaccggaaagccctggaaacttacgagatcatcttcaaaattatcggcccaaaaaggctggccaaagacctgttcttatactcgtccggcctattcccacttctggcgaacgccgcaatgagtgtcaaacctaccttactcagcctatatgagatctattatctgcccctgggcaagaccctcaagccgggtctgcagggactcctgacaggcatcctgccaggtcttgaggaggggtccgagtattacgaacgaacgaacatgctgttagaaaaggtggccgctgctgtcgaccagtcagccttttattcggccttgtgggggagtctactgacgtctcctgcagtgcggctccctggcataacgtacgtgttggcccacctgaatagaaagctgagcatggaagatcaactctacattatcggctctgatatcgagctcatgaaacaatag

SEQ ID NO: 49933 - DNA, 423 bp, Artificial Sequence
  Description of Artificial Sequence: Synthetic coding sequence
atgcagcgcctgaacatcgggtacgtcattaacgtcaccacccatctgccgctgtaccattacgagaaaggattattcaactataagcgcctgcctgctaccgactccaataagcaaaacctgcggcagtattttgaggaagcattcgagttcatcgaagaggcccaccagtgcggtaaggggctcttgattcactgccaagccggtgttagccgcagtgccacaatcgtgatagcttacttgatgaaacacacccggatgactatgaccgatgcttacaagtttgttaaaggaaaacgtcctataatcagccccaatctgaattttatgggtcagctgttggagttcgaagaagaccttaataatggcgtcacccctagaatcctgacacctaagctgatgggtgttgaaactgttgtgtag

SEQ ID NO: 49934 - DNA, 1449 bp, Artificial Sequence
  Description of Artificial Sequence: Synthetic coding sequence
atgccgccaagcccgctcgacgatcgcgttgtggtagcattaagccggccagttcggccacaagatcttaacctttgtctcgattccagttatctgggctccgccaaccccggtagtaatagccaccccccagtaatcgcaaccaccgtggtgtctttaaaggctgctaatttgacgtatatgccaagcagttctggtagtgcccgatcacttaactgtggatgctcatcagcttcgtgctgtaccgtagctacatatgacaaagataaccaggcccagactcaagcaatcgcggcaggtactacaaccactgcgatcgggaccagtacaacatgccctgctaaccaaatggttaataataacgaaaacacaggctcccttagcccttcttccggggtggggagtcctgtgagtgggacgcccaaacagttagccagcatcaaaatcatctaccctaatgacctggcaaagaagatgaccaaatgtagcaagagccatcttccgtcacaggggccagtcataattgattgtagacctttcatggagtacaacaaaagtcacattcagggcgcagttcacatcaactgcgctgacaaaatttcccgacgccgactgcagcagggcaagatcacagtgttggacctgattagttgtagggaagggaaggacagtttcaagcgaattttttccaaggagattatcgtgtatgacgaaaacaccaatgagcccagccgcgtgatgccctctcagcccctccacattgtgctagagtccctgaagcgtgaaggaaaggagccacttgttctcaaagggggattatcctcttttaagcagaatcatgagaacctttgcgacaatagtttacaactgcaagaatgtagagaagtggggggtggggctagcgccgcaagcagtctcttgccccagccaataccgaccacaccggatattgaaaacgcagaactcactcccattctcccattcctgtttttgggcaatgagcaagacgctcaggatctggacactatgcagaggttaaacatcggctatgttattaacgttacaacgcacttacccctgtatcactatgaaaagggcctcttcaactacaaacggctgcccgctactgacagcaacaaacagaatctacggcaatactttgaggaagccttcgagtttattgaagaggcgcaccagtgtggcaaggggctgcttatacactgtcaagcaggcgtgtccagatctgctactatcgtcatagcctacctaatgaagcatactcgtatgacaatgactgacgcttataagttcgtgaaggggaagcggcctattatctcccctaatctgaatttcatgggccagctgttggagtttgaagaggacctgaataacggagtgacacccaggattctcactcctaaattaatgggtgtcgagacagtggtatag

SEQ ID NO: 49935 - DNA, 1284 bp, Artificial Sequence
  Description of Artificial Sequence: Synthetic coding sequence
atgccaccatcccctctggatgaccgcgtggtggttgcgttgagccggccagtgcgaccccaggatctcaacctgtgtctcgatagctcatatcttggaagcgcaaatcccggtagtaactcccacccacccgttatcacaaccaccgccatcggaacctctaccacttgcccagcaaaccagatggtgaacaacaacgaaaatactggctccctgtcccccagcagcggcgtagggtccccagtttccggcacacccaagcagctagcatctataaagattatctatcccaatgacctggcaaaaaagatgaccaagtgttcaaaatctcatctacccagtcagggacctgtcataatagattgtagaccattcatggagtataataaatcccatatccagggtgcagttcacataaactgtgccgataagatttcacggcgacggctgcagcagggcaaaatcaccgtcttagacctgatcagctgtcgagagggaaaagatagcttcaagcgcatcttctctaaggaaattatagtttatgatgagaacactaacgagcctagccgagttatgcctagccagccgctgcacattgtcttggagtcgctgaaacgcgaaggcaaagagcctctggtcctgaagggaggactctccagcttcaagcagaatcacgaaaatctgtgcgataatagtttgcagctgcaggaatgtcgcgaggttggcggaggagcttccgcagcaagcagcttgttacctcaacctatccctaccacgcccgacattgaaaatgctgagttgacacccatcttgccctttctgttcctggggaatgagcaggatgcacaggatctggatacaatgcagcgactcaacatcggctacgtgatcaatgtcacgacacacctgcccctctatcattacgagaagggactgttcaactacaaacgtttaccggcaacagatagcaataagcagaacttacggcaatattttgaagaggcctttgagttcatcgaagaggcccatcaatgcggaaagggactcctgatccactgtcaggctggcgtgtctcgctcggccacaatcgtgattgcctatctgatgaaacataccaggatgacaatgacagatgcctacaaatttgtaaagggcaagcggcctattatatcaccaaatctgaatttcatgggccagttgttggaattcgaggaggaccttaacaacggtgtaaccccacgcattctaacccccaaactaatgggggtggaaactgtggtgtag

SEQ ID NO: 49936 - DNA, 423 bp, Artificial Sequence
  Description of Artificial Sequence: Synthetic coding sequence
atgcagcgtctgaatattggctacgtgatcaatgttacaacacacctgcctctgtatcactatgagaagggactcttcaattataagaggctgcctgccacggacagcaacaagcaaaatctgcggcagtatttcgaggaagcatttgaatttattgaagaggcccaccagtgtggaaagggcttgctgatacattgtcaggcgggtgtgagcagatccgcgaccatcgtgatcgcctacctgatgaaacacactcggatgaccatgacagatgcatacaagtttgtgaaaggaaagagacccattatcagccctaatctgaattttatggggcagctcttagagttcgaggaggacctgaataacggtgtgacacctagaattctaacacccaaattaatgggcgtggagactgtggtgtag

SEQ ID NO: 49937 - DNA, 888 bp, Artificial Sequence
  Description of Artificial Sequence: Synthetic coding sequence
atgactgaaggagtactgcctgggctgtacctgggcaattttatcgacgcgaaagatctcgaccagctgggaagaaacaaaatcacccatattataagcatccatgagagccctcagccactgctccaagacatcacctacctacgaattcccgtagcggacacacctgaggtgcccataaaaaagcattttaaagaatgtattaactttattcactgctgccgcctgaatggcggaaattgtctcgtgcactgttttgctggaattagcaggagcactactatcgtgactgcctacgtgatgacggtgacaggcttaggctggagggatgtgctggaggctatcaaggccactcggcctattgcaaaccctaaccccggttttaggcagcaactcgaagaattcggatgggctagtagtcaaaagggcgctagacaccggacttctaaaaccagtggtgcccaatgcccccctatgacttccgcgacatgtctgcttgctgcccgtgtggctctgctctccgccgcactggtgcgagaagctaccgggaggacagcacagcgctgtagactatccccgcgagcggctgccgagcgactccttggacctccacctcacgtggcagctggctggagcccagacccgaagtaccaaatctgcttatgcttcggcgaagaggatcctgggccaacccaacatcccaaggagcagttgatcatggctgacgttcaggtccagttgagacctggcagtagcagctgtacactgtccgcatcaaccgagcgcccagacggctcctcaacaccagggaatcccgacgggatcacccaccttcaatgctcttgcctgcacccaaagcgtgctgcttcaagctcctgcacaagatag

SEQ ID NO: 49938 - DNA, 708 bp, Artificial Sequence
  Description of Artificial Sequence: Synthetic coding sequence
atgggaaacggcatgacaaaagtcctccccggtttgtatctcggaaatttcatcgatgcgaaggacttggaccagctgggcagaaataagatcacacacatcatcagcatccacgagtcgccccagcccctgctacaggatatcacttacttacgaattcccgtggctgacacaccggaggtgcccattaagaagcacttcaaagaatgtatcaacttcatacactgttgccgccttaacggcggtaactgcctggtgcattgtttcgccggaatcagtcggtcaacgaccatcgttacggcctacgtgatgactgtaaccggacttgggtggcgtgatgttctggaagctatcaaggctactcgcccaattgccaatcccaatcctgggtttcgacagcagctagaggagttcgggtgggcctcttcacaaaaactaagaagacagctcgaagagcggtttggcgagagcccatttcgcgacgaggaggagctacgggctctgctccctctctgcaagcgctgcagacagggatccgctacgagcgcctcaagcgccggaccacattccgccgctagcgagggcactgtacagcggttagtgcccaggactcctagggaagcacatagaccactccctctcctggccagggtgaagcagacgtttagttgtctcccgcgttgcctctcacgtaaagggggtaagtag

SEQ ID NO: 49939 - DNA, 264 bp, Artificial Sequence
  Description of Artificial Sequence: Synthetic coding sequence
atggggaatggtatgactaagatgcccaaaacatggatttcatgggcagagattcgaagccacacgtcatccttgtctatgtcccatccaagcctttgctgtcggattagtccgacttttgccagtagatctttgattcccctgcgttatcctagcaagagtacgtctaagaacgtatcgacatcttccacagcagcagctctgatgggagggacagcattatgcacggccctgcaggcctcactggcagcccctaggttgtag

SEQ ID NO: 49940 - DNA, 699 bp, Artificial Sequence
  Description of Artificial Sequence: Synthetic coding sequence
atgactgagggggtgcttcctggtctctatctagggaattttatcgacgctaaggacctggatcagctgggtcggaacaaaatcacccatatcattagtattcacgagagtccgcagccgctgctacaggacatcacttacctccggatccccgtcgcagatactcccgaggttcctatcaaaaagcacttcaaggagtgcatcaacttcattcactgctgtagacttaatggtggtaactgtttagtgcactgttttgctggtatttcccgcagcaccaccatcgtcaccgcctatgtgatgacggtaactggcctcggctggcgtgatgtactcgaagcaatcaaggctactcggcctattgcaaacccaaatccaggctttcggcaacagctagaggaattcggatgggcttcatctcagaagctgaggagacaacttgaggagagattcggagaatctccattcagagacgaagaagaactccgcgcactgctcccactttgcaagcgatgtcgccagggaagtgctaccagcgcctccagcgcaggaccccactctgccgctagcgagggaacggtgcaacggttagtccctaggaccccacgcgaagcccatcgcccactgccgctgctcgcccgagtgaagcagactttcagctgtttgccgaggtgtctgtcccgcaaagggggtaaatag

SEQ ID NO: 49941 - DNA, 399 bp, Artificial Sequence
  Description of Artificial Sequence: Synthetic coding sequence
atgactgtcaccggactgggttggagagatgtccttgaggcgataaaagcgacacgccctattgctaacccaaatccaggattcagacagcagctcgaggagttcggctgggcgagcagccagaagttgcgaaggcaattggaagagcgctttggagagagcccatttagggacgaagaggaacttcgtgcacttctccctctctgcaagcgatgcaggcagggaagcgctacaagcgcttctagtgcaggccctcacagtgcggcaagcgaaggcacagtgcagagactagtgccgaggacccccagagaagctcatcgtccgttaccactcttagccagagtgaaacagactttttcttgtctcccgcgttgcttgagcaggaaggggggtaaatag

SEQ ID NO: 49942 - DNA, 399 bp, Artificial Sequence
  Description of Artificial Sequence: Synthetic coding sequence
atgactgtgactggtttgggctggcgtgatgtccttgaagcaatcaaggccacccgccctattgccaaccctaaccccggtttccgacagcaactggaggaattcggatgggcctcttcccagaagctaaggagacagcttgaggaacgcttcggtgagtccccgtttcgcgacgaggaagaactccgggcactgctgccgctgtgtaagcggtgccgccaggggtccgctacaagcgcctcatccgccggaccacacagtgccgctagcgaaggcacggttcagaggcttgtgccgcgtacccctcgtgaagcacaccgccctctccccctgttggcacgcgtgaagcagaccttcagctgtctgcctaggtgtcttagccgcaaggggggaaagtag

SEQ ID NO: 49943 - DNA, 282 bp, Artificial Sequence
  Description of Artificial Sequence: Synthetic coding sequence
tgaacacgtctgcccccaggcggttggtcccccgaccctaagtatcagatctgcctatgtttcggagaggaggaccctggcccaactcaacatccgaaggagcagcttattatggcggacgtgcaggtgcaattacggcctggctccagttcctgtactcttagtgcatcaaccgaaaggcctgacggatcatcaacccctggcaatccagatggaattacccacttgcagtgttcctgcctgcatcctaaaagggccgcatcatcgtcttgcactcgctag

SEQ ID NO: 49944 - DNA, 399 bp, Artificial Sequence
  Description of Artificial Sequence: Synthetic coding sequence
atgactgtgactggcctgggttggcgagacgtcctggaggctatcaaggccacacgtcccatcgctaaccctaatcccggttttagacagcagctggaagaatttggatgggcgagctcccagaagcttagacgccagttggaggaacggttcggagagtccccgttccgcgatgaagaagagttgagagcccttttgcccctatgtaagcgctgcaggcagggctctgctacttcagccagcagcgcaggtccacattccgctgcatccgagggaaccgtccagcggttggtacccaggacccctcgtgaggctcacaggcccctgcccctgctcgcgcgtgtgaagcaaacgttttcatgtctgccccgttgtttgagcaggaaaggtgggaaatag

SEQ ID NO: 49945 - DNA, 2514 bp, Artificial Sequence
  Description of Artificial Sequence: Synthetic coding sequence
atggctaaggccgcagctagctcctcactggaagatttggatctttccggtgaggaagtgcagcggcttacctccgcctttcaggatcccgagtttcggagaatgttctcacagtatgcagaggagctgacagaccccgagaataggagacggtatgaagccgaaatcaccgccctcgagcgagagaggggcgtagaagtgagattcgtccaccccgagcctgggcacgtcttacggacttcactggacggggctcgcaggtgcttcgtaaacgtgtgcagtaatgcgctcgtaggggctcccagtagtaggcccggatctggcggtgataggggggctgcaccagggagccactggagccttccctacagtttggcacccggtcgagaatacgcaggtcgctcctcttctagatacatggtgtacgacgtggtgtttcatcctgacgctcttgctctcgcgaggcgccatgagggattccgacagatgctcgatgccactgctctggaggctgtggagaaacagtttggtgtgaaactggataggagaaatgccaaaaccctgaaggccaagtacaagggcactccagaagctgcagttctgcggacaccccttcctggtgtcattcctgccagacccgatggcgagccgaaggggccattgccagatttcccctatccctatcagtacccggcagcgccaggacccagagctcccagccccccagaagcagccttgcagcccgcacctactgaaccacggtactctgtggtgcagcgccaccacgtagatctgcaggattaccgatgcagtcgggactctgccccttctcccgtgccacacgagctcgttatcacaatcgagctgccgcttctgaggtcggctgaacaggccgctttagaggtcacgaggaaactgctctgcctggattcccggaagccagattaccgtttacggttaagtcttccatacccagtcgacgatggacggggtaaggctcagttcaataaagccagaagacagttggtggtgaccctacccgtcgtgcttcccgctgcacgccgagaacccgctgtcgccgtggccgctgctgcccctgaggagagcgctgaccgctcggggactgatggacaggcctgcgcgagcgcgcgagaaggtgaggcgggtcccgctcggtctagggccgaagatggaggtcacgatacctgcgtcgccggagccgctgggagtggtgtgacaactctaggtgacccggaagtcgcgccacccccagctgccgcaggcgaagaacgcgtgccgaaacccggtgaacaggacctttcacgccatgccggttccccacccggaagcgtggaggagcctagcccaggcggagaaaattctcccggtgggggagggagcccttgcctctccagtcgatcgctcgcgtggggatcatcagccggaagagagagcgcgagaggcgattccagcgtggaaacgagagaggaatctgaagggaccgggggacagaggagcgcctgcgctatggggggaccgggaaccaagtccggtgaacccctgtgcccccctctcctgtgtaatcaagataaggaaacgctcaccctgctcatccaggtcccacgaatacaacctcagagtttgcaaggagacctaaatcccctttggtacaagctgcgattttccgcacaagaccttgtttacagcttctttctgcagtttgcccctgaaaataagttgtcaactacggagccggtcatctccatttcctctaataacgctgttatcgagcttgctaagtctcctgaaagtcacggtcactggagagagtggtattacggagtgaataatgacagtttggaggagcggctgttcgtcaatgaagagaacgtcaacgaatttttggaggaggtcctaagcagccctttcaagcagagcatgagcttgaccccccctttgatcgaggtcctgcaggtgaccgacaacaaaatacagattaacgccaagctgcaggaatgtagcaactctgatcagctgcagggcaaggaggaaagggtaaacgaggaatcacacctgacggaaaaggaatacattgaacactgtaatactcccactaccgatagcgatagctcaattgccgtgaaggctttgcagatcgatagctttggcctcgtcacctgctttcagcaagagagcttggacgtaagccaaatgatactcggtaaatctcaacagcctgaaagtaaaatgcagtccgagttcataaaagaaaagagtgccacatgtagcaatgaggagaaagacaaccttaacgaatctgtcatcactgaggaaaaggagaccgacggcgatcatctgtcaagcctgttgaataaaactacggtccacaacatcccaggttttgattccattaaggaaacaaacatgcaggatggttctgttcaggtgattaaggatcacgttaccaattgcgctttcagtttccagaactctcttttatacgacctggattag

SEQ ID NO: 49946 - DNA, 2370 bp, Artificial Sequence
  Description of Artificial Sequence: Synthetic coding sequence
atggcgaaggccgctgcctccagcagcctggaggatctggacttgagtggcgaagaggtgcaacgcctgacctccgcatttcaagacccagagttcagacgaatgttctcacagtatgccgaggagctgacggatcccgaaaatagacggcgttacgaagcagagataaccgctttggagagagagcgaggcgtagaagttcgcttcgtgcatccggagccgggacatgtgctccgaactagcctagacggagcacgccgttgttttgtaaacgtctgttccaatgccctggtgggcgcaccctcaagcagacctggaagcgggggagatcgcggagccgcaccaggatcccactggagtttgccatacagcttggccccaggtcgcgaatacgccggacggagcagctcaagatacatggtctatgacgtcgtcttccatcccgatgccctggcgctggctcgtcgccatgagggctttagacagatgctggacgcaacagccctggaagcggttgagaagcaatttggtgtaaaactcgaccggagaaatgccaagaccctaaaggctaaatacaagggcactccagaagcagccgtgcttcggactcctctccctggggtcattccagctaggcccgacggcgagcccaagggccctctccctgacttcccctatccatatcagtatcctgccgcaccgggacctagggcacctagtcctccagaagccgctctccagcccgcaccgacagaaccacggtactcagtggtgcaacgccaccacgtggacctccaagactatcgctgctctagagacagcgcaccctcacctgtgccccacgaattagtgataactatagaactgcccctcctgagatcggccgaacaggccgctctggaagtgaccaggaaattgctctgcctggattcccggaagccagattatcgattacgactgtctttaccttatccagtggacgacggacgcggtaaagcacagttcaataaagccagaagacagctggtggtgacactgcccgtggtgctgcctgccgctcgaagggaacccgctgttgcggtggccgctgccgcaccagaagaatcagcagatcgatcgggtacagacggtcaggcttgtgcttccgcacgggagggcgaggcgggacccgcaagatcacgggctgaggatgggggacacgatacttgcgtggctggcgctgccggaagcggcgttacaactctcggagatccagaagtggctcctccaccagcagcagctggggaggagcgtgttccaaaacctggtgagcaggatctttccaggcacgcgggaagcccgccaggtagtgtagaagagccctcccctggcggagagaacagtccagggggaggcggtagtccctgcctaagtagtaggtcactggcttgggggtcctcagcaggacgcgagtcagcgagaggggatagcagcgtggaaacccgggaggaaagtgagggtactggcggacagagaagtgcttgtgctatgggcggtccgggtactaagtctggcgagccactgtgccctccccttctgtgtaatcaggataaagagacactgacgctgctaatccaggtgccaagaattcagccacaatcattacagggggatcttaaccctctttggtacaaactccggttttccgctcaggacctcgtttatagtttcttcctccagttcgctccggaaaataagctttctactacagaaccagtgatctccatatcttctaataatgctgtcatcgagcttgcgaagagcccagagtctcacggacactggcgagagtggtattacggggtgaataatgactcattagagctacaggaatgcagtaactccgatcagttacagggaaaagaggaacgggtgaatgaggaatcacacttgaccgaaaaagaatacatcgagcactgtaacactcccactaccgatagcgattcctctattgctgtgaaggccttgcagatcgacagcttcgggctggtgacctgttttcaacaagagtccctggacgtcagccaaatgattcttggtaaatcccaacagcctgagtctaagatgcagtccgaattcataaaagaaaagtctgccacctgctctaacgaagagaaagataatctgaacgaatcagtgattacagaagaaaaggaaactgatggagaccatctgtccagcctgcttaacaaaacaaccgttcacaacataccagggtttgattccattaaagagactaacatgcaggacgggtctgtgcaagtgatcaaagaccatgttactaattgcgcgttttccttccaaaactccctactgtacgatctggattag

SEQ ID NO: 49947 - DNA, 2154 bp, Artificial Sequence
  Description of Artificial Sequence: Synthetic coding sequence
atgtcccgtcggagccagcgactaacacgctatagccaaggagatgatgatgggagctcttcgagtggtgggtcatcagtcgctggatcgcaatcgacgttattcaaggacagtccattgcgtacccttaagagaaaatccagtaatatgaaaagactgagcccggcaccccaacttggtccgtcatccgacgcccatacgagctattacagcgaaagtctggtgcatgagtcctggtttcccccacggtccagtcttgaggagctgcatggtgacgccaactggggggaggatctgagagtgcggaggaggaggggtaccggtggatcggagtccagccgcgcatccggcttagtgggccgaaaggctacagaagactttctgggttcctctagtggctatagttcagaagacgactacgttgggtattcagacgtggaccagcaatccagctcctcccggctccgctccgctgtaagccgggctggatctctgctgtggatggtggcgacatccccagggcgactgtttcgtttgctctactggtgggctggcaccacatggtacagattgactactgcagcctccctcctggacgtgttcgtgctgacccgtcgattctcctcactgaagacgttcttatggtttctgcttccactcctgttattgacctgcctcacatatggggcttggtacttctacccctacggcctccaaacctttcatccagctttggtgtcatggtgggccgcaaaggacagccggcgacctgacgaaggctgggaagccagggacagctctccccactttcaagcggaacaaagagtcatgtctcgggtgcactccctcgaaaggagactggaggcccttgcagccgagttctcctctaactggcagaaagaggcaatgcgattggagcggctagagctgcgtcagggcgctcctggccagggcggaggcggtggactaagccacgaagacactctggccctattagagggactggtcagcagaagggaagccgctttgaaagaagactttcgtagggaaaccgctgccaggatccaagaggagctgagtgcccttcgcgcagagcaccagcaagactctgaggacctgtttaaaaagatcgtgagggcaagccaggagagcgaggctcggattcaacaacttaagagtgagtggcaatctatgacacaggagtccttccaagagagctccgtcaaggagcttcgcaggctggaggaccagctagcagggctgcagcaagaacttgccgctctggccctcaaacagagctccgttgcagaggaggtgggcctgctgcctcagcagatccaggctgtgagggacgacgtggaaagccagtttcccgcttggatttcacagtttctggcgcgtgggggagggggaagagtgggattgctccagagagaagagatgcaggctcagttgagggagttggaaagtaagatcctcacccatgtagccgagatgcagggaaaatcggctcgcgaagcagccgcttccctgtcactgactttacagaaggaaggcgtgatcggcgtcaccgaagagcaggtgcatcacatcgtgaaacaggcattgcaaaggtattccgaggacagaattggactggccgactacgccctagagtccggaggggctagcgtcattagtacccggtgctctgaaacctacgaaacaaagacagctctcctctccctcttcggtatcccactgtggtaccattcacaaagccccagggtgatcctgcagcccgacgtgcatcctggcaattgctgggccttccaggggccacagggttttgcagtcgtgcgacttagtgccagaattagaccaacagccgtaactttagaacacgtaccaaaagctctgtcaccaaatagcaccataagcagcgctccaaaagacttcgcgatcttcggattcgacgaggatcttcaacaggaagggacgcttctgggaaaattcacctatgaccaggacggtgagcccatacagacatttcacttccaagctcctaccatggccacctatcaggtggtggagttaaggattctaaccaattggggacaccccgagtatacctgcatctataggttccgcgtccacggtgaacctgcacactag

SEQ ID NO: 49948 - DNA, 1572 bp, Artificial Sequence
  Description of Artificial Sequence: Synthetic coding sequence
atggcggctgttggacgggtgggctcattcggtagcagccctcctggcctgtcttcaacctacacaggaggaccactcggcaacgagattgcatctgggaatggaggggcagctgctggggacgacgaggacggacagaatttatggtcgtgtatactgtcggaagtctctaccaggtctaggtccaagctgcccgctggtaaaaacgtgctgcttctcggagaggatggtgccggaaaaacctccctgattagaaaaattcagggcatcgaagagtacaagaagggacgagggctggagtacctgtatcttaacgtccacgacgaggacagggacgatcaaacgcggtgtaacgtttggattcttgatggagatttgtaccataagggcttacttaagttctctctggatgcagtcagcttgaaggataccctggtcatgctcgttgtagatatgtctaaaccttggactgccctggattctctccagaaatgggcctctgtggttcgcgagcacgtggacaaattaaagattcctcctgaggagatgaaacagatggaacagaagctgatccgcgacttccaagaatatgtggaacccggagaggacttccctgctagtccgcagaggaggaatactgctagtcaggaggataaagatgattctgtggtactgccgttaggtgccgacaccttaacccacaatcttggtatcccagttctggtagtctgcactaagtgtgatgctatcagcgtactggagaaagagcatgactatcgcgatgagcactttgactttattcagagccatattaggaagttttgtttgcagtacggcgctgctttgatctatacatcagtgaaggagaacaaaaatatcgatctggtttacaagtacatagtccagaagctttacgggtttccttacaagatcccagcagtggtcgtggagaaagacgcagtattcattccagcaggatgggacaacgacaagaaaataggcatacttcacgaaaacttccaaactttaaaggccgaggataattttgaggacattatcacgaagcccccagtacggaagtttgtacatgagaaagagatcatggcagaggacgatcaggtctttctgatgaaacttcaaagcctcctagccaagcagccacctacagcagccggtcggccagtggatgcgtcacccagggtccccggaggaagccccagaacacccaatagaagcgtgagttctaacgtcgccagcgtttctcccatccccgctggatccaagaagattgaccccaacatgaaggccggagctacttccgagggggtcctggcaaatttttttaacagtctgctgtcaaagaaaacaggctcacctggaggccctggagtgtctggcggatccccagcgggaggcgctggcggtggctccagtgggctccctccgagtaccaagaagagtggtcaaaagccagtgcttgatgttcatgcagagctggatcggataacccgaaaaccggtcaccgtgtctcccaccactcccacatcaccaaccgaaggagaggccagctag

SEQ ID NO: 49949 - DNA, 351 bp, Artificial Sequence
  Description of Artificial Sequence: Synthetic coding sequence
atggaagagtatcacagacattgcgacgaagtgggttttaatgccgaagaggctcataatattgtgaaggagtgcgtcgacggagtgctcggtggtgaggattataaccacaacaacataaatcagtggaccgccagcatcgtggagcagtccctcacacatctcgtgaagctggggaaggcttacaaatatattgtcacatgtgccgttgtgcaaaaaagcgcttacgggttccacacagcatcttcctgcttttgggacactacctcagacgggacatgcacagtaagatgggagaatagaactatgaattgtatcgtcaatgtttttgccattgccattgtgctgtag

SEQ ID NO: 49950 - DNA, 459 bp, Artificial Sequence
  Description of Artificial Sequence: Synthetic coding sequence
atggaagagtaccacagacactgcgatgaggtaggtttcaacgccgaagaggcccacaatattgtgaaggaatgtgtggatggagtgctcggcggtgaagactacaaccacaataatattaaccagtggactgccagcatcgtggaacagagtctcactcacctggtgaaactcgggaaggcatacaaatacatcgtgacttgcgcggtcgtccagaagtctgcctacggctttcatactgcttccagctgcttttgggatacaacctccgacggcacttgcactgtgcggtgggagaaccgcaccatgaactgcggtgtgcttttgtgccgacccggatggtcagcagtaatgcaattcaggttaacagctacctctgcctcccaagttcaggtaattctgctcccgcagccgcctgagtatctggaactgcaggcccatgccatcacacctggctag

SEQ ID NO: 49951 - DNA, 369 bp, Artificial Sequence
  Description of Artificial Sequence: Synthetic coding sequence
atggccaggtcactaggggtcctcgtggcgctcccctttccgcttcctgtgggttttaatgcggaagaggcgcacaatatagtcaaagagtgcgtggatggagtgctcgggggagaggattacaaccataacaatattaatcagtggaccgctagcatagtcgaacagagcctgacacacttggtgaagctggggaaggcctacaagtacatcgtgacttgtgccgtggtgcagaagagtgcgtacggatttcacactgcctcgagctgtttttgggatactaccagcgacggcacgtgcacggtccgctgggaaaatcgtacaatgaattgtatcgtgaacgttttcgcaatcgctattgtgctgtag

SEQ ID NO: 49952 - DNA, 1737 bp, Artificial Sequence
  Description of Artificial Sequence: Synthetic coding sequence
atggaccctgacaaacaggatgctcttaattctatcgagaactctatttaccgcacagcctttaagttgcagtccgtccagaccctgtgtcagcttgacctgatagacagcagtctcattcagcaggtactgctgaggccttccttctgggaggcgagaaaacacagcctgtccgtgcagcaactgagccaggccctgcaggaacttttccaaaaagctcgcgaagaaaacccaggccaggtgcacccgagagctcccgagctgaccctgagccttctgactacgatgtacaactcaaaagggacagggtttcttcagttaatgccagctgccgctgctcttattactttgtccggagacagtccgttgtccaaatatcgggctctgttccagctgtacgctgagaatagccggggaggatacgattcaggacccaggatgactagacgggttctgaggaaactgttaaccgacttgcagcagatcccgacattcgtcggagagtctcgggctttatgtcccgtggagagtgccacacgatcttgttttcagggagtgctgagcccagccatcaaggaggagaagttcctgtcatgggtgcaaagcgagcctcccatccttctgtggcttcctacatgtcacaggctctcagcagcggagagagtgacccaccccgcaaggtgcacactgtgtcgcacttttccaattactggacttagatacaggtgtctgaaatgcctgaattttgacatctgtcagatgtgtttcttaagtggcctccactccaaatcccaccagaagtcgcatcccgtgattgagcactgcattcagatgagtgcaatgcagaataccaaacttctttttcgtaccctgaggaacaacctactgcagggaagatgtcgcaaaaaagaagcggctaggcgacaacagctgttagatcaggtgaatccaaagggggtacctcaccacgcgcaagcccgactgctgaagaagcagctaaatcagtacaaagacaaactgcaggcaatatatacaagtcaggaggaacgaatttgtcggtttgagaccagaatccacaaactgaagacaaaccaggactcattatggacgaaactgcagcagattaggcgggaccttcaggccagactgcaacctcctggccctagtagttcctctttccagaacgtcggtaataaggttgaccattcaagtacagaaaaggttcctaaaggaggcgattacctgcagattaagaacgcaacggaggacgcctctacaggcgaacccctaccaaaactggatgaggttgatagaagccatcgttctcacactaacgccgaacacgcacttaggaatcctgagagccctgaaactacattgcactccacccgggctcagagccagacgcagaaaatgccgcagaaagtcatttctgccttaccctcctatcaggagggattgaaacaggacattcctaagatggtcccggctgaaatgtcttccccagccctggcggctgtggagaagaaggaagccggaaacattaaggaacgcaaggacgaactggaagaagaggagttacaagaacttttgagcaaacttatggacgcctttaacttagaaacacctagtggaccagagagctcagttaatatggacttatactccggtgcgcaacgtgtatgtcgggctttttctgcacttgtagatcagattgcgctaccgaatctgaaatag

SEQ ID NO: 49953 - DNA, 858 bp, Artificial Sequence
  Description of Artificial Sequence: Synthetic coding sequence
atgaatcggcttcctgatgattatgatccatacgcagttgaggaaccttccgacgaagagccagctctctctagtagcgaagacgaggtggacgtgctcctgcatggtacccctgaccagaagagaaaactgatcagggaatgcttgaccggggagagtgaatcgtctagtgaggacgaattcgagaaggagatggaagctgagctgaattccacaatgaagacaatggaagacaaactttcttcattaggcacgggctcatcctccggaaacggaaaggtggccactgccccaacacggtactatgacgatatctatttcgacagtgattccgaagacgaagatagagcagttcaggtgacgaaaaaaaagaagaagaagcaacacaagatacctaccaacgacgagctgctgtatgaccccgaaaaagacaatagagatcaagcatgggttgacgcgcagaggaggggatatcatgggcttgggccacagcgctctcggcagcagcagcctgtgcccaacagtgatgctgtgctgaattgtcccgcttgcatgactaccctgtgtcttgactgtcagagacacgagtcttataagacccagtaccgggcaatgttcgttatgaattgctcgatcaacaaggaagaggtgttacgctacaaagcttccgaaaaccggaaaaagcggcgtgtgcataagaagatgcgctctaacagagaggatgcagctgagaaggccgagaccgacgtggaagagatctaccaccctgtgatgtgcaccgaatgcagcaccgaggtcgcagtatacgataaggacgaggtgttccatttttttaacgtgctggcctcacactcttag

SEQ ID NO: 49954 - DNA, 4236 bp, Artificial Sequence
  Description of Artificial Sequence: Synthetic coding sequence
atgctcaggcgcatacttcagagaactcccggaagggtgggttcacaaggctccgaccttgacagcagcgccacccctattaacaccgtagacgttaataatgagtcatcatccgaaggcttcatatgccctcagtgcatgaagtccctcgggtcagccgacgaactgtttaagcactacgaggcagtgcacgacgcaggaaatgacagtggacatggcggagaatccaatttagcactcaagcgcgacgacgtgacgttgcttaggcaggaagtccaagatttgcaggcgtctctgaaagaggagaagtggtattcggaggaacttaagaaagaactggagaaatatcagggcctgcagcagcaagaagccaagcctgacggcttggtgactgacagctccgctgagttacagtctctggagcaacagctggaagaggctcagactgagaatttcaacatcaaacagatgaaggacttgtttgagcagaaagcagcccagcttgccacggagatcgccgacataaagtccaaatatgatgaagagcgatcattacgagaagccgcagagcagaaagtgacaaggctgacggaggagctgaataaagaggctacagtgattcaggacctcaagacagaactcttgcagagaccagggattgaagacgtcgcggtccttaaaaaagagctagtgcaggtccagacacttatggataatatgacgctagagcgcgaacgggaaagtgagaaactgaaggacgagtgtaagaaattgcagtctcagtacgcttcatccgaggccacgatctctcagctgagaagtgaactggctaaggggcctcaagaagtcgccgtgtacgtgcaggaactgcagaagctcaagtctagtgtcaatgaactcacgcaaaaaaatcagacccttacagaaaacctccttaaaaaagagcaggattacaccaaactggaggaaaagcacaatgaggagagcgtcagcaagaagaacattcaggcaacgcttcatcagaaagatctcgactgtcagcaacttcaatcacggctgtctgcctcggagaccagcctacatcgcatccacgttgagcttagcgagaaaggggaggccactcagaaactgaaggaggagctgtcagaggtggaaaccaaataccagcatcttaaggcagagtttaaacagctgcaacagcagagggaggagaaggaacagcacggactgcagcttcagtcagaaatcaatcagctgcactcgaagctactcgagacggagcgacagcttggcgaggcccacggcagactcaaggaacagcggcagctctcaagcgaaaaactgatggataaagagcaacaggtcgccgatctacagctgaagctcagtagactggaggagcaactgaaggagaaagtcaccaacagcaccgaattgcagcatcagcttgataaaaccaaacaacagcatcaggaacagcaagcgctgcagcaaagcacgaccgcgaaactgcgcgaggctcaaaatgatctcgagcaggtcttgcggcaaatcggggacaaggatcagaagattcagaatctcgaagctcttctccagaaatccaaggaaaacatatcgctgctggagaaggagcgcgaagatttgtacgctaagattcaggctggagaaggggagaccgcagtcctaaatcagctgcaggaaaaaaaccacacactgcaagagcaggttacgcaactcacagaaaaactcaagaaccagtctgagtcccacaagcaggcacaggagaacctgcacgaccaagtccaggaacagaaagcgcacttgagagctgcccaagaccgcgtcctttcactggagacaagcgtcaatgaactgaacagtcagctaaacgaatctaaagagaaagtctcccagttggatatccaaatcaaagccaaaacagaactgctgctttcagcggaggccgctaagaccgcccagagagccgacctgcagaatcacctggacactgcgcagaacgctctgcaagataagcagcaggaactaaacaagatcacgactcagctcgaccaagttacggcaaagctacaggataaacaggagcactgctctcagttggaatctcacctgaaggagtataaagaaaagtacctcagtctcgaacagaagacggaagagctggaagggcagatcaaaaaactcgaagcggactctctcgaggtgaaggcgtcgaaagaacaagcacttcaggaccttcaacagcagaggcagcttaatactgatctcgagttgagagcaactgagctctcaaaacaactggagatggaaaaagagattgtgagctccactaggctagatctacagaaaaagtccgaggctctcgagagtattaagcagaagctcaccaaacaagaagaagagaagaagatcctcaagcaagatttcgagacactgagccaggagaccaaaattcagcacgaggagctaaacaaccgcattcagacgacagtgacagaactgcagaaggtgaagatggagaaggaggccttgatgaccgagctgtctactgtgaaggataaattatctaaagtatccgattctctgaagaacagcaagtctgaattcgagaaagagaaccagaaaggcaaggccgctatcctcgacctggaaaagacatgcaaagagctgaaacatcagttacaggttcaaatggaaaataccctgaaagaacagaaagaactcaaaaaatccttggaaaaagagaaggaggcctctcaccagctgaaactggaactgaacagcatgcaggaacagctaatccaagcccagaacacgttaaaacagaacgagaaggaggaacagcaactacagggcaacattaatgagctcaaacagtcatccgaacagaagaaaaagcaaatcgaggccttgcaaggcgagctaaaaatagcagtcctgcaaaaaaccgagctcgaaaacaaacttcaacagcagctgactcaggccgctcaagagctagctgccgagaaggaaaagatttccgtcctccagaataattacgagaagtctcaggagacatttaagcaattacaatctgatttttatggaagggaatctgaactgctagccactcggcaggacttaaagtccgtcgaagaaaagctctctcttgcccaggaagatttaatctctaatagaaaccagatcggcaaccagaataagttgattcaagaattgaaaacagctaaagccacgctagaacaagattcagccaagaaggagcagcagctgcaagagcgctgtaaagctttacaggacatccagaaggaaaaaagcctgaaggagaaagagttggtgaatgaaaaaagcaaattggccgaaatagaggagatcaagtgcagacaagagaaggagattacaaagctgaatgaagaactcaagagccataagctcgaaagtattaaagagattactaacctcaaggatgccaaacaactgctcatccagcagaaactggaactccaaggcaaggctgacagtttaaaggctgctgtggagcaggagaagaggaatcaacaaatcctgaaggaccaggtgaagaaggaggaagaagaactgaagaaagagttcatcgaaaaagaagccaaactgcattcagaaataaaagagaaggaggtaggaatgaagaaacacgaagagaacgaggcaaagctcacaatgcagatcacagcccttaacgagaatttaggaactgttaaaaaggaatggcagagctcacagcgcagagtgtctgagttggagaaacaaactgacgatttgcgcggtgaaatagcggttctcgaggctaccgtccagaacaaccaggatgagaggcgcgctctgctggaacggtgcctgaaaggcgagggcgaaattgaaaagctgcagacaaaggtcctggaactccaacgcaagctggacaatacaacagccgctgtgcaggaactcggcagggaaaatcagtcgctgcagatcaagcacacacaggcccttaaccgcaagtgggccgaggacaatgaagtgcagaactgtatggcatgtggaaagggcttctctgtgaccgtacgtcggcatcattgtcggcagtgtggaaatatattctgtgccgagtgcagtgcaaagaacgcccttaccccaagtagtaagaaaccggtccgggtatgcgacgcctgttttaatgacctgcagggttag

SEQ ID NO: 49955 - DNA, 933 bp, Artificial Sequence
  Description of Artificial Sequence: Synthetic coding sequence
ctcaggcgggtggatcatgagacccccggaagggttggttcacaggggtcggacttggactctagtgccacccctatcaacactgtggacgtgaataatgaatcaagcagcgaggggttcatttgcccccagtgtatgaagagcctgggatctgcagatgagctgttcaagcactatgaagccgtccatgatgctggaaacgattccgggcacgggggtgaaagtaacctggctttaaagagagatgatgtcacactcctgagacaggaagtacaagatcttcaggcatcactcaaagaagagaagtggtacagtgaagagctcaaaaaggagctcgaaaagtatcaaggactgcaacaacaagaagccaagccggacgggctggtcacggatagctctgccgaacttcaaagccttgagcagcagctcgaggaggcccaaacagagaactttaacataaaacaaatgaaagacctcttcgagcagaaggctgcacagctcgccacagaaattgccgacataaagtctaaatacgatgaggagcgctccctgagagaagcagccgaacagaaagtgaccagactcacggaggaactcaataaagaagctaccgttatccaggacctgaaaacggaactactacagaggccgggtattgaggacgttgctgtgctcaagaaggagctggttcaggtccagacgctgatggataacatgaccctggaacgggagagggagagtgagaagctaaaagacgagtgtaaaaagctccaatcccagtacgcctccagcgaagccacaatctcccagttgagaagcgagctggccaagggtccacaagaggtcgccgtctacgttcaggagctccagaaactgaagtcgtcagtgaacgagttgacacaaaagaaccagaagaagaagaaaaaaaaatag

SEQ ID NO: 49956 - DNA, 1716 bp, Artificial Sequence
  Description of Artificial Sequence: Synthetic coding sequence
atggggcgtattgggatcagctgccttttcccagcaagttggcattttagtatcagcccagtgggctgccctcgcattctcaacacaaatctgcgacaaatcatggtcattagcgtcctggccgctgctgtaagcttgctgtactttagtgtggttatcattcggaataagtacggacggctgaccagagataagaagttccagcggtacctcgccagagtaactgatattgaggctactgacactaataacccaaacgtcaattatggaattgtggttgactgcggcagtagcggctctcgggtcttcgtgtactgctggccccgtcataacggaaaccctcacgacttactggatatcagacagatgagagacaagaataggaagccggttgtgatgaagattaagcctggaatctctgaattcgcaacatcacctgagaaggtctctgattatatctcacctctgctaaactttgcagccgagcacgtgcctcgggctaagcataaggaaacacctctgtacatcttgtgcacagccggaatgagaatcctgcctgaaagccagcagaaagccattctcgaggatttgctgactgatattcccgtgcatttcgacttcctgttctctgattctcacgccgaggtcatcagtggtaaacaggaaggcgtgtatgcatggatcgggattaactttgtcttggggcgttttgagcatatcgaagacgacgacgaggccgtagtagaagtcaacataccaggttcagagagctcggaggcaatagtgcgaaagagaactgccggaatcctggacatgggcggtgtctccacccagatcgcttacgaagtgcctaaaacagaagaggtcgctaaaaatctcctggccgagtttaatttggggtgtgacgtgcatcagaccgagcatgtgtatagagtgtacgttgcaacgtttctcgggttcggcggtaacgccgcacgacagagatatgaggataggatctttgccaacactattcagaagaacaggctgttggggaagcagacgggcctgacaccggacatgccctacctcgacccatgtctgcccctggatatcaaggatgaaatacagcaaaacgggcagacaatctacctgagagggaccggcgattttgatctgtgccgagaaacgatccagccttttatgaataaaacaaacgaaacccaaacttcattaaacggggtgtaccaacctccgattcacttccagaactctgaattctatggattttccgaattctattactgcactgaagatgtgctgaggatgggcggagactacaatgccgctaaattcaccaaagctgcaaaagactattgcgccacgaaatggtctatccttagagaacgctttgacagaggtttatacgcatcacacgccgatttgcatcgtctcaagtaccagtgttttaaaagtgcttggatgttcgaagtgttccaccgcggtttttctttcccggtgaattataaatcattgaagactgccctccaagtgtacgacaaagaggtgcagtggaccctgggcgcaatcttgtaccggactcggtttctacctctgcgcaagataggcatgctgattattccatgctccggaggctgccccaagttgtgttgtgcagtttggcagccccctccttatggtgctacgaagcacctgcagtgcgctgcttggaattag

SEQ ID NO: 49957 - DNA, 1851 bp, Artificial Sequence
  Description of Artificial Sequence: Synthetic coding sequence
atggggaggattggaatctcatgcctgtttccagccagctggcacttctctatctcaccagtgggttgccctaggatcctgaacaccaacctgcggcaaattatggtcatttctgtgttagctgctgccgtgtcacttttatattttagcgtggttattattcggaacaaatatggccgtctgacacgcgacaagaagtttcagcggtacttagcaagggtgacagatattgaggccacagacaccaacaaccctaatgtgaattacgggatcgtggtggactgtggcagcagtggctcgcgagttttcgtgtactgttggcctcgtcacaatggcaatccacacgatctcttggatattagacagatgcgagacaagaacagaaagcccgtagtcatgaagatcaagccagggatctccgagttcgccaccagccccgagaaagtttccgactatatctcgccactgttgaacttcgctgctgagcacgtgcccagagccaagcacaaagaaacaccattgtatatcctctgcacagcaggcatgcgcatcctgcccgaatctcagcaaaaggccatattggaggacctgttaactgatatcccggttcacttcgattttcttttttctgatagtcatgccgaggtcataagcggtaagcaggaaggagtgtatgcctggattggaatcaatttcgtgctgggacggtttgaacatatagaggacgatgatgaggcggttgtggaagtgaatatccccggatcagagtcctccgaggctatcgttcggaagcgaactgccggaattctggacatgggaggagtgtctacacaaatcgcctacgaggttccaaaaaccgtatcctttgcatccagccagcaggaggaggtcgcaaagaacctgcttgcggagtttaacctgggatgtgacgtacaccaaacggagcatgtgtaccgcgtttatgtagctacgttcctgggctttgggggtaatgcagccaggcagagatacgaggaccggattttcgcgaatacaattcagaagaaccgactgctaggcaaacagacagggctgacccctgacatgccatatctcgacccctgtctccccctcgatattaaggatgaaatccagcagaatggccagacaatatatctgcgcggtaccggagattttgacctgtgccgcgaaacgatccaaccctttatgaacaagacaaacgaaacccaaacatctttaaacggggtataccagccgcctatccactttcaaaactccgaattttatgggttctccgaattctattactgcacagaggacgtgttaagaatgggtggcgattacaacgcagcaaagttcacgaaagcagccaaggactactgcgccacaaagtggtcgattttaagggaacggtttgaccgcggattgtacgcctctcacgcagatctccatcgcctaaaataccagtgctttaagtccgcctggatgttcgaggtttttcaccgtggcttctcgttccctgtgaattataagtctcttaaaactgccctgcaagtttacgacaaggaagtccagtggaccctgggcgcaattctgtaccgcacacggtttttacctctgagagatatccaacaggaagctttccgagcctcacatacccattggcgtggggtaagttttgtgtataaccactacctattctcaggatgttttctcgtggtattattagctatcctgttgtacctgcttaggttgcgacgcatccaccgcaggacacccagatcatcaagtgcagccgctctatggatggaagagggccttcctgctcaaaacgctcccggtaccctctag

SEQ ID NO: 49958 - DNA, 1827 bp, Artificial Sequence
  Description of Artificial Sequence: Synthetic coding sequence
atgggccgtatcgggatttcatgtctgttcccagcgtcttggcacttttcaattagccccgtcggctgcccccgaatccttaacacaaacctgagacagatcatggtgatctcagtacttgccgcagccgtcagcctcctgtacttcagcgttgtgatcattcggaataaatatggaaggcttacgcgagacaagaaatttcagaggtatctggctcgcgtaaccgacattgaagctactgatactaacaatccaaatgtgaattacgggatagttgttgactgcggttcgagcggctctagagttttcgtgtactgctggcctcggcacaatggcaatcctcatgacctgcttgacatccggcaaatgcgtgataagaataggaagcctgttgtgatgaagatcaagcctgggatctctgaatttgccaccagtcccgaaaaggtatccgattatatctctcctctgcttaacttcgccgctgaacatgtccctcgcgcaaaacacaaagagaccccgctttacatactttgtacggccggaatgcgcatccttccagaatcccagcagaaggctattctagaggatctcctaaccgatattccagtccatttcgactttctgttcagtgattcccacgcagaggtgatcagcggaaagcaggaaggggtgtacgcatggattggcataaactttgttcttggaaggtttgaacacattgaagatgatgacgaagcagttgtagaggtgaacatccctggtagcgaaagctcagaggctatcgtacgcaagcggaccgcagggattctcgatatggggggagtgtctacccagattgcttatgaggtgcccaaaacagaagaagtcgccaaaaatctcctcgcagagttcaatcttggttgtgacgtgcaccagaccgagcacgtctatcgggtgtacgtggcgacatttctcggattcggcggaaatgcagcgaggcagcggtatgaagatagaattttcgcgaacacaatccagaaaaatagactgctcgggaagcaaaccggcttaacacctgatatgccttacctggatccctgccttccccttgacatcaaagatgaaattcaacagaatggccagactatttacctgcggggaacgggagattttgacctctgccgggaaacaattcaaccttttatgaataagaccaatgaaactcaaacatccctcaatggcgtgtaccagcccccaattcacttccaaaactccgaattctacgggttcagcgaattttactattgtaccgaagacgtcctgcggatgggaggggactacaacgcggcaaagtttaccaaagctgcaaaagactattgcgctaccaaatggtctattctgcgggagcggttcgatagaggactgtatgcctcccatgctgacctgcatagactgaaataccagtgttttaagtctgcctggatgtttgaggtgttccatcgcggattctctttcccagtgaactacaaatctttgaaaaccgcactgcaggtgtacgacaaggaggtgcaatggacactgggtgctatcctgtatcgcacccgttttctacccctccgagatatccaacaggaggcgttccgcgcaagccacacccactggcggggtgtttcctttgtgtataaccattaccttttttcagggtgttttttggttgtcctgctggctatcttattgtacctgctgaggcttaggcgtattcaccgacgcaccccgaggtcttcaagcgccgctgcactgtggatggaggaaggcctgcctgcacagaacgctcccggtactttatag

SEQ ID NO: 49959 - DNA, 1815 bp, Artificial Sequence
  Description of Artificial Sequence: Synthetic coding sequence
atggcccgtatttctttctcatacttgtgtccagcctcatggtacttcacagttcctaccgtgtctcctttccttcggcaacgtgtggctttcctgggcctttttttcatcagctgtctgctgctcttgatgctcataattgattttcgacattggtccgcttcgttgcctcgagatcgccaatacgagcggtacctcgccagagtcggggaattagaagcgaccgacaccgaggaccctaatctgaactacgggctggtagtagattgtggctcttctggatcacggattttcgtctacttctggcctagacacaatggcaaccctcacgacctcctggacattaaacagatgcgggatcggaactctcaaccagttgtgaaaaagattaaacctgggatttccgctatggccgacactccagaacacgcttcagactacctgcgaccactgctttcattcgcagctgctcacgtgcccgtgaaaaaacacaaagagacacccctgtacatcctatgcacagccggaatgaggttgctgcccgagcggaaacagttagccatcctcgccgacctggttaaagatttaccattagagttcgatttcctgtttagtcagtcccaggcagaagttatcagcggcaaacaagaaggtgtatacgcttggatcgggatcaacttcgtgttaggcagatttgaccacgaggacgagtcagatgctgaagccacccaggaacttgctgctggtaggaggcgaaccgtcggcatcctggatatgggcggtgccagtctgcaaatagcttacgaggtacccacaagcaccagtgtgctgcctgccaaacaagaagaagcagcaaaaattctgttggctgagttcaacctgggctgcgacgtccagcacactgagcacgtctacagagtctacgtgacgactttcctgggcttcggaggcaatttcgccagacagcgatacgaagatcttgtcttgaacgaaactttgaataaaaatagactgcttgggcagaagacggggctcagccccgataaccccttcctggacccctgtctgcctgtaggactgacggacgtggttgagcggaattcccaggtactccacgtgagaggccgtggagattgggtgagttgcggagccatgctttcaccgctgttggcaagatctaacactagtcaggcctccctgaacgggatataccagagtccaatagattttaataattctgagttttacgggttctctgaattcttttattgcacggaggatgtgctgcgtataggcggtagatatcacggacctacttttgccaaggcagcccaggactactgtggtatggcctggtctgtcctgactcagaggtttaaaaacggtctattttcgagccacgctgatgaacaccgcctcaagtatcagtgcttcaagtcagcatggatgtatcaggtgttacacgaaggctttcacttcccctacgactatccaaatttgagaacggctcagctagtatatgatcgcgaagttcagtggaccctcggtgccatactgtataagaccaggtttcttccccttcgcgatcttcggcaggagggtgtacgccaggcccatggatcctggtttcgcctcagtttcgtttataatcactacctctttttcgcttgtatcttggtggtcctgctggccatctttctctatctgctccggctccggcgaattcaccataggcagacacgcgcaagcgcccctctggatctactgtggctggaagaagtcgtcccaatgatgggagtccaggtcggtccatag

SEQ ID NO: 49960 - DNA, 1377 bp, Artificial Sequence
  Description of Artificial Sequence: Synthetic coding sequence
atgggcctgtcccgtaaagagcaggtattcctcgccctcctgggtgcttccggcgtgtctggattgacagctctaattttgcttcttgttgaggctacttctgttctccttcctacagacatcaagttcggcatcgttttcgatgccggttcaagccacacatcattgtttctttaccagtggctcgccaacaaggaaaatggaactggcgttgtgagccaggccttggcgtgccaggtagaaggccctggtatcagtagttacaccagcaatgccgctcaggcaggcgagtccttgcaaggttgcctggaggaagctctcgtactgattccggaagcccagcaccggaagacacccacattcctgggtgcgaccgccggaatgagattactgtcaaggaagaattcgtcccaggccagggatattttcgctgcagtcacacaggtcctgggcagatctccggtggacttctggggtgccgagctactggcaggccaggccgagggcgcatttgggtggatcactgtgaactacggcctgggcacactggtcaaatattccttcactggtgagtggatccaacctcccgaggagatgctcgtaggagccctggacatgggaggggcttctacacagatcacctttgtgccaggaggaccaatcctggacaaatctactcaagctgactttcgtctgtatggctctgattactcagtgtacactcactcttacctctgctttggcagggaccaaatgctgtcaaggttgctggtgggtttggttcagtctcgacctgcagcactcctgagacacccatgctatctgagtgggtaccagacaactcttgcattgggtccattatatgaaagcccatgtgttcacgccacgccgcctttatcactgccccagaacctaacagtggagggcaccggcaatcccggtgcgtgcgttagtgccattcgggagcttttcaacttttcaagctgccaaggccaggaagactgtgcctttgatggagtttaccagccgcctctccgaggtcagttttacgtagaggcctcatacccaggccaggatcggtggctgagagattactgtgccagcggattatacattctcacactcctgcatgagggctacggattcagcgaagagacatggccatccctggagtttagaaaacaggcaggaggagtagatattggctggacacttggatatatgctgaacttgactgggatgattcccgcagatgctccggcacagtggcgggcagagtcctacggcgtgtgggtggccaaggtggtattcatggtgcttgcactcgtggccgtcgtcggggcagccctagtccagcttttttggttgcaggattag

SEQ ID NO: 49961 - DNA, 1488 bp, Artificial Sequence
  Description of Artificial Sequence: Synthetic coding sequence
atggggctttctcgcaaagaacaagtctttctagccctgctcggtgcgtctggtgttagcgggctcacggcactcattctgctactggtcgaggccacatcagtgctcctgccaactgacatcaagtttggcatcgtatttgatgccggttcatcacacacctccttatttctctaccagtggcttgccaacaaggagaatggcaccggggtggttagtcaggcactggcctgccaggtggaggggccaggaatcagtagttacacctccaatgcagctcaggccggagaaagcctacagggatgtctggaggaagcgctggtcctgatacccgaagcccagcatcggaaaactcccaccttcctcggagcaacagccggtatgcgcctgcttagtcgtaagaactcctcgcaggctcgggacatctttgcggctgtaacacaggttctcggcagaagtccagtggacttctggggcgcagagctgctggctggccaggctgagggcgcatttggatggatcacggtgaactacggtctggggacgttggtgaagtactccttcacaggtgagtggattcagccacctgaggagatgttagttggagctctggacatgggcggagcatcaacccaaattaccttcgttcccggtggcccaatcctagataaatccactcaggctgacttccggctgtatggcagtgactacagtgtgtacacccattcctacttatgcttcggtcgcgatcaaatgttgtcaaggctcctggtgggactcgtccagagcaggccagcagccctactgagacatccttgttacctgagtggttatcagacaacgctggctctcggacccctgtatgaatccccatgcgtgcacgctacacctcccttatcccttccacagaatcttaccgtcgaggggacgggtaaccccggtgcctgtgtgagtgcaattcgtgaactctttaattttagttcctgccagggccaggaggactgcgctttcgacggtgtgtatcagccaccattacgcggacagttttatgccttctcgaatttctattacacttttcattttctaaatctaacctctcgccagcccctgtctactgtaaatgcgacaatatgggaattctgccaacgaccctggaaactggtggaggccagttaccctggacaagataggtggctccgggactactgtgccagtggtctgtatatcctgacacttctccatgaaggttatggattttccgaagagacttggccttcacttgagttcaggaaacaagcaggtggtgtagatatcggctggacgctgggctacatgctgaatctcaccggcatgatcccagccgatgcacccgctcagtggagggccgagtcttatggagtttgggtcgcgaaggtagtatttatggtgcttgctctggtggctgtggttggcgctgcgctcgtgcagctcttttggctgcaggattag

SEQ ID NO: 49962 - DNA, 1488 bp, Artificial Sequence
  Description of Artificial Sequence: Synthetic coding sequence
atgggacttagccgaaaggagcaagttttcctggcactacttggggcttctggcgtgtcggggttgaccgctctgatactgcttctggtggaagcaacgtcagttttgctgcctacggatattaaatttggaatcgtcttcgatgccggttctagtcacacctccctcttcctttaccagtggctcgctaataaagagaatgggactggtgtggtatcgcaagccctggcgtgccaggtcgaaggtcccggaatttcttcatatacttcgaacgcggctcaggcaggcgaatctctccagggttgcctggaagaggccctcgttcttatacccgaagcccagcacagaaaaactcccacttttctaggcgcaaccgctggcatgaggcttctgtctcgcaagaattcttcacaggccagggatatctttgcagccgtgacccaagtcctcggacgaagccccgttgacttctggggagccgagctcttagccggacaagcggagggagcattcggatggatcacggtcaactatgggttaggtaccttagtcaagtatagctttactggtgaatggattcagccccctgaagagatgttagtgggagctcttgacatgggcggagcctccacgcagatcacattcgtgcctggaggcccaatactggacaaatccacacaggccgatttcagattatatggctccgactacagcgtgtatactcacagctacctgtgcttcggtagggatcagatgttgagccgtctcctcgtaggtttggttcagtcccggccagccgcacttcttagacacccgtgttacctctcggggtaccagacaaccttagccttaggcccactctacgaatccccatgcgtgcatgcaacccctccgttgtctttgccgcaaaacctcaccgtggagggcaccggaaacccaggcgcatgcgtgtccgccatccgtgagctcttcaattttagttcttgtcaaggacaggaggactgcgctttcgatggcgtgtaccagcctccactgcggggacagttctatgctttcagcaatttttattatacattccacttcttgaacctgacctcaagacagcctttgtccactgtgaatgcgacaatatgggagttttgtcagcgcccttggaaactggtagaagcctcctatcccggacaggatcgctggttgagagactactgcgcttccggtctctatattctgacgctgctacacgaagggtacggcttttctgaggagacctggccttctctcgaattcaggaagcaagccggaggggtggacatcggatggacccttggatatatgctgaatctgacgggcatgattccggctgacgccccagcccagtggagggcagaatcttatggtgtgtgggtcgccaaggtagtctttatggtactggctctagtggctgtggtcggcgctgccctggtacaattgttctggttgcaggactag

SEQ ID NO: 49963 - DNA, 1362 bp, Artificial Sequence
  Description of Artificial Sequence: Synthetic coding sequence
atgaagctgttggtcatcttgctattttctggcctgatcaccggcttccgctccgattccagcagctctttgccccctaagctcttgctcgtgagtttcgatgggtttagggccgactacctgaagaattacgagtttcctcatctgcaaaatttcattaaggagggtgttctagtggaacatgttaagaacgttttcattacaaaaacttttcctaatcactactcaattgtcacaggcctctacgaagagagccacgggatcgttgccaattccatgtatgatgccgtaacaaagaaacatttcagcgattccaatgacaaggaccctttttggtggaacgaggctgtaccaatctgggtgaccaatcaactgcaggaaaaccgttcctctgcagcagcaatgtggcctggcaccgatgtgccaattcacgataccatatcctcttactttatgaactataactcatcagtgtcgttcgaagagcggctcaacaacatcaccatgtggctgaacaattcaaatccccctgtaaccttcgctaccctatactgggaagaacctgatgcctctggacacaagtatggcccagaagataaggaaaatatgagtcgagtcctgaaaaaaatcgacgacctcattggggacctggtgcaaaggctgaaaatgctggggctgtgggagaatcttaacgtaatcatcacgtcagatcacggcatgacacaatgctcacaggacagactgattaacttggactcttgtattgatcactcgtactataccttgatcgacctgagtcccgttgccgctatcctccctaaaataaacagaacggaggtgtacaataagcttaagaactgtagcccacacatgaatgtttacctaaaggaggacattccgaataggttctactaccagcacaatgatcgcattcagcccatcatcctcgttgccgacgaaggttggaccatcgttttaaacgaaagcagccaaaaacttggggaccatggatacgacaactcactcccatctatgcatccttttctcgctgcccacggccctgcctttcataagggttataaacactctactattaacattgttgatatttatcctatgatgtgtcatatcctggggctgaagccccaccctaataatgggacctttggccacacgaagtgtctgcttgttgaccagtggtgtattaacttgcccgaggcaatcgctatcgtgatcgggtcgctgttggttttgaccatgctgacgtgtctgatcatcatcatgcaaaacaggttgtccgtaccccgacccttcagccggctgcagcttcaagaggatgacgatgaccccctcattggctag

SEQ ID NO: 49964 - DNA, 1362 bp, Artificial Sequence
  Description of Artificial Sequence: Synthetic coding sequence
atgaaattgctagtaatactactcttttctggtctcatcaccggattcagatcagacagcagttctagtttaccaccgaagctgcttctggtgagcttcgacgggttcagagcggattacctcaagaattatgaatttccgcacttgcaaaatttcattaaagaaggagttttagtggaacatgtgaagaacgtgtttatcaccaaaaccttcccaaatcactattctattgtgaccgggctgtatgaagagtcccatggcattgtagccaactcgatgtatgatgcagttacaaagaagcatttttctgattcaaatgataaggaccctttctggtggaacgaagcagtaccaatttgggtgacaaaccaactccaagagaatcgatcctcagctgccgcaatgtggcccggaaccgacgttccaatacatgatacaattagcagttatttcatgaattacaacagcagcgtgtccttcgaagagagactaaataatattaccatgtggctgaacaactcaaatcctcccgtcacctttgccactctgtattgggaagagccagatgccagtggccataagtacggtcccgaggataaagagaacatgtcaagagtgttgaaaaagattgatgatctgatcggggatctcgtccagaggctcaagatgttgggattgtgggaaaatctgaatgtgatcattacaagcgatcacgggatgacacagtgctctcaagatcgtcttatcaatttggacagctgtatcgatcactcctattacactctgatcgacttgtccccagtcgctgccattcttccaaaaattaatcggactgaggtttacaataaactgaagaattgctctccgcatatgaatgtctatctgaaagaagacatccccaaccggttctattaccaacacaacgatagaatccagccaatcatcctcgtcgccgacgagggttggaccattgttttaaatgagagctctcagaaattgggcgatcatggctacgacaactcacttccaagcatgcacccttttctggcagctcacgggccagcttttcacaaagggtacaaacattctaccatcaacatcgtcgatatctatcccatgatgtgccatattcttggtcttaaaccccacccaaataatgggaccttcgggcatactaagtgcctgctggtcgatcaatggtgcatcaacttgccagaggctattgctattgtcattggaagcctcttggtcctgactatgctgacctgtctcattattattatgcagaatagactgtctgtgcccagacctttcagtaggcttcaactccaagaagatgacgacgaccctctgattgggtag

SEQ ID NO: 49965 - DNA, 1377 bp, Artificial Sequence
  Description of Artificial Sequence: Synthetic coding sequence
atgagaggcttggctgtgttgcttacagttgctcttgcaaccctgctggctcctggagccggagctcccgtccagtcccagggctctcagaacaaattgctcctcgtgagcttcgatggctttcgatggaactacgaccaggatgtggacacccccaacttggatgccatggcccgagacggagtgaaagctagatacatgacccccgcattcgtgactatgacatctccgtgtcattttacactggtgactggtaaatatattgaaaaccatggtgtcgtgcataacatgtattacaacactacttctaaggtcaaattaccctatcatgctacattgggtatccagagatggtgggataacgggtccgtgccaatctggatcaccgcccagaggcaaggcctgagagccggatcctttttttatcccggaggcaatgtgacctatcagggggtcgctgtcaccagatccaggaaggagggcattgctcacaactataaaaacgagacagagtggcgggctaacatcgataccgtgatggcttggttcacggaggaggacttagatctggttacactgtactttggtgagccagactctactgggcatcgctatggccctgagtcaccagagagacgagaaatggtccggcaggtcgatcggactgtgggctatttacgggaatctattgcccgtaatcatctgacggaccgcctgaacctgatcatcaccagcgatcatggcatgaccaccgtggacaagcgcgcaggcgatttggttgaatttcacaagttccccaacttcacatttagggacatcgaatttgaactgctggattacggccctaacgggatgttactccctaaagagggcagactggagaaggtgtatgacgccttaaaggatgcccaccccaagcttcacgtctataagaaggaggccttcccagaggcgttccactacgccaataatccacgagtgacaccgttgttgatgtattccgatctgggttacgtcatccacggcaggattaatgtgcagttcaacaacggagagcatgggtttgataacaaagacatggatatgaagaccatattcagggcagtgggaccaagcttcagggctggcctagaggtcgagccttttgaatctgtacacgtatacgagctcatgtgtagactcctggggatcgtcccggaggccaacgatggccacctggcgacactgctgccaatgctccacaccgaatccgcattaccccctgatgggcgaccgacacttctgccaaaagggagatctgccctgcctccatcgtcgagaccgctattggtgatgggactgctggggactgtcattctcctctccgaagtggcctag

SEQ ID NO: 49966 - DNA, 1305 bp, Artificial Sequence
  Description of Artificial Sequence: Synthetic coding sequence
atggccgcagctgcgggttcctgtgcccgagtagctgcctggggcggaaaacttcggcgaggccttgcggtttcaaggcaggccgtccgctccccaggaccgctagcagccgcagtggccggagctgcgctcgccggagctggcgcagcctggcaccattcacgggtaagtgtggctgcaagggatggcagctttaccgtctcggcccagaagaacgttgagcatggcatcatttacatcggaaagccatcgcttagaaagcagcgatttatgcagttcagctcactcgagcacgaaggcgaatattatatgacccctcgggacttcttattctccgtgatgttcgagcagatggaaagaaaaacgtccgtaaagaagctcacaaagaaggatatcgaggatacactttcagggatccagacagcaggatgcggctcaaccttctttagggacctcggtgacaaaggtctgatctcttacaccgaatatctgttcctccttacaatactgaccaagccacatagcggattccacgtcgccttcaagatgctagacactgacggcaacgagatgatcgagaaacgcgaattcttcaagcttcagaagatcataagcaaacaggacgatctaatgaccgtaaaaaccaacgaaacaggatatcaagaagcgattgtgaaggaacccgaaattaatacaacactgcagatgcgattcttcggaaaacgaggccagcggaagctgcattataaagaattcaggaggtttatggaaaacctccagactgagatacaggagatggaatttttgcagttttccaaagggttaagtttcatgagaaaggaggactttgctgaatggctactgttcttcactaatacagaaaacaaagatatatactggaagaatgtgagagagaaattaagtgcaggcgaaagcatatcactcgacgaatttaaatcgttttgtcatttcaccactcatctggaggatttcgcaatcgccatgcagatgtttagcttagctcatcgccctgtcaggctggcagaatttaaaagagcagtgaaagtggccacaggacaagagttaagcaataacatcctcgacacggtctttaaaatctttgatttggatggcgacgagtgtctgtcccatgaggagtttttaggcgttcttaaaaacagaatgcataggggcctgtgggtcccgcagcaccaaagcatccaggagtactggaaatgcgtgaagaaagagagtatcaaaggagtcaaagaagtttggaagcaagctgggaagggtttgttctag

SEQ ID NO: 49967 - DNA, 1593 bp, Artificial Sequence
  Description of Artificial Sequence: Synthetic coding sequence
atggccgcactccgcaggctgctctggccaccaccacgagtttcgccacccctgtgtgcacaccagcccctgttggggccatggggtcgtcctgccgtcacaaccttaggcctgcccggacggccatttagcagccgcgaggatgaggagcgcgctgtagcagaggccgcttggcgccgacgacgaaggtggggcgagctttccgtggcggcagctgccggtggcggtctggtgggcttagtgtgttaccagctgtatggagaccctagagcgggaagcccagccaccggacggccttcaaagtccgcagccaccgagcctgaggacccgccacgcggacggggtatgcttcccatccctgtcgctgctgcaaaggagactgtggccatcgggaggactgacatcgaagaccttgacctctacgctacgagtcgtgaacgacgcttcaggctcttcgcctcaatcgagtgtgaagggcagctgttcatgaccccgtacgacttcattcttgccgtgaccactgatgagcccaaggtggccaagacctggaagtcactgagcaagcaagaactcaatcagatgctggccgagacacctcctgtgtggaaggggagctcaaaattgtttagaaatctaaaggagaagggggtcatttcgtacacggagtatctcttcctgctgtgcattcttaccaaaccccatgccggattccggattgcatttaacatgttcgacaccgatggaaatgaaatggtcgataaaaaggaattccttgttctccaggagatctttagaaagaagaacgagaagcgcgagattaagggcgatgaggagaagcgggctatgctccgcctgcagctgtacgggtaccattcacccactaatagtgtcctgaaaacagacgctgaggaactggtgtcacgaagctactgggacactttgcggcgtaatacctcacaggccctgttctcagatctcgccgagagagcggatgacatcacatcgctcgtgaccgatactacgctgcttgtgcatttttttggaaagaagggtaaggccgaactaaatttcgaagatttttatcgattcatggacaatctgcagactgaagtcttagagatcgagtttctttcctactccaacggaatgaataccatttctgaggaggacttcgctcacattctcctgcgctacactaacgtggaaaacacatcagtgttcctggagaatgttcgctactccatacccgaagagaaggggatcacctttgatgagttccggagtttctttcaattcttaaataacctcgaggactttgccatcgctctgaacatgtacaatttcgccagtcggagcatagggcaggacgagtttaagcgtgccgtatacgttgctaccggcctgaagtttagccctcacctcgtcaacaccgtcttcaaaatattcgacgttgataaggacgatcaactctcctacaaggaatttatcgggatcatgaaggatcgcctgcaccgaggatttagaggatacaagactgtccagaaataccctacatttaaatcctgtctcaagaaagaactccattctcgctag

SEQ ID NO: 49968 - DNA, 534 bp, Artificial Sequence
  Description of Artificial Sequence: Synthetic coding sequence
atgtttaaacagtacgacgccggacgagatggttttattgatttaatggaactcaagttgatgatggagaaactgggcgctcctcagacccatttgggcctcaaaaacatgattaaggaggtagacgaggactttgattctaagttatcttttcgtgagtttctgttgatttttcgcaaagccgcagcgggtgagctccaagaagactctggcctgtgtgttcttgcgaggctgagcgaaatcgatgtgagttctgagggagtgaagggtgcaaagtcttttttcgaagccaaatggaactgggtttgtcgttgggccccacgcactgggagtcggggtagtggctggcagcaattagaaagattgcctagcagcgcactggctctgcaacagccccagaacatcggaccagggcatcagcgagtacagccgcttcggggtggagatcaaggccgagccggaggcaaggaagaagccggtggaggggacgaggcagctgaatcagggctacagggcgctgccgtacatctctag

SEQ ID NO: 49969 - DNA, 723 bp, Artificial Sequence
  Description of Artificial Sequence: Synthetic coding sequence
atggcgaccgatgagcttgctaccaagttgtctaggagactccagatggagggggaaggcggaggagaaacacccgaacagcccggtctcaacggggcagctgctgccgcagctggcgcacctgacgaagctgcagaggccctcggctccgccgactgtgagctcagcgcaaaactgctgcgtcgcgcagaccttaatcagggaatcggagaaccccagagcccatcccgccgagtgttcaatccatatactgaatttaaagagttctcacggaagcagatcaaggacatggagaagatgttcaagcaatacgatgcgggacgagatgggtttatcgacctgatggagttaaagttgatgatggaaaagctgggcgcacctcagacacatctaggactgaaaaatatgattaaggaggtcgacgaggacttcgattctaagctgtcttttcgggagttcttactcatcttccgaaaagcagcagctggagaactgcaggaggactctggcctatgcgtgctggccaggctttctgagatcgacgtgtcttccgagggcgttaagggtgccaaaagcttcttcgaagccaaggtacaggctattaacgtatcttcccggtttgaggaagagattaaggccgagcaggaggaaagaaaaaagcaggctgaagagatgaagcaacggaaggccgctttcaaggaacttcagtctacatttaagtag

SEQ ID NO: 49970 - DNA, 540 bp, Artificial Sequence
  Description of Artificial Sequence: Synthetic coding sequence
taaaagatgttcaagcagtacgatgcaggacgcgacgggtttatcgatctgatggaactgaagctgatgatggagaagctgggcgctccacagactcacctcggactgaaaaacatgatcaaggaggttgatgaagactttgactccaagctatctttccgagaattccttttgattttccggaaggcggcagctggggagctgcaggaggactctgggttatgtgtgttagcaagactgtccgagatcgacgtttcgagcgaaggggtcaaaggcgcaaaaagttttttcgaggcaaaatggaactgggtttgccgctgggcgccaagaacaggcagcagggggagtggatggcagcagctagagagactgccttcttctgccttggccctgcagcaacctcagaacatcggccctggccatcagcgggtgcagccattgcgcggaggagaccaggggagggccggagggaaagaggaggccggaggtggtgacgaggcagccgagagcggcctccagggcgctgccgtgcacctctag

SEQ ID NO: 49971 - DNA, 2073 bp, Artificial Sequence
  Description of Artificial Sequence: Synthetic coding sequence
atgaagagacttcccctgctggttgtcttctctaccctgctgaactgttcttatacgcagaattgtactaaaacgccctgcttgcccaatgcaaagtgtgaaatccgcaatggtatcgaagcctgctactgtaatatgggatttagtgggaacggagtcactatatgcgaagacgacaatgaatgtggaaatctaactcagtcgtgcggcgagaatgcaaactgtacgaacaccgagggttcttactactgcatgtgcgtgcccggatttagatcctcatccaatcaggatcgttttataacaaatgacggcaccgtgtgtattgaaaacgttaacgcaaactgccatctggataacgtctgtatcgccgcaaatattaacaagaccctcactaaaatccggtctattaaggagccagtggccctcctccaggaggtttaccgaaattcagtgactgacttgtctcccacagacattataacttacatcgagatcctggcagagagcagcagtctcctcgggtacaagaataacacaataagcgccaaagatacactgtctaacagtactctgactgagttcgttaaaactgttaataactttgtgcagcgcgacacatttgttgtctgggacaagctgagcgtcaaccatcgccgaacacacttaacaaaactaatgcatactgtggaacaggccaccctgagaattagccagtcttttcaaaagacaacagagttcgatacgaacagtacggacatcgctttgaaggtgtttttctttgatagttacaatatgaagcacatccaccctcacatgaatatggatggcgattatattaacatttttcctaagaggaaggccgcttatgactccaacggaaacgtggcagttgcgtttgtttactataaaagcatcggacccctgctgagctcctccgacaacttcctgctaaaaccacagaactacgataacagcgaagaagaggaacgggtgataagcagcgtaatctctgtcagtatgagcagcaatccccctactctgtacgagctggagaaaataacatttacccttagtcacagaaaggtgaccgatcgataccggtcattatgcgcattttggaattacagccctgatacgatgaatggctcttggagcagtgaaggctgtgaattgacgtatagcaacgagacccatacatcctgcaggtgtaaccacctgactcacttcgcaattctaatgtcaagcggcccttccattgggatcaaagactataacatcctcacaagaatcactcagctcggtattattatcagcctcatatgcctggccatctgtatttttaccttctggtttttttccgagattcaatcaacacgaaccaccattcataagaatctttgctgttctctgtttctcgcagaactggtcttcctggtggggattaatactaatacaaataagctcttctgtagtataatcgctgggctgctccactactttttcctggccgcttttgcctggatgtgcatagagggcatccacctctaccttatcgtggtgggagtgatctacaacaaggggttcttacataagaacttttacatcttcggctacttaagccccgcagttgtcgtaggtttctccgctgccctcggctacagatactacggcacgactaaggtgtgttggctttccactgagaacaacttcatttggtcgtttatcggccctgcctgtctcattattctcgtcaatctgctagcttttggggtgattatctataaggttttccggcacacggctggcctaaagcccgaagtctcgtgctttgaaaatatcaggtcttgcgctcgtggggctcttgcgctcttattcctgctcggcactacatggatatttggagtcctgcatgtggtgcacgccagcgttgtgactgcttacttattcactgtctctaacgccttccaggggatgtttattttcctctttctatgtgtgctcagtcgaaagatccaagaagaatactatcgattatttaagaacgtcccctgctgtttcggctgtctccgatag

SEQ ID NO: 49972 - DNA, 450 bp, Artificial Sequence
  Description of Artificial Sequence: Synthetic coding sequence
gttgtggtgggcttctctgcggctctcgggtatcggtactacggcaccactaaggtgtgctggctgagcacagagaacaatttcatctggagtttcattgggccagcttgtctaatcatcctggtaaacttgcttgcatttggtgtcatcatctacaaagtatttcgacacactgccggtctgaaaccagaggtctcctgcttcgaaaatattcggagttgcgctagaggcgctttagccctcctctttctcctaggaacaacttggattttcggggtgcttcacgtagttcacgccagtgtggtgaccgcctatctcttcaccgtcagcaatgcatttcagggaatgttcatatttctattcctctgtgtcctgagcaggaaaattcaggaagaatattatcgcctatttaagaatgtcccgtgttgctttgggtgcctatcttgttag

SEQ ID NO: 49973 - DNA, 2472 bp, Artificial Sequence
  Description of Artificial Sequence: Synthetic coding sequence
atgggcggtagagtttttctggttttccttgccttctgcgtatggctgaccctgccgggagctgaaacccaggactcccgaggctgcgcgaggtggtgcccacaagatagcagctgcgtgaacgccacagcctgccgctgcaacccagggttctcaagcttttctgagattatcacaacccctatggagacatgtgatgatataaacgaatgtgcaacactgtctaaggtgagttgcggtaagttcagcgactgctggaacactgagggaagctatgactgcgtgtgttcaccgggatacgagccagtcagtggtgccaagacctttaagaacgaaagcgagaacacctgccaggacgtcgatgagtgccagcaaaaccctcggctttgtaaatcttatgggacatgcgttaacaccttaggctcctatacctgccagtgtctgccaggctttaagctgaagcccgaagacccaaaactgtgcactgatgtgaatgagtgtacaagcggacagaacccctgccactctagtactcattgtctgaacaacgttggaagctatcagtgtaggtgtcggcctggttggcagccgatcccgggatccccaaacggacccaacaacaccgtgtgcgaggacgttgatgagtgcagcagcggtcagcatcagtgtgatagttctacggtttgtttcaatactgtcggcagctactcatgtcggtgccgcccaggctggaaaccacggcacggtatccctaacaatcagaaagacaccgtctgcgaagatatgacatttagcacctggactccccctccaggggtgcattcacagactctgagcagattcttcgacaaggtgcaagacctggggcgtgattataagcctggcctcgctaataacacgatccagagcattctgcaagcactagacgaactactcgaagcacctggtgatttagagactctcccacgcttgcagcaacattgtgtcgccagccacttgcttgatggcttggaggatgtgctgaggggactcagcaaaaatctttcaaatggcctgcttaacttctcctatccagcaggtactgaactgagccttgaggttcaaaagcaagtcgatagatccgtgacactgcggcagaatcaggctgtcatgcagctggattggaaccaggctcagaagagcggagacccaggaccatcagtcgtcggactggtgagcatccccggaatgggcaaattactagccgaggcccctctcgttcttgagccagagaaacagatgttgctccatgagacacatcagggtctgctccaggacggaagcccgattcttctttcagacgttatttccgctttcctgtctaataatgatactcagaatttatcttctccagtcactttcaccttctcccataggtcggtcattcctcgccagaaggtgctgtgtgtcttctgggagcatgggcagaatgggtgcgggcattgggctaccaccggatgttcaacaatcggaacacgggatacgagtaccatctgcaggtgtacgcatctgagctctttcgccgtattgatggcccattacgatgtgcaggaagaagaccccgttctgactgtgattacctacatggggctgtctgtctcattgctctgtctgctgctcgcggctctcacattcctgttgtgtaaagcgatccaaaatacttccacatctctgcacctccagctctctttgtgcttgtttctggcccatttgctcttcctggtggcgatcgaccagaccggccacaaggtcctgtgctccattattgccggaaccctgcattatctatatctggccaccctgacttggatgctcctggaggcgctgtatctgttcctaacggcccgaaatcttacagtggttaattattcgagcatcaatagattcatgaaaaaactgatgttcccggtgggctacggggtcccagccgtgaccgttgctatatctgccgcaagtaggccccatttgtacggtaccccctccagatgctggctgcaaccagagaaaggcttcatatgggggtttctgggcccagtgtgtgctatattctcggtgaacctggttctctttctcgtgaccctttggattcttaagaacagactgtcaagcctgaacagcgaggtctcaaccctgaggaatactcggatgctggcgttcaaagcaaccgcccagctgtttatcttggggtgtacctggtgcctgggcatcttgcaggtgggccctgccgcaagagttatggcatacttgttcaccattatcaactctttacaaggtgtttttatcttcctcgtgtattgcctgctgtcgcagcaggttagagagcagtatggaaagtggagcaaaggtattaggaaactgaagacagaaagtgaaatgcacacactgtcatcgtcagccaaggcggacacctctaaaccatccactgttaattag

SEQ ID NO: 49974 - DNA, 2472 bp, Artificial Sequence
  Description of Artificial Sequence: Synthetic coding sequence
atgggtggaagggtgtttcttgtgtttctggccttttgcgtatggctgacattaccgggagccgagactcaggactcaaggggctgcgcgagatggtgtcctcaagacagctcttgtgtgaatgcaacagcttgccgctgtaacccgggattcagctctttttctgagatcatcactactccaatggaaacatgtgatgatataaacgagtgtgccacactatctaaggtctcctgtggcaaattctcagattgttggaacacggagggatcgtatgattgtgtgtgtagtcctggctatgagcctgtgtcgggtgcaaaaaccttcaagaacgagtcagaaaatacttgtcaggacgtcgacgagtgccagcagaatcctcggctatgtaaaagttatgggacttgtgtaaatactcttggatcctacacctgccagtgtctgcctggtttcaaactgaaacctgaggatcctaaattgtgcactgacgtaaacgagtgtaccagtggccagaatccctgccactcctccacgcattgcctgaataatgtgggcagctaccagtgccggtgccgcccagggtggcagcctattccagggtcaccaaacgggccaaataatacggtctgcgaggacgtcgatgaatgctcatctggccagcatcagtgcgattcgtcaacggtttgcttcaatactgtaggctcttatagctgtcgctgtcgtcccggttggaaacctcgccacggcattcctaacaaccaaaaggacaccgtgtgtgaggacatgacattttcaacttggacacccccacctggtgtgcattctcagacactgtcacgtttttttgacaaagtccaggacctcggccgtgactataagccgggacttgctaacaataccatccagagtatcctgcaagccctcgacgaactactcgaagcaccaggtgacctcgagacccttcccagactccagcagcattgcgttgcgagtcaccttctagatggactggaggacgtgctgcggggtctctcgaaaaacctttcaaacggtctcctgaatttttcgtaccccgctggaaccgaactcagtcttgaagttcaaaaacaggtcgaccgctctgtcacactccgccagaatcaagccgtgatgcagcttgactggaatcaggcacaaaaaagcggggatccaggcccaagcgtcgttggcctagtaagcattccgggtatggggaagttattggcagaggcgcctctggtgttagagccggaaaaacaaatgttgctccacgagacccatcagggcctgttgcaggatggtagccctatcctgctgtcggacgtcatctctgcatttttatccaacaacgacacgcaaaatctctcttctcctgtcacctttacttttagtcacaggagtgttatccctcgccaaaaagtcttgtgcgttttctgggaacatggccagaacgggtgcgggcactgggccactacagggtgctcaacaattggaacacgcgatacatcgaccatctgcagatgtacccacctttcctctttcgctgtgttaatggctcactatgacgtccaggaagaagaccccgtgctcacagtcataacatatatgggcctttctgtcagtctcctgtgtctgttactcgcagcgctgaccttcttattatgcaaagccatccaaaacaccagcacttctctacacctccagttatctctctgtctgttcctcgcacatctacttttcctggtcgccatcgatcaaactgggcacaaggttttgtgcagtattatcgccggaaccctgcattacctctaccttgcaacattgacttggatgctgctcgaggctctttacctttttctaacagcaaggaatttgaccgtagtgaactactcatccataaataggttcatgaaaaagttaatgtttccagtggggtatggcgttcccgcagtaaccgtagcgattagcgccgctagtcgcccacatctatacgggacaccctcccgctgctggctgcagcctgaaaagggcttcatctggggctttctgggccctgtctgtgccatcttttcagttaatttggtactcttcctggtgaccctttggatcttgaagaatcgtctgtcatcacttaattccgaggtaagtacactgagaaacacgaggatgctggcttttaaggctacagcccaactcttcatcctgggatgtacatggtgccttggcatcctacaggtagggcctgcggctcgggttatggcatatttattcaccattataaacagcctgcagggagtgtttattttcctggtctattgcttgctgtctcagcaggtcagggagcagtatggcaaatggagtaagggcatcaggaagctcaagaccgagtcagagatgcacaccttatcttcctctgctaaagcagatacctcgaagccttccaccgtgaactag

SEQ ID NO: 49975 - DNA, 2325 bp, Artificial Sequence
  Description of Artificial Sequence: Synthetic coding sequence
atgggcggaagggtttttctggtgttcctggctttttgcgtgtggctgacgctgccaggggctgaaacgcaagattctcggggatgcgctagatggtgcccgcaggactcctcctgcgtgaacgccactgcatgccgctgcaaccccggtttcagctccttttccgagataattaccacaccaatggagacttgcgacgatatcaatgagtgtgcaactctctctaaggtgagctgcggcaagttctccgactgctggaataccgagggatcatatgactgcgtttgcagccccggttatgagcctgtgagtggagctaagaccttcaagaacgaatctgagaatacatgtcaggacgtggatgagtgccaacagaaccccaggctgtgtaagtcatacggtacttgtgtgaacaccctgggaagctatacctgccagtgtttacccggtttcaaactaaagccagaggatcccaagctgtgtacggatgttgacgagtgcagctcgggacagcaccagtgcgacagttccactgtttgttttaacacagtgggttcatactcgtgtaggtgtagacctgggtggaaacctagacacgggattcctaataatcagaaggacactgtgtgcgaagacatgacattctccacttggactcctccgcctggcgtccacagccagaccctgtcgcgtttctttgataaagtccaggacctcgggagagattacaagcctgggctcgccaacaatacaatacagtcaatcctccaggccctcgacgaactgcttgaggccccaggcgatcttgagaccctccctagactgcagcagcactgcgtcgccagccatctcctagacggactggaggatgtgttacggggattaagtaaaaaccttagcaatggattgctcaatttttcgtatccggctggaaccgagctgtcattagaagtccaaaagcaggtcgatcgatcagtaactctgcgccaaaaccaggcggtgatgcagctagattggaatcaggctcaaaaaagcggagaccctggccctagcgtggtgggcctcgtttcaattcccggtatgggcaaattgttggctgaggctcctctggtgttagaacccgaaaagcaaatgctcctgcatgaaacccaccagggactgttacaggatggatccccgatactgcttagtgacgtgatctcagctttcctttcaaataacgatacccaaaatctgagcagccccgtgacctttaccttcagccaccggagcgtgatcccacggcagaaggtgctctgcgtcttctgggaacatggacaaaacgggtgcggccattgggccaccacaggttgttctactataggcacccgggatacaagcaccatttgcaggtgcactcacctgagtagctttgctgtgctcatggcgcactacgatgtgcaggaggaggaccctgttctgacagtgattacatacatgggcctgtccgtgagtctgctatgtctgctcctggcggctttgacattccttttgtgcaaggcaatacagaatacatccacatcgcttcacctacagttaagcctctgtctctttctcgcgcacctattgttcctagtggccattgatcagaccggacacaaggtgttgtgtagcatcatcgctggcaccctgcattacctgtacttggctaccttaacctggatgctcctcgaggcactatacctcttcctgactgcaagaaatctgaccgttgtgaattacagtagcataaatcgcttcatgaagaagctcatgtttcccgtgggttatggggtgcctgccgtaactgtagcaattagtgcagctagccggccacacttgtatgggactccctcacgttgctggctgcagcctgagaaggggtttatctggggtttcttgggacctgtgtgtgccatcttttcagtgaatttggtcttgttcttagtgaccctgtggattctgaagaatcgccttagttcactgaactcagaagtcagcacactgcgtaacacacggatgctggctttcaaggctacagctcagttattcattctcggctgtacatggtgcctcggcatcttgcaggtaggcccagctgctcgggtaatggcctatctcttcactatcatcaacagcttgcagggcgtgtttattttcctggtgtactgtctcttgagccagcaggtcagggagcagtacgggaagtggtctaagggtattaggaagctcaagactgaatccgaaatgcacaccctctcctcctcggctaaagccgacacttctaaaccctccacggttaattag

SEQ ID NO: 49976 - DNA, 2046 bp, Artificial Sequence
  Description of Artificial Sequence: Synthetic coding sequence
atggggggaagagtgtttctagtctttctcgcgttctgtgtatggttgaccctacccggtgccgagactcaggactcgagaggctgcgccagatggtgtcctcaggactctagctgcgttaacgccaccgcttgcaggtgcaatccgggattttcaagttttagcgaaatcattaccactccaatggaaacgtgtgacgatatcaacgaatgtgcaactctctctaaagtaagctgtggaaagttttctgattgctggaacacagaaggctcttacgactgtgtctgctccccagggtatgaaccggtgtcgggcgctaagactttcaaaaacgaaagcgaaaatacctgtcaggacatgaccttctccacttggacacctcccccaggcgtgcacagtcagacacttagccgattctttgacaaagtacaggatctcggcagagactacaagccaggcctagccaacaatacgatccagtcaatcctacaagctttggatgaacttctggaggcacccggagatctcgaaaccctgccccgtctgcagcagcactgtgttgcttcacacctcttggatggactggaagacgtactacggggactgtcaaagaatttatcaaacggcctgctgaatttcagctaccccgcaggaaccgagttgtctcttgaagtgcaaaaacaggtcgaccgatctgtgaccctgcgccagaatcaagctgtgatgcaattggattggaaccaggcccagaaaagcggtgaccctggaccttcggtcgtgggactcgtaagcattcccggtatgggtaaattgctcgcagaagccccacttgtgttagagcctgagaaacagatgttgctccacgagacccatcagggactcctgcaggatggctcgccaattctgctctctgatgtgatctctgccttcttaagtaataacgatacacagaacctttcttctccggtgacatttaccttctcccaccggtcagtcatcccccgtcagaaggtgctttgcgtgttttgggagcatggtcagaacgggtgcggacactgggctactacaggatgctccacaatagggacaagggatacctctacaatctgccgatgcacccatctgtccagcttcgccgtgcttatggcacactatgatgtgcaggaggaggatccagtgttgacggtcatcacttacatgggactgagtgtgagcctattgtgcctcctcctggcggctctcacgttcttgttatgtaaagcaatccaaaacacttcaacaagccttcatctgcaactgtccctgtgcttgttcctggcccaccttctgttcctcgttgccatcgaccaaacaggtcacaaggtactgtgttctattattgccggtactctgcattacctctacctggccacattgacctggatgcttctcgaggcattatatctattcctgacagccagaaacctcaccgtcgttaattattccagcattaatcgctttatgaaaaagttgatgtttcctgttggatatggcgtgcccgctgtgactgttgccattagcgccgcatcccggccacacctttacggcacacccagccgctgctggctgcagccggaaaaggggttcatatggggattcctaggaccggtctgcgccatcttttctgtgaacttggtcctcttcctggtcaccctatggatcctgaaaaaccgactatcgtccctgaatagcgaagtgagcacactacggaataccaggatgttggctttcaaggctaccgcgcagttgttcattctgggatgcacttggtgcctggggatcctccaggtgggcccagctgccagggttatggcttacctgttcactataatcaattccttgcagggagtcttcatatttctcgtgtattgtctcctgtcacaacaggtaagggagcagtacggcaagtggtccaaagggattcgcaagctcaaaaccgagtctgagatgcacacactgtcgtcctccgcaaaagccgacaccagcaaaccatccaccgtcaattag

SEQ ID NO: 49977 - DNA, 2193 bp, Artificial Sequence
  Description of Artificial Sequence: Synthetic coding sequence
atggggggacgtgtatttcttgtgttcctggccttctgtgtatggttgaccctgcccggagctgaaacccaggattcccgtggctgtgcacgatggtgcccgcaggattcaagttgcgtcaacgctacggcgtgccggtgtaatcctggattttcctccttctccgagattataacgacacctatggaaacttgcgacgacatcaacgagtgcgccacactgtctaaggttagctgtggtaaattcagtgattgctggaacacagaagggtcctatgattgcgtctgctctcctggctacgaacctgtgtctggcgcaaaaacctttaaaaatgagtcagagaatacctgtcaggacgtggacgagtgctccagcgggcaacaccagtgcgactccagcacggtgtgcttcaatacggttggaagctacagctgtcgttgtagaccagggtggaaacctcgtcacgggatccccaataatcaaaaggacactgtatgcgaggatatgaccttcagcacatggaccccaccacccggtgtgcacagccagacactgtccaggttcttcgacaaggtgcaggatctgggacgtgattacaaacctggtctcgccaacaacaccatccagagcattctccaggccctggacgagctcctggaagcacccggagatcttgaaactctgcccagactgcaacaacactgtgtcgccagtcacctgctggacgggcttgaagatgttctgcgtggcttatccaagaatctaagcaatgggcttctgaatttctcttatcctgcaggcaccgagctctctctggaagtccagaaacaagtcgatcgtagtgtgactctgcggcaaaaccaggctgtcatgcagttggactggaatcaggcgcagaaaagcggagatccagggcctagtgtggtggggttagtcagtatccccggaatgggtaaactgctcgctgaggcccctctggtacttgagccagagaaacagatgctattacacgagacacatcaagggctcctgcaggacggctctcccatccttctgtctgacgtcatcagcgcttttctatcgaataacgacacacaaaatttgtcctcgcccgttactttcacttttagccatagatccgtgattccacgtcaaaaagtgctttgtgttttttgggaacatgggcagaacggttgcggccattgggcgacgacaggatgtagtaccatcggcaccagggatacatctactatctgccgttgtacacacttatcctcgttcgccgttcttatggcccactatgacgtgcaggaggaggatcccgttttaactgtcattacctacatgggactgtccgttagtctactgtgcctgcttctggcggcattgaccttcctcctgtgtaaagcaattcaaaatacctcaaccagtctgcatttgcaactctctttgtgtctgttcctcgctcacctactcttcctcgtcgctattgatcaaaccgggcacaaagtgctttgttctatcatcgctggaacccttcactatctgtaccttgctaccctgacatggatgctgctcgaagcactttacctcttccttacagccagaaatttaacagtggtgaattactcgtcaattaatcgattcatgaagaaactcatgttcccagtgggatacggggtaccggcagttaccgtcgcgatcagtgcagcctccagaccacacctatatggaactccaagcaggtgctggcttcaacctgagaaggggtttatttggggattcttgggacccgtttgcgcaatattctcagtcaaccttgtgctgttcctggttacactctggattttgaagaatcgactgagctctctgaactccgaagtgtctacccttcgtaacacacgaatgttggctttcaaggctacagctcaactgtttattctgggttgcacgtggtgtcttggaattttacaagtgggccctgccgcaagagtaatggcttacttatttactatcatcaatagcctacagggcgtctttatatttttggtgtattgtctgctgagtcagcaagtgcgcgagcaatacggaaagtggtcaaagggaattcgaaagctgaagacagaatccgagatgcatacactctctagttccgctaaagcagatacctccaaaccctcaactgtgaattag

SEQ ID NO: 49978 - DNA, 720 bp, Artificial Sequence
  Description of Artificial Sequence: Synthetic coding sequence
atgggcggtagggttttcttggtcttcctcgccttttgtgtctggctgacactgcctggcgcagagacccaggattcacgcggatgcgccaggtggtgtcctcaggacagctcctgtgtcaatgccactgcctgcaggtgtaaccccggtttcagttcattcagcgagataatcaccaccccaatggagacctgcgacgatattaacgaatgcgccacacttagtaaagtgagctgtggcaaattttctgactgctggaataccgagggcagctatgattgtgtgtgtagccctgggtacgagccagtctccggcgctaagaccttcaaaaacgagagtgagaatacttgtcaggatgtggatgagtgccagcagaacccacgtctgtgtaagagctacggcacatgcgtcaatacactaggctcttacacctgccagtgtttgccaggattcaaactgaaaccagaggaccccaagctatgcaccgacgtcaacgaatgtaccagcggacagaacccttgccacagcagcactcactgtttaaacaacgtaggatcttaccaatgcagatgccggcctggatggcagcccatcccaggaagtccaaacggcccaaacaacactgtgtgcgaaggcagagaactgcgctctcatgtgcctagggatccccagacgtccgatcatatgttcaacggtgctcataccaatcaggctgaatag

SEQ ID NO: 49979 - DNA, 1140 bp, Artificial Sequence
  Description of Artificial Sequence: Synthetic coding sequence
atggggggtcgcgtgttcctggtgtttctggccttctgcgtgtggctcacattgcctggcgcagagactcaagactcccgcggttgtgccaggtggtgcccacaagattcttcctgcgtcaacgctaccgcttgtaggtgcaaccctgggtttagctccttttctgaaatcatcacaaccccgatggaaacttgcgacgatatcaatgaatgtgctacgctcagcaaagtgagctgtggtaaattttccgactgttggaatacggagggttcctacgactgtgtctgcagccctggatacgaacccgtgagcggggctaagacgttcaaaaatgagagcgagaatacatgtcaagacgtggacgagtgtcagcagaatcccagactgtgcaagagctatggaacttgcgtcaatacattgggaagttatacatgtcagtgcttgcctggatttaagcttaagcccgaggatcctaagctgtgcaccgatgttgacgagtgctcctcaggacagcaccagtgcgacagtagcactgtttgtttcaatactgtggggtcctattcatgcagatgtcggcctgggtggaaacctaggcatggcatccccaacaatcagaaggacacagtttgcgaggatatgacattctccacatggacaccgccacctggtgtgcacagtcaaacgttgtcaagattctttgacaaggtgcaggatctgggtcgggactataaaccagggctggctaataacacgatacagtccattttgcaagccctggatgaactgctggaagctcccggtgaccttgaaactttgcctaggcttcagcagcattgcgtggcttctcatctgcttgatggactggaggacgtcttgaggggcctatccaagaacctgtcaaacggcctgctgaatttctcttatcctgctggcactgaactgagtcttgaggtgcagaaacaggtagaccgtagtgtcaccctgagacagaatcaagcagtgatgcagctagactggaaccaggcccagaaaagtggcgaccccggaggaggaagtcgcgcagactgccaccacctccatggcgcagaacggctctcagccgtgcctccgccagggggaccccacttctctccagtctag

SEQ ID NO: 49980 - DNA, 678 bp, Artificial Sequence
  Description of Artificial Sequence: Synthetic coding sequence
atgacattctcaacctggaccccaccacccggagtgcatagtcaaacactaagtaggtttttcgacaaggttcaagatctcgggagagactataaacccggactggcaaacaatacaatacagtcaatcctccaggcactggatgagttgctcgaggctccgggtgatctggaaacacttcctcgcctgcagcagcactgtgtggcttctcacctcctggatggtctggaagacgtactgagaggcctgtccaagaacctttccaacggtctgttgaacttcagttaccccgctgggaccgagttatccttagaagtacagaagcaggtcgacaggtccgtgaccctgagacagaaccaggctgtgatgcaacttgattggaaccaggcccaaaaatctggagacccagtgagcgacccagagactgagggcgctctgtgtctgctgggcgcatggccagagtggatgtggagcctaggacaccatcgtctgcagcacaataggcaccagagacatcaacatcatttgcccctgcacccccctgagcagctttgccggcctcacggcccattgcgatgtgcgggaggtggctctcgcgctgactgtcaccatctgcacggagccgaacgtctgtcagcagtaccccctccaggagggccacacttctcaccagtgtag

SEQ ID NO: 49981 - DNA, 2298 bp, Artificial Sequence
  Description of Artificial Sequence: Synthetic coding sequence
atgggcggtagagttttcctggtgttcctggctttttgcgtgtggctgacactccccggagcagagacccaagattcaagaggctgcgccagatggtgcccccaggattcatcttgtgtgaatgcaaccgcctgtaggtgcaacccaggcttctctagttttagtgagatcattactacacccatggaaacctgtgatgatattaacgaatgtgctacactgtccaaggtgtcatgtggcaagttctcggattgctggaacaccgagggctcgtatgattgtgtgtgttcccccggatatgagcctgtctccggagcgaagacctttaaaaatgagtccgaaaacacttgccaggatgttgacgaatgtcagcagaatcccagactctgcaagtcttatgggacctgtgtgaacaccctgggaagttatacatgccagtgcctgccaggatttaagctgaaacccgaagatcccaaattatgtacagacgttaatgagtgtacctctggccagaacccttgtcattccagtactcattgtctcaacaacgtcgggagttatcagtgtcgctgccgtccaggctggcaaccgatccctggcagccctaacggcccaaacaatacagtttgtgaggatgtggacgaatgctcgagtggccagcaccaatgtgactccagtacagtatgctttaacaccgtgggctcttattcctgtcggtgtcgccctgggtggaaacctagacacggcatcccgaacaaccaaaaggacaccgtgtgtgaggatatgacatttagcacttggacaccaccgccaggggttcatagccagacattaagccgcttctttgacaaggtgcaagacttaggccgagactacaagccgggactggcaaataataccattcagagcattctccaggcactggatgaattgctggaggctcccggtgatctggaaacactgccaaggcttcaacaacattgtgttgctagccacctgctcgatggtctggaggatgtactccgcggtctgtctaagaacttgagcaacggcttgcttaacttctcatacccagcgggaacagagctgtctctggaagtgcagaaacaggtagacagaagcgttaccttaagacaaaatcaggccgtgatgcagttggactggaatcaggcccaaaaaagcggcgacccaggaccttctgtggtgggactagtctcaatccccggaatgggcaaattgctggctgaagctcccctggtgctcgaacctgaaaagcaaatgttactccacgagacccaccagggcctccttcaggatgggagtccgatactgctgagtgatgtgataagtgccttcctgtctaacaacgatactcaaaacctgtcttcccccgtgactttcactttctcccatcgcgaggaggatcctgtcctcactgtaatcacttatatggggctttccgtgtcgctgctatgcctactgctggcagcactgaccttcctcctctgtaaggcgatccagaacacctccactagcctacaccttcaactttccctgtgtctatttttagcacatctgctttttctagttgccattgaccagactggacacaaggtcctctgttctattattgctgggacgctgcactatctgtatctggcgacactgacttggatgctgctggaagccctttacctatttctaacagcccgaaatttaacagtagttaactactcaagcatcaaccgctttatgaaaaaactgatgtttccagtgggatatggtgtccccgcagttaccgttgctatttccgccgcttcccgcccacacttatacggcaccccttctagatgctggctgcagcctgagaagggattcatctggggattcctgggcccagtctgtgcaatattctctgttaatctcgtgctgtttcttgtgaccctatggattcttaagaacaggctcagcagccttaacagcgaagtcagtactcttcggaatacacgtatgctcgcgtttaaagctactgctcagctcttcattctaggatgcacctggtgtttaggcatcctgcaagttggaccagcagcaagggtgatggcctaccttttcacaattattaacagtctacagggggtcttcatattcctggtttattgtttgctgtcccagcaagtgcgcgaacagtatggaaaatggtcaaaggggattcgtaagctgaagactgagtcagagatgcataccttgagctccagtgccaaggccgacacctcaaaacccagtaccgtgaactag

SEQ ID NO: 49982 - DNA, 2439 bp, Artificial Sequence
  Description of Artificial Sequence: Synthetic coding sequence
atgggcggtagagtgttcctggtcttcctggctttttgtgtctggttgacgctgcccggtgcagagacacaggatagccgcggatgcgcaaggtggtgcccacaggattccagctgcgtcaatgccacggcttgcaggtgtaatcctgggttttcctcctttagtgagatcattaccaccccaatggagacctgcgatgatattaatgagtgtgcaacattgagcaaagtgtcttgtggcaagttttccgactgttggaacactgaaggcagttatgattgcgtgtgttctccaggctacgagcctgtatccggggctaagactttcaagaacgagtcagagaatacctgtcaggacgtggatgagtgccagcagaatcccagactgtgcaagtcttacggaacgtgcgtgaataccctcgggagttacacgtgccagtgtctgccagggttcaaactgaagccagaggatcccaagttgtgcacagatgtgaatgagtgcacaagcggccagaacccatgccattctagtacccattgtctgaataacgtcgggtcttaccagtgtcggtgtcgccctggctggcaacccatccccggttcccccaatggaccgaacaacacagtttgtgaagacgtagacgagtgcagctccggacagcatcagtgtgactccagcaccgtttgtttcaatacagtcggctcttactcctgtcgctgccggccaggttggaaaccgcgtcacggcattcccaacaatcagaaggataccgtgtgcgaggacatgacctttagtacttggacacctccccctggtgttcactcccagacactgtctcggttcttcgacaaggtgcaggacctggggagagactacaagcctggactggcaaataacacaatccagagcatcctccaagcccttgacgaactccttgaggcacctggagacctggagactctgcctcgcctgcagcagcactgcgtcgcctctcatttactggacggtctggaggatgtgctgagaggactgagtaagaacctatcaaacggactgttgaatttcagttacccggctggaaccgaattgagtctggaagttcagaagcaggttgaccgcagcgtgaccctccggcaaaatcaagccgtcatgcagttagactggaatcaggctcaaaagagtggtgaccccggaatgggcaaattactggccgaggccccattggtgcttgaaccggagaagcagatgctgttgcatgaaacccatcagggtctgctgcaagatggatcccccatcttactcagcgatgtcatttccgctttcttgtctaataacgacactcagaacctcagctcaccagtgacctttacttttagccataggtccgtgatccccaggcaaaaagtcctttgtgtattctgggagcatggtcagaacggctgcgggcattgggccactaccgggtgctctacaattggaacacgcgatacgtccactatctgccgatgcactcacttatcatctttcgcagtgctcatggcacattatgacgtgcaggaggaggacccagtgctgacagtcatcacttacatgggcctgtctgtaagtctactgtgcctcctgctggcagcgttgacattccttctctgcaaagccattcagaatactagcactagtctgcatttacaattgtcactttgcctcttcctcgctcacctgctatttctagtggcaatcgatcagacaggacataaggtactgtgtagtataattgccggaacccttcattatctgtacttggccacactcacctggatgctattggaggctctttatctgttcttgactgccagaaatctcactgtggtcaactattctagtataaatcgttttatgaaaaagcttatgttccccgtgggttatggggtcccggctgtgacagtcgcaatcagtgccgctagcagaccccatttgtacggcaccccgtcccgttgctggcttcagcccgaaaaggggttcatatgggggttcctcggtcctgtgtgcgccatcttctccgtgaatcttgtgctttttctggtgacgctctggattctgaagaaccgcctctcgtcccttaattcagaggttagcaccctgagaaatacaaggatgctggcatttaaggccactgcccagttatttatcctggggtgtacctggtgcttgggcatccttcaggtcggtcctgccgctcgcgtcatggcatatttattcaccatcataaattctttacagggcgtcttcatctttctcgtctactgtttgctttcacagcaggtccgcgagcagtatgggaaatggtctaaagggattcgcaaacttaagacagaatccgagatgcacaccctttctagttcagcaaaggcggataccagtaaaccttcaacggtgaactag

SEQ ID NO: 49983 - DNA, 2874 bp, Artificial Sequence
  Description of Artificial Sequence: Synthetic coding sequence
atgtatgggtccgctagaaccataactaacctcgaaggttcacctagccgctcccctcggctccctcggtctcctagactggggcatagacggactagttcaggcggtggcggtggcactggaaagacgttaagcatggaaaatatccagagcctgaatgcagcatacgcaacctccggtcctatgtacctcagtgaccacgagggtgtggcgtctactacttaccccaaggggactatgactcttgggagggctactaatagagcggtatatggaggccgtgtgaccgcaatgggctctagccccaatatcgcctcagccggtctctctcatactgatgtgttgtcatacactgatcagcatggcggtttaacgggctcctctcaccaccaccatcaccaagtcccttcgatgttgagacaagtgcgggatagtactatgctcgacctccaagcccagctaaaagagctccagagagagaatgacctccttcgcaaagaactggatatcaaagacagtaagctaggttcttccatgaattctattaaaacattctggtctcctgaactgaagaaagagcgtgttctgaggaaggaggaggccgcacgcatgtcagtgttgaaggagcagatgcgagtctcacatgaagaaaaccagcatctgcagctgactatccaggcactgcaggatgaacttcgtacacagagggacctgaaccacctgctgcagcaggaatccgggaaccgcggagcagaacactttaccatcgagctgaccgaggagaacttccggcgattacaggccgagcatgaccgtcaagctaaggagctgtttttacttaggaagactcttgaagagatggaacttcggattgaaacacagaagcaaactctcaatgcgagggatgagtcaatcaaaaagttgctggaaatgctgcagagcaaaggacttccatccaagtctctggaggatgataacgagaggacccgcagaatggcggaggccgagtcccaggtgagccaccttgaagtgattttggatcaaaaggaaaaagaaaatattcacctcagagaagaactccaccgcaggtcccaactacagccagaacccgctaaaacaaaagccctgcaaacagtgattgaaatgaaagatactaagatcgcttctttagaaagaaacattagagatttagaagatgaaatccagatgttgaaagcaaatggtgttctcaatacggaggacagagaagaggagatcaaacagatcgaggtgtataagagtcactctaaatttatgaaaacaaagatcgatcagctcaaacaggagctgagcaaaaaagagagtgagctattggctttacagactaaactggaaactttgtcaaatcagaactcagattgcaaacagcacatcgaggttctgaaagagtccctgacagctaaagagcaacgggctgcgattctgcagaccgaagtggatgcgctgcggctccggctggaggagaaggaaagctttttgaataagaagacaaaacagcttcaggatctgacagaagaaaagggtacccttgcgggtgagatcagagacatgaaggatatgttagaagttaaagaacggaagattaatgtgcttcagaagaaaatcgaaaacttgcaggagcagctgagagataaggataagcaacttacaaatctgaaagatcgtgtgaagtcccttcagacagatagttcaaataccgatacagctctggcgactctggaggaggctctgagcgagaaggagcgcataatcgagagactgaaggagcagcgggaaagagatgaccgtgagcgcctggaggagatcgaatccttccgaaaggagaataaagacctgaaggaaaaagtcaatgcactgcaggccgagctcaccgagaaggagtcctctttaatcgatctgaaagaacacgcctctagcctggcctcagccggactgaaacgtgacagcaaattaaagtccttagagatcgcaatcgaacaaaaaaaggaagaatgttctaagctagaagcccagctcaaaaaggcacacaacattgaggatgacagtagaatgaatccagagtttgcagaccagatcaagcaactggacaaggaagcaagctattaccgtgacgagtgcgggaaagctcaggccgaggttgacaggttactggagatcctcaaggaggtggagaacgagaaaaatgataaggataaaaagattgctgaactcgaaagtttgactctgaggcatatgaaggaccaaaacaagaaggttgccaatcttaaacataatcagcaactggaaaaaaaaaagaatgcccagttgttggaggaagtcagaaggcgagaggattctatggccgataactcacagcacctgcagattgaagagctgatgaatgcacttgagaagaccagacaggagctggacgcaacaaaagctcgtctcgcttccacacagcaatctctagccgaaaaagaggcccacctcgcaaatttgcgcattgaacggagaaagcagctggaagagatccttgaaatgaaacaggaggcactactcgctgctatcagcgagaaagacgcgaacatcgctttgctagaactgtccgcgagtaaaaaaaagaagacgcaagaagaagtcatggccttgaagcgcgagaaagatagattagtgcaccaactcaagcaacagactcagaatagaatgaagttgatggcagacaactatgatgacgaccaccaccattaccatcaccaccatcaccatcaccaccatcgcagcccgggtcgcagccaacattctaatcaccgtccctcccctgatcaagacgacgaggagggcatctgggcttag

SEQ ID NO: 49984 - DNA, 2874 bp, Artificial Sequence
  Description of Artificial Sequence: Synthetic coding sequence
atgtatggatcagcacggacaataaccaacctggaggggtcacctagtcggtccccacggttacctaggagcccaagactcggccacaggaggacatcctccggcggagggggaggcaccggtaagactttaagtatggaaaatattcaaagcctcaatgccgcatatgcaacaagcgggccaatgtacctgagtgaccacgaaggcgtggccagtactacgtaccccaaggggactatgaccctgggcagggctactaatagggcggtctatggcggacgggttaccgccatgggttcatctcccaacatcgccagtgccggactctcccacaccgacgtactcagttacaccgaccagcatggcggactgactggctcgagtcatcatcatcatcatcaggtgcccagcatgctgcgccaggtccgagactccacaatgctcgatctgcaggcccaacttaaggaactccaaagggagaatgatctactgcgaaaggaacttgacatcaaggactcaaagttggggtccagcatgaactccatcaagactttttggtcccccgaactcaagaaagaaagagtgctgcggaaagaagaggccgcaaggatgtccgtgctgaaagaacagatgagagtcagtcacgaagaaaatcaacaccttcagctcacaatccaagctctgcaggacgagttacggactcagagggatcttaatcacctgctgcaacaagaatcgggcaaccgtggagctgagcactttactattgagcttaccgaggaaaactttcgcaggttacaagcagagcacgacagacaggctaaggagttgtttttgctcagaaagacgctcgaagaaatggagctgcggatcgagacacagaaacagaccctgaatgctcgagatgagtccattaaaaagctgcttgaaatgctccagtccaaaggcctcccttccaagtccttggaagacgacaatgaacggacacggaggatggccgaggcggagtcgcaggtgtcacacctggaagtaattcttgaccagaaagagaaagagaatatacatctaagagaagaactgcatcggcgttcccagctccaacctgaaccagccaagaccaaagcactgcagactgtgattgaaatgaaagatacgaaaattgctagcttagaaagaaatatcagggatctggaagacgagatccagatgctgaaagcgaacggagtcctgaatacggaggatagggaggaggaaattaagcagatcgaggtgtacaagagtcattctaagtttatgaaaacaaagattgaccagctcaagcaagagctgagcaaaaaggaatctgaactcctagccctccaaactaagctcgaaacattgagcaaccagaattccgattgcaagcagcacatagaagttctgaaggagtccctgactgctaaggagcagagggctgccatattgcaaaccgaagtggatgctctgcgcctccgcctcgaagagaaagaatcattcctgaacaaaaaaactaagcagttacaagatttgaccgaagaaaaagggacactggccggagaaatcagggatatgaaggatatgctcgaagtgaaggagaggaagattaacgtgttacaaaaaaagatcgaaaacctgcaggagcaactgcgtgataaggacaaacagctgacgaatttaaaagacagagtgaagagcttacagaccgatagtagtaatactgacaccgcccttgcaactctcgaggaagccctctccgagaaggaacgtattatcgaacgattgaaggagcagcgcgaaagagacgatagggagagactggaagaaattgaaagcttcaggaaggagaataaagatctcaaggagaaagttaatgccttgcaggccgagctcacagaaaaggagagcagtttgatcgacttaaaagaacacgcaagttcactggcctcggccggattgaaaagggattctaagctcaagagcctcgaaattgcaatcgaacaaaaaaaagaagagtgcagcaagctagaggctcagctcaagaaagctcataatattgaggatgactctcgaatgaacccagagtttgctgaccagataaagcagctagacaaggaggcttcctattaccgcgacgagtgtggcaaagcccaggctgaagtggaccgactgctggaaatcctgaaagaagtggagaacgagaagaatgacaaagataaaaagatcgctgagttagagtccttgacgctaaggcatatgaaagatcagaataagaaagtggcaaacctgaaacacaatcagcagctggagaaaaagaagaacgcccagctgcttgaagaggtgcgtcgcagggaggactcaatggctgataactctcagcaccttcagattgaagagctgatgaacgccctcgaaaagacgagacaagagcttgacgccactaaggcacgcttagcctcaactcagcaatctttagctgaaaaggaagcccacctcgcaaatctccgcatcgagcgaagaaagcaactcgaggagatccttgaaatgaagcaagaggcgcttctggccgcaatctccgagaaggatgccaatatcgccctgctcgagctcagtgcaagcaaaaagaagaaaactcaagaagaggtgatggccctcaagcgcgaaaaagacaggcttgtgcaccaattgaagcagcagacacagaaccggatgaaactcatggctgacaactatgacgacgaccaccaccattaccaccaccatcaccaccatcatcaccacagaagccctggtagatcccagcatagcaaccaccgacctagcccagaccaggatgacgaagaaggcatttgggcttag

SEQ ID NO: 49985 - DNA, 1587 bp, Artificial Sequence
  Description of Artificial Sequence: Synthetic coding sequence
tgaagatcacaactccagccggaacccgctaaaacgaaagctttgcagacagtgatcgaaatgaaggatacaaaaattgcctcactggagaggaatatccgcgacttagaggacgagatccaaatgctgaaagcaaacggggtgctgaacaccgaggaccgagaggaggagatcaagcagatcgaagtctataaatcacacagcaagttcatgaagaccaaaatagatcagctgaagcaagaattgtcgaagaaggagagtgaactacttgctttgcaaaccaaactggagactctcagcaatcagaactctgactgtaaacagcacatagaagtgctgaaggagtctctgacagctaaggagcagagagctgccattctgcagactgaggtcgacgctttgaggcttagactcgaagaaaaggagtccttcctgaataagaaaactaaacagctccaggatctgaccgaggaaaagggtactctggcaggggaaatcagagatatgaaagatatgctggaagtaaaagagcggaaaattaatgttctccagaaaaaaatagagaacctgcaggaacagctgagagataaggataaacagctgactaatctgaaggatagggtgaaaagtttgcagactgatagttctaatactgatacagcgctggcgactctagaggaggcattgtctgaaaaggagcggataattgagcggttgaaggagcagcgagagagggacgacagagagcgcctggaggagattgagtcatttaggaaggaaaataaggacctgaaggaaaaggtgaatgcgctgcaggctgaattgaccgaaaaggagtccagtttgattgacttgaaggaacacgccagttctctggcaagcgcaggattgaagagggatagcaagctgaagtccctcgagatagcgatcgaacaaaaaaaagaagagtgcagcaaactggaggctcaactgaaaaaacaagcggaacagttgttcaatcagatgtacaacccagctcacaacatcgaagatgatagcaggatgaaccctgaatttgccgaccaaatcaaacaacttgataaggaggcttcatattatcgggatgagtgcgggaaggcacaggcggaagtagacagactcctggaaatcctcaaagaggtggagaatgaaaagaacgataaggataaaaagatagcagaattagagcggcatatgaaagatcagaacaagaaagttgcaaatctgaaacataaccagcagttggaaaaaaaaaaaaatgcccagctactggaggaagttagaaggagagaagacagcatggccgataattctcaacaccttcagattgaggagctaatgaatgctctagagaagacccggcaagagctggacgccaccaaagctaggctggcctctacccagcagtctctggcagaaaaagaagctcatctggcaaatctcagaatagaacgtcgcaaacaactggaagaaattcttgagatgaagcaggaagctctgctcgcggcaatatctgagaaggacgccaacattgccttgctggagctgagtgctagtaagaaaaagtag

SEQ ID NO: 49986 - DNA, 984 bp, Artificial Sequence
  Description of Artificial Sequence: Synthetic coding sequence
atgcgtgccctgccgggacttttggaagctcgggctagaacccctcggttgctcttgctccagtgcttattggccgctgcacgccctagctccgcagacgggtctgctcctgactcccctttcacttctccgccacttcgggaagaaattatggccaataatttttcgctggaatcccataacatcagcctcaccgaacacagttcaatgcctgtggaaaagaacatcacactggagaggccatctaacgttaacctcacctgtcagtttacaacatccggggacttgaacgcagtgaacgtcacttggaaaaaagacggcgagcagttagaaaacaactaccttgtgagcgctaccggttctacactgtacacacagtacaggtttaccatcattaattctaaacagatggggagttacagttgtttcttcagagaagagaaggagcagcgcggaacctttaactttaaggtgcctgagctgcatggaaaaaacaaaccacttatatcgtacgtgggagacagcaccgtgctcacctgtaagtgtcaaaactgcttccccctgaactggacttggtatagttccaatggctccgtgaaagtccccgtcggagtgcagatgaataaatatgtgattaacggcacttacgccaatgagactaagctgaaaataacccagttgttagaggaggacggcgagtcctattggtgccgggctttgtttcaattaggggaatcagaggaacacatcgaactggtggtcctctcttatcttgtgccactgaaacccttcctcgttattgttgctgaagtcatcctgctagtagccacgatactgctatgtgaaaagtacacccaaaaaaagaaaaaacactctgatgaagggaaagaattcgagcaaatcgaacagctcaaatcagacgatagcaacgggattgagaataatgtccccaggcatcgaaagaatgagtccttgggacagtag

SEQ ID NO: 49987 - DNA, 621 bp, Artificial Sequence
  Description of Artificial Sequence: Synthetic coding sequence
atgggcgcagagtgggaacttggcgcagaagccggaggatcactgctgctctgcgcggctctgctggctgccggttgtgccctgggattaagactggggaggggacaaggggcagctgataggggggcactgatctggctctgttacgatgctctggttcactttgctctggaaggtccgtttgtttatctctctctagtgggaaatgttgcaaatagtgacgggttgatagcatctttgtggaaggagtatggaaaggctgatgccagatgggtgtactttgatcccacaatcgtgagcgtcgagatattaaccgtagctctggacgggagtcttgcactcttcctgatttacgcgattgtgaaggaaaagtactaccggcactttttacagataaccctgtgtgtgtgtgagctctacgggtgttggatgactttcctgcccgagtggttgactcgttctcccaacctcaacacatccaattggttgtactgctggctgtatttatttttcttcaacggcgtttgggtgctgattcccggtcttttactgtggcagtcgtggctggaactgaaaaagatgcatcaaaaggaaacctcctctgtcaagaagttccagtag

SEQ ID NO: 49988 - DNA, 261 bp, Artificial Sequence
  Description of Artificial Sequence: Synthetic coding sequence
atgggcgctgaatgggaactgggggcagaggccggaggctccctgcttctttgcgcggcattgcttgccgcagggtgcgctctgggtttaagactgggacgcggtcagggggcagccgaccgcggagccctcatttggctgtgttacgacgcactggtgcacttcgcactggaacgcgtggggaaaacgaccaaccaggaatcagcgggagttctgggctcaacagaatggaattttaagaataccgacaagttgttgtag

SEQ ID NO: 49989 - DNA, 1257 bp, Artificial Sequence
  Description of Artificial Sequence: Synthetic coding sequence
atggctacttctgagcagtctatttgccaagccagagcctcagtgatggtgtatgatgataccagcaaaaaatgggtgcccataaagcccggacagcaaggattctcacgaatcaacatttatcataacacggcctctaacaccttccgtgtggtgggagtgaagctacaagatcagcaagtcgtgatcaattactccattgtgaagggactaaaatacaaccaggcgacaccgaccttccatcagtggcgtgacgcacgacaggtctatgggctgaatttcgcttccaaggaagaagctactacattctccaatgccatgttatttgcgcttaacattatgaattctcaggagggagggccatccagccagcggcaggtgcaaaatggacctagccccgacgaaatggacatccagaggcggcaggttatggagcaacaccaacagcagagacaggagagtctcgaacgccgaacttccgccactggacccattctgccacccggtcacccttccagcgctgcctctgctcccgtttcttgcagtggtcccccacctcccccacctcctcccgtgccccctccacctacgggtgccaccccccctcctcccccaccgctcccggctgggggagcacagggcagctcccacgatgaaagttctatgtcaggattggcggctgctatagcaggagcaaagctgcgcagagtgcagcggccagaagacgcctcaggcggaagttcaccctcagggactagcaaatctgacgctaacagggcgtcaagcggtggcggagggggaggccttatggaggagatgaataaactgcttgctaaacggaggaaggccgcaagtcaaagcgacaaacctgccgagaaaaaggaggacgaaagccagatggaggacccttccacaagccccagccctggaacacgcgcagcatcgcaacctccgaactcatctgaggctggaagaaagccttgggagcgcagcaactcggtggagaagccagtttcaagcattctatcaagaacccccagcgtagcgaagagtccagaggctaagagcccactgcagtcccagccccattcaaggatgaaacccgcaggttcagtcaacgatatggccctggacgccttcgacctggaccgtatgaaacaggagatccttgaagaggtcgtgcgcgagctccacaaggtgaaagaagagatcattgatgcaatcagacaggagctgtctgggatcagtacaacctag

SEQ ID NO: 49990 - DNA, 1251 bp, Artificial Sequence
  Description of Artificial Sequence: Synthetic coding sequence
atgtccgagcagtccatttgtcaagccagagccagtgtcatggtatacgatgatacctccaagaaatgggtgcctattaagccaggacaacagggattctcccggataaacatctatcacaataccgcgtcgaacacatttcgtgtggtaggcgtgaaactccaagaccaacaggtcgtcatcaactacagtattgttaaaggcctgaaatacaaccaggcaacgccaacattccatcagtggcgagacgccagacaggtttacggcctcaactttgcttccaaagaggaagcaacaaccttcagtaacgcgatgctctttgccctcaacatcatgaactcccaggaaggagggcctagttcccagcgccaggtgcaaaatggcccttccccagatgaaatggatatccagaggcgacaggtgatggaacagcatcagcagcaaagacaggagagcctcgaacgtaggacttcagccaccggacctattctgcccccaggtcacccttctagtgccgcttctgctccagttagctgttctgggccacccccacctccacccccacccgttcctcctcctccaacgggtgccacacccccaccgccaccgcctttacctgctggtggggctcaggggagctcacacgatgaatcttctatgtcagggctggcagccgctatcgctggggcaaagttgaggcgggtgcagcgcccagaggacgcatccgggggttcttctccctccggcacttctaaatctgatgccaacagagcatccagcggtggcggagggggtggccttatggaggagatgaacaaattgttggccaagagaagaaaagccgcatcccagagcgacaagcctgcggaaaagaaggaggacgaaagccagatggaggaccccagtaccagtccaagtcctggaaccagagcggcatcccagcctcccaacagcagcgaggccggacgaaagccttgggagaggtcgaactctgtcgaaaagcccgtatcctcaatcttaagtcgtacaccatccgtggcaaagtcccccgaagcaaaatcgccactccagagtcaaccacactctcgtatgaagcctgcagggtcggtgaatgatatggctctcgacgccttcgatttagacaggatgaagcaggagatccttgaggaagtggttagagagttgcacaaggtgaaggaggagatcatcgacgctatccgccaggaactttccggcatctccaccacttag

SEQ ID NO: 49991 - DNA, 1146 bp, Artificial Sequence
  Description of Artificial Sequence: Synthetic coding sequence
atggcaacttcagaacaatccatttgccaagcacgtgctagcgtgatggtgtacgacgacacttcaaaaaagtgggtgcccattaaacctggtcagcagggcttcagtcggataaatatttaccataacactgcttccaacacattccgggttgtgggggtaaaactgcaggatcaacaggtggttatcaattacagcatagtaaaaggactgaagtataatcaggctaccccaacattccatcagtggcgtgacgccagacaagtgtacggcctcaattttgcttcgaaagaggaagctactacatttagcaacgctatgctttttgcactgaacatcatgaacagccaggagggcggaccaagtagccaacgacaggtacagaatggccctagcccagatgagatggacatacagagaagacaagtcatggagcagcaccaacaacagaggcaggagtcgctggaaagacggacctcagccaccggcccaatccttcctccgggacacccatcttcggcagcaagcgctccagtgtcttgttcgggcgctcctagcggcttggccgcagcaatcgcgggagccaaacttagacgggtacagaggcccgaggacgcatccggagggagttcaccatcaggcactagtaaatctgatgccaacagagcaagcagtgggggtggaggtgggggacttatggaagagatgaataagctactcgccaaacgccgtaaagcagctagtcagtctgacaagccagccgagaaaaaagaagatgaatcacagatggaggacccctcgacaagcccttctcccggaacaagggccgcttcccaaccaccgaattctagcgaggcagggaggaagccctgggaacggtccaactccgtggagaaacccgtatcctcaatactgtcacgcacacctagcgtggctaaatcacccgaagcaaagtcacctcttcaaagtcaaccacactcaaggatgaaacccgcaggtagcgtgaacgacatggctttagacgcattcgatcttgatcgcatgaaacaggaaattcttgaagaggtggttcgcgagctgcataaagtgaaggaggagatcatcgatgctatccgtcaagaattaagcggtatctcgacaacatag

SEQ ID NO: 49992 - DNA, 1173 bp, Artificial Sequence
  Description of Artificial Sequence: Synthetic coding sequence
atgtttgcctttgaagaattttcagaacagtcaatttgtcaagctcgtgctagcgtcatggtctatgatgacacttccaaaaaatgggttccaataaaacccggacagcaaggctttagtcgtatcaatatataccataacacagcctccaacactttccgtgtggtgggagttaaactccaagaccaacaggtggtgattaactattcaatcgtgaaggggttaaagtataaccaggccactcccaccttccaccaatggcgtgatgctcgtcaggtgtatggcctgaatttcgcatcgaaagaggaagcgacaaccttctccaacgctatgctgtttgccctgaatatcatgaactcccaagagggagggccatccagccaaaggcaggtgcaaaacggacctagtcccgatgaaatggacattcaacggagacaggttatggaacaacaccagcaacagcggcaggaatcgttggagcgcagaaccagcgctacgggccctatccttccacctgggcaccctagcagtgccgcttccgctccggtgagctgtagtggaccaccaccccctccacccccacctgtgcctccaccgcctacaggggctacacctccgcctccccctccacttcccgcaggcggtgcccagggcagctctcacgacgagtcatctatgagcgggctagccgcagccatcgcaggggcaaaactgaggcgagtgcaaaggccagaagatgcatctggcggatcaagcccctcaggtacatccaaatctgatgctaatcgagcttcgagtggcggtggcggagggggattgatggaggaaatgaacaaattgctcgccaaacgcaggaaggcggcaagccaaagcgacaagccagctgaaaagaaagaggatgagagccagatggaggacccctcaacgagtccttcccccggaactcgagctgccagtcagccacccaattcctccgaggccggacggaagccttgggagaggagcaacagcgtcgaaaagccagttagttccattctctcaagaacgccaagcgtcgcaaagtcgcctgaagctaaatcaccgctccagtcgcagccccacagtagataccggactacactgttactgacctgcccgcctggatttggagccccactgtctcctgtcccatag

SEQ ID NO: 49993 - DNA, 639 bp, Artificial Sequence
  Description of Artificial Sequence: Synthetic coding sequence
ccgcctcctcccccacccgtgcccccaccaccaacgggcgctactcctcctccaccccctccactgcccgcaggaggggctcagggctccagccacgacgagtcatcgatgtctgggctcgctgcggcaatagcaggcgctaaattgaggagggtgcagagacccgaggatgccagcggaggctcatccccttccggcacttcaaaaagcgatgctaatcgggcttcctctgggggaggcggtgggggactgatggaggaaatgaataagctcctggctaaacgtcgcaaagccgcatcccagagcgataaaccagcggaaaagaaagaggatgaatctcagatggaagatccttcaacgagcccatcccctggaacccgggcagcatctcagccacctaatagttctgaggctgggaggaagccttgggaacgtagcaactcagtcgaaaagcctgtgagttcaattctgtctcggatgaagcccgctggtagcgttaatgatatggcactagacgcattcgacctcgacagaatgaagcaggagatattagaagaagttgtgagagagctgcacaaagtgaaggaggagattattgacgctatccgccaggagcttagtgggatcagcacgacctag

SEQ ID NO: 49994 - DNA, 1617 bp, Artificial Sequence
  Description of Artificial Sequence: Synthetic coding sequence
atgggactgttgctgctggtcctgattttgacgcccagcctcgccgcataccgtcaccccgattttccattgctggagaaagcccagcagctcctgcagagtactgggagtccttacagtaccaattgttggctgtgcacatcctcgtccacagagacccctggaacagcgtatcccgcatcaccccgtgaatggacttcgatcgaagcagaactgcatattagctacaggtgggatcctaatctaaaaggactcatgcgtccagcgaatagtctcctgtctaccgtcaaacaggactttccagacattcgccagaagccacctatattcggtccaatttttacaaacatcaacctcatgggcattgcaccaatctgcgtgatggccaagcgcaagaacggaactaatgtgggaaccctaccttcaaccgtgtgcaacgtcacctttaccgtcgactcaaatcagcagacttatcagacatacacacataatcaattcagacaccagccccgattcccaaagccccctaatattacctttcctcaaggcaccctgctcgataagagttcccggttttgtcaggggcgaccgtcctcctgctctacccgcaatttctggtttcgcccagcagattataatcagtgtctgcagatttcaaacctgagctccacagccgagtgggttctgctggaccaaacccggaattccctgttctgggaaaataaaaccaagggagctaatcagagccagactccatgtgtccaggtgttggccggaatgacaatcgcaaccagttatctgggcattagcgccgtttccgagtttttcgggacttcattgacgccattatttcatttccatatttcgacttgcctcaaaactcaaggcgcattctacatatgcggccagagcatccaccagtgccttccaagtaactggacgggcacgtgcactataggatatgtgacccctgatatttttatagccccaggcaatctctcgttgccaatcccgatttacgggaactctcctctgcccagagtacgacgggctatccacttcatccctctgctcgctggccttgggatattggctggcactggtactgggattgcaggaattacaaaggcatcgctgacatattcacagctgtcaaaggagatagccaataacatcgacaccatggccaaagctctaaccaccatgcaggagcagattgattccttggccgcagttgtgctccagaatcggcgtggtctagatatgctgaccgccgctcaggggggaatttgtttggcattggacgagaagtgttgtttttgggtcaaccagtctggaaaggtgcaggataatatcagacagctcttgaaccaggcatccagtctcagagaacgcgcaacacaaggatggctgaattgggaaggtacgtggaagtggttctcatgggtgcttccccttacagggcctctagtgtctctcctactcctgttgttattcggcccttgtttgctaaacctgattacacagttcgttagctcaaggcttcaagccatcaaattgcagactaacttgtctgccggtcgacaccctcgaaatattcaggaatcccccttttag

SEQ ID NO: 49995 - DNA, 1617 bp, Artificial Sequence
  Description of Artificial Sequence: Synthetic coding sequence
atggggcttcttctgctggtcttgatactgacaccctccctggccgcttacaggcacccagatttccctttactggaaaaagcccagcagctccttcagagtacagggtctccctattctactaattgctggctgtgtaccagcagttccacggaaacacccggaaccgcctaccccgcatcacctcgcgagtggacttctattgaagccgaactgcacatttcttacaggtgggacccaaatctgaagggactaatgcggccagcaaattcccttctctctacagtcaaacaggactttcccgacattcgacagaagccaccgattttcggcccaatttttacaaacatcaacctaatgggaatagcacctatatgcgtaatggccaaacggaaaaacggtaccaatgttggaactctgcctagtacggtgtgtaatgtaaccttcactgttgatagcaatcagcaaacctaccagacatatacacacaatcagtttaggcatcagccaaggttccccaagccacctaacatcacgttcccacaggggacactgttggataagtcttcccgcttctgccagggcagaccaagctcttgttctacaaggaatttctggttcagacctgcagattacaatcagtgcctgcagatcagcaatctgagcagtaccgcagagtgggtcctcttagatcaaacaagaaatagcctgttctgggagaataaaaccaaaggagcgaaccaatcacaaacaccatgtgtgcaggtccttgccggaatgaccattgcaacaagctatctaggtatcagcgcagttagcgagttttttgggacgagcctgactccacttttccacttccacatctcgacctgtctaaagacccagggtgctttctatatctgtggacagtccatccaccagtgtctaccctcaaattggacaggaacctgtactatcggatacgtgacacccgatatcttcattgctcctggtaacctatcccttcctatccctatctatggcaacagcccactgcctcgcgtgagacgggctatacattttattccactgttggctgggctgggaattttggcaggcaccggaacaggaattgcgggtattactaaggccagcttgacctactcgcagctatcaaaggagatagctaacaatattgatacaatggccaaggcactaaccaccatgcaagagcagatcgattccctcgcagctgtcgtgttgcagaaccgcaggggactcgacatgttaacggcagcccagggtggaatctgtctggcactcgatgaaaagtgctgcttctgggtgaaccagtctggcaaggtgcaggacaatattcgacaactgctcaatcaggcttcttctttacgcgaacgggcaacacaggggtggctgaactgggaaggcacttggaaatggttctcttgggtcctacctctgactggtccactcgtttccctgctcttgttgcttctattcgggccatgccttctgaatctgattacccagtttgttagctctaggctgcaggctattaaacttcagacaaacttaagcgccggtagacacccgaggaatatccaggagtcaccattttag

SEQ ID NO: 49996 - DNA, 1617 bp, Artificial Sequence
  Description of Artificial Sequence: Synthetic coding sequence
atggccctgccttaccacatctttctgtttactgtgctcctcccctctttcaccctgactgcacctcctccgtgtagatgtatgacatcgagttctccttaccaggaattcttgtggaggatgcagcgtcctggtaacatcgatgccccatcctatcggagcctgagcaaagggacgcccaccttcactgctcacacccatatgcctaggaactgttaccattcggcaacactgtgtatgcatgctaatactcactactggaccggcaagatgatcaatccctcctgccctggcggattaggcgtcactgtttgctggacgtatttcacgcagaccggtatgtcggacgggggaggtgtgcaggatcaggctcgagaaaaacatgtaaaggaagtgatatctcagcttacacgcgttcacggtacaagctctccctacaaagggctggacttgtctaaactgcacgaaactctgcggacccacacaaggctggtgtctctctttaacacaactttgactgggctccacgaagtcagtgcccagaatcccacaaattgttggatttgtctccctttgaacttcagaccgtacgtgagtatacctgtgcccgagcagtggaataacttttccacagagataaataccacctctgtgcttgtgggtcccttagttagcaacttggaaatcactcatacgagtaatctcacttgtgtaaagttctcaaatacaacttataccaccaatagccagtgcattagatgggtgacccccccaacccagattgtttgtctgccctccggtatcttcttcgtttgcggcacgtccgcctacaggtgcctgaatggttcctccgaatccatgtgttttctgtcattcctggtgcctcccatgaccatttatacagaacaggatctgtacagctacgtgatttctaagcccagaaacaaacgtgtccccatactaccatttgttatcggtgctggggtcttgggtgcacttgggactggcatcgggggaataacgacatctacacagttttattataagttgagccaagagttaaatggtgatatggaacgggtggccgactccctcgtaaccctacaagatcagctgaattcgctcgctgctgtcgtgctccagaaccggcgagccctcgacctgcttaccgccgaacggggagggacttgcttgtttctgggtgaggaatgttgttactatgtgaatcagtccggtattgtgactgaaaaagtgaaggaaatacgcgaccgcattcagcgcagggctgaagaactccggaacactggaccttggggtctcctgtctcaatggatgccctggattctcccatttctggggccactggcagcgataatcttactcttgttatttggcccttgcatttttaacctgcttgtaaatttcgtaagctctagaatcgaagccgttaaactgcagatggagcccaaaatgcaatccaagactaaaatctaccggagacctctggatcggccagcctcccctagatctgacgtgaatgacatcaaagggacaccccctgaggaaatctcggctgctcagcctttgctgcgcccaaattctgccggatccagttag

SEQ ID NO: 49997 - DNA, 1710 bp, Artificial Sequence
  Description of Artificial Sequence: Synthetic coding sequence
atgggctccaccttaggatgtcaccggtcaatacctagggaccccagtgatctgtcccactctaggaagttcagcgcagcttgtaatttctctaatatccttgtcaatcaggaaagactgaacatcaacaccgctacggaagaagagctcatgacactccccggagtgacaagggcagttgcacggtctattgtggagtacagagaatacataggtggcttcaaaaaagtggaggatttggccctggttagcggcgttggcgcaactaagttggaacaggttaaattcgagatttgcgtttcatctaaaggctctagcgcacagcactcccccagcagcttgcggagggacttactggcagagcagcaacctcaccaccttgcaacagctgtcccactgacacctagggtgaatattaatacggctactccagcccagctgatgagcgtaagggggctgtccgaaaagatggcattatccatcgtagattttagaagagagcacggcccatttcggtcagtcgaggatctggtaagaatggatggcatcaatgccgctttcctggatagaattagacaccaggtttttgccgagcgcagccggccaccctccacccataccaatggcggtctcacttttacagccaaaccccacccaagccctacttccctttctctgcaaagtgaggatctggacctgccccctgggggaccaacccaaatcatcagcactaggccgagtgtggaggcctttggaggtacgagagatggcaggcctgtcctgaggttagccacatggaatcttcaagggtgctctgtggagaaagctaacaatccaggggtgagggaggtcgtgtgtatgacactcctagaaaactcaattaaactcctagcagtgcaggaactcttggatcgggaggcattggagaaattttgcactgagctcaaccagcccactctgccgaatatacgtaagtggaagggccctagaggatgctggaaagccgtggtcgcagaaaaaccttcgagtcagctgcagaagggagcaggttacgcgggatttctttgggacgcggcagccggaatggagcttcgagatgcagggtctcaagagagttctccatccaatggtcacgggaaactcgccggtccctctccgtacttaggaagattcaaggtgggttcccacgaccttactcttgtgaatttgcatttagctgcactcacccttctaggtagtgaaaatccgagtaaaaaccactcagatggccaccgcctcgccagtttcgctcaaaccctgcaggagacgctcaagggagaaaaagacgtgatcattctgggggacttcggccaagggccagattcgaacgactatgatatcctaagaaaagagaaatttcatcacctgatcccagcccatacattcacgaacatctcaacaaagaacccacaggggagtaagtcactggacaatatctggatcagcaaaagccttaagaaggtctttactggtcactgggctgtcgtgcgggaaggactgaccaatccatggatccctgataattggtcttgggggggagtggcatcagagcactgcccggtgcttgcggagttctatacagaaaaagactggagtaagaaagacgctcctaggaatgggagtggagtcgctctggaaaggtccgaggctaatatcaaacatgaacgctag

SEQ ID NO: 49998 - DNA, 1710 bp, Artificial Sequence
  Description of Artificial Sequence: Synthetic coding sequence
atgggcagcaccctcggctgccaccgcagcataccccgtgatccttccgacctgtcgcacagcagaaagttcagcgctgcttgcaatttttctaacatactggtcaaccaagagagactcaacattaacacagctacagaagaagaactgatgaccttaccgggtgtcacgcgagcagttgcaagaagtatcgtcgagtatagggaatacatcggaggctttaagaaggtggaagacctggctctggtgagcggtgtgggagcgactaaactggagcaggtgaaattcgaaatttgtgtctcttccaaggggagcagcgcacagcactccccttcctctctgcggagggacctgctggccgaacagcagccccaccacctggcaactgctgtgcccctgacccctagagtcaacataaataccgccacccctgctcagctgatgtcggttcggggtctttcagagaaaatggccctgtccattgtggactttagaagggagcatggtccctttaggagcgtagaagacttggtgcggatggatggaattaatgccgcttttcttgaccgcataaggcatcaggttttcgccgagcgaagcaggccacccagtacccacactaacggaggcctgacctttactgccaaaccccatccctcacccacatcgctgtcactgcagagcgaggatttggacctgcctccaggcggacccactcagataatttcgaccaggccaagcgtggaagctttcgggggtacaagagatgggaggcccgtcctaagactggccacctggaatttacagggctgcagtgtagaaaaggccaataaccctggcgtgagagaagttgtctgtatgactctgctggagaacagcatcaagctcctcgctgtccaggagttgctggatcgcgaggcgctagaaaaattttgtacagagctgaaccagcctactctgcccaacatcagaaaatggaaggggccaaggggatgttggaaggctgtggtggcggaaaagcctagcagccaactgcagaaaggggctggttatgccggattcctgtgggacgccgctgccggaatggagctacgggatgcaggctcacaggagtcgtcaccctctaacgggcacggaaaactggcagggccatcaccttacctcgggcgatttaaggttggaagccatgacctaactctggttaatctacatctggcggctctgactctccttggcagcgagaatcccagtaaaaatcattctgatggccaccggttagcttctttcgctcagaccttacaggagactctgaaaggcgaaaaggatgtgataatcctaggtgacttcgggcaagggcctgactccaacgattatgatattctgagaaaggaaaaatttcaccacctgattcccgcacacacatttaccaacatcagtaccaagaatccgcaaggaagtaagtcactggataatatctggatttccaaatcgctaaaaaaagttttcacagggcactgggctgtcgttcgggagggactcactaacccatggatccctgataactggtcttggggaggcgtcgccagcgaacactgtccagtgctggcagagttttacaccgagaaggattggtctaaaaaagacgccccaaggaacggcagcggagttgccctggagcgcagcgaagccaacatcaaacacgagcggtag

SEQ ID NO: 49999 - DNA, 822 bp, Artificial Sequence
  Description of Artificial Sequence: Synthetic coding sequence
atggaggccgctccgagcaggttcatgtttctgttgtttctcttaacttgcgagctggccgcagaggttgccgctgaagtcgagaaatcgagtgatgggcctggagccgctcaagagcccacgtggcttacggacgtaccagctgcaatggagttcatcgctgcaaccgaggtggctgtcatcggctttttccaggacctagaaattccagctgtgccaatcctgcattccatggtgcagaagtttcccggtgtaagctttggcatttcaacagactccgaggtcctgacacactataacatcacgggaaacacaatctgtctgtttaggctggttgataacgagcaactgaatctggaggatgaggatatcgaatcaatagatgctacgaagctgtcgagattcatagagatcaattccctccacatggtgactgaatataatcccgtgacagtgatcggcttattcaattccgttatccaaatccatctgctgctgataatgaacaaagctagccctgaatatgaggaaaatatgcacagatatcagaaggccgctaaattattccaaggaaaaatcctctttattctggttgactctgggatgaaggagaacggaaaagtgatctccttcttcaaactcaaagagtcgcagctgcccgcacttgccatctaccaaactctggacgacgaatgggatacgttgcctacagctgaggtatctgtggaacatgtgcagaatttctgcgacggattcctgtctggcaaacttcttaaagagaacagggaatcagagggcaaaactccgaaggtggagctctag

SEQ ID NO: 50000 - DNA, 2934 bp, Artificial Sequence
  Description of Artificial Sequence: Synthetic coding sequence
atgccagccagacgtctgctgctgctgctgactctcctattgcccggtttaggtatcttcggaagtacaagcactgtgaccttgcccgagaccctactgtttgtatctacgcttgatggtagtctgcatgccgtcagtaagcgcaccgggagcattaaatggactctgaaggaggaccccgttctgcaagttccaacacatgtggaggaacctgcattccttcccgatcccaatgacggcagtctgtacacgctcggatcaaagaacaatgaagggctgacaaaactgcctttcacaatcccagagctggtccaggccagcccctgcagaagcagcgatggcattctatatatgggaaaaaagcaagacatctggtatgtcatcgaccttctgaccggggagaaacaacaaacgctgtccagtgcgttcgccgactctctgtgtccttccaccagcctattgtatttgggcagaaccgagtacacaattacgatgtatgacacgaagactcgcgagctgaggtggaacgcgacttacttcgactacgccgcaagtttgccggaggacgatgtagactacaagatgagtcacttcgtgtcgaacggagatgggttggtggtaactgtggacagtgagtccggcgacgtcctgtggatccagaactatgcctcacctgtagtcgctttctacgtgtggcagcgcgaaggcctccgaaaagtcatgcacatcaacgtcgctgtggaaaccctgcgatacctcacctttatgagtggcgaagttggacgcatcaccaagtggaaatatccattccctaaagaaactgaggcaaaatccaaacttacgcccacgctctacgtcgggaaatatagcacttccctgtacgcaagcccctccatggtgcatgagggggttgcggtggttccgcgaggaagcacgttgcctctcttagaaggccctcagaccgacggcgtcacgatcggtgacaaaggggaatgcgttatcaccccttctacggatgtgaagttcgaccccggtctgaagtctaagaacaaattaaactacctgcggaactattggttattaattggacaccacgagacccccctgtccgcgtccactaagatgctggaacgattcccaaataacttgccaaaacatagggaaaatgtgataccagctgattctgaaaaaaaatcattcgaagaggttatcaacctggtggaccagacttcggaaaacgcacctacaacagtttcacgagacgtggaggaaaaaccagcccacgcccctgcgcgacccgaggccccagtggactcaatgctgaaagacatggcaactataattctaagcacctttctcttgattggatgggtggcctttatcataacctacccccttagtatgcaccagcagcagcagctgcagcaccaacaattccagaaggagcttgaaaaaatccaactcttgcagcagcaacagcagcagctccccttccacccaccgggagatacagcgcaggacggagagctgctggacacttccggcccatatagcgagagtagcggaacctcatcgccctccactagtcctagagcaagcaatcactccctgtgctctggctcctcggccagcaaagccggttcatccccctctcttgaacaggatgacggcgacgaagaaacgagtgttgttattgtcggcaaaatttctttttgccctaaagacgtcttaggacacggagcggaaggcactattgtctacaggggaatgtttgacaatagggacgttgcagttaaacgcattctgcctgaatgcttctccttcgcagatagagaagtccaactgctgagagagagtgacgaacatccaaatgtcattcgttatttctgtaccgagaaagaccgccagtttcagtacatcgccattgagctatgcgcagccacactccaagagtatgtcgagcagaaggacttcgcacatctgggtctggaacctatcacacttcttcagcagacgacttccgggctggcgcaccttcattcgcttaacattgtgcatagagatttaaagccgcataatatcttgatctcaatgcctaacgcccatggcaaaatcaaggcaatgatcagcgatttcggactgtgcaagaaactggccgtgggacgtcattcattctctcgtcgatctggagtgcccggtactgaggggtggatcgcgcctgagatgttaagcgaggactgcaaggaaaacccaacctacaccgtggatatcttctccgctgggtgcgtattctactacgtgattagcgaaggctcccatcccttcggtaaatccctgcagcggcaggcaaacatcctcctaggcgcatgctcactcgattgcctgcacccagaaaagcacgaagacgtcatcgccagagaactcattgaaaagatgattgccatggaccctcagaagcgccctagcgcaaagcatgtgcttaagcatcccttcttctggagcctagaaaaacagctccagttcttccaggatgtgtcagaccgcattgaaaaggagtccctcgacgggccaatcgtgaaacagctcgaaagagggggaagggcggtggtgaaaatggattggcgcgagaatattacagttccacttcagacagatctgcggaaatttcggacttataagggaggaagcgtgcgggacttgctgcgagcaatgaggaacaaaaaacatcattacagagagctgccggcagaggtcagagagaccctgggcagtttgccagatgactttgtctgctatttcacgagtcgattcccacatcttttagctcatacatatcgagcaatggaactttgtagtcacgagcgactgtttcagccatactactttcacgagcctcctgagcctcaaccacccgtgacccctgacgctctgtag

SEQ ID NO: 50001 - DNA, 873 bp, Artificial Sequence
  Description of Artificial Sequence: Synthetic coding sequence
atgccgttcgacttccggagatttgatatttaccgaaaagttccaaaggatctgacccagcccacctacactggagccatcatctcaatttgttgctgcctgtttatcctattcttatttctctcggaattgacagggttcatcacgacagaggtggttaatgagctctacgtcgatgaccccgacaaagatagcggcggtaaaatagacgtctctttaaatattagtctgcccaatctgcattgtgagctggtgggactggatatccaggacgaaatggggaggcacgaggttgggcacatcgataacagtatgaagatacctctcaacaacggtgccggatgcagatttgagggtcagttttcgatcaacaaggtgccgggtaatttccatgtttccactcacagtgctaccgcccagccgcagaacccggacatgacacacgtgatccataagttgtcttttggtgataccctccaggtgcagaatatccacggcgctttcaatgctctgggcggtgcagaccgcctcacctccaaccctcttgccagtcacgactacattcttaagatagtgcccaccgtgtatgaggacaaaagcggcaagcagcgctactcttaccagtacaccgtggccaataaggagtacgttgcctattcacataccggtcgaattattcccgctatctggtttcgctacgacttgagtcccataactgtgaagtacactgaacggaggcaacctctctatcggttcataaccacgatctgtgcaatcatagggggtactttcaccgttgccggaatcctggacagctgcatttttaccgcaagcgaagcgtggaagaagatacagttggggaagatgcactag

SEQ ID NO: 50002 - DNA, 108 bp, Artificial Sequence
  Description of Artificial Sequence: Synthetic coding sequence
tagtgcagtactgctaatggggagaaggactcaattacccttatatcgatgaagaatatcaacatgaataatgggaagcagtctctcagcgcggaaaaagttctatag

SEQ ID NO: 50003 - DNA, 219 bp, Artificial Sequence
  Description of Artificial Sequence: Synthetic coding sequence
atgggcacagcgggtgcgatgcagctgtgctgggtgattttggggtttctcttgttcagggggcacaactcccagccgacaatgacccagaccagcagctcccaagggggtctgggtggactaagcttgactacagagccggtgtcatccaaccctggatatattccgtcaagtgaggctaaccgccctagccatcttagcagcacaggaacgccttag

SEQ ID NO: 50004 - DNA, 768 bp, Artificial Sequence
  Description of Artificial Sequence: Synthetic coding sequence
atggctagccccggtgcaggcagagcgccacccgagttacccgagagaaactgcgggtacagagaagtcgagtattgggatcagcgttaccagggcgctgctgactctgccccatacgattggttcggcgacttctccagcttcagagccctcttagaaccagagctgcgaccagaggaccgcatcctggtgctgggctgcgggaatagcgcactgtcatatgaactttttcttggcggtttcccaaatgtgacatctgtggattatagctccgtcgtggtggcggcaatgcaagccaggcacgctcatgtgccccagctcagatgggagactatggatgtcaggaaactggattttccttccgcgagcttcgacgtcgtactggagaaaggaactttagatgcactactcgctggggagcgtgatccctggacggtctccagcgagggtgttcacacagtcgaccaagtgctgtcagaggtatcccgagtgctggttcctggcggtcgcttcatttcgatgacatctgcagcccctcattttcggacaaggcattatgctcaggcttattacgggtggtctttgaggcacgcaacttacggcagcggcttccattttcacctgtacctgatgcacaaaggcggaaagctttctgtagcccagttagcgctaggcgcacagatcctatcaccacctagacctcctacgagtccatgtttcctccaggacagcgatcacgaagacttcctgtctgctattcagctctag

SEQ ID NO: 50005 - DNA, 2211 bp, Artificial Sequence
  Description of Artificial Sequence: Synthetic coding sequence
atgaatgtcgcgctccaggaactgggcgcaggaagcaatgtggggttccagaagggaacacggcagcttctcggctcacgtacacaacttgaactcgtcttagctggcgctagtttgctactggcagctcttctgctgggttgccttgtggctctaggtgtccaataccaccgagatcccagtcattccacatgcttaactgaggcctgcattcgagtcgccggaaagattctggagagcctcgacagaggagtatccccatgtgaggacttctaccagttctcctgcgggggttggattagacggaatcctctgcccgacggtcggagcagatggaataccttcaatagtctgtgggaccagaatcaggccatccttaaacacctgctggaaaacacgacatttaactcttcctccgaggctgagcagaagactcagaggttttacctaagctgtctacaggttgaaaggattgaggaactgggcgctcagccgctcagggaccttatagagaaaattgggggatggaatatcaccggcccatgggatcaggacaattttatggaggtgctcaaagctgtggccggaacatatcgcgcaaccccattcttcacagtatatatctccgcagactccaaatcatcaaattcaaatgtgatccaggtagaccaatcaggattgtttctgccttcacgagattactacctaaaccggaccgctaacgagaaagtcctgacagcttatctcgactatatggaagaactaggcatgctgcttggaggcaggcctacaagtacccgggagcaaatgcagcaggtgctggaacttgaaatccagttagctaacatcacggtgcctcaggatcagcggagggacgaggagaaaatctaccataagatgtcgatcagtgaactgcaagctttagctccctccatggattggctcgaatttctgagctttctcctctcccctctggagctgtccgacagcgagccagtggtcgtgtatggcatggattacttgcagcaggtgagtgagcttattaatcgcactgagcctagtattttgaacaactatctaatctggaacctggtgcagaagaccacatcatctctggatcgaaggtttgaaagtgcccaggaaaagctactcgagacgttatacgggaccaagaagagttgcgtgcctcgatggcagacttgcatttcaaacaccgacgatgctttaggattcgcccttggctccctcttcgtgaaggcgacttttgaccggcagtctaaggaaatcgccgagggaatgatctccgagatcaggacagcattcgaggaagccttgggtcagcttgtttggatggatgaaaaaacaaggcaggccgcaaaagaaaaagcggacgcgatctacgatatgataggcttccccgatttcatcctggaacccaaggaactggatgatgtctatgatgggtatgaaattagcgaggattctttcttccagaacatgttaaatttatataactttagcgcaaaggtgatggcggaccagcttcggaaaccgccttcgagggatcagtggtcgatgacaccacagactgtaaatgcatattatctccctacaaagaacgagattgtgttcccggctggcatcctgcaggcgccattctatgcaagaaaccaccctaaggctctgaactttggtgggatcggggttgttatgggccatgaactgactcatgctttcgatgaccaaggtcgggaatacgataaagagggcaacctccgcccttggtggcagaatgaaagcctcgcggctttccggaaccacactgcctgtatggaggagcaatataaccaatatcaggttaacggggagcgccttaatgggcgacagaccctcggcgagaacatagcagacaatggcggacttaaggcagcgtataatgcttataaggcctggctgcgcaagcatggcgaagagcagcagctccctgcggtggggctcaccaatcatcagctgttttttgtggggttcgcacaagtgtggtgttctgtgagaacaccagagtcttctcacgagggattggttactgacccccactctcctgccagattcagagttctgggcaccttgagcaattctcgggatttcttgcggcatttcggatgtcctgtaggatcccccatgaatccaggacagctttgtgaggtttggtag

SEQ ID NO: 50006 - DNA, 2652 bp, Artificial Sequence
  Description of Artificial Sequence: Synthetic coding sequence
atggcaagcccaggggctggcagagcccctcccgaattacctgaacggaattgcggttacagagaggtggagtactgggaccagcgctaccagggggctgctgacagcgcgccatacgactggttcggagacttctctagctttagagcgctcctcgagcctgagttgcgacctgaagatcgcattctagtcctggggtgtggtaattccgccctatcatacgaattattcctggggggtttccccaatgttacaagtgtggattatagctccgttgtagttgctgcaatgcaggccagacacgcccacgtgccacagctgcgatgggagacaatggacgtgagaaaactggactttccctccgcctcgtttgatgtggtcctggagaagggcacactagacgcattgctggctggcgaaagagacccctggaccgtttcttcagaaggggtgcatactgtggatcaggtactatcagaggtgggctttcagaaaggcacccggcagctccttggttcccgcacccaacttgagctcgtgttagcaggggcatcgctcctcctggccgctctgctcttaggctgcctcgtcgccctaggagtgcagtatcaccgagatcctagtcactcaacatgtctgactgaggcgtgtattagagttgccggtaagatattggaatcactggaccgaggggttagcccctgcgaggacttttaccagttctcttgcgggggatggatccgtaggaacccactgcccgacggacgctcgaggtggaacacttttaacagcttatgggaccagaatcaggcaattcttaagcaccttctggaaaataccacctttaacagctccagcgaggccgagcagaaaacgcaaaggttttaccttagctgcttgcaagtcgagagaatcgaggagctgggtgcacagcctctgcgcgatctcatcgagaaaatcggaggatggaacattacgggcccttgggatcaggacaacttcatggaggtgttaaaagcagttgccggaacataccgagcaacccccttcttcacggtatatatttcagctgattccaaatccagtaattccaacgtgattcaggtggaccagtctggtctgttcctcccatctagggactattacttgaaccggaccgcaaatgaaaaggttctgacggcttacctcgactacatggaagagctgggaatgcttctgggtgggagacccacctccactcgagaacagatgcagcaggtcctcgaacttgagattcagctggccaatatcacagtgccccaggatcagcgcagggatgaggagaagatttaccacaaaatgagcataagcgagcttcaggctctcgctccgtctatggactggttagagttcttgtcctttctcctgagtccgctcgaactgagcgatagtgaaccggtagtggtctatggtatggactaccttcagcaagtgtccgagctgatcaatcgaacagaaccaagtatcctgaacaactatttaatctggaacctcgtgcaaaaaacaactagcagccttgatagacgattcgagtcagcccaggaaaagctgttagagaccctgtacggtactaagaagagctgtgtgcctagatggcagacatgcatctctaacacagatgacgccttagggtttgcactcggcagcctcttcgtcaaggccacatttgatcgccagagcaaggaaatagccgagggtatgattagtgagatccgcactgcctttgaagaagcactgggtcagctggtctggatggatgaaaagacacgtcaggcggctaaagagaaggcagatgctatttatgacatgatcggctttcctgacttcattctggagcccaaggagttggacgacgtgtacgacggctacgagattagcgaggattccttctttcaaaatatgctgaatctgtacaacttcagtgcaaaggtgatggccgaccagctgcggaagccccctagccgggaccagtggagtatgacccctcagaccgtcaacgcttactatttgccaactaagaatgaaatagtcttccccgcaggcatcttgcaggcaccattttatgctcggaatcatcctaaggccctcaacttcggtggaatcggagtcgttatgggccatgagctgacgcacgcgttcgacgaccagggcagggaatatgataaagaagggaacttgcgcccatggtggcagaacgagagtctggcagcatttcgcaatcatacggcctgtatggaagaacaatataaccagtatcaagtcaatggggaaaggctgaacggccgtcagacactcggggaaaatatcgctgataatggtgggctgaaagctgcatacaatgcgtacaaagcctggcttcggaaacatggcgaggagcagcagctgcccgcagtgggacttaccaatcaccagctgttcttcgttggattcgcacaggtatggtgtagcgtgcgcaccccagaaagctcgcatgagggactggtgacggatcctcattccccagccagatttagggtgctaggcacactaagtaatagcagggacttcctgaggcattttgggtgtccggtgggcagtcccatgaatcccggtcagctttgtgaagtttggtag

SEQ ID NO: 50007 - DNA, 2298 bp, Artificial Sequence
  Description of Artificial Sequence: Synthetic coding sequence
atgaatgtcgctctccaagaactcggggctggatccaatatggtagaatataaacgggcaacactgagagacgaagacgcaccggagacccccgtggaggggggtgccagccccgacgctatggaagtgggttttcagaagggaacccggcagcttctgggctcccgaactcagctggagttggtgctagccggagcatctctcctgttggccgcattactgcttggatgcttggtggccttaggggtgcagtaccaccgggacccatcccattctacttgtctgaccgaggcatgcatccgagttgcagggaaaatcctagagtccctggatcgcggagtgagtccctgcgaggatttttaccagttctcctgcggtggatggataagaaggaaccctctcccagacggaaggtccaggtggaatacattcaactccctctgggaccagaaccaggccatacttaagcaccttttagaaaataccacattcaactctagcagcgaggctgagcagaaaactcagagattctacctgagttgcctgcaagttgagcgtattgaggagctcggagcacagccactcagggacctgattgagaagatcggtggatggaacattactggcccttgggatcaggataacttcatggaagtgctgaaagcagttgctgggacctaccgggcaaccccctttttcaccgtgtacatctcagcagactcaaaatcctccaactctaatgtgattcaagtcgaccagagtggcctctttctcccctcacgggattactacctgaaccgcaccgcaaacgagaaagtcctcaccgcctacctggactatatggaggaactgggaatgttgttaggcggacgtcccaccagtacccgagaacagatgcagcaggtgctggaactagagatccagttggccaacattacagtgccgcaagaccagaggcgcgacgaagaaaagatctaccacaagatgagcatctcagaattacaggcacttgcgccatctatggattggcttgaattcttgtcattcctattatctccgctcgagcttagtgattccgagcccgtggtggtgtatggcatggattacttacagcaggtgagcgagcttattaatagaactgaacctagtatcctgaacaattacctgatctggaatttagtgcagaagaccacgtcctcactggaccgtagattcgagagcgcccaggagaagttgctcgaaaccttgtacggaacaaagaagagctgcgtgccacggtggcaaacctgtatcagcaacactgacgacgcactcggatttgccttgggctcgctatttgttaaggccacatttgatcgacagagcaaagaaatcgctgaaggcatgatcagcgagattcggacggccttcgaagaggctttgggacagctggtgtggatggacgaaaagacccgacaggcggcaaaagagaaggctgatgcaatctatgacatgatcggcttcccagattttatcctggaaccgaaagagctggatgacgtttatgacgggtacgaaatcagcgaggatagcttctttcagaacatgctcaacctgtacaacttctccgctaaggtaatggcggaccaattaaggaaaccgccaagtcgagatcaatggtccatgactccccagacggtgaacgcttactacctcccaacaaaaaacgagattgtcttcccagcgggaatcctgcaagctcctttttatgcgcgtaaccatcccaaggcccttaattttggcggtattggagttgttatgggccacgaactaacccatgctttcgacgatcagggaagagagtatgacaaagaagggaacctgagaccgtggtggcagaacgagtccctggctgcgttcagaaatcataccgcatgcatggaagaacagtacaaccagtatcaggtgaacggggagaggctcaatggacgacaaaccctgggagagaacatagcagataatggcggactcaaagccgcttataatgcctataaagcctggctaagaaagcatggggaagaacagcaattgccagcagttggactcacaaatcaccagcttttttttgtgggctttgctcaagtgtggtgttccgtgcgtacccccgagtcgtcccatgaagggctggttacggacccccatagccccgcaagatttcgcgtcctgggcacgctctctaatagccgggatttcctgcgccacttcgggtgtccggtggggagccccatgaatcctggacagctctgcgaggtgtggtag

SEQ ID NO: 50008 - DNA, 2436 bp, Artificial Sequence
  Description of Artificial Sequence: Synthetic coding sequence
atgaacgtggcactacaggagctgggagctggtagtaatatggtagaatataaacgggcaacccttagagatgaggatgccccagagacaccagtggagggtggtgccagtcctgacgccatggaggttggtaagggggcatccccattcagtcctgggccttccccaggcatgacccctggcaccccccgatccagcggcctgttctggagggtcacctgcccacacctgcgttcaattagcggtttatgtagtcgaactatggtcggctttcagaaggggacaagacaactcctcggatcccgtacccaactggagctggtcctggctggtgcctcactgcttctggctgccctgctgctgggttgcctcgttgccctaggcgttcagtaccatcgggacccaagtcatagtacttgcttgactgaagcttgtatacgtgttgctgggaagattcttgaatctcttgacaggggtgtttcgccctgtgaagacttctaccaattttcctgcggtggatggatccggcgaaaccccctcccagacgggagaagccggtggaacacttttaacagcctatgggatcagaatcaggcgatcctcaagcacctcttggaaaacaccactttcaactctagcagcgaagccgagcagaaaacccaaaggttctatctgtcatgcctccaggttgagcggatcgaggagttgggggcacagcctctgcgagatttgatagagaaaatcggcggatggaatattactgggccttgggaccaggataacttcatggaagtcttgaaggcagtcgctggtacctatagggccactcccttttttacggtctacatctctgccgactccaagtccagcaattcaaatgtgatccaggtggatcagtcgggactttttctcccatcccgcgactattatctgaacagaactgctaacgagaaagttttaactgcctatctggattacatggaggagctaggtatgctgcttgggggacggcctaccagtacacgcgaacaaatgcaacaagttttggagctcgaaatccagctggctaatatcaccgtgccccaggaccaacgcagggacgaagagaaaatctatcacaaaatgtcgatcagcgaattgcaggcgctcgctccgtccatggactggctggagttccttagctttctgttgtcccccctagagttgagtgattctgaacctgttgtcgtgtacgggatggattacctgcagcaggtttcagagctgattaaccgaacagaaccttctattctgaataactacctcatttggaacctcgtgcaaaagacaacttcaagtttagacaggaggtttgagtcagcgcaggaaaagctcctcgagaccctctacgggaccaagaagtcatgcgtgccgagatggcagacgtgcatttcaaacacagatgatgccttgggttttgcacttgggagcttattcgtaaaggccacttttgaccggcagagcaaggaaattgcggaggggatgatcagcgagattcgcacggcctttgaggaagccctcggacagttggtgtggatggacgaaaaaacgcgccaggctgccaaagaaaaagcggatgccatctacgatatgattgggtttccagatttcatcttggaacctaaagagctcgacgacgtctacgatggatatgagatctcagaggacagcttctttcagaatatgctcaacctttacaatttttcagccaaagtgatggcagaccaattgagaaagccaccatctagggaccagtggtctatgactccccaaaccgtaaatgcatactatctccctaccaaaaacgaaatcgtctttcccgcaggcatcctgcaggcgcctttctacgcaagaaaccatcctaaagctctgaacttcggtggaattggagtggtaatgggccacgaacttacacatgcctttgacgaccaagggcgagagtacgataaggaaggaaacttgcgaccttggtggcagaacgagagcttggctgccttccgcaatcacactgcttgtatggaagaacaatataaccaataccaagttaacggagagcgcctcaatggaaggcaaaccttaggcgagaatattgcggataacggcggactcaaggcggcatacaacgcttacaaggcttggttgcgtaagcatggtgaggaacagcagttacccgctgtgggcctcacaaaccatcagctattcttcgttggcttcgcccaagtgtggtgctctgtccgcacccccgaatcctcacacgaagggctagttacagatccccattcacctgcaagattccgggtgctcggcacactgagtaattctagggattttttgaggcacttcggctgcccagtgggctccccaatgaatccgggtcaactgtgcgaagtgtggtag

SEQ ID NO: 50009 - DNA, 786 bp, Artificial Sequence
  Description of Artificial Sequence: Synthetic coding sequence
atgctccgggtgctgtgcttactcaggccgtggagacccctacgagcaagaggatgcgcctccgacggtgctgccggtgggtccgagatccaggtccgcgctctcgccggtccagatcagggaattaccgaaatccttatgaataggcctagtgctcggaatgctctaggaaatgtcttcgtatcagagctgctggagaccctggcacaactcagggaagatcggcaggttcgagtgcttctgtttcgctccggggtgaagggtgtgttttgtgctggcgcagatctcaaagaacgagagcaaatgagcgaggcagaagtgggcgtgttcgtgcagcgactgcggggactgatgaatgacatagcctcttccgccgtgatgggactaattgagaccacaagaggactactgcccggagctggcggtacacaacggctgccccgatgcttgggggtggccctcgcaaaagaactcatttttaccggcagacggctgagtgggacagaagctcacgtcctcggtcttgtaaatcatgccgtggcccagaatgaggaaggggacgcagcgtatcagcgggcacgcgcattggctcaggaaatcttgcctcaagctcctatcgcagtcagacttgggaaggtcgccatagacaggggaacagaggttgatatagcttctggtatggctattgagggcatgtgttatgcccagaacatccccacacgtgatcgcctggagggaatggccgctttcagggaaaagagaacaccaaagtttgtgggcaagtag

SEQ ID NO: 50010 - DNA, 879 bp, Artificial Sequence
  Description of Artificial Sequence: Synthetic coding sequence
atgttacgtgtcttgtgcttgcttaggccatggaggcccctgcgcgcacggggatgtgctagtgacggtgccgctggagggtcagaaatacaggtgagagccctcgccggacctgatcagggtattactgagatactaatgaacaggccaagcgcgagaaatgccctgggaaacgtctttgtctctgaactcctggagacactcgcgcagttgagagaagaccgacaggtgagggttttactattcaggagcggggttaagggggtgttctgtgccggagcagacttgaaggaaagggagcagatgtcagaggccgaggtaggcgttttcgttcagaggttgcggggtctgatgaacgatatagccgcatttcctgcaccaacgatcgccgctatggacggcttcgcactgggaggtgggctggagctggcactcgcttgcgaccttcgggtagcagcctctagtgctgtgatgggactcattgagaccacgcgcggtctgctccctggggcaggtgggactcagcgactgccaaggtgcctgggggtggcactggccaaagaactcatctttactgggaggcgcctcagcgggaccgaagcccacgtccttggtctggtgaatcacgctgtcgctcagaatgaagagggtgacgccgcttaccaacgggctcgcgcactcgcacaggaaatcctgcctcaggcacctatcgccgttaggttgggaaaggtggcaattgacagagggaccgaggtggacatcgctagtggtatggcgatcgaaggaatgtgttacgctcaaaacatcccaaccagagaccgtctggaggggatggcagcctttcgcgagaaacgcactccgaagttcgtcggaaagtag

SEQ ID NO: 50011 - DNA, 741 bp, Artificial Sequence
  Description of Artificial Sequence: Synthetic coding sequence
atgaatagaccttccgcgcgtaatgctttaggcaatgtgtttgtttctgaattgctcgagaccctcgcacagctccgagaagacagacaggttagggtcttgttgttcagaagcggagtgaagggagtgttttgtgccggtgctgatcttaaggaacgcgagcagatgagcgaagcagaggttggtgtctttgttcagagactgagggggctgatgaacgatattgcagctttcccggcacctacaattgccgctatggacggatttgctctggggggtggccttgagctggcattggcttgtgatctcagggtggccgcatctagtgccgtgatgggactgattgagacaaccagaggcttgctgcctggagccggaggaacccagcgcctgcctcggtgtctcggagtggcgttagctaaagagctgatctttaccggaaggcgtctgtctggtactgaagcccacgttctcggtctcgtaaaccacgctgtcgctcagaacgaagagggtgatgccgcttaccagcgggcacgagccctggctcaggagattctgcctcaggcgccaattgccgtgcgcctgggtaaagtggccatcgatagaggtaccgaggtggatatcgcttcagggatggccatcgaaggcatgtgctatgcccagaacattcctacaagagaccgcctcgaaggaatggcagcttttagagaaaagaggacacccaagttcgttggaaaatag

SEQ ID NO: 50012 - DNA, 384 bp, Artificial Sequence
  Description of Artificial Sequence: Synthetic coding sequence
atgaacagacccagtgcacgcaacgccctgggtaatgtgtttgtgagtgagctgctggaaacgctggcccagctccgggaggacaggcaggttcgcgttctcttatttcgttccggcgtaaaaggggtgttctgcgccggtgctgacctcaaggaaagggagcagatgtccgaggccgaagtcggagtattcgtgcagcgcctgcggggacttatgaacgacatcgcagccttccctgctcctaccatcgccgctatggacgggtttgccctggggggaggtctggagcttgccctggcctgtgacctccgggttgccggtacaggccctgggctgggggctggcggaggggcacgggagtcgggagtgagtgagacgggttag

SEQ ID NO: 50013 - DNA, 660 bp, Artificial Sequence
  Description of Artificial Sequence: Synthetic coding sequence
atgctccgagtgctctgcctcctgagaccctggcgacctttgcgcgctagaggctgcgcttctgacggtgccgctggcggttccgagatccaagttagggcgttagccggaccagaccaagggataacagaaatcttaatgaaccgcccttcagcgaggaatgcattagggaacgtgttcgtgagcgagctgttagagaccctagcccagctgagggaggatagacaggtcagggtcctgttgttcaggtctggagtgaagggggttttctgcgcaggtgcagacctcaaagaacgtgagcagatgagtgaagctgaggtgggagttttcgttcagagattgcgaggtctgatgaatgatatcgcgtccagtgctgtgatgggtctgatcgaaaccacacgcggactcctccctggagctggcggtactcagcgtctgcctcggtgtcttggtgtggccctggccaaagagctcattttcaccggccgtagactaagcgggaccgaggctcatgtgcttgggttggtcaatcacgcggtggctcaaaacgaggagggtgacgccgcttaccagcgggctcgggctttggcacaggaaatccttccacaggtagatatcgcctctggcatggccatcgaggggatgtgctatgcccaatag

SEQ ID NO: 50014 - DNA, 912 bp, Artificial Sequence
  Description of Artificial Sequence: Synthetic coding sequence
atggcggctgttgcagttctccgagccttcggtgcgtcgggcccaatgtgcttgaggcggggaccgtgggcacaacttccagcacgcttttgctctagagatccagccggagccggtagaagagaatccgagccacgcccaacttcagcaaggcagttggacggtattcgcaacatagtgctcagcaacccaaaaaagcgtaatgccctttccttggctatgctaaaatccctgcagtccgacattctgcatgacgcagactccaacgacttgaaggtgatcattatctcagctgagggacccgtgttctccagtggacatgacctgaaggagctcactgaagagcagggcagagactatcacgcggaagtgtttcagacgtgttcgaaggttatgatgcacatcagaaaccatcctgtacctgttattgctatggtgaacggcctggccgctgccgcaggatgtcagctggtagctagttgtgacattgcagttgccagtgacaagtcctccttcgccacgcccggtgtgaatgtgggactgttctgctcaactcccggtgtggcgttagccagagctgtcccccgtaaggtcgcacttgagatgctcttcacaggcgagcccatttccgcccaagaggccctactgcatggcttgctttcaaaagtggttcctgaggcagaactccaggaggagaccatgcgaattgcacggaagatcgcgagcctgagtcgccctgttgtgtccctgggcaaggccaccttttacaaacagctcccgcaagacttgggtaccgcttactacctgacaagccaagcaatggtggacaacttagcacttcgagacggacaggagggcatcaccgcatttttgcagaaacggaaaccagtttggagtcacgagccagtgtag

SEQ ID NO: 50015 - DNA, 726 bp, Artificial Sequence
  Description of Artificial Sequence: Synthetic coding sequence
atggccgctgttgccgtgctacgggcattcggcgcatcagggccaatgtgcctgaggcggggtccttgggcgcagctgcccgcaagattctgtagccgcgatccggctggcgctggccgaagggagtccgagcctcggcctacctccgcaagacagctggacggcatcaggagcgcccctgggcgagccggttcaagccggtggtgtcgcgtcggagtaagggccccacctctcactagggggggacccggagagcctgagccccgtctgagaccttggggcggaaatagcccctgccctggaccaggaccaggaagcgaaacccggagaaatatcgtgttgtccaaccccaagaagaggaacgcgctaagcttggcaatgctcaaaagcctgcagtcggacattctccacgatgcagactccaacgatctcaaagtgattatcatctccgctgagggtcccgtgtttagcagtggccacgacctcaaagagttaaccgaagaacaaggcagagactatcacgccgaggtgttccagacatgtagcaaggtcatgatgcacatcagaaatcaccctgtgccggttattgctatggtgaatgggctggcagcagcagccggatgtcagttggtggccagctgtgacatcgcggtggcttctgataagagctcattcgccacacccggtgttaacgttggtctgttctgttccacacctggggtctag

SEQ ID NO: 50016 - DNA, 501 bp, Artificial Sequence
  Description of Artificial Sequence: Synthetic coding sequence
atgctgaagtcactgcaaagcgatattctccatgatgctgactccaatgatctcaaggtcatcatcatttccgcagagggacctgtgttcagtagcggtcacgatctgaaggaactgactgaggaacagggtagggattaccacgcagaagttttccagacctgttctaaagtgatgatgcacatcaggaatcatcccgtgcctgtcatcgccatggtgaatggactggccgcagctgccggttgccagcttgtggccagctgcgacattgctgtggcttctgacaaaagctcttttgccacgccaggcgtcaacgtggggttgttttgctccacccccggagttgcactggcccgtgccgttccaaggaaggtggctctggaaatgctgtttactggagaaccaatttcagctcaggaggctcttctccacggactgttatccaaggtggtccctgaagccgagctccaggaagagaccatgagaatagccaggaaatag

SEQ ID NO: 50017 - DNA, 909 bp, Artificial Sequence
  Description of Artificial Sequence: Synthetic coding sequence
atggcactggtggcctcagtgcgcgtgcctgcccgagtgctgcttcgcgcaggagctcggctgccaggagctgccctaggcaggacagaacgagccgctggcggtggggacggggctcggaggttcggcagccagagggttctggttgaaccagatgccggagcaggcgtagctgtgatgaaattcaaaaacccacctgtcaattctctttccctggaattcctgacagaactcgtcatctcattggaaaagctggaaaacgacaagtcatttaggggagtgatacttaccagtgatagacctggagtgttttcggcgggactggacttgaccgagatgtgtgggagatcacccgctcattatgcgggatactggaaagctgtgcaggaactctggcttaggctgtaccaatccaatctcgtgctggtctcagctatcaatggcgcttgtcccgcaggaggctgtctcgtggcattaacctgtgactatcgcattctggcagacaatccaagatactgtatcggcctcaacgagacgcaactgggcataattgcgcctttttggctgaaagacaccctggaaaatacaattgggcatagggcagcggagcgggctctgcagctcggccttctgtttcccccagccgaggctttgcaggtgggcattgtcgaccaggtcgttccggaggagcaggtccagagcacagcactgagcgccatcgctcaatggatggccatcccagaccatgctcggcagctcacgaaggctatgatgagaaaagccacagcgtcacggcttgtgactcagagagatgccgacgtccagaactttgtaagttttatctcaaaggactctattcagaagagcctgcaaatgtacctcgaacgcttgaaagaggaaaagggctag

SEQ ID NO: 50018 - DNA, 858 bp, Artificial Sequence
  Description of Artificial Sequence: Synthetic coding sequence
atggcattggtggcatcggttagggtgcccgctagagtcctactcagagcgggagcccgtctacctggggcagcactgggcaggaccgaaagagctgccggtggcggtgacggtgcccgacgcttcggatcccaaagagtgctcgtcgaaccggatgccggtgctggtgtagccgttatgaagttcaagaaccccccagttaatagcttgagtctagagttcctcaccgagctggtgatatccctggaaaagctggaaaacgataagtcctttcggggagtgatcctgacatccgatcggcctggagttttctcagcgggtttggatttgactgaaatgtgtgggaggtctcctgcccactatgcaggctactggaaggccgtccaggagctgtggctgagactgtaccagtctaatctggtgctggtttcagctatcaacggggcatgtcccgctggcggttgtctcgtggccctgacgtgcgattacaggattttggctgacaatcctcggctgaaggacaccctggagaacactatcggccatcgggctgccgaaagagccctccagctgggcctgctgttcccccctgcagaggcccttcaagtgggtatcgtggaccaggtggttcctgaagagcaggtacaatcaactgctctctctgccatcgctcagtggatggccatccccgatcatgccaggcagctcaccaaggccatgatgcgtaaggctacagccagtaggctggttacccagagggatgctgacgttcagaacttcgtgagcttcataagcaaggactcgatccagaagtctctgcagatgtatcttgaacgcttgaaggaagagaagggatag

SEQ ID NO: 50019 - DNA, 1095 bp, Artificial Sequence
  Description of Artificial Sequence: Synthetic coding sequence
atgaacaggacagctatgagagcgtcgcagaaggactttgaaaactctatgaaccaggttaaactgttaaagaaagatcctggaaatgaagtgaaactgaagctatacgccctgtacaagcaggccacagagggcccttgtaatatgcccaagcccggagtgttcgatctgataaacaaggcaaagtgggacgcttggaatgctcttggctccctgcccaaggaagccgctagacagaattacgtggatctcgtttcctcactgtcgccatccctagagtcctcttcccaggtggagcctggaaccgataggaagtccacgggcttcgagacacttgtcgttacctcagaggacggaatcacaaaaatcatgtttaatcgtccaaagaaaaagaatgctattaacacggaaatgtatcatgagataatgcgggctctgaaggctgcctcaaaggatgatagtatcatcactgtgctcaccggcaatggagattactatagctctggaaatgatctgacaaacttcacggatattccccctggaggagtggaggaaaaagcaaaaaataatgccgtattgttacgcgaatttgtcggctgttttatcgacttccccaaaccgcttattgctgttgtaaacggtccagctgtcgggatatctgtgacattactaggcctgttcgacgcagtctacgcctcggatcgggctacatttcatactccatttagtcatctaggacaaagccctgagggttgctcttcttatacatttcccaagattatgtcccctgccaaggccacagagatgcttatattcggcaagaagctgacagcaggcgaggcttgcgcacagggcttggttaccgaggtgttcccagattctactttccagaaggaagtgtggacaagactgaaagcatttgctaaactgccaccaaacgccctgaggatctccaaggaggtcattcggaagcgcgagagggaaaaattgcacgccgtaaacgccgaagaatgtaacgtgcttcaaggcaggtggctatcggatgaatgtacgaacgcagtggtgaatttccttagccgaaaaagtaaactgtag

SEQ ID NO: 50020 - DNA, 1185 bp, Artificial Sequence
  Description of Artificial Sequence: Synthetic coding sequence
atggccatggcctatcttgcctggaggcttgccaggaggtcatgccctagctctctgcaggtgactagcttccccgtcgtgcaactccacatgaacaggactgccatgcgcgcttcccagaaagacttcgagaacagtatgaaccaagtgaagctgctcaaaaaagaccctggcaatgaagtgaagctaaaactgtacgccctgtataagcaggccaccgagggtccctgtaacatgccaaagcctggggttttcgaccttattaataaggctaaatgggacgcatggaatgctctgggctctctgcccaaggaagctgcaaggcaaaattatgtcgacctcgtgtcctcattgagtccctcgttggaatcaagctctcaggtggaaccaggcacagataggaagagcacgggcttcgagacattagtcgtgacatccgaagatgggataaccaagatcatgtttaatcggcctaagaagaagaacgccataaacacagaaatgtaccatgaaattatgcgagccctgaaagccgcttcaaaggatgacagcatcatcacagtcctgaccggcaacggtgattactattcctcagggaacgaccttacgaacttcaccgacatccctccaggcggtgtggaggaaaaggcaaaaaataatgctgttctgcttagagagttcgtgggatgcttcattgatttccccaagccgcttattgctgtggtaaatggcccagctgtggggatctcggttactctcctagggttgttcgacgctgtctatgcaagcgatagagctaccttccatactccattttcacacctgggtcaatcacccgagggttgtagtagctatacctttccaaagataatgtccccagccaaagcaaccgagatgctgatatttggaaaaaaactgacagccggtgaggcatgtgcacagggattggtgacagaggtttttcctgactcaacttttcagaaggaggtgtggaccagactcaaagcctttgctaagcttcccccaaatgccctgaggatatctaaagaagtaattaggaagagggaacgcgaaaagttgcacgccgtgaatgcggaggagtgcaatgtgctccaggggcgatggctgagcgacgaatgcactaatgcagttgtcaacttcctcagcagaaagagtaagctgtag

SEQ ID NO: 50021 - DNA, 1095 bp, Artificial Sequence
  Description of Artificial Sequence: Synthetic coding sequence
atgaacaggacggccatgagggcctcccagaaagatttcgaaaacagtatgaatcaggtgaagctcctcaagaaggaccccggaaatgaagtcaagctgaagctctacgccctgtacaagcaagcaaccgagggcccttgcaatatgcctaagcccggagtattcgatttgattaacaaagcaaagtgggacgcctggaatgccctcggcagcctgcccaaagaggcagccaggcagaactacgtggacctcgtgtccagcctgagcccctccctggaatcctcatcccaggtggaacctggcacagatcgaaagtccacaggctttgagactctggtcgtcacttcagaagacgggatcaccaaaattatgtttaatagaccaaaaaagaagaacgccattaatacagaaatgtatcacgagataatgcgcgctctcaaggctgccagcaaagatgatagcatcatcaccgtgcttacaggaaacggagactactactctagcggcaatgatctcacaaacttcacagacatccctccaggaggtgtggaagagaaggccaagaataacgccgtgctgctcagggaattcgttggctgcttcatagactttcccaaaccactcattgctgtcgtgaacggtcctgctgtaggaatctctgtgacactgctgggcctctttgatgccgtctacgcttctgacagagcaacattccacacacctttttcccacttgggccagtctccagaggggtgttcctcctacacattccctaaaatcatgagtcctgctaaggccacagaaatgctgatattcggtaagaagctcacagcgggtgaggcctgtgcacaggggctggtgactgaggtgttccctgactcgaccttccagaaagaggtatggacccgcctgaaggccttcgcaaaactcccacccaatgcactgagaatatccaaggaagtgataagaaaacgcgagcgggaaaaactgcatgccgtcaacgccgaagagtgcaatgtgctccaggggaggtggctttctgatgagtgcaccaatgctgttgttaactttctctcccgcaaatctaaattatag

SEQ ID NO: 50022 - DNA, 684 bp, Artificial Sequence
  Description of Artificial Sequence: Synthetic coding sequence
atgtaccacgaaatcatgcgggctttgaaggctgcctccaaagacgatagcatcataaccgtgctcacgggaaatggtgactattatagcagcggaaacgatctgaccaactttacagatatacctcccggaggcgtggaggagaaggcgaagaacaacgctgtactgttgcgggagtttgttggctgttttatagacttcccaaaacctctcatcgccgtggttaacggccctgcagttgggatcagcgtgacattgttaggactcttcgatgcggtatatgcaagcgatagggcaacatttcacactcccttctcccatctgggccagtctccagaaggatgttcgtcgtacacatttcctaagatcatgagccctgctaaggccaccgagatgctgatctttggaaagaagctgacagctggtgaggcctgcgcccaagggctggtcactgaggtcttcccagactcaacctttcagaaggaagtctggacccgattgaaagccttcgctaaactccctcccaacgccctcaggatctcaaaagaggtaattaggaagcgggagagagaaaaactccatgctgtgaacgcagaggaatgtaatgtgctccaaggtcgctggctcagtgacgaatgcaccaacgccgtcgtcaacttcctgtcaagaaagtctaagctgtag

SEQ ID NO: 50023 - DNA, 1095 bp, Artificial Sequence
  Description of Artificial Sequence: Synthetic coding sequence
atgaatcggacagcgatgcgagcaagtcagaaagactttgaaaattctatgaatcaagtgaagctccttaagaaggaccctggcaatgaagttaagctgaagctctacgctctgtataaacaggcgacagaagggccatgcaacatgcccaagccaggcgtgttcgatctaattaacaaggccaagtgggacgcctggaatgcattgggaagccttcccaaagaggccgctcgccagaactatgtcgatctcgtgtctagtctgagcccatcgttggaatctagttctcaggttgagcccggaaccgacagaaagtccactggcttcgagaccctcgtggtaacgtctgaggatgggatcacaaaaataatgttcaacagacccaagaaaaaaaacgccattaacaccgaaatgtaccacgagatcatgagggctctgaaggcagcaagtaaggatgactcaattattactgtcttaactggtaacggagattactacagctctggcaacgatctcacaaacttcaccgatataccccctgggggagttgaggagaaggccaagaataatgccgtcctactgcgcgaatttgtgggctgtttcatcgacttccctaaacccctgattgccgtagtcaacgggccagcagtgggcatttctgtcacattactgggcctgttcgacgcggtgtacgcctccgatcgcgcaacattccacacacccttttcacacctcggacaatcccccgagggatgtagctcctacacctttcccaaaatcatgagtccagcaaaagctacagaaatgctgatcttcggaaaaaagctgacagccggagaggcttgcgctcagggcttagttacagaagtgttcccagattcgacatttcagaaggaggtgtggacaaggctgaaggctttcgctaagcttccccctaacgccctacgcatctccaaggaagtgattagaaagagagagagagagaaactgcacgcagtcaatgctgaagagtgtaatgtgctgcaaggtagatggctgtctgacgaatgtactaatgccgtcgtgaactttctgtctcgcaagagcaaactctag

SEQ ID NO: 50024 - DNA, 2961 bp, Artificial Sequence
  Description of Artificial Sequence: Synthetic coding sequence
atggctgggatcttctattttgccctgttcagctgcctctttggcatatgtgatgccgtcactggaagtcgtgtctatccagcaaacgaagtgactttgctggatagcagaagcgttcaaggcgagcttggatggatagccagtccactggaagggggttgggaggaggtttctattatggatgagaaaaacacccctattcgcacctaccaagtttgcaacgttatggaaccctcccagaataattggcttcgcacagactggattacccgagaaggagcccagagggtctatatcgagatcaaattcaccctgagagactgtaacagtctccctggtgtgatggggacatgcaaagagacatttaatttatactattatgagagcgataacgacaaagaaagatttatcagagagaatcagtttgtgaaaatcgatactatagcggcagatgagtcttttactcaggtggacatcggcgatcggatcatgaaattgaataccgagattagggatgttggccctctgtccaagaaggggttttacctcgcctttcaagatgtcggtgcttgtattgctctggtttccgtgcgtgtattctacaaaaagtgccctttgacagtgcgcaacctcgcacaattcccagatacaataaccggcgcagatacatccagtctcgttgaggtccggggttcttgtgtgaacaacagtgaggaaaaagacgtccctaagatgtactgcggcgctgacggggaatggctggtgcccattggcaattgcctgtgtaatgccggtcatgaggagagatctggagagtgccaggcttgcaaaattggctattacaaggctctgagcacagacgcgacttgcgctaaatgccctccccattcctacagtgtgtgggagggcgctacatcctgcacttgtgatagaggctttttccgagccgataatgatgcggcatcaatgccctgcacacgccctccaagtgcacccctgaatctgatttccaatgtcaatgaaacctccgtcaacctcgagtggtccagcccccagaataccggagggcgtcaggacataagttacaatgttgtttgcaaaaaatgcggcgctggtgacccctcaaaatgtagaccatgtgggagtggcgttcattataccccacagcagaatggtctcaaaaccaccaaagtgtccatcacagacctactagctcatactaattacacgtttgagatctgggcagtcaacggggttagcaagtacaacccaaatcccgaccaatcagtctccgtgactgtgactaccaatcaggcagctcccagcagtatagcgctggtgcaagcgaaggaggtcacccgatactctgtggccttggcctggttagagcccgaccgcccaaatggcgtcatcctcgagtatgaagtgaaatactacgagaaagatcagaatgagcgctcttaccgtattgtgcgcaccgccgcaagaaacactgatataaaggggctgaatccattgaccagttacgttttccacgtgcgggctagaaccgctgccggatatggagacttttccgaacccctggaagtgactacaaatacggtccctagcaggatcattggagatggcgctaatagcactgtgctactggttagcgtgagtggttcagttgtgctggtggtaatcttgatcgctgctttcgtcatatccaggagacgctccaagtactcaaaggcaaaacaggaagccgatgaagagaaacatctaaaccagggcgttaggacctatgtagatccattcacatacgaagatccgaatcaagcagtgcgggagttcgctaaagagattgacgcctcttgtataaagatagagaaggtgatcggcgttggcgagttcggggaggtttgtagtggaaggcttaaagtacctgggaaacgagaaatctgcgttgctattaaaacccttaaggccggatataccgataaacagcggagagacttcctctctgaagccagcattatgggacagttcgaccaccccaacattattcatctcgagggggtcgtcaccaagtgtaagcccgtgatgatcataacagagtatatggagaatggtagcttagatgcattccttcgaaaaaacgatggcaggttcactgtaatacaacttgtgggaatgctgcgaggtatcgggtccggaatgaagtacctgtccgatatgtcctacgtgcaccgggacctagcagcacgcaacatcttggtaaacagcaatctggtctgcaaagtctctgattttggcatgtctcgggtcctggaggacgatcccgaagctgcatatactaccagaggagggaaaatccctattcgctggaccgctcccgaggccatcgcttacaggaaatttacctctgcctctgacgtctggtcatatgggatcgtgatgtgggaagtaatgagctatggagagcggccatactgggacatgagtaaccaggacgtgataaaagccattgaagagggatatagactgccccctcctatggactgtccgattgccctgcaccagctaatgctggattgttggcagaaagagcggagtgatagacctaagtttgggcagattgtgaacatgctcgacaagttaattagaaatccaaattccctgaagcgcacaggcactgagtcatcacgccctaatacagctctgcttgaccctagctccccagaattctctgctgtagtgtctgtgggggactggttgcaggccatcaaaatggataggtacaaggacaacttcacagccgcaggttataccacgctggaggccgtggttcatgttaaccaggaagatcttgccaggattggcataactgccatcacacaccagaataaaatcctgagctctgtccaggccatgcgtacccaaatgcaacaaatgcacggtaggatggtgcccgtctag

SEQ ID NO: 50025 - DNA, 2808 bp, Artificial Sequence
  Description of Artificial Sequence: Synthetic coding sequence
atgaaatgggaggaagtgtccatcatggacgaaaagaacacccccatccgcacctatcaggtttgtaatgtcatggagccaagccaaaacaactggttacggacggactggatcacacgcgaaggtgcccaacgagtttacatcgaaatcaagtttacgctccgggactgtaacagtcttcctggagtgatgggcacatgtaaagagacattcaatctgtattactatgaatcggacaacgacaaggagcggttcatcagagagaatcaattcgtcaagatcgacacaattgccgctgacgagtccttcacccaagttgatatcggagatagaatcatgaagctcaacaccgagatcagagacgttgggccactgtccaagaagggtttttacctggcgtttcaggacgttggcgcttgcattgccctagtttccgtgagggtgttttacaagaaatgtccactgacagtaaggaatctggcccagttcccggatacaattacaggggctgatacctcttctttggttgaggtgagaggaagttgtgtgaataacagcgaagaaaaagacgtgccaaagatgtattgcggggcagacggggagtggttggttcccattggaaactgcctgtgtaatgctgggcacgaggaacgctccggggagtgccaggcttgtaagatcgggtattacaaggctctctctacggatgccacatgtgctaagtgccctccccactcctacagtgtctgggagggcgcaactagctgtacctgcgatagagggttcttccgggcagacaacgacgctgcgagtatgccttgcacaaggccaccaagcgcccctctgaacctcatttcaaacgtgaatgagacaagcgtgaatctggagtggagcagtcctcagaatacgggcggtcggcaggacatctcctacaatgttgtctgtaaaaagtgcggtgccggtgacccatccaaatgtaggccttgcggctctggcgtccactacacaccccagcagaatggcttgaagacgactaaggtgagcattactgaccttctcgcccatactaactacacctttgagatttgggcagtcaacggagtgagcaaatacaacccaaacccagatcagtctgtgtccgtgacagtcactaccaaccaggcagcgccttcctccattgcactggtccaggccaaagaagtgacgcgctatagtgtggctcttgcttggctggaacccgacaggcctaacggagttattctggaatatgaggttaagtattatgagaaggaccagaacgaacgcagttatcggatcgtacggaccgccgctcggaataccgatattaaggggctgaacccactgacgtcctatgtgtttcacgttcgggctcggaccgccgcaggttacggggacttcagtgagcccctcgaagtgactaccaacacagtgccctcgcgcatcataggggatggtgcaaactcgacagtgttgctggtctccgtctctggctctgtggtgttggtggtcatactgattgcagcttttgtcatttccagacgccgatccaagtactctaaggcaaagcaggaggctgatgaggagaagcatttgaatcaaggagtccggacgtacgtcgatccctttacatacgaagacccgaatcaggcggtgcgcgaattcgccaaggagatcgacgcgtcatgcatcaagattgaaaaagtgattggcgttggggaattcggcgaggtgtgcagcggacgactgaaagtgcctggcaagcgggagatttgcgtagctatcaagactttaaaagccggttacactgacaaacagcgaagggatttcttgtcagaggcttccatcatgggacagtttgaccatcctaatatcatccacctagaaggggttgtcactaaatgcaagcccgtcatgatcatcaccgaatatatggaaaacgggtctctcgacgccttcctcagaaagaatgacggccgattcaccgtcatacagctcgttgggatgctgaggggcattggctcaggtatgaaatatctctcagacatgtcctatgtgcatagggacctggcagctcggaacatccttgtcaatagcaacctggtctgcaaggtcagtgacttcggcatgtccagggtcctcgaggacgatcccgaggcggcttacactacccggggagggaagataccaatccggtggaccgcaccagaagcaattgcctatagaaagtttacctccgcatccgacgtttggtcctacggcattgtaatgtgggaggttatgtcctatggcgaacgcccttactgggatatgtcaaaccaggacgtcatcaaggccattgaggaaggatatagactgccaccccctatggattgtcctatagcactccaccagcttatgctggactgctggcagaaggagcgatccgacagacctaagtttggccagattgtcaacatgcttgataagctcataaggaaccccaactccttaaagaggaccggcacagagtccagtaggcctaatactgcgctgttggatccttcttctcccgagttttccgccgtggtatccgtgggagattggctgcaagcaataaaaatggaccggtataaggacaatttcaccgctgccggttacaccactctagaagccgtcgttcacgtaaatcaggaagaccttgctagaattggtattactgcaatcacacatcagaacaaaatcctgagtagtgtgcaggcaatgaggacacagatgcaacagatgcatgggcgtatggtgccggtgtag

SEQ ID NO: 50026 - DNA, 2850 bp, Artificial Sequence
  Description of Artificial Sequence: Synthetic coding sequence
atggccggaatcttctatttcgctctgttctcatgcctgttcggaatatgcgacgccgttaccggctcacgcgtgtaccctgctaatgaggttaccctgttggattccagaagcgtgcaaggagaactaggctggattgccagcccactggagggtggatgggaggaagtatctatcatggacgaaaagaacacccctataaggacctaccaggtgtgtaatgtcatggagccctcccagaacaattggctgcgcaccgactggatcactcgggagggtgctcagagagtgtacatcgagataaaatttaccctcagggattgcaacagtttgcctggagtgatgggaacatgcaaggaaacctttaatttatactactacgagagcgataacgataaagagaggttcattcgggagaaccagttcgtgaaaatcgacacaatagcggctgatgagagcttcactcaggtagatattggagataggattatgaagctcaatactgagattcgcgacgtaggccctctaagtaaaaagggattttatctagccttccaggacgtgggcgcttgtattgcacttgttagcgttcgcgtgttctacaaaaaatgtccactgacagttcgcaatcttgcccagttccctgatactatcactggcgcagacacatcctcactcgtggaggtccgaggatcttgtgtaaataatagcgaagagaaagacgtgcccaagatgtattgcggagccgatggagagtggctggtcccaattggaaactgcctctgcaacgcaggccacgaggagcgctctggagagtgccaggcttgcaagattggatactacaaagccctgtctaccgacgccacttgtgcaaagtgccccccacattcctatagcgtgtgggagggcgctacctcatgcacgtgcgacagaggcttctttcgcgcagataatgatgccgcaagcatgccatgtaccagaccgccatctgcccctctgaacctgatcagcaacgtcaacgaaacctcagtgaatctcgagtggagtagcccccagaatactggaggtcgccaagacatatcttataacgtggtctgcaaaaagtgcggagcgggagaccccagcaagtgcaggccttgtggtagtggcgtgcattacaccccacagcagaatggtttgaaaactacaaaggtgagcattacggacctgctggcgcacaccaattacacgttcgagatttgggcggtaaacggagtgagcaaatacaatccaaatcctgatcagtcagtgtctgtcacagtcacaacaaatcaggcagccccttctagcatcgcactcgtgcaggcgaaagaagtgacacgctacagtgtcgccctggcctggctggagcctgatcgacctaacggcgtaatcctggaatatgaggtgaagtactatgagaaagatcaaaacgaacgctcctaccggattgttagaactgccgcaaggaacaccgatattaaaggcttgaatcctctgaccagctacgtgtttcacgtccgcgcacggactgcagctggatacggcgatttttctgaacccttggaggtcaccactaacactgtgccctcccggatcatcggggacggagctaacagcactgtattgctcgtgtcagtgtcgggcagtgtcgtcctcgtggtcatacttatcgcagcgttcgtgataagtcggcgaagatccaaatactccaaggctaagcaggaagcagacgaggaaaagcatttgaatcagggagtcaggacctatgtcgatcccttcacatacgaagacccaaatcaagccgtaagagagttcgccaaggaaatcgatgcctcatgcatcaaaattgaaaaggtgattggagttggagaattcggggaagtttgctcaggcagactgaaggtcccgggtaaaagggaaatatgcgtggccatcaagacgctgaaagccggatacaccgacaaacagaggcgtgacttcctcagcgaggcctctattatggggcagtttgaccaccctaatattatccatctggagggcgtcgtcaccaaatgtaagcccgtaatgatcattaccgagtacatggaaaacggttccttagacgccttcctgcgcaaaaacgacggtcgctttaccgtgatccagctggtcggtatgttgcgaggtatcggaagcggcatgaaataccttagcgacatgtcctacgtgcatagggacttagcagccaggaacatcttggttaactcaaacttggtgtgcaaggttagtgactttggcatgagccgcgtgctggaagatgatccggaagcggcatatactactcgtggcggtaagatccctattcgatggaccgcccctgaggcaatcgcataccgaaagttcacctcagcgtccgatgtgtggtcctacggtatcgtgatgtgggaagtgatgagctatggagagaggccctactgggatatgtctaaccaggacgtgatcaaagccattgaggaaggctatcgcctgcctccccctatggattgtcctatcgccctgcatcagctgatgcttgactgctggcagaaagagagatctgaccgcccaaagtttgggcaaattgttaacatgttggataaactcatccggaatccaaacagcctgaagaggactgggactgagagttctcgccctaacaccgcgttgctggatccctcctctcccgaattcagcgcggttgtgagtgtgggagactggctccaggcaatcaaaatggatagatacaaggataattttacggcagcgggttacaccacgctagaggccgtggtccacgtgaatcaggagtag

SEQ ID NO: 50027 - DNA, 2961 bp, Artificial Sequence
  Description of Artificial Sequence: Synthetic coding sequence
atggcaggtattttctacttcgctctcttctcttgcctctttggaatttgtgacgcagtaaccggaagccgggtctatccagccaatgaagtgacacttctggacagcaggtccgtccagggggagctggggtggatcgccagtcctctggaaggagggtgggaggaggtctcgataatggacgaaaagaatacacccataagaacgtaccaggtatgtaacgtgatggagcccagccagaataattggctgagaacggattggatcacccgggagggcgcacagagagtgtacatcgagattaaatttacattgagggattgcaactccctaccaggggtaatgggcacttgcaaagagacttttaatctatattactacgagagcgacaatgacaaggagcgattcatccgggaaaaccagttcgtgaagatcgatacaattgctgctgacgagtcatttacacaagttgacattggggaccggataatgaagctaaataccgagatccgggatgtgggcccactgtcgaaaaagggtttctacctggccttccaggacgtgggagcctgcatcgccctagtttctgttcgggtattttataagaaatgtcctctgacagtgcggaacttagcccagttcccggatactatcaccggggctgatacatcctccctggtggaagttcggggaagctgcgtcaacaattctgaggagaaggatgtgccgaagatgtactgcggcgcagatggcgaatggctggtacccataggcaactgcctgtgtaatgccggacacgaggagcgatcaggagagtgccaggcgtgcaagatcggctattacaaggcactctcaactgatgccacctgtgctaaatgcccgccacatagctattcagtgtgggagggggctaccagttgtacgtgcgatcgcggatttttcagggccgataacgacgccgcatccatgccatgtacaaggccgccaagcgcccctctgaacttaatttcaaatgtgaatgagacctctgtaaacctcgagtggtccagtcctcaaaatacgggcggaagacaggatatctcatacaacgtggtttgtaaaaaatgtggtgccggagatcctagtaagtgcagaccctgtggctccggcgtgcactacacccctcaacagaatggacttaagacaacaaaggtctctattacagatctgttagcccatacaaactacaccttcgagatttgggcagttaacggggttagtaagtacaatcccaatcctgatcaatctgtcagtgtgacagtgaccacaaatcaggccgcaccgagctccattgctctggtgcaggccaaagaggtcaccagatactctgttgccctggcatggttggagccggatcgcccaaatggggtgatcctggaatacgaggtcaaatattatgagaaagatcaaaatgaaagaagttataggatcgtgaggacagcggctagaaataccgacattaaagggctgaatcccctgacctcttacgtgttccacgtaagggctaggactgctgccggatatggagacttcagtgaacctctggaagtcacaacaaacaccgtaccttccagaattatcggcgatggtgccaattctacagtgttactggtgagtgtgtcaggctccgtcgttctggtggtgattctcattgcagcattcgtgatatcgcgcaggcggtctaagtatagcaaggccaaacaggaggctgatgaagaaaagcatctcaaccagggggtacgcacttacgtggacccatttacttacgaggatcctaaccaggcagtcagggagttcgcaaaggagattgacgccagttgtatcaagattgaaaaagtgattggcgtgggcgaatttggtgaggtttgttccgggagactgaaggtacccggaaagagagagatctgtgtggccatcaaaactctgaaggcgggttacactgacaagcagcggcgagactttctctccgaggcctcaatcatggggcagttcgaccatccaaacatcatacacctggaaggggtcgtgaccaagtgcaaacccgttatgatcattacggaatatatggagaacggtagcctggacgcttttctgcgtaagaacgacggacgcttcactgtgatccaattagtcggcatgctgcgtggtattggctctggcatgaaatacctttccgatatgagttatgtgcacagggatttggccgctaggaacatattagtgaactctaatctcgtgtgtaaggtctctgattttggaatgagtcgtgtcctggaagatgacccagaagccgcttacacgaccaggggaggtaaaatcccaataagatggaccgcccctgaagccatcgcttaccgtaaattcacatctgcttctgacgtctggtcctatggtattgtcatgtgggaagtcatgtcatatggcgagaggccttactgggacatgtcaaatcaagacgtgatcaaagccatcgaagaagggtaccgcctgccccctcctatggattgcccaatagctctgcaccaactgatgctcgactgctggcaaaaggagagaagcgatcgccctaaatttggtcagatagtcaacatgcttgataaactcatacgcaacccaaacagcctgaaacgtacaggtactgaaagtagcagacccaatactgctctactcgatccttcctcccctgagtttagtgctgtggtctccgttggcgactggctccaagctataaaaatggatcggtacaaggataatttcaccgccgctggctacaccaccttggaggctgtcgtgcacgtcaatcaggaggatctggcccgtataggaattaccgccatcacacatcagaacaagatactgtccagcgtgcaggcgatgaggacgcagatgcagcaaatgcatggacgaatggtcccagtctag

SEQ ID NO: 50028 - DNA, 276 bp, Artificial Sequence
  Description of Artificial Sequence: Synthetic coding sequence
atggctggaattttctactttgcactgtttagctgtctcttcggaatctgtgacgccgtcacaggatctagggtgtacccggctaacgaggtgacactacttgattctaggtcagtgcagggagagttaggctggattgcgagtccactggagggaggatgggaagaggtgtctattatggatgaaaaaaataccccgatccggacataccaggtgtgtaacgtgatggagccaagccagaacaactggttacgcactgactggatcacacggtag

SEQ ID NO: 50029 - DNA, 450 bp, Artificial Sequence
  Description of Artificial Sequence: Synthetic coding sequence
atggcaggcatcttctatttcgcgcttttttcttgtctgttcggaatctgtgacgcagtgactggctcacgggtgtacccagcaaatgaggtcacactgctggatagccgcagtgtgcagggcgagctgggctggatagcctccccgttagagggcggatgggaggaagtttcgatcatggacgagaaaaatacccccatccgtacctatcaagtctgcaacgtgatggagccgtcccagaataactggctgagaacagattggattacccgcgaaggcgctcagcgcgtatacatcgagattaagttcacattaagagattgcaatagcctcccaggtgttatggggacgtgtaaggaaactttcaacctttattattacgagtccgataacgacaaggagcgtttcattcgcgaaaaccaatttgtgaagattgacactattgcctag

SEQ ID NO: 50030 - DNA, 840 bp, Artificial Sequence
  Description of Artificial Sequence: Synthetic coding sequence
atggtgtttcagacacgttatccgagttggatcatcctgtgctatatctggttgttgcggtttgcacacactggcgaggcacaagctgctaaggaagtgcttctgttggatagtaaggctcagcagactgaactggaatggatttcttcaccaccaaatggatgggaagaaatcagcggactggatgagaactatacgccaatcagaacttaccaggtctgccaggtgatggagcccaatcagaacaactggcttagaacaaattggatttccaaaggtaatgcacagcgaatctttgttgagttgaagttcacactcagagattgcaactccctgccgggagtccttggtacctgtaaggaaaccttcaacctttattactacgagaccgattacgatacgggacgtaatatccgagagaatctctatgttaagattgacacaatagccgcagacgagagttttacccagggggatttaggggagcgcaagatgaaactgaacacagaagtaagggagatagggccactgtctaagaagggattttatttggcattccaggacgttggtgcatgtattgcactggtctccgtgaaggtctactataaaaagtgctggagcatcattgagaacctcgctatctttcccgatactgttaccggaagcgagtttagctctttggttgaagtacggggaacatgtgtctctagtgcggaggaggaggctgaaaacgctcctcgcatgcattgcagtgctgaaggggaatggttagtaccaattggtaaatgcatttgtaaagccggataccagcaaaaaggcgatacctgcgaacgaaaatag

SEQ ID NO: 50031 - DNA, 2997 bp, Artificial Sequence
  Description of Artificial Sequence: Synthetic coding sequence
atggtgtttcaaaccagataccctagctggattattctgtgctacatttggcttctgaggttcgcccacacgggggaagcccaggctgctaaggaggttctcctgcttgatagcaaagcccagcaaacagagctggagtggatttcatcaccgcctaatggatgggaagagatttccggtttggacgagaactacacacctataagaacataccaggtttgccaggtgatggagccgaatcagaacaattggctgcgtaccaattggatttccaagggcaatgcccaacggatttttgtcgaattaaaatttacactcagagattgcaacagcctcccaggggtgctcggtacttgtaaagaaacattcaatctgtattactatgagactgactatgacaccgggcgaaatattagggaaaatctttatgtgaaaatcgataccatcgcagccgatgagtctttcacccagggcgatttgggcgaacgcaagatgaaattaaacactgaggtacgagaaataggacccctgtctaagaaaggcttttatctggccttccaggacgtgggcgcatgtattgcattagtgagcgttaaggtttattataagaaatgttggagtatcatcgaaaatttggctatattccccgacactgttaccgggagcgaattttcctccctcgtggaggtgaggggaacctgcgtgtcttccgccgaggaagaggccgagaatgcccctagaatgcattgtagtgccgaaggagagtggctcgtgcctatcggaaaatgcatttgcaaagcaggttaccaacagaagggggatacatgtgagccttgcggacgaggtttttataagtcgagttcccaggacctgcagtgttctcgatgtcccacccatagcttcagcgacaaagagggatcgtccagatgtgagtgtgaggatggttactacagagctcctagcgaccccccttacgtggcctgcacccggccaccctcagctccgcagaatctcatctttaatatcaaccagaccaccgtgtcactcgaatggagtccccctgccgataacggcggaaggaacgacgtaacttacaggattctgtgtaagcgatgttcctgggaacaaggtgagtgcgtaccctgtgggtccaacatcggttacatgcctcagcagacaggactcgaagataattatgttacggtgatggatctcctggcccatgccaattatacttttgaggtggaggctgtgaacggggtcagcgatctgtcccgttctcagcgcctctttgcagctgtcagcattacaacaggtcaagctgcacccagccaggtatcaggcgtaatgaaagaacgcgtattgcagcgtagcgtggaactatcctggcaggagccagaacaccctaacggggttatcactgagtacgagatcaaatactatgaaaaggaccagagagagcggacttactcgacggtcaaaactaagtcaaccagtgcaagcatcaataacctgaaacccggaactgtatacgtgttccagattcgtgcatttaccgcagctggctacggcaactattcccctagactcgacgtggctactcttgaggaggccacagggaaaatgttcgaggccaccgctgtgagttctgaacagaatccagtgattattattgctgtggtcgccgtggcgggaaccatcatcctcgtgttcatggttttcgggttcatcattggcagacgccactgtgggtacagcaaagctgatcaggaaggagacgaggagctgtacttccacttcaagtttcctggaacaaagacttatatcgaccctgaaacttatgaagatccgaaccgcgctgttcatcaatttgctaaggagttggatgcaagctgcatcaaaatcgagcgcgttatcggcgcaggcgaattcggggaagtatgcagcggtcggcttaaactgccagggaagcgcgatgtggccgtagccattaaaaccctgaaagtcggttatacggaaaaacagcgcagagacttcctatgcgaggcttcgatcatgggccagttcgaccacccgaacgttgtccacctcgaaggtgtcgtcactagagggaagcctgtgatgatcgtgattgaattcatggagaacggcgcattggacgcttttcttcggaaacatgatggacagtttaccgtgattcaacttgtggggatgcttagggggatcgccgcaggaatgcgttacctggcagatatggggtacgtccatcgggatcttgcggctcggaatatcctcgtcaacagcaacctggtgtgtaaggttagcgactttggtctgagccgtgtgatcgaagatgatccggaggcagtctacaccaccacagggggtaagatcccggtacgctggacagctcctgaagccattcagtaccgaaaatttacctcagctagtgacgtttggtcctacggtattgtcatgtgggaagtgatgtcatatggtgagagaccatattgggatatgagcaaccaggatgtaatcaaggccattgaagagggctaccgcctgcccgctcccatggactgcccagcaggcctgcatcagctgatgctggactgctggcaaaaagagagggctgagagacctaagtttgaacagatcgtgggcatcctggataaaatgatcagaaacccaaattctctgaagaccccccttgggacctgctcccgcccaatatctcccttactagaccagaacaccccagatttcacgacgttttgtagtgtaggggaatggctgcaggctataaaaatggagcggtataaagacaattttacggccgctggatacaactcactcgagagcgtggctagaatgacaatcgaggacgttatgagccttgggattacattggttgggcaccagaaaaaaattatgagcagcatccagactatgcgcgctcaaatgttacacttacacggtactggcatccaggtttag

SEQ ID NO: 50032 - DNA, 687 bp, Artificial Sequence
  Description of Artificial Sequence: Synthetic coding sequence
atgttgcacgtcgagatgctgaccctcgttttccttgtgctgtggatgtgtgtgttcagccaggatccaggctccaaagccgttgccgaccgatatgctgtgtactggaactcaagtaatcccagattccagcgaggtgactaccatatagatgtgtgtatcaatgattatctagacgtgttctgtccccattacgaagactctgtgcctgaggataagacagaacgttacgttttgtacatggtgaactttgacggatactccgcttgcgaccacacatccaagggattcaagcgatgggagtgcaaccgtccacattctcctaatggccctcttaaattttccgagaaattccaattgtttaccccattttctctgggattcgagttccgacctgggagagaatacttctacatcagcagtgccatcccggataacgggaggagatcctgtctgaagctgaaggtgttcgtccggcctaccaacagctgtatgaagaccattggagttcacgatcgggtgttcgatgtcaacgacaaagtggaaaactccttggagccagccgacgatacagtgcatgagtcggcagagccatcgcgcggagagaacgcggcacagactcctcgcattcccagcaggttgttagccatactgttgttccttctcgcaatgcttttaaccctctag

SEQ ID NO: 50033 - DNA, 2595 bp, Artificial Sequence
  Description of Artificial Sequence: Synthetic coding sequence
atggcggctcccctcattccactctctcagcagatcccaaccggaaacagcctgtacgaatcctattataaacaagttgatccggcttatacaggccgagtaggtgcgtctgaggccgctctgttcctgaaaaaatccggcctgagtgacattatcttagggaagatctgggacctggccgacccagagggtaagggattcctggataaacaggggttctacgttgcactgcgcctggtggcgtgtgcccaatccggccatgaagttaccctgtctaacctgaacctgtccatgccccctcccaaattccacgacacctcaagcccactcatggtgacccctccctcagcagaagcacactgggccgtgcgggtggaagaaaaggcaaagttcgatggaatctttgaaagtctcttacctattaatggccttctgtctggagacaaagttaaacccgtcctgatgaacagtaaactgccattagatgtcctcggtcgggtctgggacctgtcagatatagataaagacgggcacctggacagagatgagtttgccgtcgctatgcacctggtgtaccgtgcccttgaaaaggagccagttccaagtgccttgcccccttctttaatccctccaagtaagcgaaagaaaacggtgttccctggagccgtgcccgtcctccctgcctcacctccacccaaagactccttgagatctacccccagccacgggagtgtatccagcctgaactctacgggcagcctttctccaaaacactccttaaagcagactcagccaacagtgaattgggttgttcccgttgctgacaagatgagattcgacgagatattccttaaaacagacctggacttggacgggtatgtctctgggcaggaggtgaaagagatctttatgcatagcgggctgacacagaatctgttagcgcatatatgggccctcgccgacaccaggcagaccggcaagctaagcaaggatcagtttgctctcgcaatgtatttcatccagcagaaggtgagtaagggaatcgacccccctcaggtgctgagcccagacatggtacccccttccgaaagggggacgccagggcctgactcatctggctctttagggagcggagagttcacaggagttaaagaactggatgatattagtcaagaaatagctcaactgcagcgggagaagtacagcttagagcaagacattagagagaaagaagaggccatccggcagaagaccagtgaggtgcaggagctgcagaacgacctggatagggagacatcctctctgcaggagctggaggcccaaaagcaggatgcccaagacagactggacgagatggaccaacagaaggccaagctgcgggatatgttgtccgacgtcagacaaaagtgtcaggatgaaacacaaatgatctcctccctgaagactcagattcagtcccaggaaagtgatttgaaatcccaggaggatgacctgaatagggcaaagtctgaactgaataggctgcagcaggaggagacacagctggagcagtctattcaagccggacgagtgcagctagagaccatcattaagtctttgaagtccacccaggatgagatcaatcaggccaggagtaagctgagccaacttcatgaatcccggcaggaagcacaccgttcgctggaacagtacgatcaagtactggacggggctcacggcgctagcctgaccgatctcgccaacctatcggagggagtgagtctggctgagcgcggtagtttcggtgccatggacgacccttttaagaacaaggccttgctgttttctaacaacacccaagaattgcacccagacccgttccagacagaagacccttttaagagcgatccgttcaaaggagccgacccattcaaaggcgatccattccagaatgatcctttcgcggaacagcagacgaccagcactgatccatttgggggtgacccattcaaagaaagcgacccattcagggggtcagcaaccgacgacttcttcaagaaacaaacgaaaaacgatccatttacgtcagatccattcaccaagaacccctccctgcctagtaaattggatccattcgagtcctctgaccctttcagttcctcctccgtgtcgtcaaaaggcagtgacccctttggcaccctggacccttttgggagcgggagctttaattcagcagaggggttcgcggacttctctcaaatgtccaagccgcctccaagtggccctttcacttcctcattgggaggtgccggattttccgatgacccattcaaatcgaaacaggacacacccgcactgccaccgaaaaaacctgctccacccaggccaaaacccccatcaggcaaatctacaccagtgagtcagctcgggagcgctgacttccccgaagcccctgacccttttcagcctctgggcgcagacagtggagacccatttcaaagcaaaaaggggttcggcgatccattttcgggcaaagacccctttgtgccgtcttcggcggcaaaaccttccaaggcttccgcctccggcttcgctgatttcacctctgtgagctag

SEQ ID NO: 50034 - DNA, 2733 bp, Artificial Sequence
  Description of Artificial Sequence: Synthetic coding sequence
atggcggcacccctcatacccctttcgcagcaaatccctacgggcaactcactgtatgagagctactataagcaggtggatccagcgtacacaggtagagtgggcgctagtgaggccgcactgttcctgaaaaaaagcgggctgagcgacataatactggggaagatctgggaccttgcggaccctgaagggaagggtttcctggacaagcagggcttttacgtggccttacggttggttgcatgtgctcagtccgggcacgaggtcaccctgagcaacctgaatctcagtatgccgccaccaaaattccacgacacatcatcacctcttatggttacccccccatctgccgaggcgcactgggcggtgcgagttgaggaaaaagcgaagttcgacggaatattcgagtcccttctgcccattaatggcttactcagcggcgacaaggtgaaacctgtgctgatgaacagcaaacttcccctggatgtgctgggcagagtttgggacttgagtgacatcgacaaggatggccaccttgaccgcgacgaattcgccgtggcaatgcaccttgtgtaccgggcactggagaaggagccagtgccaagtgcccttcccccatccttaatcccaccctcaaagaggaaaaaaaccgttttccctggagccgtccctgtgctgccagctagccctccaccaaaggattcccttcggagtacaccaagtcatggttcggttagctcgcttaattctaccggatctctgtctccaaaacacagtctcaagcaaacgcagcctaccgtgaattgggtagtccctgtagccgataagatgaggttcgatgagattttccttaaaaccgatttggaccttgatggatacgtaagcggacaggaggttaaggagatcttcatgcacagcgggctgacccagaacttactggcccatatctgggccttggccgatacgaggcagaccggaaagctgagtaaagatcagtttgccctggccatgtatttcatccagcagaaagtgagcaaagggatcgacccaccacaggtgctctcccctgatatggtcccaccttctgagcggggtaccccaggacctgacagctccggtagcctcgggtcaggtgaattcaccggagtcaaggagctcgatgacatttctcaagagatagcccaactgcagagagaaaaatacagcctcgaacaagatatccgcgagaaagaagaggccatccgacagaagacctctgaggtgcaggagcttcagaacgacttggacagggaaacttcctctttgcaagaactggaagcccaaaaacaagatgctcaggacaggctggatgaaatggatcagcagaaggccaagctcagggatatgctgtccgatgtacgccagaaatgtcaagatgaaacccagatgatcagttccttgaagactcagattcaaagccaagagtctgacctgaagagccaggaagacgatctgaaccgagcaaaatccgaactcaaccgccttcagcaggaggagacacaactggagcaatccattcaggcaggaagggtccagctcgagacaattattaagagcttgaaaagcacccaggatgaaattaaccaggctcgaagcaagctctctcagttgcacgaaagccgccaggaggctcatcggagcctggaacagtatgaccaggtactggatggagcacatggtgccagcctgacagaccttgcgaatctttccgaaggcgtctccctggcagagcgcggatctttcggggcaatggacgatcccttcaaaaataaggcactgctgttcagtaataatactcaggaactgcaccctgatccattccaaaccgaagatccattcaagagtgatccttttaagggcgcagatcctttcaaaggtgacccgtttcagaacgatccattcgccgagcagcagacaaccagtaccgaccccttcggaggcgaccctttcaaagaatctgatccttttcgcggaagcgcaacggacgacttttttaagaaacagactaaaaacgacccctttacaagcgatcccttcactaagaatccgtccctcccgagcaagctggatccgttcgagtcttcagatcctttctcgagcagctctgtttcctctaaaggttcggatccatttggcacactcgatccattcgggagcggcagcttcaatagcgcagagggattcgccgatttctcccagatgagcaagccgccacccagcggtccctttacttcatccctcggcggtgccggtttctcagacgaccctttcaagtccaagcaggataccccggctctgccccctaaaaagccagcccctcctcgcccaaaacccccaagcggcaagtccactcctgtttcccagttaggtagcgcagacttcccagaggcacccgatccatttcaacccctcggtgccgattcaggcgatccttttcagtccaaaaaaggctttggggacccattcagcgggaaggaccctttcgtaccatcatcggcagcaaagccttctaaagcctcagcctctggattcgccgacttcacctctttcggtaacgaagagcaacagctcgcttgggccaagcgggagagcgagaaagcggagcaggagcgcttggccagacttcgacgccaggagcaagaagacctggagctcgccatcgcgctgagtaaagccgacatgcccgcagcctag

SEQ ID NO: 50035 - DNA, 2265 bp, Artificial Sequence
  Description of Artificial Sequence: Synthetic coding sequence
atggctgcaccgttaatcccgctcagtcagcaaattccaactggtaatagcttgtacgagtcctattataagcaagtcgatcccgcttatacagggagggtgggcgcatccgaagcggcactgtttttgaagaaatctggactatctgacataattctcgggaaaatctgggacttagccgaccctgagggtaaagggttcctggacaagcagggattttacgttgctttaaggctggtggcatgtgcccagtctgggcatgaggtgaccctgagcaacctcaatctctccatgccgcctccaaagtttcacgatacctccagccctcttatggtcaccccgcctagcgccgaggcccactgggcagtcagggtagaggaaaaagctaagttcgatggcattttcgaatcgctcctacccatcaatggactcctcagcggtgacaaagtgaagccagtcttgatgaattccaaacttccgttagacgtgctgggcagggtgtgggatctgtccgatatcgacaaggatggtcatctcgaccgtgatgagtttgccgtggccatgcacctcgtttaccgcgctcttgaaaaggagccagtccccagtgctttgcctccaagcttgattcctccctccaaaaggaagaaaacagtcttccccggagcagtgccagtgttgccagctagtccaccacccaaggactccctgcgcagtacaccctctcatgggagcgtcagctcactgaactcaacaggttctctgtcccccaaacacagcctgaaacagacccaaccaaccgtaaattgggttgtgcccgtggcagacaagatgcgcttcgacgaaatctttctgaaaaccgacctagacctggatggctacgtcagcgggcaggaggtaaaagagatttttatgcactccggattgacccaaaacttgttagcccatatctgggcgttagccgacactagacagactgggaaactctcaaaagatcagtttgcacttgccatgtacttcattcagcaaaaagtgtccaaaggcattgacccacctcaggttctgagccctgacatggttcccccttccgagcggggtacccccggaccagattcgtctgggtccctgggcagcggggagtttacgggagtcaaagagctcgacgatatctcccaagaaatcgcccagctgcagcgagagaagtactcccttgagcaggatatcagagaaaaggaggaggctatacggcaaaagactagtgaggtgcaagaattacagaatgatttggatagggaaacttccagtttacaggagcttgaggcccaaaagcaggatgctcaggatagacttgatgaaatggatcagcaaaaggccaaattgcgggatatgctaagtgacgtgcggcagaagtgtcaagacgagacccagatgatcagctctctcaaaacacagattcagagtcaggaatctgacctcaaatctcaggaagatgatctcaacagagccaagagtgagctgaacagactccagcaagaggaaacccagcttgagcaaagcatccaagccggtcgggtgcagctggagacgattattaaatctttaaaaagcactcaggacgagatcaatcaggcacgttccaagctctctcagctccacgagtccaggcaggaggcccaccgctccctcgagcagtacgaccaggtgctggacggcgctcacggcgcttctctgaccgaccttgccaatctctcagagggggtgtctctagccgagcggggatccttcggagcaatggacgacccttttaaaaataaggcactgctgttcagtaacaatactcaggaactgcatccggacccattccaaacagaggatccctttaaatcagaccctttcaagggcgctgaccctttcaagggggatccgtttcagaatgatcccttcgctgagcaacagaccacctctactgacccattcgggggagatcctttcaaggaatccgatcccttccgaggctctgccacagatgatttcttcaaaaaacagaccaagaacgacccattcacatctgatccctttaccaagaatcccagcttacccagtaaacttgatccatttgagagttccgatcccttctcatcttcttctgtcagcagtaaagggtcagatcctttcggcaccctggatccatttggctcagggagttttaacagcgccgaaggcttcgccgacttttcacagatgtccaaagtgaaggtgcacttgtag

SEQ ID NO: 50036 - DNA, 1806 bp, Artificial Sequence
  Description of Artificial Sequence: Synthetic coding sequence
atggccgctcctcttattccactgagtcaacaaattccaactggcaactcactgtacgagtcatattataaacaggtggacccagcctacaccggtagagtcggagcttctgaagccgctctgttcctcaagaaaagcggactgagtgatatcatcctggggaaaatttgggatctagccgacccggaagggaagggcttcctggacaagcaaggcttctacgttgcactgaggctggtggcgtgcgcgcagtctgggcacgaagtgaccctgtctaatttgaatctcagcatgcctcccccaaagtttcacgacacaagctctccccttatggttaccccaccgagcgccgaggcccattgggccgtgcgggtggaggagaaagcgaaatttgacggaattttcgaatctctgctcccaatcaatggtctgttgtcgggagataaagtgaagcccgtgctgatgaatagtaaactgcccttggatgtgctgggaagagtgtgggacttatccgacatcgacaaagacgggcatcttgacagggatgagtttgcagtggcgatgcaccttgtgtatcgggcactcgagaaggaacccgtgccctccgcgctgccaccctcactgattccccctagcaaacggaaaaaaacagttttccctggagcggtgcctgttttgccagcgagcccaccacctaaggatagcctgcggtcaaccccctcacatggctcggtctcttcacttaatagcactgggtctctatctcctaagcacagtctgaaacagacccaacctaccgttaattgggtcgtgccggtggcggacaagatgcgtttcgacgagattttcctgaaaactgatctggacctggacggttatgtgagcggacaggaagttaaagagatcttcatgcacagcgggctgacacagaatttgctggctcatatctgggcactggcagatactcgacagaccggaaagctgtctaaggaccagttcgctcttgccatgtacttcattcagcagaaggtatctaagggtatcgacccacctcaggtattgtccccagacatggttcccccatcagaacgcggtacgccaggaccagactcttccggatccctgggttcaggagaatttacgggtgtgaaggagctcgatgacatctcacaagaaatagcgcagctgcagagggagaaatactcactggaacaggacatccgtgaaaaggaagaagccatcaggcagaaaacttccgaagtgcaggagcttcaaaacgaccttgatcgcgaaacctcaagcctgcaggaattggaagctcagaagcaggacgctcaagataggttggacgaaatggatcagcagaaagctaagcttcgtgatatgctctctgatgtcaggcaaaaatgtcaggacgagactcagatgatatcttctctgaaaacccagatccagagccaggaatccgatctaaagtcgcaagaggatgatcttaaccgagccaaaagtgaactgaataggttgcagcaggaggaaactcagcttgaacaaagcatccaagctggcagggtgcagctggaaactattattaagagtctgaagtccacacaggatgaaatcaatcaggccagatcaaaactgagccaattgcatgaaagtcgacaagaagcccatcggtccctggaacaatacgaccaggtgttagatggcgctcatggagcttcgctgaccgatctggcaaatctgagcgaaggcgtttctctggccgaacgagggtctttcggcgctatggtcaaggtcgagtag

SEQ ID NO: 50037 - DNA, 1824 bp, Artificial Sequence
  Description of Artificial Sequence: Synthetic coding sequence
atgtggatgacacccaagcggagcaagatggaggtagacgaggccctggtgtttcggccagaatggacacagcggtacctcgtcgtggagccaccggagggcgacggtgctttgtgtctcgtctgccgcaggctcatcgtagcgacgagagaacgcgacgttcgccgacattacgaagcagaacacgaatattatgaacgttatgtagccgacggggagagggctgccctggttgagcgcttacgacagggagacctgcctgtggcgagttttactcccgaggaaagagccgctcgggcagggttgggcttgtgcaggctgctggccctcaagggaaggggatggggtgaaggggactttgtttaccagtgcatggaagtcctgctgagggaggtgttgccagagcacgtcagtgtactgcagggggtcgacctttctcctgacatcacaagacagcgtatactaagcattgataggaatctgagaaatcaattgttcaaccgagctcgcgactttaaggcttatagccttgcgctcgatgaccaagccttcgtggcttatgagaattacctgctggtgtttattaggggcgtgggaccagagctggaagtgcaagaagacctcctgactatcatcaatctgacacatcacttcagcgtgggcgctctgatgtctgcgatcctggagtcccttcagacggccggactgtcactccagaggatggtggggctgacaactactcacacattgcgaatgataggagaaaattccggcctggtgtcttacatgcgcgaaaaagccgtttcccctaattgctggaacgtcatccactactccggttttctgcatctcgagttgttaagttcgtatgatgttgatgtgaatcaaattatcaacaccatctccgagtggattgtgctcatcaagacccgcggtgtgaggcggccagagttccagactctcctcactgaaagcgaatcggaacacggcgaacgcgtgaatggaagatgtctgaacaactggcttcgtcggggaaaaacgttaaagctgatcttcagtctcaggaaggagatggaagccttcctggtgtcagtaggcgcaaccactgtgcacttttcagataaacagtggctctgcgactttgggttcctggttgacataatggaacatctccgggaattgtctgaggagctgagggtgtcaaaggtgttcgcagccgcagcatttgatcacatatgtacttttgaggtcaagttaaacctgtttcagcgacatatcgaggaaaaaaatctcaccgattttccagccctcagggaggtggttgacgagttgaagcaacaaaataaggaagatgagaaaattttcgaccctgatcgatatcagatggtcatttgtcggctacaaaaagaattcgagagacacttcaaggacctgcgcttcattaagaaggacctggagctgttctctaaccccttcaatttcaagcccgagtatgcgcctattagcgtgcgcgttgaacttacaaagctgcaggctaatacaaacctttggaacgaatataggattaaggatctcgggcagttttacgccggactgagtgccgaatcatatcccattattaagggggtcgcatgtaaggtggcatccctgtttgacagcaatcagatttgtgagaaggccttttcctatctgactcgcaatcagcacaccttgtcccagccactgaccgatgagcaccttcaggccctttttagagtggccactaccgagatggaacccggatgggatgacttggtgagagagaggaacgagtcaaatccttag

SEQ ID NO: 50038 - DNA, 1089 bp, Artificial Sequence
  Description of Artificial Sequence: Synthetic coding sequence
atggctcgactaagggactgcctgcccaggcttatgttgactctcaggagcctcctattctggtctcttgtctactgttattgcggactttgtgcttcgatccacctgctcaaactgttgtggtcgctgggcaaaggacccgcacagaccttccgcagaccagcacgcgaacacccacctgcctgcctcagtgatcccagtcttgggacacattgttatgtgaggatcaaggatagcggattgcgatttcactacgttgcggcaggcgagaggggcaagccgctgatgctgctactacacggctttccagagttctggtattcttggcgctaccagcttcgggagttcaaatctgaatacagagttgtcgctcttgaccttcgaggctatggggagacagatgcaccaattcaccgacagaactacaagctcgactgcttgattactgatatcaaggacatcttagactccttgggctactcaaagtgcgtgctcatcggacatgactggggaggaatgattgcctggctgatcgcaatctgctatccagaaatggttatgaaactgatcgtcattaacttccctcatcctaatgtctttaccgagtacatcctgcgccaccctgcacaattactgaagtcttcttattattactttttccagatcccatggttccccgaatttatgtttagcatcaacgatttcaaggtgttgaaacacctgtttacctcccactccaccggtatcggacgcaaaggctgtcagctgacaaccgaggacttggaagcctacatatatgttttcagccagcccggtgctctcagcggacccatcaatcactatcgaaacattttctcctgcttgcctctcaaacatcatatggtaaccacgcccactctactgttgtggggcgagaatgatgcttttatggaggttgaaatggcagaggtgacaaaaatttacgtgaaaaactatttccgacttactatactgagtgaagccagccactggctgcaacaagatcagcccgacatagtgaacaagctgatttggaccttcctgaaggaggagaccaggaaaaaagattag

SEQ ID NO: 50039 - DNA, 1974 bp, Artificial Sequence
  Description of Artificial Sequence: Synthetic coding sequence
atgcagtggcgcgctttggtccttgggctggtcctcctgcgcttgggccttcatggggtgttatggcttgtgttcggtttggggccatcaatgggcttctaccagagatttcctctttctttcgggttccagaggctgcggagtcctgacggcccagcctccccaacaagtggccctgtcggaagaccaggaggggtgagcgggcctagttggcttcagccaccgggaaccggagcggctcagtcaccacggaaagccccacggaggccagggccaggaatgtgcgggcctgcaaattggggttacgtcctgggaggacgaggcagagggcctgacgaatacgagaagagatactcgggggcatttcccccacagctgcgggctcagatgcgcgacctggctagggggatgttcgtatttgggtacgacaattacatggcccacgcttttccacaggacgagctgaaccccattcattgtagaggaagaggtcccgatagaggcgacccatctaacctaaatatcaatgatgtgctgggcaattatagtcttacgttggtggacgctttagacacactggccataatgggaaatagttccgaattccagaaagctgtcaaactagtcataaataccgtttcttttgataaggactcgaccgtccaagtcttcgaagccaccatcagagtcctcgggtcccttctgagcgcccataggatcatcaccgattcgaagcagccattcggggatatgactattaaagattacgataacgagttgctgtatatggcccatgacctggccgttcgtttgttgccagccttcgagaataccaagaccgggattccatatccccgagtaaaccttaaaacaggtgtgcccccagacactaataacgagacctgtacagcaggagctggcagcttactggtagaattcggaatcctgtccaggctactgggtgatagcacatttgaatgggtcgccagacgggctgtcaaagcgctgtggaacctgcggtccaatgacaccggtttgttgggaaatgtggtcaacatacagacagggcactgggtcggaaagcagagcgggcttggtgcaggtctggatagtttttatgagtacctcctcaaaagttacatcttatttggcgagaaagaggacctcgagatgtttaacgctgcttaccagtctattcagaactatctgcgccgtgggagggaggcgtgcaatgagggcgagggcgacccaccactgtatgtgaatgtgaatatgttttcagggcagcttatgaatacatggatcgacagcctccaggcctttttccctgggttgcaggtcctgataggtgatgtggaggatgccatctgccttcatgctttttattacgccatatggaagcggtatggggcactccctgagcggtacaactggcagctccaagccccagacgtgctcttttacccgctacgacctgaactggttgaaagtacctatctgctatatcaggccacaaaaaatcctttctatctgcatgtcggcatggatatcctccagagtctggagaaatataccaaggttaagtgtggatatgcgacgctgcaccatgtgatcgacaagtccaccgaggacaggatggaaagtttttttctctccgagacgtgcaagtacctgtacctcctgttcgatgaggacaatccagtgcacaagtctggcactcgttacatgtttacgaccgagggccacatcgtgagtgttgacgagcacctgagggagctcccctggaaggaatttttctccgaggaaggtggccaggaccagggcggaaaaagtgtgcaccgccctaagcctcacgagctgaaggtgatcaattcaagcagtaattgcaatcgcgtgcccgacgagcggagatattccctccctttaaagtccatctatatgagacagatcgatcagatggtgggcttgatttag

SEQ ID NO: 50040 - DNA, 639 bp, Artificial Sequence
  Description of Artificial Sequence: Synthetic coding sequence
atgcactggattcatctgcaggtcctgggttctctgctgtctgcccacaggatcattacagatagcaagcagcctttcggtgacatgaccataaaagactacgacaatgagttgctctatatggcccatgacctggcagtccgactcttgcctgctttcgaaaatacgaagacaggcatcccctatcccagagttaacctgaaaactggggttccacccgataccaataacgaaacctgcaccgccggagctggatctctgctggtggaattcggcattctgtctagactgctgggggacagtacatttgagtgggtggcacggagggccgtaaaggccctgtggaatctgcggagcaacgacacaggcctgctggggaatgttgttaacatccaaaccggccactgggtgggcaaacaatctgggctgggcgctggccttgattccttttacgagtaccttcttaagtcttatatcctgtttggggaaaaggaagatctcgagatgtttaatgcagcgtaccagtccatccagaattacctgagacgaggtagagaagcctgcaatgaaggagagggagatccgccattgtgccagcgcgagcacgtgcaatgggcagctgatgagcacttggattag

SEQ ID NO: 50041 - DNA, 1131 bp, Artificial Sequence
  Description of Artificial Sequence: Synthetic coding sequence
atgggcaactctagtgaattccaaaaagcagtgaagctggtcatcaatacggtgtctttcgataaagacagcacagtgcaggtgttcgaagctactattcgcgtactgggcagtttactgtctgcacataggatcataactgattcaaagcagccatttggtgatatgaccataaaggactacgataacgaactgttgtacatggctcatgacctagcagttaggttactgcccgcttttgagaataccaaaacggggattccatacccacgggtgaacctaaaaacaggggttccacctgataccaacaatgagacctgcacggccggtgcgggaagcctgctggtggagtttgggatcctgagccgcctgctgggagactccacttttgaatgggtcgcccgacgggctgtgaaggccttgtggaacttgaggtcgaatgatactggtttgctgggaaacgtcgtaaatatacagaccggacactgggtaggcaaacagtcaggactgggagctggattagactcattctatgaatatctgctgaagagctacatcctcttcggggagaaggaggacttggagatgttcaatgcagcctatcaatcaattcagaattacctgcggcgaggaagagaggcatgtaacgagggagagggcgacccccctctttatgtcaatgtgaatatgttctccggccagctgatgaatacgtggatcgactctcttcaggcttttttccctggcttacaggtgcttataggcgatgtggaggatgctatctgcttgcatgccttctactatgctatctggaagcgctacggggctctccctgaaaggtataactggcagctgcaggctcccgatgtgctgttttatccactccggcctgagctagttgagagcacatatctactttaccaagcaaccaagaaccctttctacttacacgtaggtatggatatactccagtccctcgaaaagtatactaaggttaagtgcggctatgccaccttacaccacgttatagataagagtacggaagatcgaatggagtcattcttcctatcagagacctgtaaatacttgtacttggtgtgcgtgctgcaagatgaaccgcgtaatatttag

SEQ ID NO: 50042 - DNA, 2799 bp, Artificial Sequence
  Description of Artificial Sequence: Synthetic coding sequence
atgtccgaagctgggggtcgcggttgtggaagcccagtacctcagagagcacgctggagactggtggcggcaacagccgctttttgtctagtgtcagccacaagcgtgtggactgctggagccgagcccatgtccagggaggagaagcaaaagctgggaaatcaggtgctggaaatgtttgatcatgcctacggaaactacatggagcatgcctacccagccgatgaattgatgccgcttacttgccgaggcagagtgcggggacaggaaccatcccgcggtgatgtggacgacgctctggggaagttttccctgactctgatcgacagcctcgatactttagtcgtgctcaacaagaccaaggaatttgaggacgcagtcagaaaggtgctcagagacgttaatttagacaacgatgtcgttgttagcgtttttgagactaatatccgggtgctgggaggcttgttagggggacacagtctggctatcatgttgaaagaaaaaggcgagtacatgcagtggtataacgacgagctgttgcaaatggcaaaacagctgggctataaattacttcccgcattcaacacaacctctgggttaccataccctcggattaatttgaaattcggaatccgcaaacccgaagcaaggacaggtaccgagactgacacttgtactgcatgtgctggtacccttatactggagttcgcggctctttctcgctttaccggcgctacaatcttcgaagagtatgccagaaaagccctcgactttctctgggaaaagcgacagcgttccagtaacttagtgggcgtcacaatcaacattcataccggtgactgggtccggaaggactcaggtgtcggcgctggtatcgacagctattacgaatatctcctgaaagcttatgtgctcctgggcgacgacagcttcctcgaacgctttaatactcattacgatgccatcatgagatatatcagtcagccacccctgttgctggacgttcatatacacaagccaatgctcaatgcaaggacctggatggatgctcttctggctttctttcctggtctgcaggtactgaaaggggatataagaccagcgattgagacccatgagatgttataccaggttataaaaaaacacaactttctgcctgaagccttcacaacagactttcgcgtgcattgggctcagcaccctctgagacccgaattcgccgagtcaacctatttcctctacaaagccaccggagatccttattatttagaggtcggcaagacattgatcgagaacctaaataagtacgcaagagtgccttgtggcttcgcagccatgaaagacgtgaggacaggttctcacgaagaccggatggactccttcttcttggccgagatgtttaaatacttgtatttgctgttcgcagataaggaagatatcatttttgatatcgaagattatatttttacaaccgaagcacatctgctgcctctgtggttgtccactaccaatcagtccataagtaaaaaaaacaccacgagcgagtataccgaattggacgactccaacttcgactggacttgccctaacacacaaatcctgtttccgaatgatccgctttacgcgcaaagcatcagagaaccgctgaagaacgttgtcgacaaatcatgtccgcgagggatcatccgtgtggaagaatccttccgcagcggagccaaacccccattgcgcgcacgggattttatggcaacaaatcccgagcacctcgaaatactgaagaaaatgggcgtgagcctgattcatttgaaggatggtcgtgtccaactggtgcagcacgcaatccaggcagcttcctctatagacgccgaggatgggctacggttcatgcaagaaatgatcgaactgagcagtcagcagcagaaggagcaacagctgccaccgagagcagtgcagatcgtgtctcacccttttttcggccgtgttgtgctgaccgctggccctgcccagtttggactcgacctgagcaagcataaggagactcgtgggttcgttgctagcagcaaaccaagtaatggctgctccgaactcacaaaccccgaggcagtgatgggcaagatcgctctcatccaacgcggacagtgtatgtttgccgagaaagcccgaaatatacagaatgcaggcgcaatcggtggaatcgtgatcgacgacaatgaaggctccagttctgacactgcacctttattccaaatggccggagacggcaaggatacggacgatatcaaaatcccaatgctcttcctcttttccaaagaaggaagtattatcttagacgcaatccgcgagtatgaggaagtagaggtgctgcttagtgataaggccaaagatagggaccctgagatggagaacgaagagcaacccagctcagagaacgactcccaaaaccagtcaggagaacagatatctagttcttctcaggaagtcgatttagtcgaccaggaatcatctgaggagaatagcttgaactcacatcccgagagcttgtctttggccgatatggataatgcagccagtattagccccagtgaacagacttcgaaccctactgagaaccacgagactaccaatcttaacggtgaatgtacagatctggataaccagcttcaggagcagagtgaaactgaggaggacagtaatccaaatgtgagctggggaaagaaagttcagcccatcgacagcatactggccgattggaacgaggacatagaggcctttgagatgatggaaaaggacgagctgtag

SEQ ID NO: 50043 - DNA, 2718 bp, Artificial Sequence
  Description of Artificial Sequence: Synthetic coding sequence
atgtcccgggaagagaagcaaaaactcggcaaccaggtgctcgaaatgtttgaccatgcctacggcaattacatggaacacgcgtatccggctgacgagctgatgcccctcacgtgtagggggcgagtgaggggccaagagccctcacggggtgatgtggacgacgctcttgggaagttcagccttactctaattgactctctggacaccctggttgtgctcaacaaaacaaaggagtttgaagatgctgtgcgcaaagtgctgcgggatgtgaacctcgataatgatgtggtggtctcagtgttcgagacaaatatacgggtcctcggagggcttctgggcggacacagccttgccatcatgctaaaagagaaaggagaatacatgcagtggtataacgacgagctcctgcagatggctaagcagctgggatacaaactcttacctgccttcaataccacaagtggtctcccatatcctaggataaatttgaaattcgggatacggaagcctgaggccagaactgggacagagaccgacacatgcacagcctgcgcgggtacactcatcttggagttcgcagcattgagcaggttcaccggtgctacaatattcgaggagtacgcacgaaaggcactagacttcctctgggaaaagcgccagcgtagcagcaacctggtcggggtcaccattaacatccatactggcgactgggtcaggaaagattccggggtgggggctggcatcgatagctattacgaatacctgctgaaggcctatgtgctactaggagacgatagcttccttgagaggtttaacacacattatgatgccatcatgagatatatctcacagcctccccttctgcttgacgttcatattcacaaaccaatgctgaatgctcggacttggatggacgccctgctggctttctttcccggactccaggtgcttaagggagacattcggccagctattgaaacccacgagatgttataccaggtgataaagaaacataacttcttgcccgaggcttttacaaccgactttcgtgtccactgggctcaacacccccttcggccagagttcgccgagtctacctactttttgtacaaagccacaggcgatccttactatttggaggtcggtaagactctcatagaaaatctgaacaagtacgccagggtcccatgtggtttcgctgctatgaaagatgtgagaacaggcagccacgaggatcgcatggattctttcttcttggctgagatgtttaaatatctctacctccttttcgcggacaaggaggacatcatttttgatattgaggattacatatttactacagaggcacatctcttgcccctatggctttccaccaccaatcagtccataagcaaaaagaatacaacttcagagtacacagaactggatgactccaactttgattggacttgcccaaatacccaaattcttttcccaaacgacccattgtacgcccagtcaattcgagaacctctcaagaacgttgtggacaaaagttgtcctaggggtatcatcagggtagaagaatcctttcggagcggcgctaaaccccctctccgcgctcgcgattttatggctacaaatccagagcacttggagatcctaaagaaaatgggcgtatctttgatccacctcaaagacgggcgtgttcaacttgtgcagcatgctattcaggccgcttcctccatcgacgcagaagacggcctgcgctttatgcaggagatgatcgagctctcatcccagcaacagaaggaacaacagctgcctcccagggcagtgcagatagtgagccacccctttttcgggagagtcgtactgaccgccggtcctgctcagttcgggttggatttaagcaagcacaaggagaccagggggtttgtcgcttcttctaaaccctccaatgggtgtagtgagctgactaacccagaggctgtaatgggaaaaatcgcattgatccagagagggcagtgtatgttcgctgagaaggcgaggaatattcagaacgccggtgcaattggaggaattgtgatcgatgataatgaaggaagcagttcagacacggcccctctttttcaaatggcaggagacgggaaagatactgatgatatcaagattcctatgcttttcctgttcagtaaggagggttccattatcctggatgccatccgagaatacgaggaggtggaagtcttgctttctgataaggcaaaagacagagccgctattttaaagggaaaaatgataccaagctacattataaatagcaatccggaaatggagaatgaagagcagccatctagtgagaacgattcccagaaccagtccggagaacaaatttcgtcatcctcacaggaggttgacctggtggaccaagagtcttccgaggaaaattctcttaatagtcaccccgaatcgctatccctggccgacatggacaacgccgctagcatttcacccagtgagcagaccagtaatcctactgaaaaccatgaaacaactaacctcaacggagagtgcacagatctggacaaccagttgcaggagcagagtgagacagaagaagacagtaatccaaacgtatcttggggcaagaaggttcagcctattgactctattcttgccgattggaatgaggatatcgaggctttcgaaatgatggaaaaggacgagctgtag

SEQ ID NO: 50044 - DNA, 1314 bp, Artificial Sequence
  Description of Artificial Sequence: Synthetic coding sequence
atggcggcaccctcttggcggggagcgaggcttgttcaaagcgttttgcgggtgtggcaagtagggccacacgtcgccagggagcgggtcatcccattctccagcttgctcgggtttcaaagacggtgcgtgagttgtgtcgccggatctgccttctcgggcccaaggctggcctcagcatcccggagtaacggccaagggtcagcccttgaccacttcttgggattcagccaacctgatagtagcgtgactccttgcgtcccagctgtgtctatgaacagggacgaacaggacgtcctactcgtgcatcacccagatatgccagagaatagcagggtgctgcgggtcgtcctgttgggagccccaaacgcaggaaagtcaacactgtcaaaccagctcctcggcaggaaggtcttcccagtttctagaaaggtgcacacgaccagatgtcaggccttgggagtaattacggaaaaggaaactcaggtaattctgctggacactcctggcatcatttcccccggaaagcagaaacggcatcacctggagctgtccctgctagaagacccatggaagagtatggaatctgccgacctcgttgtggtcctggtggacgtcagcgataagtggacgcgcaatcaactctcgccacaactgctgaggtgtctgacaaagtactcccagatcccctcagttctcgtgatgaataaagtggactgtctgaagcaaaagtctgttcttctggaattgactgcggctctgacagagggcgtggtgaacgggaaaaaactcaaaatgcggcaggcattccattcacaccccggtactcactgccccagtcccgctgtcaaagacccaaatacccaaagtgttgggaatcctcagcgtatcggttggccccatttcaaagagatcttcatgctgagtgctcttagtcaggaagatgtgaaaactctgaaacagtacctccttacacaggcacagcccggaccttgggaatatcacagtgccgttctcacaagccaaacgcctgaagagatctgcgcaaacataataagggagaagttactggagcacctgccccaggaggttccctacaatgtccagcagaaaaccgccgtttgggaggagggaccaggaggtgaacttgtcatacagcagaaacttttagtgcctaaagagtcatacgtgaagctgctcatcggtcccaaagggcacgtgatcagccagattgcccaagaggccggacatgacctgatggatatttttctgtgtgacgtggatattcggctctctgtgaagctgctgaaatag

SEQ ID NO: 50045 - DNA, 732 bp, Artificial Sequence
  Description of Artificial Sequence: Synthetic coding sequence
atgtctaggatgagttcctggagcattaccctgatttgcctgcgaattcctggttcctacgagtggtccagctgggaacctagaatgcaggggagtcagcacagccccacatcctactgggcagagagatgctcactgtttccaggcagatgtatacttctggctgcaaagctgtggggctcttcacagcgccgtcgcccaagatggtgggtgcccaccaagggcgtcttagaaactgggcagagggttaaactgcgcggttctcctctgccttctgcactgaagaagatgatggtcacattcatatatatcctattggacacaccaggcatcatttcccccggaaaacagaagcgccatcacctggaactaagcctacttgaggacccttggaagagcatggagagcgcagatctcgtcgtggtactcgtagacgtcagtgacaaatggacacgcaatcaattgagcccccagctccttcgctgcctgacaaaatacagtcaaatcccaagcgtgcttgttatgaataaggtggattgtctcaagcaaaagagtgttctgctcgagctgaccgcagctctaacagagggtgtggtcaatgggaaaaagctgaagatgcggcaggccttccatagccacccaggtacccattgcccaagtccagctgtcaaagaccccaacacccaaagcgtgggcaatccccagcggattgggtggccccacttcaaatag

SEQ ID NO: 50046 - DNA, 1167 bp, Artificial Sequence
  Description of Artificial Sequence: Synthetic coding sequence
atggaggctctcggtaaactcaaacagttcgacgcttacccaaagacactggaggacttcagggttaagacctgcgggggagccacggtgactattgtttcaggcctgctgatgctgcttctgtttctgtcggagcttcagtactatcttaccaccgaggtccaccccgaactatatgtcgataaatcccgaggcgataagctcaagataaacattgatgttctcttccctcatatgccatgcgcctacctgtctattgacgcaatggacgtggctggtgagcagcagctcgacgtcgaacacaacctctttaagcagcgtctcgacaaggacggcatacccgtttcttctgaggccgagcgacatgaactggggaaggtcgaagttacagtgttcgatcctgactctttggacccggaccggtgcgaatcttgctatggcgcagaagccgaagatatcaagtgttgcaatacctgtgaagacgtacgcgaggcttatcgtagacgtgggtgggcattcaagaacccagacactatcgaacagtgtcgcagagaaggattcagccagaaaatgcaggaacaaaagaacgagggctgccaagtgtacggattccttgaggtgaataaagtagccggaaactttcacttcgcacctggaaaatcattccaacagtcccacgttcatgtgcagggcgaggaggtccatgaccttcaatccttcggattggacaacatcaatatgacccactacatccagcacctatcatttggtgaggattatccaggaatcgtgaaccccctggaccacacaaacgtaacagccccacaggcctctatgatgtttcagtacttcgtcaaggtggtgcccactgtgtatatgaaggtggatggcgaagtgctgaggactaaccagttctccgtgacacgacacgagaaggtggccaacggtctgctaggtgaccagggtctcccgggtgtctttgtcctttacgagttgagccccatgatggtgaaactgacagaaaagcaccggtcatttactcactttctcactggagtctgtgccattattggaggaatgttcaccgtggccggattaatagatagcctaatctatcactccgccagagcgatacagaagaaaatcgatttgggcaaaacaacttag

SEQ ID NO: 50047 - DNA, 1152 bp, Artificial Sequence
  Description of Artificial Sequence: Synthetic coding sequence
atggaggctctggggaaactgaagcaattcgatgcataccccaaaacgttggaggatttccgcgtaaagacatgcggaggcgctaccgttaccatcgtcagcggtttgcttatgttactgttatttctcagtgagctgcaatactatctcacaactgaagtacatcctgagctctacgtcgacaaaagcagaggagataaacttaagataaatatcgacgttcttttcccgcacatgccttgcgcctatctcagcattgatgcaatggacgtggccggtgagcaacagttggacgtcgagcacaacttatttaagcagcgactggataaggacggaatacctgtgtcctcggaagctgagcgtcatgagcttggtaaagtggaggtgactgtctttgaccccgatagcctcgatcctgatagatgcgaatcatgctacggcgcagaggccgaggatataaagtgctgcaatacgtgtgaggatgttcgcgaagcctaccgacgcaggggttgggccttcaagaacccggacactatcgagcagtgccgcagagagggattttctcagaagatgcaggagcaaaagaatgaagggtgccaggtctacggatttctcgaggtgaataaagtggctggtaacttccatttcgctcccggaaaatcatttcagcaatctcacgtccatgtgcacgacctgcaaagctttggccttgacaacattaacatgacccactacatccagcacctgagttttggcgaggactatcccggtatagtgaatcctctagatcatacaaatgttaccgcgcctcaagcctctatgatgttccaatactttgtgaaggtagtacccactgtgtacatgaaggttgatggtgaagtactgcggactaatcaattctctgtaacccgccatgagaaggtcgctaacgggctgttgggggatcaaggcctgccgggagtgtttgtcctgtacgaactatccccaatgatggtcaagctcacagagaaacaccgttcctttactcacttcctgaccggagtttgcgccatcattggcggtatgtttaccgtggccggtttgattgatagcttgatctaccattcagcacgcgcaatccagaagaagatcgaccttggaaaaaccacatag

SEQ ID NO: 50048 - DNA, 597 bp, Artificial Sequence
  Description of Artificial Sequence: Synthetic coding sequence
ctgtccgttgcattttcatgctgctacggcgcagaggccgaggacattaagtgctgtaatacttgtgaagacgtacgggaggcataccggcgtcgtggatgggctttcaagaatcccgacaccattgagcagtgcaggcgcgaaggcttttcacagaaaatgcaagagcagaagaacgagggatgccaggtttatgggtttttggaggtcaataaagtggctggaaactttcactttgctccgggtaaatcttttcagcagtcgcatgttcacgtgcatgatctgcagagctttggacttgacaacattaatatgacccactacatccagcatctgagctttggagaggattaccccggaattgtgaatccacttgatcacaccaacgtgactgcaccccaggccagcatgatgttccagtattttgtgaaagtcgtccccaccgtctacatgaaagttgatggcgaggtccttagaacgaaccagttctcagtgacccggcacgagaaggtggcaaatggactgctgggagaccaggggctgcctggcgtctttgcacatcttcccctatcaacctcccaccctgaggaaaattag

SEQ ID NO: 50049 - DNA, 1167 bp, Artificial Sequence
  Description of Artificial Sequence: Synthetic coding sequence
atggaggcactcgggaagttgaaacagtttgatgcctacccgaagacgttagaggacttcagggtgaaaacctgcggaggagcaactgttactatagtttctggtttactcatgttgttactcttcctgagcgagctacagtattatttgaccaccgaagtgcatcctgagctgtacgtcgataaaagtcggggagataaacttaagataaacattgacgtgctttttccccacatgccatgtgcttacctctctatcgacgctatggatgttgcaggcgaacaacagttagacgtcgaacataacttattcaaacagcgactcgataaagacggaatccctgtgagcagcgaggcagagcgccacgaactggggaaagttgaggttacagtctttgaccctgatagtctggaccccgatagatgtgagtcgtgctatggggcagaggctgaagacattaaatgttgtaacacctgcgaggacgtcagagaggcgtacaggaggaggggctgggcttttaagaaccctgatacaattgagcaatgccgcagagaaggatttagccagaaaatgcaggaacaaaaaaatgagggatgtcaagtgtacgggttcctcgaagtaaacaaagtggccggtaacttccattttgcgcctggaaaatcctttcagcagtctcacgtccatgtgcacgccgtggaaattcacgatttgcagtcatttggactggataatatcaatatgacacactatattcaacacttgtcgttcggagaagattacccaggtatcgttaatcctctggatcacactaatgtgacagctccacaagcttcaatgatgttccagtactttgtgaaggtagtccccacggtatatatgaaagtcgacggcgaagtccttcgcacaaaccagttcagcgtgacccgacacgagaaggtggcaaatggactgctgggcgaccagggattgcccggtgtttttgttctatatgaactgtctcccatgatggttaagctgactgaaaaacatagaagttttactcactttctgactggagtgtgtgctattataggtggcatgttcactgtcgctggactgattgatagcctcatataccactccgccagggctatccaaaagaaaatagatctgggcaagaccacatag

SEQ ID NO: 50050 - DNA, 1197 bp, Artificial Sequence
  Description of Artificial Sequence: Synthetic coding sequence
atggaagccctcggtaagctgaaacaatttgatgcatatccaaaaacccttgaagattttcgcgttaaaacttgtgggggtgcaaccgtgacgattgtgtctggcttactcatgcttctcttgttccttagtgagctgcaatattatctaactacggaagtgcaccccgaactgtatgtagacaagagccgcggagacaaacttaagatcaatatagatgtgcttttcccacacatgccatgcgcttacttatcaatagacgcgatggatgtggccggtgagcagcaacttgacgtcgagcacaatttgtttaaacagcgacttgacaaagacgggatccccgtgtcaagcgaagctgaaaggcatgagttagggaaagtggaggtcacagtgttcgacccagatagcctcgaccccgaccgatgcgagtcatgttatggcgctgaggctgaagatattaaatgttgcaacacctgcgaggacgttcgggaagcataccgaagaaggggatgggctttcaaaaaccccgataccatcgagcagtgtcgccgagaaggtttctcacaaaagatgcaggagcagaagaatgagggttgtcaggtgtacgggtttctagaggtgaataaagtggctggaaacttccatttcgcacccggtaaaagcttccagcagtcccacgtccatggatgcgtttgtcggctgaaaatgattgcccgttccctcgcttgcgtgcacgatctgcagagttttggcctggacaacattaatatgacacactacatccagcatctctcttttggggaggattacccagggatagttaaccccctggaccacaccaacgttactgcaccacaagcttccatgatgttccagtattttgtgaaagttgtgcccactgtgtatatgaaggtcgatggtgaagtgctgagaacaaatcagttcagcgtcacccgacatgagaaagtggctaacggactcttgggggatcaggggctgcctggcgtgtttgtgctctacgagctctctccaatgatggtaaaacttacagagaaacacagatcattcacacattttctgaccggagtctgcgcgataataggcggtatgttcaccgtggccggactcatagatagcttgatttatcattccgccagggccatccagaagaaaattgacctgggtaaaaccacttag

SEQ ID NO: 50051 - DNA, 1407 bp, Artificial Sequence
  Description of Artificial Sequence: Synthetic coding sequence
atggggcgaggctggggcttcttgtttggactgctaggcgcagtctggctgctatcttctggccatggagaggagcagcccccagagaccgctgcacaaagatgcttctgccaagtcagtggatatctggacgattgtacgtgcgacgtggagaccatcgataggtttaacaactatcgactcttccctcgcctacagaagctgctggaaagtgactactttaggtactacaaggttaaccttaagcgaccctgtcctttctggaatgatatctcccaatgcggtagaagagactgtgctgtgaagccatgccagtcggacgaagttcctgacgggatcaagagcgcttcttataagtattccgaggaggctaataatctgatagaggagtgtgagcaggctgagagactgggcgctgtggacgaatcactgtccgaggagacccagaaggcagtgctgcagtggacgaaacatgacgacagcagcgacaacttttgcgaagccgacgatatccagtctcccgaagccgagtacgttgatctcctattgaacccagagcgttataccggatataaaggaccagacgcctggaagatttggaatgtaatttacgaggaaaactgcttcaagcctcagacaattaagagacctctcaatcctctggcctctgggcagggtacttccgaggaaaataccttttattcctggttggagggcctgtgtgtggaaaaaagggctttctatcgcctgataagcggccttcacgcctccattaatgtgcatctgtccgccagatacctgctgcaggaaacttggctagagaaaaagtggggacataacatcacagaatttcaacaaagattcgatggaatcttgaccgagggcgaaggacctaggcgactgaagaacctctatttcttataccttatcgagttgagagcacttagcaaggtgctgccattctttgagcgccctgacttccagctctttacaggcaacaagatacaagatgaggagaataagatgttgttgctcgaaatcctgcatgagatcaaaagcttcccactgcactttgatgaaaacagtttctttgcgggtgataagaaagaggcccataagctgaaggaggattttagactacacttcagaaatataagtcggatcatggattgtgtggggtgctttaagtgtaggctctggggaaaactccagactcagggactgggtacagccctaaaaatcttgtttagcgagaagctgatagccaacatgccggaatcaggcccatcatacgagttccacttgaccagacaggaaatcgtctcactgtttaatgcgtttggcagaatttctacctccgtcaaggagctagagaatttcaggaacctgctacagaatatccactag

SEQ ID NO: 50052 - DNA, 522 bp, Artificial Sequence
  Description of Artificial Sequence: Synthetic coding sequence
tggggccctaacatcaaagaattcaagcaccgctttgatccggtggagaccaaaggggaggggccacgcagactcaagaatctttattttctctacctgatcgagctgagggctttatccaaggtggccccttattttgagcggagcattgttgacctctatactggaaacgccgaggaggatgctgacacaaaaacacttctgctcaacatttttcaagacacgaaatcctttccgatgcactttgacgaaaagagcatgtttgcaggggacaaaaaaggcgctaagagcctgaaagaggaattcaggctgcatttcaaaaacatctcaagaatcatggattgtgtgggttgcgacaaatgtaggctgtggggcaaactgcagacacagggtctggggactgcccttaagatcctgttttccgagaaggagatccagaaacttcccgaaaactccccatccaaaggctttcagctgacccgacaggaaatcgtcgccctactcaatgctttcggacggtag

SEQ ID NO: 50053 - DNA, 435 bp, Artificial Sequence
  Description of Artificial Sequence: Synthetic coding sequence
atgtcacagggcgtccgcagagctggtgcgggacaaggagtagcggcagccgtgcaattgctggtcacccttagcttcctgcgctctgtcgtagaagcacaggtgactggtgtcttggacgactgcctgtgcgacattgatagcattgataacttcaatacctacaagatttttcccaagattaagaagctgcaagagcgggactactttcgatactacaaggtgaacctgaaacgcccttgtccattttgggctgaagacggacattgctcaattaaggactgtcatgtggaaccctgtcctgagtctaagattccagtggggatcaaagccggacatagcaacaaatacctgaagatggcaaataatactaaagagctggaggactgtgaacaggcaaataagttgggcgcaatcaattccactctccgctag

SEQ ID NO: 50054 - DNA, 1404 bp, Artificial Sequence
  Description of Artificial Sequence: Synthetic coding sequence
atgagtcagggtgtgcgtagggctggcgctggacaaggggttgccgcagcagtgcaactgctggtgactctgtctttcctgcgctctgtggtagaggcccaggtgacaggcgtgcttgacgattgcctgtgtgatatagattccattgataacttcaatacctataaaatctttcccaaaataaaaaagctgcaggaacgggattattttaggtattataaggtcaacctgaaaagaccctgccctttctgggcagaggatggacattgctctattaaggattgccacgtggagccatgccccgagtctaaaatccccgtgggtatcaaagccggacactccaataagtacctgaaaatggcgaacaataccaaagaattagaagactgtgaacaggcaaataagctgggggctatcaactctaccctctctaatcagtccaaagaggccttcatagattgggccagatacgacgatagcagagatcacttttgtgagctggatgacgagaggagtccagctgcgcagtatgtggacttgcttcttaatccagagcgctatacaggttataagggcaccagcgcttggcgggtatggaactcaatatatgaggagaactgcttcaagcccagaagcgtataccgacctctgaaccccctcgccccatcacgtggtgaggatgacggcgaatctttttacacgtggctggaagggctgtgtctggaaaagagggtgttctacaagctgatctcagggctgcacgccagcataaaccttcacctctgcgccaattacctgctggaagaaacctggggcaaaccttcctgggggccaaatataaaagagttcaagcatagatttgatccagtggagactaaaggcgaaggcccaagacgcctgaagaacctctatttcctatacctgattgaactgcgcgcactgtccaaggtcgctccatacttcgaaagatcgatcgtggatctatacactggaaacgcagaggaagatgccgacactaaaactctgcttctgaacatctttcaggacacgaagagcttccccatgcacttcgacgagaagtcaatgtttgcgggagacaagaaaggtgctaagtcacttaaagaggaatttcggctgcatttcaaaaatattagtaggataatggattgcgttggatgcgataagtgccggctgtggggaaaactccagacacaaggactgggtactgccctaaaaattctgttttcggagaaggaaattcagaagctgccagaaaacagtccatcaaagggtttccagttaacccggcaggaaatcgttgccctgctgaatgcttttggacgattgagtaccagcatccgggatcttcagaatttcaaagtgctcctgcagcattctagatag

SEQ ID NO: 50055 - DNA, 216 bp, Artificial Sequence
  Description of Artificial Sequence: Synthetic coding sequence
atggctaataatactaaagaattggaagattgcgagcaggctaataagttgggggctatcaactctaccctgtctaaccaatccaaagaggcttttatcgactgggcgcgatacgatgactcacgcgaccacttctgcgagctagatgacgaacgatcacccgcagctcaatacgttgatctactgctcaatcctgagcggtatacaggctattag

SEQ ID NO: 50056 - DNA, 702 bp, Artificial Sequence
  Description of Artificial Sequence: Synthetic coding sequence
atggagctgccaaccaagccaggaacctttgaccttggactggccacctggagcccatccttccagggcgaaacgcatagggcacaggcacgcaggcgcgacgtggggagacaacttcctgagtacaaggccgtcgtggtcggcgcatcaggagtggggaaatcggctctgactattcaactcaaccaccagtgctttgtggaggaccacgatcctaccatccaggattcttactggaaggaattaaccctggattccggcgattgtatcctcaatgttctagacacggctggtcaagcaatccacagggccctccgagaccaatgtcttgcagtgtgcgacggcgtcttgggggtgtttgccttagacgatccgagctctttaatacaactccagcagatttgggccacgtggggccctcaccctgcccaacccctcgtattagtaggaaacaagtgtgaccttgttaccactgccggagatgctcacgccgcagctgcggctctcgctcattcctggggggctcactttgttgagacctccgctaagacccggcagggggtggaagaagctttctccctgcttgtacacgagatccagcgtgttcaagaagccatggccaaagagcccatggcccgatcttgccgagagaaaaccaggcatcaaaaagctacgtgccattgcggatgctcagtggcttag

SEQ ID NO: 50057 - DNA, 2178 bp, Artificial Sequence
  Description of Artificial Sequence: Synthetic coding sequence
atggcaatggccatgagtgactcgggggcttctagactccggcgacaactggagagtgggggtttcgaggcgaggctgtacgttaagcagctttcccagcagagcgatggcgatagagacctgcaggagcaccgccaaaggattcaggcactggccgaagagactgcccagaatttaaaaagaaacgtctaccagaactacagacagtttattgaaacagctcgcgaaatctcttatctcgaaagcgagatgtaccagctgagccatcttctcactgagcagaagtcaagcttggaatccatccctctaacccttctgcctgcggcagcggctgctggggctgccgcagcctctggcggtgaggagggcgtgggaggagctggcggtagagatcatttacgtggccaggcaggcttctttagtacccctggtggagcttcacgggatggctcaggtccaggcgaggaaggaaaacagcgcactctaacaacactcttagagaaggtggagggctgccggcacctgctcgaaacgcccggacagtatcttgtgtataacggagacctcgtggaatatgatgcagaccacatggctcaactccagcgggttcatggttttcttatgaatgactgtctactagttgccacttggctgccccagcgaagaggaatgtataggtataatgcactttactctttagacggcctggctgtggtcaatgtgaaagacaatcctccgatgaaggacatgtttaagttactgatgtttcccgagtcccgcatttttcaagcagaaaacgccaaaatcaagcgggaatggctcgaagtcctcgaagatactaaaagggccttgagtgagaaacgtaggagagaacaggaagaggcggctgcaccaagagggcctccccaggtcaccagcaaagcgacaaacccttttgaggatgacgaggaggaagaacccgctgtgcccgaggttgaggaggaaaaggtggacctgtcaatggaatggatccaggagctgcctgaagacctcgacgtgtgtattgcgcagagggattttgagggcgctgtagatctgctggacaagttgaaccattacctggaagacaaaccctctccccctcccgtgaaggagctgagagctaaggtggaggagagggtgcgccagcttaccgaggtgttggtatttgagctaagccccgaccgatctctgaggggaggaccgaaagcaactcggagggcagtatcacagcttatacgcttgggacagtgcaccaaggcatgtgaactgttccttcgtaaccgtgcggcagcggtgcacacagcaattagacaactccgtatcgagggtgctacgctcctatacattcacaagctttgtcatgtgttctttacctctcttctggagactgccagggaatttgagattgacttcgcgggaacagattcaggatgctattctgcctttgtggtttgggcccgatccgcaatgggcatgttcgtggacgccttctcaaaacaggtctttgactccaaggaatctctctccaccgccgctgaatgtgtcaaagtggccaaagaacactgccagcagttgggagatattgggctggatctgacattcatcatccacgccctcttagtgaaagatatccagggagcacttcattcctacaaagaaattataatcgaagcaactaaacataggaattctgaggagatgtggaggagaatgaacctcatgacgcccgaggccttgggcaaactgaaggaagagatgaaatcatgtggggtgagtaactttgaacagtatacgggcgacgattgttgggtcaacctgtcatataccgtcgtggcctttaccaagcagaccatggggtttctcgaagaagcactgaagctttatttccctgaactgcacatggttctcctagagtcattagtagagataatcctggtagccgtccagcatgtggattactccctaagatgcgagcaggacccagagaagaaggcctttatacggcagaatgcttcttttctgtatgagactgtgctgccagtggtcgaaaagcggttcgaggagggagtcggcaagccagccaaacaactgcaggatctccgaaacgcctcgcggctgattcgggttaatcctgagagcactaccagtgtcgtctag

SEQ ID NO: 50058 - DNA, 2166 bp, Artificial Sequence
  Description of Artificial Sequence: Synthetic coding sequence
atgtccgatagcggcgcaagtaggctgcgccgtcagctggagtccgggggattcgaggctcgcctttatgtgaaacagttgtcccagcagtccgacggggacagggacctgcaggagcatagacagagaatccaggcactggccgaggagactgcccagaaccttaaacggaacgtttaccaaaattatcgccaatttattgagactgctcgggaaatatcgtatctcgaatctgaaatgtaccagctgtctcacctgctcaccgagcaaaagtcttctctcgaatcgatcccattaacactgcttcctgccgcagcggctgctggcgctgcggctgccagcggaggcgaggagggcgtgggtggggcaggcggaagggaccatctcagagggcaagctggatttttttcaacccccggaggcgcatcccgcgatggctccggcccaggcgaggagggcaagcagcgcaccctgaccactctactggaaaaggtcgagggttgtcgccacctgctggagacccccggtcagtatcttgtgtataatggcgacttggtggagtacgacgctgatcacatggcccagctgcagcgagtgcacggtttcctgatgaacgactgtctacttgtggcaacctggcttccacagagacgaggtatgtatcggtacaatgccctgtattccctagacggcttagcagtggtaaatgtcaaagataatccacccatgaaggatatgtttaaactgctcatgtttccagaatcgagaatcttccaggccgagaacgccaaaattaagagagagtggttggaggtgctcgaagacactaagagggccctcagcgagaaaaggagacgggaacaggaggaagctgcggctcccaggggccctcctcaggttacgtcaaaagccacaaacccattcgaggacgatgaggaggaagagccggctgttccagaggtggaagaagaaaaggtcgacctgtccatggagtggatccaggaactgccagaggacctggacgtctgtattgctcaacgcgacttcgagggggctgttgacttactggataagctcaaccactatttagaggataaaccttcacccccacccgtaaaggagttgagagccaaggtggaagaacgggtccgccagctcaccgaggtactggtctttgagctgagtcccgataggtctctgcggggagggcctaaggccacacgtcgggctgtgagccagctgattcgactgggccagtgcaccaaggcttgcgagttgttcctgaggaaccgcgcagctgccgtacacaccgccatcaggcagctcaggatcgaaggggctacgctgctctatatccacaagctctgccacgttttcttcacctcactcctggagacggcacgagagttcgaaatagactttgctggcacggactccggttgctacagcgcattcgttgtgtgggcacgctccgcgatgggcatgttcgtggatgcattcagcaagcaagtatttgacagtaaggagtctctgtcaaccgcggctgaatgtgtcaaggtggccaaagagcactgccagcaactcggtgacataggcttagatctcacatttattattcacgcattactagtgaaagatatccagggagcgctgcactcatacaaggagattatcattgaggccaccaaacatcgaaactccgaggagatgtggcgcagaatgaatctcatgactccggaggccttgggcaagttgaaagaggaaatgaagagttgtggagtcagcaatttcgagcagtacacaggggatgattgttgggtgaatcttagctacaccgttgttgcctttactaagcaaacaatggggttcctggaggaggcactgaagctatactttcccgagctccacatggtactactcgaatcactggtggaaataattcttgttgctgtccagcacgtggactatagcctgcgatgtgagcaagacccagagaaaaaggcctttattcgtcaaaatgcgagctttctgtatgaaactgtcttgcctgtggtcgagaagagatttgaagaaggggtcggaaagcccgctaagcaactgcaggaccttcgtaacgcatcaagacttattcgggtgaaccccgaatctaccacaagcgtggtgtag

SEQ ID NO: 50059 - DNA, 3345 bp, Artificial Sequence
  Description of Artificial Sequence: Synthetic coding sequence
atggaacgtagccctggagagggacccagcccctctcctatggatcaacccagtgcaccctctgaccccacagatcagccacctgcggctcacgctaaacccgaccctggaagtggaggacaacctgccggtcccggagccgctggagaggccttggccgtcctcaccagtttcggaaggcgcctgcttgtgctcatccctgtttacctggctggagctgtcggtctttctgtggggtttgtactgtttggattagccctctacctgggatggaggcgcgtgagagacgaaaaagagcgctctctgagagccgcaagacagctcctagatgacgaagaacagctgacggccaagacattgtacatgtcccatagagagctccctgcatgggtgagctttcccgatgtggaaaaggctgagtggctgaataagatcgtggctcaggtgtggccttttctgggtcagtatatggaaaagctcttagctgagaccgtcgcccctgcagtcagagggagcaatcctcacctgcagacttttaccttcacgagggtggaactaggtgaaaagccgctgaggataattggggtcaaggtccatcccggacagcgcaaggaacagatcttactcgacctcaacatttcatatgtgggtgacgtccagatagacgtcgaagtgaaaaaatatttttgtaaagccggagtgaagggcatgcaactgcacggcgtgctgagagtgattctggagccattgatcggtgacttgcctttcgtgggcgcagtgtccatgttctttattcgcaggcccaccttagacatcaattggaccggaatgaccaacctgctggatatccctggcctatcaagtctttctgataccatgatcatggactctattgccgcatttttggtgttaccaaatcggttgttggtgccattggttcctgaccttcaggatgtcgcacagctgcggtcacctttacctaggggaattatccggattcatctcctggccgctcgtgggctgtctagcaaggataagtatgtcaagggcctgatcgaggggaagagcgacccctacgcattagttaggctggggacccagaccttctgcagtagagtgattgatgaggagctgaacccccagtggggggagacctacgaggtgatggtgcacgaggtgcccggacaagagattgaggtggaggtcttcgataaggatcctgacaaggacgactttttggggaggatgaaactggacgtggggaaggttctgcaagcttccgttttggacgactggttccctttacaggggggacaaggacaggtgcatctgcggcttgagtggctgtcacttctaagtgacgcagagaagcttgagcaggtgctccagtggaactggggggtttcctcccggccagatcccccttcggctgcaatcctcgtggtctacctggatagagcacaggatcttcctatggttacttctgaactctacccaccccagctgaaaaagggcaataaggagccaaatccaatggtccagctgagtattcaagatgtgacccaggagtctaaggcagtgtattccaccaactgcccagtgtgggaagaagctttccgatttttcctgcaagacccacaaagccaggaactcgatgtccaggtgaaagatgactcaagggcattgacacttggcgctctaaccctgccgctcgctagactcttgacagcacccgagctgatccttgatcagtggttccaactctctagctctggcccaaactcccggctatacatgaaattggtgatgcgtatcctttacctggacagttccgagatatgtttccccactgtgcccggttgtccaggcgcatgggatgttgactctgaaaacccacagcggggatctagcgttgacgcccctcccaggccctgccacaccactccagattcccaattcggcacagaacacgttcttaggattcacgtcttggaagctcaggatctgatcgctaaagatcgcttccttggtggtttagtgaaggggaagtcagatccttacgtcaagctcaaactagccggaagatccttcaggtcacacgtggtgcgggaggatctgaatccgaggtggaatgaggtcttcgaggtgattgtgacttcagtgcctggtcaagaactggaggtcgaagtgttcgacaaggacctggacaaagatgacttcctaggcaggtgtaaagtcagacttacgactgtgcttaattccggattcttggatgagtggctgacactggaagatgtgccgagcggcaggttacatctgaggttggagcggctcactcctagacccacggcggctgaactcgaggaggtgctgcaggtcaacagcttaatacagacccagaaatccgccgagcttgctgccgctttgcttagtatctacatggagcgcgctgaggacttgcccttgagaaaagggaccaaacatctgagcccctacgctactcttactgtcggggactcttcccataagaccaaaactatcagtcagacctccgctccggtctgggacgaatctgcctctttcctcatcaggaagccacacacagaaagtctggagctgcaggttcgcggagaaggcaccggtgtgctcggtagcctgtcacttcctttgtcagaactgctcgttgcagaccaattatgcctggacaggtggttcacactttccagcgggcaggggcaagtcctgctgcgggctcagcttggaatcttggtgagtcagcacagcggcgtcgaggctcactcgcatagctattcccattctagttccagcctgagcgaagagccggagctgtcaggaggcccaccgcacatcacttcaagtgcccctgaattaagacagagactcacccacgtagatagccctctggaggcccctgcaggtcccctaggtcaggtcaaactgacactttggtattactccgaagaaaggaaacttgtatccatagtgcacgggtgtcgctcactcagacagaatgggagggaccctcccgacccctacgtgtccctcctgcttcttcctgataaaaacagagggacgaagaggcggacctctcaaaagaaacgcacattgagcccggagttcaacgagagattcgagtgggagctccctctggacgaagcacagcggaggaagctggacgtgtcagtgaagtccaattccagtttcatgtctcgggagagagaactgcttgggaaggtgcaactcgacctggcagagacggaccttagccagggggtggctagatggtacgacttgatggacaataaggacaagggatcttcctag

SEQ ID NO: 50060 - DNA, 3315 bp, Artificial Sequence
  Description of Artificial Sequence: Synthetic coding sequence
atggaaaggtctccaggggaaggcccatccccttcccccatggatcaacccagcgccccttctgatcctaccgaccaaccccctgctgcacatgccaagccagaccctggcagtggagggcagcccgcaggcccaggcgctgcaggcgaggctctggctgtgctgacgtcatttggtcgtcgtcttttagtgcttatacccgtgtacctcgcaggggctgtggggttgtcggtcggcttcgtgctgtttggactggcattatacctgggctggaggagggtccgagacgaaaaggagaggtcactgcgggcagcacgtcagctgcttgacgacgaggagcagcttaccgccaaaaccctgtatatgagtcatcgcgagctgcccgcttgggtttctttccctgacgtcgagaaggccgaatggctgaataagatcgtcgcccaggtctggccattcctaggacagtacatggaaaaactcctggctgagaccgtggcccctgctgtcagaggatctaaccctcatctgcagacctttacttttactcgagtggaactgggggaaaaaccgttacgcataatcggggtcaaagtccaccccggacaaagaaaggagcagattctgctggacttaaacatttcctacgttggggacgtccagattgacgtagaagtcaagaaatatttctgcaaggccggagtcaagggcatgcagctccacggcgttttgagggtaatcttggagccgctaatcggtgacctcccttttgtgggagctgtgagtatgtttttcattaggcgtcccacgctcgatattaactggacaggaatgacaaacttactggacatcccaggactgtcaagtctctcggatacaatgatcatggacagcattgccgctttcttagtgcttcccaaccgactgctcgtgcccctggtgcccgacctgcaggacgtggcgcagctacgaagcccactgcctcgtgggatcataagaatccatcttcttgcggctcgcggtttatcgtccaaagacaagtacgtaaaggggctgattgagggcaagtccgacccttacgcattagtgcgtttgggaacccagacattttgttccagggtgatcgacgaggagttgaatcctcaatggggagagacgtatgaagtgatggtgcatgaagtacccggtcaagaaatagaggttgaggtcttcgataaggaccctgacaaagacgacttccttggacgcatgaaattggacgtaggcaaagttctgcaggccagcgtcttagacgattggtttcctctacaaggcggacagggtcaggtgcatctgcgacttgaatggttgagcctcttgtccgacgccgagaaattggaacaagttctgcagtggaactggggagtgtctagccgaccagaccccccttctgcagctatcttggtggtctatctcgaccgagcccaggacctccctttgaaaaaggggaacaaagagcctaatcctatggtgcagctttccatccaagacgtgacccaggagtcgaaagccgtttacagcacgaactgcccagtttgggaggaggcttttaggtttttcctccaggaccctcagtcacaagaactggacgttcaggtgaaagacgattcccgcgcattaacattgggcgctctgaccctgcctctggccaggttactcacagctcccgagctgattctggatcagtggtttcagttatcctcgagcggccctaacagtcgattatatatgaagcttgtaatgcgtatactctatctcgacagctccgaaatctgtttccccacagtgccaggctgtcccggagcttgggacgtggattccgagaatccacagcgaggctcatcagttgacgcgcctcctaggccctgtcatacaactcccgatagccagttcgggactgagcacgtcctacgcatccacgttctggaagcgcaggacctgatagcaaaggaccgcttcctcggcggtctcgtcaaaggcaaatccgacccatacgttaaattaaaactcgccggtcggagcttccggtcacacgtggtacgtgaagatctaaacccccgttggaacgaagtgttcgaagtgattgtcacatctgtcccagggcaggagctggaagtagaggtgttcgataaagacctggacaaggacgacttcctgggaagatgcaaagtgaggctcactactgtcctgaatagcggatttctggatgaatggttaacactcgaggacgttccaagcggccgactgcatcttagattggagaggctgaccccccgacccactgcagccgaattggaggaagttctgcaggtgaattcgcttatacaaacccagaaatcagccgagctggcagccgcactcctgagtatctatatggaacgtgccgaggacttgcccctgagaaaaggaacaaaacacctatcaccttatgccactctgactgttggcgatagttctcataaaaccaagactatcagtcaaacaagcgcccctgtgtgggatgaatcggcctcctttctcattcggaagcctcacacagaatctctcgaactgcaggtgaggggagagggcaccggtgtcttgggaagtctgtctctcccactgagcgaacttttagttgcagaccaactctgtctggacagatggttcacactgagctccggccagggccaggtcctcctccgggctcagttaggaattttagtgtcacaacatagcggtgtggaggctcactcgcactcctacagccactcttcgagctctttgtccgaggagccagagctgtccggagggccacctcacatcacaagttctgccccagagttaagacagagactgacccatgttgattcacctctggaggcacctgccggacccctcggacaagttaagcttactctgtggtactactccgaggagcggaagctggtgagcattgtccacggatgtcgaagtctgcgacagaacgggcgagatcctcccgacccttacgtgtccctccttcttttgcctgataaaaatagggggacgaaacgtagaacgtctcagaagaaacgcacgctgtcacccgagtttaacgagcgtttcgagtgggagctgccactcgatgaggcacagcgcaggaagctcgatgtgtctgtgaagagcaatagtagtttcatgagtagggaacgagaacttttggggaaggttcagctggatctggctgaaacagacttgtcccaaggggtcgctcggtggtacgatttgatggataacaaggacaaggggtcttcatag

SEQ ID NO: 50061 - DNA, 3177 bp, Artificial Sequence
  Description of Artificial Sequence: Synthetic coding sequence
atggagcgatctcctggggaaggtcctagcccatcacccatggaccagccaagcgccccaagtgatcccacagaccagccgccagctgcccacgcgaaaccagatccagggtccggaggacagcctgccggacccggtgcagccggagaagctttggccgtactcaccagcttcggaaggagattactagtgctgatccccgtgtatctcgccggagctgtcgggctaagcgtcggctttgtgttgttcgggctggctctgtatctggggtggagaagggtgcgagacgaaaaagagaggagtcttagggccgctaggcagttgttggatgacgagaagcttcttgctgaaacagttgcccctgcagtgagaggtagtaaccctcacctccagacatttacatttacccgagtcgagttgggggaaaagcccctgcggatcatcggcgtcaaagtacaccccggacagcgaaaggagcagattctgctggacttaaacatctcttacgtgggcgatgtacagatcgatgtggaggttaagaaatatttctgcaaggccggagttaagggcatgcagcttcacggcgtgcttagggtcatcctggagccactaatcggcgacctccccttcgtgggagccgtttctatgttcttcatcagacggcctacactcgatataaattggacaggcatgacaaatctgctggacattccgggtctgtcctccttgagtgatactatgatcatggattcgatcgccgcatttttagtccttcccaatcgactgctcgtgccattggtccctgatctccaggatgtggcacaactgaggagcccgttaccgagagggatcatccggatacacctcctggcagcaagggggctgtcatccaaggacaaatacgtcaagggcctgattgaaggaaagtctgacccgtacgctctggtcagacttggaacgcaaaccttttgttctagggtgattgacgaagagctgaaccctcagtggggagagacctacgaagtaatggtccacgaagtgcccggacaagagattgaggtcgaagtgttcgataaagatccagataaagacgattttctgggcaggatgaagttggacgttggaaaggttcttcaggctagcgtgcttgatgattggttccctttacagggcggacaaggtcaggtccatctgagactagaatggctgtccctgctgtccgatgcggaaaaacttgaacaggtcttgcaatggaattggggcgtgtcttctcggccagaccctccctctgccgctatcctggttgtgtatttggaccgagcccaggacctaccactaaagaagggcaataaggaacctaaccctatggtgcagctctcaatccaagacgtgacgcaagaatccaaggcagtatattccaccaactgccccgtatgggaagaagccttccgattctttcttcaggacccacagtcgcaggagctggatgtacaggtgaaagacgactccagagctctgaccctgggtgctctcaccttgcctctggccagactcctgaccgccccagagctaatcctggatcagtggttccaactctcttctagcgggccaaatagccggttatacatgaaactggttatgagaatattgtatctcgactcctccgagatttgttttccaactgtgccgggatgtcccggagcttgggacgtggacagcgagaacccacagcggggttccagcgtcgacgccccaccaagaccatgtcatacaaccccagatagccagttcggcacagagcacgttctacgaatacatgtacttgaagcacaggatctgatagcaaaagatcgatttctggggggacttgtgaaaggaaagtcggacccctacgttaagctgaagcttgctggcaggtcatttagatcacatgtcgtgagagaggatctgaatcctagatggaatgaggtatttgaagtgatcgtcaccagcgtgccgggacaggagctggaagttgaggtctttgataaagatctcgataaggacgatttcctgggtaggtgtaaagtaaggctgacgactgtgctgaactcagggtttttggatgaatggttaaccctggaagacgtcccatccggcaggcttcacttgcgcctcgaaagactgacacctcggcctaccgctgccgagctggaggaagttctgcaagtgaatagcctgattcaaactcagaaaagcgccgagctggctgctgctctgctctccatatatatggaaagagctgaagacctccctttacgaaagggtaccaagcacctgtccccctacgccaccctcacagtgggtgacagcagccataaaactaaaaccatctcgcagacaagtgctccagtatgggacgaatcagcctccttcctgatccggaagccccacacggagtccctggagcttcaggtgcgcggtgagggtaccggggttctgggttcccttagcctaccactcagcgaacttctcgtcgccgatcagctttgcctcgacagatggttcactctgagcagtggacagggccaggtgctattgagggcccaactgggcatcttagtttcccagcatagtggtgtcgaagcacactcacactcctacagccactcctcaagttccttatctgaggaacccgaactctccgggggtccgccacacattaccagctctgcacctgagctgcgccaacgcttaacgcacgtggactctccactcgaggcccctgctggacctttagggcaggtaaaacttacactatggtattacagtgaagaaagaaagctcgtgtctattgtccacgggtgcaggtccctgagacagaatggtagggaccccccagacccttatgtatccttattgctcctaccagacaaaaatcgcggtacaaaaaggcgaacctcgcaaaaaaaacgcacattgtcacccgaattcaatgagcgctttgagtgggagcttccgctcgacgaggcacagcgccgaaaacttgatgtatctgtcaagtccaactccagtttcatgtcccgggagcgtgaactgctcggtaaagtccagctggacctggcagagaccgatctatcacagggcgtggcacgctggtatgaccttatggacaacaaggacaagggcagctcctag

SEQ ID NO: 50062 - DNA, 3345 bp, Artificial Sequence
  Description of Artificial Sequence: Synthetic coding sequence
atggagagatcaccgggagaggggccttctccaagtccaatggatcaacctagtgccccatctgatcctacggatcaacctccagctgcccatgctaagcccgacccagggagcgggggtcagccagctgggcctggagccgcaggtgaggcactcgccgtgctgacctcattcgggaggcgcctcctggtgctcatcccagtgtatctggcaggagcggttgggcttagtgtgggctttgtgctgttcggtttagctctgtacttaggctggcgtcgcgtgcgagatgagaaagagcggagcctgcgggcagcacgacagttgctagacgacgaagagcagttgacagcgaaaactctttatatgtcccacagggaactccccgcatgggtttccttccccgacgtcgaaaaggccgagtggctgaacaaaatcgtggctcaagtttggccattcctcggccagtatatggaaaagctgctcgccgagactgtggctcctgctgtgagggggtctaatccacacttgcagactttcacctttaccagagtcgaactgggcgaaaagcctctcagaatcattggggttaaggtgcaccctgggcagcgcaaagagcagatcctgctcgatctcaacataagttatgtaggtgacgttcagatcgatgtggaagtgaaaaaatatttttgtaaggcgggtgtgaagggaatgcagctccacggcgtcctgcgggtgatactggagcctctgatcggcgacctcccctttgttggcgctgtctccatgtttttcatccggaggcctacgttagacatcaactggaccggtatgactaacctgctggacatccctggattgagctccctgtcggataccatgattatggacagtatcgccgcatttctcgtgttacctaatagactgcttgtgcccctcgtgcctgatctgcaagacgtggctcagctgagatctcccctcccaaggggaatcatcagaatccacctacttgccgcacgcggactcagcagcaaagataagtacgtcaaggggctcattgaaggtaagtctgacccatacgctctggtccgattgggtacacagacattttgttcacgggtgatcgacgaggagctcaatccccagtggggcgagacatacgaggtgatggtgcatgaggttcctggacaggagatcgaggtggaagtgttcgacaaggacccagacaaagacgattttcttggacggatgaagctcgatgtcggcaaagtgctgcaggcttccgtgctggacgactggtttccattgcagggcggacagggtcaggtccaccttaggctggaatggctgtccctgctaagcgacgcagagaagctggagcaggtgctgcagtggaattggggggtatccagccggcctgatcccccttctgcggctattctggtcgtctacctggatagagcacaggacctgccgatggttacttcggaactgtacccgcctcagctcaaaaaaggaaacaaggaaccgaaccctatggtgcaactgtccatacaagatgtgacccaggagtccaaagccgtgtactcaactaattgtccagtgtgggaggaggcctttcgtttcttcctgcaggatcctcagtcccaggagctcgacgtccaggtaaaagatgattcacgtgcactgacactgggagccctgacgttacctctggccaggctgctgactgctccagaactgattttggatcagtggtttcagctgtctagctctggaccgaacagtcgactgtacatgaagttggtcatgcggatcctgtatctcgactcttctgaaatctgtttcccaacagtgcccggatgtcccggagcctgggatgtggacagtgagaacccacaacgcggaagtagcgttgatgcacccccaaggccctgccatactacgccagattcgcagtttggcactgagcacgtgctgaggatccacgtgctggaagcgcaggatctcatagccaaggacagatttctgggagggctggtaaagggtaagagtgatccttacgtcaaactgaaactggctggccgaagttttaggtctcacgtcgtgagggaagatctgaacccaagatggaatgaggtcttcgaagtaatcgtgacgagcgttcccggacaggagctggaggtggaggtttttgacaaggatttggataaggatgactttcttggcaggtgtaaagttcgtctgactacagtcctgaactccgggtttctggacgagtggctcactttggaggatgtcccctcaggaagattacatctcagactggagaggctgactccccgacctacagcagccgaactggaggaggtgctgcaggtcaatagcctgattcagactcagaagtcagccgaactggccgcagctctcctgagtatctacatggagcgggctgaagatttgcctctccgtaagggcaccaagcacctgtccccatacgccactcttacagttggcgactcctcacataagactaaaaccattagccagacatccgccccagtttgggacgagagcgcctctttcctaatccgtaagccccacacggaatctctggagctccaggtccggggtgagggtacaggcgttctaggatcgctgtccctgcctctgagcgaactgttggtcgctgaccagctgtgtctggatcgttggttcacactgtctagcggccagggccaggtgctactgagggctcagttaggaatcttggtgtcacagcacagtggggtggaagcacattctcattcctattcacacagtagcagcagccttagcgaagaacctgagctgtccggcggacccccacacataacatccagcgcgcctgaactgcgccaacgactgacccacgttgattcacccctcgaggccccagccggacccctcgggcaggtgaaactgactctttggtactactcggaagagcggaaactggtgagtattgtgcacggatgccgctcactccgccagaatggacgagatcccccagacccctacgttagcctccttctactacccgacaagaatcgcggaacgaaaaggagaacatctcagaagaagcgaacactgtctcccgagtttaacgagaggttcgagtgggaactgcctttggatgaggcccaaaggcggaagctggacgtttccgtgaagtcgaatagctcattcatgtctcgcgagcgggaactcctaggaaaggtccaactagacctggctgagaccgacctgtcacagggggtcgctcgatggtacgacctcatggataataaagataagggaagcagctag

SEQ ID NO: 50063 - DNA, 2661 bp, Artificial Sequence
  Description of Artificial Sequence: Synthetic coding sequence
atgcgtgcggaagaaccctgcgcacctggggctccctccgccctcggcgcacagcgcaccccgggtcctgagttgaggttatccagccagttgctccctgagctctgcacatttgttgtacgggttctgttttaccttgggcctgtatacctggctggttatctgggcctgtcgatcacctggttgctgttgggcgctcttctatggatgtggtggcggaggaatagacggggaaagctagggcgtctggctgctgccttcgaattcttagataacgagagagagtttatatcgagagagttacgcggtcagcatctgcctgcttggatccatttcccagacgtggaaagagtggagtgggccaataagataatctctcagacgtggccttatctgtctatgattatggaatccaagtttcgtgagaagctggaaccaaagatccgtgagaaatccatccatctgaggaccttcaccttcacaaagttgtactttggccagaagtgtccaagggtgaacggagtgaaagcccacacaaacacatgcaatcgcaggcgggtgaccgttgatttacagatctgctacatcggtgactgtgagatatccgtggagttacagaagatccaggcaggggtgaatggaatccagttgcagggcaccctgagagtcattctggaacctcttctggtcgacaaaccattcgttggtgccgtgactgtcttctttctgcagaaaccccacctccagatcaattggaccgggctcactaacctgcttgacgctcccggaattaacgatgtctcagatagtctgctggaggacttaatcgccactcaccttgtgctgccgaatcgggtgacggtgccagtgaaaaagggactagacctcaccaacctgaggttccccttgccctgcggagtcattcgggttcacctacttgaggccgagcaactggcccagaaggacaatttcctgggcctacgcggtaagtccgacccatacgcaaaagtctctatagggctccaacacttccgctcacgcactatctaccgaaacctaaacccaacatggaacgaggtgttcgagtttatggtgtacgaagtccccggtcaggaccttgaagtcgacctatatgatgaggatactgatcgcgacgatttcctggggagcctccagatttgcctcggggatgtgatgactaatagggttgtagatgaatggttcgtcctgaacgacactaccagtggacgcctacatctacggctcgagtggcttagcctcctgacggaccaggaggtgctcacagaagatcacgggggattgagcacagccattttggttgtgtttctggagtctgcctgcaatctcccgcgaaacccatttgactacttaaacggtgaataccgtgcaaagaaactttccaggttcgcaagaaataaagtgtccaaagatccttcttcttacgtgaaactgtcagtcgggaaaaagacacacacaagcaaaacctgcccccacaataaagatccagtttggtctcaggttttctccttcttcgtacataacgtggcgaccgagaggttacacctgaaagttctggacgatgaccaggaatgtgcattgggtatgctagaggtccccctgtgccagatcctgccttacgcggacttaaccttggaacagagatttcagctggatcatagcggcttggattcacttatttcaatgcgcttggtgttgagattcctgcaagtagaagagcgagaattaggaagtccttacacggggcctgaggcccttaaaaaagggcctctgctaattaaaaaggtcgccacgaaccagggcccaaaagctcaaccccaggaggaaggacccaccgacctgccttgtccgccagatccagcttcggatacaaaagatgtctcgcgcagcaccactacaactacgtccgccacaacagtggccactgaaccaacaagccaggaaactggacctgagcccaaagggaaggattccgcgaagagattctgcgagccaattggcgagaagaagtcaccagctacgatattcctgaccgttcctggccctcacagtccaggcccaatcaaatcccctagaccaatgaagtgtccagcatccccctttgcctggccaccgaagcggctggcaccctccatgtctagcctcaactcactggcaagttcctgtttcgatcttgctgacattagtctcaatatagaaggcggagacctccgccgtcgccagctgggtgagatccagttaacagtgagatacgtgtgcctgcgcaggtgcctctcagtgctgataaacggttgtaggaatctgaccccttgcacttcaagtggcgctgacccctatgtccgtgtctacttgctgcccgaaaggaaatgggcatgtagaaaaaagacttcggtgaaacgtaagaccttggagccactcttcgacgagacctttgaatttttcgtgccaatggaagaagtgaaaaagagatctcttgatgtagctgtgaagaattcacggcctttaggatcacaccggagaaaggagttgggtaaagtactgatcgatttaagtaaggaggatcttatcaaggggttttcacaatggtatgaactgacgcctaacggtcagcccagatcatag

SEQ ID NO: 50064 - DNA, 2463 bp, Artificial Sequence
  Description of Artificial Sequence: Synthetic coding sequence
atgctccgtctcggactctgcgccgcagctctgttatgtgtctgtcggccaggagccgtgcgagccgattgttggttaatcgagggggataaggggtacgtttggctcgctatctgttcccagaaccagcctccctacgagactatccctcaacacataaacagcacagttcatgatctcaggttgaatgagaataaactcaaagctgtgctgtattcttcactcaatagattcggaaacctcacggacctgaatctcactaagaacgaaatctcctacatcgaagacggagcattcctcggccagagcagtttacaggtccttcagctcggatacaacaagctgtctaacctgacggaggggatgctccggggtatgtctcggctgcagtttcttttcgtccaacataatctaatcgaagttgtgacccccacagctttctcagagtgcccttctctgatttccatcgatctgagttctaataggctgtcacgtctcgacggcgcaaccttcgcttccctggcgtctctaatggtgtgtgaactcgcgggaaacccattcaactgtgagtgtgacctgtttggttttctggcctggctggtggtctttaacaatgtgacaaagaattatgatagactgcagtgcgagtctccaagggagttcgccggataccctctgctggtccctcgcccttatcatagcttgaatgccattactgtactgcaagcaaagtgtaggaatggtagcctgcccgctcgtccggtgtcgcatcctactccgtacagcacagatgcccaaagggagcccgacgagaatagcggctttaatcctgacgaaatactctctgtcgagcccccagcgtcaagcactacagatgcctccgctggcccagccattaagctgcatcacgtgactttcacaagtgccactcttgtggtgattatcccgcatccatattcgaagatgtatattcttgtgcagtataacaattcgtacttttcggacgtgatgacgttaaagaataagaaggaaattgtgacattagacaaacttagagcccacacagagtatacattttgtgtgacttccctgcggaacagccgtcgattcaaccatacttgcctcacatttaccacacgtgatcctgtgccaggtgacctcgcccctagcacgtcgactactacacactatattatgacaatcttgggttgcctgttcggtatggtgatcgtgctgggagctgtttattactgtctgcggaaaagaagaatgcaggaagagaagcagaagagcgtgaacgttaaaaagacgattcttgaaatgagatatggcgcagacgtcgacgcaggcagtattgtgcatgccgcacaaaagctgggcgagccaccagtgctcccagtttccaggatggcgtccattccatcaatgataggcgaaaaactaccaaccgccaagggcctagaggccggtctggacactccgaaagttgctacaaaaggaaactacatcgaggtgcgaactggcgctggaggagatggcctggcaaggcctgaagacgacctgccagacttggagaacggtcaggggtctgcagcagagatatccactattgctaaagaggtcgataaggttaaccagatcattaacaactgtatcgatgctctgaagttggattccgcctcttttctcggcggtggatctagctctggagatccagagctagcgtttgagtgtcaatctctcccggcagctgccgcagccagttccgccaccgggcctggggctctggagcgcccaagttttttatcccctccgtacaaggaatcatctcaccatcccttgcagcggcagctgtcagctgacgctgcagtcactcgcaagacctgctcggtcagcagcagtggcagtattaagagcgctaaagtcttttccctggacgtgccggatcacccggcagccacaggactagccaagggagactcgaaatacattgagaaaggatcaccattaaactcacctctggataggctgcctctggtcccggcagggagcggcggaggatcgggaggtggaggaggcatccatcacctcgaggtcaagcccgcttatcattgctccgaacacagacacagctttccagcgttgtattatgaagaaggagctgacagcctttcacaaagggttagttttctcaaacccctgacccgatccaaaagggatagcacctacagccagctgtcccccaggcattattactcaggttactcatcctcaccggaatatagttcagaaagcacccataaaatatgggaaagatttcggccttataagaaacaccatcgagaagaggtgtacatggctgcaggccacgccctgagaaaaaaggtgcaattcgccaaagatgaagatctgcacgatatactcgactattggaagggcgtctcagctcagcagaagctctag

SEQ ID NO: 50065 - DNA, 2463 bp, Artificial Sequence
  Description of Artificial Sequence: Synthetic coding sequence
atgctccggctgggcctatgcgctgccgcactgctgtgtgtgtgccgcccaggagccgtgcgtgctgattgttggctgatagagggcgacaaaggctacgtgtggctcgctatctgcagccaaaaccagccaccctatgagacaattccccagcatataaactcgacagtccacgatctgagactcaatgaaaataaactcaaggccgtgctgtatagcagtctgaacagattcggaaacctcacagatctgaatcttaccaaaaatgaaatctcttatattgaggatggggcttttctgggtcagtcttcgctccaagtgctccaactgggctacaataagctgtctaatttgaccgagggtatgctgaggggcatgagcaggttgcagtttctgttcgtccagcataatcttatcgaggtggtcactcctactgccttttccgagtgtcccagcctgatctccattgacctatcaagtaaccggttaagcagactggacggagcaacgttcgctagcttggcaagtctgatggtctgcgaactggccggtaacccattcaattgcgaatgcgacctctttggcttcctcgcatggttagtggttttcaacaacgtaactaaaaattacgaccgtctccagtgtgagtcaccccgagaatttgctgggtaccccttgttagtcccacgaccctaccactcactcaacgcaatcactgtactgcaagcgaagtgccggaatggatcactccctgcgcgaccagtgtcccatccaaccccctactccaccgacgcccagcgggaaccagacgaaaactcaggctttaatcctgacgaaatcttaagcgtcgagcctccagcctcatccacaaccgacgcatcagccggaccggctattaaactgcaccacgtcaccttcacctcagctaccctggttgtgataattccccacccctattctaagatgtatattctcgttcagtataataattcctacttttccgatgtcatgaccttgaagaataaaaaagagatcgtgacacttgataaattacgcgctcataccgaatacaccttttgcgtgacgtcccttcgaaattcgcggaggttcaaccacacatgtctgacattcaccacacgcgatcccgtcccaggtgatctggcgccatcaaccagcactactacacactacatcatgacaattctggggtgcttatttgggatggtgattgtgctcggggctgtctattactgcctgagaaagcggcgaatgcaggaggagaaacagaagtcagttaacgtgaaaaagactatactcgagatgcgttatggcgctgatgtagatgccggaagcatagtgcacgcagcccagaagctgggggaacccccagtgctccctgtgtccagaatggcaagcataccttctatgatcggcgaaaagttgccgaccgctaagggattagaggccggacttgatacacctaaggttgccacgaaaggtaattacattgaggttcgcactggggcaggaggtgatgggctagccaggccagaggacgacctgcctgatctcgagaacggacaaggatctgccgcagagattagtactattgcgaaagaagtggacaaggttaatcagatcatcaacaattgcatcgacgcactcaaactcgacagcgcgtcttttctcggcggtgggtcttcctctggcgaccctgaattagccttcgagtgccagagtctcccagccgcagctgcagcctcatcagcaacaggtccaggcgcactagaaagacccagttttctgtctcctccttacaaagagtcatcacatcacccactgcagcggcagttgtccgctgatgcggcagttactcgcaagacctgttccgtgtcaagctccggctccatcaagtccgccaaagtgttttcgctggacgttcccgatcaccctgctgccactggtcttgccaaaggggactctaagtatatcgaaaagggctctcccctcaatagcccactggaccgcctacctctggtgcctgccggttcagggggaggaagtgggggtggaggcggtattcaccatctggaagtgaagccagcgtatcactgctctgaacacaggcacagtttccccgcattgtattatgaggagggggctgatagtctttcgcaaagagtgagctttctgaaaccgcttactcgctctaaaagagattccacctattcgcagctgtctccacggcactactacagtggctacagttcttctcccgaatactcaagtgagtccacacacaagatttgggaaaggtttcgcccatataaaaaacaccatagggaggaagtgtatatggcagctgggcatgcgcttagaaaaaaggtgcagttcgctaaggacgaggatctgcacgacattcttgactattggaagggagtgtcagcacaacagaagctgtag

SEQ ID NO: 50066 - DNA, 558 bp, Artificial Sequence
  Description of Artificial Sequence: Synthetic coding sequence
atggttggtctgagatggtggaaccacatcgatgaggatgggaaatctcattgggtattcgaatctagaaaagagagctctcaggagaacaaaacggttagtgaagctgagtccagaatcttttggctcgggttaatcgcttgttctgttctgtgggtgatttttgcattctctgcccttttctccttcacagttaagtggctggcggttgtgatcatgggcgtggtactgcagggagctaatctgtatggatacattcgctgcaaggtccggtccaggaaacatctcacctctatggcaacgagttactttggaaagcagttcctcaggcaacggcgttctcggcacatagctcagacagggttaaaggtgctgggatcaagagaccctcccgcatccgctttccagtccgctggaatcacaggcgtgtcccgctgcccgggtcaccctagcagaaagtttcatcaagactcacaaaagactctcgactttcctggttcttatcttaaaaacatgactcccggaaggcccatgagtcctattcctttgaggcagtag

SEQ ID NO: 50067 - DNA, 864 bp, Artificial Sequence
  Description of Artificial Sequence: Synthetic coding sequence
atgccacccctgtgggcactgctggctctaggctgcctgagattcggctcagccgtgaatctgcagccacagctggcctccgtgactttcgcgaccaacaaccctacactgacgaccgttgcattggagaaacctctatgcatgttcgatagcaaggaggcactcactggcacccatgaggtctacctctacgtgttggtggattcagctatcagtaggaacgcctcggtgcaggattcaacgaacacccccttgggctctacatttcttcagacagaggggggacgaacagggccatataaggccgttgcctttgatctgatcccgtgttccgatttaccctccctggatgccattggagatgtgagcaaagccagccagatcctcaatgcctacctggttagggtcggtgctaatgggacatgtctttgggaccctaattttcagggattgtgcaatgcaccattgtctgctgccacagagtataggttcaaatatgttctagtgaatatgtccaccggccttgtcgaggaccagaccctgtggagtgatccaatcagaacaaatcagctcacaccttactctacaatcgacacctggccaggtcggcgaagcgggggtatgattgtgatcacaagcatacttggttcattgccatttttcctcttagtgggatttgcaggggcaatcgccctgtccctggtggacatgggctcaagcgatggcgagaccacccacgactcccagattacccaggaagcagtacctaagagcctaggagctagcgagagctcctacacctccgtcaacagaggaccaccactcgacagagctgaggtttatagctctaagctgcaagactag

SEQ ID NO: 50068 - DNA, 528 bp, Artificial Sequence
  Description of Artificial Sequence: Synthetic coding sequence
atgaaatatggcgtcctccatatccacggactgtatacagacccctgtggcgttgtgttagaccctagcggatataaagatgtgacacaggatgcagaggttatggaggtgctccagaacctataccgcactaagagcttcttattcgtcgggtgtggcgagacgctcagagatcagatctttcaagcactgtttctctacagtgtgcccaacaaagtcgacttggaacattatatgctggtgctgaaagagaacgaggaccattttttcaagcatcaagccgatatgctcctgcacgggattaaggtcgtcagctacggtgactgcttcgaccacttcccaggttacgtgcaggatctcgccacccagatttgcaaacagcagagcccagatgcagatagggtggattccactaccctgctggggaacgcctgccaggattgcgccaaaaggaaattggaggagaacgggatcgaagtctctaagaagcgcacacagtccgataccgatgacgcgggaggcagttag

SEQ ID NO: 50069 - DNA, 420 bp, Artificial Sequence
  Description of Artificial Sequence: Synthetic coding sequence
atggattctgtggagaagaccacaaacaggagtgaacagaagtcgagaaagtttctaaagagcttgattcgcaaacagcctcaggagctgctccttgtgattggaacaggagtctccgctgctgttgcccctggcatccccgcactgtgcagctggcgtagctgcatagaagcggtgatcgaggcagcagagcagttggaggttctgcatcccggtgacgtggcggaattccgaaggaaggtgaccaaggacagggatcttctagtcgtggcccatgacttgattcgcaagatgagccctagaactggggacgctaagccaagcttcttccaggactgcttaatggaagtgtttgacgatcttgagcagcatatcagatcacctgtggtactccagagcatcctgtctctgatggactag

SEQ ID NO: 50070 - DNA, 1074 bp, Artificial Sequence
  Description of Artificial Sequence: Synthetic coding sequence
atggacagcgtggaaaaaacaaccaacaggagtgaacagaaatcccgcaagttcctgaagtcccttattaggaagcagccacaagagctgctcctggtaatcggaacgggtgtgtcggccgcagttgctcctggaatacctgctctgtgctcctggcgatcctgcatagaagcggtgattgaggcagccgaacagctcgaggttttgcatccaggagatgtggctgaatttaggcgcaaagttacaaaggacagggacctactggtggtcgcccacgatttgattcgtaaaatgtctcccaggaccggagacgccaaaccttctttttttcaggactgcctcatggaagtttttgacgatttagagcaacacatacgctctccagtcgttctccagtcgattctgtctctgatggaccggggagccatggttctcactactaactacgacaatttactggaagcatttggcagacgacagaataagccaatggagagcctggatctgaaggacaagacgaaggttctcgagtgggcccgaggtcacatgaaatatggtgtgctgcacatacacggactgtacacagacccatgtggcgtcgtgctggacccgtccggttacaaggacgtgacacaggacgcagaagttatggaagtcctgcaaaatctctatagaacaaaaagtttcctattcgtagggtgcggggaaaccctcagagaccagatttttcaggcacttttcctatatagtgtgcccaataaagtggacctcgaacactatatgcttgtgctgaaagagaatgaggatcatttcttcaaacaccaggctgatatgctgttgcacggaatcaaggtggtttcgtatggcgattgtttcgaccatttccccggttatgtccaagatctcgccacgcagatttgtaaacagcagagtcctgatgctgatcgggtcgattcaacaacactgctgggcaatgcctgccaggactgtgcgaaacggaaactggaagaaaatggcatcgaagtgtctaaaaagcgaactcagagtgacactgacgacgcgggtggatcttag

SEQ ID NO: 50071 - DNA, 822 bp, Artificial Sequence
  Description of Artificial Sequence: Synthetic coding sequence
atggacccagtcccaggaactgacagcgcgccattggcgggactggcctggagtagcgcatccgctccacccccaagaggattcagtgctatctcatgcacagtcgagggcgctcccgcttcatttggtaaaagtttcgcgcaaaagtcggggtacttcctgtgcctgagctcgctcggcagtctcgagaatccccaggaaaatgtcgtggccgatatccagattgtcgttgataagagcccactcccgctgggcttcagtcctgtttgcgaccccatggacagcaaggcatccgtctcaaagaagaagcgtatgtgtgtaaagctgctgccgctcggggctacagacacggccgtcttcgacgtgaggctgtctggtaaaactaagacagtacccggataccttaggatcggagacatggggggtttcgcaatctggtgcaagaaggcaaaagctccaagacctgttcccaaacctaggggactttcacgcgatatgcagggcctgagcctggacgccgctagccagccatcaaaagggggtcttctggaacggactgcttcacgattgggatcacgggcatcaaccttaaggcggaatgatagcatttacgaggcctcttctctgtacggtatttctgcaatggacggcgtaccttttaccttgcacccgaggtttgaaggcaagtcctgcagtcctctcgctttctctgcctttggcgaccttactatcaagtccctggccgacattgaagaggaatataactacggatttgttgtggagaagacagccgctgctagattacctccgtcggtgtcatag

SEQ ID NO: 50072 - DNA, 702 bp, Artificial Sequence
  Description of Artificial Sequence: Synthetic coding sequence
atggacccagtccccggaacagactccgcccctctggcaggattggcctggtctagcgccagcgctccccctcccagaggtttcagtgcaatttcctgcacagtcgaaggagcgcctgcctcctttggcaaatcgttcgctcaaaagtctggatactttctgtgcctctcctccttaggcagcctggagaacccacaagagaacgttgttgcagatattcagatcgtggtggataagtccccccttcctttggggttttcacctgtgtgtgatcctatggacagcaaagctagtgtatcaaaaaagaagaggatgtgtgtgaaactgctgccgctcggtgccaccgacaccgccgttttcgacgtgcgcctgtccggcaagaccaagaccgttcccggatacttgcgaattggcaaaggaggcttgctagagcgcactgctagccgtctgggttcgcgcgctagcaccctgagacgcaatgattccatttatgaagcaagttccctgtatggcattagtgctatggacggtgttcctttcaccctgcaccctcgttttgaaggaaagtcatgtagccccctggccttcagcgcttttggcgacctcacaatcaaaagtctcgccgatatcgaagaagaatacaattatggattcgtggtggagaagaccgctgccgcaagactcccaccgtcagtgtcttag

SEQ ID NO: 50073 - DNA, 822 bp, Artificial Sequence
  Description of Artificial Sequence: Synthetic coding sequence
atggaccccgtacctggtacagacagcgcaccattggctggcctggcatggtcaagtgcttctgcgccacctccacggggtttttccgcaatcagttgcactgttgagggtgccccagccagctttgggaaatcatttgctcagaaatccggatatttcctgtgtctctcatccctggggtcactggaaaaccctcaggagaacgttgtagccgatatccaaattgtggtggacaagagccctctaccattaggcttctcacccgtctgcgatccaatggactctaaggctagcgtatctaaaaaaaaaaggatgtgcgtgaagctgctcccgctcggagcgaccgatacggccgtatttgacgtcaggttgtctggcaagacaaaaacagtgcccggatacctgcgtatcggtgacatgggaggtttcgccatctggtgtaagaaggccaaagcacccaggccagtgcccaagcctaggggtctgagccgggacatgcagggcctctctctggacgctgcctcccagccctccaaggggggactgctcgaacgaacggcatctcgacttgggagtagagcttcgaccctcaggagaaacgattcgatctacgaagcgagcagtttgtacggaattagtgctatggatggcgtgccctttactctccatccacgttttgagggtaagtcctgttcccccctagccttttcagccttcggcgatctaaccataaagtcacttgccgatattgaagaggagtacaattatggtttcgtcgtcgagaagactgctgctgccaggcttccaccttccgtgagctag

SEQ ID NO: 50074 - DNA, 960 bp, Artificial Sequence
  Description of Artificial Sequence: Synthetic coding sequence
atgcggagctgcttctgtgtccggagaagcagagatcctccaccccctcagccaccaccccctccgccacagcgcggaaccgaccagagtacaatgcccgaggttaaagacctgagtgaggccctgccggagacatccatggacccgatcactggcgtgggagtggtcgcttccaggaaccgggcaccaaccggctacgatgtcgtcgcgcagactgccgacggggtcgatgccgatctgtggaaggatggattattcaaaagcaaggttacgaggtacctgtgtttcacacggtcattctccaaggaaaattcccacctcggtaacgttctggtcgacatgaagctcatagacataaaggataccttgccagtggggttcatccccatccaggagactgttgatactcaggaggttgcctttcgaaagaaacgactgtgcatcaaatttattcctcgggacagcaccgaggccgctatctgcgacatcaggattatgggccgtaccaagcaggctcccccacagtataccttcatcggcgaattgaacagcatgggcatttggtaccgcatgggccgagtgccgagaaatcatgacagctcccagccaaccacgccatcgcagagctctgctgcatccacacctgccccaaatcttcctaggcatattagtctgacattaccagcaaccttcaggggaaggaactcgacccggacagactacgagtaccagcacagtaacctgtatgccatttcagccatggacggtgtgccattcatgatctccgaaaagttctcttgtgtccccgagtcgatgcaaccattcgatctgctgggtatcacaattaagagtttagctgagatcgaaaaagagtacgaatattctttccgaaccgaacagtcagctgccgctaggctaccaccatctcccacacgatgccaacagatccctcaaagttag

SEQ ID NO: 50075 - DNA, 618 bp, Artificial Sequence
  Description of Artificial Sequence: Synthetic coding sequence
atggacactgggctgagtagccaaccttccgaggaagaccagtctaccatgcccgaggtgaaagacctttccgaggctctgcctgaaacaagcatggacccaatcaccggtgtgggcgttgtggcttcaagaaaccgagccccaacggggtacgacgtggtagcacagactgctgatggggtggatgctgacctgtggaaggacggcctcttcaaatccaaggtaactcgctacttatgctttactaggagttttagtaaagagaactcccacctgggaaacgtgctggtcgacatgaagctgatagatataaaagatacactacctgtcggattcattccaatacaggaaaccgtggacacacaggaagtagcatttagaaagaagcgcctttgtatcaagttcatccctagggacagtactgaggccgcaatctgcgatataagaattatgggaaggactaaacaagcacccccacagtacacattcattggggagctcaattccatgggcatatggtacagaatggggagggtgcctcgtaaccatgatagctcccagccaaccaccccttcacagtcctccgcagcgtcgaccccagcccctaacctgccatag

SEQ ID NO: 50076 - DNA, 915 bp, Artificial Sequence
  Description of Artificial Sequence: Synthetic coding sequence
atggacactggcctcagttcacagcctagcgaagaggaccaatccacaatgcctgaggttaaggatctctctgaagcactccctgaaacttcgatggatccaatcaccggagttggagtggtcgcgtccaggaatcgggcacctacggggtacgacgtggtggcgcagacggcggatggtgttgatgctgatctatggaaagacgggctgttcaagagtaaggtgacaaggtacctgtgtttcacccggtccttctcaaaggaaaattctcacctcggcaatgtgctcgtggatatgaagttgattgatattaaagatactctgcccgtgggcttcattcctatacaagagaccgtggacacccaggaggttgcattcagaaagaaaaggctttgcatcaagtttatccctagggatagcactgaggcagccatttgcgacattcgtatcatgggacgaactaaacaagccccaccacagtacacttttatcggagaactgaactcaatggggatctggtacaggatgggcagggtccctaggaaccacgactctagccaaccaactactcccagccagtcttcggcagcttcaacacccgcacccaatctgccccgacatatctccttgaccctgccggctaccttccggggaagaaacagcacccgcacagactatgagtaccaacacagcaacctctacgccatttccgctatggatggtgtaccctttatgatctctgagaagttttcttgcgtgcccgaatctatgcaaccctttgacctccttggtattaccatcaagtctctggccgaaattgagaaggaatatgaatacagcttccgtaccgagcagagcgccgcagctagactcccccctagccccaccaggtgtcaacagatcccacagagttag

SEQ ID NO: 50077 - DNA, 645 bp, Artificial Sequence
  Description of Artificial Sequence: Synthetic coding sequence
atggaggcccctgcacatggcctcgagccttgtggctggggtgcctgttggttggtttgctatacagtgggaaggcgcgctggatcctggttgcgctcctgggcagggccaccttggagattccccgagacaaaaccaagtgttagcagtgtccaagggcgaaggttggaagcgagacgtcgtgtcgcccaaacagctgatggggttgatgcagacctgtggaaagacggtctgtttaaatctaaggtcactaggtacctgtgctttactcgctcgttttcaaaggagaactcccacctcggaaacgtgctcgtcgatatgaaactgattgacatcaaggacactcttcccgtgggctttatccctatccaggagacggtggatacccaggaggtagcctttagaaagaagcgcttgtgtataaagttcataccccgagattcaacggaggccgcaatttgcgacattaggataatgggtagaaccaaacaggctccccctcagtacacctttatcggggaactgaattcaatgggtatctggtataggatggggcgagtacccagaaaccatgactcttcccagcctactactccctctcagagctctgctgcctcaacacccgctccaaatttgccacgatag

SEQ ID NO: 50078 - DNA, 666 bp, Artificial Sequence
  Description of Artificial Sequence: Synthetic coding sequence
atgaggtcctgtttttgtgttagacgttctcgggatccaccccctcctcagcccccaccacctcctcctcagaggggtacggatcagtctactatgcccgaggttaaggacttgagtgaagctctgccggaaacatctatggatcccatcactggtgtcggagtcgtggctagcagaaatcgagctcctactggctatgacgtcgtcgctcagaccgctgatggagtggatgctgacttgtggaaagatggcttattcaaaagtaaggtgaccaggtatctgtgcttcacaaggagtttctcaaaggagaattcccacctgggaaatgtgcttgtggatatgaaactgatcgatatcaaggatacgctaccagttggcttcattcctatacaggaaaccgtggatacacaggaagttgcattcaggaaaaagagactctgtatcaaatttatcccacgcgacagcactgaagccgctatctgtgatatccggatcatgggcagaaccaagcaggcgcctcctcagtatacctttataggagagctcaactccatgggcatatggtaccgtatgggaagggtgcctagaaaccacgatagcagccagccaacaacaccgtcgcagtcttcggccgctagcactcccgcaccaaatctcccgagatag

SEQ ID NO: 50079 - DNA, 2787 bp, Artificial Sequence
  Description of Artificial Sequence: Synthetic coding sequence
atgggtgggtcagcatcctctcagctggacgaaggtaaatgcgcatatattcgaggcaaaactgaagccgctattaagaactttagcccttactacagtcggcagtattcggtagctttctgtaaccacgttaggacagaggtggagcagcaaagggacctgacgtcccaattcttgaaaacaaaaccgccactggccccaggcaccattctgtatgaggccgagctctcacagttctctgaagacataaaaaagtggaaagaaaggtatgtcgttgtgaagaacgactacgctgtggaaagctacgagaataaagaagcataccaacgcggagcagcccctaagtgtcggattctgcctgcaggaggaaaagtgctgacatcagaagatgagtataatctgctgtccgaccgtcactttccggaccctctcgccagttcagagaaagaaaatacccaaccatttgtggtccttccgaaagagtttcccgtgtatctatggcaaccctttttccgccatggttatttctgttttcatgaagctgccgatcagaaaaggttctccgctctcctgagcgactgtgttagacatttaaatcacgactacatgaaacagatgacttttgaggctcaggcgtttctggaagccgttcaatttttccgacaggagaagggacactatgggtcttgggaaatgatcactggcgacgagattcagattctttccaacctcgtaatggaagagttgctgcctacactgcaaacagatcttctgccgaagatgaagggaaagaagaacgatcgtaagcgtacctggctgggcttgctcgaagaggcctatactctggtgcagcaccaggtctctgagggactgagtgcactgaaggaggagtgtagggcgttaacaaaaggactcgaaggtactatcaggagcgacatggatcagatcgtgaacagcaagaattacctcatcggaaagatcaaggccatggttgctcagcctgcagaaaaatcttgtctagagtctgttcagccattcctggcgtccatccttgaagaactcatgggccctgtgtcttccggtttttctgaagtgagggtgctgttcgagaaagaggtgaatgaggtttcacagaattttcagacaacaaaagattccgtccagctgaaggagcacctggaccggttaatgaatctgcctctgcattctgttaaaatggagccctgttacacaaaagtaaatctgctgcatgaaagactacaggacctgaagtccagattcaggtttccccacatagatctagtcgtgcagcgcactcagaattacatgcaggagctgatggagaacgcggtgtttacgttcgagcagctccttagccctcacctacaaggagaagcctctaagaccgcagtcgcaattgagaaggtgaaactcagggtgctaaaacagtatgactacgactcgtccacaattcgcaaaaagatttttcaggaagccctcgtgcagatcacccttccaaccgtgcagaaggcattagcctccacgtgtaagcccgagttacagaaatacgagcagttcatctttgctgatcacaccaatatgatccacgtggaaaatgtgtatgaggagattctgcatcagattttgctggatgaaacactcaaagttatcaaggaggccgcaatcttaaaaaagcataacctgttcgaagacaatatggccttgccgagcgaatccgtgtccagtctcacagaccttaagccccctacgggaagtaatcaggctagtccagcaagaagggcatctgcgatcctgcccggagtgttggggagcgaaactctgagcaatgaagtgttccaggagtcggaagaagaaaaacagcccgaggtccctagctccttggccaagggtgagagcctaagcctacctggcccaagtcctccacccgacggcacggagcaggtaatcatatcaagagtggacgatcccgtagtgaatccagtggcgacagaagacactgccggtctccctggaacttgtagtagtgagctcgaattcggcggaaccctggaggacgaagaaccggctcaggaggagccagaaccaatcactgcttctgggagcttaaaagcccttaggaaactgctaacagcctctgtagaagtgccagtcgattccgctcctgtgatggaagaagatacaaacggagaatctcacgtgccccaggagaacgaggaagaggaagaaaaggaacccagccaggcagccgcaatacatcctgataactgtgaggaatccgaggtgtctgagagggaggcacagcccccttgcccggaagcccacggtgaagagcttgggggattccctgaagtcgggtctccagcctcccctcctgcctccggagggctaacggaggagcccctcggccctatggagggcgagctccccggtgaagcatgtactctcaccgctcacgagggacggggtggcaaatgtaccgaggagggggatgcctcacagcaagaggggtgcacactgggctctgatcccatttgtctgagcgaaagccaggtctcagaagagcaggaggaaatggggggtcagagttcagcggctcaagcaactgcctctgtgaacgccgaagagattaaggttgctcgtattcatgagtgccagtgggtggtggaagatgctccaaatcccgatgtgcttttgagccataaggacgatgtgaaggagggagaaggcggacaggaatcatttcccgagcttcctagtgaggaatag

SEQ ID NO: 50080 - DNA, 303 bp, Artificial Sequence
  Description of Artificial Sequence: Synthetic coding sequence
tgagcagtcgccatcgaaaaagtgaaactgagagttttaaaacagtatgattatgactcaagcaccattcgcaagaaaatctttcaggaggctctggtgcagatcaccttgcccaccgtacagaaggctctcgcatctacctgcaagcctgaactgcagaagtatgagcagtttattttcgccgaccacacgaacatgattcatgtagagaatgtctatgaagaaattctccaccagatcctgctcgacgaaacccttaaaggtgcatacattcccataaaatgttcctcgctgaagtcctag

SEQ ID NO: 50081 - DNA, 1632 bp, Artificial Sequence
  Description of Artificial Sequence: Synthetic coding sequence
atggcttctgggggaggcggaggaaataccggggcaggtgggggacctgggatgggtctgtccctgggtctgggtttggggctgtctttagggatgtctgaggctacatctgaggctgaggaggaggctgctacagctgaagctgtggggagactggctacaacgctgtggctccgcctgcggggatgggaggccgttttggctgctgctcaaaggctgctagtctgggagaaaccgcttcactccctcgtgaccgctgccgcactcaatggactgttttggctgcttagcagctcatcgctgaggcctttcttcctcttgtccgtgagtttactggcctatttcctcctggacctttggcaaccccgtttcttgccagatgtcagcgcgagctcgcctgaggaacctcattccgacagcgagggggcaggttccggggctaggccccacctactctccgtgcctgagctgtgtcggtatctcgccgagagttggctgactttccagatccacctgcaggagcttctgcaatacaagcgacagaatcctgcacagttttgcgtcagagtttgttcagggtgcgctgtcctggctgttctggggcactatgtgcctggaatcatgatctcctacattgtactgctgagcattcttctgtggccgttggttgtataccatgagttaattcagcgtatgtacacgagacttgagcccttgctcatgcaactggattactcaatgaaggccgaggccaatgctttacaccataaacacgacaagcgtaaacggcaaggaaagaatgcacctcccggtggggatgagcccctggcagaaaccgagtcagaaagtgaggccgaattggctgggttctcacccgtcgtagacgtgaaaaagacagcactggccctcgccatcaccgacagtgaactgagcgacgaggaagcctctatccttgagagcggaggcttcagtgtgtctagggccaccaccccacagctgacagacgtgagtgaagatttggatcagcagagcttgccatcggagcccgaggaaacgttgagtagagacctgggcgagggcgaggagggtgaactggcccctccagaggacctcctcgggagacctcaagcattatctcgacaggcacttgattccgaggaagaggaagaggacgtcgctgccaaggaaaccttgctccggctgtcaagcccgctgcattttgttaatacgcacttcaatggagctgggtctcccccagatggcgtcaagtgctcccccggaggtcccgttgagactctatctccagagaccgtgtctggcggtttgacagccctgcctggaactctgagcccaccgctctgccttgtgggcagcgaccctgctccatccccgtccatcttaccaccggtgccccaggactcacctcagccgctcccagcacctgaagaggaggaagcacttacgaccgaagactttgaactgctcgatcagggggaactcgagcaattgaacgccgaactcggcctggaacctgagacaccgccaaaaccaccagacgcccctcctttggggccagacatacactcactggtccagtcagatcaggaggctcaagccgtggccgaaccctag

SEQ ID NO: 50082 - DNA, 906 bp, Artificial Sequence
  Description of Artificial Sequence: Synthetic coding sequence
atgatctcctatattgtgctgctgtccatcctcctttggcccctcgtggtctaccatgagctgatccaaagaatgtacaccagacttgagccacttctgatgcagcttgactactctatgaaggcagaggccaacgccctgcaccataagcatgataaacgaaaacgacaaggcaaaaacgctcctcccggtggtgatgagcctttggcagaaacggaatccgaaagcgaggctgagctggctggcttttcgcccgtagtggatgtgaagaagaccgcactggccttagcgattacagacagtgaacttagtgatgaggaggcatcaatcttagagtccggtggatttagcgtgtcccgagctacaacccctcagcttacagacgtgtcagaggatcttgaccagcagtctctccctagtgaacctgaggagacccttagccgggatttaggcgaaggcgaggagggcgaactcgctccaccggaggatcttctgggcagaccacaggccctctctaggcaggccctcgactctgaggaagaggaagaggatgtcgctgctaaggagacacttttgcggctgtccagcccccttcacttcgtcaacactcatttcaacggggcagggagtccgccagacggggtgaagtgctcacctggcggaccagtggagacactctccccggagacagacagcccccagcctctccccgctccagaggaggaggaagcactcactacagaagatttcgagctgctcgaccagggagaactcgagcagctcaacgccgaattagggctggaaccagaaacgccgcctaaacctcctgatgcccctcctcttggaccggatatccactcactggtccagagtgatcaagaagcacaggcagtggccgaaccttag

SEQ ID NO: 50083 - DNA, 1401 bp, Artificial Sequence
  Description of Artificial Sequence: Synthetic coding sequence
atggcagaggctgaaggggttcccacaacaccaggcccagcgtccggtagcacctttcgcggacggagggatgtaagtggctcctgggagagggatcagcaggtggaggccgcacagcgcgctcttgtggaagtcctgggaccttatgaacctctgctgagcagggttcaggctgccctcgtatgggagcgccctgctcggtccgcactctggtgcctgggccttaatgccgcattctggttctttgctctgacctccttgcggctggtgtttctgttggcctttggcctgatgattatcgtttgcatcgatcagtggaaaaataaaatctggcccgagataaaagtgcccaggccggatgctctggacaatgaatcttggggcttcgtccatccaagactgttgtctgtgccggagctgtgccaccacgtggccgaagtctgggtgtcgggcactatctttatccggaacgttcttttgttcaaaaagcagaatccaggtaaattttgtctgctctcctgcggcatcctgacttttctggcagtgctggggaggtacgtccccggattattacttagctacctaatgctagttaccgtcatgatgtggcctctagctgtatatcatcgtctatgggacagggcttatgtgcgcctcaagcccgctctgcagcggctggacttcagcgtcagaggttatatgatgtcaaaacagagagaaagacagctgcgacgacgggcactccatccagagcgcgcaatggataaccattccgattcagaagaagagttggccgctttttgcccccaactggacgattccaccgtggccagagagctcgccatcacagacagtgaacactcagacgcagaagtgagctgtaccgacaatggaacttttaatctgtcacggggacaaaccccactgactgagggttcagaggacctagatgggcacagtgatccagaagaaagtttcgccagagatttgcccgactttccctccatcaatatggacccagccggactggacgatgaggacgacaccagcattggaatgccatccctcatgtacaggagccccccaggagctgaagagccccaggcccctccagccagcagagacgaggccgctttgcccgaactccttttgggcgcattgcctgttggttccaacctgacaagcaatctggcctcgctcgtgagtcagggcatgatccaactggctttgtctggggcttcacaacctggcccaagtggggctcccgctcagagggcaacccgtggcttcctgcggagtcccagttctgatctcgacaccgacgccgagggggatgactttgagctcctcgaccaaagcgagctgagccagctcgaccccgcttctagccgcagccattag

SEQ ID NO: 50084 - DNA, 816 bp, Artificial Sequence
  Description of Artificial Sequence: Synthetic coding sequence
atgttggttacagtgatgatgtggcccctcgcagtttaccacagactttgggatagggcatacgtgcggcttaaacctgccctacagagactggactttagcgtgcggggatacatgatgtcaaagcagcgcgagcggcaattgagacgaagagccctccaccctgagagagctatggacaaccactccgattcagaggaagagctcgccgcattttgcccccagctcgatgactctaccgttgcgagagaattggctattactgacagcgagcatagcgacgccgaagtcagctgcacagataatggcactttcaacctcagtaggggtcagactcctctgacggaggggagcgaagatctggacggacatagcgacccagaggaaagttttgcacgcgatctacccgacttcccgtccattaatatggaccccgcaggcctggatgacgaggacgacactagcatcggcatgcctagtcttatgtaccggtccccacccggagctgaagagcctcaggcgccacccgcaagtcgcgatgaggccgcactgccagaacttttgctcggagctctgccggtggggtcaaatttaacttctaatctagccagcctggtgagtcaaggtatgatccaattggctctaagcggcgcatcccagcccggtccatccggtgcccctgcgcagagagctacaagaggatttttgagaagcccttcatctgacctggacaccgacgctgagggcgacgattttgagctgctggaccagtcagaattaagtcagctggatcctgcctccagccggagccactag

SEQ ID NO: 50085 - DNA, 3960 bp, Artificial Sequence
  Description of Artificial Sequence: Synthetic coding sequence
atgaccgaggtccaggcaatggtggagttcagtgtagaactcaacaagttctacaatgtggatttatttcagcggggattctaccagatccgggctagtatgaaaatcccaagccggatcccccatcgcgtggaagcttcactcttgcacgcgactggcatgactctagcatttccagcttctgtacacgattccctcatctgctcgaagacattccagattttgtacaagaatgaggaggttgtgctgaacgacgtcatgatcttcaaagtcaaaatgctgctggacgaacggaagatagaggaaacgctggaggaaatgaatttcttgctgtcccttgacctgcatttcaccgatggtgactattcagcagatgatctgaacgccttgcagctgatctctagcagaacgcttaaattgcacttctctccacaccggggtttgcatcaccatgtgaacgtgatgttcgattacttccacttatcagttgtctcagtgacagttcacgcgtctctggtcgctcttcatcagcctcttatctcattccctagacccgtgaagaccacatggctaaatagaaacgcacctgcacagaataaggacagcgtgattcccacactggaatccgtggttttcggcataaactataccaagcagctctctccggacgggtgctcctttattatagcagattctttcttgcaccatgcatatagatttcactacacactctgtgccaccctcttactcgcctttaaagggctgcatagttacttcattaccgtgaccgaagaaatacccagctgccagaaattagagttagaggaaatggatgtcgaggccaggctgacagagctctgcgaggaagtaaaaaagattgagaacccagacgaactggccgaactcataaatatgaacttagcccagctgtgctccttacttatggccctttggggacaattcctcgaggtcatcactctgcatgaagagctgcgaattctcctggcccaggagcaccacacactgcgggtgaggcggtttagcgaagcttttttttgcttcgaacatcccagagaggccgctatcgcttaccaggagctgcacgcgcagtctcacctccaaatgtgcacagccattaagaatacgagcttctgtagctcactgcctccactgcctatcgagtgcagtgaacttgatggagaccttaatagtttgccaatcatcttcgaggacagatatctggactccgttacggagggcaagctcgatatcagtcaagacgatagcgagattacccaaatggaacacaatctggctagccggagatctagcgacgactgccacgatcatcagactacaccaagccttggggtccggaccattgaaattaaaccctccaacaaggatccattttctggcgagaatatcaccgtaaagttggggccttggaccgaattacgccaggaggagatccttgtcgacaatctgttgcctaacttcgagtccctagagagcaatggcaagtctaagtcaatcgagatcaccttcgagaaagaagctctgcaagaggccaagtgcctttccattggtgagagtctgaccaagttgaggagcaacctccccgcaccatccactaaagaataccacgtcgtagtgtccggcgatactataaaactaccggatattagtgctacttatgcctcctctaggttttctgactccggagtggagagcgagccttcaagctttgctacacatccaaacacagatctggtgttcgagaccgtgcaaggacagggcccatgtaattccgaacgcctattccctcaactgctgatgaaacccgattataacgttaaattcagtctgggaaaccattgcaccgaatccacttctgccatatctgaaatccagagttctttaacttcgatcaattcccttccttcagatgatgagctgtctcccgatgagaactcaaagaagtctgttgtcccagagtgtcatcttaatgattccaagaccgttctcaaccttggaacaactgacctgcctaagtgcgatgatacgaaaaaaagttctatcactctgcaacaacagagtgttgtgttctctggcaatctcgacaacgaaacagtggcaattcacagtcttaatagctcgattaaggacccccttcaattcgtctttagcgatgaggagactagcagcgatgtcaagtcgtcatgctcctctaaaccgaacctggacacgatgtgcaaaggattccaatccccggacaagagcaataattcaacggggactgcaataactttgaactctaaattaatttgccttgggacaccatgcgtgatcagcggctctatatcatctaataccgacgtgtccgaggaccgcactatgaagaagaattccgatgtactgaaccttacccagatgtatagtgagattcctacagttgaatcagagacccacctcggcacatcagaccctttttctgctagcacagatattgtgaagcagggtctcgtcgaaaattatttcgggtctcagtcgtctactgatatttctgatacatgcgccgtctcgtactcaaacgctttgagtccccaaaaggagactagcgaaaaggagatttcgaatctacagcaagagcaggataaggaagatgaggaggaggagcaggaccaacagatggtccagaatgggtattatgaggaaacagactacagcgccctcgacgggacaatcaacgcacattacacctctcgtgatgagctaatggaggaacgcctgactaagtctgaaaaaatcaacagcgattacttaagagatggaatcaacatgcccacagtctgcacatctggctgcctgtccttcccctcggccccaagagaaagcccatgcaacgtcaagtattcttctaaaagcaaatttgatgctatcacaaaacagccgagttccacctcctacaacttcaccagcagtatctcctggtacgaaagctccccaaaaccgcagattcaagcattcttgcaagccaaggaggagttaaagttgctcaagttaccagggtttatgtattcagaagtaccgctgctcgctagttcagtgccctacttttctgttgaagaagaagacggatctgaggatggagttcacctgatagtgtgcgtgcatggtctcgacggtaacagtgccgacctgcggctggttaagacatacatcgagctgggtctccctggcggtagaatcgatttcttgatgtcggagagaaaccagaatgacacctttgcggatttcgactccatgaccgatcgtctcctagacgagatcatacagtatatccagatttattcactgaccgtgtcaaagattagctttattgggcactctctcggaaacctcatcatacggagcgtgttaaccaggcctagattcaagtactatctaaataaactccatacctttctatcactatcgggccctcatctcggaactctatataattcttccgccctcgtgaacaccggcctctggttcatgcaaaaatggaagaagagcggcagcctgctacagctgacctgtcgggatcacagcgacccccgtcagacatttctctacaaactcagcaacaaggctggtctccactacttcaagaatgtagtcctggtgggttctcttcaggacaggtacgttccgtaccactctgctcgcatcgaaatgtgcaaaaccgccctcaaggataagcagtccggccaaatctatagcgaaatgattcataatctgctgcgacctgtgttgcaaagtaaggactgcaatttggtgagatacaacgtaattaatgcactgccaaacacagccgattcgctgattgggagggccgctcacatcgccgttttggactccgagatctttctggagaagttttttttggtcgctgctctgaaatactttcagtag

SEQ ID NO: 50086 - DNA, 3909 bp, Artificial Sequence
  Description of Artificial Sequence: Synthetic coding sequence
atgaccgaggttcaggctatggtcgagttttctgtggaacttaacaaattttacaacgtagacctatttcagcgaggcaagactttccagattctgtacaaaaatgaggaggtggtcttgaatgatgtgatgattttcaaagtgaagatgttgctagatgaaaggaaaatagaggagaccctcgaagaaatgaacttcctcttatccctagacctccacttcaccgatggggactactccgccgacgacctgaatgccttacaactgatctcttcacgcaccctcaagctgcatttttctccccatcggggtcttcaccatcacgtgaatgtgatgttcgattacttccacttgtcagtcgtcagcgtcactgtccacgcttccctcgtggctctccatcagcccctcatctctttcccacgccctgtgaagactacctggcttaatcgtaacgctccggctcaaaacaaagattcggtgatacctactctggagtccgtagtcttcggcatcaattacacaaagcaactaagccccgacggatgttctttcatcattgcggatagcttccttcatcacgcttacagattccactataccctttgtgccacactattactggctttcaagggtttacattcctacttcattactgttactgaagagataccctcctgccaaaagctggaactcgctaaagccaacatgcagctgttgtatgagcgtttgctccgtcggaaacaattgcgtactcagaaggacaaccatctggaagaaatggacgtggaagcgaggctgactgagctctgtgaggaggtcaagaaaattgaaaacccagatgaactggccgaactgattaacatgaacctcgctcaactgtgttcgctcctcatggcactgtggggtcagtttctggaagttataaccctgcatgaggaactgagaatcctcttggcccaagaacaccacacgcttagggtccggagatttagcgaggcatttttttgcttcgaacacccaagagaagctgccatcgcctaccaggagctccacgcccagagccacttgcaaatgtgcaccgccatcaagaataccagcttttgttcttctctgccaccactgcccatcgagtgctccgagctggatggcgatctcaattccctgccaattattttcgaagatcgctatctggattcagtgacagagggaaagctggacatcagccaagatgactctgagatcacacagatggagcacaacctcgctagccggagatctagtgacgactgccacgaccatcagactactccaagcctgggtgtccgcacaatcgaaatcaaaccgtcaaacaaggacccgttttcaggcgagaacatcaccgtcaaactgggcccatggaccgaattacggcaggaagaaattctggtggacaacctactccctaactttgagtccctggaaagcaatggaaagtcaaaatccatcgaaattaccttcgagaaggaggctttacaagaggccaaatgcttgtctattggagagagcttaactaaactgaggtcaaatctgcctgccccatcaactaaggaataccatgtcgttgtatctggggataccattaagcttccagacatctctgccacgtacgccagctctcgatttagtgactccggtgtggagagcgagcctagcagttttgccactcatcccaataccgatttggtgtttgaaactgttcagggtcagggcccatgcaattctgaacgattatttccacagctgttgatgaagccagactataacgtaaagttttcccttggtaatcattgtaccgagagtacatctgcaatctccgagattcagagctctctcacctccatcaactccctcccaagcgacgacgagctctctcccgacgagaactccaagaagtctgtagtgccggagtgccacctgaatgattctaaaacagtcttgaatttgggcaccactgaccttcctaaatgtgacgacactaagaagtccagcatcactctgcaacagcagtctgtggtgttttcaggaaaccttgacaacgagacagtggcaattcatagcctcaattcttctatcaaggatccactgcagtttgtgttttctgatgaagaaacaagctctgatgtgaagtccagttgcagctccaaaccaaacctggatacaatgtgcaagggattccaaagcccagataaaagcaataacagcacaggcaccgcgatcacactgaacagtaaattgatatgtttagggactccatgtgtgatttctggaagtattagtagtaatactgacgtgagtgaagacagaacaatgaaaaagaacagcgatgtacttaatctgacccagatgtacagtgagattcccactgtggagagcgagacacaccttgggacatctgaccctttttctgcctcaaccgatattgttaagcagggactggtcgagaactatttcggaagtcaaagcagcacagacatctcagatacctgcgccgtgtcatactcgaacgccttgtcaccacaaaaggagaccagcgagaaggaaatctctaacctgcagcaagagcaggataaggaggatgaggaagaagaacaagaccagcagatggtgcagaatggatactatgaggagaccgattattctgctctggacgggaccattaatgcacactacacgtcccgtgacgagctaatggaggagcgactcacgaaaagcgagaagatcaatagcgactacctccgggacggaattaacatgcctaccgtgtgtacgagtggttgcctgagctttcccagcgccccaagggagagcccttgtaatgttaaatactctagcaaatccaagttcgacgctatcactaagcagccctccagcaccagctataatttcacttcttcgatcagttggtacgaaagtagccctaagcctcagatccaggcgttcctccaggctaaggaggagctgaaattgttgaagttaccaggatttatgtactcggaggttcctctcctggcctcctctgtgccttatttttcagtcgaggaggaagatggcagcgaggacggagtgcacctgatcgtctgtgtccatggactcgacggcaattcggccgacctcaggctggtaaagacttatatcgagcttggtctccccggaggacggatcgactttctgatgagtgaacggaatcagaacgacactttcgctgactttgattcaatgaccgatcggcttctggatgagattatacagtatatccagatttactccctgacagtttctaaaatctcatttataggccatagtctgggcaaccttattattcgttccgtgctgactagaccccgtttcaaatactatctcaataaacttcacacctttctaagcctgtctggaccccatttagggacactgtataatagctcagccttggtaaacacaggcctttggtttatgcagaagtggaaaaagagtgggagcctgctgcagctgacgtgccgcgaccactccgatccgaggcaaacattcctgtacaaactgtcaaataaagcaggactccactactttaaaaatgtcgtcttagttggttctttacaggatcggtatgtcccctatcacagtgcaagaattgagatgtgtaagacagccctcaaggataaacagtctgggcagatctatagtgagatgatccacaatctgctaaggcccgtcctgcaatcaaaggactgcaatttagtgcgctacaatgtgatcaacgccttgccaaacacggcagacagccttatcggacgagcagcacacattgccgtgttggatagtgaaattttcctggagaagtttttcttggtcgcagctctgaaatattttcagtag

SEQ ID NO: 50087 - DNA, 4548 bp, Artificial Sequence
  Description of Artificial Sequence: Synthetic coding sequence
atgaccgaggtccaggccatggtagagttcagcgttgagctcaacaagttttacaatgttgacctgttccagagagggttctatcagattagggctagtatgaaaattcccagcagaattccacatagggtcgaggcctccctgctccatgctactggtatgacactcgccttccccgcttccgtgcacgactcccttatatgtagcaagaccttccagatcctgtataagaatgaagaggtggtgcttaatgacgtgatgatcttcaaagtcaagatgttactggacgagagaaaaattgaagagacactggaagaaatgaactttctgctgtcactagacctacactttacagacggcgactattctgcggatgatctcaacgcgctgcagctaatcagttctaggactttgaaactgcacttttcccctcatcgcggtctgcatcatcacgtcaacgtcatgttcgactacttccacctgtctgtggtgagcgttactgttcacgcttccctcgtcgccttacatcaacccctgatttcttttccacgtcccgtaaaaaccacttggctgaaccggaatgccccagcgcagaataaggattcagttatacccacccttgagtcagtggtcttcgggataaattataccaagcagctgtcaccggacggttgctcttttataattgcggatagcttcctgcaccacgcttataggtttcattatacattatgcgcgactctgttgctggctttcaaaggcctacatagttattttattacagttacagaggagattccgagctgtcaaaagctggaactggaagaaatggacgtcgaagcacgcctcaccgagctatgcgaggaggtgaagaagatcgagaatcccgacgaactggccgagcttatcaacatgaacctggcccaactgtgttctctcctgatggccctgtggggccaattcctggaagtaattaccttacacgaagagctgaggattttgcttgctcaggagcatcataccctgagagttcgaaggttctccgaggcgttcttctgctttgaacatcctagagaagccgctatcgcttaccaggagctgcatgcccagtcccacctgcagatgtgcactgctattaaaaatacctccttctgcagttctcttcctcccctcccaattgaatgctccgaactggacggagacctgaactcccttccaatcatctttgaagaccgttatctagactctgtcactgaagacttagacgcgccttggatgggaatccaaaatctccaacggtccgaaagttcaaagatggacaagtacgagacagaggagtctagcgtcgcagggctgtcctcacccgagctgaaggtaaggcctgcaggcgctagcagcatttggtatacagaaggtgaaaaacagctgaccaaatccctaaagggaaaaaatgaggagtctaataagagcaaggtgaaggtgactaagttgatgaagaccatgaagtcggagaacactaagaagctaatcaagcagaactccaaagattctgttgtcctcgtcggctacaaatgtctgaaaagtactgctagtaatgacctgatcaaatgctttgagggcaatccttcgcactctcagaaagagggactggatcctacaatctgcggctataatttcgatccgaagacttatatgcgacaaacgtcacagaaggaggccagctgtttgcctaccaatacagagcgaaccgagcagaagtcccccgacatcgaaaatgtgcagcctgaccaatttgacccattgaactctggcaacctcaacctgtgcgcaaacctgtctatcagcggcaagcttgatataagtcaggacgatagtgagataacccagatggagcacaacctggctagtaggcgcagctcagacgactgtcatgaccaccagaccacaccaagtttaggagtgagaacaattgagattaagcccagtaacaaggacccgttctccggggagaacataactgtgaagctcggtccgtggacagaacttaggcaggaggaaatcttggttgacaacttattacctaatttcgaaagtctagagagcaacgggaagtcaaaatctatcgaaattactttcgagaaggaggctttgcaggaagcgaagtgtttgagcattggagaatctttgaccaaactgcgcagcaacctccccgctcccagcactaaggagtaccacgtcgttgtctcaggcgatacaatcaagctgcctgatatctctgccacttacgccagcagtaggttttctgacagtggagtcgaaagcgagccgagcagttttgcaactcaccctaacacagacctcgtgttcgaaacagttcaggggcagggaccctgtaactctgaacgcctatttcctcagctgctgatgaagccagattataatgtcaagttctctctgggcaatcattgcacggagtcaacaagtgccatcagcgagatccagagttcattgacctctattaattccctgccctccgatgatgagctcagccccgacgagaattcgaaaaaatccgtagtgcctgaatgccatttgaatgacagtaagacggttctgaacttgggtaccaccgacctgccaaaatgtgacgacacgaagaaatcaagcatcactcttcagcaacaatctgtggtgttctctggcaacctggataatgaaactgtggccatacattccctgaattccagcatcaaagaccccctgcagttcgtcttttcggacgaggagacatctagtgacgttaagagcagctgttcttcgaagcccaacctggacaccatgtgcaagggcttccagtctccagacaagagtaataacagcaccgggaccgctatcacgctaaactccaaacttatatgtctgggtaccccctgcgtgatctctgggtcaatcagttccaacacagacgtgtctgaagatcggacgatgaaaaagaattcggacgttctgaatttgactcagatgtattccgaaatcccaaccgtggaatccgagacacaccttggaactagcgaccccttctcagcgtctacagatatcgttaagcagggcctagttgaaaactatttcggctctcagtcttctaccgacataagcgatacctgcgccgtttcatacagtaacgccctgagccctcagaaggaaacaagcgagaaggagattagtaatctgcagcaggagcaagacaaagaggatgaggaagaagagcaagaccagcagatggtacagaacgggtactacgaagaaaccgattattctgcactcgatggaactatcaatgcccactacacaagtcgggacgagctgatggaagaaaggctcactaaaagcgagaagattaatagcgattacctgcgtgatggaatcaacatgcccacagtctgtactagcggatgcttgtcatttccctcggccccacgggagtctccttgcaacgttaaatactcaagcaaaagtaaattcgacgcaatcacaaaacagcccagtagcacgagctacaacttcacgtctagtattagctggtatgagtcaagtccaaaaccccaaatccaggcctttctgcaggccaaggaggagcttaagctcctgaagcttccgggtttcatgtacagcgaagtgccgctgctggcttcttccgtgccctacttctccgtggaggaggaagacggatcagaagacggcgtgcacctcatagtctgtgtgcacggactcgatggaaacagtgccgacctgaggttggtcaaaacatatattgaactcgggttgcctggaggcagaatcgactttctgatgagcgagaggaatcaaaacgacacgtttgctgactttgacagcatgaccgacagactccttgatgagatcattcagtatattcagatatactccctgacggttagtaaaatcagcttcatcggacatagcctcggtaacctgattattaggagcgtgcttacccggccaaggttcaaatattacttgaataaactccatacttttctgtcgctgagcgggcctcatctgggaaccctctataactcaagtgccctcgttaacacaggactttggtttatgcagaagtggaagaaaagtggctctcttctgcagcttacatgtagagatcatagtgatcccagacagacattcctgtataagcttagcaacaaggctgggctgcactactttaagaatgtggtgctggttggatccctccaggaccgctatgtaccgtaccactccgccaggattgagatgtgtaaaaccgcactgaaagacaaacaatcagggcagatttactccgagatgatacacaacttacttaggcccgtgctccagtccaaagactgtaacctggttcggtataatgtcattaatgctctgcccaacacggcggatagtctcatcgggagggccgcacacattgcagtactggattctgaaatcttcctggagaagtttttcttagtggccgctctgaagtactttcaatag

SEQ ID NO: 50088 - DNA, 3909 bp, Artificial Sequence
  Description of Artificial Sequence: Synthetic coding sequence
atgaccgaggtccaggcaatggtggaattttccgtggaacttaataagttttacaacgtggatttgttccagagagggaaaactttccaaatcttatacaagaatgaggaagtggtgctgaatgacgtgatgatttttaaggtcaaaatgctgttggatgagagaaagatcgaagagacactcgaggaaatgaacttcctcctgagcctcgacttgcacttcacagatggggattattccgctgacgacttgaacgcactgcagctgatttccagccgaaccttgaaactgcattttagccctcatcggggactgcaccaccacgtcaacgtgatgttcgattatttccatctgtctgtggtctccgttactgtgcatgctagccttgttgctttacaccagcccctgatatcattccctcggcctgtaaaaacgacctggctgaataggaatgctcctgcacagaataaggactctgtgatcccgacattagaatcagtggtgtttggcattaattacactaaacagctgtcgcccgatgggtgtagctttattatcgcagacagctttctgcaccacgcctataggttccattacactctgtgcgctacgctgctgctagcctttaaaggcttgcactcctacttcataaccgtgacagaggagattccctcttgtcaaaagctagagcttgcgaaggctaacatgcaactgctctatgagagattgcttaggcgcaagcagctaagaacgcagaaagataaccacctcgaagaaatggacgtcgaagcccgtctgacggagctttgtgaagaagtaaagaaaatagagaaccctgacgaacttgcagagttgatcaatatgaacctggcccagttgtgtagcctcttaatggcgctatgggggcagttcctggaggtaatcactctccacgaggagctaagaattttgcttgcccaggagcaccatactcttcgcgtgcgcagatttagcgaggcgttcttctgttttgaacaccctcgagaagcagcgatcgcctaccaggagctgcacgcccagagccatctccagatgtgtacagctattaagaatactagtttttgttcctctctcccaccactcccaatcgaatgtagcgaactggacggcgatctgaattctctacctatcatttttgaagaccgttatctggacagtgtgaccgaaggtaagctcgatattagtcaggacgacagtgagatcacccagatggaacacaatctggcatctcgccgttcttccgacgactgtcacgatcaccaaacaactccttctctgggagtgcggactattgagattaaaccctccaacaaggacccatttagcggagaaaacatcaccgtcaagctggggccttggaccgagctgaggcaggaagagatcctggtggacaacctgctgcctaatttcgaaagcctcgagagcaacggaaagagcaaatccattgaaatcactttcgagaaggaggcactccaggaggctaaatgcctctcaatcggcgaatctcttacaaaactgaggagtaatttgccagctccttcgacaaaagagtaccacgtggttgtgtcaggtgataccattaagctgccagacattagcgcaacgtacgcctcttcccgcttctctgacagcggcgtggaatcagagccaagctcttttgctacacaccctaatacggatctggtgttcgaaactgtacagggccaaggcccatgtaattctgagagattatttccccagctgctgatgaagcctgactataacgttaagttcagcctgggaaatcactgtactgaatctacctccgccattagcgagattcagagttcactcacaagcataaacagtctgccatcagacgatgagctatctcccgatgaaaatagcaagaagtctgtggtgcccgagtgtcacctgaacgacagtaagaccgtgctgaatttgggaaccacagacctccccaaatgcgatgatactaagaagtccagtattactctccaacagcagtccgtagtgttcagtggaaatctcgacaacgagacagtggccattcacagcctcaacagctccataaaggatccgttgcagttcgtattctccgacgaggaaacctcatctgacgtgaaaagcagttgttctagtaaacctaacctggacaccatgtgtaagggattccagtcccccgacaaaagcaacaactccactggcaccgcgataacactaaacagcaaactgatctgccttggaacgccatgcgtgatctccggcagcatcagtagtaacactgacgtgtctgaagacagaacaatgaagaagaattcagacgtcctcaatctaacccagatgtactctgagattcccaccgtggaatccgagacccacctgggaacaagtgatcccttttctgctagcacagatatcgtaaagcagggcttagttgaaaattatttcgggagccaatcctctacagatatcagtgatacatgtgccgtcagttactcaaacgccctgagcccacagaaggagacttcagagaaagagatcagcaatctccagcaggagcaagacaaagaggacgaagaggaggaacaggaccaacaaatggtgcagaacgggtattacgaggagactgattatagcgccctagatggcaccattaacgcacactacacatccagagacgaactcatggaggaacgcctgacaaagagcgagaaaataaacagcgattaccttagagatggtatcaacatgccaactgtatgcacttctggctgtttatccttccccagtgcacctagagagagcccgtgtaacgtaaagtactcctcaaaatccaaatttgatgcgataacaaagcagccaagctccactagttacaatttcacaagcagtatttcatggtatgaatcttcccctaaaccccagatacaggcctttttacaggccaaggaggagcttaaactgctgaaactgccaggctttatgtattctgaggtcccactcctagctagtagtgtcccatatttttcagtggaagaggaggatgggagcgaggacggtgtacacttaatcgtttgcgtccacggactggatggcaacagtgccgacttaaggttggtgaaaacttatatcgaattaggcctccctggagggcgaatcgactttctgatgtcagagcgcaaccagaatgacacgtttgcagacttcgattccatgactgaccgccttctggacgaaataatccagtatatccagatctacagtctcaccgtgtcaaaaatctcattcatcggccactctttgggcaaccttattattagatctgtgctaacgagacctcgcttcaaatactatttgaacaagctccacacctttctatccctgagcgggccacatctggggacgctgtacaactctagcgctcttgtcaatacaggcttatggtttatgcagaaatggaagaaaagtggttctcttctgcagctcacatgcagggaccactctgatcccaggcagaccttcttgtacaaacttagcaataaggctggcctgcattattttaagaacgtggtcttagttgggagtctccaggatcgctatgtgccgtatcacagtgcaagaatcgagatgtgcaaaaccgccctgaaggacaagcagtctggtcaaatctatagcgaaatgatccacaacctgcttagaccagttctacaaagcaaggattgtaatctcgtccggtacaacgtgattaacgcactcccaaatactgcggactccctcattggacgtgcggctcatattgcggtgttggattccgagatttttctggaaaagttcttcctcgtggccgcactaaaatactttcagtag

SEQ ID NO: 50089 - DNA, 153 bp, Artificial Sequence
  Description of Artificial Sequence: Synthetic coding sequence
atgaccgaggtccaagcaatggtggaattctccgtggagttgaataaattttataatgttgatttgtttcaaagaggtttttaccagattcgtgcgtcgatgaagatcccatccaggatcccacacagagttgaggcctcactcctgcactag

SEQ ID NO: 50090 - DNA, 96 bp, Artificial Sequence
  Description of Artificial Sequence: Synthetic coding sequence
atgacagaggtgcaagctatggttgaattttccgtggaactgaataagttttataacgttgacctgtttcaaaggggtttctaccagatccgctag

SEQ ID NO: 50091 - DNA, 1518 bp, Artificial Sequence
  Description of Artificial Sequence: Synthetic coding sequence
atgacagaggtgcaggcaatggtggaattctccgtagagctgaataaattttacaacgtggacttattccagaggggattttaccagatccgggctagcatgaaaatcccatctaggatccctcatcgcgtggaggcttctctactccatgccaccggtatgaccctagccttccccgcaagtgtgcatgattcactgatctgttcaaagacgtttcagattctgtataaaaatgaagaggtcgttctgaatgacgttatgatattcaaggtgaaaatgctgctcgacgaacgaaaaatcgaggagacattggaggagatgaactttctcctgagtctggaccttcatttcactgacggcgactactccgccgatgatcttaatgccctccagttaatcagcagtaggacattgaagcttcacttttcccctcatcgaggtctgcaccaccatgtaaacgtgatgttcgattatttccatctgtccgtagtcagcgtgaccgtgcatgctagcctcgttgccctccaccagcctttgattagctttcctagaccggtgaagactacctggctgaatcggaacgccccagcacaaaacaaggattctgtcattccaactttggaaagcgtggtctttgggataaactatacaaaacagttaagccccgacggctgcagttttattattgccgattccttcttacaccacgcttatcggttccactatactctgtgtgctacgctgctattggcatttaaggggttacactcatactttattaccgttactgaggaaataccaagctgtcagaagctggaactcgaggagatggatgtggaggcaagactcaccgagttatgtgaggaggtcaagaagattgaaaatcctgacgagcttgctgagctgatcaacatgaacctggcccagctttgttccctccttatggccctgtggggccagtttctggaggtgattaccctacacgaagaactcaggatcctcctcgcccaggagcatcacactctcagagttcgacgcttttctgaggcctttttttgttttgaacaccctcgagaggccgctatagcttaccaggagttgcacgctcagagccacctgcagatgtgcacagccattaagaacacctccttttgctcctccctgcccccactgccgattgaatgttctgagttggatggtgacctgaattccctcccgatcatctttgaggatcgatatctggactcagtcaccgaggatctcgacgccccatggatgggcattcagaaccttcagcggagtgaatcatcaaagatggacaagtatgagactgaggaatcatcggtggccggactgtcgagtcccgagttaaaggtccgtccagcaggggcaagtagcatatggtataccgagggcgaaaagcagcttaccaaatccctgaaggggaagaacgaggaatcaaacaagagcaaagtcaaggtcaccaaactgatgaagaccatgaagagcgaaaattag

SEQ ID NO: 50092 - DNA, 462 bp, Artificial Sequence
  Description of Artificial Sequence: Synthetic coding sequence
atgtcagagattcaggggaccgtcgagttctcagtggaactgcacaagttttataatgtcgacctgttccaacgaggctactaccagatcagggtaacccttaaagtgtctagcaggatcccccaccggctcagtgcctccatagccggtcagacagaaagtagttctctacattcagcttgcgtccatgattccactgtgcacagtagggtatttcagatcctctatcggaatgaggaggtgcctattaacgacgcagtggtctttcgtgtgcacctgctgttgggcggtgaacgcatggaagacgcactctccgaggtggattttcagctaaaagtggatctccacttcaccgacagcgaacagcagctgcgggatgtggccggagcgcctatggttagtagccgcactctcggccttcattttcaccctagaaacggactgcatcatcaggttccctag

SEQ ID NO: 50093 - DNA, 4221 bp, Artificial Sequence
  Description of Artificial Sequence: Synthetic coding sequence
atgtctgaaattcaaggcaccgtcgagttctctgtggaacttcataaattttataatgttgatctgtttcagaggggatattatcaaattagagtcacgttaaaagtttccagtcgcatccctcatagactgtcggcctccattgcaggacaaaccgaatcttcatcccttcacagcgcttgcgtccacgattctacagtgcattcgcgggtcttccagattctgtaccggaacgaggaggttcccattaatgatgccgtagtgttccgcgttcatctgctgctgggcggagagaggatggaggacgcgctgtccgaggtggacttccagctcaaggtggatcttcacttcaccgattccgagcagcagctgcgggacgtggccggagccccaatggtatccagccggacactcggcctgcacttccatccacggaacggcctgcaccaccaggtcccggttatgttcgattattttcacctcagcgttatctccgttacagtgcacgccgctcttgttgcactccagcagccactcatttcgtttactaggccaggaaggggatcctggcttggcaaaggcggaccggacaccggccaggaacagagtatcatctccttagagaacctggtctttggcgctgggtactgtaagcccactagcagtgaaggctcgttttacattaccagcgaaaattgtatgcagcatgctcataaatggcaccgagatttatgcctgctactgttgcacgcttatcgtggcctgaggctccatttcttagtgatcatgcgcgacatccccgaactgcctcacacagagctggaggcccttgctgtggaggagaccctaagccagctctgtagtgagctccaaatgttgaacaaccctgaaaagattgcagaacagatctcaaaagatcttgcctggcttacaagccacatgatgacgctctggacgcagttcctggacaccgtgactctccactctcaagtgacgacttatctcactcaggagcatcacacgctcagagtccggaggttttcagaggcttttttctatatggagcaccagaaacttgcagtgcttacatttcaggaaaaccttattcaaacgcatagccagctttcgctggacatccgcaattccgagtacctgacctccatgcctccgttgccagctgagtgcctggacatcgatggggactggaatactctgcctgtgatctttgaggacaggtatgtagactgccccgctacaggccacaatctgtctgtttacccaaacttcgatgtaccggtcactagccccacaataatgaacctaaaagataaagaagataattgcatggtgaattctaatctgtccttccgcgaggacctagtgttatccacaatcaagcctagccaaatggactcagatgaggaggttatcagatgcccagaacccggagagaatgtcgctacccaaaaccacatggatatgtgctccgaatcgcaggtttatatatccattggtgagttccagaacaaggcaggtgtccccgaggacgagtgttggacagggcagacatctgatgccggtacctatccggttgccgacgttgacaccagccgcagaagcccagggcctgaggatgggcaggcaccagtgctgacttacatcgatgtcaaaagcagcaataagaacccctcacgcgctgaaccactggtcgcatttaatgctcaacatgagagcaggagtagccgtgataagtatggactcgatcgaaccggcctgtccaaggtggtcgtgggaggctctcaccagaacgcaattagtagcgataagacaacactgcacgagctgtccacactgggaaagggaattgaccaggagggaaagatggttttactgagcttaaaactcacaccctccgagccttgcgatcccttaagctccacgctcagagaacccctggatatccggagctcattaaaggattcccacaccgaggaacaagaggagttgagcgtgctgtccggggtcataaagcgctcttctagtatcatttccgacagcgggatcgagtccgagccctcatctgtagcctggtccgaggcccgtagcagggctctggagttgccctccgacagagaggttctccatccttttgtgaggcgacatgccctgcatcggaatagcctagagggcggacacactgaaagcaatacctctcttccctccgggatccaagcatccttaacctccatcagctcccttcccttcgaggaagatgagagggaggtcgcactcaccaagttgaccaaatccgtatccgccccacatatttcaagccccgaagaagcggctgaggacgccgacactaagcagcaggacggcggttttgcagaaccctctgacatgcattccaagtcacagggtagtcctgggtcctgttcccagttatgtggcgattccggtaccgacgcaggggcagaccatccattagtggaaatagtgttggacgccgataatcagcaaggtcccggatacattgatatccccaagggaaaggggaaacagtttgatgcccaagggcactgccttccggatggtagaacagagaacactccgggagtggaaaccaaaggcctgaacctgaaaatcccaagggtgatagctttagaaaatccccgtactcgcagccttcaccgggcactggaagagactccaaagggcatgcccaaggatctgaatgttggacaacaggcgctttcaaactctgggatcagtgaagtggaaggcctgtcccagcaccaggtgccggagttgtcatgcacgagcgccgcagatgctatcaacaggaattccaccggccaacagtctcagtctggatcaccctgtatcatggacgacaccgcattcaataggggggtgaacgcgttccccgaggccaaacacaaagccggtaccgtttgtcctactgtgactcacagcgtccatagccaggtgctcaagaaccaggaactgaaggcaggcacctcaattatgggcagccatctaacctctgccgagacattcactctagacagcctgaaagccgtggaggtggtcaacctgagtgtttcttgtacggctacttgtctaccctttagcagcgtaccaaaagagacacccgctcgggcaggcttcagttcgaagcaaactttgttcccgattacccatcagccgttgggcagtttcggagtggtttctactcacagcagcacactcgatgaagaggttagcgaacgtatgttttcgttttaccaagccaaagagaaatttaaaaaagagctcaaaattgaaggattcctgtactcggatctcactgttctggcaagcgacattccatactttcctcctgaagaggaggaggaaaacctggaagacgggatccacttggtcgtttgtgtgcatgggttggacggcaattccgcagatcttcggctggttaaaaccttcattgagcttgggctgcctggcggaaaactggacttcctgatgtccgaaaagaaccagatggacacattcgctgactttgataccatgacagaccgccttctggacgagattatacagcacatccaattgtacaacctttctatttccagaatcagcttcatcggccattccttgggcaatatcatcattcggagcgtactgactagaccccgattccggtattacttgaacaagctgcacacattcttaagcctgagcggcccacatctgggaacgctctataacaattcaactctcgtgtccaccggactttggctgatgcagaagctgaaaaagtcagggagtctgctccaattgacgttccgcgataatgccgatctacgcaagtgttttctctatcagctctcccagaaaacaggactgcagtatttcaaaaacgtagtgcttgtcgccagccctcaggacagatatgttccatttcattccgcccgaatcgaaatgtgtaaaaccgccctcaaggatcggcacacgggccctgtgtacgccgaaatgatcaataatctgttagggccactggtagaagcgaaggattgcaccctgatccgacataatgtcttccatgccctacctaacacagctaacacgctaatcgggagagcagcacacatagccgtcctggacagcgaactgtttttggagaagtttttcttagtagcaggcctaaactacttcaagtag

SEQ ID NO: 50094 - DNA, 207 bp, Artificial Sequence
  Description of Artificial Sequence: Synthetic coding sequence
atgagcgagattcaaggaaccgtggagttctcagtggaactacataaattttacaatgtggacctgtttcagcggggatactatcagatccgggtgacgctgaaagtctcaagtaggattccccatcgtctttctgcctcaattgcaggacagacagaagttctaaatatccacatgagcgaacaagagcctgcccagggtaagtag

SEQ ID NO: 50095 - DNA, 1197 bp, Artificial Sequence
  Description of Artificial Sequence: Synthetic coding sequence
atggtctgccgcgagcagctaagcaagaaccaagttaagtgggtttttgccggaattacgtgcgtgtcagtggtcgtgatagccgcaatcgtgcttgcgatcaccttgagaaggcccggatgtgagttggaggcctgctcgcccgatgcggacatgctggattacctgcttagtctcggccagatctcacgtcgggacgctctggaggtaacctggtaccacgctgcaaactccaagaaagcaatgaccgctgccctgaatagcaacattacagttctggaagcagacgtgaacgtcgagggcctaggcacagcaaacgagacaggagttcccattatggctcacccccctaccatctatagcgataacactcttgagcagtggctcgatgccgtgttaggctcttcgcaaaaaggaatcaagttggactttaaaaacatcaaagccgtggggccatccctggatctgctgcgccagttgacagaagaaggcaaggttcgacggccaatttggatcaacgccgacatcctgaaaggccctaatatgctgatctctaccgaggtaaacgccacacagtttctcgcacttgtccaagaaaaatatccaaaggctactctgtccccaggatggacaaccttctatatgtcaacgtccccgaatcgcacctacacccaggcgatggtggagaagatgcacgagctggttggtggggttccgcaaagggtcacgttccctgtgcggagttcaatggtgagggcagcttggccccattttagctggcttctgtctcagtcagagcgttattcgttgacactgtggcaggccgcttcagatcctatgtctgtggaagacctcctgtatgtcagagataataccgcagtccatcaggtgtattacgatatctttgaacccctgcttctcactgatatgctggaactgtgtcagggcctgtggcagcccgtatccttccaaatgcaggccatgctcctgggtcattcaacggccggtgcgatcggcagactattagcatcatcccctagggccacggtgacagtggagcacaatcccgcaggcggagattatgcaagcgtgcgcaccgccctgctagccgcaagggcggtggaccgcactcgcgtctactacaggctgccccaggggtaccacaaggacttgctggcacacgtgggcagaaactag

SEQ ID NO: 50096 - DNA, 1758 bp, Artificial Sequence
  Description of Artificial Sequence: Synthetic coding sequence
atggtttgtcgcgagcagctgtccaagaaccaagttaaatgggtgttcgcaggaatcacgtgtgtgtccgtggttgttatcgccgctattgttctggctatcacgcttcggaggccaggatgtgaactagaggcgtgctctcccgacgcagacatgctggattatctcctcagccttggtcagatctcgcgcagggatgccctggaagtcacttggtatcatgcagcaaactcaaagaaagcaatgactgccgcactgaattccaacatcacagtgctcgaagcggacgtgaacgttgaggggttagggactgccaacgaaactggcgttccgattatggcccatcctccaactatctattcagataataccctggaacagtggttagacgccgtgttgggtagttcccaaaagggcatcaagctcgatttcaaaaacataaaagccgtgggccctagcctagatctgctgaggcagcttaccgaggagggcaaagtgaggagaccaatctggattaacgctgatattctcaaggggcctaatatgctgatttcaaccgaggttaatgcaacccagttcctagctctggttcaagagaaatatcccaaagctacactctcgccgggatggacaaccttctacatgtccacttcaccaaacaggacttacactcaggctatggtggaaaagatgcacgaacttgtgggtggggttcctcaaagagtgacgtttccagtgcgctcgagcatggtgagggctgcttggccgcacttcagctggctattatcacagtctgagagatacagcctgacactgtggcaggcagcgagcgatccaatgagcgtggaggacctcctgtacgtcagggacaatactgctgtgcatcaggtgtactacgacatctttgaacccctgctatcccagttcaaacagcttgcactaaatgccacaagaaagcctatgtattacaccggtgggtccctcatccctttgttacagttgccgggagacgacggtctcaatgtcgagtggctggtgcccgacgttcaaggttctgggaagacagcgacaatgaccctccccgacacagagggaatgattctactcaataccggattggaaggtactgtcgcagagaatccagtaccaattgtgcacaccccctcaggtaacatacttaccctcgagagttgtttacagcagttagcgacccacccgggtcactggggcatacacctgcagatagctgagccagctgctttgcgtccatcactggcactgttggcacggctgagttccctaggactgttacactggccagtctgggttggggcaaagatctcacacggttccttctccgtgccagggcatgtggctggacgagaactgctgaccgcagttgcagaggttttcccgcacgttacagtcgcccctggatggccagaagaagttcttggctctggataccgagagcagctcctgaccgatatgcttgagctgtgccagggtttgtggcagccagtgtccttccagatgcaggctatgctgcttggacactccaccgccggtgccatagggagactgctcgcctcctcgcctagggccacagtgacagtcgagcacaatcccgctgggggagactacgcatcagttagaacagccctcctggccgcaagagctgtggaccggaccagagtatactacagacttccccaaggatatcataaggatctgttggctcatgtgggcaggaactag

SEQ ID NO: 50097 - DNA, 936 bp, Artificial Sequence
  Description of Artificial Sequence: Synthetic coding sequence
atggtgtgcagggaacagctctccaagaaccaagtcaaatgggtctttgccggtatcacttgcgtaagtgtggtcgtcatcgccgctattgtcctggccataacacttcgcaggcctggatgtgagctggaagcttgcagccccgacgcggacatgctcgactatctgcttagcctcggtcagatcagtagaagagatgccctggaggttacttggtatcacgcagccaactcgaaaaaggccatgaccgcagccctgaacagcaatataactgtgcttgaagcagatgtgaacgtggaagggttgggcacagctaatgaaacaggggtcccaattatggcccaccctcccactatctattctgacaataccctggagcagtggctggacgcggtgctgggcagcagtcaaaagggcatcaagctcgactttaaaaatatcaaagcagtaggaccatctctcgacctgctgagacaactcaccgaggagggaaaggtgcgtagaccaatatggataaacgctgatatactgaagggacccaatatgttgatatctacggaggtcaacgccactcaattcttggcgttggttcaagagaagtaccccaaagcaaccctgagtcctgggtggactaccttctacatgagcacatctcccaatagaacctacactcaagcaatggtcgagaagatgcacgagctggtgggcggagtgcctcaacgggtcacttttccagtccgatcttccatggtgcgggcagcttggcctcacttttcctggttattgtctcagtcggagaggtacagcctcaccttgtggcaggcagcctcagaccctatgagcgtggaggacctgctttacgtccgagataataccgcagtgcaccaagtgtactacgacatctttgaaccccttctttgctcgcagatttgctag

SEQ ID NO: 50098 - DNA, 1377 bp, Artificial Sequence
  Description of Artificial Sequence: Synthetic coding sequence
atgactcgaggcgcatggatgtgccgtcagtatgacgatggcctgaaaatctggctggcagcaccaagagagaacgagaaaccttttatcgattcggagagggctcagaaatggagattaagtcttgccagtctgctttttttcactgtgctgctctccgaccatctgtggttttgcgctgaggccaagctgacccgagccagagataaggagcatcagcaacagcagagacagcagcagcaacagcaacagcagcagcgtcagaggcaacagcagcagcagcaacgcaggcagcaggagcccagttggcctgctctgcttgcgtccatgggggagagctcaccggctgcgcaagcacaccggctgctctccgcatcctcttcacccactctcccaccaagccccggagacggaggaggagggggtgggaagggcaacaggggcaaagatgatagaggaaaggcattgtttctaggcaattctgctaaaccagtctggaggcttgagacatgctaccctcagggggcatcttctggtcagtgttttacagtagagaacgcagatgccgtgtgcgcgaggaactggtctcgcggagccgcagggggagatggccaagaggtgcggtctaaacatcccactcctctgtggaacttaagcgatttctacctgagtttttgcaatagttataccctttgggagctcttctcgggcctgtcctccccaaatacactcaactgcagtctggatgttgtccttaaggaaggcggagaaatgacaacctgtcggcagtgtgtcgaggcttaccaagactatgatcatcatgcccaggaaaaatacgaggaattcgaaagcgtcttgcataagtatcttcaaagcgaagagtatagtgtcaagtcatgccctgaggactgtaaaattgtgtataaggcgtggctttgctcacagtactttgaggtcacccaattcaattgcaggaagacgatcccctgcaaacagtattgcttagaagttcaaacccgctgccctttcattctgcctgataatgatgaggtgatctacggaggtctgtcgtcattcatttgcaccggactttacgagaccttcttaacaaacgatgaacccgagtgttgcgatgtgcgtcgggaagaaaaaagtaacaaccccagtaaaggcaccgtggaaaaaagcggttcctgtcaccgaactagtctcacagtctcttctgctacaaggctttgcaattctcggctcaagctgtgcgtgttggtattgatcctgcttcacacggtattaacagcttctgccgcacagaacaccgctgggctgagcttcggagggattaatacactggaagagaactccaccaatgaagagtag

SEQ ID NO: 50099 - DNA, 1419 bp, Artificial Sequence
  Description of Artificial Sequence: Synthetic coding sequence
atgttcagaggagcttggatgtggcccggaaaggacgccgctgctctgacgatctgttgttgttgctgctgctgggcacctcgtccaagtgataagccttgcgctgatagcgagcgcgcacagagatggcggctgtcgctggcctctctcctgttctttaccgtgctccttgccgatcacctctggctctgcgcaggagcaagaccccgtgccagggagctttcttccgcgatgcgacctccatggggcgcaggaagggaaagacagcctgtgcctcctcgcgctgtactacctctgccccctcctccccctggggaaccgagtgcgcctcccggaacatgtggtccgaggtactcaaatctgacaaaagctgcccctgcagcgggatcacggcctgtgtgcggaggcgtacctgagcccactggtctggatgccgcttgtaccaagctgcagagcctgcaacgtctttttgaacctaccacgcccgcaccgccactgaggccccctgattcgctgtccagggcacccgctgagttcccgagcgccaagaaaaatcttcttaagggccattttcgaaatttcaccctgtccttttgcgatacctataccgtgtgggatctccttctcggaatggacagaccagacagcctggattgcagcttggataccctgatgggcgacctgctggccgtggttgctagtcctggcagcggcgcttgggaggcttgttctaattgtattgaagcctaccagcgcctagaccgtcacgctcaggaaaagtatgatgagtttgatttagtgctgcacaaatacctgcaggcggaggaatatagtatccgtagctgcacaaaggggtgcaaagccgtctataaggcttggctgtgctctgaatacttttcagtcacccagcaggaatgccaacggtgggtgccttgcaaacaatattgtctagaagtgcagactaggtgcccctttatcctaccagataatgaggagatggtatacgggggacttcctgggttcatatgcacagggctcctggatacttccccaaaaaggctcgagaccaagtgctgtgacgtccaatgggtgtcttgtgaggccaagaagaagaagtttaaggagagcgaggcacctaagacacaccaacagcagtttcaccactcctatttccaccattaccaccagcaataccaccattaccacccccaccacgatccacctggtcgtgtttccaacaagcctgctctgctgcccgtgtccggaggttcccgcctcagtcccagccggatccggctgtgcgttctcgtgttaatgctgctgcacaccgtcgtttctttctctagtaaccaaggcggtggaggtttaggcctcgaaaccctcccagctcttgaggagggcctgactcgtgaagagtag

SEQ ID NO: 50100 - DNA, 642 bp, Artificial Sequence
  Description of Artificial Sequence: Synthetic coding sequence
atggatccactgcagaagcgaaacccagcatctccctctaagagcagccccatgactgccgcagagacctcacaggaaggtccggctccatcccagcccagctactctgaacagcccatgatggggctgagcaacttgagtcctggtccaggaccttcccaggccgtgccactgccggaggggctgctgaggcaacgataccgcgaggagaaaaccctggaggagaggaggtgggaacgcctggaattcctgcaacggaaaaaagcctttctgaggcacgtgagaagaagacacagggatcacatggcaccttacgcggtcgggcgagaggctaggatctctcctctgggagaccgctcacagaacaggttcagatgcgagtgtaggtactgccagtcccatcgccctaacctgtcagggatccctggggagtccaacagagccccacacccgagcagttgggagacactcgtgcaaggactgagtggtctgacgctctccttgggaactaaccagccaggccctctccccgaggcggctctgcagcctcaggaaaccgaggagaaaagacagcgtgagcgccagcaggaaagtaagatcatgttccagaggctgctcaaacaatggttggaggaaaattag

SEQ ID NO: 50101 - DNA, 642 bp, Artificial Sequence
  Description of Artificial Sequence: Synthetic coding sequence
atggaccccctgcagaaaagaaatccagcctcgccctctaaatcctcgcctatgacggccgcagagacatcccaggaagggcctgccccatcccagccaagctactctgagcagccaatgatggggcttagcaacttgagtccaggacccggaccatctcaagccgtacccctgcccgagggtttgctgaggcagcggtatcgggaggagaagaccctagaagaacgtaggtgggagcgactcgagtttctgcagagaaagaaggcctttttgcgacatgtccggaggcggcacagagatcatatggctccctacgcagtcgggagagaagccaggatctcaccactcggggaccggagccaaaatcgctttagatgtgaatgccgctactgtcagtctcataggcctaacttatcaggaattcctggcgaatctaaccgggcaccgcaccctagtagctgggaaaccttggttcaggggctctcaggccttacactgagccttggcaccaatcagcccggacctttacctgaagcagccctgcagccccaagaaaccgaagaaaagcgtcagcgagagaggcaacaggagtccaaaataatgtttcagcgccttcttaagcaatggttggaagaaaattag

SEQ ID NO: 50102 - DNA, 642 bp, Artificial Sequence
  Description of Artificial Sequence: Synthetic coding sequence
atggaccctctccagaaacgcaatcccgcatctccttcgaagagttccccgatgacagcagctgaaacatcccaggagggtcctgcaccttctcagccctcctatagcgaacagcccatgatgggactttctaacctgtccccagggccaggcccatcacaggccgtcccccttcccgaaggtcttttgcgacagaggtatagagaagaaaagaccctcgaagaacggaggtgggaacggctcgagttcctgcagagaaagaaagctttcctcagacatgttcgaagacggcaccgagaccatatggcaccatatgctgttggtagagaggccaggattagtccactgggcgacagatcgcaaaatcggttcagatgcgaatgtcgctattgccaatctcacagacctaatttgtctggcataccaggtgaatccaatcgagcaccccacccttcttcctgggagacgctggtgcaaggtttatctggtctgactctcagcctgggaactaaccaacccggaccgctgcccgaggccgcattgcagccgcaagagacagaggaaaagcgtcaacgtgagagacagcaggagtcgaagattatgtttcagaggctgctgaagcaatggctcgaggagaattag

SEQ ID NO: 50103 - DNA, 381 bp, Artificial Sequence
  Description of Artificial Sequence: Synthetic coding sequence
atggaccctttacagaagcgcaacccagcaagtcccagcaaatctagccctatgacagcggctgagacatcacaggaaggaccggctccgagccagccaagttacagtgagcaaccgatgatgggcttaagcaacttgtctccagggcctgggcctagccaggcggtacctctacccgaaggactgctcaggcagaggtatcgagaggaaaaaactttggaggaacgtcggtgggagcggctggaattcctccaaagaaagaaggcttttttaagacatgtaagacgcaggcaccgtgaccacatggcgccatatgctgttggaagggaggctcggatcagtcccctgggcgatcgttcccagaaccggttccgctgttag

SEQ ID NO: 50104 - DNA, 555 bp, Artificial Sequence
  Description of Artificial Sequence: Synthetic coding sequence
atggatccccttcagaagcggaatccggcatcgccttcaaaatctagccccatgaccgccgctgagaccagccaagagggtccagcaccaagccagccaagttatagtgaacagccaatgatggggctgagcaatttatcgccgggtcccggacctagccaggctgtgcctttgccagagggactgctgcgccagagatatagagaagagaaaacattggaagagcgcaggtgggagcgcctggagttcctccaacggaagaaggcattccttcgtcacgtacgcaggaggcaccgggatcacatggcaccgtacgcagtcggacgcgaagctagaatttcaccactgggcgaccgcagtcagaacaggttcaggtgtgagtgtcggtattgtcagtcccaccggcctaacctgtccgggattccaggcgagtctaatcgagctccgcatccgtccagctgggagaccctcgtccagggcctatcgggactcactctgagtctgggtaccaaccagcccggtcccctacccgaagcagctcttcagccacagtag

SEQ ID NO: 50105 - DNA, 642 bp, Artificial Sequence
  Description of Artificial Sequence: Synthetic coding sequence
atggaccctctgcagaagcggaacccagctagtccttccaaaagcagtccaatgacagcagccgagaccagccaggagggcccagcgccatctcagccatcatattctgagcagccaatgatgggactgtccaatctgagtcctggtccaggtccatcacaggccgttccattgcctgagggattgttacgacaacgttatagagaagaaaagaccctggaagagcgccgatgggagcggttagagtttttacagcggaagaaggcattcctacgccacgtgcgacggcgacatagagatcacatggctccttatgcagtgggaagagaggcccgtatttcacccctcggagaccgctcacagaatcggttccgatgtgagtgccgctactgtcagtctcatcgccctaacttgtcaggtatccccggagagtccaatcgggctccacatccatcatcttgggaaaccctcgtgcaggggttgagcggtcttacactgtccctggggaccaaccagccagggccactccccgaggccgctctgcagccccaggagactgaggagaagagacagagagagaggcagcaagagtcaaaaattatgttccagaggttgttgaaacagtggttggaggagaattag

SEQ ID NO: 50106 - DNA, 33 bp, Artificial Sequence
  Description of Artificial Sequence: Synthetic coding sequence
atggatccattgcaaaagcggaacccggcatag

SEQ ID NO: 50107 - DNA, 567 bp, Artificial Sequence
  Description of Artificial Sequence: Synthetic coding sequence
atggatcctctgcagaaacggaaccccgcttcaccatccaagtcatcaccaatgaccgccgctgaaacaagccaggagggccctgccccttcccagcccagctactcagaacagccgatgatgggactgtccaatctgagtccgggtcctggtccctcacaggccgtgcccctccctgaagggctgcttcggcagcggtacagagaggagaagacactagaagagagacgttgggaacgcctggagtttttacaacgaaaaaaggcctttctacggcatgtgcgcaggcgacacagggaccacatggcgccatatgctgtcggacgtgaggcacgtatctccccattgggcgatcggtcgcagaacagatttcgctgtgagtgtcgttactgccagtcccacaggcctaaccttagcggcatacctggagagagcaaccgagctccgcatccttcttcctgggaaaccctggtccagggcctctccggcctgaccctgagtcttggaactaatcaacctgggcctttgcccgaggccgcactacagccccaggagacggaagaatag

SEQ ID NO: 50108 - DNA, 327 bp, Artificial Sequence
  Description of Artificial Sequence: Synthetic coding sequence
atggaccctttacagaaacgtaacccggcttctccttctaagtcttccccaatgacggcagcagagacctcacaggagggacccgctccctcacaaccttcttactccgagcaaccgatgatggggctgagcaacctcagccccggaccagggccaagccaggcggtgccactgccagaagggttgctcaggcagcgataccgcgaagagaaaacgctggaggaacgacggtgggagaggttggagttcttacagcgcaagaaagcattcctgaggcacgtgcgcagacggcatcgagaccacatggcgccttacgccgttggctag

SEQ ID NO: 50109 - DNA, 336 bp, Artificial Sequence
  Description of Artificial Sequence: Synthetic coding sequence
atggacccactgcaaaaaaggaaccccgctagtccatctaagtcctccccgatgacggctgcagagactagtcaggagggaccagctccgtctcagccctcttactccgagcagcccatgatgggattgagcaatttgagtcctggacctggaccatcccaagccgtgcccctgcctgagggcctgctgcggcagagatacagagaggaaaagacgctggaagaacgacgctgggaaaggcttgagttcctgcagaggaaaaaggccttcctccgacatgtacggaggcgtcaccgtgatcatatggctccttacgcagtgggacgtgaagcatag

SEQ ID NO: 50110 - DNA, 396 bp, Artificial Sequence
  Description of Artificial Sequence: Synthetic coding sequence
atggacccactgcagaagaggaaccctgcctctccctcaaagtcaagccctatgaccgccgcagaaacctcccaggaggggccagccccttcccagccttcctactcagagcagccaatgatggggctgagcaatctgtctcctggaccaggcccatcacaggctgtgcccctccccgaaggcctacttcggcaaaggtaccgtgaggaaaagacattggaggagagacgctgggagcggctggaatttctgcagcggaaaaaggctttcctccgccacgttaggagaaggcacagagaccatatggcaccctatgcggtgggacgcgaagctcgcatcagtcccctgggggatcggtcccagaaccgcttcaggtgtgagtgtaggtattgctag

SEQ ID NO: 50111 - DNA, 12 bp, Artificial Sequence
  Description of Artificial Sequence: Synthetic coding sequence
atggacccctag

SEQ ID NO: 50112 - DNA, 258 bp, Artificial Sequence
  Description of Artificial Sequence: Synthetic coding sequence
atggatcccctgcagaagcggaaccctgcgagtcccagcaaatcaagtcccatgacagccgcagagacctcccaagaaggtcccgcaccctctcaaccatcttattccgagcagccgatgatgggattgagcaacctgtctcccggaccgggtccctcccaagcagtcccactgcccgagggtctgcttagacagagataccgcgaggagaaaacactggaagagcgaagatgggaaagacttgaatttctgcagtag

SEQ ID NO: 50113 - DNA, 642 bp, Artificial Sequence
  Description of Artificial Sequence: Synthetic coding sequence
atggaccctctacaaaagaggaatcctgcctcgcccagcaagtcctctccaatgacagccgctgaaacaagtcaggaagggccagcgccttcccaaccttcttacagtgagcagccaatgatgggcttgagcaacctgtcgcccggtcctggaccatctcaagcagttccactgcctgaggggctgctccggcaaagatacagagaggaaaaaaccttggaagagcgccgttgggaaaggcttgaattcctgcagcggaagaaggcctttttgaggcacgtgcggaggcggcacagggatcacatggcgccatacgccgtgggacgcgaggcaagaatctctcctctcggtgacaggagccagaatcgctttcggtgtgaatgccggtattgccagtctcatcggcctaatctgtcgggtatccctggagagtccaatcgggcaccacacccatcctcctgggagacactggtgcaaggacttagcgggttgaccctgtccctcggcaccaatcagcccggtcctctcccggaggctgccctgcagccccaagagactgaggagaagcgtcagagagaacgacagcaagaatccaagataatgttccagcggctccttaagcagtggctggaggagaattag

SEQ ID NO: 50114 - DNA, 642 bp, Artificial Sequence
  Description of Artificial Sequence: Synthetic coding sequence
atggaccccctgcaaaagcggaatcctgctagcccgtctaaaagttccccgatgacggcagctgagacatcacaagagggccctgcaccatctcagccctcctacagtgagcaacccatgatgggccttagcaacctctctcctggccctggcccttcccaagctgtacccctgcccgaagggctgctgcggcagcgttaccgagaagagaagacactcgaagagcggaggtgggagcgcttagagtttcttcaacgtaaaaaggccttcctcagacatgtgagacgtcgccatcgggatcacatggcgccttatgccgtgggtcgggaggccaggattagcccgctgggggatcgatcacagaatcgcttccgatgcgagtgccggtattgtcagagtcataggcccaatctgtcagggatccctggcgagagtaaccgggcacctcaccctagcagctgggagactctggttcagggtcttagcggactgaccttatctcttgggactaatcaacctggccctctaccagaggccgcactgcagccacaggagacagaggagaagcgccagcgcgaaagacaacaggagtccaaaattatgtttcagcggctgctgaaacagtggctggaagagaactag

SEQ ID NO: 50115 - DNA, 642 bp, Artificial Sequence
  Description of Artificial Sequence: Synthetic coding sequence
atggacccgctgcagaaacgcaacccagcaagtccctcgaagagctctccaatgacagcagccgaaaccagtcaggagggcccagcccctagccagccatcttactccgagcagcccatgatgggcttgtccaacctgtctccagggcctggtccatcccaggctgtacccctccctgaaggtctgttgcgccagaggtacagggaagaaaagacccttgaggaacgtagatgggaaagactggaattcctgcagaggaaaaaagccttcttgcgtcacgtgcggcgaaggcatagggaccacatggctccttacgctgtgggccgtgaggctcgcattagtcccctgggagataggtcacaaaatagattccgctgtgagtgccgctattgccaatctcacaggccaaacctctctggtattcctggcgaatccaatagagctccacacccttcctcatgggagaccctggtgcaggggctcagtggactcacactctctctcggtacaaaccagcctggacccctgcccgaagcggcattacagccccaggaaactgaagagaaaagacagcgggagcggcagcaggagtccaagatcatgtttcaacgccttctgaaacagtggttagaggagaactag

SEQ ID NO: 50116 - DNA, 642 bp, Artificial Sequence
  Description of Artificial Sequence: Synthetic coding sequence
atggaccctctccagaaaaggaatccagcctcccctagcaagtccagccctatgactgcagctgaaacaagccaagagggcccagctccttctcagcctagttactccgaacaaccaatgatgggcctctctaacctgtctcctggccctggacccagccaagccgtcccactgcctgagggcctcctgcggcaaaggtacagggaagaaaagacgcttgaggaacgcaggtgggagcggctagagttcttacagagaaagaaagcctttctaaggcacgtgaggagacggcacagagaccacatggctccatacgcagtcggccgagaggccagaatttcccctttgggtgaccggagccagaatcgatttcggtgtgaatgtcgctactgccaaagtcaccgacctaacctgtcaggcatccctggagagtcaaaccgcgcacctcacccatctagctgggagaccctggtgcaaggattgtctggactgaccttgagcttaggaactaatcaaccgggtccgctccccgaggccgcacttcaaccccaggagaccgaggaaaagcggcagagagaacggcagcaggaatccaagataatgttccagcgtctgctcaagcagtggctggaggagaactag

SEQ ID NO: 50117 - DNA, 642 bp, Artificial Sequence
  Description of Artificial Sequence: Synthetic coding sequence
atggatcctctgcagaagagaaacccagcttcccctagcaagtcctcccccatgacagcagccgagacttctcaggagggccctgcacccagccaaccatcctattccgaacagcccatgatgggcctttcaaatctaagtcccggacccggaccctcccaagcagtgcctctgcccgagggcttgcttagacaacgatatagggaggagaagacgttagaggagaggaggtgggagcggctggaattcctccagaggaagaaagcgtttttgcggcacgtccgtagaagacatcgagaccacatggcaccatacgctgtcggtagggaggctcgcatttcaccactgggtgacaggtcccagaatcgtttcagatgtgagtgtagatactgccagtcccatcgcccaaacttgagcggaatcccaggcgagtcaaatcgcgctccacatccttcatcttgggaaacactcgtgcaaggactgagcggtctaaccctgtctctgggaacaaatcagcctggcccactaccggaggcagccctccaaccccaagaaacggaagagaagaggcagcgggaacggcagcaggaaagcaagataatgtttcagaggctgttgaagcagtggctcgaagaaaactag

SEQ ID NO: 50118 - DNA, 642 bp, Artificial Sequence
  Description of Artificial Sequence: Synthetic coding sequence
atggaccctctccagaagcgcaaccctgcttcccccagtaaatcaagtcccatgacagctgccgaaacctctcaagaagggccagcccctagccagccctcttatagtgagcagccaatgatgggtttgtcaaatttatcacccggaccgggacctagtcaggctgtacccctgccggaaggcctgctgcgtcagcggtaccgcgaagagaagaccttggaggagagacggtgggagcggctcgagttcctccagagaaaaaaagcttttctgcgacatgtgaggagacgacatcgggatcacatggcaccatacgccgtcgggagagaggcgagaatcagccccctcggggatcgcagccaaaacaggtttaggtgcgaatgcaggtattgccaatctcacaggccgaatctctcaggaatccccggtgaatccaatagggctccgcatccgtcctcttgggaaaccctggtgcaggggctgagtggcctgacactgtctcttggcacaaatcagccagggcctttgcctgaggcggctctgcagccacaggaaacagaagagaagagacagcgtgagcgccagcaggagagtaaaatcatgtttcaaaggttgctgaagcagtggttggaagagaattag

SEQ ID NO: 50119 - DNA, 642 bp, Artificial Sequence
  Description of Artificial Sequence: Synthetic coding sequence
atggatccactccaaaagcgtaaccccgcaagcccaagtaagagctcccctatgaccgccgctgagacctctcaggagggacccgctccgagccaaccttcgtatagcgagcagcccatgatgggacttagcaacctgtcccccggtccaggccctagtcaggccgtgccgctgccagaggggctgctcaggcagagatacagagaagagaagaccctcgaggagagacgatgggaaagattagaattcctgcaacgcaagaaggcctttttaaggcacgtgcggagaagacacagggatcatatggccccatacgctgtgggtagagaggccaggatctcgccgctcggcgaccgttcccaaaaccgtttcagatgcgagtgcagatattgtcagagccatcgcccaaatctctctggcatccctggcgaatccaatcgggctcctcatccaagctcctgggagactttagtccaaggcctgtcaggactcaccctgtctcttggtaccaatcagcccggacccctccccgaagccgctttgcagcctcaagagacagaagaaaaacgccagcgcgagcgtcagcaggaatctaagatcatgttccagcgactcttgaaacaatggttggaagaaaactag

SEQ ID NO: 50120 - DNA, 573 bp, Artificial Sequence
  Description of Artificial Sequence: Synthetic coding sequence
atgtcaggcgcatgcacctcttacgtctccgctgagcaggaggttgttcggggtttttcctgccctaggccgggaggcgaagcggctgctgtgttttgttgtggttttagagatcataaatactgctgcgatgacccacacagcttttttccctatgagcattcatatatgtggtggctgtcaataggcgcactgattgggctttcagtggctgctgtagtgctgctggcctttatcgtaaccgcatgtgtgctctgctacctttttatctcttccaagccacataccaagcttgacctcggtttgagcctgcagaccgctggccctgaagaagtgagtccagattgtcaaggcgtcaatacagggatggctgccgaggtccctaaggtgtctccactgcagcagtcatatagctgcctgaatccccagttagaatccaatgaaggacaggcggtgaacagcaagagactgctacaccactgcttcatggcgaccgtgaccacttctgacatccctggctccccagaagaagcttctgtcccaaaccccgatctttgcggacccgtcccgtag

SEQ ID NO: 50121 - DNA, 510 bp, Artificial Sequence
  Description of Artificial Sequence: Synthetic coding sequence
atgggatctctgagcggtttacggctggccgctggaagttgtttcagactgtgtgaaagggatgtttcctcttctttacggttgacaagatcaagcgatttgaagaggattaacgggttttgtactaagccacaggaaagccctggagccccttcccgccatctgcagcaaagcgcctttacacagacgtatggcttagccgaaaaggaccctcatatggttagatctttgcaggaagatgaaattccagaaacggtgtccctggaaatgttggacgccgctaaaaacaaaatgcgcgtgaaaatatcttacttaatgattgctcttaccgttgtaggatgcatattctggctgctgcgggcaaggtcctgtccaaaaacacgggactttaacaagctcgaactgagaaaagagagctcctccgagcgcggatcctcttacgaaggtcagaatagagtcgcagaggtgtctgtgctggctatcttaaaaatccaagaactgtgttattag

SEQ ID NO: 50122 - DNA, 465 bp, Artificial Sequence
  Description of Artificial Sequence: Synthetic coding sequence
atgggctccttgtcaggtttaaggctggcagctggctcatgcttccgcctatgcgagagagacgtgtcttcctccctgagactgactcggagtagcgatctgaaaagaatcaacggcttctgtactaagccacaggagtcccctggcgctccctctagaacttacaaccgggtgcccctccacaagcctacagactggcagaagaagatccttatttggagtggcaggttcaagaaggaggacgagattcctgagacggtcagcctcgagatgctcgacgcagccaaaaacaagatgagagttaagatcagttatctcatgatcgctctaacagtagtgggatgtatttttatggtcatagaagggaagaaagcggctcagcgtcacgagactttaacttctcttaacctcgagaaaaaagccaggctaaaagaagaggcagctatgaaagccaagacagaatag

SEQ ID NO: 50123 - DNA, 489 bp, Artificial Sequence
  Description of Artificial Sequence: Synthetic coding sequence
atgctgcgggcagtggggtcactactgaggttaggcaggggcctcactgtgcggtgcggtcctggagccccattagaggccactcgtcgccctgctcctgcccttcccccacggggacttccctgttattcaagcgggggagctcccagcaactcagggccacaaggccacggcgagattcacagggtacccacacaacgtaggcctagtcagttcgacaagaaaatccttctctggactggaaggtttaagtctatggaagaaatccccccaagaatcccccctgagatgatcgacactgcacggaacaaggcaagagtaaaagcatgttacattatgatcgggctgacaattatcgcttgttttgcggtaatagtctctgccaagcgcgcagttgagcggcacgagagcttaacctcttggaatttggcaaaaaaggccaaatggcgggaagaagcagccctggcggcacaggctaaagccaaatag

SEQ ID NO: 50124 - DNA, 504 bp, Artificial Sequence
  Description of Artificial Sequence: Synthetic coding sequence
atgaccgccggaactgtggtgatcaccggtggaatattagcgacagtcatattgctgtgtattatagccgtgttgtgctattgtcgcttacagtactactgctgtaagaagtcagggactgaggtagctgatgaggaagaggaaagagagcatgaccttcctacccatccaaggggacctacctgcaacgcttgttccagccaggccttagacggaaggggcagcctcgctccactcacctctgaaccttgcagccagccctgcggcgtcgctgccagtcattgcaccacatgttcaccatactcctctcctttttatatccggaccgcggacatggtcccaaacggcggaggaggagagcgtctctcgtttgcccctacgtattacaaagaggggggtccgccaagcctaaagctggcagccccacagtcataccctgttacttggccaggttctggcagagaggctttcaccaacccaagagccatcagcaccgacgtttag

SEQ ID NO: 50125 - DNA, 501 bp, Artificial Sequence
  Description of Artificial Sequence: Synthetic coding sequence
atgacagcaggaactgtggttatcaccggaggtatattggcgacagttatcttgctgtgtatcattgccgtcctttgctactgtcgccttcaatattactgttgcaaaaaggatgaatccgaagaagacgaggaagagcctgactttgcagtccacagtcacctgccccctctccactctaaccggaaccttgtgctgacaaatggccctgctctctatcctacagcctcaaccagtttcagtcagaaatctccccaggcccgtgctctgtgccggtcttgttcccattgtgagccgcctacgttctttttgcaagagcctcccgaagaggaggaagacgtccttaacggtggcgagcgggtgctgtataaatctgtcagccaggaagatgtggagctcccaccaggaggatttgggggtctgcaagctttaaaccctaaccgcctgtccgcgatgcgagaagcattcgctcggtcacggtctatcagcactgacgtctag

SEQ ID NO: 50126 - DNA, 501 bp, Artificial Sequence
  Description of Artificial Sequence: Synthetic coding sequence
atgaccgccggaaccgtggtgatcacggggggaatattagccacagtgatactgctctgtatcatagccgtgctgtgttattgcagactccaatactactgttgtaagaaggatgagtctgaggaggacgaagaagagccggatttcgcggtgcattcccatctaccgccacttcattccaatcgcaacctggtactcactaacggccctgccctctatcccactgcaagcacatcgttttcccagaagagtccccaggcgagggctctgtgccggagttgtagccactgtgaaccgcctaccttctttctccaggagccacccgaggaggaggaggatgtcctaaacgggggtgaacgagtcctatataaaagcgtatcacaagaggatgttgagttgccgcctggaggcttcgggggtctccaggctctgaaccccaatagactgtccgccatgcgtgaggcgttcgccaggagccggagcatctcaacagacgtgtag

SEQ ID NO: 50127 - DNA, 177 bp, Artificial Sequence
  Description of Artificial Sequence: Synthetic coding sequence
atgaactggaaggtgttagaacacgtgcaccttcttctttatatcctcgcagccaagaccttgatcctgtgcttagcttttgcaggtgtgaaaatctatcagcgcaaacgcttagaagccaaacaacagaaactggaagccgagagaaaaaaacaaagtgaaaagaaggataattag

SEQ ID NO: 50128 - DNA, 177 bp, Artificial Sequence
  Description of Artificial Sequence: Synthetic coding sequence
atgaactggaaggtactggaacacgtccccctactcctgtatatcctggccgctaaaactctgatcctttgcctgacttttgctggagtgaagatgtatcagagaaaacgactggaggccaagcagcagaaactggaggctgaacggaaaaagcagagcgaaaagaaagacaattag

SEQ ID NO: 50129 - DNA, 177 bp, Artificial Sequence
  Description of Artificial Sequence: Synthetic coding sequence
atgaactggaaagtgcttgagcacgtccctctactgctttacatcctggccgctaaaactctcatactgtgtctgacctttgcaggggtaaaaatgtatcaacggaagcggctagaagctaagcagcagaagttggaagctgaacgaaagaaacagtctgagaagaaggataattag

SEQ ID NO: 50130 - DNA, 597 bp, Artificial Sequence
  Description of Artificial Sequence: Synthetic coding sequence
atgagtcgatccgctaccctcctcctttgcctgttgggttgtcatgtttggaaagccgtaacgaaaacgcttcgggagccaggagccggtgctcaagaggtaaccttgaaggtgcatatttctgatgcctccacacatcagcccgtcgccgacgccctcatagagatctttacaaaccaggccagcattgcctccggaacttccggaacagacggagtagccttcataaagttccaatacaaactgggatcgcagctcattgttactgcttcaaaacacgcgtacgtgccgaactctgccccttggaagcctattcgactgcctgtgttttcatcactcagcctgggtctgctgcctgagagaagcgctactctcatggtgtatgaggacgtcgttcagattgtatccggatttcaaggtaactcaacgcggcacgacctcacccccgtaaccgctgtatccgttcatctcttgagctctaatgggactcccgtgctggtggacgggccaatttacgtcaccgtgccactggctacccagagcagcctacggcataacgcatatgtagccgcttggcgcttcgatcagaaactctag

SEQ ID NO: 50131 - DNA, 2673 bp, Artificial Sequence
  Description of Artificial Sequence: Synthetic coding sequence
atgtcacgcagcgctactctactgctgtgcctcctgggttgccacgtctggaaggccgtaaccaaaacactgagggagccaggcgctggcgctcaggaggtgaccttaaaggttcacatatctgacgcatctacacaccagcccgtggcggacgccctcattgagatttttactaaccaggcctccattgcttcgggtactagcggaacagatggcgtggcctttataaaattccagtataaacttggctcacagctcatcgtcactgcatcgaaacacgcctacgttcccaactcagctccatggaagcccatccgcctccccgtgttctcttccttaagcctggggctcctgcctgagaggtcagctacactgatggtttatgaggatgtagtccaaatagtgtcggggttccagggtgccagaccacagcctcgcgtccactttcaaagacgggcattacgcctgcccgaaaacacaagctacagcgacctgacagcttttctgactgccgcatctagtccatcagaggtggattcttttccctatctgagggggctcgatggaaatgggacaggaaactcaactcgccacgatctgacaccggtgaccgccgttagcgtgcatctcctttcgtccaatggcacgcctgtgcttgtggatggacctatctacgtgaccgtacctctcgcgacccaaagtagcctgagacataatgcctacgttgcagcctggagatttgaccagaagttgggaacatggctcaaatctggactcggactcgttcatcaagaggggagtcaattgacttggacctatattgctccccagctgggttattgggtcgccgctatgtcccctcctatccccggtcccgttgtcactcaggacattacaacataccacaccgttttccttcttgccattttaggagggatggccttcatacttctcgtcctgctgtgtcttctgctatattactgtagacgaaagtgtctaaaacccagacaacatcatcgcaagctgcagctcccagcgggtcttgagtcgtctaaaagagatcaaagcacgagcatgtcccacatcaatctacttttttcgcggagagcatctgagtttccaggaccactttctgtcaccagccacgggaggcctgaggcaccgggaactaaagaactcatgtcgggggtacatctggaaatgatgagtcctgggggagaaggcgacctgcacacgcctatgctcaagctgtcctattctactagtcaggagttctcgtcacgcgaggagctactgagctgcaaggaagaggataaaagtcagatttcttttgataacctgacgccctcaggtacgttgggaaaagactaccacaaatctgtcgaagtttttccactgaaggcgaggaagtcaatggagcgtgaggggtatgagagctccgggaacgacgactataggggctcctacaacaccgtcctgtctcagccactcttcgagaagcaggaccgggagggaccagccagcaccggcagcaagctgaccattcaggagcacttgtatccggctcccagctcgccagagaaagaacagctgctggaccggaggcccactgagtgtatgatgagcagaagcgtggaccacctggagaggcctaccagtttccctcgcccaggccaattgatttgttgtagttccgtggatcaagtgaatgattccgtttatagaaaggtgttgcccgctctggtgatcccggcacattatatgaaattgccaggggaccacagttacgtatcacagcctctggtggtgccagccgatcagcagctcgaaattgaaaggctccaagctgagctgtccaacccccatgctggtatttttccccaccccagttcacagatacagccacagcccctgtctagtcaggccatatcccaacagcatctgcaggatgctggcacccgagagtggagcccgcaaaacgcttccatgagcgaatctctgagtatcccagcttctctaaatgatgccgcattggcccagatgaactccgaggtccaattacttacagagaaagctctcatggaactcggaggcggtaaacctttaccccatcctagagcgtggttcgtgagcctggatggacgctccaatgctcatgtgcgacatagttacattgatttacagcgagccggacgcaacgggagcaatgatgcttccctcgattcaggcgtggacatgaatgagccaaagtcagcgaggaaagggaggggagacgctctgtctctgcagcagaattacccgcctgtgcaggagcaccaacagaaagaacctagggctcccgatagtaccgcctatactcagcttgtgtatcttgacgatgtcgaacaaagcggttccgagtgtggaactacagtctgcacgcccgaagacagcgccctccggtgcctgttagaggggtctagcaggagatccggcggacaactccccagtctacaggaagagacaaccaggcgcacagccgatgcccctagcgaaccagctgcaagtcctcatcagcgaaggtccgcccacgaggaggaagaagatgatgatgacgacgaccaaggcgaggacaaaaaatccccgtggcagaaacgcgaagagcggcctctgatggcctttaatattaagtag

SEQ ID NO: 50132 - DNA, 2670 bp, Artificial Sequence
  Description of Artificial Sequence: Synthetic coding sequence
ggtggcgacgaacaagtacgtgatgccgctgccgtgccagcaggcctgccacgacttgaggggggtgatactttacgcgagcccggagcgggtgctcaagaggttacgctgaaagtccatatttctgatgcaagcactcaccaacctgtggcggatgcccttatcgaaatttttactaatcaagctagtatagcatcagggacttcagggaccgatggggtcgcctttattaagttccagtataaattgggctcccagcttatcgtgactgcatccaagcacgcctacgtgcccaactctgctccttggaaacccatccgtcttcccgtcttctcatctctgagcctcggactgctccctgagagaagcgcgaccctcatggtgtatgaggacgtcgtccagattgtgtctggttttcagggcgctcggcctcagccacgggtccattttcagagacgggctctgcgcctacccgaaaacacctcctactcggacctgaccgctttcctcaccgccgcttcttccccctctgaagtggattcatttccatatttgaggggtctcgacggcaatggaacagggaatagcactcgacacgatctgacccccgtcacagccgtgtccgtacatttgctgtcctccaacgggacccctgttctagtggatgggcctatttacgtgacggtgcctctggccacccaaagtagcctacggcacaacgcctacgttgcggcttggagattcgaccagaaactcgggacctggctgaagagtggactgggactggtgcatcaggagggctcccagctcacttggacctacatcgctccccagctgggctactgggtggcagccatgtctccccctataccaggtcctgtggtgacacaggacattacaacctaccataccgtatttctactggctattctcggtggtatggctttcatcctgctggtcctgctgtgcctgctgctctactattgtagaagaaagtgcctgaagccgcgtcagcaccaccgaaagctgcagctcccggctggccttgagtcttcaaaaagagaccaatccacttccatgtcccacattaatctgcttttcagccggagagccagcgagttcccagggcctctgagcgtgacatcgcacggcaggcccgaagcgcctgggaccaaagagttgatgtcaggtgttcaccttgagatgatgtctcctggcggagagggcgatcttcacacgccgatgttgaagctcagttatagcaccagccaggagttctctagcagagaggaactactgtcctgtaaagaggaggacaagtcacaaattagttttgacaatctgacaccctctggaacactgggcaaggattaccacaagagtgtagaagtgttcccattaaaagccagaaaatccatggaaagggaagggtacgagagttctatgatgacaaccggggtggtgacaacgccatgcagtcacagcctgtatctcaaaagccgcactgaaaaggtgcagcccccaagagaggctaactctccattcaggaatatttgtacaccaaggctgcatcatctccggaaaaactcatgttggaccgccgatccgctgaatatgatgagtagatcggtggatcacctggagcgccctactagttttcctcgaccgggtcagctgatctgttgcagctccgtggatcaggttaatgactctgtatacagaaaggtgctccccgctctggtgatacctgctcactatatgaaattgccaggtgatcacagctacgttagtcagcctctcgtggtgcccgcagaccagcagcttgagattgaacgcctgcaggcagagctttctaatcctcatgctggcatcttcccacatccgtctagccagattcaaccccaacccctgtccagtcaggcaatttcacagcagcacctgcaggatgccggaacaagagaatggagcccccagaatgccagcatgtccgagtctctctccatacccgcatcactgaacgacgccgcactggcccagatgaatagcgaggtacagttgctgaccgagaaggcccttatggagttgggtggtggtaaacctctgcctcaccccagggcatggttcgtgtctcttgacggtaggagcaacgcgcatgtaaggcattcatacatcgatctgcagcgtgccggaaggaatggtagtaacgatgcttctctcgattctggcgtggatatgaatgaacctaagagtgcacgaaaaggcagaggtgacgccctttcgctgcagcagaactaccctcccgttcaggagcaccaacaaaaggagccacgggcacccgatagtaccgcttacactcagctggtttatctggatgatgtggaacagagcggcagcgagtgtggtacgaccgtgtgcactcctgaggactccgcacttcgttgcctcctcgaggggagtagcagacgcagtggtggacagttgccatctttacaggaggagactacccggagaacagccgacgctcctagcgagccagccgcaagccctcatcaacgtagatctgctcacgaagaagaagaggatgatgacgacgatgaccaaggagaggacaagaagagtccctggcagaaacgtgaggagcggcctctgatggcctttaacatcaaatag

SEQ ID NO: 50133 - DNA, 597 bp, Artificial Sequence
  Description of Artificial Sequence: Synthetic coding sequence
atgtcaagaagtgcaactcttcttctgtgcctccttggatgtcatgtgtggaaggctgtgaccaaaacgttgcgcgagccgggtgcaggagcccaggaggtcacgctcaaggtgcatatctccgatgcctctacccaccagcctgtcgcagatgccctgatagagatttttactaaccaggcctcaattgcaagtggtacaagcggcactgatggggtggccttcataaagtttcagtacaagctggggtcccaattgatcgtgactgccagtaagcacgcttacgtgcccaactcagctccttggaagcccataagacttcctgtctttagttccctgtcattagggctgctgcccgagcgttccgcaactctcatggtgtatgaggatgtagtgcaaatcgtaagtggattccaagggaattccactagacatgatctcacacccgtcactgcggttagcgtgcaccttctaagcagcaatgggacacccgtccttgtggatggccctatctatgttaccgtgcctttagccacccagagctctctcagacacaacgcatacgttgccgcttggcgctttgatcaaaaattgtag

SEQ ID NO: 50134 - DNA, 2481 bp, Artificial Sequence
  Description of Artificial Sequence: Synthetic coding sequence
atgccgccagcatcggggccttcagtcctggccagactgctcccacttcttggcctactgctggggagcgcgtcccgcgcaccaggcaagtcccccccagagccaccctccccccaggaaattctgatcaaagtccaagtgtacgtatccggggaactcgttccacttgccagagctagcgtcgacgtgttcgggaataggaccctgttagcggctggcacaaccgactccgaaggcgtcgccacactccccctgtcctatcggctggggacttgggtgttagtgaccgctgcacgtcccggatttctgaccaactctgtcccttggcgagtggataagctgccgctgtacgcctcggtctcactatacctactgccagagagacctgccactcttattctgtacgaagatctggtgcacattttgctgggctcccctggggctcgcagccagcccctggttcagttccagaggagggctgcgaggctcccggtgagctccacctactcacagctgtgggcatctctgacgcccgcttctacccagcaggagatgcgggcatttcccgcattcctggggacggaagcttcctcatccggcaatgggtcatggctagagctaatgcctctgaccgctgtgtccgtccatcttctgacaggaaacggcacggaggtgccactctctggcccaatccatctgtcactcccggttccctcagagactcgtgcattaactgtcggcaccagcatccctgcttggcggttcgaccctaaatctggattatgggtcaggaacgggacaggagtgatcaggaaggagggcagacagttgtactggacgtttgtgagcccacagcttggctactgggtggctgcaatggcttcccctacagctggtctcgtgaccattacttctggcattcaggatatcggtacatatcatactatctttctcctgacaatcctggccgcactcgcactgctggtgctgatactgctctgcttgctgatctattactgtcggcgtcgctgtctcaagcctcgacaacagcaccggaagctgcagctgtcgggaccgagcgacgggaacaagcgcgaccaagcaacaagcatgtcacagctgcacctgatctgtgggggaccgctggagccagcacccagtggcgatcctgaggccccaccccctggcccactgcattccgctttctcatctagcagagatctggcaagctcccgggacgacttttttcgaactaagccaagaagtgcaagtagacccgctgcagaacccagtggagccagaggcggagagagtgctggtctgaagggagctcgtagtgcggaggggcctggtgggctggaacccggtttggaagagcaccggagaggaccttccggggcagccgcattccttcatgaacctccttccccccctcctccctttgaccactacctcgggcacaagggcgctgctgagggcaagacgccagacttcctgctgagccagtctgtggaccagctggcaagaccaccatccctgggccaggcgggacagctgatattttgcggttctatcgaccacctgaaggacaacgtctaccgaaatgtgatgccaaccctggtaattcccgcacattatgttagactcggcggtgaagcgggtgcagcaggcgttggggacgagccagcccctcccgagggaaccgcccctgggcctgcacgtgcatttccccagcccgatcctcagcgaccccagatgcccggacactccgggccaggaggggaaggcggaggcggaggcggagaaggatggggggcaggtcgcgcagcaccagtttcaggctcggtcacaatccctgtgctcttcaacgaaagcacgatggcccaactaaatggcgagctgcaggctttaacggaaaaaaagctactggaattgggagttaaacctcacccccgagcctggttcgtgagcttagacggacgatctaattctcaagtgaggcacagctatattgatctgcaagctggcggaggggctagaagcactgatgcctccttggactccggggtcgatgttcatgaagctaggccggcacggcgaagaccagcacgcgaggaacgggagagagcccctcccgcagcccctccgcctcccccagcccctccaagattggcactgtccgaagatacagagccttcaagctcagagagccggacgggcctgtgttccccggaagataactctctgactccactcctggatgaggttgccgctccagaagggagggcagccacggtgcccaggggcagagggaggtcacggggagacagctcccgaagctctgcttctgagctgcggcgagatagtctgacttctcctgaagatgaacttggcgcagaagtcggggacgaggcaggcgataaaaagagcccgtggcagaggcgtgaagaacgtccactcatggtcttcaacgtgaagtag

SEQ ID NO: 50135 - DNA, 1284 bp, Artificial Sequence
  Description of Artificial Sequence: Synthetic coding sequence
atggcgaggttatgccgtcgagtcccgtgcactcttcttctcggccttgccgtggtgctgctaaaggctaggctggtgcctgctgcagctagagctgagctcagtcgatccgacctctctctgattcagcagcagcagcagcagcaacagcagcagcaacaacagcagaagcagctggaagaggccgaggaagaaagaacagaggtgcctggtgccacaagcactctcacagtcccggttagcgtgttcatgctgaaagtacaggtcaatgacataatttccaggcagtacctcagccaggctgtggtcgaggtgttcgtgaattataccaagaccaattcaacggtcacaaagtccaatggcgcagtccttattaaggttccatacaaactgggcctgtctctcactattatagcttacaaggacggatatgtgttaactcccttgccctggaaaactcgacggatgcccatctatagctccgtcacactgtcgctcttcccacagtcccaggcgaacatctggttattcgaagatactgtactaatcactggcaaactggccgacgccaaatcccagcctagcgtccagtttagtaaagctctgatcaaactcccagacaatcatcacatctctaacgtcaccgggtacctgacagtgctgcagcaattcctgaaggtagataattttctccacaccaccgggatcacattgaacaaaccagggtttgaaaacattgaactgaccccgctggctgccatctgcgtcaaaatatatagtggaggcaaggagctgaaagtcaatggttctattcaggtgagtctgcctctgctgaggttgaatgatatttcggctggcgatcggattcctgcctggaccttcgacatgaatactggcgcttgggtaaatcacgggaggggcatggttaaagagcacaataatcatctcatctggacatacgacgcaccccacttgggatattggattgccgctccactgccagggactagggggtccgggatcaatgaggatagcaaagacattactgcataccacaccgttttcctgaccgccatcttgggaggaactatcgttatcgtcatcggttttttcgccgtcctcctgtgttactgtcgcgataagtgtggcaccccccaaaagcgtgagagaaatataaccaagctggaggtcctgaagcgagaccaaactacaagcaccacgcacattaaccacattcggaatcgccgtaagagtttccacggtaagaattctgggcgattctag

SEQ ID NO: 50136 - DNA, 2481 bp, Artificial Sequence
  Description of Artificial Sequence: Synthetic coding sequence
atggccagactgtgtaggagagtcccttgtacactcctcttagggctcgcagtcgttcttttaaaggcgagactggttcccgctgccgcaagagccgaactcagtagatctgacctctctctgatacaacagcaacagcagcaacaacaacagcagcagcagcagcaaaagcaattggaggaggcggaagaggagcggaccgaggtgcctggggcaacatctaccctgaccgtgcccgtttccgtgttcatgctgaaggttcaggtgaacgacatcatctccagacagtacctgtcgcaagcggtggtcgaggtgttcgtcaattataccaagactaattccacagtaaccaagagcaacggcgctgtgttaataaaggtcccttataaactgggactgagcctgaccatcatcgcctacaaggacggatacgtgttgacccctctgccctggaagacccgccgaatgcctatttactctagcgtgacgttgtccctgtttccacagagccaggctaacatttggctatttgaggataccgtcctgataacagggaagctggccgatgccaaatctcagcctagtgtgcaatttagcaaggcgttaattaaactccctgataaccaccacatatctaacgtgactggatacctgacggtgctgcagcagtttctcaaggtcgacaatttccttcatacaactggcattacccttaataagcctggctttgagaacattgagcttacacccttagcggctatttgtgtaaaaatctatagcggaggcaaagaactgaaggtgaatggatccatccaggtcagcctccccctcctcaggcttaatgacataagcgccggagaccggattccagcctggacctttgatatgaacactggtgcttgggtaaatcacgggagagggatggttaaagagcacaacaatcacctgatttggacatacgacgcgccacacctgggctattggatcgctgcgccactacctggaacacgcggatcaggaatcaatgaagacagcaaggacattaccgcataccataccgtttttctgactgctattctaggagggactattgtcatcgtgatcggcttttttgccgtactgttgtgttactgccgtgataaatgcggcacacctcagaaaagggaacgtaatatcacaaaactcgaggtgctgaagcgggaccagactacatctactactcatataaaccacatctccacggtgaaggtggccctcaaagccgaggacaagtcacagctcttcaacgctaagaattccagctattccccccagaagaaagaaccaagtaaggccgaaacagaagagagagtctcaatggtcaaaacaagagatgatttcaaaatctacaacgaggatgtgagtttcctgagtgtcaatcagaacaactattcaagaaacccaactcaatccctcgagcccaacgtgggaagtaagcaaccgaagcacattaataataacttaagtagttccctgggcgatgcccaagatgaaaagcgctatctaaccgggaacgaagaagcttatggcaggtctcatatcccagaacaactcatgcacatctattcacagcccattgccatactacaaacaagcgatctcttctccactccggagcagttgcacaccgcaaagtcagccactttaccacgaaagggccagctcgtatacggacagctgatggaacccgtcaatcgggaaaacttcacccagacactccccaaaatgcccattcactcacatgcccagcctccagacgccagagaagaggatatcatccttgagggccagcagtcgctgccctctcaggcgagtgattggtcccgatactcctctagtctgctggagagcgtgagtgtacctggtactcttaatgaagccgtggtgatgacgcccttttcgtcggaactgcagggcattagtgaacaaacgctccttgagctttccaaaggtaagccctctccccatccgcgagcttggtttgtgtctttggatggcaaaccggtcgcccaggtgaggcacagcttcattgacctgaaaaagggcaagcggacacagtctaacgatacgagcctcgattcgggggttgatatgaacgaactccattcctcacgcaaactcgaacgggagaagacttttataaagagtatgcaccagccaaaaatcctttacctcgaagacctggacctgagctccagcgagagcgggactacggtgtgctctccagaggacccagccttacgccacattctggatgggggatctggcgtgatcatggaacaccccggtgaagaatctcccggtcgcaagagcaccgtcgaagatttcgaggccaatacctccccaacgaaacgtagaggccgtccaccattagctaagagggatagcaaaacaaacatttggaagaagcgggaggaacgtcccctcatacctatcaattag

SEQ ID NO: 50137 - DNA, 708 bp, Artificial Sequence
  Description of Artificial Sequence: Synthetic coding sequence
atggagcaggacgatcccgtcgaagccctcaccgagcttcgcgagcgaaggctcggggcactggagctgttgcaggccgcagccggttcaggcctggctgcgtacgccgtctgggccttactgctgcaaccgggatttcgcagggtgccactgaggctccaagttccgtatgtgggcgcaagtgcacggcaggtcgagcatgtgctgtctctgcttcgcggtcggccaggaaagaccgtggatcttggttctggcgacggcaggatcgtgttagcagcccaccgctgtggcctgcgcccagctgtgggatacgagctgaatccctggctggttgctttggccagactgcacgcttggcgcgcaggatgcgctggcagcgtttgttaccggagaaaagatctgtggaaagtgtcactgagagattgccgcaatgtgagcgtatttttggccccttctgtgctgcccctgcttgaggataagctacgtacggaacttccggcaggggcaagagtggtttcaggccgtttccccctgcccacgtggcagcctgtgactgccgttggagaagggctggatagagtgtgggcttacgacgtgccagaagggggtcaagctggcgaggccgcttcatctcggattccaatccaagctgcccctgggcctagctccgcccctataccaggcggattaatctcacaggcaagctag

SEQ ID NO: 50138 - DNA, 879 bp, Artificial Sequence
  Description of Artificial Sequence: Synthetic coding sequence
atggcacaaccgcctccggatgtggaaggcgatgattgcctccccgcttacagacatctgttctgtcccgatctccttcgagacaaagtggcctttattacaggcggtggatcgggaatagggtttcgcattgcggaaattttcatgcgccacggctgccacactgtcatcgcctctagatccctcccaagggttctgactgcggctcgcaagctggcgggagccaccggccgacgttgtctcccattgagtatggatgtacgtgcaccgcctgccgtgatggcagccgttgatcaggcacttaaagagttcgggagaatcgacatcttgattaactgcgccgcaggcaatttcctgtgtcctgcaggagccttgagttttaatgcttttaagactgtgatggacatagacacttctggcacctttaatgtatccagagtgctctatgagaagtttttccgagaccatgggggagttatcgtcaacatcaccgccacactgggcaatcgtggccaggccctgcaggtgcatgcgggtagtgccaaagcagctgttgacgctatgacgcgtcacttagcagtggaatgggggccacagaatattcgggttaatagtcttgcacccggtccgatttccgggacagagggcctgagaagactgggaggaccccaggcctccctgagcaccaaagtgacagcaagccctttgcagagactgggaaacaaaaccgagatcgcccacagcgtgctgtatctcgcgtctcctctggcatcatatgtgacgggagcagtcctggtggctgatggtggcgcttggttgaccttcccaaacggggtgaaaggcttaccagacttcgcttcgttttcggctaagttatag

SEQ ID NO: 50139 - DNA, 702 bp, Artificial Sequence
  Description of Artificial Sequence: Synthetic coding sequence
atggaaggtggcggtggtataccactggagaccctgaaggaggagtctcaaagtagacacgtgttacctgcaagttttgaggtgaacagcctccagaaaagcaactggggctttctgctcacaggtcttgtgggaggcactctggttgcagtttatgccgtggcaacacccttcgtgacccccgcactgagaaaagtctgccttccctttgtacctgccactacaaaacagatcgagaacgtagtgaaaatgttgcgctgtcggagggggtctcttgtggatattggttcaggcgacggtcgcatcgtgattgctgccgctaaaaagggctttacagcagtgggctacgagctaaacccatggctggtgtggtatagtcggtatcgcgcatggagggaaggggtacacggaagtgctaaattctatatcagcgatctgtggaaagtaaccttcagccagtattccaacgtggtcatctttggtgtgccccaaatgatgctacagttagagaagaagctggagcgggaacttgaggacgatgccagagtaattgcgtgccgattcccgtttccacactggacccctgaccacgtgacaggagaaggaatagacaccgtctgggcctacgatgccagtactttcaggggcagagaaaaaaggccatgtacatcaatgcattttcagctcccgattcaagcctag

SEQ ID NO: 50140 - DNA, 573 bp, Artificial Sequence
  Description of Artificial Sequence: Synthetic coding sequence
atgaaagcatctcagtgttgttgctgccttagccatcttcttgccagcgttctcctgctactgcttttacctgagctcagcggcccactggctgtgctcctgcaagctgcagaggcagcgcctggtctggggcctcccgaccctcggcctcgaacgctaccgcctcttccaccaggcccaacccccgcacagcaacccggacgcggactggcagaggccgctggccctcgcggaagcgaaggcggaaatggatcaaatccagtggcaggactcgagaccgatgaccacggcggaaaggccggagaagggtcagtcgggggaggcctcgcagtatctccgaatcctggcgacaagcctatgacccagagagctcttacagtcctgatggttgttagtggggctgtcctggtgtactttgtggtgcgcacagtccggatgagacggcgaaatcggaaaacccggcgttatggagtgttggatactaatatagaaaatatggagcttacgccgttggagcaggacgacgaagatgatgacaacaccttgtttgacgccaatcaccctaggcgctag

SEQ ID NO: 50141 - DNA, 480 bp, Artificial Sequence
  Description of Artificial Sequence: Synthetic coding sequence
atgagagctgtgcctcttccagcccctctcctcccccttctcctgctcgccttactagctgcccctgccgcacgagcctccagggctgagagcgtctcagcaccatggccagaacccgagcgggagtctcgccctcctcccggtcccggtccgggaaataccactaggtttgggagtggagctgcaggaggcagcggttcctcctcgtccaatagcagcggcgatgccttagtgaccaggatttccatccttttaagagatctccccaccctgaaggcggctgtgattgtggcctttgcctttacgacattgctgattgcttgtttgctgctgcgcgtttttcgcagtggcaagaggttaaaaaagactcgaaaatatgacattataacgaccccggctgaacgggtggagatggcccctctgaatgaggaagacgacgaggatgaggacagtactgtcttcgatatcaagtacagatag

SEQ ID NO: 50142 - DNA, 1293 bp, Artificial Sequence
  Description of Artificial Sequence: Synthetic coding sequence
atggccgctagattactgaggggcagcctcagggtgctgggcggacatagagctcccaggcaactacctgctgcaaggtgtagccacagcggcggagaagaacgactcgaaaccccctccgccaaaaaactgacagatattggaatcaggaggatctttagcccagaacatgacatctttaggaaaagcgtgcgcaaattttttcaagaagaggtgatccctcaccactccgaatgggagaaagccggtgaagtgtcaagagaggtgtgggaaaaggctggcaaacagggcctgctgggggtgaatatcgccgaacaccttgggggtatcggtggcgacctgtacagcgccgctatcgtgtgggaggagcaggcttactctaactgctctgggcctgggttttccattcattcaggcatagtaatgagctacattaccaatcacggctccgaagaacagatcaagcatttcattccccaaatgaccgctggcaaatgcatcggggctatagccatgaccgaacccggagcgggttccgatctccagggtattaaaacaaacgctaaaaaggatgggagtgattggattctgaatggctctaaggtgtttatcagtaacggcagcctgtctgacgtggtgatcgtcgtcgcagtgacaaaccatgaagctccctctcccgcacatggcattagcctattcctggtcgagaacggtatgaaaggcttcataaagggcaggaagttgcacaagatggggctgaaagctcaggacacagctgagctcttcttcgaggacatccgcctccccgcatcagcacttttgggggaagagaataaggggttttattacataatgaaggagcttccacaagaacgacttttaattgccgatgtcgcaatcagtgcctctgagttcatgttcgaggagacacgcaattacgtgaagcagcgcaaggcatttgggaaaacagtggctcacctgcaaacagtgcaacacaagctggcagaactgaagacccacatctgtgtaactcgcgcattcgtcgacaattgtttgcagctccacgaggcaaagagacttgacagcgccaccgcctgcatggccaaatattgggcctctgaattgcagaattcagtagcttacgactgcgtgcagctccatgggggatggggatatatgtgggaatatcccatcgctaaggcctacgtggatgcgagagtccagcccatctacggcggaaccaacgagatcatgaaggagcttatagctagagagattgtgttcgataaatag

SEQ ID NO: 50143 - DNA, 459 bp, Artificial Sequence
  Description of Artificial Sequence: Synthetic coding sequence
atgcgcctacctttgtcgcactcgccggagcatgtggaaatggctctactcagtaatattctggctgcgtattcctttgtgtctgaaaacccagagcgagctgccctctatttcgtgagcggagtatgcattggtctggtgctgacccttgctgccttagtcattaggattagttgccacacggactgcaggaggagaccagggaaaaagtttctgcaagaccgcgagtcttccagtgacagctcagattccgaagacgggagcgaggacacagtaagcgacctgtccgtccgccgtcataggaggttcgaacgcacactgaacaaaaatgtttttaccagcgccgaggaactcgaacgggcacaacgtctggaagagagagagcggatcatcagggaaatatggatgaacggccaaccagaggtgccaggaactcggtcactgaaccgatactattag

SEQ ID NO: 50144 - DNA, 459 bp, Artificial Sequence
  Description of Artificial Sequence: Synthetic coding sequence
atgcgactccccctgagtcattcacctgaacacgtggagatggctctcctgagcaacattctggccgcttactcattcgttagcgaaaatcctgaacgagccgcactgtacttcgtcagcggagtgtgtatcgggctggtgctaacactggccgcactcgtgatacggatctcctgtcatactgactgtcggagacgccctggcaaaaagttcctacaagaccgggagagcagttccgattcatcagactccgaggacggaagtgaggataccgtctccgacctgagcgtcaggcgccacaggaggttcgaacggacactgaataagaacgtctttacaagcgctgaggagctggaacgagcccagcgtttggaggagcgcgagaggattatccgtgagatttggatgaatggtcagcccgaggtgcctggtaccagatcgcttaataggtactactag

SEQ ID NO: 50145 - DNA, 459 bp, Artificial Sequence
  Description of Artificial Sequence: Synthetic coding sequence
atgcgactgccactctctcactcccccgagcacgtggagatggccctcctctccaatattctcgccgcttacagctttgtgtccgagaacccagaaagagctgccctgtacttcgtaagcggagtttgcattgggctggtcttaactttggctgcgttggttattcggatctcgtgccatacggactgtagacggagaccgggaaaaaagttcctccaagacagagagtcctctagcgatagctctgattctgaggacggttcagaagataccgtctcagatttatcagtaaggagacaccgcagattcgagagaacgcttaataaaaatgtgttcacctctgctgaggagctggagcgtgcacagaggctggaagagcgcgaacggatcattagggagatctggatgaacggacagcccgaagtgcccggaacgcggtcgctgaatcgctattattag

SEQ ID NO: 50146 - DNA, 432 bp, Artificial Sequence
  Description of Artificial Sequence: Synthetic coding sequence
atgagactaccattgtcacactccccagaacatgtagagatggctctgctgagcaatatcctcgctgcgtactcctttgtcagcgagaaccccgaaagagccgctctatacttcgtgagtggagtgtgcatcgggcttgtcctcacacttgcagccctggtgattaggatctcatgtcatacggactgccgccgacggcctggaaaaaaattccttcaggaccgcgagtcatcaagcgactcctcagactcagaggatggttccgaggacaccgttagtgatctctctgtccggcgacatcgaaggtttgagagaacacttaacaaaaacgtctttaccagcgcagaggaactggaacgagcacagaggcttgaagagcgggagcgaatcatccgcgagatctggatgaacggacaaccagaggtgccctag

SEQ ID NO: 50147 - DNA, 306 bp, Artificial Sequence
  Description of Artificial Sequence: Synthetic coding sequence
atgcggcttccccttagccattcgccagaacacgtggagatggctctgttatctaacatcctcgctgcctattctttcgtaagcgaaaatccagaaagagccgcattgtactttgtgtccggggtttgtatcggattggtcctcactctggccgctttagttatcagaatctcgtgtcatacggactgtcgtcggaggccagggaagaagtttctacaggatagagaaagctctagcgactcctcagatagtgaggacggttctgaggacaccgtttccgatctgagcgtccggaggcaccgctag

SEQ ID NO: 50148 - DNA, 612 bp, Artificial Sequence
  Description of Artificial Sequence: Synthetic coding sequence
atgctgcaacaggactctaacgatgataccgaagacgtgtccctgtttgacgccgaggaagaaactactaataggccaagaaaggcaaaaatacgacaccctgtcgcctcattcttccacctcttctttcgggttagcgcaattattgtatgtttgctatgtgagctactttccagttcttttataacctgcatggtgaccattattctgttgctgagctgtgatttctgggctgtcaagaacgtcacagggaggctgatggtcggactccgctggtggaatcatattgacgaagacggcaagtcacactgggtgttcgagtcaagaaaagaatcctctcaagagaataaaaccgtttccgaggctgaaagccgaatattctggctcggactgattgcgtgcagtgttctctgggtgatctttgcctttagcgccctgttttctttcactgtcaagtggcttgctgtcgtgatcatgggagtggtgctccaaggcgctaatctgtatggatacatcagatgtaaggtgcgttctaggaagcatctaacttcaatggcgacctcttactttgggaagcagttcctgcgccaagtgtcagtgttctggatgtag

SEQ ID NO: 50149 - DNA, 642 bp, Artificial Sequence
  Description of Artificial Sequence: Synthetic coding sequence
atgaagcaagcactagtcgacgatactgaggacgtaagtctggacttcggtaatgaagaagaactagctttcagaaaagccaagatccggcacccactggctacctttttccatctgttttttagggtcagtgccatcgtgacttatgtatcatgtgactggttttcaaaatcgttcgtcggttgctttgtgatggtcttattattgctgagcctggacttttggtcagttaaaaatgtaactggccgtctcctggttgggttgaggtggtggaatcagatagatgaagacggcaaaagtcattggatcttcgaagcaagaaaggtaagccccaactcaattgcggctaccgaggcagaagcccgaatattttggctgggtctgattatctgtccgatgatttggattgtctttttcttctcaaccctgtttagcctgaaactcaagtggctggcactggtggtggccggtatatctttgcaggccgctaacctgtacggttatatcttgtgcaaaatgggtggcaactcagatatcgggaaggtgaccgcgtcattcctgtctcagactgtgttccagactgcctgtccaggcgactttcaaaagccgggattggaggggctggagatccatcagcactag

SEQ ID NO: 50150 - DNA, 567 bp, Artificial Sequence
  Description of Artificial Sequence: Synthetic coding sequence
atgaagcaagctttagtcgacgataccgaggacgtgtccctcgacttcggaaatgaggaagaactggcgtttcgcaaggccaagatacgcgatagggtgtcaaagcttcttgcctctgtgattcttctcccctggccacccaaggtcctgggcctcaagaacgtaactggacggcttcttgtcgggctcaggtggtggaaccaaatcgatgaagatggcaaatctcattggattttcgaggcacgaaaggtgagtccgaactctatagcagcaaccgaagcagaagcaagaattttttggttaggactcattatttgccctatgatatggatcgtgttcttcttttcaacgctgttctccctaaagctgaagtggctggcactggttgtggccggaatttccttgcaggccgctaatctgtacggctatatcctttgcaagatggggggaaatagcgacattggaaaagtcactgcgtcctttctgagtcagacggtgttccagacagcctgccctggcgattttcagaaaccaggcctggaggggttagaaattcatcaacattag

SEQ ID NO: 50151 - DNA, 618 bp, Artificial Sequence
  Description of Artificial Sequence: Synthetic coding sequence
atgctgcaacaggatagcaatgatgataccgaggacgtcagtctcttcgatgcagaagaggaaacaaccaatagaccacggaaagctaaaatccgccatccagtggctagctttttccatcttttctttcgcgtgagtgcaattatcgtctacctgctctgcggcctcctgtctagttcattcattacctgcatggtgaccattattctgttgctgagctgtgacttctgggccgttaaaaacgtgactggcaggctgatggtgggactccgctggtggaatcacatcgacgaagatggtaagagccattgggtgtttgagagccgaaaagagtcctctcaggagaataagacagtgtctgaagccgaatctcgaatcttttggctcggccttatcgcctgccctgtattgtgggtgatctttgctttctccgccctgttcagttttagagttaaatggcttgcagtggtcatcatgggggtggtcctccagggtgccaacctgtacgggtatatccggtgcaaggtaagaagcaggaagcaccttacttcaatggcaacctcctattttggcaaacaattcctgagacagaacactggggacgatcagacctcctag

SEQ ID NO: 50152 - DNA, 786 bp, Artificial Sequence
  Description of Artificial Sequence: Synthetic coding sequence
atgacttgctggctgagaggggtgacggccaccttcgggcgtcctgctgaatggcccggatacttaagtcacctgtgcggcagatctgccgctatggacctggggcctatgagaaagagttataggggggatagggaggcctttgaggaaacacatctgacctcccttgaccccgtgaagcaattcgctgcgtggttcgaggaagctgtgcagtgccccgatatcggcgaggcgaatgcaatgtgcctcgcaacctgtactagggacggcaaaccttcagcacgcatgctgctcctgaagggctttggcaaagacgggtttcgctttttcaccaactttgagtctcgtaaggggaaggaattagattccaacccatttgcctctctggtgttctattgggaacctttgaaccgtcaggtacgggtagagggcccagtgaagaagctgcccgaggaggaggctgagtgttacttccatagtcgccctaaatcctcccagatcggcgcagtagtttcacatcagtccagtgtaattcccgatagggagtacctgagaaaaaaaaacgaggaactggaacagctttatcaggaccaagaggtgcccaaacctaaatcgtgggggggttatgtgctgtaccctcaagttatggaattttggcaggggcagactaaccgcctccatgaccgcatagtctttagaaggggattacccacaggtgactcccccttagggccaatgacacacaggggggaggaggactggttgtatgagagactcgccccttag

SEQ ID NO: 50153 - DNA, 612 bp, Artificial Sequence
  Description of Artificial Sequence: Synthetic coding sequence
atgctccagcaggattctaacgacgacacggaagatgtgtccttgttcgatgcagaagaagaaactacaaataggccaaggaaggcaaaaatccggcaccccgtggcctctttttttcatctcttcttccgggtgtccgctatcattgtctgtcttctgtgcgaactcctcagcagctcattcataacatgcatggtgacgatcattctcttgctctcctgcgatttctgggctgttaagaatgtgactggcagactgatggtgggtctcaggtggtggaaccacatcgatgaggatgggaaaagccactgggtgtttgagagcagaaaggaatcttcacaggaaaacaagaccgtgagcgaggccgaatcacggatattctggttggggctgatcgcctgctccgttctatgggtgatcttcgccttctcggcacttttctctttcacagtcaaatggcttgcagtggtcataatgggagtggtgcttcaaggagctaatctgtatggatacatcagatgcaaggtgcggtctaggaagcacctcaccagtatggctacaagctacttcggcaagcaattccttagacaggtgtcagtcttttggatgtag

SEQ ID NO: 50154 - DNA, 558 bp, Artificial Sequence
  Description of Artificial Sequence: Synthetic coding sequence
atggtgggcttacgctggtggaaccatatcgatgaagacggtaagtcgcactgggttttcgaatctagaaaggaaagtagccaggagaataagacggtgtctgaagccgagagtagaatcttctggctgggcttaatcgcgtgtagtgtgctgtgggtcatcttcgccttctcagctcttttcagcttcacagttaaatggctggcagtagtgattatgggagtcgttctacagggggcaaacctttacggatatatccgctgtaaagttcggtcacggaaacacctcacaagtatggccaccagctactttggtaagcagttcctgcgccagaggcgatctaggcacattgcacaaacgggcctgaaggtgctaggatctagggatccacccgctagcgcctttcagtcggctggcatcacaggcgtctcccgttgtccgggacatcccagtcgcaaatttcaccaagatagtcaaaagacacttgactttccaggtagctacttaaaaaacatgactcctggtaggcctatgagtcccatccccctgaggcaatag

SEQ ID NO: 50155 - DNA, 1110 bp, Artificial Sequence
  Description of Artificial Sequence: Synthetic coding sequence
atgcccccaatgctgtggctactcttacattttgcggcaccggctttaggcttttacttttccatcagctgtcccagcgggaagcagtgccagcaggccctcctctcggggaacgatattttattatattgtaactcctcaggagcccattggtactatctattcacccagggcaaaaaagggaggcttacttcattgactaacataagtaacatggaaataatgcctgagggcagcctgctgatcaaggatccgttaccttcccagaccggtttatatcattgttggaacaagaacggacgccaggtagtccagtatgagattgactttcaggatgtcacaactttgcatatcacacacaaggatctggggcagcgacccttacaaaatgagacgctgcacttggggagcaagcagctgatttttacttggtgggaaccatggcaagactgcaaccgctgcgaagaacccggagagtgtaaaaggctgggctacaggtacatcgaggaacccctcgaagaggctatgccatgttggctttaccttggtgaggtgctggtgtggtcaagcaggctgcgccctgagcttcaagtcgaagcatgtcacgtgcagtgtaccaacaacacacagttaagagtggactatgtgatatttgataattttcggttagacgaaaagactgagttcgtgtggctcgactgcccattaggttccatgtatagaccggtcaactggcgagccaatgatacacctcttacctgggaatcacagctgtctgggcaggacttcactacatttctcgacccaagcacggggggacggcaactgcaggtgtttcagccagcggtctacaagtgcttcgtccagcaggagctggtcgcacagtttaagccagctgccagtctggagaccctggaggcccaatggagggaaaatgatgcccaatggcgtgaggctcgtaaggccctgagagggagagctgattcagtgttgaaggggctgaagctggtgctgttagtggtcaccgttctcgcactcctaggggcactgctgaagtgtatccatcccagcccaggacggagatccacacaagttctggttgtgaagtag

SEQ ID NO: 50156 - DNA, 1620 bp, Artificial Sequence
  Description of Artificial Sequence: Synthetic coding sequence
atgccgcctgccggagggcctcgggcaccgaggcccgctgcccttcccaggagtctgtccaggctccgagagtgccctgggagaagcagaattgtgctggcactcggcgcaacccagatggctctaggatgccttatagtcgctgtctcctttgctgcgctggccttgaccacaagcgccagagtgcgtcatagttgtcccttttgggcaggcttctccgtgctactgtccggtttgattggcgtcgtcagctggaaacggcctctctcactcgtgataaccttttttatgttgttgagtgcagtgtgcgtgatgcttaatctggctggatcaatcctgagctgtcagaatgcccagttggtgaactctctggagggatgccagctcatcaagtttgacagcgtcgaagtgtgtgtctgctgtgagctccagcatcagtctagcggatgcagcaatcttggtgaaacgctgaaactgaaccccctgcaggaaaactgtaacgcagtccgtctcaccctgaaggacctactgttctccgtttgtgctcttaacgtgcttagtacaatcgtgtgcgctctcgcaacagccatgtgctgtatgcagatggtgagttcagatgttctccagatgttcctacctcagaggtcgcacccagctaatcctacctgcgtgacaccgcacggaacagtgcttcatcagacactggactttgacgagttcattcctccattgcctccgcctccctactacccccctgaatacacttgtacgccaagcacagaagctcaacgcggtctgcacctcgatttcgctccatcgcccttcggaactctgtacgacgtcgcgataaactctccaggccttctttatcccgctgaactcccccctccatacgaggcagtcgtagggcagcccccagcctcacaggttacttccataggtcagcaagtggccgagagttcttctggagacccgaatacatctgccggatttagcacaccagtacctgccgatagtacaagcctgctcgtctcggaagggacggcgacacccggttcatcaccctcacccgatggccctgtaggcgctcccgcaccatcagagccagcgctcccccctggacatgtctcccccgaggacccagggatgggatctcaagtgcagcccggaccaggaagagtgtcaaggagcaccagtgatccaacactgtgcaccagctctatggcaggcgacgctagctcacacaggccatcgtgttcacaggacttggaagctggacttagtgaagccgtgccaggtagtgcctctatgagcagaagtgccacagcagcttgtcgagcccagctgtcgcctgccggtgaccctgacacatggaagactgaccagaggcccacacccgagcccttcccagcgacctctaaagagagacccaggagtctggttgactctaaagcatatgcggatgcgagggtgctggtcgccaagttccttgagcattcacactgcgcactccccaccgaggcgcagcacatggtgggggcaatgcgcttggccgtgacgaatgaggaaagactggaggaagaggcagtcttcggcgcagacgttcttgatcaagtatag

SEQ ID NO: 50157 - DNA, 1353 bp, Artificial Sequence
  Description of Artificial Sequence: Synthetic coding sequence
atgatattgctcgttaatctgttcgtccttctgtcagtggtctgcgtactcctgaatctggccggatttatcctagggtgtcagggagcccagtttgtgagcagcgtccctcgttgcgatctcgtcgatttgggagaaggcaagatttgtttttgctgtgaagagttccagccggcaaagtgcaccgacaaggagaatgccctgaaactttttcccgtacagccttgctctgctgtgcatttgttgcttaagaaggtcctgttcgcactgtgcgctttgaacgcccttaccactacggtttgcctcgtcgctgcagcgttgcggtacttgcagatcttcgcaacccggagatcctgtattgacgagagtcagatatctgcagaggaggccgaagatcatggaagaatccctgaccctgacgatttcgtccctcccgtgccccctccctcgtactttgctacattctatagctgcaccccacgtatgaataggaggatggtcggtcccgatgttattcctttgccccatatctacggtgccagaattaagggagtcgaagtgttttgtcccctggatccacccccaccctacgaagctgtcgtatcacaaatggaccaggagcagggcagctcatttcagatgtccgaaggctcagaagcagccgtgattccattagatttaggttgtacacaggtgacacaggacggcgatatccctaatatacctgcggaggagaacgcttcgacgagtacgccctcctccacgctggtacgtcctataagaagcaggcgcgcactcccccctttgaggacgcgaagtaagtcagatccagtgctgcatccttcggaagaacgcgcagctcccgtgctgtcttgcgaggctgcaactcagaccgaacgtcgtttggatctcgccgctgtcacgttgcggagaggactgaggtcacgagcaagcagatgccgcccacggtccctcatcgattacaaatcatacatggatacgaaacttctcgtcgctaggttcttggagcagagctcatgcaccatgactccggatattcacgagcttgttgaaaacatcaaatctgtattaaaatcggatgaagaacacatggaagaagcaattacgagcgcgtctttcctcgagcagatcatggccccactgcagccgagcacctccagggcccacaagcttccgtctagaaggcaacctggacttctgcatctccagagctgtggcgatctgcacacgttcactcctgctggcaggcctcgagctgagcggaggcctcggagggtggaagccgagcgtcctcacagcctgatcggcgtgatccgggaaactgtgctgtag

SEQ ID NO: 50158 - DNA, 858 bp, Artificial Sequence
  Description of Artificial Sequence: Synthetic coding sequence
atggtcggacctgatgtcattccactaccgcatatttacggagcccgtataaaaggagttgaggtgttctgcccactggatcctcccccaccttatgaagctgtggtgagccagatggatcaggagcagggttcttcctttcagatgagtgagggcagcgaagccgctgtaattccgctcgatcttggttgtacacaggtcacacaggacggagatatccccaatatcccggctgaagagaacgcctctacatcaaccccatcaagtactctcgtgcgacctatccgtagccgaagagccctcccaccccttcgaactagatccaaatctgaccccgtcctgcaccctagcgaggaaagagccgcacccgtgttatcgtgcgaagccgctacccagacagaacgccgactcgatttagcagcagtgacactcaggaggggtttgcggtcacgagcatcaaggtgtcgccctcgaagcttgatagactacaaatcttacatggatactaagctactcgtcgccaggttcctggagcagtcttcttgtacaatgaccccggatattcacgagttagtggaaaacatcaaatccgtactgaaatcagatgaagagcatatggaagaagcaataacatcggcctccttcttggaacagatcatggctcccctacagccctcaacttcacgcgctcacaagctgccaagccgcagacagcccggtttattacatctgcagtcatgcggcgatctgcatactttcacacctgcgggaagacccagagcagaacgccgaccgagacgcgttgaggcagagcgccctcacagtcttatcggggtgattcgagagactgtgttgtag

SEQ ID NO: 50159 - DNA, 714 bp, Artificial Sequence
  Description of Artificial Sequence: Synthetic coding sequence
atgacgtgctttggcccttaccctatagggacaggcctgcaagggattacgctttgttgcttcccttctttctgcaaaatgaaaagccgtatgtgtatggctatctcaatatgccagatgttatctatgctgtctttcgtggtttgcgcttttcgctaccgccacatgtttaagcgtggatggcctatgggaacttgttgtctgttcctgcccacagcggcaccagtgctctcctgtgaggccgctacgcagacggagcgacgacttgatttggctgccgtcaccctgcgacggggattacggtccagagcctcacgatgtagacccaggagcctgattgactacaagtcttacatggataccaagctcctggtggctagatttttggaacaatctagctgtactatgaccccagatatccatgaattagttgagaacattaagtcggtgctgaaatccgatgaagagcacatggaagaggccattacctctgcctccttcttagaacagattatggccccactgcagccgagtaccagtcgagcccataagctcccctctcgcagacagcccggactcctgcacttacagtcgtgcggtgatctgcatacctttacacctgcaggccgacccagggccgaaaggaggccgcgaagggtcgaggcagagcggcctcactcgctgatcggcgtgatccgagagactgtcttatag

SEQ ID NO: 50160 - DNA, 1350 bp, Artificial Sequence
  Description of Artificial Sequence: Synthetic coding sequence
gttctgctagtaaatctgttcgtgctattgtctgtcgtgtgcgtcctgcttaatctagcaggatttatactgggatgccagggcgctcagtttgtatccagcgtgcccaggtgtgacctcgtagacctcggagaaggcaaaatttgtttttgctgtgaggagttccagcccgcaaagtgtacggacaaagaaaacgctctgaagttattccctgtacagccctgtagtgccgtgcatctgctgctaaagaaggtactctttgcattatgtgccctgaatgctcttactaccaccgtgtgccttgtggccgcagcattgcgctatctacaaatcttcgccacccgcagatcttgtatcgatgagtcccaaatcagcgccgaggaggctgaggatcacggtcgtatccccgatcccgatgacttcgttccccctgttccacctccatcatattttgctacattctactcttgtaccccacggatgaatcgtcggatggtcggaccagatgtgattcctctccctcatatctacggggctagaatcaaaggtgtggaagtcttttgccctctggacccccctccaccctacgaggccgttgtgtcccagatggatcaggagcagggctccagtttccagatgtccgaaggttctgaggcggcagtgattcccctggatttgggctgtacacaagtgactcaggatggcgatatacctaacatcccagctgaggaaaacgccagcacttccacaccttcttctactctagtgaggcctatcagatcacgaagagctctgcctcctctgagaactcggagtaaatctgaccccgtgctccatccttccgaagagagagctgcacccgttctgtcttgcgaggcagcaacccagaccgaacgtcgcctggatctagccgcagtcactctgagacgtggcctgcggagtagggcctccaggtgtaggccacgatccctgattgattacaagagttacatggacaccaaactcttagttgctaggtttctggagcaatccagctgcacaatgaccccggacatccatgaactagtagaaaatatcaaatctgtgcttaaatcagatgaggaacacatggaagaggccatcacttctgcttcattcttggagcagatcatggccccactgcaaccgtctaccagtcgcgctcacaaacttccttctaggcgacaacctggcctcttacatctgcagagctgcggtgacctgcatacttttacgcctgccggtagacccagagctgaaaggcggcctaggagggtagaggccgagaggcctcacagccttataggagtgatccgagaaactgtcctgtag

SEQ ID NO: 50161 - DNA, 1353 bp, Artificial Sequence
  Description of Artificial Sequence: Synthetic coding sequence
atgatactcctcgtgaacctgttcgtgctgctcagcgtagtgtgcgttctccttaatcttgccggtttcatccttggttgtcagggggcacagttcgtgtcgtcagtgcccagatgtgacttggtcgacttgggtgaaggcaagatatgcttttgctgcgaagagtttcagccagctaaatgtacggataaggagaatgccctcaagctcttccctgtgcaaccctgttccgccgtccatctactgctgaaaaaagtgctgttcgctttatgtgcactcaacgcacttacaacaacagtatgtttggtcgccgctgctttacggtacctgcaaatcttcgctaccaggcggtcgtgtattgacgagtcccagattagcgccgaggaggctgaagaccatggccgaatcccagaccctgatgatttcgttccccctgttcccccaccttcttattttgccacattttattcttgtactccaagaatgaaccgccgaatggttggccctgacgtgataccactgccccacatttatggagcccgaattaagggagtagaagtgttttgccccctagacccaccaccgccttatgaggccgttgtgtctcagatggaccaggagcagggttcatccttccagatgtcagagggaagcgaggctgccgtgattcctctggacctgggctgcacccaggtgacacaagacggggatattccaaatatccccgcagaggaaaatgccagcacctctaccccttcttccactcttgtccggcctatccgttcacggagagccctgcctccactcaggactcggtctaagtcagacccggtcctgcacccatccgaagaacgggcagccccagttttgagctgcgaagctgcaacacaaacagagaggcggctcgacttagctgcggtaacgctgagacgaggtcttaggagccgcgcttccaggtgccgcccaaggagtcttattgattataagtcatatatggatacgaagctcctggtagccaggttcctcgaacagagctcctgtaccatgacccctgacatccatgaacttgtggaaaacatcaagagtgtgctaaaaagcgacgaagaacacatggaggaggccataacgagcgcctcatttctggagcagatcatggctccactccagccatcaactagtcgcgctcataaacttccaagccgacggcagcccggactgttgcacctgcagtcatgcggcgatttgcatacttttacccctgccggacgcccacgggcagaacggcgtcctcgacgagtggaagcggagcgaccccattctctgatcggtgtgattagagagaccgttctctag

SEQ ID NO: 50162 - DNA, 1074 bp, Artificial Sequence
  Description of Artificial Sequence: Synthetic coding sequence
atgggacttagaggagactctcaggccactttgttcgaccctcagctgcatgacggcagttgcatctgcgaacgagtggcttccatcgtggacgttagcatggactccggtagcttggtcctcagcgccatcggtgacttgcccggaggatcctcgccaagcgaagattcctgtctgttggaacttcaagggtcagtcagatccgtagactacgtgctgtttaggagtattcagcgaagcagagccggttactgtctgtcactagattgcggcttaaggggaccttttgaagaatcacccctgcctcgaagacccccacgcgctgcccgatcctacagctgtagcgccccagaggctccaccccctcttggagcaccaacagcagctcgcagttgtcataggttggagggctggcccccatgggtcgggccttgctttcccgattccagcggatctctgacacccccaggacaccgacctccgcaccccgcatcacctccgccactgctcctgcccaggtcccactcagaccctgggataactacaagttccgataccgccgacttccgagacctttacaccaaggttctggaagaggaagccgcatcggtgagctcagcagacaccggactatgctccgaagcttgtttgtttaggctcgctaggtgtcccagccccaagctcctgcgtgctaggagcgctgagaagcgacgacctgtgcccacctttcagaaagtaccattaccgagcgggccagcccctgcgcactctctgggggatttgaaagggtcctggcctgggagaggattggtgactaggttcctccaaatcagtagaaaggcacccgatcccagcggcactggtgcgcacggccataagcaagtaccaagatctctctggggcagaccgggacgagagtcactccacctgcgaagttgcggggacctgagctccagctcatgtggcgtgtcctgcctggcagccggatggtccgtggtacctgctcctaccgcctccgcgtctaccggggctgccggaaggctcggcagcgatttggggttcctcagccattag

SEQ ID NO: 50163 - DNA, 729 bp, Artificial Sequence
  Description of Artificial Sequence: Synthetic coding sequence
atgatgccctctcccagcgacagctctcgcagcttgacgagcagaccaagtactaggggcctcactcacctgagattgcaccgcccttggttacaagctctgctgacactgggtctcgtccaggtgttacttgggatcctcgttgtgacgtttagcatggtggcttcttcagtcactaccacagagtctataaagcgaagctgcccctcctgggccggtttcagtaatcttctgttcagtgtctgcgggctgaccatatgcgcggctatcatttgtaccctttccgccattgtttgctgtatccagatcttctccctggacttagtccataccctagctcctgaacgtagcgtatccgggccattggggccactaggatgcaccagccctccccctgcccctctgctacatacaatgctggatttagaggagttcgtgcccccagtcccaccccctccctattatccacccgagtatacttgctccagcgagaccgacgcccagtccattacttataacggcagtatggattctccggtcccactttacccaacagactgccctcccagttatgaagcagtgatggggttaaggggaggtaagcagatactcgttcccctgagaatgagggtcgccctttccgacctgcaaggacattacggccaggggaagggaatggcccaggtttttaaatatagggtaacctgcgcctatgctatgggctggtag

SEQ ID NO: 50164 - DNA, 1719 bp, Artificial Sequence
  Description of Artificial Sequence: Synthetic coding sequence
atgatgccgagcccgtctgattcctctcgttccctgacaagtcgccctagtacaaggggcctaacgcacctgcgactccatagaccctggctccaggccctgctcactctaggactagtgcaagttctgctcggtatccttgtggtgactttttcgatggtcgcctcgagcgtaacgacaaccgaaagtataaagaggtcatgtccatcatgggcgggattcagcaatctgctcttctccgtgtgcgggctgaccatatgcgcggcaattatttgcactctgtccgctatagtatgttgtatacagatcttcagtctggatctggttcacactttagctccagagaggagcgtctcaggccctcttggtcccctggggtgtacatcccccccacctgctcccctgttgcacaccatgttggatttggaagaattcgttcccccagtgcctcccccaccttactatccaccagagtacacgtgctcttcagagacggacgctcagtccatcacctacaacggcagcatggatagccccgtcccactttaccccacagactgtcctccctcctatgaggctgtgatgggacttcgtggcgactcccaggctaccctgttcgatccacagttgcatgatggttcgtgcatctgtgaacgcgtggcgtctattgtagacgtgtccatggacagtggaagtctcgtgctaagtgccatcggcgatcttcccggaggcagctccccaagcgaagacagctgcctactggagctccaggggagcgtacggtctgtggattatgtattattccgttcaatccagcgttcccgggcagggtactgccttagtcttgattgcggactgcgcggacccttcgaagagtcccccctgcccagacggccacctcgggcagcaagatcttactcatgctccgcacctgaagcacccccacctctgggcgcaccaaccgccgcacggtcttgtcataggttggaaggatggccgccttgggtgggcccttgttttccagaattgcggagacgggtgcccagaggcggaggtcgccctgcagcggctcctcccactcgggctccgactaggagattttctgacagctcaggatcacttacccccccagggcaccggcctccgcacccggctagtccccctcctctgctacttccacgtagtcattctgatcctggcataactacatcatctgacaccgctgacttccgcgatctatatacaaaagttctagaggaggaagccgcttcagtcagttctgcagatacaggactgtgctcggaagcctgtttatttagactggctaggtgccctagtcctaagctacttcgcgcaagatccgctgagaagagacggcctgtgccaacattccagaaggtgccactgccctcaggccctgccccagcccacagtctaggtgacctgaagggttcctggccaggacggggacttgtgactcgctttctgcaaatcagcagaaaagcacctgatccctccggcaccggggcacacgggcataaacaggtgcccaggtcgttgtggggtaggcctggtcgagaatcacttcatttgcgtagctgcggagatctgtcgtcctcttcaagcctcagaagactgttaagtgggcgacggctggagagggggacaagaccccattccctgtcgctaaacggcggatcacgtgaaactgggctgtag

SEQ ID NO: 50165 - DNA, 2007 bp, Artificial Sequence
  Description of Artificial Sequence: Synthetic coding sequence
atgatgccatctcccagcgattcttcaaggagccttacttctcgccctagcacccgcggactgacacatctcagactgcacagaccatggcttcaggcactacttactctcggtctggtacaggtgcttctgggtatcctggtcgttacattctccatggtcgcctctagtgttactactacggaaagcataaaaagatcatgcccctcgtgggcgggattctcattggccttttcaggcgtagtcggaatcgtgtcctggaagaggccctttacactggtcattagctttttttcactgctcagtgttctgtgtgttatgctgtctatggcaggttccgtcctgtcttgtaaaaatgcccagctcgccagggacttccagcagtgctccctcgaggggaaggtctgtgtctgttgcccatcagtaccattgcttaggccctgccctgagagcgggcaagaattgaaagtggctcccaatagtacgtgcgacgaggcacggggagcattaaagaatctcctgttcagtgtctgtggtctgactatctgtgccgcaatcatttgcaccctgtcagcaattgtctgttgcattcagatcttctccttagatcttgtgcatactctcgctcctgaacgcagtgtgagcggccctcttggtccacttggctgtactagccctccccctgcgcctttactgcacaccatgctggacctagaagaatttgtgccccctgtcccaccaccgccatactatccccctgaatacacatgttctagcgagacagatgcacagagcattacgtataacgggtctatggactctcctgtcccactctatcccactgactgccctccaagctatgaagctgttatggggctacgcggagactcacaggctacactttttgatccacagctccatgacggctcctgcatttgcgaaagggtcgcttcaatagtagacgtttcaatggatagcgggtccttggttctgagtgcgatcggagacctccctggcggaagctctcctagcgaggattcctgtctgctggagctgcagggcagtgtgaggtccgtggactacgtactgtttaggtccatccaacgttcccgggctggatattgcctgtctttggactgtggactacgaggcccttttgaggagagtccactcccaaggaggcctcctcgtgctgccaggtcgtactcttgttcagcccctgaggcacctccccctctcggggctcccacagctgctaggtcctgtcatcgcctggaagggtggcccccttgggtcgggccatgctttcctgagctccgtaggagggtcccgcgaggcggtggacggccagctgctgcgccacctacaagggccccaacaaggaggttctcagattccagcggctctctgactccgccagggcaccgaccccctcatcccgcatccccccctccactgctcttacccagatcgcattctgaccctggcataaccacttcctccgatacagccgatttccgcgatctgtataccaaagtactcgaggaagaagctgcatctgtatcatccgctgataccggcctctgctccgaggcatgcctcttcagactggccagatgcccttcccctaagctactccgagcacgatccgccgagaagcgcagaccagtgccgactttccagaaagtaccattaccttccggccctgcccctgcccactcactgggagacctcaaagggagctggcccggacggggtctggtgacgcgattcctccagatctcccgcaaggcacctgatccaagcggtaccggggctcacggtcacaagcaggtgcccaggtccctgtggggcagaccaggcagagagtccctacatctgcgctcctgcggggatctgtcttcgtcatcctctctgcgcaggcttctgtccggccgtcgcctggaacgaggaaccagaccacactccctgagcctgaacggtggaagtagagagactggattgtag

SEQ ID NO: 50166 - DNA, 1953 bp, Artificial Sequence
  Description of Artificial Sequence: Synthetic coding sequence
atgatgccatccccttctgatagcagtaggtctctgaccagccggccatccactcggggattgacacatctccggctgcataggccctggctgcaggcactgctgaccttaggcctggtgcaggtgctgctcgggattctggtggtgactttctctatggtcgcgtccagtgtgactaccactgaaagtattaagcgatcctgcccctcctgggccggtttttccatatccttcttcagcttgctgtctgtgctatgcgtaatgttgtccatggcaggaagcgtcctcagttgcaaaaatgcacagctggctcgggactttcagcagtgttctttggaaggaaaggtgtgtgtgtgctgcccctcggtgcctctactgcgcccttgtccagagagcggccaagagctgaaggttgcaccaaattccacatgcgatgaggcaaggggggctctaaaaaacttgctcttctcagtgtgcgggctcacgatctgtgctgcgatcatctgcacactgtctgctatcgtatgctgcatacaaattttttccctggatctcgtgcacacccaactcgcccctgaaagatccgtgagcggcccactgggaccactggggtgtacttccccccctcccgcacccctgctacacaccatgcttgatctggaagaatttgtgccgccagtgccgcctccaccgtattaccctcctgagtatacatgctcttctgagaccgatgcccagtcaatcacttataacggttcaatggacagcccagttccgctgtaccctactgactgtccaccttcatatgaagctgtcatgggactccgaggcgattcccaagctacactctttgatccccagctgcatgatggctcgtgcatttgcgaaagagtggcatctattgttgacgtctcaatggatagcggctcgctcgtactctcagctatcggggacctgcctggtggctcttcaccgagtgaagactcgtgtctgctcgagctccaaggcagtgtcaggagcgtggactacgttctgtttcgcagcatccaaaggagtcgggctggatattgcttgtcattagattgcggcctcagggggccatttgaggaaagcccccttccacgccgaccgccaagagccgctcggtcatacagctgctccgcaccagaggcaccaccacccctcggggcacctaccgccgcacgctcttgtcacagactggaggggtggccaccttgggtgggcccttgctttccagagctgagacgcagggttccacgtggtggaggcaggcctgccgctgctccgcctacccgcgctcctactcggcgattttccgactcttccggaagtctgaccccgccaggacaccgcccaccccacccagcttctcccccaccgcttctgctgcctaggagtcattccgaccccggtatcaccacatcctccgatacggctgactttagagatctgtatactaaagttttagaggaggaggcagcctctgtctcttccgccgacacaggactctgttcggaagcctgcttgttcagacttgcccgatgccctagccctaaactcctgcgagccaggagcgctgaaaagaggagaccggtcccaaccttccagaaggtcccgctccccagcgggcctgctcccgctcattctctgggggatctgaagggaagctggcctgggaggggcctggtgactcggttcctgcagatttcacgcaaggctcccgacccgagcgggactggagcccatgggcataagcaggtgcccagatccctgtggggcagaccaggtcgcgaaagtttgcatttacgttcttgtggcgacctgtctagctcctcaagcctgaggcgtttgctaagcggtcgaaggctggaaagaggcacgagaccccattctctctccctgaatgggggttcccgggagaccggactgtag

SEQ ID NO: 50167 - DNA, 435 bp, Artificial Sequence
  Description of Artificial Sequence: Synthetic coding sequence
atgatgccttccccgtctgattcgtcacggtctctcaccagtcggccatcaacaagagggctgacccatctacggctgcaccggccttggctgcaggcactactgaccttgggcctcgtgcaagtactgctaggaatccttgtcgttaccttctctatggtggcctctagtgtcacgaccacagagtcgatcaaacgcagctgtcccagctgggcgggttttagcaatctgttattttccgtttgtggcctaactatttgtgcagcgataatctgcactttaagcgccatcgtgtgctgtatccaaatcttttcactggacctggtccacactcttacatcaggcacctttatacctaaatgtctacggaagaaactcctgttgttccctttgcagattcaggggtccgccctcaaaccggcttcgagcgcgtag

SEQ ID NO: 50168 - DNA, 1560 bp, Artificial Sequence
  Description of Artificial Sequence: Synthetic coding sequence
atgacatgtccagataagcctggccagctaatcaattggtttatttgctccctctgcgtgccgagagtgcgtaagctgtggtccagccgaagaccccgtactcggagaaacctcctcctagggactgcttgtgctatatacctgggctttctggtgtctcaagtgggaagggcatcgctgcagcatgggcaggctgccgagaaaggcccacaccgtagccgggacaccgccgagcctagcttccccgagatcccgttggacggaactctggccccacccgagagccagggtaatggtagcacgctgcaacctaacgttgtgtatattaccctgcgctctaagaggtcaaaaccagcaaacatccggggaaccgtgaagcctaagcgacggaagaagcatgccgtagcttccgccgctccgggacaggaagccctggtggggccttcgttgcagccacaggaggccgctcgcgaagctgacgcagtggcccctggctatgctcagggagccaatctcgtaaagattggagaacggccatggcggcttgtcagaggacccggagtgcgggcaggcggacctgacttcctccaaccttcctctcgagagtccaatattcgaatctactccgaaagtgctccctcctggctgtcaaaggacgatattagacgaatgcgactcctggccgactccgccgtggccggactaaggccagtgtccagtagatcaggcgcacgtcttctggtgttagaaggcggtgcccctggtgcggtgcttcgatgcggcccatccccttgtgggttgctgaagcaacccctcgacatgtccgaggtctttgctttccatttggaccgaatcctgggccttaacaggactctgcctagtgtaagccggaaggcagagtttatacaggacgggagaccttgtccgatcatcttgtgggatgcctcgttatcatccgccagcaatgatacccactctagtgtgaaacttacatgggggacctatcagcagctgctcaaacagaagtgctggcagaatggacgtgtccctaaaccagaatccggctgtaccgaaatccatcatcatgaatggtcgaaaatggcccttttcgatttcctcctgcagatctacaaccgcctggacaccaattgctgcggttttcgccctcgcaaagaagacgcttgcgtgcagaacggactccggcctaagtgcgacgaccagggctcagccgcactggcacacatcatccagaggaagcacgaccctcgccacttggtatttattgataataaaggatttttcgaccgcagcgaggataacttgaactttaaactgctggaggggattaaagagttccccgcatccgcagtaagcgtgcttaagtcgcaacatctgcgccagaagcttctgcaatccctgttcttagacaaagtatactgggagagccaaggaggccgacaggggatcgagaaactgattgacgttatcgagcatcgggcaaagattctgatcacctatatcaatgcgcacggcgtcaaggtcctgccgatgaacgaatag

SEQ ID NO: 50169 - DNA, 1560 bp, Artificial Sequence
  Description of Artificial Sequence: Synthetic coding sequence
atgacatgccccgacaaaccaggacagctgatcaattggtttatctgtagcctttgtgttcccagagtgaggaagctgtggagttcacggaggcctaggaccaggcggaacctactgctcgggactgcctgtgcaatatacttggggttcctagtaagtcaggtggggcgagcaagcctccagcacggccaggcggcagagaagggccctcacaggtctcgtgatactgcggaaccgtcatttcctgagataccactggacggcaccctggcccctcccgaatctcaaggcaacgggagcactctccagccaaatgtcgtgtatattacccttcggtccaaaagatcgaagcccgctaatattcggggtacagtaaaacctaagcgtcgtaaaaaacatgctgtggcctctgcagctccgggacaagaagcccttgtggggccaagcttacagccacaggaggcagcccgtgaggccgatgccgtggctccaggatatgcgcagggagccaaccttgtgaaaataggcgaaaggccttggcggctcgtgcgtggaccaggtgtcagagccggagggccagactttctgcagccttcctcaagggagtccaatattcgaatttacagcgaatcagctcccagttggctgtccaaggatgatattagacgaatgaggctactggccgattctgcagtggcgggtcttcgcccagttagttcacgctctggcgcaagactcctggtgctcgaaggcggagccccaggtgccgttcttagatgcggtccttctccatgtgggcttctgaaacagcctctcgatatgtccgaggtgtttgccttccatctagacaggattctgggtctcaacagaaccctgccctcagtgagtaggaaagccgagttcatccaggatgggcgaccgtgccccattatcctctgggacgcctctctcagcagcgcaagtaacgatacccacagcagcgtgaaactcacctggggtacctaccagcagttgttgaagcagaaatgttggcagaacgggagggtacccaagccagaaagcggctgtaccgaaatccatcatcatgagtggtccaagatggcgctcttcgatttcctcctgcagatatacaatcgccttgataccaactgctgtggcttccgtcccaggaaggaagacgcttgcgtgcagaatggccttcgccctaaatgtgacgaccagggttcagcagcactagcccatataattcagcggaaacacgaccccaggcaccttgtttttattgataataagggctttttcgatcgctccgaggataatctgaactttaagctgctcgagggcataaaagaattcccagctagcgccgtaagcgttctcaaatcacagcacctcagacaaaagctgctgcaaagcctgtttctggacaaagtgtattgggagtctcagggcggacgccagggtattgaaaagttaatcgacgtgatagagcacagagccaagatcctgataacatacattaacgctcatggggtgaaggtgctgcctatgaacgaatag

SEQ ID NO: 50170 - DNA, 1560 bp, Artificial Sequence
  Description of Artificial Sequence: Synthetic coding sequence
atgacatgcccagacaaacctggtcagttaataaactggttcatttgctcactatgcgtgccgagggtgcggaagttgtggtcctccaggagacctcggactcgtagaaatttgttactcggcaccgcgtgcgctatatacttgggtttcctggtcagccaggtgggccgagcttcattgcagcacggacaggccgctgaaaaggggcctcatagaagccgagatactgccgagccctctttcccggagattcctctggacggcactctggccccacccgaaagccaaggcaatggctcaactctccagccaaacgtcgtgtacatcaccctcaggtcgaaaagatccaagcccgctaacataagagggacagtcaaaccaaagaggcgcaaaaagcacgccgtcgcttccgctgcacccggacaagaagctttagtaggcccatcccttcagccgcaggaggcagctcgtgaggcggacgcggtcgcacccggttacgcccagggggctaatcttgtgaagattggcgaaaggccttggcggctggtccgtggcccaggcgttcgcgctggaggccctgattttctgcagccatcaagccgcgagagcaacatacggatttactcagagagtgccccaagttggctatccaaggatgacattcgcaggatgcgactgcttgcagactctgctgtcgcaggcttgcgcccagtgtcaagccggagcggcgctcgccttctagtgctcgagggaggagccccaggagccgttcttcggtgtggcccatctccatgcggactgctgaaacagccgctggacatgagcgaagtgttcgcttttcatctggatagaatattaggactgaatcgcacactgccttcggtgtcccgaaaggcagaattcattcaagatggaagaccatgtccaatcatcctgtgggacgcctctctcagtagcgcgagtaatgatacccacagttctgtgaagctcacctggggcacctatcagcaactactcaagcagaaatgctggcagaatggccgtgttcctaaacctgaatctggctgtactgaaatacaccaccacgagtggtccaagatggccctgtttgacttcctgcttcagatctacaatagactcgatactaattgctgcgggtttaggcctcggaaagaagacgcttgtgtacagaacggcctcaggccaaagtgtgatgatcaggggtcagctgcactggcccacatcatccaacggaaacacgacccccgtcacctcgtgtttatcgacaacaaaggcttcttcgacagatccgaggacaacctgaattttaagctgttggaaggaattaaggagttcccagcttctgcagtttctgtactgaaaagccaacatctgcgacagaagctgttacagagcctttttctcgataaggtgtattgggaatcccagggcggaaggcaagggattgagaagctgatcgacgtgatcgagcacagggccaaaatcttgatcacctatatcaatgcccatggggtaaaagtgctccccatgaacgagtag

SEQ ID NO: 50171 - DNA, 1584 bp, Artificial Sequence
  Description of Artificial Sequence: Synthetic coding sequence
atgacatgccctgataagccgggacaactgatcaactggttcatctgctccctgtgcgtgccaagagtgcggaaactgtggagttctaggcgccctaggaccaggagaaatctcctgctcgggaccgcgtgtgccatctatctgggattcttggtttcccaggtcggtcgcgcatcactgcagcacggtcaggctgcagagaaaggccctcacagatctcgagacacagcagagccctcttttccagaaattcccctggatggtactctcgccccaccagagtcgcagggaaacgggtctaccctgcagccaaacgtggtctacatcactctccgatcaaagcggagtaaacccgctaacatccgtggaactgtcaaacctaagagacggaaaaaacatgctgtagcctcagccgctcccggacaagaagcgctggtgggcccaagtctgcagccccaggaagccgcacgggaagcagacgccgtggcccctgggtacgctcagggcgctaaccttgtgaaaatcggcgaaagaccatggagactggtcaggggccctggagtgcgagcaggcggacctgactttctgcagcctagctcacgggagagcaacatccgaatatacagcgagagcgcaccaagttggctgtcaaaagacgacattcgcaggatgcggttactagcggactccgctgtcgctggcttacgcccagtttccagtcgctcaggcgctcggctgctggtcttagagggcggtgcaccaggcgctgttctacggtgcggacctagcccctgcgggcttctgaagcagccccttgatatgtcagaggtgttcgcttttcaccttgaccgtatcctgggactgaatcgtaccctgccatcagtgtcccgaaaggccgaattcattcaggcggctgccgcagcatgcttgagcatgagattggcgttctttatattcccagcctgggaagatatgcgggtgcccggaaagtgctgcataggccatgctcggttaacttgggggacatatcagcaactgcttaagcaaaagtgttggcaaaacgggagggtgcctaaacctgaaagcggctgcaccgagattcaccaccatgagtggagcaagatggcattgttcgactttctcctccagatctataataggctggatactaactgttgcggctttagaccgaggaaagaggacgcatgtgttcagaatggactgcggccaaaatgcgatgatcagggcagtgcagccctggcacacatcatacagcggaaacacgatcccaggcacttggtttttatcgacaacaaagggttctttgatcggtcagaagacaatctgaactttaaactcctcgaggggatcaaggagtttccagcctcagctgtatccgtcctaaaaagccagcatctgcgccagaaactcttacagtccttatttctggataaggtgtactgggaaagtcagggcggaagacagggaatagagaagctgatcgatgttattgagcacagagctaagatccttattacatacataaatgcccatggagtgaaggtcctgcccatgaatgaatag

SEQ ID NO: 50172 - DNA, 996 bp, Artificial Sequence
  Description of Artificial Sequence: Synthetic coding sequence
atgacctgccctgacaaacctggacaactgatcaactggttcatttgcagcctgtgcgttcctagggtaagaaaattgtggtcgtcaagacgcccaaggaccaggagaaatctactcctgggcactgcatgcgcgatttatctcggatttttagtttcacaggtcggcagagcctccctgcaacatggacaggccgcagaaaaaggacctcacagatcccgcgataccgctgaaccaagttttccggagattccactcgatggcaccctggcccctccagagagccaaggcaatgggtctacgctgcagcctaatgtcgtttatattaccctccgttcaaagcgatccaaacctgctaacatacgaggcacagttaagcctaagaggcggaagaaacacgctgtagcctcagctgcgcctggccaggaagctctggtgggcccatccttacagccccaggaagccgcacgcgaggccgacgccgtggcgcctggctacgcgcaaggtgctaatctggttaaaattggagagaggccatggcgattagtgagaggaccaggggtgcgagctggaggacctgactttctccagccttcctcacgagaatccaacatccgcatttactccgagtccgctccttcctggctgtccaaggacgacatccgacgaatgagattgctagctgactctgcggttgccggactgcgaccagtgtccagtagaagcggagctagactgctggttctagaagggggagccccaggggcagttctacgatgcggcccttccccttgcggtttgctgaaacagcctttggacatgtctgaagtgttcgccttccatcttgaccggatcctagggctcaatagaactctgccctccgttagccggaaggcagaattcatccaagggaaccggttcacatgtttcgtgatatgtagctgctggggtttttggtttattttctttttccccagcctgtcattctccaagtag

SEQ ID NO: 50173 - DNA, 1608 bp, Artificial Sequence
  Description of Artificial Sequence: Synthetic coding sequence
atgactcctgagtctagggatacaacagatttgagtcccggagggacacaggaaatggaaggaatcgtcattgtgaaggtggaagaagaggacgaagaagaccatttccaaaaggagagaaacaaagtggaaagctcccctcaggtgttaagtaggagcaccacgatgaacgagcgagcgctgctgagctcatatctggtagcttacagggtagcaaaggaaaagatggctcacaccgcggctgaaaaaattatattaccggcatgcatggacatggtccggaccatcttcgatgataagtcagccgataagctacggacaattccactgagcgacaatacaatttcacggagaatttgcacaattgcgaaacatctcgaggctatgctgataacaaggcttcaatccggcattgacttcgcgattcagcttgacgagtccactgatatagctagttgccccaccctgctcgtctacgtgcgatacgtttggcaggacgattttgtggaggacctcctgtgttgcctcaacctgaatagccacatcactgggttggatctgttcacagaactggagaattgcttgttaggacagtacaaactgaactggaaacactgtaaaggcattagcagcgacggaactgccaacatgacaggaaagcacagccgccttacagaaaagctgctcgaagctacgcacaataatgccgtatggaatcattgcttcattcacagagaggcactcgtgagcaaggagatttcaccatctctgatggacgtcctcaagaatgccgtgaaaactgtgaattttattaagggatccagcctgaactcccggctgctggaaattttctgttcagagataggcgtgaaccatacccacctcctgttccataccgaagtgcgctggcttagtcaagggaaagtgctctcacgcgtctacgagctcagaaacgagatttacatttttctagtggagaagcagagtcacctggcaaacattttcgaggacgatatatgggtcactaagctggcatacctatctgacatctttgggatattgaatgaattgtctttaaaaatgcaaggcaagaacaacgatatcttccagtaccttgagcatatcctggggttccagaagacgctgctgttatggcaggctagacttaaaagcaatagaccctcctactacatgtttcccacactgttgcagcacattgaggagaatatcataaatgaagattgcttaaaggagatcaagctcgagattctcctgcacctgacatctttgtcccagacctttaactactacttccctgaggagaaattcgagtccctgaaagaaaatatttggatgaaggatccattcgcctttcagaacccagagtcaatcatcgaattgaatctcgaacctgaggaggaaaatgaattgctgcagctgtctagcagcttcacactcaagaattattacaaaattttatcattgtccgctttctggattaaaattaaagatgatttcccactgctgtcccgtaaatccattctgctgctgctgccctttactactacctacctgtgcgagctgggtttctcgatcctaacacgttag

SEQ ID NO: 50174 - DNA, 1722 bp, Artificial Sequence
  Description of Artificial Sequence: Synthetic coding sequence
atgacccctgagtctcgcgacacaaccgacctttccccaggcggaacccaggagatggaaggtatagttatagtgaaggtggaagaggaagacgaagaagaccactttcaaaaggagcggaataaagtagagagctctccccaggtcctcagtcggtccacaacgatgaatgagagagcactgcttagttcgtatttggtagcgtaccgtgtagcaaaagagaaaatggctcacacggctgctgagaaaatcattttgcccgcatgtatggacatggtaagaaccattttcgacgacaagtccgccgataaactgcgaacaatcccgctctcagataacactatttctcggagaatctgtacaattgcaaagcacttagaagctatgctaatcacccggttgcagagcggcattgattttgccatacagctggacgaaagtaccgatattgcatcatgccctactctgttggtatacgtgcggtatgtgtggcaggatgattttgtggaagatctgttatgttgtctgaacttgaactcccacataaccggcttggatttatttaccgagctggaaaactgcctgctgggccagtataagctgaattggaaacactgcaagggcatttcctcggacggcactgccaacatgacagggaaacactcccgcctgacagaaaaattattggaggccacgcacaataatgccgtgtggaatcattgcttcattcatcgagaggcgcttgtttcaaaagaaattagcccttccctgatggacgtgctgaagaacgcggtgaagacagttaatttcatcaagggctcttccctgaattcacggctgttggagatcttctgcagcgaaattggggtgaatcatacccaccttctgttccatactgaggtacgatggctgagccaaggcaaggtgttgtctagagtatatgagttgagaaatgagatctacatatttcttgttgagaagcagagtcatctggccaatattttcgaagacgacatctgggtcacgaaactcgcatacctgtctgatatcttcggtattcttaacgaactctcgttgaagatgcagggcaagaacaatgacatattccagtatctcgagcacattctcggatttcagaagacgctactgctgtggcaggctcgattaaaaagtaatcgaccatcgtactatatgtttcctaccctcttgcaacacatcgaggagaatattatcaatgaagactgtcttaaggaaataaagctggaaatcctcctacacctgacttccctgagtcagacctttaattattactttcccgaggaaaagtttgagagcctgaaggaaaatatatggatgaaggatccattcgcctttcagaaccccgagtccattattgagctcaacctggagcccgaggaggagaatgagctactgcagttgtcaagcagctttacattaaaaaattactataaaatcctgtcgttatctgctttttggatcaaaataaaggatgactttcccctcctttccagaaagagcattctgctgctgctgcccttcaccacaacctacctgtgtgagctggggtttagtatcctaaccaggctgaagacaaagaaacgcaatcgcctgaacagcgcccctgacatgcgagtggccttatccagttgcgtccctgactggaaggagctaatgaaccgacaggctcatccatctcattag

SEQ ID NO: 50175 - DNA, 4008 bp, Artificial Sequence
  Description of Artificial Sequence: Synthetic coding sequence
atgctgtcacctacattcgtattgtgggaagtgggctatcccctgtatatatacggcagcatctttattgtcatcgtgattatttggcaggttaagcggagtcatcacgaattgagttccgaaccaaagcgaagctgctgccgttgtcaccagaaagttaggcagagggcacgcgacgctgcatcgaccgccagaagacggagccgagaggaagctgagaaaccccagaagctgctgtccattattaagtctcaaggttggctgccactagaacgttcagtcaggcgaatcttatgcgccgatccgtgttgtcagatttgtaatagcgtggctctggagatccaacagctgctcgtaggcgaaaataaccagatctcattaacattgagcggcccattgcagggctctagttgcctcgagatgctgtctacttcgtcgatgagcctcgatcagtctttggaattccattcctggcatacaagggagctatctctatcaagcgtcaccccaactcttagccaactgactgaccagaaatccctgacccagtcagccgctcagtccacttatgctgacggaatacaggactactgggccgaccacctgcagttgggtcaggagttccaggtacccgacgtgctccgcggaccaaacaccattgcgagctcgcgtatagagaaacctcgggctccgctgaatcaagaggagatgacccagagcaatccatctctcgtacagggtaaccagggccagcaccaccttaacagccaggtctccctcctgtccctgaaccccgagacattgaatagaatgcaccccatggccttgcacatggtcttaccagcccacctccccttcctgtctcccgaggtgttgcgtcttctcgaagtgcacgtcaaaaagtggatgcacttccagagatggggcttgcccagacgggtagaagagtctctgaggcagcttatgcccaacccccctctttattaccaacccggaaacgatcagcctgtcagcttcaacctgaaaaatacacctcaagtgtccctccatcgtttcgagactatctccctgcagacatggtgcagttgcgtcgccggacagccaattcagaccttctgggtgtccgagtggtccactatgaaccccgaacaaaggcaccactgccaacaaacgcctaatccaatggccctggccctgccatcaccagcactaaaggcgctgtcagggcctcatccccagtccggcggtcaggataacgattcaggatctgacttgcagcagaagtactctcaactcttctgtggcctccccagtctgcatagcgagtctctggttgcgacgttcatgggtagtcaggggctgcctaaaattgaaaatgttcccaagccacccttgaaagacccatttctctttaatgaactttcattccctcaactgctccccaaaacctctccacagagtgcacccccatccagtccccttagtccaaactggatgtctcccagcgatcatcagcgtgcgcaaataaacgtcccgttcctgaccctggctgagtatgaagcactggagtggcacttactccagcgccagctccagctccagtggggctggcccgctgccctccagcgtagccaacatacacagtgcctcatgcagcacgaaccctgcgggaaggcacaatcacccgagacaaccaccgcgtcacagacaggcaagtctatcagtgtgctcactcgggaacttctattcttccccgaacacgcccgaaagctccttgaattccatattcagaagcaactcatccgacacagatggggattgccccagaaaatccaacagtcaattcaattactcttaactagcactgaccagcagacagtctcgagctcatccacagctctagccaatgtgagtatcccgcaacctgtcgccctggaggctaacggagcctgcgacgtactatccccaatcgccgctcccgtgtcgatcccaaggccacacctcttgacccaggttaaggctatcctgcagagccatattgacagtaagtgcggccaaatacatcagggcaaaattcctgcatgcgtacacagatcatgggactgccgaatctcaggagtgctcgccgtggccccatttccctgtatcccagaatcacagttccttgaacttcaaactgcgtctgatcctgacctgcatcataaggtgatgccatggatgcctaccgccttggatcagcagcagcaggctctccccggaacagtcacagagcatccaaagctgctcagagtgctgagtgtggaagccatcgaaaaactggagacgaccctccggcacaaacacctggcctttctgagcggtctccccgcactctattatgtcgcgctgcccagagcattggcaccagccgtgaccagtcagtctgtgatcactgagatggaaccatctccggtagagattcctgccgagcctttgattcagatggtctccttcgaggagcagtgtatctcccttgggccttgccctcaagggaataacgaatcatgcacagatgtggccaaagaattccagccagcagtgccagtgaaggggaccatggagactttaccactcgaatctcagacacatcccaccagtccacacagcctccagactcacatccttaccaagctgaacttccaccttcgtaagaaggtactggaaatccaatggggaattcctatccgggcaaggaagagtagagagcagaccgtggcggctcctgagaatataagtactcagaagagcctggagagtctcaaccaccagggggagaccctccttcaggagctcccaataccccctgacactctgcctgcccctaacccagagggggtgcatttaaaagaacagctggctaatgatctaaaggccgtacagcagaaccaaaagcagtccaactccaaggctgtgccacagggatctgcccactccgtgagtaagataagccagccttcgggcgatatgaccgaggcacatatgccatgcgtgcaagtggaggcaaacgtgaacaagccatctctggaggagccatgcggccctgagccgcagtcaccgagtaagagtaaggaccctgcacacgtgcctatgctagcagggaacagggaagaccctgaggagaccaaagctgccagggaccacagggaaggcgacgccggtttcggccgatccagtacccgtgaggagcgcagacctgccgaggatcagagacctgcagggatgcttccaaacaagaccccacgcggatcttggcggtggagccggtcttttcatcttgccgatccttgccaacactcccctcagcaccacccacagctaaaactgccccaactgccacctagagtccccggtgaaaaggaatctgagaaggacctccaggacagccaaacaaaactcacggtgatcttggaacctgccacaattcccgagaacgctcagaccgtactcccgcaggcttcccagggacagccttttctaagccagcctacccaagctaagccgcttcagggtcagacgctgcagggacaagttcttcacgggcttgtgatgccagttcacgcacaaaaaaaaccctctctcaccgaatccagttttcgaaataaaatcaaatgcttcctgcagcatatcaatccgaagactaagggcaaagggcacgaggatagtatgttttccgctgccgctaaagtcgctaaaaccaggaaggaaaacgtggccaagtcattggccccagctaagtcccccgtgggtcgctcaaagaccgagaaacccaccggctgctctaaggctcagtctcgcccagcccaaaagctggtcggtcccgctttcctggacggtcctcagagcttggatgacaaactacgactgcactctcggcagcccggatcagcttccgccttagggtatccaaggcattgcccgagacattgtccacgggaagcatgtgccaacaagccaggccacccaacatag

SEQ ID NO: 50176 - DNA, 516 bp, Artificial Sequence
  Description of Artificial Sequence: Synthetic coding sequence
atgtggacgttgaaatctagtttagtgcttctcctctgcctaacctgtagctacgcttttatgttttcatctctgcggcaaaagacaagtgagccccagggaaaagtccagtatggagaacatttccgcatccggcagaacttgcccgagcatacccagggatggttaggtagcaagtggctttggttactcttcgtggtggtgcccttcgtaatactccagtgtcaaagggactccgagaaaaataaggagcagagcccgccagggctccgcggaggacagttacacagcccattaaaaaagaaacgcaacgctagcccaaataaagattgtgcctttaatacattgatggaactggaagtcgagctaatgaagtttgtgtccaaggtgcggaatttaaaacgggcaatggccacaggatccggttccaacctgcgcctgagaaagtctgagatgccggcagacccctaccatgttactatttgtgaaatctggggcgaggagagcagcagttag

SEQ ID NO: 50177 - DNA, 516 bp, Artificial Sequence
  Description of Artificial Sequence: Synthetic coding sequence
atgtggactctgaaatcttccttggtcctcttgctctgccttacgtgctcatatgcctttatgttctcttccctacgccaaaagacatctgaacctcagggtaaagtgccttgcggcgaacattttagaataagacaaaatttaccagagcacacccaagggtggttaggcagtaagtggctgtggttactgttcgccgttgtgccctttgtcattttacaatgccagagagacagtgaaaagaataaggaacagtccccacctgggctacgaggctttccttttaggactcccctgaaaaagaaccaaaacgcctctttatataaggattgtgtgtttaacaccctcaacgagctcgaggttgaattgctcaaatttgtgagcgaagtacagaatctgaagggggcaatggctactggctccggctcaaatcttaaattgcggaggtctgagatgcctgccgatccctatcacgtgacaatctgcaaaatttggggtgaagaatcatccagctag

SEQ ID NO: 50178 - DNA, 4026 bp, Artificial Sequence
  Description of Artificial Sequence: Synthetic coding sequence
atgatgaacagaactactccagatcaagagttggcgcctgccagcgagccggtttgggagaggccttggtctgtggaggagattaggcggagcagccagtcctggagtcttgcagctgatgcagggcttctgcagttcttgcaggagtttagtcagcagaccatctccaggacccacgagattaaaaagcaggtggatggactgatccgagagacgaaggcaactgattgccgcctgcacaacgtgtttaatgacttcctcatgttgtcaaatacccagttcattgagaacagggtgtatgacgaagaagtggaggaacctgtactaaaggccgaagccgagaaaacagaacaagaaaaaacacgcgagcaaaaagaagtcgacctgatacccaaggtgcaagaagctgtgaattacggactgcaggtgttggatagcgctttcgaacagcttgatattaaggcaggtaattccgatagtgaagaggacgacgctaatggccgagttgaattgatccttgaacccaaagatctctatatcgatcgcccattgccttatctcatcggctccaaactctttatggagcaggaagacgtgggcctgggggagctttcttcagaggagggctctgtaggctccgataggggctcgatagtggatactgaggaagagaaagaagaggaagagagtgatgaagacttcgcccaccattctgataacgaacagaacagacacaccacccagatgtcagatgaagaagaggatgacgacgggtgtgatctctttgcagactcagaaaaagaagaggaggacattgaggatatcgaagaaaacacacggcctaagaggtcgaggccaacctcttttgcggatgagctcgctgccagaataaagggagacgcggtgggcagagtggacgaagagcccacgacattgccttctggagaggccaaaccccgaaagacactgaaggaaaagaaagagagaagaacaccctccgacgacgaagaggacaacctgtttgcacctcccaaacttacagacgaggatttttcacccttcggctctggaggaggcttgttcagcggcggaaaaggtctgtttgatgatgaggacgaagaaagtgatctctttacagaagcaccacaggatcggcaggccggtgcgtctgtcaaggaagagagctccagttccaagcctggcaagaagataccagctggggcagtgtcggtcttcctgggcgacactgatgtcttcggagccgcatccgtgccttccatgaaggaaccgcaaaaacctgagcagcccaccccgagaaaaagtccctacggccctccgccaacaggactttttgatgacgatgatggggacgacgacgatgattttttctctgctccacatagcaagccctccaaaactggcaaggtacagagcacagctgatatttttggcgatgaggaaggggacctcttcaaggagaaggcggtcgccagccccgaggcaactgtctctcaaactgatgaaaacaaggcgcgagccgagaaaaaggtgacactttcatctagtaaaaacttgaagccttcaagtgagactaagacacagaagggcttattttcagatgaagaagacagcgaagatttattcagctcccagagcgcaagcaagttgaaaggggcttcccttctgccgggaaagttgcctaccctggtttctcttttcgacgatgaggatgaagaggataatctctttgggggaaccgctgctaaaaaacagaccctatgcctgcaagctcaacgcgaagaaaaggccaaagcttctgaattgagcaagaaaaaagcaagcgccctcttgttctcttctgacgaggaggatcagtggaatattcccgcatcacaaacccacctggctagcgactctcgttccaagggcgaaccacgggactctgggaccctgcagagtcaggaagccaaggccgttaaaaagaccagtcttttcgaagaggacgaggaggatgacctcttcgccatcgcgaaggatagtcaaaaaaaaacccagagggtgtcactattatttgaagacgacgtggatagtggagggagcctatttggcagtccccctacctcagttcccccagctaccaaaaagaaggagaccgtgtcggaagcacctccccttctgttcagcgacgaagaggaaaaagaggcccagctgggagtgaagtcagtcgacaaaaaagtggagagtgctaaagaatcactgaagtttggtcggaccgacgtggctgagtccgagaaggagggtttgcttacacggtcagcccaggagaccgtgaaacattccgacttattttctagcagttccccatgggacaaaggaactaaacctcggaccaaaaccgtcctgtctctttttgacgaggaagaggacaagatggaagatcagaacattatccaggcaccacagaaagaggtgggtaaaggcagggatcccgacgcccaccctaagtctaccggagtttttcaagatgaagagctcctgttttctcataaacttcaaaaagataacgatcccgacgtcgacctgttcgccggtacgaagaaaacaaaattgttggagccctccgtggggtccttgtttggagacgacgaggacgacgacttattctcctccgccaaaagtcagccactggtccaggaaaagaaacgcgtcgtaaaaaaggatcattctgtggactcctttaagaatcaaaagcaccctgagtccatccaaggctccaaagaaaagggaatttggaaacctgaaacccctcaggactcaagcgggctcgcacctttcaagacgaaagaaccttcaaccagaatcggaaaaattcaggccaatctagcgattaaccccgcagccctcctgcctaccgccgcatcccagatttccgaggttaagccagtgctccctgaacttgccttccctagttctgagcacaggcggtcccacggacttgaatccgtgcctgttctgccagggagtggggaggcaggtgtctccttcgacttacctgcccaggccgatacactgcacagcgcaaataaatcacgcgtgaagatgagaggcaaacgtcggccacagacacgcgctgctagacggctggccgctcaggaatctagcgagacagaggacatgagcgtgccacgcggtccaattgctcagtgggcagacggggcaatttcgcctaacggacaccgaccacagctgcgggctgcatctggcgaggactccactgaggaggccctggctgctgcagctgctccttgggaaggaggaccggttccaggggttgatcgcagtcccttcgcaaagtcccttggacattccagaggggaagcagacctgtttgacagtggcgatatattttctactggtacaggatctcaatctgtggagagaaccaaaccaaaggcgaagattgctgagaatccagcgaatcctcctgtcggaggaaaggcaaagtccccaatgttccctgcacttggcgaggctagttcagatgacgatctattccaaagtgctaaacctaagcctgcaaaaaaaaccaatccctttccgctgctcgaagacgaggatgatctgtttacagaccagaaagtgaagaagaatgagacaaagtcaaactctcagcaggacgtaatcctgaccacccaggacatttttgaggatgatatttttgccacagaggctatcaagccttcccagaaaacgcgagaaaaggaaaagacattggaatcaaacctcttcgacgataatatagacatctttgctgatctgacggtcaagccaaaagagaaaagtaagaagaaagtggaggccaagtccatttttgatgatgacatggatgatattttttcttctgggatccaggctaaaaccacaaagccaaagtctagatctgcacaggctgcacccgaaccgcgattcgaacacaaggtgtccaacatctttgatgaccccctcaacgcattcggtgggcagtag

SEQ ID NO: 50179 - DNA, 3840 bp, Artificial Sequence
  Description of Artificial Sequence: Synthetic coding sequence
atgatgaatcggacgactcccgaccaagaactcgcccctgcgagtgagcccgtctgggaaagaccttggtcagtagaggaaatccggcgaagcagtcagtcttggagcctcgcagccgacgccggactcctacagtttctccaagagttttctcagcagacaatcagtcggacccacgaaatcaaaaaacaggtcgatggcctaatccgagaaactaaagcaactgactgcagactccataacgtcttcaacgatttcctgatgctgtcgaatacgcagttcattgaaaaccgcgtttacgatgaggaggtggaggaacctgtgctcaaggccgaggccgagaagactgaacaggagaagacgagggagcaaaaggaagttgatctcatccctaaagtccaggaggcagtgaattacggactgcaggtattggacagcgcgttcgagcagctggatattaaagctggaaattccgatagtgaggaagacgacgcaaatgggcgagtggaactaattctcgaacctaaggacttatacattgaccgccctctgccgtatcttataggttccaaactttttatggaacaggaggacgtgggattaggcgaactatctagtgaggaagggtctgtggggagcgatcgaggatcaattgttgacactgaagaagagaaggaggaggaggaatctgacgaggattttgctcatcattcagacaacgaacaaaatcgacatacaacacagatgagcgacgaagaggaagacgatgatggttgcgatttattcgccgacagtgaaaaagaagaagaggatatcgaggatattgaagaaaacacccgacccaagcggagtcggccaacatctttcgccgacgaattggccgctagaatcaaaggagacgcagtgggcagggttgatgaggagccaacgactcttccctctggggaggctaagccaagaaaaacactgaaagagaagaaggaaaggaggacccctagcgacgatgaggaagacaatctgtttgccccaccgaaactgacagatgaggacttctcaccctttggatcaggagggggattattctcaggcggtaaaggattattcgacgatgaagacgaagaatccgatctcttcaccgaggcccctcaagaccgtcaagcaggtgccagcgtgaaagaagaatcctcgtcaagcaaaccaggaaagaagatccccgcaggcgctgtgagcgtttttctgggagacactgatgtgtttggcgctgcatccgtgccgtcaatgaaagagccacagaagcctgaacaaccgactccgcgaaaaagcccttacggtccccctccgacggggcttttcgacgatgatgatggcgacgatgatgatgatttcttctcagccccacactctaaaccctcaaagaccggcaaagtccagagcacggcggacatatttggcgatgaggagggggacctcttcaaggagaaggctgttgccagtcccgaagcaacagtgtcccaaacagacgagaacaaggccagagcagagaagaaagttacactcagttcctccaagaatctgaaaccttcttcagaaacgaaaacccaaaaagggctgtttagtgacgaagaggacagcgaggacctcttctcgagccagagcgccagcaagctgaaaggcgctagtcttctgccgggaaaattgccaactcttgttagcttatttgacgacgaagatgaagaggataatctgttcgggggaactgccgctaagaagcaaacgctatgcctgcaggctcaaagagaagaaaaagcgaaggcatcagagctcagtaagaagaaggcaagcgccttacttttttccagtgacgaggaggaccagtggaatatccccgcttcgcaaacgcatcttgcttccgactcccgaagcaagggagaacccagggattccggcactttacagtctcaagaggcaaaggccgtaaagaagacaagtttattcgaagaggacgaggaagacgacttatttgctattgccaaagacagccaaaagaagacacagcgtgttagtctgctgtttgaggatgatgtggacagcggtggcagcttgttcggctcccccccaacctccgtcccacctgccacgaagaaaaaagagaccgttagcgaggctccgccactgctgttctccgacgaggaggagaaggaggcccagctcggcgtcaaatctgtggacaaaaaagtggagtccgctaaagaatcattaaagtttggaagaacagatgtggccgagagcgagaaagaaggcctgcttactcggagcgcacaggagacagtgaaacactccgacctcttctcttccagcagcccatgggataaagggaccaagcccaggactaagaccgtcctttccctttttgacgaggaagaagacaaaatggaggatcagaacatcatccaagcacctcagaaggaagtagggaaaggacgagacccagacgcgcatcccaagagcactggcgtgtttcaggacgaagagctccttttttcacacaaacttcaaaaggacaatgaccctgacgtagacttgtttgctgggaccaagaagacaaaactgttggagccatctgtgggatcattgttcggggacgacgaagatgatgacctgttcagctccgccaagtcccaaccactggccaatctggccatcaatccagcagccctactaccgactgctgcttctcagattagtgaagtgaaacccgtgctccctgagttggcgttccccagtagtgaacacaggaggagccatggcctggaatccgtccctgttctgcccggttctggagaggccggagtctcttttgatctaccagctcaggccgacactcttcattccgcaaataagtctcgagtcaagatgaggggcaagaggcgacctcagaccagagccgcacggcgacttgcagctcaagagagctcagaaactgaggacatgtcagtacctcgtggtccaatagcccagtgggctgacggcgctataagccctaatgggcatagaccacaactaagagctgctagcggagaagattccacagaagaggccttggctgctgccgctgcgccatgggaaggtgggcctgtaccaggcgtggacagatccccctttgcaaaatcattaggacattcacgcggagaagctgacctctttgattctggcgatatatttagcacaggaactggctcccagagcgtggagcgcaccaaaccgaaagcgaagatcgcggaaaatcccgctaatccacccgtcggtggaaaagccaagtccccgatgtttcctgctctcggcgaagccagctccgatgacgacctcttccaaagcgcaaagcccaagccagctaagaaaaccaacccctttcccttgttggaagatgaggacgatctgttcactgaccagaaagtaaagaaaaatgagaccaaatctaacagccagcaggatgtgatactgacaacacaggatatcttcgaagacgatatctttgcaaccgaggccattaaaccctctcagaagaccagggaaaaggaaaagacgctggagtcaaatttgttcgatgataatatcgatatttttgcagatctgaccgttaagcctaaagagaagtctaagaaaaaagtagaagcaaaaagtatatttgacgatgacatggacgatatcttttcctctggaatccaggccaagactacaaagccaaagtccagatccgcacaggccgcaccagaacccagatttgaacacaaggtctctaatatatttgacgaccctctgaacgcattcggcggacagtag

SEQ ID NO: 50180 - DNA, 3963 bp, Artificial Sequence
  Description of Artificial Sequence: Synthetic coding sequence
atgatgaaccggacaacgccagaccaggaactggctcccgcaagtgagccagtgtgggagaggccttggagtgtcgaggagattcgcaggtcctcacagagctggtccctagctgctgatgccggactactgcagttcctgcaggagttctcccagcagacaatcagcagaacacatgaaataaagaagcaggtggacggcttaattcgtgagacaaaagcaaccgactgtaggctccacaatgtgtttaacgactttctgatgctgtctaacacacaattcatcgagaatcgggtttacgatgaagaggtagaggaacctgtgctgaaggctgaggccgagaaaacggaacaagaaaagaccagggagcagaaggaggtggacctgattccaaaggtacaggaagccgtcaattatggactccaggttctggattctgccttcgagcagttggatattaaagctggcaatagcgattccgaagaggatgatgcaaacggcagggtggaactcatactcgaacctaaagatctttacattgacagacctttgccgtacctgatcggtagcaaattgtttatggagcaagaggacgtagggctgggtgagctcagttcagaggaaggatctgttgggtctgataggggaagcatcgtggacaccgaggaagagaaggaagaggaagaaagcgacgaggactttgcccatcactcggacaacgaacaaaacagacacactacacagatgtctgacgaagaagaagatgacgatgggtgtgatcttttcgcagattcagagaaggaggaagaggacatcgaagacatcgaggaaaacactcgccctaagcggtctcggcctacgtctttcgcagatgaactggctgccagaatcaagggagacgccgtgggtagagttgacgaggagccaactaccctgccctcaggagaggccaagcccagaaaaacgctgaaggaaaaaaaggagcggaggactccatctgacgacgaggaggataacttgttcgcacctccaaaacttactgatgaggactttagtccgtttgggtccggtgggggtttgttctccggaggaaaagggctattcgatgatgaagatgaagagtccgacttgttcactgaagccccacaagataggcaggccggtgcatccgtgaaagaggaatcaagcagttcaaagcccggtaaaaaaatcccagctggcgctgtgtcagtgttcctgggagacacggatgtcttcggcgctgccagtgtccccagcatgaaggagccacagaagcccgagcaacctaccccaaggaagtcgccctacggcccacccccaacgggcctgtttgacgacgacgacggagacgacgatgacgattttttttcagccccacactcaaaaccttctaaaactggcaaagtgcagtcaacagcagacatttttggggacgaggagggcgacctattcaaagaaaaggctgtggccagtcctgaggcaaccgtgagtcaaactgatgagaacaaggctcgagcagagaaaaaagtgacgctcagttcaagcaagaacctgaagccaagctccgagactaagactcagaagggtcttttctcagatgaagaggatagtgaggatttattttcttcgcagagcgccagcaaactcaagggtgcgtccctcttgcccggaaagctgcccaccctcgtgtctctcttcgacgatgaggacgaggaagataatttgtttggtggtactgctgccaagaagcagactctgtgtttgcaagctcaaagagaggagaaagctaaagcctcagaactgagtaagaagaaagcctcagccttattattcagctctgatgaggaagaccagtggaatatccctgccagccagacccacctggcgtctgactctcgctccaagggcgagcccagagactctgggactctgcaatcacaggaggctaaggccgtcaaaaagaccagtctatttgaagaagatgaggaggatgatctgtttgccatcgcgaaggacagtcagaaaaaaacccaacgagtgtctttgctgtttgaggatgatgtggattcaggtgggtctctttttggaagcccaccaacgtcagtgcctccagccactaaaaagaaagagactgtgtctgaggcccctcctctgctgttttccgatgaggaggaaaaggaagctcagttaggggtcaaatcagtggataaaaaggtggaaagtgcaaaggagtcattaaagttcggaagaaccgacgtcgccgagagcgagaaggaaggtctccttaccagaagcgcacaggagactgtaaaacacagtgacttgttctcttcatcctctccatgggacaagggtactaagccgagaacgaaaacggtgctgtctctgttcgacgaggaggaagacaagatggaagatcagaacattatccaggcccctcagaaggaggtgggcaaaggcagagatccggacgcccacccaaaatcaactggcgtctttcaagacgaggagctgctattcagtcacaagttgcaaaaggacaatgacccggacgtggacttgttcgccggaactaaaaagaccaaactgctggagccaagcgtgggctcactcttcggagatgatgaagatgatgatctatttagttctgccaaatctcaaccccttgtgcaagaaaagaagcgtgtcgtgaaaaaagatcatagtgtggattcattcaaaaaccagaagcaccccgaatctatccaggggtccaaggaaaagggcatttggaaaccagaaaccccccaggcaaacctggccatcaaccctgctgctctgctgcccacagccgcatcccagatttcagaagtgaagccagtcctccccgaactggcattcccatcatcggaacacagacgctcccacggcctagaaagtgtgccagtgctgccaggctccggagaagctggcgtttcatttgacctgccggcacaggcggacaccctacattctgcaaacaaatcccgggtgaaaatgcggggtaagcgacgtccccagactagggccgctagacgactcgctgctcaggagtctagcgagactgaggacatgagtgtccccagaggacctatcgcccagtgggcggatggggcaatcagtcccaacggtcatagaccccagctgcgggctgcctccggcgaggacagtactgaggaggctctggcggcagccgctgcaccctgggaaggtggtccagtcccaggagtggaccgctctcccttcgctaaaagtctgggacactcccggggagaggccgacctctttgacagtggggatattttttccaccgggaccggctcccagtccgttgagcgtaccaaacccaaggcgaagattgcggaaaatccagcgaacccccctgtcggcggtaaggctaagtcccctatgttccctgcactcggcgaggccagtagtgatgatgatctatttcaatccgcaaagcctaaacccgcaaagaaaactaacccctttccgctactcgaagacgaagatgatctatttaccgatcagaaggtgaagaaaaatgagacaaaatccaattctcaacaagacgtgatcctcacaacccaggatatcttcgaagacgatatttttgccacagaggcaattaagccctcccagaaaaccagggagaaagaaaaaaccttggagagtaatctctttgatgacaatattgatatatttgccgatcttacagtcaaacctaaggagaagtctaaaaaaaaggtcgaagctaaaagtatttttgacgacgatatggacgatatcttctcaagcggcatacaggcaaagacaacaaagcccaagagcagaagtgcccaagccgctcccgagcccagattcgaacataaagtatctaacattttcgatgaccccctgaacgcatttggaggccagtag

SEQ ID NO: 50181 - DNA, 3762 bp, Artificial Sequence
  Description of Artificial Sequence: Synthetic coding sequence
atgccccgactgtctggaaagagcgtgagagtgtacgatgaggaggtcgaagaacctgttctgaaagcagaagccgagaagaccgaacaggagaagacgcgtgagcaaaaagaagtggacctgatccctaaggtgcaggaggccgtcaattacggtctgcaagtcttggatagcgcttttgaacagctggatataaaggccggtaattccgattctgaagaggacgacgctaacggacgcgtagagctgatcctcgaacctaaggacctgtacatagatcgccctctgccctaccttattggaagtaaactttttatggaacaggaagacgttgggctgggtgaactctcctctgaagaaggctcggttgggtctgaccgtggtagcatcgtggacactgaagaagagaaggaggaggaagaatccgatgaggatttcgctcaccactcggataatgaacagaacaggcatactacacagatgagcgacgaggaagaagatgacgacggatgcgacttgtttgccgacagtgaaaaggaggaggaagatattgaggatattgaggaaaacacacgaccaaaacggtccagacccacctccttcgctgatgagcttgcagctagaatcaagggcgacgccgtagggagggtggacgaggagcccactaccctgccaagcggcgaagccaagccgaggaagacattaaaggaaaagaaggaaagaaggacccctagcgatgacgaggaagacaacctgttcgctcctccgaaacttacagatgaggatttctccccgtttggtagcggcggaggcctgtttagtggaggcaaggggcttttcgacgacgaggatgaagaaagtgacctgtttacagaagccccacaggataggcaagctggtgcctccgtgaaagaagagtctagttcttccaagccagggaagaagatccctgctggcgcagtttccgtgtttcttggagacactgacgtgtttggtgccgcttcggtacccagtatgaaagagccacagaagcccgagcagcctacacccaggaagtccccctacggcccacctccgactggccttttcgatgacgatgatggggacgacgacgatgacttctttagcgccccacattctaaaccatcaaagacagggaaagttcagtctaccgccgacatcttcggagatgaggaaggggatctgtttaaagaaaaagccgtagcctcccccgaggccaccgtaagtcaaactgatgagaataaagccagagctgaaaaaaaagtgactttgtcatcttctaaaaacctgaaaccgagttcagagaccaaaactcagaaaggcctcttcagcgatgaggaagattccgaggacctgttctcttctcaaagcgcgagtaagcttaagggcgcttccttactgccagggaagctgccaaccctggtgagtctgttcgacgatgaggacgaagaagacaatctcttcggcggaaccgctgccaagaagcagacactttgtttacaagcccagagagaagagaaagctaaggcgtctgagctcagcaagaagaaagcatctgcactgttgtttagctcagacgaggaggatcagtggaacattcctgcctctcaaacccacctcgcttcggatagccggagcaagggtgaacctagagatagtggaaccctgcaaagccaggaggctaaagccgtcaaaaagacctcattattcgaggaagatgaagaagacgacttatttgccattgccaaggattcccagaaaaagacacagagagtgagtctgctgtttgaggacgacgtggactcaggcggaagcctgttcggtagtccccctacctctgtgccgcctgcgactaaaaaaaaagaaaccgtgagcgaagctcctccactgctcttttctgatgaagaagagaaagaggcccagttaggcgttaagtccgtcgacaagaaggtggaaagtgccaaagagagcctgaagttcggcagaacggacgtcgcggaaagtgagaaagaggggctcttgacacgctcagctcaggagactgtgaagcacagcgacctatttagtagctcctcaccatgggacaagggaacgaagccacgcacaaaaacggtgctcagtctgttcgacgaggaggaggataagatggaagaccagaatataatccaggctccgcagaaggaggttggcaagggacgggaccctgatgcccacccaaagagtacaggagtctttcaggatgaagaactcttgtttagtcacaaactgcagaaggataacgaccctgatgtggatctctttgccggaaccaagaagacgaagctgctagagcccagcgtgggctcactttttggggatgatgaggacgatgatcttttcagttccgccaagtcacagccgcttgtgcaggaaaagaaaagggtagtgaaaaaggatcactccgtcgattcatttaaaaatcagaaacacccggagtctatacaggggagcaaggagaaagggatatggaagccagagactccccaagattcatcaggcctggccccatttaaaactaaggagcccagcacaaggatcggcaaaatccaggcgaatctcgctatcaatcctgccgcactcttgcccacagccgcttctcaaatcagtgaggtgaagccagtcttaccagaattggcttttccctcctcagagcacaggcgttctcacggacttgagagcgtacccgtgctgcctggatccggtgaagccggtgtctcatttgacctgccggcacaggctgatactctccattcagccaataagagccgggtcaaaatgcgaggcaagcggagacctcagaccagggctgcaaggcgtctggccgctcaggagtccagtgaaacagaggatatgagcgtccccagagggccaatagcccagtgggctgatggggctatcagtcccaacgggcaccgcccacagctgcgagctgcatctggagaggacagcaccgaagaagctttggctgccgctgccgcaccctgggagggcggacctgttccaggtgtggaccgatccccatttgccaaaagcctgggccatagccgcggagaggccgaccttttcgactctggcgatatattctctacaggcaccggaagccagtccgttgagcgcacaaagcccaaggcgaagattgccgaaaaccccgcaaatcctcctgtcggaggcaaagcaaagagcccgatgttcccagcccttggagaggcgagctcagacgatgatttgtttcagtctgccaagcccaaaccggctaaaaagactaacccgttcccgctactggaggacgaagatgatcttttcactgaccagaaggtgaaaaaaaacgagacgaaaagcaatagccagcaagatgtgatcctgaccacccaggatatttttgaggatgacatttttgccaccgaagctattaagccatctcaaaagaccagggagaaggaaaagacactcgagtccaatctcttcgacgataacattgacatcttcgcagatctaacagtgaagcctaaggagaagtccaagaagaaagtggaggccaagtccatctttgacgatgatatggacgacatattcagctcagggatccaggccaagaccaccaaaccaaagagtcggtccgcccaggcggcacctgaacccagattcgaacacaaggtctcaaacatttttgacgaccccctgaacgcattcgggggtcagtag

SEQ ID NO: 50182 - DNA, 3204 bp, Artificial Sequence
  Description of Artificial Sequence: Synthetic coding sequence
atgaaccgaacaacccctgaccaagagctggccccagctagcgaacccgtgtgggagcggccatggtccgtggaggaaattagacggtcatcccagtcttggtcattagctgcagatgcaggactgctgcagttcctgcaggagttctctcaacagaccattagccgcacacacgaaattaaaaaacaggtggacggtttgatccgcgaaactaaagctaccgattgccgcctccacaacgtatttaacgactttctgatgctgagtaacactcaatttatcgaaaatcgggtgtacgacgaggagggttcggtgggaagcgatcggggatctatagtcgacactgaggaggaaaaagaagaggaggagagtgatgaagattttgcacatcatagcgataacgagcagaacaggcacacaacacaaatgagtgacgaggaggaggacgatgacggctgtgatctcttcgcagactctgaaaaagaagaagaggatatcgaggatatagaggaaaatacgcgccctaagcgaagtagacccacatctttcgctgacgagcttgctgccaggattaaaggggacgctgttggacgggtcgatgaggagcctacgacactaccaagtggagaggcaaagccacggaagactttaaaggaaaagaaggagcggcgtactccctcggatgatgaagaggacaatttgtttgccccaccaaagcttactgacgaagattttagtccgttcggatccggagggggtctgttcagtggtggtaaagggttgttcgacgacgaagatgaggaatcggatctcttcaccgaagcgcctcaggaccggcaggcaggcgcttcagtgaaggaagagagttcttcttccaagcctggaaagaagatcccagctggcgcagtatcagtgtttctcggagatactgacgtattcggagccgcaagcgttccatcgatgaaagaacctcagaagccggaacagcccactccaaggaagagtccgtacggtccccctcctaccggtctgttcgacgatgacgacggagacgatgacgacgatttcttctccgccccacacagtaaacccagtaaaaccggcaaggtacagtctacagctgatatcttcggagatgaggaaggagacctgttcaaggaaaaggctgtggccagtccagaggctaccgtgtcccagactgatgagaacaaagccagggcggagaagaaggttacacttagctcatctaaaaatctcaagccgtccagcgagactaaaacacagaaaggattgttctccgacgaagaagactccgaagatctgtttagctcccagtccgcttccaaattaaagggggctagtctgctgccaggaaaactgccaacgctggtgagcttgttcgacgatgaagacgaggaggataatctcttcggaggcaccgcagccaagaagcagactctgtgtttgcaggcgcagagggaggaaaaagcaaaggccagtgagctcagcaagaagaaagcatccgcccttttgttctccagtgatgaggaggaccagtggaatattcccgcatctcagacacaccttgctagcgattcacgctccaagggagagccgagggatagcgggactctgcagagtcaagaggccaaagctgtaaagaagacatcccttttcgaagaggacgaggaagacgaccttttcgccattgccaaggacagccagaagaagacgcagagagtctctcttctgttcgaggacgacgtcgactctggtggaagcttattcggtagcccccctacatcagtgcccccagctaccaaaaagaaggagaccgttagcgaggcacccccactgctgtttagtgatgaagaggaaaaggaagctcagttgggcgttaagtctgtagacaagaaggtggaatccgcaaaagaaagtctcaaattcgggaggacggacgtagcagagagcgaaaaggagggactgttaactagaagtgctcaagaaactgtgaaacactccgacctgttcagcagctctagtccatgggataaagggactaagcccaggacgaagacagttctttctctctttgacgaggaagaagacaagatggaggaccaaaatatcatccaagctccccaaaaagaggtcggcaaaggcagagaccccgatgcccacccaaaatctactggcgtgtttcaagatgaagagctgctgttttcacataagctgcaaaaagataacgatccagacgtagacctgtttgcaggcactaaaaagaccaagctccttgagcccagcgtcggctcattgttcggggatgacgaggatgatgacctgtttagcagtgcaaagagtcagccacttgtccaggaaaaaaagcgggtcgttaagaaggaccacagtgtggactccttcaaaaatcaaaagcaccccgagagtatccaggggtctaaagagaagggaatatggaagcccgagaccccccaggattcatccgggttggcacctttcaaaaccaaagagccgagtaccaggatcggcaagattcaggccaatctcgcaatcaatcccgctgcgctactgccaactgccgcttctcagattagcgaggtgaagccagtcctgccggaattggcctttccgagctccgagcatcgtagaagccacggccttgagagtgtgcccgtcctgcccggatccggggaggcgggagtctcctttgacctccccgctcaggccgacacgctgcatagcgccaataagtccagggtcaaaatgcgcggaaaacgcaggccccaaactcgggctgctcgtagactggctgcccaggaaagctctgagacagaagatatgagtgtcccccgtggacctatagcacagtgggcagatggggcaatttccccgaatggccaccgtccacagttaagagcagcaagcggtgaagatagcacagaggaggccttggcagctgccgcagccccatgggaaggaggcccagtgccaggcgtggacaggtcccctttcgcaaagtccttagggcactccagaggggaggcggacttgtttgacagtggcgacattttctctaccggtacagggtctcagtccgttgaaagaaccaaaccaaaggccaaatttgggaagttatggccacctcactgccatatcctgttgattaagttctactggaatacttag

SEQ ID NO: 50183 - DNA, 471 bp, Artificial Sequence
  Description of Artificial Sequence: Synthetic coding sequence
tctccctgggataaggggactaagccacggacaaaaaccgttcttagtctgtttgatgaagaagaggataaaatggaagaccagaacattatccaggctccacagaaggaggttgggaagggccgtgatccggatgcgcatcccaaatccacaggcgtcttccaagacgaagagttgttgttctctcataagttgcagaaagacaacgatcctgacgtggacctgttcgcaggcactaagaagaccaagctgctggagccctccgtgggcagcctgtttggggatgacgaagacgatgatttgttcagttccgcaaaaagtcagccattagtgcaggagaaaaagagggtagtaaagaaagaccacagcgtggactcgttcaaaaatcagaaacacccagaatctattcaaggatctaaagagaagggcatatggaaaccagagactccacaggtgcgcaatcccctgtag

SEQ ID NO: 50184 - DNA, 3672 bp, Artificial Sequence
  Description of Artificial Sequence: Synthetic coding sequence
cgagtgtacgatgaggaagtcgaggagcccgtgctcaaggcagaagccgaaaagacagagcaggaaaagacccgtgagcagaaggaggttgacctgatacccaaagttcaagaggctgtcaactatggtctgcaggtgctggacagcgcttttgaacagctggacatcaaggccggaaatagcgatagcgaggaagatgatgccaatggtcgcgtggaacttatcctggagccaaaggacttgtatattgaccgacctttaccgtacctgatcggctctaagttgttcatggaacaggaggacgttggtttaggagaactgtcatctgaagaaggatccgtcggatctgacagggggtcaatcgtagacacagaggaggaaaaagaggaggaagagtctgatgaggattttgctcaccatagcgacaacgagcagaacaggcataccacgcaaatgtctgacgaggaggaggatgatgatggctgtgacctcttcgctgattcagagaaggaagaggaggatatcgaggacatcgaagaaaacacgcgccctaaacggagccgcccaacatcatttgccgacgaattggcagcgcgaattaagggggatgcggtcgggcgagtcgatgaagagccaaccaccctcccatcaggcgaagccaaaccacgcaaaactttaaaagagaagaaagaaagaagaacaccctcagacgatgaagaggataacctgttcacacctccaaagttgaccgacgaagactttagcccattcggctccggcggtggattattttctggtgggaaagggctgtttgacgacgaagacgaagagtcggatctgttcacggaggccccacaggaccgacaagccggagccagtgtgaaagaagaaagctcctccagcaagccaggcaaaaaaatccccgcaggggcagtgtctgttttcctgggcgacacagacgtgttcggtgccgcttctgtaccatccatgaaagaaccccagaaaccagaacagcctacaccaaggaaaagcccatacggaccccctccaaccggacttttcgatgacgatgacggagacgatgacgatgattttttctcggctccacacagtaagccttcaaagaccggaaaggtgcaaagcaccgctgatatctttggcgatgaggaaggtgacctctttaaggagaaagccgtggccagcccagaggccactgtgtcccagacggacgaaaacaaggcaagagcggagaagaaggtcaccctgtcttccagcaaaaatcttaaaccatccagtgaaaccaaaacccagaagggattgttctccgatgaagaagatagcgaggatcttttttcatcccagtcggccagcaagctaaagggggcttccctcctgcctgggaagctaccaacctctgtctccctgttcgacgacgaggatgaagaagacaatctgttcggcggtactgcagccaagaagcagaccctctgcctgcaggctcagcgtgaggagaaagccaaggcgagcgagctttcaaaaaaaaaagctagcgcccttctgttttcatcagatgaagaggatcagtggaatattcctgcctcccaaacacatttggccagtgatagtcgcagcaaaggagaacctagagattccggcacccttcaaagccaagaggccaaggccgttaaaaaaacgtcgctgttcgaagaagatgaagaggatgatcttttcgctatcgccaaagattcacagaagaagacccagagagtgagcctcctcttcgaggacgacgttgactctaggggttccctattcggctcccctccgactagcgtgccaccagccactaaaaaaaaagagactgttagtgaggctccccctctgctcttttcagacgaagaagagaaggaggcccagttgggagtcaagtctgtggataaaaaggttgagtctgccaaggagagcctgaagtttggccgaacagatgtcgccgagagcgaaaaagaaggacttttgacaagatcagctcaggaaaccgtgaaacactccgatctgttcagctcatcgtcgccctgggataaagggacaaagccaaggactaaaacggtactgagcctctttgacgaggaagaggataaaatggaggaccagaacatcatacaggctccccagaaagaggtggggaagggccgagaccctgatgcacatcccaagtctaccggggtgttccaggacgaagagctcctctttagtcacaagctgcagaaagataacgatcctgacgtagacctgtttgctgggaccaaaaagaccaagcttttggagccttctgtgggctccctgtttggcgacgacgaggatgatgacctctttagctctgccaagagccaaccactggtccaggagaagaagagagtcgttaaaaaggatcacagcgtggactcttttaaaaatcagaaacacccagagtctatccaaggatccaaggaaaagggcatttggaagccggagacgccccaggccaacctcgcaatcaatccagcggctctgcttcctactgctgccagccagatatctgaggttaagccagtcctccccgagctggcattcccatcatctgaacatcgcaggtctcacggattggaaagtgtgccagtcctgcctggatcgggcgaggcgggagttagctttgatcttccggcacaggctgatacgttgcattccgctaacaagtcaagggtgaaaatgcggggaaagaggcgccctcagactcgggcagccagacggctcgcagctcaagagagctccgagactgaggatatgtccgtgccaagaggtccaatcgctcagtgggcagacggagctatcagccccaacggacaccgccctcagcttcgcgctgcgagcggggaagacagtacagaggaggctctcgccgctgccgctgcaccctgggagggtggtcccgtgcctggagtagatcgatccccattcgccaaatctcttggacactcgcgcggtgaggccgaccttttcgatagcggagatatattctcgactgggaccgggagccaatctgtcgagagaacaaagccgaaggcgaagattgccgaaaatcccgcaaatccacccgtaggaggtaaggccaagtcaccaatgttcccagcattgggggaagctagctcggatgatgatctattccagtccgccaaaccaaagcctgccaagaaaacaaacacatttcctctccttgaggacgaggatgatctcttcacagaccagaaagtgaagaagaacgaaacaaaatctaattcccaacaagacgttattctcactacccaagatatctttgaggacgacatatttgctacagaagcaattaagccttcccagaagacacgggagaaggagaagactttagagtctaacttgttcgacgataatattgatatttttgctgaccttacagtgaagcctaaagaaaagtctaagaagaaggttgaggcgaagtccatcttcgacgacgatatggacgacatattttccagcggtatacaggcaaaaacaacgaaacccaagagccggtccgcccaggcagctccagaacccagatttgaacacaaagtgagcaacatcttcgacgatcctttgaatgcttttggtggacagtag

SEQ ID NO: 50185 - DNA, 3762 bp, Artificial Sequence
  Description of Artificial Sequence: Synthetic coding sequence
atgcccagactttcagggaaaagtgtcagggtttacgatgaagaggtggaggagcccgtcctgaaagccgaagccgagaagacagaacaagagaagacccgggaacagaaagaagttgacctgatccccaaagttcaggaggccgtcaactacggccttcaggtgctggacagtgcattcgagcagctggatatcaaggctggtaacagcgattccgaggaggacgatgccaatggtagggttgagctaattttagagcctaaagatctctacatcgaccggccacttccttatctcatcggctctaagctgttcatggaacaagaggatgttggccttggggaactaagcagtgaagagggtagcgtgggaagcgatagaggaagcattgtcgataccgaagaagagaaagaggaggaggagagcgacgaggatttcgcccaccattcagacaacgagcaaaatcgtcatacaacacagatgagcgatgaggaggaggacgatgatggatgtgacctgtttgcggattctgagaaagaggaggaagacatcgaggacattgaggagaacacccgtccaaaacggtctcggccaacatcctttgccgacgaactggccgctcgaatcaaaggcgacgcagtgggcagagtggacgaagaaccgacaaccctgccttccggagaagccaaaccccgtaagacgctgaaggagaagaaggaacgaaggaccccctccgacgatgaggaagataatctgtttacgccccctaagctgacggatgaagatttcagtccattcgggtccggcggtggtctcttctcaggaggcaagggcctgttcgatgacgaagatgaagagagcgacctgttcacagaggcaccgcaagacaggcaggcgggagccagcgtgaaagaagagagtagctcatcgaagcccggtaaaaagattcctgctggcgctgtgtctgtcttcctcggggacacagatgtgtttggcgctgcctccgtgccctcaatgaaggaaccgcaaaagccggagcaacccaccccgcgtaaatccccttatggccctccgccaacaggactctttgacgatgacgatggcgacgatgacgacgattttttcagtgctccgcactccaaaccctcgaagacggggaaggtgcagagcactgctgatatcttcggcgacgaggagggagacctgttcaaggaaaaagcggttgcctccccagaggctacagtcagccagaccgatgagaataaagctagggcagagaagaaagtgacgcttagtagtagcaagaacctgaaaccaagctctgagactaaaacacagaaaggcctgtttagtgatgaggaggattcagaagatttgtttagcagccagagtgcatccaagctgaagggcgcttccctcctgcccggtaagcttccaaccagtgtgagcctgtttgacgacgaggacgaggaggacaacctatttggagggacagcggcaaagaaacagactctctgcctccaggcacaacgcgaggagaaagccaaggcctcagagctgtccaagaagaaggcctcagcgcttttattctcaagcgatgaagaagaccagtggaacatcccagcctctcagacacacttggcatccgactctaggtccaagggcgagcctcgggattctggcacgctgcagtctcaggaggccaaagccgtcaagaagacttcccttttcgaagaggatgaagaagatgacttatttgctattgcaaaagatagtcagaagaagacccaacgggtgagtcttctgtttgaggatgatgtggactccagaggatctctgttcggttccccgccaacctccgtgcccccagcaacgaagaaaaaagagaccgtgtcggaggcaccaccgctgcttttcagtgatgaagaagagaaagaagcccagttgggtgtcaaatccgtggataagaaagtagagtccgcgaaagagtcattaaagtttggacgaacagacgtggccgagagcgagaaggagggcttacttacaaggagcgctcaggaaacggttaagcacagcgacctcttctcctcctcaagcccttgggataagggaaccaaacctcgtacaaagaccgtcctatcattgtttgacgaagaagaggataaaatggaagatcaaaacataattcaggcaccccagaaagaggttggaaagggaagagacccggacgcgcatcccaagagcaccggtgtgtttcaagatgaggagctgttattttcccacaagctacagaaagacaacgatccagacgtggacctgttcgccggaaccaaaaaaacaaagcttctggaaccttcagtggggtcgctttttggcgatgacgaagatgatgaccttttctccagcgcgaagtcacaacctttagtacaggagaagaagagagtggtgaaaaaggaccattccgttgatagcttcaagaatcagaaacaccccgaatctatccaggggagcaaggaaaaggggatatggaagcccgagacacctcaagattcgagcggtcttgctcctttcaagaccaaggagccctcaacaagaattgggaagatccaagctaacttggcaattaatcctgcagccttgttgcccactgctgcctcccaaatcagcgaggtaaaaccagtactgcccgaactggcttttccttcttccgagcataggcgttctcacggactcgaatccgtgcccgtgctgcccggtagcggggaagccggtgtttcattcgatctacctgcccaagccgataccctccactccgctaataaaagcagagttaagatgcgcggaaaaagacgccctcaaacaagggcagccaggcggctggccgctcaagaaagcagcgagacagaggacatgtctgtcccaagaggccctatagcccaatgggccgacggagcaatctccccaaacggtcacagaccgcaactccgtgccgctagcggggaagacagtacagaggaagccctggccgcagcggcagctccctgggagggcggtcctgtaccaggcgtggaccgttcacccttcgcaaagtctttgggccacagtcgcggagaagctgatctgtttgatagcggggatattttttctacagggactggcagtcaatcagtggaaaggacaaagccaaaagccaaaattgctgaaaaccctgctaatccccctgttgggggtaaggctaaatccccgatgttccccgcactgggcgaggcttcttctgatgatgacctgttccagagtgccaaaccgaagcccgcaaagaagaccaataccttccctctgcttgaagatgaggacgacctcttcacagaccagaaggttaaaaaaaacgagaccaagagcaattcacaacaggatgtgatcctgacaactcaagatatctttgaggatgatatattcgctactgaggctattaagccaagccagaagactcgcgaaaaagagaaaacactcgagtctaatctattcgatgacaatatcgacatctttgccgacctgactgtgaagccaaaggagaaaagcaaaaagaaggtggaggccaagtcaattttcgatgatgacatggatgacattttttcatcaggaattcaggcgaaaactacgaagcccaagtctcgctctgcgcaggccgctccggagcctcggttcgaacacaaagtctctaatattttcgacgatcctctcaatgcatttgggggacagtag

SEQ ID NO: 50186 - DNA, 828 bp, Artificial Sequence
  Description of Artificial Sequence: Synthetic coding sequence
gagccgtccgtaggaagtctgttcggggacgatgaggatgatgacctgttttcaagcgcgaagagtcagcccctggtacaggagaagaagagggtggtgaaaaaggaccacagcgtagattcctttaagaaccaaaagcatccagaaagcatacaggggtccaaagagaaaggcatctggaagccagagaccccccaagattcttcaggactggctccctttaagactaaggagccatctacacgcattggcaagattcaggctaacctggccataaacccagccgcactgttgcccactgctgcgtcacaaatctcagaagttaaacccgtgctgcccgaactcgctttcccgtctagcgaacatcgcagaagtcacggattagaatccgtccctgtcctgcctggctccggggaggccggagtaagctttgacctgcccgctcaggcagacaccctccattcagctaacaaatctagggtcaagatgaggggaaagaggcgacctcagactcgagctgccagaagacttgccgctcaggaatcctctgaaacagaggacatgagtgtgcccaggggacctatagcccagtgggccgatggcgctatctcccctaatggccatcgcccacagcttcgtgccgctagtggggaagattcaacagaggaagctctggccgctgccgctgctccgtgggaggggggtcctgtcccaggggtcgatcgctcacctttcgcaaagagtttaggacattcacggggtgaggccgacttgtttgattccggagacatcttcagcacaggcaccggcagtcagtctgttgaatag

SEQ ID NO: 50187 - DNA, 2769 bp, Artificial Sequence
  Description of Artificial Sequence: Synthetic coding sequence
atgaggaagaggatgatgatggccgtgacattctccttgacgctgaggcgcaggcgcaagattctccgaacactgaagaagatcttggacttgaaggaggcagacctgcacaggctgcagatgtcctggctgcctgcatcaaggggtatgccatgggtggagtggacacggtcccgtcaaccctatccgcaggagaaacagaatctggggaggcattcgaagaggagaaggaagggtgagcttttacaaacaatgaagcgtataacctactcacacccccctcttacagatgaggattttagccccttcggctcgggcggtggcttgttttctggtggcaaaggactgttcgatgacgaggacgaagaaagcgatttgttcacggaagcaccccaggaccggcaagctggagcctccgtgaaggaagaatcaagctccagcaaacccggtaagaaaatcccggctggtgcagttagcgtcttcttgggcgacaccgacgtgttcggggctgcctctgttccctccatgaaagagccccagaagccagagcagcccacaccacgcaagtccccttacggaccacctcccactggactgtttgacgatgatgatggggacgatgatgatgacttcttttccgccccacactctaagccctctaaaacaggaaaggtgcaatccacagctgatatcttcggtgatgaagagggagatctctttaaagaaaaggcagttgcatctcctgaggccactgtctctcagactgacgagaacaaagccagagctgaaaagaaagtgacactgtccagcagcaagaacctcaaaccttcctcagaaacgaagacgcagaagggactcttttctgacgaggaggactccgaggacttgttcagcagccaaagtgccagcaagttaaagggggcatctctattgcccggaaaactcccaacgagcgtaagtctcttcgacgatgaggatgaggaagataatctcttcggtgggactgcagcaaaaaagcagaccctgtgtctgcaggctcagcgcgaagagaaggcaaaggcctcagagctgtcgaaaaagaaggcctccgccctcctgttctcctccgatgaggaagatcagtggaacattccggcatcccagacgcatctggcgagtgactcccgcagcaagggagaaccacgagactccggaacgctccagtcacaggaggctaaagctgtcaaaaaaacaagcctgttcgaggaggacgaggaagatgacctgttcgccatcgcgaaggacagccagaaaaagacgcaaagggtatctttgctctttgaagatgacgtcgattcccgcggttctttatttggctcccctcccactagcgttccccctgccactaagaaaaaggaaacagtgtctgaggcccctccactcctgttttctgacgaagaggagaaggaggcacagctaggagtcaagtcggtcgataaaaaggtcgagagcgccaaggagagcttaaaattcggacgcactgatgttgctgagtcagaaaaagagggactcctcaccaggagcgcccaagagactgtgaagcactccgatctgttcagctcttcctccccctgggataagggcaccaagccgaggaccaaaaccgtcctgtccctgttcgatgaggaggaggacaagatggaagatcaaaacatcatccaggcgccacagaaggaggtcgggaagggaagagaccctgatgctcaccccaaaagcactggagtctttcaagacgaagaacttttattcagccataagctgcaaaaggacaatgatcctgatgttgacttatttgcgggaactaaaaaaactaaactgttggagccctcagtgggctcgctattcggagacgatgaagacgatgacctgttttctagtgccaagtcacaacccttggtgcaggaaaagaaaagagtcgtcaagaaggaccactctgttgatagcttcaagaatcaaaagcatccagagtctatccaagggtcaaaggagaaaggcatctggaagcccgaaactccgcaagacagctctggacttgcaccctttaaaactaaggagcctagcacccgtatcggaaaaatccaagcaaacctcgcaataaaccccgctgcactcctgccaacagccgctagccaaatctcagaagtgaaacccgtgctgccagagctggcattcccgagctccgagcatcgcaggtcgcacgggctcgagtcggtccctgtactacccggatctggtgaggctggggtctctttcgaccttccagctcaagcggatactttacatagcgctaacaaaagccgggtcaaaatgcgaggcaagagaagaccacagacgcgggctgccagacggctcgccgcacaagaatcgtctgagacagaggacatgagtgtgccaagggggccaattgcacagtgggctgacggcgcaatctctccaaacggccatcgccctcaactcagggccgcatctggcgaagattcaacagaagaagctctcgccgctgctgcggctccctgggaagggggtcccgtacccggagttgacagaagcccctttgcgaagtccctcggccacagtcggggtgaagctgatctgttcgactccggggacattttcagcactggcaccggatcacaaagcgtcgagcgcacgaagccgaaagccaaattcggaaaactctggcctccccactgtcacatcctgctgatcaaattttactggaacacatag

SEQ ID NO: 50188 - DNA, 1533 bp, Artificial Sequence
  Description of Artificial Sequence: Synthetic coding sequence
atggaagatcagaatattattcaagccccacagaaagaagtgggaaaaggcagggatcctgacgctcacccaaagagtaccggggtgttccaggacgaggaactgctcttctcacacaaattgcaaaaagacaacgaccccgatgtcgacctcttcgcaggtactaagaaaacaaaactcttagaaccctcagttggaagtctgttcggcgacgatgaggacgacgacctgttttctagcgcgaaaagccaacctcttgtgcaagagaagaagcgcgtggtgaaaaaagaccactcagtggactcttttaaaaatcagaaacatcctgaatctattcagggatccaaggagaaaggtatctggaagccagagaccccacaggcaaatcttgcaatcaacccagccgcactcttaccaacagccgcttcacaaatatcggaggtgaagcctgtactgcccgaactcgctttccctagtagcgagcatcggagatcccacggtttggagagcgtgcccgtcttgcccggaagtggcgaggccggagtgtcctttgatctacctgctcaggcggacaccctgcattccgccaataagagccgtgtaaagatgcggggaaagcgtcgtccccagactcgtgccgcacgtagattggccgctcaagaaagtagcgaaacagaagacatgtccgtgccgaggggcccaattgctcagtgggctgatggtgccatttctcccaatgggcacaggccacaactccgggctgcgtcaggagaggattctacagaggaggcacttgcggcagccgctgcaccctgggagggcggtcctgtacccggtgttgatcgatctcctttcgctaaatccttggggcattctcggggagaagccgacctgttcgactctggtgacattttcagcaccggaacaggctctcagtctgtcgaacgcacaaagcccaaggccaagatagctgaaaacccggcaaatccgcctgtcggtggcaaggctaagtcaccaatgttcccggcactgggagaggcgtcaagcgatgacgacctgttccagtccgcaaaacccaagccggcaaaaaagactaacacattcccacttcttgaggatgaagatgatctctttacagatcaaaaagtgaaaaagaatgaaactaaatccaattcccagcaggacgtcattttaactactcaggacatttttgaggacgacatctttgctacggaggcaatcaaacctagccagaaaacaagagaaaaagagaaaacccttgagtcaaatctgttcgatgataatatagacattttcgccgacctcaccgtcaaacccaaagagaaaagtaaaaaaaaagtcgaggctaagagcatcttcgacgacgatatggatgacatatttagctccggcattcaggctaagacaacaaaaccaaagtcccgatccgcacaggctgctcccgagccgaggttcgaacacaaagtgagtaatattttcgacgatccgttaaacgcgttcggtggccagtag

SEQ ID NO: 50189 - DNA, 819 bp, Artificial Sequence
  Description of Artificial Sequence: Synthetic coding sequence
atgcagtggaatgtgcctaggaccgtgagtcgccttgcgaggaggacctgtcttgaaccccacaatgccggactgtttggtcattgtcagaacgtgaaaggaccgctgctgctttacaatgccgagtctaaggtagtcctcgtgcaaggaccacagaagcagtggctccatctgagtgccgcacagtgcgtcgcaaaggagaggaggccactggatgctcatccgcctcagcccggagtgttgcgccacaagcaagggaaacagcacgtgtccttcagacgagtgtttagtagctccgcaacagcccagggcactccagagaagaaggaggaaccagatccactgcaggataagtccatctcactttatcaacggtttaaaaaaaccttcaggcagtacggaaaggtccttatccccgttcacttgataacttcgggggtgtggttcgggactttttattatgccgcactcaagggcgtgaacgtggtcccctttctggaactgatcggattacctgacagtgtggtcagcatcttgaaaaattctcagtcaggtaacgcactaaccgcttacgctctgtttaaaatcgccacacctgcccgttacacagttactctgggaggtacctcagtgactgtgaaatatctgaggtctcatgggtacatgagtacgccacccccagtgaaggagtatctgcaggaccgaatggaggagaccaaggagttgataactgagaaaatggaagagaccaaggatcggttgactgagaagctgcaggaaaccaaggaaaaggtgtcatttaagaaaaaagtagagtag

SEQ ID NO: 50190 - DNA, 819 bp, Artificial Sequence
  Description of Artificial Sequence: Synthetic coding sequence
atgcaatggaacgtcccgagaacagtttccaggctagcaaggcgcacatgcttggagccacataacgccggtctgttcgggcactgccagaatgttaagggccctctcctgctgtataacgcagagtcgaaagtcgttctggtgcagggcccacaaaaacagtggctccacttatctgcagcgcagtgcgtcgcaaaagagaggcgacctttagacgctcatcctcctcagcccggagtcctgcgccacaagcaggggaagcagcacgtctcgttccgaagagtgttctcatcctcagccacggcccagggaacccctgagaaaaaggaggaaccggatccattacaagacaaatctatttcattataccaacgttttaagaaaactttcaggcagtacggaaaagtgcttatccctgtacacctgatcactagtggtgtgtggtttggaacattttactacgccgcattgaaaggcgttaacgttgtgccgttcctggaattaataggcctaccagactccgtcgttagcatcctcaaaaattctcaatctggtaatgccctgaccgcgtacgctctcttcaagatcgcaactcccgcacggtataccgtgaccctaggcggaacgagcgtgactgtgaagtatctaaggagtcacggctacatgagtactcccccaccagtgaaggaatatctgcaagaccgtatggaggagactaaagagctcatcactgagaagatggaagaaactaaagatcggcttacggaaaagctgcaggaaaccaaagaaaaggttagttttaaaaagaaagtcgagtag

SEQ ID NO: 50191 - DNA, 579 bp, Artificial Sequence
  Description of Artificial Sequence: Synthetic coding sequence
atggccggactgttggcgctactcggtcccgctggacgcgttggagccagagtcaggccaagggccacttggctgttgggggctaccgctccttgtgcacctccccctctggctctggccctcctcccaccacgcctggatgcaaggctactacgcacggcgaggggggattgcagggggcatcaggacccctcacaggccactggcaccacaggatcatccgtgagttgtaccgaggaaaaaaaacaatctaagagccagcagctcaaaaagatttttcaagagtacggaacagtcggcgtgagcctccacattggcatctcactgatctcccttggcattttttacatggtggtgagttctggcgtggatatgccggctatccttctgaaattaggctttaaggagtccctcgtgcagagcaaaatggcagccggaacctctacttttgtggtggcgtacgccattcataagctgtttgctcctgttagaatttctataaccctggtgagtgtccccctgatcgttagatatttcagaaaagtcgggttctttaagccgccagccgctaaaccgtag

SEQ ID NO: 50192 - DNA, 945 bp, Artificial Sequence
  Description of Artificial Sequence: Synthetic coding sequence
atgtgtcccaccctcaacaatattgtctcttccctccagaggaacgggattttcatcaactcccttattgctgccttaacaatcgggggacagcagttattctcctccagcacattctcttgcccatgtcaggtcggaaagaacttctactatggaagtgccttcctggtcattccagcgctcatacttctggttgcaggctttgccctgcgatcccaaatgtggacaattactggcgagtattgctgtagctgtgccccaccataccgcaggatctcccccctcgaatgcaagctagcgtgcctgcgattcttctctatcactggaagggcggtaattgctcccctcacctggctggccgtgacactacttaccggaacctattacgaatgcgccgcaagtgagttcgcatccgtggaccactatcccatgtttgataatgttagcgcatcaaagcgcgaggaaatccttgctggattcccctgctgtcgaagcgccccttctgatgtgattcttgtgagagatgagatagctctgctacaccggtaccagagccaaatgttggggtggatcctgattacgctcgccactattgctgcactagtgtcgtgctgtgttgccaaatgttgctcacccctgacaagtctgcagcattgttactggaccagtcatctccaaaatgaaagggagctctttgaacaagcagccgaacaacatagccggctccttatgatgcatcggataaaaaaactgttcggctttatccctggctccgaagacgtgaagcacatccgcattccctcctgccaagattggaaggatatctctgtgccaactctgctctgtatgggagacgaccttcagggacactacagctttttgggcaatagggtggatgaagacaatgaggaagataggagtcgtggcatagagctgaaaccatag

SEQ ID NO: 50193 - DNA, 387 bp, Artificial Sequence
  Description of Artificial Sequence: Synthetic coding sequence
atgctcggctggatccttataacactagccaccatagcagcactagtgtcatgttgtgtggctaagtgctgtagccccttgacttccctgcagcattgttactggacctctcatctacagaatgagagagagctctttgagcaagcagccgagcagcacagcaggctgctcatgatgcatcgcataaagaaattgttcggcttcattccaggctccgaagatgtgaaacacattagaatcccgtcttgtcaggattggaaggatatctccgtgccaactctactctgcatgggagatgatttacagggacactattcattcctggggaatagggtggatgaagataacgaggaggaccggtcacgcggaattgagttaaagccttag

SEQ ID NO: 50194 - DNA, 516 bp, Artificial Sequence
  Description of Artificial Sequence: Synthetic coding sequence
atgttcgataacgtgtccgcctcaaaaagggaggagatacttgccggattcccctgctgcaggtccgcgcctagcgacgtgatcctggtccgtgacgagattgctcttttacatagataccagagccagatgctaggatggatcctgattaccctggccaccatcgctgcactggtctcttgttgtgtcgccaaatgttgcagccctctgacatcacttcagcactgctactggaccagtcacttgcagaatgagcgcgagctctttgagcaggcagctgagcagcatagccgcctgctgatgatgcatcgaattaaaaaactgtttgggttcatcccgggttctgaagacgttaagcacattagaatcccatcctgtcaagactggaaggatatcagtgtgcctactctgctctgtatgggcgacgacctccaggggcattactcctttctggggaatcgtgtggatgaggacaacgaagaggataggagccgtggtattgagctgaaaccttag

SEQ ID NO: 50195 - DNA, 513 bp, Artificial Sequence
  Description of Artificial Sequence: Synthetic coding sequence
atggccccaaggagcgccaaagagacattcagaattaatccgaacgtggcggcaaatctgtccgccccttccgacgttatactcgtgcgagacgaaatcgcgctgttacaccgttatcagtctcagatgctgggctggattctgattactttggcaactatcgcagcactcgtaagctgctgcgtagcgaaatgctgctccccgctgacgtctctgcagcactgctactggacctcgcaccttcagaacgagagggagttattcgagcaggccgcagaacagcactctagattgctgatgatgcacaggattaaaaaactcttcggctttattcccggatcagaggacgtgaagcacataagaatcccgtcctgccaggactggaaagatatatcagtccctacactgctctgcatgggggatgacctgcagggccactactcctttctgggaaacagagttgacgaggacaacgaagaggatcgatctcgcggaatcgaattgaagccttag

SEQ ID NO: 50196 - DNA, 372 bp, Artificial Sequence
  Description of Artificial Sequence: Synthetic coding sequence
atgctcgggtggattctcattacactggcaactattgctgccctcgtgtcttgctgcgttgccaagtgttgctcccctctaacatccttgcaacactgctactggacctcgcatctccagaatgaacgggagctgtttgaacaggctgccgagcagcacagtcgccttctaatgatgcacaggataaagaagttattcgggtttatccccggatccgaggacgtgaaacacatccgcatcccctcatgccaggattggaaggatatctctgtgcccaccctgctatgcatgggagacgacctgcagggccactatagctttttaggcaatcgagtggacgaggacaacgaagaagatcggagccggggatag

SEQ ID NO: 50197 - DNA, 930 bp, Artificial Sequence
  Description of Artificial Sequence: Synthetic coding sequence
atggatgcctttcagggcattctgaagttctttctcaaccagaaaacggtaattggatatagtttcatggctcttctaacggtaggctcggaacggctgttctccgtggtggcctttaaatgcccttgcagcacagaaaatatgacctatggcctggtgttcctttttgcgcctgcctgggtgctcctgatcctgggattttttctgaacaataggagctggagattgttcactggttgctgtgttaaccctcgtaaaattttccccagaggccattcctgtagattcttttacgttctgggccaaataaccttatccagcctggtggccccagtcatgtggctgagtgtcgccctgctgaatgggacgttttacgagtgtgcaatgagtggaacgcggtcaagtgggttgctcgagctaatctgtaagggtaaacccaaggagtgctgggaggaacttcataaggttagctgcggcaagacctccatgctgcccactgtgaacgaggagctaaaactatccctgcaggcccagtcgcagattttgggttggtgtttgatatgcagcgcctcatttttttccttacttactacatgctacgcaagatgtaggagcaaggtgtcctacctccaactgtcattttggaagacttacgctcagaaggaaaaagagcagctggagaataccttcctggattatgccaataagctttcggaacgcaacctgaagtgtttttttgagaataagagaccggacccctttcccatgccaaccttcgccgcttgggaggccgcttctgagctacactcattccaccaaagccagcaacactactcaactctccaccgggtggtggacaacggtctgcagctgagtcctgaggacgatgagaccacaatggtcttggtggggaccgcacacaacatgtag

SEQ ID NO: 50198 - DNA, 948 bp, Artificial Sequence
  Description of Artificial Sequence: Synthetic coding sequence
atggaaaagttccgtgccgtgctcgatctccacgttaagcaccactccgcactcgggtatgggctcgttaccctgctgaccgctgggggtgagagaatcttttcagcggtcgccttccaatgcccatgctccgctgcctggaatctcccttacggattggtatttcttctggtgcctgcattggccctcttccttctcgggtatgtgcttagtgctagaacttggcgactcctgactggttgctgctcctcagctagggcaagctgcgggtcagccctgcgagggtcactggtgtgcactcagatttccgccgctgccgcactggcgcctctcacctgggtggcagtggccctgctgggtggcgctttctacgagtgcgccgcaaccggttctgctgccttcgcccaaagactgtgtctaggtagaaatcggtcctgtgctgccgagctgcccctggtgccgtgcaatcaggcgaaggccagcgacgtgcaggatctgctgaaagatttgaaggcccagtctcaagttctaggatggatattgatagccgttgttattattattctgttaatctttacaagtgtcactcggtgtctttcccccgtctctttcctccaactgaagttttggaagatttacttggagcaggagcagcagatcctcaaaagcaaagcaaccgaacatgcgaccgagctcgccaaggaaaatatcaaatgttttttcgaaggatctcatccaaaagagtacaacacaccttctatgaaggaatggcaacagatttcctctctgtacacttttaaccctaaaggccaatactattctatgttacacaaatatgttaatcgcaaagagaagactcattccattcggtcaacagaaggcgacaccgtgattccagtgttaggattcgtggactcatccggaatcaactcgacgcccgaactctag

SEQ ID NO: 50199 - DNA, 204 bp, Artificial Sequence
  Description of Artificial Sequence: Synthetic coding sequence
atgcggaagccccaggccggaacgggcgaagcagcccgagatccttccttaaggcccgcacggacagttttggtgggggatcaggacgagtacaccgcggctgaaaataagagtcctcgaggaaccttgtgccctaccggtgagcagaggattcatgcccgagaagatgcatgtatcttcagtaggctgttctccgagaagtag

SEQ ID NO: 50200 - DNA, 393 bp, Artificial Sequence
  Description of Artificial Sequence: Synthetic coding sequence
atggctgcgcctcctgagcccggtgagcccgaggagagaaaagcctcttgcactagcctgcatctcagctactggaaaagcctcaagctgttgggctttctcgatgtggaaaacacaccttgcgctcggcactctatcttatacggctccctgggctcagtcgtggcaggttttggacactttctctttacaagtcgtattagaaggtcctgcgacgttggtgtgggaggtttcatcctagtaacgttgggatgttggttccactgtcggtacaactatgccaagcagaggattcaggagcgtattgcaagggaagagataaaaaagaagatcttatacgagggcacccatctggacccggaaaggaagcacaatggttcctcttccaattag

SEQ ID NO: 50201 - DNA, 357 bp, Artificial Sequence
  Description of Artificial Sequence: Synthetic coding sequence
atggccgctcctcctgagcctggagagcccgaggagagaaaaagcctgaaactgcttggatttctggacgtcgaaaacaccccttgtgcccgtcactcaattctgtacggatctctgggcagcgtggtggccggattcggtcatttcctattcaccagcaggattaggcggtcctgcgacgtgggcgtcggcggtttcatcctggtcaccctgggatgctggttccattgtaggtacaattatgctaagcagaggattcaagagcgaattgccagagaggaaatcaagaagaaaatcctgtacgaaggcactcatcttgatcctgaacgaaagcataacggaagctccagcaattag

SEQ ID NO: 50202 - DNA, 1680 bp, Artificial Sequence
  Description of Artificial Sequence: Synthetic coding sequence
atggtggagaaaatactgatccatagaattctgactttatttcccaatgcaatagccaggaagttattactcatgctaacattcattctcatattctggatcatttatttagcttcaaaagaccacacaaagttttcttttaatctcgagaatcatatcattctgaatcagggcaacatttttaagaagtactcccacagcgagacgcctttatgtccggctgtaagccctaaggaaactgaactcagaatcaaggatattatggagaagctggatcaacagattcctcccaggccatttacccacgttaacacaacaactagcgctacacactctacggctacaatactaaatccgcaggacacgtactgccgtggcgaccagctcgacatacttctagaggtccgggatcatctcggccaccggaagcagtatgggggagacttccttcgcgcaagaatgtactcaactgccttaatggccggagcctccggcaaggtgactgactttaataatggcacgtacttagtcagctttacactgttctgggaaggccaagtcagcctgtcactgcttcttatacatcctagtgaaggcgtgtccgcgctgtggagggctagaaatcagggctgcgaccggatcatcttcaccggcctatttgctaataggtcatctaacgtttttaccgaatgtggactgacactgaacaccaacgccgagctgtgccagtacatggacgacagggatcaagaggccttttattgcgtccgaccccagcatatgccctgtgaggctctcacacacatgactactagaacaaggaacatcagttatctgagcaaagaggaatggcggctctttcaccgctctaatatcggtgtggagatgatgaaaaattttactcccattgaggtgattccttgcaacaagagtgagaatattaaaaaaaattgccaaatcggtatgaaaacacccttcccgagcgggtatacactgaagaaaatgtggataacagccttctgtaaacagatcaagtttaatgagaccaagaatattaatgactgcctcgaaaggaaactcatatatctgatgggcgactctactctgcaccagtggatttactacctgcagaaagccgtgaaaactttgaagtacttcgatcatcatggcgctggcattttcaagacccacgtcctcttagacgtggagcggcacattctcatccagtggaaaaaacatgggcaccccttcgtgacaaaaaagttatttagtgtgaaggatgagaattacatacccagagaaatcgatcaggtcgccggtgataagaacaccgcaatagtgatcacgctgggtcaacactttcgcccatttcccatcaacatctttatccgtcgagccatcaatattcagaaggcaattgagaggctgtttttacggtcccctgagacgaaggtaatcctcaagacagagaatacacgagagattgaacagaatgctgagatgttcagtgactttcacggatatatccaaaatctcattatcagagacatctttgtagacctgaacgtgggcatcatagacgcatgggatatgactattgcatattgcaccaataatgcgcatcccccagattacgttattcagaaccagatcggtatgttcctcaactacatttgctag

SEQ ID NO: 50203 - DNA, 1098 bp, Artificial Sequence
  Description of Artificial Sequence: Synthetic coding sequence
atggtcgagaaaatacttatacatcggattctcaccctgttccctaacgcgattgctaggaaacttctcctgatgctgacattcatattgatcttttggatcatttacctagccagtaaggaccatacaaagttcagcttcaacctcgaaaatcacattatattgaaccagggcaatatctttaaaaagtatagtcattccgagacgcctctttgcccagccgtctccccaaaggaaaccgagttgaggatcaaggatatcatggaaaaattggaccaacagatcccccctcgaccttttactcacgtgaacactaccacctcagccactcacagcactgcgacgatcctgaacccacaggatacatattgcaggggagatcaattggacattctcctcgaggtgagggaccatttgggccatcgaaagcagtacggcggtgacttcctccgcgcaaggatgtacagtacagccctgatggcaggtgcctccgggaaggttaccgatttcaacaacggcacgtaccttgtgtcgtttactttgttctgggaagggcaggtgtccttgagtctccttctgattcatcctagcgagggtgtgtctgccctatggagagccaggaatcaggggtgtgaccggatcatctttacaggactgttcgctaatcggtcctcaaacgtgttcaccgaatgtggtctgactcttaataccaatgctgaattgtgccagtacatggatgatagggaccaggaggcattctattgcgtgaggccacaacatatgccatgcgaagctctgacacacatgacaacaagaacgaggaacatctcatatctttccaaagaggagtggaggttatttcacagaagtaatatcggggtggagatgatgaagaatttcaccccaatcgaagtgatcccctgccctgcattgttttatttcattttcagggattcactcactctgtctccccgtctcgaatgctctggcatgatctcagcccactgtaatctgtgtcttccagggagttctgacagcccggactcagcctcacacgtcgccggaatcacctcagtccagcggcatacatggttgtag

SEQ ID NO: 50204 - DNA, 726 bp, Artificial Sequence
  Description of Artificial Sequence: Synthetic coding sequence
tagcagacagcacggtgtcattccggtctggtttcgtccgtgcaggcaatcatggccagcacagccggttatattgtttctaccagttgtaagcacatcatcgatgatcagcactggctgagcagtgcatatacacagtttgccgtgccatatttcatatacgacatttatgccatgttcctgtgccattggcacaaacatcaggtaaaaggccacggtggagacgatggagccgctagggctcccggatccacatgggctattgccagaggctaccttcacaaagaattcctgatggtgctccaccatgctgctatggtccttgtatgttttcctcttagcgtggtgtggcggcagggcaaaggggatttctttctgggctgcatgctcatggcagaggtctcaacacctttcgtgtgcttgggcaagatactcatacaatataagcagcaacatacgctgctccacaaggtcaacggtgcactaatgttgttgtcctttctgtgctgtcgggtgcttcttttcccatatttatattgggcctacggcagacatgccggtctgcctcttttggctgtgcctctggcaatcccagcacatgtcaatcttggcgcagctctcctgctggcccctcagttgtattggtttttcctgatctgcagaggggcttgccgcttgttctggccaaggtccaggccaccaccagcctgccaggcccaggactag

SEQ ID NO: 50205 - DNA, 825 bp, Artificial Sequence
  Description of Artificial Sequence: Synthetic coding sequence
atgctgacccctatggtcgccggaggagtagttttccctggactcttcctcctttcaaaaaataccctccagaggctcccccagctaaggtgggaggaagccgacgccgtgatcgtgagtgctcgactggtgtcgtccgttcaggccatcatggcaagcaccgctggctacattgtgtcaacctcttgcaaacacataatcgatgaccagcattggctgtctagtgcttacactcagtttgcggtaccatatttcatttatgacatttacgctatgttcttgtgccattggcacaagcatcaggtgaagggccatgggggtgatgacggtgccgcacgagcaccgggttctacatgggcaattgctcgaggttaccttcacaaggagttcctcatggtgctccatcatgcagccatggtgctcgtgtgtttccctctgagcgtagtgtggcggcaaggcaagggagatttctttcttgggtgtatgttgatggcagaagtgagtactccgttcgtgtgtctgggcaagatcctcatccagtacaagcagcagcacactctcctgcacaaagtgaatggtgctctcatgcttttgagttttttatgctgccgagtgctcttgtttccctacctttactgggcttatggtaggcatgcagggttacccttactggccgtgcctctggccattcctgctcacgtgaacctcggagctgctttgctgctggctcctcagctctattggttctttctgatctgcaggggggcttgtaggctgttctggcccagaagtaggccaccccctgcatgccaagctcaggactag

SEQ ID NO: 50206 - DNA, 1287 bp, Artificial Sequence
  Description of Artificial Sequence: Synthetic coding sequence
atggctcggtctctctgtcccggtgcgtggctcaggaaaccgtactacctacaagccagatttagctacgtacgaatgaagtaccttttcttttcctggctggtagtattcgtgggttcctggattatttatgttcagtactctacctatacagagctgtgtcggggtaaagactgcaagaagatcatttgtgacaaatacaagacaggggtgattgatggcccagcttgcaatagtctgtgtgtaacagagacactgtatttcgggaaatgtctgtctaccaaaccaaacaaccaaatgtacctgggaatttgggacaatttaccaggtgtagtgaaatgtcaaatggagcaggcccttcatttggacttcggtacggagctcgaacccagaaaggaaatcgtgttgtttgacaaacctactcgagggactacggttcagaaattcaaagaaatggtctactccctctttaaggcaaaattaggggatcagggtaatttaagcgaactagtaaacctcatacttactgttgccgatggcgacaaggatggtcaggtgagtctgggcgaagctaagtcggcgtgggccctgctccagctgaatgagtttctactcatggtgatccttcaagataaagagcacactccaaaactcatggggttttgtggagatctgtacgtaatggaaagcgtggaatacacctctctgtatggcatctctctgccttgggtgatcgagctttttattccttcaggttttcggagatctatggaccagctgttcacgccaagttggccacggaaggctaaaattgccataggtctgctggagtttgtcgaagacgtctttcacggtccctacggaaatttcctgatgtgcgacactagtgctaagaatctgggctacaacgacaaatacgaccttaagatggttgacatgcgcaaaatcgtgcccgagacaaatttaaaagaactcatcaaggacaggcactgcgagagtgatctggactgtgtgtacggtaccgattgcaggacttcctgcgatcagagcaccatgaaatgtacaagcgaagtgattcagcccaacttagctaaggcttgccagttgttgaaagattacctactgcggggagctcccagtgagatccgagaggagctagaaaaacagctctacagctgcatcgcgttaaaagtgaccgccaaccaaatggagatggagcattcgttaatcctgaataacctgaagactctgctgtggaagaaaataagctacaccaacgacagctag

SEQ ID NO: 50207 - DNA, 489 bp, Artificial Sequence
  Description of Artificial Sequence: Synthetic coding sequence
atggcacgctctctctgtccaggcgcttggctgcggaagccttactacctgcaggccagattttcttacgtgcgaatgaagtacctgtttttctcctggctcgtagttttcgtgggttcgtggattatttatgttcagtacagcacgtacaccgagctctgccggggtaaggactgcaaaaagatcatctgcgacaaatataagacaggtgtgattgatgggcctgcctgtaacagtctgtgtgtgactgaaactctgtatttcggcaagtgtctgtctactaaacccaacaatcagatgtatttgggcatctgggataatttgcctggcgtagttaagtgtcagatggagcaagcattacatttggacttcggcacagaactggaacccaggaaagaaatcgtgctctttgacaaaccaacacggggaactactgtccagaagttcaaggagatggtctactctctctttaaagacaggcataggtag

SEQ ID NO: 50208 - DNA, 1035 bp, Artificial Sequence
  Description of Artificial Sequence: Synthetic coding sequence
atggtcgagtggcgcacatgcctgagcgtcgccccagggcaacaggtatacagcggattatggcgcgacaaggatgtaacaatcaaatgcggcatagaggaaaccctggattccaaggcccgatctgacgccgcacccagaagggagctggtgctgttcgacaagcccaccaggggcacaagcatcaaagagtttcgcgaaatgacattgtctttcctcaaagctaatcttggcgatctcccaagtcttcccgcactcgtgggccaagtgttgctgatggccgattttaacaaagataacagagtgtccttagccgaggccaagtctgtctgggccttgctccagcgtaacgagtttctgctgctactgagtctacaggagaaggagcatgcctcccgtctgctcggctattgcggggatctgtacttgaccgagggagtgcctcacggagcatggcatgctgctgcattgcccccacttctgcgtcccctcctaccccctgcgctccagggcgctttacaacagtggctgggcccagcatggccctggagggctaaaatagccattggtttgctggaattcgtagaggagttatttcacgggagctatggcacattttacatgtgcgaaactacactggccaatgttggatacaccgctacctatgattttaaaatggcagatctccaacaagttgccccagaggccactgtgcgaaggtttctgcagggccgtaggtgcgagcatagcactgattgcacatacggaagggattgccgtgcgccttgtgatcgtttgatgcgacagtgcaagggcgatctgattcagccaaacttggcaaaagtgtgcgccctgctccggggatacctccttccaggcgcacctgcagacttgcgcgaggagctggggacccagctccgtacttgcaccacgctatctggtctggcctcccaggtggaggcacaccattcccttgtcttgagccacctaaaaactctcctttggaagaaaatcagcaacaccaagtattcctag

SEQ ID NO: 50209 - DNA, 1296 bp, Artificial Sequence
  Description of Artificial Sequence: Synthetic coding sequence
atgcgacggctgaggaggctggcacacctggtcttgttttgtccctttagcaagcgcctccaggggaggcttccgggactcagagtgcggtgcatatttctagcctggctgggggtcttcgctggttcctggctggtttatgtccactattcgtcatactctgagagatgccgaggccatgtttgtcaggttgtgatctgtgatcaatataggaaaggaattattagtggatcagtgtgtcaagacttatgcgaactgcatatggtagaatggcgcacctgcctgtccgtagccccaggtcagcaagtatactcaggtctgtggcgggacaaggacgtcaccatcaaatgtggcatcgaagaaactctggatagcaaagccaggagcgatgctgctcccagacgcgaactagtgctcttcgacaagccaacaagaggaacatcaattaaagaattcagagagatgactctttcgtttctaaaggcaaacctgggtgacctcccatcgttgcctgcactggtggggcaggtactgttaatggccgatttcaataaggacaatcgtgtttctctggcagaagccaaatctgtgtgggctctgctgcagcgcaacgaatttctgttgttgctttcccttcaggaaaaggaacacgctagtcggctgcttgggtactgtggtgacctctacctcacagagggggtccctcacggcgcttggcacgctgccgcactaccgcctctgctgcggcctttgctccctccggcactccaaggcgctctgcagcaatggttgggcccagcctggccatggagggccaaaattgccatcggcctgctcgaatttgtcgaagagttgttccatggttcatacggcaccttttatatgtgcgagactacacttgcaaacgtggggtacaccgcgacttacgacttcaagatggccgacctgcagcaggtcgcgcctgaagccacagtgagaaggttcctgcaaggcagacggtgcgaacactcaactgattgcacctacggcagggactgtagggccccatgtgatcgcctcatgcggcagtgtaagggcgacctgattcagcccaacctggccaaagtttgcgccttattgcgcggttacttgctgccaggtgctcctgctgatttgagggaggagttgggcacgcaactccgaacatgcactaccttgagcggcctggctagtcaagtcgaggctcatcattctctcgtgctgagccaccttaagactctgctttggaaaaagataagcaacaccaagtatagttag

SEQ ID NO: 50210 - DNA, 1260 bp, Artificial Sequence
  Description of Artificial Sequence: Synthetic coding sequence
atggcaagagccgcaggggctagaggcccagcagggtggtgtcgcaggaggggcagatgtggacgcggaacacttctggctttcgcagcctggacggcgggttgggtgcttgccgctgcgttactgctgagggcccatcccggagtgctttccgagagatgcactgacgaaaagtctcgccgaattctagccgctctgtgtcaggactatcagggaggcacactagccggagacctgtgcgaggacctctgtgtggcaggcgaactgctattccagcggtgtctgcactacaatcgagggaaaaaagtgctgcaggctgactggcgaggtcggccagtagtgctaaagagcaaggaagaggccttcagtagcttcccacctctgagcctcctcgaagaggaagccggtgagggtggtcaggatatgcctgaagccgagttactgctgatggtcgcgggagaggtgaagagcgctctcggcctggagctctccaatagctctcttgggccatggtggcccggtagaaggggtcctcgctggcgtggacagctagcctcgctgtgggccctccttcagcaggaagagtacgtgtatttttccctgctgcaagatttaagtccgcacgtgctacccgtgctgggcagttgtggacatttctacgccgtcgagtttctggccgcagggtcccctcatcaccgagcactgttccctttagatcgcgctccaggagctccaggtggcggacaggctaaagccatttccgacatcgccctctcttttctcgatatggttaatcacttcgattcagacttcagccaccgcctgcacttgtgtgacataaagcccgagaactttgccattcgcagcgactttacagttgtcgctattgatgtggacatggccttttttgagccgaaaatgcgcgagatcctcgaacagaattgcaccggggacgaagactgtaatttcttcgattgtttctcgagatgtgacctgcgagtgaacaaatgtggagcacagcgcgtcaataacaatctgcaggtgatatgtgacaagattttccggcactggttctccgcccctcttaagagctctgctgtgagcttccagctgcaactccagctacaggaagccgtgcaggagtgtgccgaccctggcgtaccttccgggaacactcgtagggcagcttcctctgtgttctggaagctaaggcaactgctccaagccacactccgagaactgcaggaggctgaaaagtag

SEQ ID NO: 50211 - DNA, 1050 bp, Artificial Sequence
  Description of Artificial Sequence: Synthetic coding sequence
atgcaccagtcattgacccagcagcgctcttcagacatgagtttgccagatagcatgggcgcttttaataggcgaaagagaaactctatttacgtcacagtgaccctgctgatcgtgagcgttctcatcctgactgtaggcctagctgctactacacgaacacagaatgtgactgtgggcggttattacccaggagtcatcctggggtttggctctttcctgggcatcatcgggtcgaacctcattgagaacaaaagacagatgttggtggcatcgatcgtgttcatttctttcggagtcattgctgccttctgctgtgcaatcgtcgatggggtattcgcagccaggcatatcgatcttaagcccctgtacgccaaccgctgtcactacgtcccaaaaacctctcaaaaagaagccgaagaggtcattagctcaagcaccaaaaactcccctagcacgagagtcatgaggaatcttacccaggctgcccgagaagttaactgtccacatctgtccagagaattttgcacacctaggatccgtgggaatacatgcttctgttgtgacctttacaattgcggcaatagagtagagattaccgggggttactacgaatatatagacgtcagctcttgtcaggacattatacatctatatcacctgctctggtctgccacgatcctcaatatcgtgggcctgttcttaggtattattacagctgccgtccttggcggtttcaaggacatgaatcccacactaccagccctaaactgctctgtcgagaacactcaccctactgtgagttattacgcccacccacaggtagcgagctacaacacatattaccacagtcctcctcacctccctccctacagcgcttacgacttccaacattcaggggtgttcccctcctcacctccaagtggactatccgacgaacctcagtctgctagtcctagtccatcttacatgtggtcatcatcggcccctcccagatattccccaccctactacccaccattcgagaagccccctccatactctccatag

SEQ ID NO: 50212 - DNA, 558 bp, Artificial Sequence
  Description of Artificial Sequence: Synthetic coding sequence
atggtgaattgcccacacctttctcgggagttttgcacacctagaattcggggaaatacctgcttctgttgcgatctatacaactgcggcaatcgagtcgaaataaccggtggctattatgaatatattgatgtgtcttcctgtcaggacattattcatctgtatcatctcctgtggagtgcgaccatcctgaatattgtgggcttgttcctgggcattatcaccgctgccgtcctcggcggattcaaagatatgaaccccactcttcccgcactgaattgtagtgtcgagaacacacatccaaccgtatcctattacgcccacccacaggtagcctcgtacaacacatattatcactcaccccctcaccttcccccatactccgcttatgacttccaacacagcggggtcttcccttcaagcccaccttctggactaagcgacgagccccagagtgcaagtccttctccatcttatatgtggtctagctccgctccccctcgttactcacccccatactatccgcctttcgagaagccgcctccttactcaccttag

SEQ ID NO: 50213 - DNA, 978 bp, Artificial Sequence
  Description of Artificial Sequence: Synthetic coding sequence
atgcatcagtcactgactcagcaacgttcttctgatatgtccctgcccgactctatgggcgcatttaaccggagaaaacgtaacagtatctacgttaccgtgacattattaattgtgtctgtgctgattctaactgtcggcctagccgctacaacacgcacccaaaacgtgaccgttggtgggtactatcccggtgtgatcctcggtttcggttctttcctgggcatcattgggtccaatctgatcgaaaacaaaagacagatgctggtggcgtccatcgttttcatctcatttggggtcatagccgctttctgctgcgcgatcgtggatggcgtgttcgctgccaggcatatcgacctaaaacccctgtatgccaataggtgccattacgtgccaaaaaccagccagaaagaagccgaggaagtgaattgtcctcacctcagccgtgagttttgtacacccaggatcagaggaaatacgtgcttctgctgcgacctctacaactgcggaaatcgggtggaaatcacggggggttattacgaatatatcgatgtctctagttgtcaagacattatccacctatatcatctattatggagcgccacaattctgaatatcgtaggcctcttcctggggatcattacagccgctgtgctgggcggattcaaagacatgaaccccacccttcctgccctcaactgctccgtggaaaacactcatccaacggtgtcctactatgcacaccctcaggtggctagctataatacatattatcattcacctcctcatctgccgccatacagcgcatatgattttcagcactccggcgtgttcccatcctccccaccctcgggcctctcggatgagccccaatccgcctcgccgtcaccgtcctatatgtggagctccagcgcacccccacgctattcccccccttattatcccccattcgaaaagccccctccctactcgccctag

SEQ ID NO: 50214 - DNA, 726 bp, Artificial Sequence
  Description of Artificial Sequence: Synthetic coding sequence
atgcaccaaagcctgactcagcagcgaagttccgacatgagcctgcccgactctatgggggctttcaaccgtcgaaaacgcaacagcatatacgtaactgttactctgttaatagtcagcgttttaatactcacagtgggtctcgcagcaaccacaaggacacagaatgtgacggtcggaggctactatccaggcgtcattctgggcttcggcagctttctcgggatcattggaagcaacctaatcgaaaacaagcgccagatgctggttgcatctattgtctttataagctttggcgtgattgcagcattttgctgtgcgatcgtcgatggtgtgttcgccgctcgacacattgatttgaagccactctatgccaaccgttgccactatgtcccaaaaacatcccagaaggaggccgaagaaaatcccacgttgccagcactcaactgctcagtggagaacacccaccccacagtgtcctattacgctcatccccaggttgcctcatataacacatactatcatagtcccccacacctccccccttattctgcttatgactttcagcattcgggggtttttcccagctctccaccttccgggctgtccgatgagcctcaatccgctagtccctcaccatcttatatgtggagctcaagcgcgccacctcgatatagcccaccgtattacccgccattcgagaagccacccccttactccccctag

SEQ ID NO: 50215 - DNA, 981 bp, Artificial Sequence
  Description of Artificial Sequence: Synthetic coding sequence
atgcagcctccagtcccgggaccgctaggtctgctggaccccgcagagggcctgtcaaggcggaagaagacgagcctttggttcgtggggagtctacttctggtctcagtacttattgtcacggtaggtcttgctgccacaaccagaaccgagaacgtgacagttgggggttactaccctggtataatcctgggcttcggaagcttcctggggataattggcatcaatttggtggagaatcggcgacagatgctggtcgctgctatcgtgttcatcagttttggggtcgtcgctgcgttttgttgtgccatcgtggacggagtgttcgctgctcagcacatagaacccagacccctgaccacaggcaggtgccagttttattcctctggcgttggttacctatatgacgtgtatcaaacagaggtgacctgccacagccttgatggcaaatgtcagttaaaggtgaggtcaaatacctgttattgctgtgatctctatgcctgtggttcggccgaaccaagtccagcttattacgagttcattggggtctctggctgtcaggatgttcttcacctgtaccgcctattgtgggccagtgcagtgttgaatgttttgggacttttcctgggtattatcaccgccgctgtattaggagcttttaaggacatggtccccctgtcccagctggcctacgggcctgcggtcccccctcagactctctacaaccctgcccagcagattctggcatacgccggtttcaggttgactcctgaacccgttccaacgtgtagctcctatccattgccgctgcagccctgctctcggttccccgtcgcccctagctctgctctagcctctagcgaagacctgcaacctccatctccgtctagcagcgggagtggcctgcctggtcaggcacccccttgctacgccccaacttatttccctccaggcgaaaagcccccaccttacgccccatag

SEQ ID NO: 50216 - DNA, 1899 bp, Artificial Sequence
  Description of Artificial Sequence: Synthetic coding sequence
atgagcgactgttgtagcgcccctgggatatcatgggaggccggagttggcagacccgcagtacctggcttagaactgcagatccgacggggagcaatgtcagaagaaacagtttctgaatcccagtttagcctgaaaactgccgcattgcgggtgttcgatctcccccttacctggtactatagcctgtcgcaaataaagttttcaccagtagccaagaaactctttgtggtaaccgctgtgtcggccattagtgtaatctttttggctcatcacttcaagcgtaagcgaggaaaaaagaaggggaaaatcctgccatgggagccagaacatcttattcttgaatacactaaaagagcggcttcggacaagggctcctcttgctcatctagccgccagaacctgaccctgagtctgtcaagcaccaaggacaagggcagccaggtttgcaattacgccaacggcggtctattcagcaaatatagcgggtcagctcagagtctggccagtgtgcagtccgtgaacagttgtcactcctgtgcgtgtgggaattcaaactcttgggacaaagcagatgaggatgacatcaagctcgtgaatatcccagtgactacccctgagaatttgtacttaatgggaatggaattgtttgaagaggctctgaggcgctgggaacaggctctcacattccgtaataggcaggccgaggacgaggcgtgtgggtcgattaagctcggagccggtgatgccatcgcagaggagaacgtggacgacattatttcaacggagttcatccacaagctggaggcgttacttcagcgcgcttaccgactacaagaagaatttgaagcgacgctgggtgcgtccgatccaaatagcttggccgatgatattgacaaggatactgacatcaccatgaaaggtaatgtggaggacttcgggttacgagataccttgtccattgcctctacagattcgtttgcctctgctgccgagttagccgaacaccgggaagtccggcatacttactctctggaatctctatgccattgtccattctacgaggaggcgatgcacttggttgaggagggcaagatctatagtagggtccttcgtacagaaatgctcgaatgtctgggggactctgacttcctcgcaaaactgcattgtattcgtcaggcgtttcaggtgattttgagtgagagcgccaatcgcatttttctggccgagagcggccgtaagatcctctctgccctgattgttaaagccaggaagaacccaaaaaagtttgaggatgtttttgacgaaatgatatactttctcgagcagacggatcactggggctcaacagaaatggagcttgccgctcgtggcgtgaaaaatcttaacttctatgacgtggtgctagactttatattaatggactccttcgaggatctggagaatccacctacaagcatccagaacgtggtgaacaatcgctggctcaactcaagcttcaaagaaactgctgtggcgagtagttgctggagtgtgctgaaacagaagagacagcagatgaaaatccctgatggtttcttcgcccacttttatgcaatttgcgaacacatcagccccgtgttggcgtggggattcttggggcctcgcaactcactatatgacctttgctgtttttttaagaatcaggtcctcctgtttctgaaggatatcttcgattttgagaaagttaggtactcgagcacagaaaccctcgcagaggatctcatgcagttactgattcgtcggacagaattgttgatggcatatctggaagcggacgccctgcggcacacttccagttgtctgtcctctcacgggcacgttatgagcactggccttctggaggcaaaggttcagtag

SEQ ID NO: 50217 - DNA, 1788 bp, Artificial Sequence
  Description of Artificial Sequence: Synthetic coding sequence
atgagcgattgctgctccgccccaggcatttcgtgggaagcaggagtgggacgaccagctgtccccggtcttgagttacagattaaattctcaccggtagcaaaaaagctgttcgtcgtcactgctgtgagcgctatctcagttatttttttagcccatcacttcaagcgtaagcgtggcaaaaaaaagggtaagatcttgccttgggagcccgagcatctgatcctggaatacaccaaacgcgctgcaagcgataaagggtcatcttgtagctcttctagacaaaacctaacactctcattgagttccactaaggacaaggggtcgcaagtctgcaactatgccaatggcggtctgttttctaaatacagtggcagcgcgcagagtcttgcttccgtccagtcagtcaactcttgccacagttgtgcctgcggcaactccaacagctgggacaaggccgacgaggacgacattaaactcgtcaatatccccgtaactaccccagagaatctgtacctgatggggatggagctgttcgaggaggctctcagaagatgggagcaagccctcacgtttaggaaccggcaggcggaggacgaggcctgcggctcgattaaactgggagcaggcgatgcgatcgccgaagaaaacgtggacgacatcatctctactgaattcatacataagcttgaggctctactgcagcgggcttatagactccaggaggaattcgaagccacgcttggcgcatcagatcctaattctctggccgatgatattgacaaagataccgatatcaccatgaagggaaacgttgaggattttggtttgcgagacaccctgagtatcgcatctaccgacagcttcgcttctgccgcagaactggcggaacacagagaagtgagacacacctactccctagaaagcctttgtcactgccctttctatgaagaagccatgcacttggtggaagagggcaagatttactctcgcgtgctgcggacggagatgttggaatgtctgggcgacagcgattttttagccaaactgcactgcattcggcaggctttccaagtgattctgagtgagtccgccaataggatcttccttgccgaaagtggcaggaaaatcctgagcgcattgatcgtcaaagctcgcaaaaaccccaaaaagttcgaggacgtgtttgacgaaatgatttacttcctcgagcagaccgatcattggggaagcacagagatggagctcgccgctaggggagtgaagaacctgaatttctacgatgtggtactcgactttatcttaatggattcttttgaggatctggagaacccccctaccagcattcagaacgttgttaataataggtggctcaacagcagcttcaaagaaacagcggtggcttcatcctgctggtccgtgctgaagcagaagagacagcagatgaaacaaatccccgacggattctttgcgcacttctacgccatctgcgagcacattagtcccgtgctggcttgggggttccttggcccaagaaacagtctgtacgacctatgctgcttctttaaaaaccaggttcttctgttcctcaaggacatattcgactttgagaaagtacggtatagttccacagagacactggctgaggacctaatgcagctgctgatcagacgtacggagctcctgatggcctatctcgaggcggacgctttgaggcacacatcctcctgcctgtcgtctcatggtcatgtgatgtctactggcctgctggaggcgaaggtgcaatag

SEQ ID NO: 50218 - DNA, 972 bp, Artificial Sequence
  Description of Artificial Sequence: Synthetic coding sequence
atggcctttcggagagcagagggtacatcaatgattcaggcacttgccatgacagttgccgagattccagttttcctttacacgacgttcgggcaatccgccttctcgcagctgcgtttgaccccgggattgagaaaggtgctgtttgcaaccgcgttgggcacggtcgccttagccctcgccgcacatcaacttaagcgtagacgacggaggaagaaacaggtcggcccagagatgggtggagagcagctgggcactgttcctcttccaatacttctcgctagaaaggttcccagtgttaaaaaagggtactccagtagacgtgtgcaaagtccctcatcaaaaagtaatgacaccttaagtggcatctcaagcattgagccatctaaacactcaggatcaagccactcagtggcttcaatgatggctgtgaactcctccagccctacggccgcttgcagtggcctgtgggacgcccgaggcatggaggagtcgttgactacatctgatggaaacgccgaaagtctttatatgcaagggatggagctttttgaggaggcacttcagaaatgggaacaggccctcagtgttggtcagcgcggagacagcggctcaacacccatgcccagagacggacttcggaaccctgagacggctagtgaaccactgtctgaaaccgagagccacagtgttgcgagactggaatgttcaggtgctattagtgcccagtgtaacttacgcttcctgggatcacgggatagtcctgcctcagcgtcccaagtcgccggaatcacagctagggtcacagcagagggagtgtgcagagaggctggcgttccagctgccccttgtctccctcccgcaggaggcgtcaggcttcaccttccaaggagacagcacgctgctaggcctagggaagatccgcacgctgctccagaccgaggccttgctgcagctgctggcggacggtag

SEQ ID NO: 50219 - DNA, 1782 bp, Artificial Sequence
  Description of Artificial Sequence: Synthetic coding sequence
atggcattcaggcgggcagaaggaacttccatgatccaggccctcgctatgacggtggccgaaatcccagtctttctctacactacctttggtcagagcgcattctcgcagctgcgcctgacgcccggtctgcgcaaagttcttttcgccacagccctgggaacagtcgcactggctctcgccgcacatcagctgaagaggcggcgacggagaaaaaaacaagttgggcctgagatgggcggtgaacagctgggcacagttccgctgccaatactgctggccaggaaggtgcctagtgtcaaaaagggatatagcagccgccgagtgcagtctccttcctctaaaagcaatgacacactctccggcatctcatccattgagccttctaagcattcagggagcagccatagcgtcgcatccatgatggctgttaactctagttccccgactgcggcatgctccgggttgtgggacgccagaggcatggaggaaagcctaacaacctccgacggcaacgccgagagcctgtacatgcagggaatggaattgtttgaagaggctctccagaaatgggagcaggctcttagcgtgggtcaacggggagatagcgggtcgacacctatgccaagggatgggctcaggaaccccgaaactgcatcagagcccttgagcgaacctgaatctcagaggaaggaattcgccgagaaattggagtcactgctgcatagagcctatcacctgcaagaggaattcggctctaccttccctgctgatagcatgctgctggatctcgaaaggaccctaatgctgcctctcacagaggggtccctacggttaagggccgatgacgaggatagcctcacctctgaggatagctttttttctgccacggagttgttcgagtccctccagaccggagactaccctatacctctttctaggccagcagctgcttatgaagaggcactccagctggttaaggagggacgggtgccatgccgaacactacgcacagaattgctggggtgttactccgaccaggacttcctggcaaagctccattgtgtccgtcaggcctttgagggtctgttggaagacaaatccaatcagctgtttttcggcaaggtcggaagacaaatggttactggcttgatgaccaaggccgagaaatctcccaaggggtttctcgagagttacgaagagatgttgtcatatgcactgaggccagaaacctgggctacaaccaggctggagctggaaggtcgcggtgtggtttgcatgagcttttttgatatcgtgctggattttattcttatggacgcctttgaggatctggagaacccaccagcctccgttcttgccgttcttcgtaaccggtggctctccgattcattcaaagagaccgcattggctacggcttgttggtccgtcttgaaggccaaaagaagactattaatggtccctgatggatttatatctcacttctacagcgtctctgaacatgtgtcacccgtgctggctttcggcttcttgggaccaaaaccccaactcgcagaggtttgcgcctttttcaaacaccagattgtgcagtacctcagagatatgtttgatcttgataacgtcaggtataccagccttcctgcccttgcagatgacatcctgcaattgtccagaagacgatctgagatcctcctgggatacctgggtgtgccggcagcatcttccgctggagttaacggggctctccctcgtgaaaacggtccattaggagagctacagtag

SEQ ID NO: 50220 - DNA, 1050 bp, Artificial Sequence
  Description of Artificial Sequence: Synthetic coding sequence
atggcatttcggcgagctgagggcacctccatgattcaggctttggccatgactgtcgcagagattcccgtatttctctatacgactttcggccagagtgccttctcacagctccggttgacaccgggtctacgaaaagtgctctttgccacggcactcggcaccgtggcccttgccttggccgcacatcaattgaaaagaaggcggaggagaaaaaagcaggttggtcccgagatgggtggggaacagctgggtaccgttcccctgcccattctgctggcgaggaaggtgccctcagtgaaaaagggttactcctccagacgtgtgcagtccccatcatccaaatccaacgacaccttgtccggcatatcttctatcgagccttccaaacactcaggatcctcacactccgtcgcttctatgatggcagttaactcctcaagtcccactgccgcttgctcagggctgtgggacgcacggggtatggaggaatcgctaaccacgtcagacggcaacgccgagagcctgtacatgcaggggatggaactgtttgaagaagccttacaaaagtgggaacaggccctgtccgtggggcagcgcggagactccggcagcactccaatgcctcgcgatggtcttcggaatccggagacagcctccgaaccccttagcgagccggagagtcagagaaaagaattcgcagagaaactcgaaagccttctgcaccgggcttaccacctccaggaggaatttggctctacatttccggctgactcaatgcttctagacctggagcgcaccctcatgttgccgcttacggagggatcactgcggctaagggcagatgatgaggactccctcacatcagaagattccttcttctctgccactgagctttttgaatctcttcagaccggggactaccccatcccattatcacggccagccgcagcttatgaggaggccctacagctggtgaaagaaggccgtgttccctgcagaacattgagggctcccaaagcttcatggagagccactaggcgctgctag

SEQ ID NO: 50221 - DNA, 303 bp, Artificial Sequence
  Description of Artificial Sequence: Synthetic coding sequence
atggcatttcggagagcggaaggaaccagcatgattcaggccctggctatgacagttgccgagattcccgtgttcttatacaccacgtttggtcaatccgccttttcccagctcaggctgacaccaggattgcgcaaagttttgttcgctacagccctggggactgtcgccctagccctagccgctcaccagctgaagagacgcagacggaggaaaaagcaggtggggccagaaatggggggagagcagcttggcaccgtacctctgcctatcctgctcgctaggaaggtcccctctgtttag

SEQ ID NO: 50222 - DNA, 384 bp, Artificial Sequence
  Description of Artificial Sequence: Synthetic coding sequence
atgtggagagagctgcgaggttgcccagggggtgacgtcgagaccgctcaacggctctcccaacgaaggcgcggtaaatcaagcgaagcagtacctgagaagacatggcgggcacagagaatgtcacaaaggcggcgaggagaaagctctgaagccgtgccggagaagacgtggaaggaactgcggaattctgaaactgtaccagaaaagacatggaagcaacttcgaagatgcctgcaggaggatgtggagcgcgtgcaacgactgtcactcctcctccatctggctgtgtttctctggattataatagccatcaatttttcgaactctggggtaaaatctcagtccagcacctaccttcctagcggcaagatccttaagtag

SEQ ID NO: 50223 - DNA, 384 bp, Artificial Sequence
  Description of Artificial Sequence: Synthetic coding sequence
atgtggagagaactccgaggctgcccaggcggagatgtggagactgcccagcggctgtcccaaagaaggagaggaaagtcttccgaggccgtgccagaaaagacctggcgggctcagaggatgagtcagcgcaggcggggagagtctagcgaagcagtgcccgaaaaaacctggaaggagctgcgcaattcggaaaccgtgcctgaaaaaacatggaagcagttgcgtcggtgcctgcaagaagatgtggagcgggtgcagcgcttgagcctgctgttgcacctggccgtcttcctctggatcattattgctatcaatttttcaaattcaggcgtgaaaagccagagctcaacctacctgccatccggaaaaatcctaaaatag

SEQ ID NO: 50224 - DNA, 4044 bp, Artificial Sequence
  Description of Artificial Sequence: Synthetic coding sequence
atggaaaatctgccctttcccctgaagctgctgtcagccagttccctgaatgccccatcctctaccccctgggtcctcgacatctttctgactctcgtgtttgcacttggattcttttttctgcttttgccttacctgagctatttccgatgcgatgatcctccttcaccctcccccggaaaaaggaagtgcccggtgggtagaagaaggaggccacgagggaggatgaagaatcacagcctccgagctgggagggagtgcccacggggactgcaggagacctcagacttactgagccagctccagagcctgctcggcccacacctcgacaagggagactttggtcagttgagcggtcccgaccctcccggagaagtcggcgagagggccccagatggagcctcacagagttcgcatgagcccatggaagatgcagcgccaatactatcacctctggccagccccgaccctcaggctaagcaccctcaggatctcgcttccactccttcccctggaccaatgaccacctcagtgagcagtctgtcagcatcccagccccctgagccttctttgccacttgagcacccttcaccggagccacccgcactcttcccacatccccctcacacgcccgatcccttagcctgttctcctccccctccaaagggctttaccgccccacccctccgcgattcgaccctgattacaccctcccactgcgatagtgtggccttgcccctaggcacggtgccacagtcattgagcccccacgaagacttagttgcttcggtgcccgctatctccggcctcggcggtagtaattcccacgtctctgccagtagcagatggcaggaaaccgccagaacctcctgtgcttttaacagctctgttcagcaggaccacctctctcggcatcctcccgagacataccagatggaagctggctccctatttctcctttcatcggatggccaaaatgccgtgggaatccaggtcacagaaaccgcaaaagttaatatctgggaggagaaagagaatgttggatcatttactgaccggatgacacctgagaagcaccttaatagtttaaggaatcttgctaagagtcttgatgcagagcaggatacaaccaaccccaaaccattctggaacatgggggagaatagcaagcagttaccgggtccccaaaaattatcggacccacggttgtggcaggagagcttttggaaaaactatagccaactgttctggggcctgcctagccttcattcggagtccctagtggccaacgcttgggtgaccgaccggtcctatacactgcagagccctcccttcctcttcaacgaaatgtctaatgtgtgccctatccagcgggagactaccatgtccccactgctttttcaggcccaaccacctagccatcttggacccgaatgccagccgtttattagcagcactccccagttccgccctactccaatggcccaggctgaggcccaagcccatctccagagctcttttcccgtcctgagtccagcgttcccttcactgattaaaaatactggcgtggcatgtccggctagtcaaaacaaagtgcaggcattatcactgcctgagacacaacaccctgagtggcccctgctgagacgccagttagagggaagactggcactcccttcccgggttcagaaaagccaggatgttttctccgtatcaacgccgaacctcccccaagagtccctcactagcatccttcctgagaatttccctgtgagtcctgaattgaggcgacagctggaacagcacatcaagaaatggatcatccagcattggggcaatctgggccgaattcaggagtccctggatctgatgcagctgcgcgatgaaagtccaggaacaagccaggctaagggcaagcccagtccctggcagtcttccatgtcaaccggcgagtcgtctaaggaagcccagaaggtcaaattccagctcgaaagggatccatgcccccacttaggccagatattgggggagactccccagaacctcagcagggatatgaaaagcttccccagaaaggtgctgggtgtgaccagtgaagaaagcgagcggaatctgcgcaagcccttgcgtagcgactcgggtagcgaccttctgcggtgtacagagcggacacacattgagaatatcctcaaggcccacatgggcagaaaccttggtcagacaaatgaggggttaattccagtgagggtccgacgcagctggttggccgttaaccaagcccttcccgtctccaatactcatgtgaagacttcgaacctcgcggcacctaagagcggaaaagcatgcgttaataccgctcaggtgttgtcctttttggaaccatgcacccagcagggcttgggggctcacattgtgcggttctgggcaaagcataggtggggcctgccgcttcgggtgttgaagccaatccagtgttttaaactggagaaagtgtctagcttatcactgacacagctggctgggccttcctcagcaacctgtgaatcaggcgctgggtcggaagtcgaggtggatatgtttctgcggaagcccccaatggctagcctccgcaagcaggtgctaactaaagcctccgaccatatgcctgagtccctcttagcctcatcacccgcatggaaacaatttcagcgcgctccgaggggaattcctagctggaacgaccatgggccactgaagccaccccctgctggccaggaaggccgatggccctcaaaacctctgacgtactccctgacagggtctacccagcagtcgagatcactcggcgcacaatcctccaaggccggtgagactcgggaagccgtcccccagtgtcgggtgccgcttgaaacatgtatgctcgccaacttgcaggcgacttctgaagatatgcatggttttgaggcacccggtacctccaagagcagcctacaccccagagtgtctgtgagccaggatccaagaaagctttgtctgatggaggaggtggtcaatgaatttgagcctggaatggcaacgaaaagtgaaactcagccccaggtatgcgccgctgtggtcctgctgccagacggacaggccagcgtggtgccgcacgcttccgaaaacctggtctctcaggttccacaaggccacctgcaatctatgcctgcaggcaacatgagagcaagccaggagctgcacgacttgatggccgcaaggcgctcgaaactggtgcatgaagagccacggaacccaaactgccagggctcatgtaaaaatcagcgaccaatgttcccccctattcataagagcgagaagtccaggaagcccaacctggagaaacacgaagagagattggaagggctaaggacccctcagctcacccccgtcaggaagacggaggatactcaccaggatgagggggttcagctgctgcctagcaagaagcaacctccttccgtgtctcacttcggcggaaatatcaaacagttctttcaatggatcttttccaagaaaaaaagtaagccagcccctgtgacagcagagagtcagaagacagtcaagaaccgttcctgtgtctacagttccagcgccgaggcacaagggctaatgaccgccgttgggcagatgctggacgagaaaatgtccctctgtcacgccaggcacgctagcaaggtgaaccaacacaagcagaaattccaggccccagtgtgcggattcccttgtaaccacaggcatctgttttacagcgagcatggacgcatcctgagctacgcggcttcttctcagcaggccactctgaagtcgcaggggtgccccaaccgagatcgacaaattaggaatcaacagcctctcaagtcggtgaggtgcaataacgaacagtgggggctcaggcacccacagatccttcatccgaagaaggccgtgtctccagtgtccccactacagcactggccaaaaactagtggtgccagttcccaccatcaccactgtcccaggcattgcttgctgtgggaaggaatttag

SEQ ID NO: 50225 - DNA, 4044 bp, Artificial Sequence
  Description of Artificial Sequence: Synthetic coding sequence
atggagaatctccccttccctcttaaactgctgagcgcttccagcttaaatgctccgtcctccaccccatgggttctcgacatcttcctcacactggtgtttgcgttgggtttcttctttctgctcttaccttacctaagttactttcgatgtgatgacccacctagtccttcgcccggaaaaagaaaatgccccgtcggacggagaagacgaccaagaggccgaatgaaaaatcactcattgcgggctggcagagagtgccggcgagggctgcaggagacctcagacctgctgagccagctccagtcacttctcggaccccatctagataaaggcgacttcgggcagctgtcagggccagacccgcctggcgaggtcggggaacgggctcccgatggcgctagccaatcaagccacgaacctatggaagacgcagccccaatcctgagcccactggcttcccccgacccccaggctaagcacccccaggacttggctagcaccccctccccaggacccatgacgaccagcgtcagttctctgtccgcatcacagcccccagaaccgagtcttccactagagcacccttctcccgaacctcctgcattattcccacatccaccccataccccggatcccttggcctgctcgccacctccccctaagggctttacggccccacctctacgcgattctactttgatcactcccagccattgtgactccgtggctttaccactgggcacagtgccccaaagcttgtctccccatgaagacctcgtggcctcagtccccgcaattagcggcttgggcggtagcaactcacatgtgagtgctagtagcaggtggcaggagacagcaaggacctcctgtgcctttaattcttcagtgcaacaggatcacttaagccgccatccccctgagacttatcagatggaggcagggtcgctgtttcttctgtcatccgatggacagaatgccgtgggaatacaggtaactgagacagccaaagtgaatatttgggaggaaaaagaaaacgtgggttctttcactgaccgcatgacaccggaaaaacatcttaactccctccgaaatctcgctaaaagtctggatgccgaacaagacaccacgaatccaaaaccattttggaacatgggagaaaattctaagcagttgcctggcccacagaagtttagcgaccctcgcctctggcaggagagtttttggaagaattacagccagctcttttggggcctcccatctctccattcggaaagtcttgtggctaacgcctgggtgacagatagatcttacacactgcagagccccccttttctgtttaacgagatgtctaatgtgtgtccaattcagcgggaaactacaatgtcccccctgttgttccaggctcagcccccatcccaccttggtcctgagtgccagccctttatcagctcaactcctcagtttcgcccaacccccatggcccaggccgaagcccaggcccacctccagtcatctttcccagtcctgtcccctgcatttccaagcttaatcaagaatacaggggtcgcctgtcccgcatctcagaataaggtccaggccctgagtctgcctgagacgcagcacccagaatggcccttgctgcgcagacagctcgaaggcagattggctctccccagtagagtccagaagtcccaggacgttttcagcgtctctactcccaatctgccacaggagtctctgacttcgattctgccagagaatttcccagtgagtcccgagttacgcaggcaattggaacaacacattaagaagtggattatccagcactggggcaatctcggtaggatccaagaatctttggatctcatgcagctgagggatgaaagccctggaacttctcaagccaaaggcaaaccgagcccatggcagagctcgatgtctaccggcgagtcttccaaagaagcccaaaaggtgaaattccaattagaaagggatccttgtcctcatctcggacagatcttaggcgagacaccacagaatttgtcaagggacatgaaatcattcccaagaaaagtcttgggggtgaccagcgaggagtcagagagaaatctccgtaagccacttagaagcgatagcggaagcgatttgctgagatgtaccgagcggacccacattgaaaacatactcaaggctcatatgggacggaatctgggacagacgaacgagggccttattcccgtaagggttaggagatcctggttggccgtgaaccaggcattgcccgtgagtaatacacacgttaagactagtaacttggccgcacctaagagcggaaaagcttgtgtgaataccgcccaggtgctgtctttcctggaaccctgcacccagcagggcctgggagctcatattgtgaggttttgggccaaacaccggtggggcctccccttacgcgtcttaaaacctatccagtgctttaagctcgaaaaagtgtccagcctgagtttgacacaactggccggaccatccagtgctacatgtgagtcaggcgctggatctgaagtggaagttgacatgttcctacggaagcctccgatggcttctctcaggaaacaggtactgacaaaggcttcagaccacatgcctgaaagcctactggcatcctctcccgcttggaagcagtttcaacgcgcaccaagagggatcccatcttggaatgatcacggaccactcaagccacccccagctggccaagaaggtcggtggccaagtaagcccctgacctattccctgacgggatcaacacagcaatctaggagtcttggtgcgcagtctagcaaagctggggagacaagggaggcagtgccacaatgcagagtgccactcgagacatgtatgttggcaaacttgcaggccaccagtgaggatatgcacggcttcgaagcgcctggaaccagtaagagttccttgcacccgcgtgtttccgtttcacaggacccaaggaagttgtgtctgatggaggaagtcgtgaacgagtttgaacccggtatggccactaagtcagaaacccagccccaagtgtgcgccgcagtggtcctactgcccgacggtcaagcttccgttgtgccccacgccagcgaaaacctggtgtcccaggtcccccaggggcatttgcagtccatgccaactgggaatatgcgggcttctcaggagcttcatgacttaatggccgctaggagatccaagctggtgcatgaggaacctcgtaacccaaactgccagggatcgtgcaagtcccagagaccgatgtttccccctatccataaatcagagaagtctaggaagcctaatttggaaaagcatgaagagcggttagaagggctgcgaacccctcagctcactccagtgagaaagacagaggatacacaccaggatgaaggagtgcagctcctgcccagcaagaaacagcctccgtccgtgtctcattttggaggcaacataaagcagttctttcaatggattttcagcaagaagaagtcaaagccagctcccgtgactgccgagagtcagaaaaccgtgaagaaccggagctgcgtgtatagctcctccgccgaagcccaggggcttatgacagcagtcgggcagatgctggacgagaaaatgagcctgtgtcacgcgcgacacgcttcgaaggtgaaccagcataagcagaaatttcaagcccctgtatgtggattcccgtgcaatcaccggcatttgttttatagtgagcacggaagaatcttatcctatgcggcatcatcccagcaggccacgctcaaaagtcaggggtgtcccaatcgtgaccggcagattagaaaccagcaacctctcaagagtgtgcgttgtaataatgagcagtggggtctcaggcaccctcagattttacatcctaaaaaggctgtgagccccgtgtcacccctacagcactggccgaaaacctccggcgcatccagtcatcaccatcactgcccaagacactgcctgctgtgggaaggtatctag

SEQ ID NO: 50226 - DNA, 4044 bp, Artificial Sequence
  Description of Artificial Sequence: Synthetic coding sequence
atggagaaccttccgttcccgctcaaactgctgagtgcctctagcctaaacgcccctagcagcaccccgtgggtgctggacatctttctgacccttgtgttcgctcttggattctttttcttgctcttaccctacctgtcctactttagatgcgacgaccctccctcacccagcccgggaaagaggaagtgccccgttggacgccgtaggagacctcggggaagaatgaaaaatcactccctgagagcagggagggaatgtcgacgtggcctcgaggagacctccgaccttctgtcccaactccagtccttgttaggcccacacttggacaaaggagattttggccagctcagcggtcccgacccaccaggcgaagtcggcgaacgggctccagacggcgcttcacagtctagtcacgaacctatggaggacgcggcacctattctgtctctgcttgcctctccagacccgcaggccaagcatccccaagacctggcctcaaccccatccccaggtcccatgacaaccagcgtcagctcactcagtgcttcgcagccgcctgaacctagcctgcccctggagcacccctctccagaaccccctgccctgtttccacacccaccccacacacccgaccccctggcctgctcgctgccccctcccaagggattcactgctccccctctgagggactccacgctcatcactccatcgcactgcgactccgttgcactcccactggggacagtcccacagagcctgtcaccccacgaggaccttgttgccagcgtccccgcaatctccggactgggagggagcaatagccacgtatcagcctcaagccgctggcaggaaactgcaagaacctcatgtgcgtttaatagctctgtgcagcaggaccatctaagccgtcaccctccggagacctgtcagatggaggccggatccctttttctgttgtcaagtgacggccagaatgtcgtgggtatccaggtcactgagaccgctaaggtgaatatttgggaagagaaggaaaacgtggggtcctttactaatcgaatgacaccagagaaacacttaaattcgctgagaaaccttgccaaaagcctggacgccgaacaagacaccactaatccgaagcccttctggaacatgggcgaaaatagcaaacagctcccaggcccacagaaactgagcgatcctaggttatggcaggagagcttctggaagaattattcgcagctgttttggggtctgcctagcctccattcggagagccttgtggcaaacgcgtgggtcacggaccgttcatacaccctgcagtcaccgcctttcctgtttaacgaaatgagtaacgtatgtcctatccaacgggagaccaccatgtcgcccctactgtttcaggcccagccactgtctcacctgggcccagagtgtcagccattcatcagctctacaccccagttccggcctaccccaatggcccaggctgaggctcaggcccacctgcagtcaagcttccccgtattgtcaccagcatttccaagtcttatccagaataccggagtagcttgtcccgcaagccagaacaaagtccaggctttgagccttccagagacacaacacccagaatggcccctgctgcgcaggcagctcgagggcaggcttgccctgccttctcgcgtacagaagagccaggacgtcttttctgtgtccactcctaacttgccccaggagtccttgacctccatactgccagagaactttcctgtctcgcctgagttgcgacgtcagcttgaacaacacatcaaaaagtggatcattcagcattgggggaatctcggacggattcaggagtctctagatctgatgcagcttcaggacgaatctccaggaacctctcaggcgaaaggcaagccctcgccgtggcagtcctcaatgtcaaccggtgagagctcaaaggaggcgcagaaggtcaagtttcagctcgaacgggatccctgccctcacttgggccagattcttggagagacgccacagaatctgtccagggatatgaaatcattcccgaggaaggtgctcggagtcaccagcgaagagctagagcgcaacttgcgtaagccattgaggagcgattctggaagtgacctgctacgatgcaccgaaaggacccatatcgagaacattctgaaggcccacatggggagaaacttgggacaaacgaacgaagggctgatccctgtcagggttaggcgaagctggctggccgtgaaccaggctctcccagtgagcaacactcatgtgaagacgtcgaacctagccgctcctaagtcaggtaaagcgtgtgtcaacaccgcccaggtcctgtcttttctcgagccatgcacgcagcaggggctaggggctcatattgtccggttctgggctaagcatcgttggggactgccactgcgggtcctgaagcccattcagtgttttaaactggagaaagtgagtagcttgtctttgacgcagctggccggaccttcgagcgctacttgtgagtctggagccggttctgaggtggaggtggacatgttcctgagaaagccccctatggcctcactacggaaacaagtattaacaaaagcctccgaccatatgccagagtcactgctcgcctcgtctcctgcttggaaacagttccagcgcgcacctaggggcatcccgagctggaacgatcatgaacccctcaaaccccctccagctgggcaggaaggcagatggccctcaaagcctctgacctactcacttaccggttctacacagcagtcacgttcactgggggctcagtcttccaaagctggtgagactcgcgaggctgtccctcagtgtcgtgtgcctctggagacatgcatgcttgcgaaccttcaagccacctcagaggacgtgcatggctttgaggcgccaggaactagcaagtctagtctgcaccctcgagtgtccgtgtcccaggatccgaggaagctgtgtttaatggaagaagtggtcagcgaatttgaacctggtatggctactaaatccgagacgcagccacaagtgtgtgccgcagtggttttgctgccagacggacaagccagcgtcgtgccgcatgcttccgagaatctcgtcagccaggttccgcaagggcatttgcagtcaatgcctacgggcaacatgagagcgagtcaagagctgcatgacctcatggccgcacgcagatccaagctcgtacatgaagaacccaggaagccgaactgtcaggggagttgcaaatcacagagacccatgtttccccctatacacaagtcagagaagttcaggaagcctaacttggagaaacatgaggaacgtctggaagggctgcgcactccacagttaactcctgtgcgcaagacagaagatacacatcaggacgaaggggtgcagctactcccaagcaaaaagcagccaccctccgtatcgcccttcggagagaacatcaaacagatcttccagtggatcttcagcaaaaagaaatctaagccggctcccgtaacggctgaatcccagaaaaccgtcaaaaatcggagctgtgtttattcttcatcagccgaggcccagggtcttatgacagccgtcggacaaatgctggacgaaaaaatgtctctgtgccacgcaagacacgcctccaaggtgaaccagcataagcagaagttccaggctcccgtgtgcggcttcccttgtaaccatcgccatctgttttactcagaacatggaaggattctgagttacgccgcaagttcacaacaagcgactctgaaatcacaaggctgtccaaacagggatcgccagatccggaaccagcagccactgaaaagtgtccgatgcaacaatgaacaatgggggctgaggcacccccagattctacacccaaaaaaggctgtaagcccagtgagcccaccccagcattggcccaaaactagtggtgccagctcacatcatcatcactgccccagacactgcttgttgtgggagggcatctag

SEQ ID NO: 50227 - DNA, 4074 bp, Artificial Sequence
  Description of Artificial Sequence: Synthetic coding sequence
taactgctagagtcgaatgcacctatccacatggagaacttgccctttccgctgaaacttctatctgcatctagcctaaacgcgccttcaagtactccttgggtcctcgacattttcctgaccttggtcttcgcactgggctttttctttgtcctattgccatatctgagctatttcaggtgtgacgatccacccagtccctcgcctggaaagcggaaatgtcctgttggacgccgaagacggccacggggaagaatgaagaaccattctcttcgcgcaggaagagaatgcagacggggactcgaagagacgagtgacttgctgtctcagctgcagagcctcttgggtcctcacttagacaaaggcgatttcggccagctgtcaggccctgacccacccggagaagtgggggaacgggctccagatggcgcttcacaatcttcacatgaacctatggaggacgctgccccaattttgagccccttagcaagcccagatccacaggctaaacacccccaggacctcgccagtaccccctcccccggacccatgacgacatctgtgagctctctttctgcctctcagcccccagaaccttcactgccgctggagcatccttcacctgagccacctgctttgtttcctcatccccctcatacccccgacccccttgcgtgtagcttgcccccacctaagggcttcaccgcacctcctctgagagactctaccctgattaccccctctcattgcgattccgtcgcgttccctttggggacggtgccacaatccctctccccacacgaagatctagtggcatccgtgccagctatttctgggttgggcggttctaatagccatgtctccgctagttcccgatggcaggaaacggcaaggacctcttgcgccttcaactcctccgtgcaacaggatcacctatcacgccaccccccagaaacttgccaaatggaagctggttccctttttctgctgtcatcggatggtcagaatgtcgtgggcatccaggtcactgagacagcaaaggttaatatttgggaagagaaggaaaacgtggggtcctttacaaaccgtatgacaccggaaaagcacctgaactctctgcggaatctagccaagtctctcgacgctgaacaggacacaacaaatccaaagcccttctggaacatgggcgaaaattctaaacagctcccgggacctcagaagctgtctgacccacgcttatggcaggaatccttctggaagaattattcccagctcttctggggcctgccttcactgcatagtgagtcactggtggccaatgcttgggtgaccgacaggtcctatacactccagagtcctccgtttcttttcaacgaaatgagcaatgtgtgtcctatacaacgcgagacgactatgtctcctttgctcttccaggcacaaccactgtctcacctggggcctgagtgtcaaccatttatctctagtacacctcaattccggcctaccccaatggcccaggcggaagcccaggcacacctgcagagcagcttccctgtcctttcgcccgcatttccctcgctgatccagaatacaggcgtagcctgccccgcatcacaaaacaaggtgcaggccctatccttgccagagacacagcacccagagtggcctctattgagacggcagctagaaggacgattggccctacccagccgtgtgcagaaatcacaagacgtgttctctgtgtccacaccaaatctgccacaagagagcttaacttccatactgccggagaacttcccagtaagccctgaactccggaggcaactcgagcagcacattaagaagtggattatccagcattggggcaacctggggaggatccaggagtcactcgatctcatgcagctgagagatgaatcaccaggaacatcacaggcaaaagggaagccttccccatggcaatctagcatgtccacaggagagtcatcgaaagaggctcaaaaagtgaagttccagcttgagcgagacccctgccctcatctgggtcagattctaggcgagactcctcagaacctcagccgtgatatgaaatccttcccgaggaaggttctgggcgttactagcgaggaattggagcggaatttacgtaagccactcagatctgacagtggcagcgacctgcttaggtgtactgagcgtacccatatcgagaatatactgaaagctcatatgggccgaaatttgggacagacgaatgaaggattgatccccgtgagagtccgaagatcctggctcgctgtgaaccaggcccttcctgtatccaatactcacgtcaaaaccagtaaccttgccgcaccaaagagcgggaaagcctgtgtcaacacagcccaagtactgtccttcctagagccatgcacacagcagggccttggagctcatatcgtccggttttgggcaaaacataggtggggattaccgctgcgggtgttgaagccaattcaatgctttaagctggaaaaggtaagctcgttgtccctgacacagctggccggaccatcttccgctacgtgcgagtcgggcgctgggagcgaggttgaggtggacatgtttttacggaaaccaccgatggcaagtctgcggaagcaggtattgacaaaggccagcgatcacatgcctgaatcccttctagctagctctccagcttggaaacaatttcagcgtgcccctagaggcatcccatcctggaacgatcacgagccactgaagcctcctccagccggacaggagggccgttggccaagtaaaccccttacttactcactcactggcagcatccagcagtccagaagcctgggcgctcagtcctctaaggccggtgagacaagagaagccgtgccgcagtgtagagtgccattggagacatgcatgctggccaatttgcaggcaacaagcgaggacgtacacggcttcgaagcgccagggacaagcaagtcttccctccacccacgggtgagcgtctcacaggacccccgaaagctgtgcctgatggaagaggtcgtgaacgagtttgagccgggaatggctaccaagagcgagacacagccccaagtttgtgcagctgtagtcctcctgcctgatggccaagcttctgttgtcccacacgcatcagagaacttggtgtcccaggttccccaggggcacttgcagagtatgcctacaggcaatatgcgcgcttcacaggagctacatgacctgatggctgccagacggtcaaagttggtccatgaagagcctcgtaatcccaattgccaagggtcatgtaaatcccagagaccaatgttccctcctatacataaatcggaaaagagccgcaagccgaacctcgagaagcatgaggagcggctggagggcttgcggacaccgcagctgacaccagtgcgaaagaccgaagatacccaccaggatgagggcgtgcagctcctgccctccaaaaaacagccgccatccgtgtctccctttggcgagaacattaaacagatctttcagtggattttcagtaaaaagaaaagcaagcctgcccctgtcacagccgaaagtcagaagactgtaaaaaacaggtctcgggtgtattcttccagcgcagaggcacagggcctgatgactgctgtaggtcagatgttggataagaaaatgtctttatgccacgctcgccacgcatctaaggtgaaccagcacaaacagaagtttcaagccccagtctgcggattcccttgcaaccatcggcacctgttctattctgagcacgggagaattcttagttacgctgcttccagtcagcaggcaacattaaagtcacagggctgcccgaatagggatcgacaaattcgcaatcaacagccattaaaaagcgtcagatgtaataatgaacaatgggggctcaggcacccgcagatattgcatccaaaaaaagcggtctcacccgtgtcaccacctcaacactggcccaagacaagcggagcctcatcacatcatcaccattgccccaggcattgcctgctgtgggaaggaatctag

SEQ ID NO: 50228 - DNA, 4044 bp, Artificial Sequence
  Description of Artificial Sequence: Synthetic coding sequence
atggaaaacttacctttcccactgaaactcctgtccgcttcgagcctgaatgctccgtcctcaacaccatgggtattggatattttcctcaccttagtctttgcattgggatttttctttgtactgcttccctatctgtcatatttccgttgcgacgatcctccaagccctagcccgggaaaaagaaagtgtccggtggggaggaggcgcaggcccaggggcaggatgaagaatcactccctgcgggcagggagagagtgcaggagaggtctcgaggaaacttccgacctattatctcagctgcagtcactgttaggtccccatctggacaagggggatttcgggcagctgagcggacccgaccctcccggagaagtgggagagcgggcaccagatggcgcatcacaatctagccatgagcccatggaggatgccgctccgatactcagccctttagcatcccccgatccacaggctaagcatccccaagacctcgcgagtacgcctagccctggccctatgaccacctccgttagttctctctccgcatcgcagcctcccgaacccagtttacctttagaacacccatcacccgagccccctgccttgtttccgcaccctccccacactcctgatccgcttgcctgttccttgccacctcctaagggatttactgctccccctctgcgtgacagcacactaattaccccttcacattgtgattcagttgctttcccactaggcacagtgccgcaaagcctgtcacctcacgaggaccttgtcgcgagtgtccccgctatcagcggcctcggcggttccaattcccacgtgtctgcgtcatccagatggcaggaaaccgctcgaacctcttgtgcgtttaattcctctgttcagcaggaccatctcagcaggcaccctcctgaaacatgccaaatggaagccggtagtctgtttctgttatcctcggatggacagaatgtcgttggcattcaggtgaccgaaacagcaaaggttaatatttgggaagaaaaggagaacgtcggcagcttcacaaaccgtatgacgcctgagaagcatctcaacagtttgcgtaacctcgcaaaatccttggatgcagaacaggacacaactaatcctaagccgttctggaatatgggggaaaactctaagcaactcccaggtccacaaaagttgtccgatccacggctctggcaagagtcattttggaaaaattactcccagctcttctggggcttgccctcacttcattctgagagccttgtcgccaatgcctgggtcactgatcgctcctacaccctacagagccccccttttttgttcaacgagatgtccaatgtctgtccgattcagcgcgagacgactatgtctcctctgctctttcaagcccagccactgagtcacctcgggccagagtgccagccctttatcagctcgacgccccaattcaggcctaccccaatggctcaagcggaagctcaggcacacctgcagagtagcttccctgtgctcagtcccgcttttccctcccttattcaaaatactggagtggcgtgccccgcttcccaaaataaggtacaagcattgtcactgccggaaacccaacaccccgaatggccacttcttcgaaggcagctggaaggcaggctggccctcccatccagggtgcaaaaatctcaggacgtcttctctgtgtcgacacctaacctacctcaggaatccctgacaagcatcctccctgaaaattttcctgtgtcaccggagctgaggagacaactggagcagcatataaaaaaatggatcattcagcactggggtaacttggggcgtatacaagagagcctggatcttatgcaactcagggacgagtcccctggcacctcgcaggcaaaaggcaagcccagcccttggcagtcttctatgagcacgggcgaatcttcaaaagaggcacagaaagtgaagtttcagctcgagcgcgatccgtgtccccacctcggccagatcctgggtgagactcctcagaacctgtctagagacatgaagtcctttcccagaaaggttctgggtgttaccagcgaagaactggagcgtaatctgcgcaagcctctgagatccgacagcggaagtgatttattgcgctgtactgagcgcactcacattgaaaacatcctcaaggcacacatgggaaggaaccttggtcagacaaatgaaggcctgataccagtgcgcgtgcggaggtcgtggctggccgtaaatcaggcgctgccagtgtccaacacccacgtgaaaaccagcaatctggccgctcctaagtcaggaaaagcctgcgtgaacaccgcccaggtcctgagctttctcgaaccatgcacccaacagggcctgggggctcatatagtcagattttgggccaaacatcgctggggattaccactgagagttctgaagcctattcagtgcttcaagctggagaaagttagctcgctgtctctaactcagctcgcaggacccagcagtgcgacctgtgaatcaggagcgggaagcgaggtagaagtggacatgtttcttcggaagccccctatggctagccttaggaagcaggttctgacaaaagcctcagatcacatgccagaatccctgctggctagctcgcccgcttggaagcagttccaaagagccccacgcggaatccctagctggaatgaccacgagccactcaaacctccccctgccggacaggagggcagatggccctcaaagcccctgacttacagccttactgggagtatccagcaatctagaagtttaggggcacaaagcagtaaggccggagagaccagagaagccgtgccccagtgtcgggtgccattagaaacctgcatgcttgcaaacttgcaggccacttccgaagacgtccatgggttcgaagctcccggtacgagcaagagctcccttcacccacgggtgagcgtctctcaagaccctcggaaactctgtctcatggaggaggtcgtgaacgagtttgagcctggtatggccactaagagcgaaacgcaaccccaagtgtgcgccgctgtcgttctcctgcctgacggacaggcctcggtcgtgccccacgcctctgagaacttggtatcacaggtgccccagggtcacttacagagcatgcccactggtaatatgagggccagccaggagctgcatgatctgatggctgcccgaaggtctaaactcgtacatgaggagccacggaacccgaactgccagggcagctgcaaatctcagagaccaatgttccctccaatccacaagagcgagaagagccgcaaacctaacctggagaaacatgaggagagacttgagggattgaggacaccccagctaacgcccgtacgcaaaactgaagatacgcatcaagacgagggagtacagctgctacctagtaagaaacagccaccaagtgttagccctttcggtgagaatataaaacagatcttccaatggatctttagcaaaaaaaagtccaaaccggcacctgttactgctgagagccagaaaactgtgaaaaatcgatccagagtttactcctcaagcgccgaggcccagggactaatgaccgctgtgggccagatgctggacaagaagatgtccctctgccacgcaaggcatgctagcaaggtgaaccagcacaaacagaagttccaggctcctgtctgcggtttcccatgtaatcacagacacctattctattccgaacacggtcggatcctgtcttatgccgcatcttctcagcaagccacactgaagagtcaggggtgccctaaccgtgacaggcagatcagaaatcagcagccgttaaaaagcgtgcgttgtaacaatgagcagtggggcttgaggcatccccagatactccatccgaaaaaagcggtgtctccagtgtccccccctcagcactggcctaaaaccagcggcgcttcctcacaccatcatcactgtccaaggcactgcctactttgggaaggaatctag

SEQ ID NO: 50229 - DNA, 4044 bp, Artificial Sequence
  Description of Artificial Sequence: Synthetic coding sequence
atggaaaatcttccattccccttgaagttgctgtccgcttctagcttgaacgcaccttctagtactccctgggttctggatatctttttgaccctcgtctttgcactagggtttttctttctactgttgccctacctgtcgtatttccgctgcgacgacccaccatctccctcacctgggaaaagaaagtgtcctgtaggaagacgcagacggcctagaggtcggatgaagaaccatagcctgcgcgctggacgtgaatgtaggaggggacttgaagagacatcagatctcttgtcacagctgcagtcattgttgggccctcatctagataagggggacttcggccaactttctgggcctgacccacctggggaagtgggcgaacgcgcaccagatggggcatctcagtcatcgcatgagccaatggaggacgcggctccgatattgtctccactggcttctccggatccccaggccaaacacccccaggacctagcatccactccctcgcccggtccaatgactacatccgtatcgtccctgtcggctagccaacctccagagcctagtctgcctttagagcacccgtctccagagcctccagcactattcccgcatccgccacataccccagatccgcttgcttgcagccttccccctcccaagggcttcaccgctcccccactccgtgacagcaccctcataacaccttcccattgcgacagtgtggccttcccccttggaactgtgcctcagtctctgagccctcatgaagacctcgtggcttccgttccagctatttcaggactcgggggtagtaatagtcatgtgtccgccagttctagatggcaagagactgccagaactagttgtgctttcaattcatctgtgcaacaagatcacctgtcacgacatccacctgaaacttgccagatggaggctggatccctcttcttactctcgtccgatgggcagaatgttgtgggcatccaggtgacagaaacagcaaaagtcaatatctgggaagagaaagaaaacgttgggtctttcacaaacagaatgacacccgaaaaacacctgaactcactgcgtaatttggctaagtctcttgacgccgaacaggacacaaccaatccgaagcctttctggaacatgggcgagaacagcaagcagcttccaggccctcagaaactctccgatcccaggctgtggcaggaaagcttctggaaaaattatagccagttattctgggggctgccaagtttgcactccgagagcctggtcgcaaacgcctgggtcactgatcggagttacaccctgcagagtccaccattcttgtttaacgaaatgagtaatgtgtgccctattcagagggaaacgactatgagtcctctccttttccaggcccagcctctcagccatctgggacctgaatgccagccgttcatttcttccaccccccagttcaggcctactcctatggcccaggcagaagctcaagcacatctgcaatcatctttccccgtgttatcaccagcatttccttcactgattcagaatacgggggtcgcatgcccggctagtcagaataaagtccaggccctgagcttgccagagactcagcacccggaatggccgttactgcggaggcaactcgaagggagactggccctcccaagccgtgtacaaaaatcacaggatgtgttcagcgtgagtacccctaacctgccgcaggaatccctgactagcatcctgccagagaactttcccgtgtcccccgaactccgccgacagctcgaacagcatattaagaagtggatcatccagcactggggcaatctcggacgtatacaagagtctctcgatctgatgcagctgcgtgacgagtctccaggcactagtcaggctaaaggaaagccttccccttggcaatcctcaatgtctacaggagaaggctcaaaagaagcgcagaaagtgaagtttcagctggaacgcgacccctgtccccacctggggcaaattctcggcgagacgcctcagaatctatcccgggacatgaagagctttcctcggaaagtgctgggcgtcacaagtgaagagttggaacgcaatctaaggaagcctttacgctccgactccgggtcagacctattgaggtgtacagaacgcacgcatatcgagaatattcttaaggcccatatgggcagaaaccttggacagaccaatgaaggcctaatccccgtgtgtgtgcgtcggtcatggctggcggtgaaccaggcattgcctgtcagcaacacgcatgtaaagaccagtaaccttgccgcaccaaagtcggggaaagcttgtgtcaacaccgctcaggttctgtcgttcctagaaccctgcactcagcagggtcttggagcacatatcgtacggttttgggcaaagcatcgttggggcctgccgttgagggtgctgaagccaatacagtgtttcaagctggaaaaagtgagcagtctctccttgacacagctggcagggccatcatccgcgacctgtgagtcaggggcaggcagcgaggttgaggtggatatgttcctccgtaaacctcccatggccagcctgagaaagcaggtgcttacaaaagcttcagaccacatgcccgagtcgctcctggcttcaagccccgcttggaagcagttccaaagagcaccgaggggaatcccttcctggaatgaccatgaacccttgaaaccacccccagcaggccaggaaggcagatggccttctaaacctctgacctactcactcaccggttctatccaacagtcgagaagcttgggggctcagtccagtaaagccggtgaaacccgcgaggccgttccccaatgtcgcgtgcccctggaaacatgcatgctggccaatctccaggctaccagtgaagacgttcatggattcgaggcaccaggaacctcaaagagtagcctgcatccacgggtgagcgtttctcaggatcctcgcaagctgtgtctgatggaggaagtagtgaacgaatttgagccaggcatggcgaccaagtcagagactcaaccccaagtttgtgcagccgtggtgctgctcccagatggtcaagcgtcggtggtgccccacgcatcagagaacctggtctcccaggttcctcaaggccacttgcaaagcatgccaaccggaaatatgcgcgcttcccaggaattacatgacctcatggccgcacggcgaagcaagcttgtccatgaagagccaagaaaccccaattgccaaggtagttgtaagagccagcggcctatgttccctccaatacataaatccgaaaagagcagaaagcctaacctcgagaagcatgaagaacgcttggagggtcttcggaccccacagctgacacccgtacgtaagaccgaagacactcatcaggatgaaggtgtgcagttgctgcccagtaagaaacagccacccagcgtgtcccccttcggagaaaatatcaaacagattttccaatggatcttctccaaaaaaaagtctaaacccgcacctgtgaccgccgagtcgcaaaagaccgtgaagaatcggagtagggtttacagctcttccgcagaagcccaaggactcatgactgctgtcggccagatgttggatgagaagatgtccctctgccacgcacgtcatgcaagcaaggtgaatcaacacaagcagaaatttcaagcccctgtttgcggtttcccatgtaatcaccggcacttgttttacagtgagcacggcaggattctaagctacgccgcttcatcccagcaagccacactcaagtcccagggttgtccaaatagggacagacaaattcgcaaccagcagcctcttaagtcagtgagatgcaacaatgaacagtgggggctcaggcaccctcagatcctgcacccaaaaaaagcggtctcccctgtgtctcctccccagcactggcctaagactagtggggcttcttcacaccaccatcactgccctcgacactgcttgttgtgggaaggaatctag

SEQ ID NO: 50230 - DNA, 4032 bp, Artificial Sequence
  Description of Artificial Sequence: Synthetic coding sequence
atggagaatctgccattccctttgaagttgctgtctgcctcttcattaaacgccccaagctctaccccttgggttctagacatctttttgacgcttgtctttgctctgggcttcttttttcttctgttaccatatctgagttactttcactgcgatgatccacctagtccttccccaggtaaacgcaaatgcccagtgggccgaaggagacggccaaggggacggatgaaaaatcattctctgagggcaggtagggaatgcccaagaggtctcgaggaaacgagcgacttattatcccagctccaatctctgctgggtccccacttggacaaaggggatttcggacagctgtcggggcctgatccccctggggaggtgggcgaacgtgcacctgatggtgctagccaaagctctcatgaacccatggaggatgcagctcctattctaagccctcttgcgagcccagaccctcaggctaagcatccacaggacttagcatctacccctagccctggccctatgacaactagtgtttctagtttgagcgccagccagcctccggagcccagtctgcccctcgaacatccaagcccagagccacccgcattgtttccccatccaccccacactccggatcccttagcttgctctccaccacctccaaagggcttcaccgccccaccccttagagattctactctgataacccccagccactgcgacagtgtcgccctgcccctgggaacagtgccgcaatctctgtctccccacgaagatctggtggcctccgtacccgctatcagtgggttaggagggagcaacagccacgtttccgcaagctctagatggcaggaaactgcgaggacaagctgtgcttttaactcttctgtccagcaggaccctctctcgagacacccccctgagacctgtcagatggaggctggttcactttttctgttgagctctgatggccaaaacgtggtcgggattcaggttacggagacagcaaaggtgaatatctgggaggaaaaagaaaacgttgggtcttttactaatcagatgacgcccgagaaacacttgaactctctggggaatctggcaaagtctcttgatgctgaacaggataccactaaccccaagcctttttggaatatgggggaaaatagcaagcagctccccggtccccagaagtgttctgacccgaggctcctgcaggaatccttttggaaaaactatagccagttattttggggactgccgagtctgcacagcgagagtctggtggcaaatgcatgggttactgatcggtcatatacactgcaatcaccaccgttcctgtttaatgagatgtctaacgtttgccccattcaaagagagacgacaatgagtcctctgttgttccaggcgcaaccactgtcacacagacaaccattcatctcctccaccccccagtttctgccaacgccaatggcccaggctgaagcccaagcacacctgcagagctctttcccggtgctatcccctgcattcccatctcttattaaaaatacaggagttgcatgccctgcatcccagaacaaagtgcaggcactaagcctgccagaaacccagcatccagagtggcctctgctgaggaagcagctggaggggagactcgcgctcccgagccgtgttcagaagtcccaggatgtgttttcagtctccactcccaatttgcctcaggaaagtttgacgagcattctacctgaaaacttccccgtctctccggaacttaggagacagttagagcagcatatcaagaaatggattatccaacactggggcaacttaggcagaatccaggaatcattagatttgatgcagctgcgagatgaaagtcctggaacaagccaagcaaaggggaagccaagcccttggcagtcgagcacatcaaccggcgaaagctccaaggaagcccagaaagtcaagtttcagctggaacgtgatttgtgcccacatctaggccagatcctgggcgaaaccccgcagaatctgtcacgtgacatgaaatctttccccagaaaggtcttgggcgtgacaagcgaggagtccgaacgcaacctccggaagccacttaggagcgatagtgggagcgatctgctgcggtgtactgaaagaacccatatcgagaatatcctaaaggcgcatatggggcgaaatttagggcagacaaatgaggggcttatccccgtgcgggtgcgaagatcctggctggctgtgaaccaggcgctgccagtgtctaacacacatgtcaagacatcaaacctcgcagcacctaaatccggaaaggcctgcgtcaacacagctcaggttctcagcttccttgaaccctgcacccagcagggactgggtgcccatatagtgagattctgggcaaagcacagatggggactgcccttaagagttctgaaacctatacagtgctttaaactggaaaaggtttcttccctctctctgacacagctcgccggaccaagcagcgctacatgcgagtccggggcaggaagtgaagtggaagtcgacatgttcctcagaaaacccccaatggcttcactgcgaaagcaggtccttactaaagcgagcgaccatatgcccgaatccctgcttgctagttcccccgcatggaaacagttccagcgagcgcctcgcggaatcccttcctggaacgatcatggtccactgaagccaccgcctgccggacaggagggcagatggccgtctaagcccctgacctacagtctaactggctccacccagcagtctcgaagcctcggcgctcagtccagtaaggccggagagacaagggaggccgttccacagtgccgggtcccactggagacctgtatgctcgcaaatctacaggcaaccagcgaagacgtgcacgggtttgaagcaccagggactagcaagagcagcttgcacccgagggtgtcagtgagccaggatccgaggaaactgtgtctcatggaggaggttgttagtgagtttgagcctggcatggcaacaaaatcagaaactcagccccaggtatgcgccgctgtggtactcctgcctgacggacaggccagtgtcgttccgcacgcatcagaaaacctggtctcccaggtgccacaaggccatctgcagagtatgcccacagggaacatgcgggcttcacaggagcttcatgatctgatggcagccagacggagtaagctcgtacaggaggagcccaggaatccaaactgccaggggtcatgcaagagccagagaccaatgttccccccaatacacaagtccgaaaagagtagaaagcctaatttggagaaacacgaggagaggctggagggcctcaggacccctcagttgactcccgtcaggaagaccgaagacactcaccaagacgagggcgtgcaactccttccttctaaaaagcaacccccatcagtctctcattttggagaaaacattaagcagttcttccagtggattttctctaaaaagaagtctaagcctgcgccagttaccgccgagagtcaaaaaactgtgaagaataggtcttgcgtgtattcttctagtgccgaagcccagggcttgatgacggccgtgggccaaatgttagataagaagatgtccctgtgtcacgcacaccatgcctccaaggtgaaccagcataagcaaaagttccaggcccctgtgtgcggtttcccctgtaaccaccgccatttgttctattctgaacatgggcgaatactaagctacgccgcatcatcgcagcaagccaccctcaagtctcagggctgccccaatagagacagacaaatccgcaatcaacaaccactgaaatccgtccgctgcaataacgagcagtggggactccgccacccacagatacttcatcctaaaaaggccgtctcacccgtttcccctccgcagcattggcccaagacttcgggggcttcgagtcaccaccaccactgtcctagacattgccttctgtgggagggcatctag

SEQ ID NO: 50231 - DNA, 4044 bp, Artificial Sequence
  Description of Artificial Sequence: Synthetic coding sequence
atggaaaatctgcctttcccactcaagctcttgagtgcctcttctttgaatgccccatctagtactccctgggtgcttgacatctttctgacgctagtgtttgccttgggttttttctttctcctgctcccttatctctcctattttcgttgcgatgatcccccaagtccgagccccggaaagcgaaaatgtcctgtcggccgaagaagacgacctaggggccgaatgaaaaatcactcattacgggctggcagagaatgtccacgcggattggaagaaactagcgacctgctgagccaattacaatcattactaggtcctcatctagataagggggacttcggccagctgtctggccctgatcccccaggagaagtcggtgagcgggcacccgacggcgcttctcagtcttcacatgagcctatggaagacgcagccccaatactctcccctctggcaagccctgaccctcaggccaaacatccccaggacctggcctctacaccatcacctggtcccatgactacatccgtttcctctctcagcgcctctcagcctccggagccctcactgcctctcgaacacccttctccagagccacctgctctgtttccacacccacctcacacacccgacccccttgcatgctcattgccaccaccaaaaggttttacagccccacctctgcgagactcaacgctcattacaccctcgcactgcgacagtgtcgcgttccccctcggcaccgtccctcagtctctctccccacacgaggacctggttgccagtgtgcctgcgatcagcggccttggaggatcaaattcccacgtgtccgcgtcttcacgatggcaagagactgctcgaaccagctgtgccttcaattcttctgtccagcaagatcatttgtcacgccatccaccagagacctgtcagatggaagccggatctctgttcctcttgtcctccgacggccagaacgtggtgggcattcaggtcaccgagaccgcgaaggtgaacatctgggaggagaaggaaaacgtcgggagctttacaaaccgaatgactcccgaaaagcaccttaactaccttagaaatctagccaagagcctggacgcagaacaggacaccactaatcccaaacctttttggaacatgggtgagaactcaaagcagctgccaggtccccagaaactgtcagaccccaggctgtggcaggagtccttttggaaaaattactcccagctgttctggggcctgccgtccctccactcagagagtttggtggccaacgcatgggttaccgatagaagctataccttgcagagtccacctttcctcttcaacgagatgtccaacgtatgtccgatccagagggagactacaatgtctccccttctgttccaagcccagcctctttcacatttgggccctgagtgccagcccttcataagcagtactccccagtttagacctacacctatggctcaggccgaggcacaggctcatctgcaaagttcctttccggttttgagccccgcttttccctctctcattcaaaatacaggagttgcttgccctgcctcacagaataaagtccaggccctatccctgccagaaacacaacatccagagtggccactgctcagaaggcaattggagggtcggctggctctacctagccgggtgcagaagtcccaggatgtattctcggtgtctactcctaatctaccacaggagtctcttacctcgatactgccggagaactttcctgtgtctccagagttaaggcgacaactggaacagcatatcaaaaagtggattatccagcattggggaaatttgggcagaatccaggagtctctcgatctaatgcagttgcgcgatgaatctccaggcacttctcaggccaagggaaagccttccccctggcagtccagcatgagtactggtgagagctccaaagaggcccaaaaagtcaaattccagctcgaaagggacccatgccctcacctcggtcaaatactgggcgaaaccccgcagaacctgtcaagagatatgaagtccttccctaggaaagtgctcggcgtgacatcagaggaattagaacgcaaccttcgtaaacccctgcgaagcgacagcggtagcgatttgctgcgatgtacggaacggacccacatagagaatatcctaaaagcacacatgggcagaaacctgggccaaaccaacgaaggccttatcccagtatgtgtccggagatcatggctcgctgtgaaccaggctttgcccgtctctaatacccatgtaaagacatccaatctggctgccccaaagtccggtaaggcatgtgtgaatactgcacaagtattgtcctttctagaaccctgtacccagcaaggtcttggcgcacatatagtgcgcttctgggctaagcatcgctggggccttcccttacgggtcctaaaacctatccagtgcttcaagctcgagaaggtgtccagcctgtctctgactcaattggccggtccctcctctgccacgtgcgagagtggcgcaggatcggaggtagaggtcgacatgtttctcaggaaacctccaatggcatcgctacggaaacaggtgctgactaaggcctccgatcatatgccagaatccttgcttgcatctagcccggcttggaagcagtttcagagagccccaaggggaatccccagctggaacgaccacgagccgctcaagccccctccagccggtcaggaggggagatggccctcaaaaccgttgacatactccctgactggtagcatccaacagtctaggagcctgggcgctcagagctcaaaggcaggtgagaccagggaggccgtgccgcagtgtagagtgccactcgaaacctgtatgttagccaaccttcaggcgacgtccgaggatgtccacgggttcgaagcgccaggcacctcaaaatcatcactacatcctcgagttagcgtctctcaggatcctcgtaaactttgtcttatggaggaagtcgtcaacgaatttgaacctggtatggctactaagagcgagacgcaaccccaggtgtgcgccgctgtagtcctcctgcctgacggacaggccagtgttgtgccccacgcttccgagaatctcgtatcacaggtgccccagggccatctgcaaagcatgcccaccggcaatatgcgtgctagccaggaactccacgacctcatggccgctcgccgatccaaactggtgcacgaagagcctaggaatcctaattgccaagggtcttgcaaaagccagaggccaatgttccctcctatccacaaatctgaaaagagccggaagcctaatctcgagaagcatgaagaacggcttgaagggttaagaaccccccagctgaccccggtgcgcaagactgaggacacacaccaagacgaaggcgtacagctcttgccaagcaagaagcagccaccgtctgtgagcccattcggcgaaaacataaagcaaatctttcaatggatattctccaagaagaaatcgaaacccgctccggtcactgctgaatctcagaaaaccgtaaagaaccggagccgcgtctattcaagctccgcagaggcacaggggctgatgactgctgtgggccaaatgttagacgagaagatgtctctgtgtcatgctcggcacgcatccaaggtcaatcagcacaaacaaaagttccaggcaccagtgtgtgggtttccttgtaaccaccggcacttgttttactctgaacacgggcgtatcctgtcctacgctgcttcttctcagcaggcgaccttaaagtcacagggctgccccaatcgagatcgtcagatcagaaatcagcagcctcttaaatccgtgcggtgtaataacgagcagtgggggctgcgtcacccacagatcctgcatcccaagaaagccgtgagtcctgtctcacctccacagcactggcctaagacaagcggtgccagcagccaccaccatcactgccccaggcactgcttgctgtgggagggtatatag

SEQ ID NO: 50232 - DNA, 4731 bp, Artificial Sequence
  Description of Artificial Sequence: Synthetic coding sequence
atggagaacattttgtgtttcttgaacagttataccgagaccggactgtcccccgatagccattggctggatattgatcctaattttatctgcctgtctgggctgggactgtttattttatatctgttctatgttgttcttacactctacagttctcctaccgagaagaacaatgacatccagaaacatcagggacgggctaagcgccgacgtaaaggcggtacattcaagggatttcccgactggaagagctttcaaagagaagaggaagaggaacggaagcttttatcactgctcaaaagttttgggcctccggtcagctgcagcccaaggggccagcatcacgatacaaaccactttcgcagactactgtgtcccgaccccgtctgtcgggtttgcaagcgcgctacagctgacattcagcagcttcttagctgggaatcactcaaagatgctgcccctagcgtaagccctctggctagttctgctagcgcgacagagtcctcatttaccctcgcctctacccccagtgcgacaccgccagaggacctgatattgtcacctcgccctaaggcttcccccccaccacccttgattctctcaccagatctcatcaccacacttgcagatcttttttccccctctccattgagagaccctttacccccacagcccgtcagtcccctggacagtaaatttcccatcgaccattcaccaccacaacagttgccctttcctctgctgccaccccatcacattgagagggttgaaagcagcctgcagccggaggctagcttaagcctgaataccattttctctttcgggtcaaccttatgccaggatatatctcaggctatgaatccaatcgacagctgtgcgcgacaccacggaccacccatccctagcgccctgcctccagaggactgcacagttactcagagtaaaagctctctcaccattctgaagacttttcctgagatgttgtccctcggaggatccgggggaagcagcacctcagccccaactatcaaaggtatagatcattcacatcttgcctcgtccgagtttacttggtggcagcctcacgccaaagattctttctcctcaaacttcgtaccatctgactttatggaggagctgctcacacttcatagttccgaggcttttctggggggtcattccgtggcaaatttaattgagcctgtgaacattagcttcttgtcacatgatatccttgctctcctggagagacaagtaaagaaaagaggagactttctgatgtggaaagagaacggcaaaaaacctggcagctttccgaaacaattgcggccaaattatcagttaaactcttctcgcaatatgttgacctccattgccgttaaacatgaccttgcggaaagctttcctttctgggcctccaaaggcaaactggagtggcaacacatccatcagcagccaccacatagcaagtgcttcgaggaccatcttgagcaaaagtacgtacaactcttctggggtctgccatctctgcactccgaatctctgcaccccactgtgctagttcagcgcggacatagttccatgtttgtgtttttcaacggtatcacaaatacctctatttcgcatgagtccccggtcttgcctccaccccaacccctcagcctcccttcaacacaaccactgccgcttccacagacgctgccccagggacagagtccccacctaacccaggtcaaaagcctggcacagcctcagtctccatttagggcactcctgccgtcgcctctgttcttgattcgtatttgcggtgtctgttttcacaggcctcagaacgaggccagaagtttacttccatctgagatcaaccatctggaatggaatgttctccaaaaagttcaagaatcgttatggggcttgcccagtgtggtgcagaagtcacaggaggatttctgccccccagcaccaaacccagagctagtgcgcaaatcctttaaagtgcatgtgcccatcagtatcatacccggagattttccccttagttcagaagtccgcaagaagctcgagcaacatatcagaaggcgccttattcagcgaagatggggtctgccacgcaggatccacgaaagcctcagcctgcttaggccacaatctaaaatttccgaactgtccgtgagcgaacggattcacgggcctctgaacatcagcctggtggagggccagagatgcaatgttctgaagaagtctgccagctcctttccgcgatcatttcatgaacggtctagcaatatgctgagtatggagaatgttggcaattatcagggatattcccaggagacagtaccaaaggatcatcttctgcatggccctgagacatcgtctgataaagatctgcggagcaactccgagagagacctcgagactcatatgatgcatctttctggcaatgacagtggtgttaggctggggcagaagcagctggaaaacgcacttactgtcagactctccaaaaagtttgaagagattaacgagggaagaatgcccggtacagtgcacagttcctggcacagtgtcaagcagacaatgagtctgccggagaagagccattcccagataaaacatcggaacctggtgacgctggtctctgaagatcattgtgttgatacttcacaggagatttcatttctcagctccaataagcagaaaatgctggaggcgcatattaaaacttttaggatgcgtatgctttgggggctaccactgaaggtattagagagcattgagattttcaaaagtaaggctgatctgtctacctccttctcccatttcgacctgccctctagcgcaacctttatctctcagggtgactccaaggacggggtcagcaagagcaggagtagatctactttccaaggagagaagctaggaacaaccagttcggtgccaatcctcgataggccccaccccgtcagcagtccagtcgtacaggaagggcaaggaactctgagacgccagttcagtgatacagaccatgatctgattgaaaccgatagcaaggatggcgcttccaccagcttacggcgaggaacaactgactttcaatctgaaaaactcgatagcacctcaagctttccaatcctaggtcactcctacttggtcacatctcctgtgaaccaagagaaacagggtaccctccgacgcgaattctctgacactgacaatgacctgacggaaagcgtgaggacaaccgaggatggaagacagacattcctaccacctcctcacagcattgtggacgaagtgagccagaagcagacggtgctggcttcaagatgctccgcagagctgcctattatgcaagcaggggctggttgcgagagctgggataagagaaagagctctttccacaatgtggaccgtctccaagggagcaggaaaactttcccagtgaccaacgcactgcagtctcagacacgcaacaacctgacgacatccaaatccggcagttgctcacttactaacgtgaaggcttccactagcaacgagacagagattttcccccctcgcatatccgtacctcaagacccaaagtcttcttacctcaagaatcagatgttgtcccagcttaagctggtgcagcggaaacactcacagccccagagccattttactgacatgtcattcgccctagacaacctttcaagtaaagacctcttgacaaattcacagggtataagtagcggtgacatgggaacttcgcaagtggtccacgtccaccttgaggactctgggatcagagtggctcagaaacaggagcccagggtaccaacttgcgtgctgcagaagtgtcaggtgacaaattttccccctgcagttaaccgagtgtccccagtccggcctaaaggcggagagctggacggcggagatgcaggattgggaacgagtcaaagacggagaaaatcgctgccagtgcacaacaagaccagtggagaagtcctcggcagtaagtccagtccgacactgaaaacccagccccctccggaaaaccttttccgcaagtggatgaaaacctccctgcagtggttcaataagccttccattagctacgaggagcaggagagtagttgggaaaaaggaagctctctgtctagttgtgtgcagaacatcggacgcgtgattagagccgcttttacaggaactactgaggcccagaagatccggaaagacactagagaattcctcgaggaaaagctggggcaccgccacggaattgacatcacctgcccccaggaacccctgtcattccccgtcggcttaggcaaagcacaacataatccagaagtgcacgtcagagctgaacctgttcaagggtgcccatgtaactaccgggctccctcctgcaaggtgaccagaactaaaagctgttctcagcaggcgatctttgtcggacagaactatcctacccgtatcagacagatcatcgacaaagaccggcagcctcaaaaagtggaagctttcaagggcaagatactttgccagagccacccacaaagcatgcctcaccggaagccagttccgcatccaaaccctacatgtcgtagacaggtctctctcgtctgcccagctgtgcccacttccgctaagtcacccgttttctcagacgtcccgtttctcaccggacaaaagatgttaccaaaacacctgcaaggaggcaaattcccaccaaccaagtag

SEQ ID NO: 50233 - DNA, 1242 bp, Artificial Sequence
  Description of Artificial Sequence: Synthetic coding sequence
atggccgagggacccgaagaagccaggggccacccccctgggcaagatgacggcggtggagaccatgagccagtcccctcactacgcggtccccctaccaccgctgtgccatgtcccagagacgatcctcaagctgaaccgcaggcccctggacgcccaaccgcacccggtctcgccgctgccgctgcagccgacaaactggagcctccaagggagttacggaagagaggagaggccgcttccggttctggtgcagagttgcaggagcaggctgggtgcgaggcgccagaggccgcagctccaagggaacgtccggcacggttgagcgcgcgagagtattcccgacaagtgcatgagtggctgtggcagtcgtactgcggatatttaacctggcatagcggcctagcagcgtttcccgcttattgctctcctcagccgtcgccacagagcttcccatcaggaggtgccgctgtaccccaggccgctgccccaccgcctccacagctgggatactacaaccccttttacttcctgagtcccggtgcggcaggacctgacccgagaactgctgccggaatcagcactcctgcccctgtcgctggactgggacctcgcgctcctcatgtgcaggcatctgtccgcgctaccccagtgaccagggttggatctgcagctccctctcgaagtcccagcgagaccggtagacaggccggacgggaatacgtgatcccctctctcgcccatagattcatggccgaaatggtggattttttcattctgtttttcataaaggcaacgattgtgctaagtatcatgcacctctccggtatcaaggatatttcgaagtttgcaatgcattatattatcgaagagatcgatgaagatacttcaatggaggatttgcagaagatgatggtggtcgccctcatttaccgactgctcgtctgtttttacgagatcatttgcatctggggggctgggggagctacgcccggtaagtttttgctcggtcttcgcgtggtgacctgcgataccagtgtgttgattgccccttctagagttctcgtgattcccagcagtaatgtctccataaccacctcaacaatccgtgcccttattaaaaacttcagcattgcatcctttttccctgcgtttattactctgcttttttttcagcataatagaacagcctatgatatcgtagctggcacgattgtcgtgaaacgcaatggcgtcagatag

SEQ ID NO: 50234 - DNA, 492 bp, Artificial Sequence
  Description of Artificial Sequence: Synthetic coding sequence
atggcagagatggtcgacttctttatcctgttcttcatcaaagccaccattgtcctttccatcatgcacttaagtggtattaaggatatcagcaagtttgccatgcactacatcatcgaggaaatcgacgaggacacttcaatggaagaccttcagaagatgatggtcgttgctctgatctaccggctgctggtgtgtttctacgagatcatttgcatttggggggctggcggagctactcccggtaagtttctgctgggcttgcgggtggtgacatgtgacaccagcgtcctgattgccccatctagggtgctcgtaattcctagttccaatgtctcaattacgacgagcacaataagagccctgatcaagaatttcagcatcgcaagtttcttccccgcttttatcactctcctgttcttccagcacaaccgaacagcttacgacatagtggcaggaactatcgtggtaaaacgcaacggcgttcgttag

SEQ ID NO: 50235 - DNA, 915 bp, Artificial Sequence
  Description of Artificial Sequence: Synthetic coding sequence
atgaacattgtgttcagtagggattcacaggtgcgcgtgatggaaaataccgttgctaacacagagaagtatttcgggcagttctgtagcttgctggctgcctatacacggaaaactgcaagactacgcgacaaggccgatcagctggtcaagcaactgatcgatttcgcaaattcagagaatccggagttgcgtgcgaccatgcggggtttcgccgaggatctggccaaagtgcaagattaccggcaagcccaagtggagcgcttggaaactaaagtggtcaacccccttaagctgtacggcgctcagatcaaacagaccagagctgagatcaaaaagtttaaacacgtccagaatcatgagattaaacagttggagaagctagaaaaattgaggcagaagtctccatctgaccagcagatgattgggcaggcagagacacgggtgcagagagcagcggtggattcatcacgtacaaccttgcaactggaggaaaccgtggatggtttccagcggcagaagttaaaggatctgcaaaagttcttctgcgatttcgtgaccatcgagatggtgttccacgcaaaagctgtggaggtctacagcagtgcattccagacgctggaaaagtacgaccttgaacgagacctccttgattttcgcgcaaaaatgcaaggcgtgtatggccattatgataccagactgcttgccaacacaagccctcctccaagtgtgctgcagtcactggcctcacagggcaccttacaggtccagctgtccagggccaacgaggaccccgagcatccccacgcgaatcacggacggttttccctttgtgaatgggttgtgaagggccagccagctcactgcgtctgcggacagggcggtcacctgatgttgcccggtcatagcctgtag

SEQ ID NO: 50236 - DNA, 915 bp, Artificial Sequence
  Description of Artificial Sequence: Synthetic coding sequence
atgaacatagtattctcacgcgattcacaagtgcgagtcatggagaacacagtggccaataccgagaaatacttcgggcaattttgctctctattggccgcatacacccgaaaaaccgctaggctcagagataaggccgaccagctggtaaagcagctgatcgatttcgctaactctgaaaatccggagctgcgcgcaacgatgcgaggcttcgccgaagatcttgccaaagtgcaggactatcgacaggcgcaagtggagcgcctggaaaccaaggtcgtaaatccgctaaaactgtatggcgctcaaataaagcagacgcgagccgaaatcaagaagtttaagcatgtgcagaaccacgaaatcaagcagttggagaagctcgaaaaactgaggcagaaatccccctctgatcagcagatgattagtcaggctgaaacccgagtccagcgtgcagccgtggacagcagcagaaccactctacaacttgaagagaccgttgacggctttcagcggcaaaaattgaaagaccttcagaaatttttctgcgatttcgttacaattgaaatggtattccacgccaaggcggtggaggtgtacagtagcgctttccagacccttgaaaagtacgacctcgaacgggatctcctggactttagggcaaaaatgcaaggagtctatggccattatgacactagactactggccaacacctctcccccaccctccgtcctgcagtctttagcttcgcagggaactctgcaggtccagttgagtcgcgcaaatgaagatcctgagcacccccatgccaaccacggtcggtttagcctttgcgagtgggttgtgaagggccagcccgcacactgcgtttgcggccaggggggacatttaatgctccctggacacagcctttag

SEQ ID NO: 50237 - DNA, 3402 bp, Artificial Sequence
  Description of Artificial Sequence: Synthetic coding sequence
atggcacctaaaactaagaaaggatgtaaagtcaccctgccggaaaaacccgtgaaacttgcctcccacactagggatacaacaggcgtatctcagatgttcccatcctcaaaggccagaaccaaatcgctacttggggacgatgtctttagtaccatggcgggactggaagaagcggatgccgaggtgagtggaattagtgaggctgacccacaggctttattgcaggcaatgaaagaccttgacggcatggatgcggacattctgggcctgaagaaatccaattcggcaccttcaaaaaaagctgctaaggatcccggtaaaggagagcttcccaaccaccctaagccagctggcggtgccatccccaccaaaaaatcacttccatcaccgagcagcagtgggcaccaaaacagaagattctcctcagaagaccttgaagatccactccggggactactgtcttatgacgagggaggcatcaccaagcaaccaccggtgacccaatcaaaaactgcctctgataaatcacccagcactgtgcgcgatcaaggcccaagcatccctctgaccccgggagacacacccatcagaaagaaggaagagcttctcttcgacgatggcgacgacatcatggctacattgggatttggtgactctccgaaagccgagaagcggcagatcggcgaccaggaggggccaaggccggctaggtccaccctggacgagctgctcggtcggggtatggcaactaagcttctggctcgacccggaactggagagcaccgcgagttcaagcttgataagaaataccagagacctcaggactctgaggacatgtggggcgacgaagactttacgtttggggcttaccagcccacagtagtgtcctccgaggggcgtcagtcccgtcggcaaagcgttaggttttttgctgactccggagccgaccctaagggagagcccggttctaaacagtcccccccaatggcttcatcccctatccagcctcgcaaaggcggagctgactggctcggtctcaaggatgaggacctcgacctgtttcccgctagtccaacacgggaggcccatcgggaaagcagtgtgcctgtaaccccttctgtaccgccaccggcatcccagcattccacgcctgctggattacctccttcaagggccaaaccaccaacagagggcgctggcagtccggctaaagctagccaggcctctaaactgcgggcatcaaaggaagagaaggaagattggctgtcgcacgcattatccagaaaaaagagtcaagggctggccagggagcagcatgctgggacctccgagggtctccatctggcaggaactgcagggcaccccccttccgggtctcagccactcacgtctacccaggggctggaacacgcggctgccggtggctcctccggcacgacagccagagagcgaccctgcgtgagaccaggtgtgagtggttcccccgtaacccaaaaccacgctgccagtgcactgcctaccggtagtcccaaacggggaaccgccccaggggatctgagcgctactgaaccagctacatgtttcccaagcacccaaaagccaaccgagccatcagtgcccgtgcagcccttgcttcccgaatctctcgctcgcagtttgctgccatcaaccgagtaccagaagcaattactggcagcccaggttcagctccagtgttctccagccgagttacaggcagaactgctgcattcacaggcccgactggccgaactggaagcgcaggttcggaagctcgaactcgaacgcgctcaacacgagctgctcctgggcagtctccagcagcagcaccaggccgatctggaactgatagagagcgcccatcggtctaggatcaaggtgctggaaacctcctatcagcagagagaagaaagactgcgcagggagaacgaagagcttagcgctcgctacctttcgcagtgtcaagaggctgaacaggcccgagcagaactcaccgcacagcaccagcgtcggcttgccgcaatagcccaagaaaaggatcaagaaatggaacgattgagagaattacagcgcgcttctatccttgacatgagaagagatcacgaggaacagctgcaaaggttgaagctgctcaaggacagagaggtggacgcggcaaccagtgcaacttcccacacgcgaagtctgaattcaatcatccaccagatggagaagttctcttcttctctccacgagttatcttctcgagtggaggctagccatctgacaacatcacaagagcgtgaattaggaataagacagagggatgagcaactgcgggctcttcaggaacgcctcggccagcagcagcgagacatggaagaggagagatcaaggcagcaagaagttattggtaagatggaggccaggctaaacgagcagtcaaggctgcttgagcaagagaggtggcgggttaccgccgagcagtcgaaggcggaatctatgcagagagccctggaagaacagcgtaaagtaaccgcacagcagatggctatggaacgggcagagctggaacgggctaagtctgctttgctagaagaacagaaatctgtgatgctcaaatgcggtgaggaacgccgtcgccttgccgcagaatgggctgagttctctgctcagcagaagctcagtaaggaacgcgcagagcgcgaggcagaacgagctctgcaggtcgatacacagagagaaggaacactcatctctcttgcaaaggagcaagccgagctgaagattagagcgtccgagttaagagccgaggaaaaacaattggccgcagaacgtgcagccctggagcaggagcggcaggagcttaggctggagaaagaacgcattaatgctacagctctccgggtgaaactgcgagcggaggaagttgagagtatgagtaaggtagcatctgagaagtacgaggaaggggagagggcccttagggaagcacagcaagttcaggccgagcaacaggccagactgcaggcggtccaacagcaacaggagcgtctccggaaacaggaacagcatatgcatcaggaacatctctcactggcccagcagcgcttacagttggatcgtgctcgacaggacctccccagcagtttggtcggcctgttcccaagggcccaggggcctgcggctagctcacagtccgccctcatgccacctgctcctactacacggtggtgtagccaacccccaaccgggctggatcccagccctctccatctgcacgcccgtcttgctctgcttcgacacatggccgagcaggatcgggatttcctggagaacgaacagttctttttggaaaccctgaagaagggtagttacaacttgacttctcattcagcgtag

SEQ ID NO: 50238 - DNA, 2493 bp, Artificial Sequence
  Description of Artificial Sequence: Synthetic coding sequence
atggcgccaaagaccaaaaaaggatgcaaagttacactacctgagaaacctgtgaaacttgctagtcacaccagggacacaacgggcgtatcccagatgtttccttcctctaaggctcgcactaagtccctgctgggggacgacgttttctctactatggcaggcctggaagaagcagacgccgaagtatctggaattagtgaagcagatccacaggccctcctccaggcaatgaaggacctagacggtatggacgccgatatcctggggctgaagaagtctaatagcgctccaagtaaaaaggccgctaaggatccgggaaaaggagagctgcctaaccatccaaaacctgcaggaggagccattccaacaaagaaaagcctcccatctcccagctcctcgggccaccagaacaggcgtttttccagcgaggacttggaagatcctctccgtggactcttgtcctacgacgaaggagggatcactaaacagcctccggtcacacagtccaagacagccagtgataagagcccctcaacggtgagagatcaggggccatctattccattgacacctggtgataccccgattcgcaagaaagaggagctactgttcgacgacggtgacgacatcatggcgaccttggggttcggggattccccgaaggccgagaagcgccagattggagatcaggaaggacccaggccagccagatctacgctggacgaattgctcggtcggggtatggccacgaagctccttgctcgacccggaacaggcgagcacagagagttcaagttagataagaaatatcagagacctcaggattccgaagatatgtggggggatgaagatttcaccttcggggcttaccaacctacggtcgtgagcagtgaagggagacagtccagacgccaaagcgtatcccgcttcttcgcagacagtggggcagacccaaagggcgagcctgggagcaagcagtccccacccatggctagctcccccattcaaccacggaaaggaggcgctgattggctgggtctcaaggacgaggacctcgacttgttccccgcttctcctacaagggaggcccaccgcgaatcatcagtccctgtgacaccatcagtgcctccacctgcctctcagcactccacccccgcagggctgcctcctagccgcgctaagcctccaacagagggtgcgggatctcctgcaaaagctagccaggcttccaagcttcgggcatccaaggaagagaaggaagactggttgtcacacgccctgagccggaaaaagtctcaaggtctggccagggagcagcacgcaggaacctcagagggcctgcatttggccggaaccgccggtcaccctccatccggcagccagccccttacatctactcaggggcttgaacacgctgctgctggcggaagttccggaacgactgcaagagaaaggccatgcgtacgtcctggagtgtcaggcagtcccgttacacagaatcacgccgcttcagccctgcctactgggtccccgaagcggggtactgcccctggtgatctgtccgctactgaacctgccacatgttttcctagtacacagaagcctaccgagcccagtgttcctgtacagccactactgccagagagtctagcgcgttcactgctcccttctacggagtatcagaaacagctactcgcggctcaggtccagctccagtgttcacctgcagagttgcaggctgaacttcttcactcccaggcgagactggccgaactggaggctcaagttcgcaagctagagcttgagcgcgcacaacatgagcttttgctcgggagcctccagcaacagcaccaggctgaccttgagctgattgagtccgcacaccggtccaggattaaggtgctggaaacctcataccagcagcgagaagagagattgcggagagagaacgaggagttgagcgctcgctatctgagtcaatgccaggaagcagagcaggctagagctgaactgactgcccagcaccagcgtcgtttagccgctattgcacaggaaaaagaccaggaaatggagaggttacgggaactacagagggctagcattctggacatgaggcgcgaccacgaagaacaactacagaggctcaagctgctcaaggacagggaggtggatgccgctacctccgcaacttcgcatacccggagcctcaattccattatccatcagatggagaaattctcttcctctctacacgagctttcctcccgggtcgaggcctctcacctgacaacttcacaggaacgggagctgggcattaggcagagggacgagcagctccgagcgcttcaggagcgactcggccagcagcagcgcgatatggggcgtgatgaggagggctccttatgtgctgcccacctccctaaagcccagctgtccggatacgcggtggaggccacccgtaaccaatctcaattgcaacgatttctatag

SEQ ID NO: 50239 - DNA, 3405 bp, Artificial Sequence
  Description of Artificial Sequence: Synthetic coding sequence
atggcaccaaaaacaaagaaagggtgtaaggttacacttccggagaagccggttaagctggcatcccacaccagggacacaactggggtcagccagatgtttccttcgtccaaggctaggaccaagtctctcttaggggacgatgtcttcagcacgatggctggcctggaggaggcagatgcagaggtttccgggatctccgaagccgatccccaggctctgcttcaggccatgaaggatctcgatgggatggatgcggatattctgggcctgaagaagtcaaactcagccccttctaaaaaggccgctaaagatcccggaaagggtgagctgccaaatcaccctaagccggctgggggtgccattcccactaagaagagcctgcccagccctagttctagcgggcaccagaacagacgcttttccagcgaggacctcgaagatcctctgcggggactcctgtcatatgatgagggcggaatcactaagcagccccctgtgacacagtccaagaccgccagtgataaatctccgtctactgttagagatcagggaccatcaatcccactcacacccggagatacaccaattcgaaagaaggaggaactgctgttcgatgacggcgacgacatcatggccacgctgggatttggcgatagtcccaaagccgaaaaaagacagattggggatcaagaggggccacgcccagccaggtccaccctggacgaactactggggagggggatggcgactaaactgctggcccgacctggcacaggagagcaccgcgagttcaaattggacaagaagtatcagaggccacaagattccgaggatatgtggggtgatgaagattttacctttggagcctaccagccaactgtggtctcctccgagggacggcagtctagacgacagagcgtgagtaggttcttcgcagatagtggggctgacccaaaaggagaaccagggagcaagcagtctcccccaatggcttcctcacctattcagccgcgtaaaggtggtgccgattggctgggtctcaaggacgaagatctagatttgttccctgcctcacccacccgcgaggcccacagggaatcctctgttcccgttacgccgtcagtaccaccgcctgcttctcaacattccacccctgctggtcttccacccagcagggctaaaccccctacagaaggggctgggagccccgcaaaagccagccaggcttctaagctgcgagcgtcaaaagaggagaaagaggactggttgtcccatgcgctgtcacggaaaaaatcccaaggactcgctcgagaacaacacgcgggtacaagcgaaggcctgcacctcgcagggactgcaggacaccctccgagcggaagccagcccctgactagtactcagggtctcgaacacgccgctgcgggtggaagcagcggaactaccgcgcgagagaggccatgtgttaggcctggcgtcagcgggtcaccagtgacccagaaccacgcggcttcggccctgcccacgggctcacctaagaggggaactgccccaggcgatctctctgcgacggaaccagcgacatgttttccaagtacgcagaaaccaacagagccctcagttcccgtacagcccctcctgccagagtccttagccagaagtctgttgcctagcactgagtatcagaagcagctgttagccgcacaggtacagctgcaatgctcacctgcggagcttcaagcagaactactgcactctcaggctaggcttgctgaattagaagcccaagtgagaaaattggaactggaaagagctcagcacgaactattactggggagcctacaacagcagcatcaggcggatctcgaactcatagaaagtgcacaccgctcgaggattaaagtgctcgagacttcttatcagcaaagagaagaacggttgcggagggaaaacgaggaactttcggctagatatctgagtcaatgccaggaggccgaacaggccagagcagaactaacggcgcagcatcagcgtcggctcgccgctattgcccaagagaaagatcaggaaatggaacgtttgagagagcttcagagggcaagtatcttagacatgagaagagatcacgaggaacagctacagcggttgaaacttctgaaggaccgggaagttgacgcggctacctcagccaccagccatacaaggtcattgaacagcatcattcaccagatggaaaaattcagctcttctctccatgaactgtcaagtcgggtggaagcttcccatttaactacctctcaagagcgcgaattgggtattaggcaacgagacgagcaacttcgggcactgcaggagcggctcgggcagcaacagagggatatggaggaggaacggtcccgacagcaagaggtcattggaaaaatggaggccaggctcaacgagcagtctagattgctcgaacaggagcgatggagggtgaccgccgagcagtcaaaagcagagtccatgcagcgggcattggaggaacagagaaaggtgaccgcccaacagatggctatggagcgcgctgagttagagagggccaagtccgctctgctggaggagcagaaaagcgtaatgctcaaatgcggcgaggagcgcaggcggcttgctgctgaatgggcggaattcagtgcacagcagaaattaagcaaagaaagagctgagagggaggcggaacgcgctctccaggtggacacccagagagagggaacactgatttctttggctaaagagcaagccgagctgaaaatccgtgcatccgagctgcgcgctgaggagaagcagctcgctgccgaaagagctgctttggagcaggagaggcaggagcttagactggaaaaagaacggatcaatgccacagcgctcagggttaaactccgcgcagaggaggttgaatccatgagtaaggtcgcctcagagaaatacgaagagggcgagcgcgcactgcgtgaggcccagcaagtgcaggccgaacaacaggccaggttgcaggccgtgcagcaacaacaggaaaggctgcgcaagcaggagcagcatatgcatcaagagcatctttccctcgcacagcagcgtctgcagctggacagggccaggcaggatttgccatcctccctggtgggtctgttccccagagcacagggaccagcggcatcctctcagtccgcactaatgcctccagcccctaccactcggtggtgtagtcagccccctacaggtctagacccctctccgctgcacctccatgcccgtctagctctcttacgccacatggctgagcaggatagggacttccttgagaacgaacaattcttcttggagacacttaagaaagggtcatacaatctgacctcacattccgcctag

SEQ ID NO: 50240 - DNA, 3444 bp, Artificial Sequence
  Description of Artificial Sequence: Synthetic coding sequence
gcaccaaagaccaaaaagggctgtaagggaagcattgatgacttcctaggggacttattaggagatgatatgaccttacctgaaaagccagtaaaattggcaagtcacacaagggacaccacgggggtctcgcagatgtttccaagttcgaaggccagaaccaaatccttgctgggcgacgatgtctttagcactatggcaggattagaggaggcagacgcagaagtgtccggtattagtgaagctgacccacaggccctgttgcaggccatgaaagacttggatgggatggatgccgacattctgggactaaagaagtccaatagcgcgccttctaagaaagcagcaaaagacccgggaaagggcgaacttcccaatcacccaaagcctgcaggaggtgccattcccaccaagaagtcactgccttctccatcatcttcaggccaccagaataggaggttcagttccgaggacctggaggaccctttgcggggtctcctaagctacgacgagggaggcattacgaagcagccccctgtgacccagtcaaaaaccgcctcggacaaatcgccaagcactgtgcgcgaccagggtcctagcattcctttgacccctggtgacactccgattaggaagaaggaagagctgctgttcgacgatggcgatgacatcatggccacactgggcttcggcgatagtccgaaggccgagaaaagacagataggggatcaggagggacccagacccgctcggagtacactggatgaattgctgggaagaggaatggctacaaagcttctggccaggcccggtaccggagaacacagagaattcaagctggacaaaaagtaccaacggccacaagactccgaggatatgtggggcgatgaggacttcacctttggagcttaccagcccactgtggtatcaagcgagggaagacaatctagaaggcagtccgtgtcccgattcttcgcggatagtggcgctgatcctaagggcgagcctggatccaaacagagtcctcctatggcaagttctccaatccaacccaggaaaggaggcgctgactggttagggctgaaggacgaggacctagacctgttccctgccagtcctacaagagaggcccatagggaaagttccgtccccgtgacaccttcagttccccctccggcaagtcagcacagcacccccgctgggctgcccccaagtcgcgctaaaccccctacagaaggagcaggctccccggcaaaagcaagtcaagcctccaaattacgcgcatccaaggaagagaaggaggactggctatctcacgctctcagccggaagaaaagtcaaggactcgcacgcgaacaacacgcaggcaccagcgaggggctgcacctcgcgggaactgctggtcaccccccttcgggctctcagccacttacatcaacgcagggtctggagcatgcagctgctggaggctcttccggcactaccgccagggagaggccttgcgtcaggcctggagtctcagggagccccgtgacccagaatcacgctgccagcgcactgcctactggctcccccaagagaggtacagcacctggcgacctttcagctactgagcccgcaacatgttttcctagcactcagaagccgactgaacccagtgtgcccgtgcagcccttactgccagaatctcttgccagaagcctgcttccctcgaccgagtaccagaaacagctgctggccgctcaagtccagctacagtgttcccctgccgagttgcaagctgagttgctacacagccaagcgaggttggccgaactggaagcacaggtgaggaagcttgagttggagcgagcccagcacgagcttcttctcgggtccctgcagcagcagcaccaagctgacctggagctgattgaatctgctcatcgttcacgaattaaggtccttgaaacctcataccagcaaagagaggagcgcctgcgaagggaaaatgaggagctgagcgcacggtatctgagtcagtgccaagaggcggaacaagcgcgtgccgaactgaccgcccaacatcagcggcgactggctgccattgcccaggagaaagatcaagaaatggaacgactgagagagctccagagggccagcattctcgacatgcgcagagaccacgaagaacagttgcaaaggctcaagctattgaaggacagggaggtggatgcagcaacctctgccacctcacatacccgaagtctgaactcaatcattcatcagatggagaagttcagcagttctctccatgagctttccagcagggtagaggcatcccatctcacaacgtcccaggaacgggaattgggtatccgccagcgcgatgagcagctgcgcgctctccaagagagactggggcagcagcagagggacatggaggaggaacgatcccgacagcaagaagtgataggtaagatggaagctcgactgaacgaacagagcaggcttcttgagcaggagcgatggagagtgaccgcagaacagagtaaggctgaatccatgcagagggcacttgaagagcagcggaaggtgacagcccaacaaatggcgatggagcgagccgagttagaaagggcaaaatctgctcttcttgaagaacagaagtctgtgatgttgaagtgcggcgaggagagacgcaggctggcagcggagtgggccgaattttccgcccagcagaaactgagtaaggagcgcgctgagagggaggctgaaagggccctccaggtggacacccagcgagagggcacacttatcagcctggccaaagagcaggccgagctgaagatccgcgcatcagaattgagagcagaggagaagcagctggccgcagagcgagctgcattggagcaagagagacaggaattgcgattagaaaaagaacggatcaatgcaacggccctgagggtgaaactgcgggcagaggaggtagagtcaatgtcaaaggtggccagcgaaaagtacgaggagggtgagcgggctctgcgggaggcccagcaagtgcaggctgagcagcaggccagactacaggccgtgcagcagcagcaagaaagactgcgcaaacaggaacagcatatgcaccaggagcatctgtccctcgcccagcagcgtctgcagctggaccgggctcgacaggacctgccatctagcctggtcgggctcttccctagagctcagggcccagccgcaagtagtcagtctgctttgatgccacccgctccaaccacacggtggtgtagtcaaccacctacgggcctcgaccctagccctcttcacctgcatgccaggttggcactcttacggcacatggcagagcaggatcgtgactttctagagaacgaacagttctttttggagaccctgaagaaaggtagctacaacctaaccagccacagtgcatag

SEQ ID NO: 50241 - DNA, 831 bp, Artificial Sequence
  Description of Artificial Sequence: Synthetic coding sequence
atgaaaaaaacacctgtgtttctggaatccttagtgaccaacatgctccgattacgcgctatctgccccttttcttggcgcgtctttcaatttcgtcccatatcttgcgagcctcttatcatccagatgaacaaatgcacagatgaagagcagatgttcggctttatagaacggaataaggctatcctatccgagaagcaggttggatgcgcatttgatatgttgtggaaattgcagaaacagaagactagcctccttaagaatgccgagtacgttagagaccatcctcaatttctgactcttcacaacctggccacaaataaattcaagctcatgaatgatgatacactggtgaatgtgctctatgttactcaacagttcgccggagaagcccacgacccactggtcgaagccctcgtgaccgaagcctggcgtcgactcgagcgttttgacattaagttgctttcggagttctcctcctgcttggcggatcaacatctgtatttctctccgttgatgggtaaaattgccgatatcgttcatcggaacctggagaccacccaggatctttcaagcctgtcagtactgatggtaaacattagttcattgatctcaagacacttccagcagcagttggtcaataagactgaactgctgttcgataccatcgattcatcagaagtgaatgtggcaaagtcaattgctaagttcctgcggaatgtcagatataggtaccagccgctgctcgagcgctgtaacaacgtatttctatccaatgtggatcacttggacttagatagtataagcaagattctgagcgtatataaatag

SEQ ID NO: 50242 - DNA, 2544 bp, Artificial Sequence
  Description of Artificial Sequence: Synthetic coding sequence
atgaagaaaacgcccgtgtttcttgagagcctggtcactaacatgttgcgattgagagccatctgccccttctcctggagagtgttccagtttaggcctatctcctgcgaacccctgatcattcaaatgaacaagtgcactgacgaagaacaaatgttcggatttatcgaacgcaataaggccattctttctgaaaagcaggtgggctgcgcattcgatatgttgtggaaactccagaagcagaaaacctctcttcttaagaatgctgaatatgttagggaccatccgcagttcctcactctgcacaacctggcaaccaacaagtttaaacttatgaatgatgatacactcgtgaatgttctctacgttactcagcagtttgccggagaagcacatgatcctctcgtggaagctttggttaccgaggcatggcggagactggagcgttttgatatcaagctactctctgagttctcatcatgcctcgccgaccaacacctgtatttctctccgttgatggggaaaattgctgacattgtgcacaggaaccttgagactacccaggatctaagttcactgtccgttttgatggtgaacatatcctctttgatctccagacactttcaacagcaactcgtgaataagactgagctcctgtttgacaccattgacagctccgaagtgaatgtcgccaagtccattgcgaaattcctacggaacgtccgctataggtaccagcctctcctcgagagatgcaataatgtgtttctcagtaatgtcgatcatttggacctggattctatctcgaagatcctgagtgtgtataaatttctgcagtttaacagttttgaatttattattatggctaagaaaaagttgacggaaatgatcccgctatgcaaccatccagcgtctttcgttaaactctttgtggctctcggaccgattgctggtccggaagagaagaagcaactcaagtctaccatgttgctcatgagtgaagatctcaccggtgaacaagcgctggcagtgctcggggctatgggggacatggaaagcagaaatagctgcctgatcaaacgcgtgacctccgtcctccataaacatctagatggatacaagcctctcgagttattgaaaatcacccaagaattgacctttctgcacttccagcgtaaagagttcttcgctaaactgagagagctgctccttagctacctaaagaattctttcatcccaaccgaggtcagcgttctggtccgtgctatctccctgctgccttctccccacctagatgaggtgggcatctctagaatcgaggcagtgctgccgcaatgtgatctgaataatttgtcctcttttgccaccagtgtactgcggtggatccaacacgaccatatgtaccttgataatatgaccgctaagcaactgaagctgctgcagaagcttgaccattatggcaggcaacgcttgcaacactcaaacagcctggacctcctacgcaaggaactgaaatccctcaaaggtaacacattccctgagagcctactggaggagatgattgccaccctccagcacttcatggatgacattaattatatcaatgttggcgagattgcatctttcatctcaagtactgattacctgagcaccttgctcctggatagaatagcttctgtggctgtccagcagatcgagaagatccaccctttcacaatcccagctattatccggccattttcagtgctcaactatgaccccccacaacgagatgagttcctcggcacctgtgtgcagcacctgaatagctatctgggcattcttgacccttttatactggtctttctcggcttcagtcttgcaaccctggaatacttccctgaggatttgcttaaggccatctttaatatcaaattcctggcacgattagacagtcagcttgaaatcctgtctccttctcgctcagctcgcgttcagtttcatttaatggagctaaataggtcggtgtgtctcgagtgcccagagtttcagattccatggttccatgataggttttgccagcagtacaataagggcatcggcggtatggatggtacacagcagcagattttcaaaatgctcgcagaggtactgggcggtatcaattgcgtgaaagcgagcgtacttaccccctactatcacaaagtggacttcgaatgtatcttggacaagcggaagaagcctctgccttacggctcacacaacatcgctctgggccagctaccagaaatgccttgggagtcgaatattgaaattgtggggtcaaggctgccacccggtgcggagagaatcgcattagaatttttggacagtaaggccctctgcaggaatattcctcacatgaagggaaagtccgctatgaaaaaacgccacctcgaaattctgggctatcgagttattcaaatttcacagttcgagtggaacagcatggctctgtccactaaggacgccagaatggattaccttcgggaatgcatttttggagaggtcaagtcctgcctgtag

SEQ ID NO: 50243 - DNA, 2415 bp, Artificial Sequence
  Description of Artificial Sequence: Synthetic coding sequence
atgaagaaaacaccagtgttccttgagtccctagtcaccaatatgctccgtctcagagccatttgcccattctcatggcgggtatttcagtttagaccaatttcatgcgagccattgattattcaaatgaataagtgtaccgacgaggaacagatgttcgggttcatcgagcggaacaaagctattctgagcgaaaaacaggtggggtgtgccttcgacatgctctggaagcttcaaaagcagaagacctccttactaaaaaacgcagagtacgtgcgtgaccatccacagttcctgaccctgcataacctagctacgaacaagtttaagttaatgaacgacgacaccctggtgaacgtgttgtatgtgactcaacagttcgcgggagaggcacatgacccactggtcgaggcactggtgacagaagcatggagaagactcgaacgatttgacattaagcttctgtcggagttttctagctgccttgctgaccagcatctttatttttccccattgatgggcaagattgccgatatcgtgcataggaatttagagactacccaggacctcagtagcctgtccgttctgatggtcaacatctcaagtctgatctcaagacactttcagcaacagctcgtgaacaagactgaattactgttcgatactatcgattcctcggaggtgaacgtggctaagtccattgctaaatttctgcgtaacgtgcggtacaggtaccagccattgttagagcggtgtaacaacgttttcttgagcaatgtggaccacttagacttggacagcatttctaagatcctcagtgtgtataaattcttacagtttaatagttttgagtttattatcatggctaagaaaaaactgaccgagatgatccccctgtgcaaccatccagcttctttcgtgaagttatttgtagcgctgggaccaatcgctggcccagaagaaaaaaagcagctaaaaagtacaatgctgctcatgtcggaggatctcacgggagagcaggccctggctgtgcttggagcaatgggagatatggagtcaagaaactcctgtttaatcaaacgcgtaacttctgtgctgcacaagcatttagatggctacaaaccactggaactgctaaagattacccaggaactgacatttctgcatttccagaggaaagaattctttgccaagctgcgggaactgctgttatcctatctgaaaaatagctttatacctacggaagttagcgtgctggtgcgagcgatctctctgctcccttctccacacctcgacgaggtgggtataagtagaattgaggcggtactgcctcaatgtgaccttaataacttatccagtttcgctacttcagtgctacggtggatccagcatgaccatatgtacctcgataacatgacggcgaagcaacttaagctgctgcagaagttggatcattacggtagacagcgccttcagcactcgaatagccttgacttactcagaaaagagttaaaatctctgaagggtaacaccttccctgagtcacttctagaggagatgattgctacgctgcagcactttatggacgacatcaactatattaacgttggagagattgcgtccttcatctctagcaccgactacctgtctactctgctcctcgatagaatagcctcagtagccgtgcagcagatcgagaaaatccaccctttcacaatacctgcgattattcggccattttctgtgcttaactatgacccccctcagagagatgagttccttggaacttgtgttcagcaccttaattcctacctcgggatcctagatccatttatcttagtgttcctggggttcagcctggccacgcttgagtattttccagaagacctgttgaaggcaatcttcaatataaagtttctggcacgtctggacagccagttggagtcaatagggggaatggacggaactcagcaacaaatattcaaaatgctggccgaggtattaggtggtatcaattgtgtgaaagcctccgtcctgacaccatactaccataaggttgactttgaatgcattttggataaaaggaaaaaacccctgccgtacggatcccacaacattgcgttagggcagctgccagagatgccatgggaaagcaacatagagattgtagggagccgccttccccctggtgcggaaagaattgctctggaatttcttgactctaaagctctatgcaggaatattccacatatgaaaggaaagagcgcaatgaagaaacgccacctggagatcttgggttaccgcgtcatccagatcagccagtttgagtggaatagcatggccctgagcactaaggacgcccgtatggattacttaagggaatgcatcttcggcgaagtgaagtcatgtctatag

SEQ ID NO: 50244 - DNA, 1989 bp, Artificial Sequence
  Description of Artificial Sequence: Synthetic coding sequence
atggccctgatcacactccgcaaaaacctctatagactcagtgactttcagatgcatagagctctagcagcactgaaaaacaagcccttgaaccacgtccacaaggtagtgaaagagcgcttgtgtccgtggctgtgcagtcgacaacccgagccgttcggggtgaaatttcatcacgctcactgtaaaaaattccacagtaagaatggtaacgatttacatcctctgggcggaccggtatttagccaggtttcagactgcgacaggctagagcagaatgtgaagaacgaggagagccagatgttttaccggcgtctgtccaaccttaccagcagcgaggaggtgctgagcttcatttccaccatggaaaccctgccagacactatggccgctggagccctccagcggatatgtgaggtggagaaaaaagacggcgatcaggggctccccaaagagattttagagaattccatttttcaggccttatgttttcagttcgaaaaagaaccaagccagctgtccaacacaagcctggttaccgctttgcaggccttaattctgctgcacgtagatccccagtccagtcttctgttgaacctggttgccgagtgccaaaatcgcctgagaaagggaggaatggaggtgagaaacctatgcatcctcggcgagtcactcatcaccctgcattctagcggctgcgtcacactggagttaataataaaccagcttcagggggagaaacttgagacgtttactcctgaggatatcgtagcactgtaccggatcctccaggcctgtacggagaaggtcgatgaacatcagaccttcctgaacaagatcaataacttctccctgtctatagtttcaaatctaagtccaaaactcatctctcagatgttgaccgcccttgtcgttctcgaccagtcccaagccttcccccttatcattaagctaggaaagtacgtggttaggcacgtgccccactttactaacgaggagctccgacgagtcctggaagccttcatctacttcggtcaccatgatactttctttactaaggccctggagcaccgagtggccgctgtttgcctgacgctggatcccgaggttgtctgtcgagtcatggaatattgttctcgggagctgatccttagtaagcctattctgaatgccgtggctgaaacttttgtatgtcaaaccgaaaagttttcaccgcgacagataagcgccttgatggagcccttcggcaagctgaactacttaccccctaacgcctcagctttgtttcgaaaactggaaaacgttctgttcacccatttcaattattttcctccaaagtctctgttgaagctgctgcactcctgctctctgaatgagtgccatccagtgaacttcctggcaaagatcttcaagccactgttccttcaaagattacagggcaaagaatctcatctagataccctttcgcgcgctcagctcacccagctgttcttggcatccgtgcttgagtgcccgttctataagggcccaaagctgctgcctaaataccaggttaagtccttcctgacaccttgttgctccctcgagaccccagtggactcccaactgtacaggtacgtgaaaattgggttgacgaatctcctgggggctagactgtattttgcgcctaaggtgctaacaccctattgctacaccattgacgtggaaatcaagctggacgaagaaggctttgtactgccctcaaccgcgaacgaagacatccacaaacggatcgccctctgcattgacggccctaagcgattttgttctaattctaaacatttgctgggcaaagaagctatcaaacaaaggcacctgcagctgctgggctaccaggtagtgcagatcccttatcacgagatagggatgctcaagagccggagggagctcgtcgagtacctgcagcgtaaattgttcagtcaaaataccgtccactggttacaggagtag

SEQ ID NO: 50245 - DNA, 738 bp, Artificial Sequence
  Description of Artificial Sequence: Synthetic coding sequence
atggcattgataaccctgagaaaaaatctttaccggttaagtgactttcagatgcaccgagctttggccgctctaaaaaacaagccgctcaaccatgtgcataaagtcgtgaaggagcggctctgtccgtggctgtgctcccgacagcctgaaccttttggcgtgaagttccaccacgcacattgcaagaagtttcacagtaaaaatggaaacgacttgcatccgttggggggtcccgtgttctcacaggtctcggactgtgacaggctggagcagaatgtcaagaatgaggagtcccagatgttttaccgcagattgtccaatctcacctccagcgaggaagtcctcagcttcatctctactatggaaaccctgcctgataccatggccgctggggcactccagcgcatttgcgaggtggagaagaaagatggagatcaggggcttcctaaagaaatcctggagaacagcatctttcaagccctctgtttccaatttgagaaagaaccgtctcagttgtctaatacaagcttagtcaccgccttgcaagccttgatccttctgcacgtcgacccccaatcaagcctgctgctcaatctggtcgccgagtgtcagaatcggctccggaaaggcggaatggaggtgcgcaacttgtgcatactaggagagtcactgatcactctccactcgtctggttgtgttactctcgagctgatcataaatcaactacagggttag

SEQ ID NO: 50246 - DNA, 879 bp, Artificial Sequence
  Description of Artificial Sequence: Synthetic coding sequence
atggagagggggcctgtggtcggtgccggattgggcgctggggctcggattcaggctctgcttggatgccttctaaaagtactcttatgggttgcatcagcactcctgtactttggaagtgagcaggcagcacggcttttgggcagtccttgtttgcggaggctgtaccacgcttggctggctgcggtggtgatattcggaccactgctccaattccatgtcaatcccaggacaatcttcgctagccatggcaatttctttaatattaaattcgtcaatagtgcttggggctggacctgtaccttccttggaggcttcgtgctgctggtagtcttcctcgctactcgccgagtcgccgtgaccgcacgtcacctcagccgactggttgttggggcagctgtgtggaggggtgcgggtagggctttcctccttatcgaagacctgacaggcagttgttttgaaccgctcccccaggggttacttctgcatgaacttcccgataggcgaagttgtctggccgctggccaccagtggcggggatacacagtctcatcacacacattcctgctgaccttttgttgcctactcatggcggaagaggctgccgtgtttgcgaagtacctggcccacgggctgccagccggagcgcctctgcggttagtctttttgttgaacgttctactgctgggcctgtggaacttcttgctgctctgcactgttatatatttccaccaatacactcacaaagtggtcggggctgccgtgggcaccttcgcgtggtacctgacgtacgggagctggtaccatcagccatggtcgcccggtagtcccggacatggcttgttccccagacctcacagttcaagaaaacacaactag

SEQ ID NO: 50247 - DNA, 789 bp, Artificial Sequence
  Description of Artificial Sequence: Synthetic coding sequence
atggagcacctcgaaagatgtgagtggctgctccggggaactctcgtgcgcgctgccgtccggagatatctcccctgggctcttgttgcttcgatgttagcaggaagtctcttgaaggaattaagccctcttccggaatcatacctttcaaacaagcgaaatgttttaaacgtgtactttgtgaaggttgcgtgggcttggaccttctgcctcctgcttccttttatcgcacttaccaattatcatctcactggaaaggccggtctggttctccggagactgtcaacgctgttggtgggcacagccatatggtacatttgcacgagtattttctcaaatatagagcactacacaggctcatgctaccagtctccagctctggagggggtacgaaaagaacaccaaagcaaacagcagtgccaccaggaaggcggtttttggcatgggtttgatatctctgggcacagctttttgttgactttttgtgctctgatgatcgtggaggagatgagcgtgctacatgaggtgaagacagaccgatcgcattgcctgcataccgctattacaacactggtcgtggcccttgggatcctgaccttcatttgggtgctgatgtttctgtgtactgctgtctacttccacaatctctcccagaaggtcttcggcaccctgtttgggctcctcagttggtatgggacttatggattttggtacccgaaggcattcagccccggtctgcctccacagtcctgctctctaaaccttaagcaggactcctacaagaaatag

SEQ ID NO: 50248 - DNA, 1053 bp, Artificial Sequence
  Description of Artificial Sequence: Synthetic coding sequence
atggagcctaccgagcctatggaacccacggagccaatggagccggcacgttctgctcaccggggaggcgaagctctgctgcgggagcttgaagtcctggtgcaagatgtcgttcggactagcagctggtgggagcgtcacggcgttgattgcgccattctcgcccttagcctatttgcgttacccgctggcttcctctgcttgagatgggagaatgcactggtgttcgcatcaggcatcaccattctgggggtctgtcattataccctgactgtgaagggatctcatctggctacccatggcgcactcacagagagtaaaaggtggtcaaagatttggttactgttctttgtggaggtttgtactgcctttaccgccgaacacgcaacacacgggcatgtcaagatgcatcacgcatacaccaatgtggtcgggctgggagattcatcaacgtggcggctgccgtgcctcaacagatatgtctacatgtttctggcccctttcctgctgccaatagcaactccactagtggctgtcgagaggctccgcaaagtcgaattggggaccgccctgagaacgcttgccctgatcagcctcggactgtattcccactattggcttctgcttaatgtttccggctttaagaatccttcctcagcgcttggttgcatgtttcttacccggtcactgctggcccacccttatctgcatgtcaacatctttcagcacatagggctacccatgtttagtagagataataaacccaggaggattcacatgatgagcctgggcgtgctgaaccttgctcgccttcccgtcctggactgggcattcggacacagcattatatcctgtcatgtcgaacaccacctgtttccccgactgagcgataacatgtgtctgaaggttaagccagtggtctctcagtttctcagggaaaaacagctcccctacaacgaggatagctacctcgctcgatttcaacttttccttcgccgatatgaagagttcatggtgcaggcccctcctatcacagagctcgttgggctttag

SEQ ID NO: 50249 - DNA, 615 bp, Artificial Sequence
  Description of Artificial Sequence: Synthetic coding sequence
atgcagggactgagacgatggggatgcagcccaggaagtcagcgctcctgcattgctcagctttgcctcacaggtaccccggtgagctttctggtgcctagttcaagatgtgcccagccctctctccagtccacaccgcgtatgggtactagccgttgcaccatgccaactcccacctggtgggcctggggaacgccggctcgcggaggatgtttggcgtctactgctatgtcaacctgctctctcctgcttagttctagtccttccccattacactggtggttgagccacatcggtctgcctatgttctcacgggataacaaacccagacggatccacatgatgtcactcggtgtgctgaatctggccagactccctgtgttggactgggcctttggtcacagcatcatcagttgtcacgtggaacaccacctgttcccacgcttgtccgataacatgtgtctgaaggtcaagccagtggtttcccagttcttgcgtgagaaacagctgccctacaacgaagacagttatcttgccaggttccagctgttcttacgccgttatgaagagttcatggttcaagccccaccgattaccgaacttgtgggtttatag

SEQ ID NO: 50250 - DNA, 1548 bp, Artificial Sequence
  Description of Artificial Sequence: Synthetic coding sequence
atggttagcatacctgagtactacgaaggcaagaatgtcctactcactggcgcaaccggatttttgggcaaggtcctccttgagaaactgctgagaagctgtccgaaagtgaactcagtgtatgtgctagtgcgccagaaggcgggacagaccccccaagagcgcgttgaggaagttcttagtgggaagctgtttgatcggttgagggacgagaacccagattttcgcgaaaaaatcatcgcaatcaatagcgaactgacacaaccgaagttggcgctttctgaggaagataaagaggtgattattgactccactaatattatctttcactgcgcagcgactgtccgcttcaatgaaaacctgagggatgccgtccagctgaatgtcatcgccacaagacaactcatcttgctggcccagcagatgaagaatttggaggtttttatgcatgtgtcgactgcttacgcctattgtaaccggaagcacatcgacgaggtggtctatccaccacctgtcgatccgaagaagctcatcgactcgttagaatggatggacgatggcttggtcaacgacattactcctaagctgatcggagatcgccctaacacatatatatacacaaaggcccttgcagaatacgttgtgcagcaggagggggctaaattgaacgtggctattgtccgaccaagcattgtgggagccagttggaaggaaccattccccggttggatcgacaacttcaacggccctagtggcttgttcattgccgcaggaaaggggattctacgcacaataagagcgtcaaataatgcactcgcagatctcgtaccagtggacgtcgttgtgaatatgagccttgccgcagcgtggtattccggggtcaacaggcctcgaaacattatggtgtacaattgcacaacaggctcaaccaatcctttccactggggggaggtggaataccacgttatcagcacattcaagaggaaccctctggagcaggccttcagaagacctaatgtgaatttgacatcaaatcatctgctgtaccattactggatagcggtcagccacaaggctcccgcatttctgtatgatatctacttacgcatgacgggacgttctccacgtatgatgaagactattaccaggctgcataaagcaatggtgtttctggaatactttacatctaattcatgggtatggaataccgagaatgtgaacatgttgatgaaccagctgaacccagaagacaagaagaccttcaacatcgatgtacgccaactccattgggcggaatacatcgaaaactattgcttggggacaaaaaagtacgtgctcaacgaggaaatgtccggcttgccagctgctaggaagcatttgaacaaacttcgaaatatccggtatggattcaataccatcctggtgattctgatctggcgaatctttatagctaggtcacaaatggcacgcaacatttggtatttcgtagtaagtctgtgctacaagttcctcagttacttccgagctagttctactatgaggtattag

SEQ ID NO: 50251 - DNA, 1029 bp, Artificial Sequence
  Description of Artificial Sequence: Synthetic coding sequence
atggtcagcattcctgagtactatgaaggaaagaacgtcttgctcaccggggctacggggtttctgggaaaagtgcttctcgagaaactcctacgctcctgtcccaaggttaatagcgtgtatgtgctggtcagacagaaagccggtcagactccacaagagagagttgaggaggtgctttctggaaaattattcgacagattgcgcgacgagaatccggacttcagagagaagataattgcgatcaattcagaactgacccagccaaaacttgctttgagcgaagaagacaaggaggttattatcgactctaccaacatcatttttcattgtgccgcaaccgtgagattcaacgagaatctacgcgacgctgtgcagctcaatgtgatcgcgacacggcaactgatactcttggcgcagcagatgaaaaatctggaggtatttatgcatgttagcacagcctacgcgtattgcaatcgcaaacatattgacgaagtcgtgtatccccctcccgtggatcctaaaaagctgatcgattctctcgaatggatggacgatggattagttaatgacatcacacccaaactcattggagatcgcccaaacacgtatatttacacaaaggccctggccgagtacgtggtccaacaagaaggggctaagctgaacgtagccattgtccgacctagtattgtgggtgcgagctggaaggaaccgtttccaggatggatcgacaatttcaatggccctagcgggctctttatcgccgctggcaagggcatcctgcggacaataagagcctcgaataatgcacttgctgatctagtcccagtagacgtcgtggtaaacatgtctctggccgctgcttggtactccggagtgaatagacccagaaatattatggtatataattgtaccactggctcaacgaaccccttccactggggcgaggtaggcatgatcctgcccgtcttcctgaacgttagaatcaatttaaaagagccacgcaaaaagaaaaagaaaaaatag

SEQ ID NO: 50252 - DNA, 1548 bp, Artificial Sequence
  Description of Artificial Sequence: Synthetic coding sequence
atgtctactatcgccgctttttatggcggaaagtctatcttgataaccggagctacaggttttcttggtaaagtgctaatggaaaaactattcagaacctcacccgatctgaaagtgatctacattctggtccggccaaaggccggacagactttgcagcaacgtgtgtttcaaattctggactctaagctttttgagaaggtcaaagaagtgtgcccaaatgtccacgagaaaataagagccatttatgccgatcttaatcagaacgatttcgccatttcgaaagaagacatgcaagagctgctatcttgcaccaacatcatctttcactgcgccgctaccgtgcgcttcgatgataccttaagacacgctgtgcagttgaacgttacagcaacccgtcagctactgctgatggcctcccagatgccaaagctcgaggccttcatccacatcagcactgcctattcaaattgtaatctcaagcatatagatgaagtgatctacccttgccccgtagagcccaaaaaaatcatagactcccttgagtggttagatgatgcaataatcgatgaaatcaccccaaaactgatccgcgattggcctaacatatacacatacaccaaagcccttggcgagatggttgtgcagcaggagagccgcaatctgaacattgccattattcggccaagcatcgtcggcgctacttggcaggagccattccccggatgggtggacaacattaatggccctaatggcattattatcgcaacgggaaaagggttcctgagagccattaaggcgaccccaatggccgttgccgacgtgatccccgtggatactgtcgtaaatttgatgctggccgtgggttggtacacagctgtgcataggcctaagagcacgctggtataccacatcacatccgggaatatgaatccatgtaattggcataaaatgggcgtacaggttctagctacattcgaaaaaatcccgtttgaacggccatttaggagaccgaatgctaactttacctctaactctttcacgtcgcagtattggaatgccgtttcccaccgcgctcccgcaataatctacgattgttatctgaggctgaccgggagaaaacctcgcatgacaaaactcatgaatcgcctactgcgtactgtctcgatgctggagtatttcatcaaccggagctgggaatggagtacatacaacacagagatgttgatgagcgaactgagccccgaagaccagcgagtgtttaacttcgacgtccgtcaactgaactggctcgaatatattgagaattatgtccttggcgtcaagaagtatctgttaaaagaggatatggctggtatccccaaggcaaagcagcggctcaagcgcctccgtaacatacactatttgttcaataccgcgctcttcttgatcgcatggcgtcttctgattgctcgcagccaaatggcgaggaacgtgtggttcttcatcgtgagtttctgctacaagttcctcagctatttccgggctagtagcacccttaaggtgtag

SEQ ID NO: 50253 - DNA, 1548 bp, Artificial Sequence
  Description of Artificial Sequence: Synthetic coding sequence
atgagcacgatcgctgctttctacggtggtaagtcaatcctcatcaccggcgcaacgggtttcttgggaaaggtcctgatggagaagttgtttcggacaagtccagacctgaaagtaatttacatcctggtacgcccaaaagccggacagactctccagcagcgggtgttccagattctggattcaaaactgtttgagaaagtgaaggaagtgtgccccaatgtgcatgagaagatccgggctatctatgccgatctaaatcagaatgacttcgccataagcaaggaggatatgcaggaattgctatcttgtaccaatatcatcttccattgtgctgcaacagttcgttttgacgacaccctacgccatgccgttcaactgaatgtcacagccacacgtcagctcctgttaatggccagccaaatgcctaagctcgaggccttcatacacatcagcacagcctatagtaattgcaacctgaaacacattgacgaggtgatttatccatgccctgtggagccaaagaagatcattgatagcctagaatggctggatgacgctattattgacgagattacgccgaagttaattagggactggcccaacatctatacatatacgaaagcactcggcgaaatggtggtccagcaggagtcccgaaatctcaacatagccattattcgacccagtattgttggggcaacctggcaggagccgtttcctggatgggtggacaacatcaacgggcctaatgggatcattattgctacagggaagggattcttgcgtgcgatcaaagctaccccaatggccgtggcggacgtgatccctgtggataccgttgtgaatttgatgctcgccgtcggttggtacacagctgtccaccggccaaaatctaccctcgtgtaccatattaccagtggcaatatgaatccatgtaactggcacaagatgggagtgcaagttctggccacattcgaaaagatccccttcgagcgtccatttcggcgacccaacgccaacttcacttctaattctttcacaagtcaatattggaacgccgtgtcgcatcgggctcctgccatcatctacgactgctacttgcgcttgacgggacgcaaacctcggatgacaaaactcatgaatcggctcctgagaacagtgagcatgctcgaatattttattaataggtcatgggaatggagcacgtacaacaccgagatgctgatgagcgaactatctccagaagaccagcgtgtctttaattttgatgtccgacagcttaattggctggagtacattgagaactacgtgctcggcgtcaagaagtatctccttaaggaagatatggcgggtatccccaaagccaaacaacgtctgaaacgtttgcggaatattcactacctgttcaacactgctctgttcctgattgcatggaggctgctgatagctagatctcagatggcacgaaacgtctggtttttcatcgtctctttctgttacaagttcctttcctatttcagggcaagctcgacattaaaggtttag

SEQ ID NO: 50254 - DNA, 609 bp, Artificial Sequence
  Description of Artificial Sequence: Synthetic coding sequence
atgttgctctggtctttattggtaattttcgaaagagtgagggagaaccttgactcgttaaccttagtggctccgtctagtgtctttgaaggcgactctatcgtactcaagtgtcagggcgagcagaactggaaaatccagaagatggcctatcataaggataataaggaactgtccgtgtttaagaagttttccgatttcctgatccagtcagcagtgctgtccgactctgggaactatttctgttccaccaaaggtcaactattcctgtgggacaagacttccaacatcgtcaaaattaaggtccaaggccctgacggatacagaagagatctgatgaccgctggagttctctggggcctattcggagtcctgggctttaccggggtcgctctcctcctgtacgctttgttccacaaaatatccggggaatcctctgcaactaacgagccacgcggtgcctcacggccaaatccacaagaatttacctacagcagccctacgcccgatatggaggaactacagccagtgtacgttaatgccaatatccgaacactgcttgagaataaggactcccaggttatctattctagtgtgaagaaaagctag

SEQ ID NO: 50255 - DNA, 1527 bp, Artificial Sequence
  Description of Artificial Sequence: Synthetic coding sequence
atgttactgtggtctttgctggtcatctttgacgctgtgacagagcaagctgactctctgacattggtggctccaagctcagtttttgagggcgattccattgtgttgaaatgccagggcgagcagaattggaaaatccagaaaatggcttaccacaaggacaataaagaattgtctgtgttcaagaaattttccgactttttgattcagtccgccgtgttgtctgatagcgggaactatttttgcagcactaaaggccagttattcctatgggacaagacctccaatatcgtgaaaatcaaggtccaggagctattccagagacccgtactcaccgcttcgtcatttcagcccattgaaggaggtccagtcagcttgaagtgcgagacacggctgtcaccccaacgtctggacgtgcagctgcagttttgtttcttccgggagaaccaagtgctgggctctggctggtccagttccccagaactccagatctcagctgtatggagcgaagacaccggaagctattggtgtaaggctgagacggtgacacaccggatcaggaagcagtccctccagagtcagattcacgtgcagagaattcctatctccaacgtttctctggagattcgcgctccaggtggacaggtcacagagggccaaaagctgatcttgctgtgcagtgttgccggaggtaccggaaacgttaccttttcctggtaccgcgaagcgaccggcacgtccatgggcaaaaaaacccagcggtctttgagtgccgaattagagatacctgccgtgaaagagagtgacgccggaaaatactactgcagggcagataacggccacgtgcctatccagtccaaggtcgtcaacatccctgtccggatccccgtgtcccgccctgtcctcactctgcgatctcctggggcacaggcagcagtgggtgacctgttggagctgcattgtgaggccctgcggggatcccccccaattctttaccagttttatcatgaagacgtcacattaggtaactcatctgcccctagtggagggggagcttcctttaacctgagtttgacagccgagcattcaggaaattactcctgtgaagccaacaacggactaggagcacagtgttccgaggccgtgcccgtcagtattagcggcccagatggataccggagggacctgatgaccgcaggggtactttggggactttttggagttctaggatttactggggtcgcgcttctactttacgcgctatttcataaaatctcaggggagtctagcgccactaatgagcccagaggagcctccaggccaaacccacaggaattcacatactctagtcccacccctgatatggaggagctgcaacccgtttacgtgaacgttgggtcagtggacgtggacgtggtctacagccaagtgtggtctatgcaacagccagagagtagtgccaacatccggactcttttagagaacaaagattcccaggtgatttatagttctgtaaaaaaatcctag

SEQ ID NO: 50256 - DNA, 609 bp, Artificial Sequence
  Description of Artificial Sequence: Synthetic coding sequence
atgctcctgtggagccttctggtgatcttcgacgctgtgactgaacaggccgactccctgactctggtcgccccttcgtccgttttcgaaggtgattctatagtgctcaagtgccaaggcgaacagaattggaagatccagaaaatggcctatcacaaggacaataaggagctaagcgtgttcaagaagttcagcgacttcctcatacagagtgcagtgctgtctgactcaggtaattacttctgctctactaagggacagctctttctgtgggacaagacatctaacatcgtcaagataaaagtgcagggtccagacggataccgaagggacctgatgaccgctggggtcttgtggggtctgtttggcgtgctcggatttactggggtcgctttgctgttgtatgcactatttcacaagatttctggtgagagttccgctaccaacgagccgcgaggcgcatcaagacctaatcctcaggagttcacatactcctcccctaccccagacatggaagagcttcaacctgtttacgtcaatgcaaacattaggacactgctggaaaacaaggacagccaggtgatttactcatcagtgaagaagtcttag

SEQ ID NO: 50257 - DNA, 1335 bp, Artificial Sequence
  Description of Artificial Sequence: Synthetic coding sequence
atgctgctgtggtcactgctggtaatctttgacgcggttaccgaacaggctgattctttgacactggtagctccatcctccgtctttgaaggggattcaattgtgctgaagtgccagggtgaacaaaactggaagatccagaagatggcttaccataaagacaacaaagaactctccgtctttaaaaagttttctgattttttgatccagtccgccgtgctaagcgactcaggaaattacttctgcagcaccaagggacagctgtttctctgggacaagacctctaatattgtgaagataaaggtgcaggagctttttcagagaccggtgctaaccgcctcatcttttcagcctattgagggcggaccagtcagcttaaagtgcgagaccagactgtctcctcaacgattagacgtgcagctgcaattctgtttttttcgggagaatcaggtgctaggttcagggtggagcagctctccagagctacagatctccgccgtctggagcgaggacactggcagttactggtgcaaggccgaaaccgtgacccacagaattcgaaagcagtcactacagtcacagatccacgtgcagagaataccaatatcaaacgttagccttgagatccgtgcaccagggggtcaggtgaccgagggtcaaaagctgattctgctttgcagcgtcgctggaggaaccggtaatgtcaccttcagctggtatcgggaggctaccgggacttccatgggaaagaagacacagagatcactgtctgccgaacttgaaattcctgccgtcaaggagagcgacgctggtaaatactactgcagagccgacaacgggcacgtccctatccagtcaaaggttgtcaatattcctgtccggattcctgtttcgagaccagtgctgacgctgcggtcccccggtgcacaggccgctgtgggggatctcctcgagttgcattgcgaagctcttagaggtagcccgccaattctctaccagttttaccacgaagacgtaacccttgggaactcatccgctccttccggaggcggagcctctttcaatttgagtctaacagctgagcattccggcaattatagctgcgaagccaacaatgggctaggtgctcagtgctctgaggccgtccctgtgtccatttcaggcccagacggttacaggagggacctgatgacagccggtgtgctatggggtctattcggggttctggggttcaccggggtagctctcctgctgtatgccctctttcataaaatttccggagagtcaagtgcaactaatgagcctagaaccccgaaatctagcaccttattgtag

SEQ ID NO: 50258 - DNA, 579 bp, Artificial Sequence
  Description of Artificial Sequence: Synthetic coding sequence
atgtgggaatggaagatctgtaacagccatggtgctagacctttcgctgaaccagccggttgggagtttgtcaatctcctccgccatcataagtcttttctaatcgctccactgtgtctgtccgtgcccgtgtcgcgccctgtgctgactcttcgcagccctggtgcccaagccgcagtcggcgacctgttagagttacactgtgaggctttaagaggaagcccgccaattttgtaccagttctatcacgaagacgtgaccctaggaaacagctctgcacctagcggcggaggcgcttccttcaacttgtctctcacagctgagcactccgggaattacagctgcgaagccaacaacgggcttggagctcaatgctctgaggcggtgccagtatccatcagtgggcctgatggataccgcagagacctgatgaccgcaggggtattgtgggggctgttcggagtgctgggttttacgggtgtggcactcctgctctatgccctatttcataagatcagtgggtgtatctaccatcttgacagcccttattttgccatgacctttcccttgctcatctag

SEQ ID NO: 50259 - DNA, 2124 bp, Artificial Sequence
  Description of Artificial Sequence: Synthetic coding sequence
atgctcctgtggctcttgcttctaatcctgacacccggtcgtgaacagtctggggtggctccgaaggctgtgttgttgctaaacccaccgtggtctaccgcttttaagggggaaaaagtggccctgatatgcagctccatctcgcattcgttggctcagggcgatacctactggtaccacgatgagaagttgctgaaaattaagcacgataagatccagatcaccgaacccggtaattaccagtgtaagaccaggggaagtagtttatctgacgcggtgcacgtggagtttagccccgactggctgattttacaggcactgcaccctgttttcgaaggcgacaatgtcatcctaaggtgccaggggaaagacaataaaaacactcatcaaaaagtctactacaaggatggaaagcagctccctaattcttacaatctggaaaaaataaccgtgaacagtgtgtccagggacaattctaaatatcattgcaccgcgtataggaaattttacatcttggatatagaggtgacttcaaagcccctgaatatccaggtccaggagctttttctgcatcccgtcctaagagcttcatcttccacccctattgagggttcaccaatgacactgacatgcgagacacaactttcaccccagcggcctgatgtccaattacaattcagcctgtttcgcgattcccagacattgggtctcggctggtctcgctcccccaggcttcaaatcccagcaatgtggaccgaagacagtggctcatattggtgtgaggtggagaccgttacacacagcatcaagaaaagatccctcaggtctcagattcgcgtgcagagagtgcctgtcagcaatgtgaatctagaaatccggccaactgggggacaactcatcgagggggaaaatatggtgttaatctgcagcgtcgcccaggggagcgggaccgtgaccttctcctggcataaagagggcagggtccgcagccttggcagaaagacccagaggagtctgctggccgagcttcatgtgctaaccgtgaaggagtctgatgccggtcgctattattgcgcggcagataacgtgcacagccccatactttcgacgtggataagggtaactgttcggattcccgtctcccaccctgtgctcacgttcagagcccctcgggctcacacagtcgttggagatctcctggagcttcactgcgagtccctcagggggagccctcccatcctgtataggttctaccacgaggatgttacattgggaaactcctcagcaccttctggcggaggcgcttcctttaatcttagtttgaccgcagagcactccggtaattacagttgcgatgccgataacgggctgggggctcaacactctcatggggtgagcttgcgtgtaactgtgccggttagcagaccagtactgacactccgcgctcctggggctcaggccgttgtgggggatctgttagaactgcactgtgaatctctccgtggttccttccccattctgtattggttttatcatgaggacgacactctggggaatatctccgctcacagtggcggtggcgctagcttcaatttgtctcttacaactgagcattccggcaattattcttgcgaggcagataacgggctgggcgcacagcattcgaaagttgtaactctgaatgtgacgggcacatctcggaatcggaccggcctgactgcagctggtatcacgggacttgtactctcaatcctggttctggccgcagctgccgctctgctgcattatgccagagctaggcgcaaacctggcggactgtcagccacagggacatcatctcattctcccagcgagtgccaggaaccatcaagctctcgaccaagccgcattgacccgcaggaaccgacacattccaaaccactggcacccatggaactggaaccaatgtactccaatgtgaatccaggcgacagcaaccccatttattctcagatttggtcaatccagcacactaaagagaactccgcgaattgccccatgatgcatcaggagcacgaggaactaaccgtactgtactcagagcttaaaaaggaacagagctctcgcttctcgatgtccttatag

SEQ ID NO: 50260 - DNA, 2205 bp, Artificial Sequence
  Description of Artificial Sequence: Synthetic coding sequence
atgctcctctggcttctcttgctgatattgacacccggtagggaacagtcaggcgtcgcccctaaggcagttcttctgttgaaccccccatggtcaaccgcattcaagggcgagaaagtcgctctgatttgtagcagcatcagccacagtctggctcaaggggatacctactggtaccatgacgagaagctcctcaaaataaagcatgacaaaattcagatcacagagccgggtaattatcaatgcaaaacgagggggagtagcctgtccgacgcagtgcatgtggagttcagccccgactggctgatcctgcaggcgctccaccctgttttcgagggagacaatgtgattctgagatgccagggaaaggataacaagaacacccatcagaaagtttactataaagatggaaaacagcttcctaatagttataatctggaaaagatcaccgttaattcagtgtctagagataatagtaagtatcattgtacagcctataggaagttttacatcctcgacatcgaggtaactagtaaaccactgaatatccaagtccaagaactatttctgcatccagtacttcgagcttcatcttccactccaatcgaggggtctccaatgactctcacatgtgagacacagttgtcaccgcagcggccagatgtgcagctccagttttccttattccgcgactctcagacactgggcctgggatggtccaggtctccacggctgcagattcctgctatgtggaccgaagactcgggcagctattggtgcgaggtcgaaacagtgacacactccattaaaaaacgttctctccgatcccagattagagttcaaagggtccccgtgagcaacgtgaaccttgagatacggcctaccggcggtcagctgatcgagggagaaaacatggtgctcatctgctctgtggctcagggtagtggaacagtgactttctcctggcataaagaagggcgtgtgcgcagtctgggcagaaagactcaaaggtccctgctcgccgaacttcacgtgttgacagttaaagaaagcgatgctggcagatactactgcgccgcagataatgtccacagccctatactgtctacatggatccgtgtgacggtcagaatccccgtgagtcacccagttctcacctttcgagcgcctcgcgcacatacagtggtgggggacttgctcgaactgcattgcgagagcctgagagggagccctcccatcctgtaccgtttttaccatgaagatgtaacactcggcaattcatcggccccaagcggtggaggggctagctttaacttgtctctgacagctgagcacagtggaaactattcttgcgacgccgataacggtctcggcgcacaacactcccacggagtctccctgcgagtaaccgtcccagtgtctaggcctgtcctaaccttaagggccccaggcgctcaggctgtggttggtgacctgctagagctgcactgcgagagcttgaggggaagctttcctatactgtattggttctatcacgaagacgacacactcggcaatatcagcgcgcactctgggggaggcgcatctttcaaccttagtcttacaaccgagcactcaggaaattattcttgtgaggcagataacgggctgggggcacaacatagtaaggtcgtgacgctgaacgttacaggaacatctagaaataggactggcttaacagcagcaggcatcaccgggttggtgctgagcattctcgtactggctgccgcagctgcactactacactacgcacgggctcgaagaaaaccaggcggacttagcgccactgggacctcctctcattctccatccgaatgtcaagaaccttcttccagtaggccctcccgtatcgatccacaggagcccactcactcaaagccattggcgcctatggaattagagcctatgtactctaacgtaaatcccggagatagcaatccaatctattcacagatttggtcgattcagcacactaaggaaaattcagctaactgtcctatgatgcatcaggagcatgaagaactcacggtcctttattccgagctgaagaagacccaccccgacgattccgccggagaagcatcttccagaggacgcgcacacgaggaggatgatgaagagaactatgagaacgtcccgagggtgttgctcgccagtgaccattag

SEQ ID NO: 50261 - DNA, 2229 bp, Artificial Sequence
  Description of Artificial Sequence: Synthetic coding sequence
atgctcttgtggttgttacttctaatcctcacaccgggtagggagcagagcggagttgcgccaaaggcggttctattgctgaacccaccatggtcaaccgcttttaagggcgaaaaggtggctcttatttgcagtagtatctctcattcactggcacagggcgatacttactggtaccacgatgagaagctgctgaaaatcaagcatgataaaatccagattacagaaccaggcaattatcagtgtaaaactcggggatcctcactgtcggacgcagtgcacgtggagttttcccctgattggctcatccttcaggcactacaccccgttttcgagggagacaatgttattctgcgatgccaagggaaggacaacaagaatactcatcagaaggtctactacaaagacggcaagcagctccccaactcttacaacctcgagaagattaccgtgaactccgttagtagagacaattcgaagtaccactgtaccgcttaccggaagttttatattctcgatattgaagtcactagtaaacccctgaacattcaggtgcaagagttgttccttcatcccgtcttgagggcatcatcaagcactcctattgaaggtagcccaatgactctgacttgcgaaactcagctaagtccgcagcgacctgacgtccagctgcagttctccctgtttcgggattcccagaccctgggcctcggatggtctcgatccccccgactgcagataccagccatgtggaccgaagattctggaagttattggtgtgaagtagagacagttacccattcaatcaagaagcgcagtctgcgaagccagatccgcgtccaaagggtccccgtgagcaatgtaaacctggaaattcggcctacgggcggacagctcatagaaggcgagaacatggttcttatctgctctgtggctcaaggctccggaaccgtcacgttttcttggcacaaggagggcagggtgagatctctcggtcggaaaactcagcggagcttgcttgccgaattgcatgtgcttacagtgaaggaatctgatgccggtagatactactgtgcggctgataatgtccatagcccaatactctctacttggattagggttacagttcgcatccccgtgtcccaccccgttctgacattccgagccccacgggctcacactgtggtcggtgacctgttggagttgcattgtgaatcactgaggggtagtcctccaatcctgtaccggttctaccacgaagatgttacactggggaactcatccgctccttcaggcggaggtgcaagcttcaacttgtcattgaccgcggagcacagtgggaattattcctgtgacgctgacaatgggttgggtgcacagcattcccacggagtgagcttacgggtgactgtgccagtttcccggccagttctgacactcagggccccaggcgctcaggctgtggtgggggatcttctcgagttgcattgtgagtcactgcgcggttcttttccgatcctgtattggttctatcatgaagatgacaccctagggaacatcagcgctcattcgggcggtggggcaagctttaaccttagtctcaccacagaacactccggtaattacagctgtgaggctgataatgggctaggggcacagcacagcaaagtcgtgaccctgaatgtgactggcacgtcacggaatcggaccggactgaccgccgctggcatcactgggctcgtgctctctatcctagtcctcgccgctgctgccgcactcttgcattacgcgagagcacgcaggaagcccggtgggctgagtgccaccggaaccagctcccactctccatctgagtgtcaggagcccagctcaagcaggccctctcgcatcgacccccaggagcccacacattccaaacccttagccccaatggaacttgagcccatgtattcgaacgtaaatccaggcgactccaaccctatatactctcagatttggtcaattcagcacaccaaggagaacagtgccaactgccccatgatgcatcaggaacatgaggagttaacggtcctgtatagcgaactgaaaaaaactcatcccgacgacagcgctggcgaggcttcaagcagaggacgggctcacgaggaggatgatgaagagaactacgagaacatcctgaaccctaggaagaacaaggtccaagatttcccatgtctctgtaatacctag

SEQ ID NO: 50262 - DNA, 2205 bp, Artificial Sequence
  Description of Artificial Sequence: Synthetic coding sequence
atgttgctctggctgttgttactgatcctgacacccggaagagagcagtcaggtgtggctccgaaagctgtgctactgctgaatcctccttggtccacagctttcaagggggagaaggtggcccttatatgctcttccattagccacagtctcgcacaaggggacacctattggtaccatgatgagaaactgctcaagattaagcacgacaaaatccagatcacagaacccggtaactaccaatgtaaaaccagagggagctctctctcggacgccgtgcacgtggagttttcacctgattggttaatactgcaggctcttcaccctgtttttgaaggggataacgtcatcttgaggtgccaggggaaggacaataaaaacactcaccagaaggtttattataaggatggtaagcagctgcctaactcatataatttagaaaaaattacagtgaactccgtaagccgggacaattccaagtatcattgcaccgcataccgaaagttctacattctggacatcgaggtgacctcaaaacccttgaatatccaggttcaggagttatttctccacccggtcctcagggcatcatcatccaccccaatagagggctccccgatgacactgacatgcgagacccaactgtctccacagcgtcccgacgttcagctgcagttctccttattcagggatagccagactctgggcctggggtggagccggagtcccaggttgcagatccccgcaatgtggaccgaggactcaggatcatactggtgcgaggttgaaactgtgacccactcaattaagaagcgctccttgcgcagccagataagagttcagcgagtcccagtgagtaacgtaaaccttgagatacgaccaaccggtgggcagctaatcgaaggggagaacatggtactcatttgctctgtggcccagggatccgggaccgtgacattttcgtggcataaagagggcagagtgaggagcctcgggcgtaagacacagagatctcttctggctgagctgcacgtcctcacagttaaggaatcagacgcagggagatactattgcgcggcagacaatgtccattcacctatcctctcaacctggattagagtgacagttagaatcccagtgagccatcctgtgctgacctttcgagcacctcgagcgcacacagttgtgggcgacctgctcgagttgcattgcgagagccttaggggttctccacccatcttataccgattttatcatgaggacgttactctcgggaactcttccgccccttcggggggaggtgcctccttcaatttgtcactgacggctgaacattccggcaattattcttgcgatgctgacaacggtctcggcgctcaacattcgcacggagtcagtcttcgggtcactgtccctgtatcaagacctgtgcttacgcttcgagccccaggagcccaggcagttgtcggtgatctgctcgaacttcactgcgagagcttgcgtggctctttcccaatcctgtactggttctaccacgaggacgacacactgggaaatatttcggcccatagcgggggtggagccagctttaacctttcactgacgactgagcactccgggaattattcctgtgaagctgataatggactgggggcacagcactccaaggtcgtgactctcaacgtcaccggaacctcccgaaacaggacaggactcacagctgccggtatcacaggccttgtgctcagtattctggtgctcgccgcagccgctgccctgctgcactatgctcgcgctcggcgaaagccaggaggcctgtcagccactgggacaagttctcatagcccgtccgaatgtcaggagccaagctcaagccggccaagccggatcgacccccaagagccaactcactctaagccactagctcccatggaactcgaaccaatgtacagcaacgtgaatccgggagactcaaaccccatctactctcaaatttggagcatacagcatactaaggagaactccgctaactgtccgatgatgcaccaggaacacgaagaattgacagtcttgtacagcgagctcaaaaaaacacacccagacgactcagcaggcgaggcttcaagccgcggaagggcccatgaagaagatgatgaggagaattacgagaacgtccctcgtgttctgttagcaagcgaccattag

SEQ ID NO: 50263 - DNA, 1548 bp, Artificial Sequence
  Description of Artificial Sequence: Synthetic coding sequence
atgctgttgtgggccagcttgcttgctttcgcacccgtctgtggtcaatctgccgctgctcataaacccgttattagcgttcacccaccctggactacattctttaagggtgagcgcgtgactctaacctgcaatggctttcagttttatgccacggagaaaacaacctggtatcaccggcattattggggtgaaaaactgaccctcaccccagggaacacactcgaggtccgtgaatcgggtctctaccggtgtcaggccaggggttcgcctaggtcaaatcctgtgcggctgttgttcagctctgactcactgattctgcaggctccctatagcgtgttcgaaggggacacactggtcctccgctgtcaccggaggagaaaagaaaagttaaccgctgtcaaatatacgtggaatggaaatatcttgtccattagcaataagagctgggacctgcttattccgcaggcctcatcaaataacaatggaaactacagatgcattggttatggggatgagaatgatgtttttaggtccaactttaagattattaagatccaagaattgtttcctcatcccgaactaaaggccactgactcacagcccacggaggggaatagcgtaaatctcagctgcgagacgcagctgccgccagagcgtagcgacactcccctgcactttaacttttttcgggacggggaagtcatattatcggactggagcacttatccggagttgcagcttccaaccgtgtggagagagaacagcggctcttactggtgtggagctgaaactgtaagaggcaacatacataaacactcccccagccttcagattcatgtccaacggattccagtcagtggagtccttcttgaaactcagccgagcgggggtcaggcagtggaaggagaaatgctcgtcctcgtgtgctcagtggccgaaggcactggcgacacgacattttcgtggcaccgcgaggacatgcaggaaagcctgggccgtaaaactcagaggtcactgagagctgagctggagctacccgctattcgccagtctcatgccggaggatactactgtaccgctgacaattcttatggaccagttcagagtatggtgcttaacgtaacagtgagggagaccccaggcaatcgggacggcttggtggctgcaggagctacaggaggtctactatcagctctgctcctggctgttgccctgctgtttcattgctggaggaggcgcaaatccggggtaggattcctgggggacgagacgcgtctgccacccgctccaggacccggtgagagttcgcactctatctgcccagcccaggttgagttgcagagtctgtacgtcgatgtccatccaaaaaaaggagatctcgtgtattcggagatccagacaactcaactcggagaggaggaagaggctaatacgtcaagaactctgctcgaagataaggacgtgagcgtagtgtattccgaagtaaagacccagcatcctgacaactccgccggaaaaatatcctcgaaagacgaggagtcctag

SEQ ID NO: 50264 - DNA, 2934 bp, Artificial Sequence
  Description of Artificial Sequence: Synthetic coding sequence
atgctactgtgggtaatactgcttgtcctggtgccgagccctgggcagttccctcgaactccgaggcctataatttttctccaacctccctggactaccgtcttccagggcgaacgggtgactctgacttgcaagggctttaggttctatagccctcaaaagaccaagtggtatcaccggtacttaggaaaagagatcctccgcgagacaccggataacatcttagaagtacaggaaagcggggagtatagatgtcaggcacaagggtcgccactcagcagtcccgtccatctggacttttcttccgcttccctgattctgcaggccccactatcagtgttcgagggcgactcagttgtgctcagatgtcgcgcaaaggctgaggtgaccttgaacaacacaatttataagaatgacaacgtgctggctttccttaacaaaagaactgacttccacatccctcatgcttgcttgaaggacaacggtgcctaccgttgcaccgggtacaaggaaagctgctgtcctgtttcatctaatactgtgaagatccaggtgcaggagccttttaccagacccgtactaagagcaagttcctttcagcctatttctgggaatcccgtgactctgacttgcgagacccagttaagcctggaacgaagtgatgtgcccctccgattcagattcttcagagatgaccagaccctggggctggggtggagcctgagccctaacttccagatcacggccatgtggtccaaagattctggcttctattggtgcaaggccgctactatgccctatagcgtgatcagtgattcacccaggagctggattcaggtccaaatacccgcaagccaccctgtgcttactctgtctcccgagaaggctctcaactttgagggtactaaggtgaccctccactgcgagactcaggaggatagtttacggaccttgtaccggttttatcacgaaggagtcccattacggcataaatcagtgagatgcgagaggggcgctagcataagcttctccctgaccaccgaaaattccggcaactactactgtaccgctgacaacggcctcggggctaagccctctaaagctgtatctctgtccgtgacggtgcccgtgtcccaccccgtgttgaaccttagcagtcccgaggatctgatcttcgagggggcaaaagtgaccttacactgtgaggcacagaggggctccttgcccatcctctaccagttccatcacgagggagctgctctggagagacgcagcgccaactcggccggtggcgttgccattagcttctcactgaccgccgagcacagcggtaactattattgcacggccgacaacggcttcggcccacaaaggagtaaagccgtgtcactttctgttacagtccctgtgagtcatcccgtgttgaccttgtcctcagctgaggctctcacattcgagggtgctactgtgacactgcactgcgaggttcaaagaggtagcccccagatcctgtaccagttctaccacgaggatatgccactgtggagcagtagtactccatccgttgggagagtcagtttttccttcagtttaactgagggacatagcggtaattactattgcacagcggacaatggatttggaccacagcggagcgaagttgtgagcctattcgtgactgtcccggtctcccgtcccatccttactctgcgggtccccagggctcaggccgtagtcggggatctgctcgagctgcattgcgaggcccctcggggatcaccgccaattttatactggttctatcacgaggacgtgaccctcggttctagttccgcaccatctggcggtgaggcctctttcaatctttctctgacagccgagcattcagggaattacagctgtgaagccaacaatggtctggtagcacagcattccgacactatctcactgagtgttattgtccctgtgtctcgcccaatcctcaccttccgcgcaccacgggctcaggccgtggttggcgaccttcttgaactgcactgcgaggcactcaggggctcctcccccatcctctactggttctaccacgaggacgtcactcttgggaagataagtgccccttccggtggaggggcatcctttaacctgtccctgaccaccgaacacagtggcatatattcgtgcgaagcggataatggcctcgaagcacagagatctgagatggtgactcttaaggtggcagtccccgtctcccgcccagttttaacgctgagggccccaggcacacatgcggcagtgggagacttactggagctgcattgtgaagccctgagggggagtcctttgattctctaccgattcttccatgaagatgtcacccttgggaaccggtcctcacctagcggcggtgcctcactgaatctgtccttgacagccgaacactcgggcaattacagctgtgaagcagataacgggctgggcgctcagcgatccgagaccgttactctatacataacagggctgaccgctaatagaagtggacctttcgctaccggcgttgccggtggacttttgtctatagctgggctggcggctggggctctcttgctctattgttggttgtctcgaaaggccggtcggaagccggctagcgatcctgcccgatcacccagcgactctgactcacaggagccgacatatcacaatgtcccagcatgggaagaacttcagccggtttacaccaacgccaatcctcggggagagaacgtcgtatactccgaggtacggattatccaggaaaagaagaaacacgccgtggcctccgatcctagacacctgcggaacaaggggagccccattatatattccgaagttaaagtagccagcacccccgtgagcggatctctgtttttggcgtccagcgcacctcacaggtag

SEQ ID NO: 50265 - DNA, 2934 bp, Artificial Sequence
  Description of Artificial Sequence: Synthetic coding sequence
atgcttctgtgggtcatcctgctcgtactcgcccctgtgtccgggcagttcgcacggactccccgtcctataatcttcttacaacctccgtggacaacggttttccagggggagagagttactctaacctgcaagggcttccgcttttattcgccccagaaaaccaaatggtaccacaggtacctcggaaaagaaattctccgcgaaacacccgacaacatcctggaagtgcaagagtctggggaatatcgatgccaggcccagggctcacccctgagcagtcccgtgcatttggacttcagctctgccagcctgattcttcaagcacctctatccgtgtttgagggcgacagcgtcgtactgcgatgcagagccaaagctgaggtgaccctgaacaacacgatctataaaaacgataacgtgttggcattccttaataagcgaactgatttccatattccgcacgcttgtctgaaggataacggtgcctaccgctgtaccggctacaaagagtcatgttgccctgtgtcaagtaatacggtgaagatacaggtgcaggagcccttcacgagaccggtgttgcgggcaagctcctttcagcccatctcaggcaatcccgttacccttacctgcgaaacgcaactgagcttggagcgcagcgacgtgcctctgcgctttcgcttcttcagggacgatcagacactcggccttggctggagtctgtctcccaatttccaaatcactgctatgtggtcaaaggattctggattctattggtgcaaggccgcaaccatgccctattcagtgatctctgacagcccgcgtagctggatacaggttcaaatccccgcatcacacccagtccttaccctgtctccagagaaggctctgaattttgagggaactaaggtcactcttcactgtgaaacacaagaggactccctgaggaccctgtaccgcttctatcatgaaggcgtaccactgcgccataagagtgttcggtgcgagagaggtgcgagcatcagcttcagcctgactaccgagaattccggaaattactactgcacggctgataatgggctgggagccaagccatccaaagctgtttctttgagtgtcacagtgcccgttagccaccctgtgctgaacctctcatcccctgaggacttaatcttcgagggcgctaaagtcacgctccattgcgaagcgcagaggggtagtctccctatcctgtaccaattccaccacgaaggggctgctctggaaaggcgctccgctaattccgcaggtggcgtggcaatctcttttagcttgactgctgaacacagtggaaattattattgtactgctgacaatggatttggtcctcagcgttctaaagcggtctccctgagcgtcactgtgccagtatcgcatcccgtgctcactctttcaagtgccgaagccctgactttcgaaggcgcaacagtgacgctccactgcgaagtgcaaagaggctcgcctcagatcctataccagttctaccatgaggacatgcccttatggtcatcttccacaccctctgtcgggagggtctcattttctttttccctgacagagggccactctggcaattattactgcactgcagacaacgggtttggaccccagaggagtgaagtcgtaagtctctttgtaacagtaccagtaagccgacccatactgacgctccgggtcccacgcgctcaggccgtggtgggcgacttgttggaactgcattgcgaggcaccacgtggttcccctcccattctatattggttttatcacgaggatgtgactctgggctcttcttccgccccttcaggtggggaagcatccttcaatcttagcttgactgccgaacattcagggaactacagctgcgaggccaacaacggcctggtggcccagcatagcgacaccatcagtctgtccgtgatagtaccagtcagccggcctattctgactttccgcgcacccagagctcaggccgtggttggtgacctgttagaactccactgtgaggctttgcgcggatcaagccccatcttgtattggttctatcatgaggacgtaaccttgggcaagatctccgcgccatccggcggaggcgctagcttcaatctttctctcaccactgagcattccggaatttacagttgtgaagcagataatggccttgaagcacagagatcagaaatggtaaccctcaaagtcgcggtgccagtatctagacccgttttaacccttagggcccctggcacgcatgccgctgtgggggatcttctggaactccactgcgaggcactgcgcggatcccctctaatactatatagattctttcatgaagatgtcactctcgggaatcgctcaagtccatccggcggtgcgagccttaacttgtctcttaccgccgagcactccggcaactattcgtgcgaggccgacaatggcctgggggctcagcggagcgagactgtgaccttgtatatcacgggtcttactgcgaaccgcagtgggcctttcgccacaggggtcgccggaggcctgcttagcatcgcaggactggcggctggagccctgctgctgtattgttggctgagtaggaaggctggacgcaaacctgcctctgacccggcaagatctccctctgacagtgattcacaagaaccgacctatcacaacgtcccggcttgggaggagctgcagccagtgtacacaaacgctaatccccgtggcgaaaacgtggtgtattctgaagtgcggatcatacaggagaaaaaaaaacacgctgtggcctctgaccctcgccatctcagaaacaagggttcacccatcatctattctgaagtaaaggttgcttctacacccgtgagcggcagcctgtttctggcatcttctgccccacacagatag

SEQ ID NO: 50266 - DNA, 375 bp, Artificial Sequence
  Description of Artificial Sequence: Synthetic coding sequence
atgcttctgtgggtgatcctcctggtactcgcacccgtgagcggtcagttcgcacggacacctagacccataattttccttcagcccccttggactacagtgtttcaaggggaaagagttacattaacctgcaaaggtttccgattctatagccctcaaaaaactaagtggtaccacagatacctcggcaaagaaatcctcagggaaactccagataacatccttgaggtgcaggaaagcggcgagtacagatgtcaagcccaggggtcgccgcttagctctcccgtgcacttggatttctccagtgagatggggttccctcacgccgctcaagccaacgtggagctgttgggctcatcagatctcctcacttag

SEQ ID NO: 50267 - DNA, 1779 bp, Artificial Sequence
  Description of Artificial Sequence: Synthetic coding sequence
atgctgttgtgggtcatcttactcgtgcttgccccagtctccggccagttcgcaagaacccccaggcccatcatttttctccagcccccatggacaacagtgtttcagggtgagcgagtgaccctcacatgcaagggttttcggttttacagccctcagaagacaaaatggtaccacagatatctgggaaaggaaattcttcgcgagactccagataacatcctggaagtgcaggaaagcggagaatatagatgccaggcccagggcagcccactgtcatcccctgtgcatctggatttctccagcgcaagccttattctgcaagcgcctcttagtgttttcgaaggcgatagtgtcgtgctccgatgccgcgcaaaagcagaggttactctgaacaataccatctataagaacgacaacgtcctggcatttctgaataagcggacagattttcacattccccacgcttgtctaaaagataatggagcctaccgttgcacgggctataaagagtcttgctgccctgtatccagcaataccgtgaagatccaagtccaggagccgttcacaaggcccgtgctaagggctagttcctttcagcccatctctggaaaccctgtgacattgacatgtgagactcaactctccctagaaagatccgacgtgccgctgcgtttccgcttctttcgagacgaccaaactcttggtctgggatggagcctcagtcctaatttccagattaccgcaatgtggtcaaaggacagcggtttctattggtgcaaggcggcaaccatgccttactctgtaatttcagactctcccaggtcttggatccaggttcagattcctgctagccatcctgtgcttaccttgtcccctgaaaaggctctgaattttgagggaacgaaggttactctgcactgtgagacgcaggaggacagtcttcggactctgtatcgcttctatcacgaaggtgtcccgctcaggcacaagagcgtcagatgcgaacgaggcgcatctataagcttctctctgacaaccgagaacagcgggaattactactgtacggcagataacggcttgggagccaaaccttcgaaggccgtcagcctttccgtcaccgtccccgtcagccacccagttcttaacttgagtagtccagaggatctgatttttgagggggcaaaggtgaccctgcattgcgaggcacagcgaggctcactccctattctgtaccaattccaccacgaaggggctgctctggagcgcagatccgccaactccgctggtggggtggctatctcgttcagcctcactgctgagcattccggaaattattactgtacagctgacaacggcttcgggccacaacggtcgaaagcggtctctctctctgtaaccgtgcctgtgtctcatccagtgctaactctgtcaagcgctgaggctcttacctttgaaggagccactgtcacattacactgcgaggtccaaagggggagcccccagatcctttaccagttctatcatgaggacatgccgttatggagcagcagcacaccctccgtggggcgagtttcattttctttctctctaactgaaggacacagtggcaattactactgcaccgcagataatggattcggtcctcagcggagcgaggttgttagcttgtttgtaacaggcaagtgttgggtcctagcttcacaccccccactcgccgaattcagcctgactcactctttcaaaaatttattcgctctctcatctttcctcccgtag

SEQ ID NO: 50268 - DNA, 2280 bp, Artificial Sequence
  Description of Artificial Sequence: Synthetic coding sequence
atgttgttgtgggtcatcctactcgtgctggccccagtttctgggcagtttgctaggaccccaaggcccattatatttctccagccgccttggaccaccgtgttccagggtgagagagtaaccctcacatgtaaaggtttcaggttttacagtccacagaagacaaagtggtatcaccgctacctagggaaggagattctgcgagaaacccccgacaacatccttgaggtgcaggagtccggagaatacagatgccaagcccagggatcacccctgtctagccctgtacacctagacttttcttccgcttcactgattttgcaggcgccactcagtgtgttcgagggggacagtgtggttctgaggtgcagggccaaagcggaggtgacccttaacaatactatatacaagaatgataacgtccttgctttcttaaacaaacggaccgatttccacattcctcacgcatgcctgaaggataacggggcatatcgctgcaccgggtataaggaatcgtgctgtccagtttcttccaataccgttaaaatccaagtacaggaacccttcactagacctgtgctccgcgctagctcattccagcctatcagcggcaacccagtcacgctcacttgcgaaactcagttgagcctggagagaagtgacgtgcctctgcgctttcgcttctttagagatgaccaaactttaggactcggatggagcctcagccccaactttcagatcacagcaatgtggagcaaagacagtggattttactggtgcaaggctgcaacgatgccctatagtgtgatctccgatagccccaggtcttggattcaagtgcaaattcctgcttctcaccccgtcctgactctttcaccagaaaaggctctgaatttcgaaggcaccaaggttactttacattgcgagactcaggaggactccctgcgcaccctctaccggttttatcacgagggcgtgcccttgcggcacaagagcgtgagatgcgaaaggggggcatctatatctttctcgctcactaccgagaacagtgggaattactactgtaccgctgacaatggactgggagccaaaccctctaaggccgtctccctttccgtgaccgtgccagtgtctcaccccgtccttaatctaagcagtccagaagatttgatattcgagggagctaaggtcacactccactgtgaggctcagcggggttccttaccgattctgtatcaattccaccatgagggagcagccctggaacgcaggagcgccaactccgcgggaggagtagcaatttctttcagtttgacagctgagcacagtggcaattactattgcaccgctgacaacggtttcggccctcagcggtcaaaggccgtctcactttccgtaaccgtgcccgtttctcaccccgtactgactctgagttccgcagaagcactgacatttgagggtgcgactgttaccctgcattgcgaagtacagcgtggttcaccccaaattctgtaccaattttaccacgaggacatgccattatggagttcctccaccccaagtgtgggccgagtctcttttagcttctcgctgaccgaaggacattctggtaattactattgcacagcagacaacggttttgggccacagcgttcagaggtcgtcagcctatttgttacggtgcctgtctctaggccaatcttgaccctgcgcgtgcctcgagctcaggctgtggtgggggatttgctggagctgcactgtgaagctccacgcggaagtcctcccattttgtattggttctatcacgaggacgtgacactcggctcatcttctgctcctagtggcggtgaggcctcctttaatttgagcctgaccgccgagcacagtgggaattatagttgcgaagcaaacaatgggctggtagcccagcactccgatacaataagcttgagcgtgatagttcctgtgtccaggccaattcttacatttcgcgcaccacgggcacaggctgtcgtgggggacttgctagaactgcattgtgaggccctgaggggaagttcccccatactctactggttctatcacgaagacgtgaccctggggaaaatcagcgccccatctggaggcggtgcatcttttaacctatctctgaccacagagcacagtggaatttactcatgcgaagcagacaatggcctggaggcccagaggtccgaaatggtcactctaaaggtggcaggcgaatgggcccttccgacaagttcaacctcagagaactag

SEQ ID NO: 50269 - DNA, 2025 bp, Artificial Sequence
  Description of Artificial Sequence: Synthetic coding sequence
atgctgctttgggtgatcctactggtgttagctcccgtgtcaggccagttcgcatctcttattttgcaggctcccctgtctgtctttgagggagactccgtggttctgaggtgccgggctaaggccgaagtgacacttaacaatacaatctataagaacgacaacgtgcttgccttcttgaacaagcgtactgactttcacattccacacgcatgtctgaaagacaacggcgcttaccgttgcaccggctataaggaaagttgttgtccagtcagctccaacacagtcaagattcaggtacaggagccctttacaagaccggttctgcgagctagttctttccaacctatttccggaaaccctgtgactcttacttgtgaaacccagctcagtctcgagcgcagcgatgtccctctgcgcttcagattcttccgtgacgatcaaacactggggctgggatggagcctgtcgcctaacttccagataacagccatgtggtcaaaagactctggattttattggtgtaaagctgcaaccatgccttacagtgttatctcagacagtcctcggtcttggatccaagtgcaaatcccagcatcccaccccgtcctcactctgtcaccggagaaggccctaaatttcgaaggaacaaaggtcacccttcactgtgagacacaagaagacagcttgcggacactctatcggttctaccacgagggcgtcccacttagacacaaatcagtcagatgcgagaggggcgcttccatctctttcagcctgacaacggagaactccggcaactactactgtaccgccgacaacggactcggggcaaagcccagtaaggcagtgagcctcagtgtgactgtccccgtgtcccaccccgtacttaacctgtctagcccagaagaccttatcttcgagggggcaaaggtgacactgcactgtgaggctcagcggggttccctgcccattctgtaccagttccatcacgagggggctgctctggagagacgttccgctaatagcgccggtggagtggccattagtttctctctcaccgcagaacacagcggcaactactattgtaccgctgacaatggctttggtccccaacgctcaaaggctgtgagtctaagcgtcacagttccagtgagccaccctgttctgaccctctccagcgctgaggcactgacatttgaaggcgctacagtcaccctgcactgtgaggtgcagaggggctctccccaaattttataccaattttatcatgaagatatgccactgtggagcagttccacgcccagtgttggcagggttagcttcagcttctccctcaccgaggggcacagcggcaattactattgcaccgctgataacggatttggcccacagcgcagcgaggtcgtgagtctgttcgtcaccgtgcctgttagtcgccctattctgactttacgcgtgccccgagcgcaggcagttgtgggcgatttattagaactgcattgtgaagcgccacgtggctctcccccaatcttgtactggttttatcatgaggatgtcacgctgggtagcagcagtgctccttccggcggagaggcgtccttcaatctgtcactgaccgctgaacatagcgggaactattcttgtgaggctaataacggtcttgttgcacagcactctgataccatttcgctgagcgtcatcgtgcctgtgtcccgacccatccttactttcagagcacccagggctcaagcggtggtaggggatttgttggaactgcactgcgaggctctgcggggatcttcacccatcctgtattggttctatcatgaagacgtcactcttggcaagatttccgcaccgagtggaggtggagcgtcttttaacctcagccttaccaccgagcattccggaatatactcatgtgaggcggataacggcttggaagcacagcggagtgagatggtcactctgaaggtggcgggtgagtgggccctgccgactagttcaacctcagagaattag

SEQ ID NO: 50270 - DNA, 1194 bp, Artificial Sequence
  Description of Artificial Sequence: Synthetic coding sequence
atgctgttgtggaccgccgttttgctctttgtgccctgcgtcggaaaaactgtttggctgtacctgcaagcctggcccaatcccgtgtttgaaggtgacgccctgactttgcggtgtcagggatggaagaatacgcctctgtctcaggtgaagttttatagagatggcaaatttcttcacttcagcaaggagaatcagactctatcaatgggcgcagcaaccgtccagtcgcgtggccaatacagctgctctggtcaggtgatgtacatcccgcagacctttacacagaccagcgagacagccatggtacaggtgcaggagttgttcccacctccagttctgtctgcaatcccttcaccggaacctagggaaggctcactcgtgactttaagatgccagacaaagctgcatcctctgcggtcagcactgcggctgcttttttcctttcacaaggacggacacaccctgcaggatcggggaccccacccggagctttgtattcctggcgctaaagaaggggactccggcctttactggtgcgaggtggcacctgaagggggacaagtgcagaagcaatccccccagctcgaggtcagggtgcaagcccctgtgagcagacctgtactgaccttacatcacggacctgctgaccccgcagtgggagatatggtgcagttgctgtgcgaggcacagcgcggttcgccgccaatcctctatagcttctacctggatgaaaagatcgtcggtaaccactcggctccatgtggaggcacaacctcactgctttttcctgtgaaatcagaacaggatgccggtaattactcatgcgaagcagagaactctgtgtcaagagaacgaagcgagccgaaaaaactgtctctaaagggaagtcaggtgcttttcactcctgcatcaaattggctggtgccgtggttgcccgcaagtcttctggggttgatggtcatcgccgctgcccttctggtgtatgtgaggtcatggcggaaagccggaccgctgccctctcagatacccccaactgccccaggcggagagcaatgcccattatatgctaacgtccaccaccagaagggaaaggacgagggagtggtgtacagcgtcgttcataggacctccaagcgcagcgagggacagttctaccacctttgtgggggtgagatgcctgccgcacagtag

SEQ ID NO: 50271 - DNA, 1305 bp, Artificial Sequence
  Description of Artificial Sequence: Synthetic coding sequence
atgcttctttggaccgcggtgctgctgtttgtgccttgtgtgggtaagaccgtctggctgtatctgcaggcttggcccaatccagtttttgaaggagacgccttaactcttcgctgccaaggctggaaaaatacacccctatcacaagtgaagttttaccgcgatggtaagttcctgcacttcagcaaagagaaccagactctctcaatgggcgctgccactgtccagtctcgcggtcagtactcgtgcagtggccaagtgatgtatataccccagacgttcacccaaacctctgagaccgctatggtccaggttcaggagctgttcccgccacctgtgctttctgctattccttcacccgaacctagggaggggtccctggtgacgcttagatgtcaaaccaaactccatccgctgcggtctgctctgagattactcttttcgtttcacaaagatgggcacaccctccaggacagaggcccacaccccgagctgtgtatcccaggcgctaaggaaggggattctggcttgtattggtgtgaggtggccccagagggcggacaggttcagaagcagagccctcagctggaagtgagggtccaggcacctgtgtctcggcctgtcctgaccctccaccacggcccagctgatcccgctgtcggcgacatggtccagctcctgtgtgaggcgcagagaggatcaccgcctatcctctatagcttctacctcgacgagaaaattgttggaaatcatagcgcaccgtgcgggggtactacaagcctgctatttccagtgaaatccgagcaggatgctggaaactactcatgtgaggccgaaaattctgtttcccgcgagcgctccgaacccaagaagttgagcctcaagggaagccaggttttgttcactccagcttctaattggctggtgccctggctacctgcctcacttctgggcctgatggtgatcgcagcggcactactggtttacgtgcgcagttggcgcaaggcgggacccctgcccagccaaattcccccaaccgccccaggcggagagcagtgccctctgtatgctaacgtacaccaccagaagggcaaagatgaaggtgtggtctatagtgtcgtgcaccgcacttccaagcgatctgaggccaggtccgctgaattcacagttggaaggaaagattccagcatcatttgtgccgaggtccggtgtctgcagcctagcgaagttagttctacagaagtaaacatgcggtcccggacactgcaagagccgttaagcgactgtgaagaggtgctgtgctag

SEQ ID NO: 50272 - DNA, 936 bp, Artificial Sequence
  Description of Artificial Sequence: Synthetic coding sequence
atgctcctctggacagctgtattgcttttcgtgccctgcgtcgggaagacagtgtggctgtatctgcaagcctggcctaacccggtctttgaaggcgacgcattgacactgcgttgccaagggtggaaaaatacccccctcagccaggtgaaattctaccgggacggcaaattccttcactttagcaaagagaaccaaacactatccatgggcgctgccacagtgcaaagcaggggccaatacagttgcagtggtcaggtgatgtatatccctcagacattcacacagacatctgagactgcgatggttcaggtgcaggccccagtttctagaccagtactgaccttacatcatggtcccgcagacccagccgtgggcgatatggttcaactgctttgtgaggcacagaggggatcgcctccaatcctgtacagtttttacctggatgagaagatcgtcgggaaccattcagccccatgcgggggtaccacctcattgctgttcccagtaaaatcggagcaagacgctggaaattacagctgcgaggcggagaatagtgtgtctcgtgaaagatcagaacccaaaaagctgtcactgaaaggaagccaggtcctttttacacctgcctccaactggttagtcccatggctccctgcctccctgcttggcctgatggtgattgcggctgccctcctggtctacgttagaagttggaggaaggcaggacctttgccctcccaaattcctcctactgctcctgggggagaacaatgtcctctttacgctaacgtacaccaccagaagggcaaggatgaaggtgtggtgtactcagtggtccataggacaagtaagcggtccgaggcacggtccgctgagttcacagtcggcaggaaattctatcacctgtgcggcggtgaaatgcccgctgctcagtag

SEQ ID NO: 50273 - DNA, 1581 bp, Artificial Sequence
  Description of Artificial Sequence: Synthetic coding sequence
atggtcaacgaagggcctaaccaagaagagagtgacgacactccggtgccagagtcagccctgcaggccgacccctctgtaagtgtccatcctagcgtgagtgtgcacccatctgtttctatcaacccaagcgtgtccgttcacccttcaagttctgcacacccatcagcattagctcagccgtctggactggcccatccgtccagctcgggcccagaagacttgtccgtcatcaaggtgagtaggcggaggtgggcagtggtgctggttttcagctgttattcgatgtgcaattcgttccaatggatccagtatggcagcatcaacaatatcttcatgcacttctatggcgtgtccgcatttgccattgattggctttccatgtgttatatgcttacttacatcccccttttgttgcctgttgcatggttgctggagaaatttggtttgcggaccattgctctcacaggaagcgctctgaactgtcttggtgcttgggttaagctgggttccctgaagccccatcttttcccagtcaccgtggttgggcagttgatttgctcagtggcacaggtcttcatcttaggaatgccttctaggatcgcctcggtgtggtttggcgcaaacgaggtctctaccgcttgttccgttgcagtgtttggcaatcagctcggaatcgcaatcggatttctggttccacccgtactggtccccaatattgaggaccgagacgaactcgcttaccatatttcaatcatgttctacattattggcggagtggccacacttctcctgattttggtcataatcgtgttcaaagagaaacccaaatatccccctagccgggctcaatcactgtcctacgctcttaccagccccgacgcgtcatacttagggtcaatagccaggctgttcaaaaatttaaactttgtgttgttagtcattacctacggcctcaatgccggagcattttacgcgctttccacactgctcaaccgcatggttatttggcactaccctggggaagaagtcaatgccggacggatcggattgaccatcgtgatcgctggaatgttgggagccgtcatctcaggaatctggctggatagatcgaagacctacaaggagaccacactggttgtgtacatcatgactttggttgggatggtcgtgtacacctttactcttaatctcgggcacctgtgggttgtgttcatcactgctggcacaatggggtttttcatgacaggttatctccccctgggattcgaattcgcagttgagctgacatatcccgagagcgaaggcatctcgtcgggcctgctgaatatatccgcccaggtgttcgggattatctttactatctcacaaggacaaatcattgataactacgggacgaaaccagggaacatatttctctgcgtttttcttactctcggggcagccctaacagccttcatcaaagccgatctgagaagacagaaggcaaacaaagaaactttggagaataagctgcaagaggaggaagaggagagcaatacctccaaagtgccaacagcggtaagcgaggaccacctctag

SEQ ID NO: 50274 - DNA, 966 bp, Artificial Sequence
  Description of Artificial Sequence: Synthetic coding sequence
atgtcagctgacaactcgtcaacgatttgcgtgtgtagatccgtgcgccaggaactgggcattgccataggctttctggtgccacccgtcctggtaccaaatatcgaagatcgggacgagctggcttatcatatttctatcatgttttatattataggaggagtggctaccctgctgctcattctggtaattatcgtgttcaaagaaaaaccgaaatatcccccaagtagggctcaaagcctgtcgtacgccctgacttctcccgatgccagctatctcggctcaatcgccaggttgttcaagaatctgaacttcgtactgctggtgattacctatggcctgaacgccggtgccttctacgccctgtctacactcctgaaccggatggtcatatggcattatccgggtgaggaggtgaatgcgggacgtatcgggctgactatcgttattgcgggtatgctaggtgccgtgatttccggaatttggctggacaggtcgaaaacctacaaagagaccacccttgtggtctacattatgacgcttgtcggaatggtcgtttataccttcacactgaacctcggacacttgtgggtggtgttcatcactgccggtactatgggctttttcatgacagggtatttgccacttggcttcgaattcgccgtggaattaacctatcccgaatccgaagggatcagctcaggtctgctgaacatttcggcgcaggttttcgggattatattcacgatttcacaaggccagattatcgataattatgggaccaaacctggcaatatcttcctgtgtgtgtttctcaccttgggcgctgcactgacagctttcataaaggctgacctgaggcgacagaaagcgaataaagaaactttagagaacaagctccaggaggaggaggaagaatccaacacgagtaaagtcccaacagccgtttcagaggaccatctctag

SEQ ID NO: 50275 - DNA, 5573 bp, Artificial Sequence
  Description of Artificial Sequence: Synthetic coding sequence
atgttcggcctcaaggttaaaaagaaaaggaataaggctgagaaagggcttattttggcaaacaaagcggcaaaagatagccagggagacactgaggccctgcaagaagagccctcacatcaagaagggcctaggggggacctggtgcacgacgacgcaagcatatttccggtcccctccgcctcgcccaaaagaagatctaaacttctgacaaagatacatgacggtgaagtgcggtcacaaaactaccagatagccatcactatcaccgaagctagacaactggtaggggaaaatatcgatccggtcgtgacaatcgagattggagacgagaagaaacagagcaccgtgaaggagggcacaaacagcccgttctacaatgagtacttcgtcttcgactttatcggccctcaggtacacctgtttgacaagatcattaaaatcagcgtgttccaccacaagctgatcggctcggtgctgatcggctcatttaaagtggacctaggaacggtgtataaccagccagggcatcaattctgcaataaatgggcgttgcttacggaccctggggacattagaacgggcactaagggctacctcaagtgcgacatatctgtgatgggtaaaggggacgttctgaagaccagccccaaaacaagcgatactgaggagcccattgagaaaaatctgcttatccccaatgggtttccactggaaaggccctgggcgaggttttatgtgcggctttataaagcggagggcctcccaaaaatgaactcaagcatcatggccaacgtgacgaaagccttcgtgggcgacagtaaagacttagtagaccccttcgtcgaagtgtcttttgcaggacagatgggacgcaccaccgtgcagaagaactgtgctgaccccgtttggcacgaacaggtgatttttaaggaaatgttcccacccttatgccggagggttaaaattcaggtgtgggatgagggatctatgaatgacgtggcactggcaacccacttcatcgatctcaagaaaatctcgaatgagcaggacggcgataagggattcctcccaacctttggccctgcttggattaacttatacggcagtccgaggaatcatagtctgatggatgattaccaggagatgaatgagggattcggtgagggcgtgagctttagagggagaatcctcgtcgagatagcagtggagatactgagcggtcgtgcgcaggagagcaaattttcaaaagctttaaaggaactcaaactgccaagcaaggacaaggattctaagtcttctaaggggaaggacaaagcggataagaccgaggacggtaaatcccaacaggcatctaacaagactaactccacagaggttgaggtcgaatcctttgacgtaccacccgagattgtgccggaaaaaaacgaagaattcctactctttggcgctttcttcgaagccactatgatagatcgcaaaattggtgataaacctatctcattcgaggtctcgataggtaattttgggaacctcattgatgggggatctcatcatgggagtaagaaaagtgccgagagtgccgaggaggacctgctccccctcctgcacgagggccaaggggacgtagctcacgatgttcctataccaatggcgagtactacacaccccgagaaacccctggtgactgaaggtaatagaaactacaactacctcccattcgaagccaagaagccatgtgtctattttatcagttcttggggagaccagacattcaggctccactggtcaaatatgctagagaagatggctgatttcctcgaggagtccatcgaagaagtgagggagctgatcaagattagtcaggaagccccagaagaaaaaatgaagactgtgttgtccgacttcatatcccgatcgagtgcattcatttcagaagcggaaaaaaagccaaaaatgcttaatcaaaccaccctcgataagaaaagactgaccctctgttggcaggaactggaagccatgtgcaaagaagcgaagggcatcattcagcaacagaagaaaaaactcagtgtggacgagatgatacacgaagcccagaactttgtggagaaaataagattcctggtggatgagcctcaacacacgatacccgacgtcttcatttggatgctgtccaataaccggagagtggcttatgcccgaatcgcctccaaggatttgctgtatagtccggtggccggtcagatgggcaaacactgcggtaagattaagacacacttcttaaagccgcctgggaagcgacctgccggatggtccgtccaggcaaaagtggatgtgtatctgtggttgggttccatcaaacatgccagcgctatactcgacaacctgcctgtgggatatgaggctgaaatgtccagcaaaggggcagggacaaatcatccccctagcaatctcctgtaccaagaacagcatgtctttcagctcagggcgcacatgtaccaggctaggggtctgattgcggctgatagtaatggccttagcgaccctttcgccaaggttacattcctgtcacactgccagacaacaaagattatctctcagactttgtccccaacctggaaccagatgttactgttcaacgacctggtgttacacggcgacgtgaaggagttggctgaaagcccaccgttagttgttgtagagctgtacgacagcgacgcagttgggaaaccggaatacctgggtgctacggtggctgccccagtcgttaaactggcagatcaagactatgaaccacccagactgtgctatcatcccatattctgcgggaacctttcagggggtgacttgctggccgtctttgagctccttcaggtgccccctagtgggcttcagggtctgcctccagtggaacccccagacatcacacaaatttatccagtccctgcaaacatccgtcccgtcctttcaaagtatcgcgttgaggtcctgttttggggggtcagggagatgaagaaggtgcaactgttatcagtagacagacctcaagccctgatcgaatgtggtggccagggggtcaaatcatgtgtgatccagtcatacaaaaataatccaaacttctccatacaagctgacgccttcgaggtcgaactgccagagaacgagctgttgcaccccccactgagcatctgtgtggttgactggagagcctttggccgatccaccctggttggaacatacacaataaattatctcaaacagtttctctgtaaactacgggagcccctggctcccattacccaagttgatggcacacagccagggcatgatataagcgatagtctcacagcaaccgaaagctccggcgctcatagcagttctcaggatccccctgccgaccatatttatgttgatgtcgagcccccaccgaccgtagtgccagactccgcccaggctcagcctgccatcctagtggacgtacctgatagctcgccgatgctggagccagagcatactccagtggcccaggagccacctaaggacggaaagccaaaagatccccgaaagcctagccggaggtccacaaagcgacgtaaaagaactattgctgatgaaagtgccgaaaacgtcattgactggtggagtaagtactacgcttcgcttaagaaagcacagaaggcgaaagaacgtaatcctaagggcaaaaaaggtaacacagaggccaagcccgatgaagtggtggtagacatagaagatggaccaaagaagaaaaaggataagatgttgaaaaagaaaccaaaagatgacggcattccaaatctcgcaatcctccagatttatgatggcgacctggagagcgagttcaacaatttcgaggattgggtaaagacattcgagctgtttaggggcaaatccaccgaagacgaccatggactggatggggatcgtgtcatcggcaaatttaaggggagcttctgtatctacaaatctccacaggattcctccagcgaggatagcgggcaactgagaatccagcaaggtatccctcccaatcaccccgtgacggttctgattagggtttatatcgtcgcagcttttaacctgtccccagctgatcccgacgggaaaagcgacccctacatagtaataaaactgggaaaaaccgaaataaaagacagggacaagtacatacctaaacagctgaaccctgtgttcgggaggtccttcgaaatccaggccaccttcccgaaggaatcactgctctctattctgatttatgatcatgacatgattggaaccgatgatttaatcggagagacgaaaatcgatctcgaaaaccgcttctatagcaagcatcgtgcaatctgtggcctccagagtcagtatgagatcgaagggtacaacgcctggagagatactagcaaacccaccgagatactgactaagctgtgtaaagacaataagcttgatggcccttatttccacccaggcaaaatacaaattggtaaccaagtcttcagtggcaagaccatcttcactgaagaagacaccgacgagacagtcgagagctacgagcatcttgccctgaaggtccttcacagctgggaagacattcccgaggtgggctgtagactggttcccgaacacatcgaaacccggcctctgtatcataaggacaagcccggaatggaacaagggaggctgcagatgtgggtggacatgttcccaaaagacatgcctcagcctggacctcctgttgacattagccctcggaggcctaaggggtacgagcttcgagtgacaatatggaacacagaggatgtgattctggaagacgagaacattttcacaggtcagaaatcatccgacatttacgtgaaggggtggctgaaaggcctcgaggacgacaaacaagaaaccgacgtccactacaacagccttactggcgaagggaactttaattggaggttcctgttcccatttcaatacctccctgcagagaaacagatggtaatcaccaagagagagaatatttttagcctggaaaaaatggagtgcaagacaccggctgtgcttgtccttcaagtgtgggatttcgagcgcctatcatcagacgacttcctggggactcttgagatgaacctgaattcgttcccaagagccgctaaaagcgccaaagcttgcgaccttgcaaagtttgagaatgcctctgaggaaacaaagatctctatcttccaacaaaagagggtcaggggctggtggcccttttccaaatcaaaggagttgaccggtaaggttgaagccgagttccacttggtgacagctgaggaggccgagaaaaacccggttggtaaggccagaaaagagcccgaacccctggccaagcccaatcgcccagatacatccttttcatggtttatgtcgccattcaagtgcctttactacctaatctggaaaaattacaaaaaatacatcatcattgcttttatcctaatcattttgatcatcttcttggtgctgtttatctatactctacctggggcaatctcccggagaatagtcgtgggctctta

SEQ ID NO: 50276 - DNA, 5573 bp, Artificial Sequence
  Description of Artificial Sequence: Synthetic coding sequence
atgtttggcctgaaggtcaaaaaaaaaagaaataaggctgaaaagggactaatccttgccaacaaggccgcaaaggactctcaaggcgatacagaggctttacaggaagagccatcacatcaggagggaccgcgaggcgatctcgtgcatgacgacgcttccattttccccgtgccctctgccagcccaaaacgtaggagcaaactgctaacgaaaatccacgacggcgaggtgaggtctcaaaactaccagatcgctatcaccatcacggaagcacgacagctcgtcggggagaatattgaccccgtggttacaattgagatcggcgacgaaaagaagcaaagcacagttaaggaaggcacaaactccccattctataatgagtactttgtgtttgatttcatagggccacaggtgcacctgtttgataaaatcattaagatttccgtattccatcacaagttgatcggaagcgttctgatcggtagtttcaaggttgatctcgggacagtctataaccagccgggacatcagttctgcaacaaatgggcgctgctgacagaccccggagatatccgcacggggacaaaggggtatctgaagtgcgacatatcagtgatgggcaaaggggacgtgctgaagacatcaccgaagacgagcgatactgaggagcccattgaaaaaaatctcttgattcccaatggttttcctctcgaacggccttgggcgcgattttacgttaggctgtataaagccgaaggtttaccaaagatgaacagctccatcatggcgaacgtcacgaaagcctttgtaggagactcaaaggatctggttgacccttttgttgaggtgtcctttgctggtcagatgggccgaactaccgtgcaaaagaattgtgcagatccagtgtggcacgagcaggttatttttaaggaaatgttccctcccctctgccgacgggttaaaattcaggtttgggatgaaggttctatgaatgatgtggccctcgcgacccacttcattgacctgaagaagattagtaatgagcaggatggtgacaagggctttctccctactttcggccctgcatggatcaatctgtatggatctccaagaaaccattcacttatggatgactatcaggagatgaacgaaggattcggcgagggcgtgtcgttcagaggcagaattcttgtcgaaattgcagttgaaatactgagcggcagggcacaggagagcaagttctccaaggctctcaaggaattaaagcttccctctaaggataaggattccaagagctccaaaggcaaagacaaggcggataagaccgaagatggtaagagccagcaggcttcaaacaagaccaattcaacagaagtcgaagtggagtcttttgatgtgccacccgagattgtgcctgaaaagaatgaggagttcctgctgtttggggcatttttcgaagcaaccatgatcgacaggaagatcggcgacaaacccatttccttcgaagtgtcaatcggtaacttcggcaatctgattgatggtgggtcacaccatggctccaaaaaatccgctgagtccgccgaggaggatttactgcccctgctacatgaaggacagggcgacgttgcccacgacgtacccattccaatggcatctacaacacaccccgaaaaaccgctggtaaccgagggcaaccggaactacaactatctccccttcgaagctaagaagccctgtgtgtactttatttcctcgtggggcgaccaaaccttccggctgcattggagtaacatgctcgaaaaaatggcagatttcctggaggagagtatcgaagaggttagagagctaatcaagataagccaggaagctcccgaggagaaaatgaagacggttttgtccgactttatatctagatcgtctgccttcatttctgaggcagagaagaaacccaaaatgcttaaccagacaaccttagacaagaagcggctgaccttatgctggcaggaacttgaagccatgtgcaaggaagctaagggaattatccaacagcagaagaagaagctctctgtcgatgaaatgattcacgaagcccaaaacttcgtggagaaaattaggtttctggttgatgaaccgcagcacaccattccggacgttttcatatggatgctatctaataaccggcgagtagcctacgccagaatcgcatctaaagatttactgtacagtcccgtcgcaggccagatgggaaaacactgcggaaaaatcaagacccacttcttgaagcctccaggcaaacggcctgcaggatggagcgtccaggccaaagtagatgtgtatctctggcttggttctataaaacatgcaagcgctatcctggataatctgcctgttggatacgaggccgagatgagttcaaaaggcgctggaaccaaccaccccccatccaatcttctgtatcaggagcagcacgtcttccagctccgggcacacatgtaccaagcaagagggcttatcgctgcagattctaacggcctctcggatcccttcgccaaggtcactttcctgtcacattgccagacgaccaaaatcatttcacagaccctgagccccacttggaaccaaatgctcctgtttaacgatctagtgttacacggagacgtgaaagaattggccgaatccccaccattggtggtggtagaactttatgactccgatgcagtgggaaaacctgagtatctcggtgccacagtggctgcccctgtggtcaaattagctgatcaggactatgaaccgcctaggctctgttatcaccctatattctgcggcaatttgtccggtggtgacctattggccgttttcgagctgttacaagtacctccgtctggcctgcagggcctccctccagtggaaccgcctgacattactcagatatatccagtgcccgcaaatatccgacccgtgcttagcaagtaccgggtagaagtcctgttctggggagtgcgcgagatgaagaaggtccagttactgtcagttgatcggccacaggcgctgatcgaatgtgggggacagggcgtcaagtcttgtgttatccagtcttacaagaataacccgaatttctctatccaggctgatgccttcgaagtggagctgcccgaaaacgagctgctccatcctcccctgagtatttgcgtagttgactggcgtgcatttggcaggagcaccctagtgggcacatacacaatcaattacttgaaacaatttctgtgcaagcttcgggagcccctggccccaatcactcaggtggacggcacccaacccggacacgacattagtgacagtctaaccgccactgagtcgtcaggggctcatagttcttcccaagacccccctgccgaccacatctatgtggatgtagagccacccccaactgttgtgcctgactcggcacaggctcaaccagccattctggtcgacgtgcccgacagtagtcctatgttggaacccgaacatacacccgtggcacaggagccgccaaaggatgggaagccaaaggatccaagaaaaccttctagacggagtacgaagagacggaagcgcactattgccgatgagtccgccgaaaacgtgatagactggtggtccaagtattacgcctcactcaagaaggcccagaaggccaaagaaagaaacccgaagggaaagaagggtaatactgaagcaaaaccagatgaagtggtagtggatattgaggacggccctaaaaaaaaaaaggataaaatgctgaagaaaaagcctaaggatgacggcatcccgaacctcgccatcctccagatctacgacggtgatttagagagcgaatttaacaacttcgaggactgggtgaaaacttttgaacttttcagggggaagagcactgaagacgaccatgggttggatggggacagggtcatcggcaagttcaagggaagcttttgtatttataagtcccctcaagactcctctagcgaagattctgggcagctaagaatccagcagggtatacctcctaatcatccggtcactgttctgattagagtgtatatcgtggccgcttttaatctcagccctgctgacccagatggcaagagcgacccttacatcgtgataaaactgggtaaaacggagataaaagatagagataagtacatcccaaagcagctgaatcccgtgttcgggaggagctttgagatccaggctacatttcccaaggagtccttgctgtcaattctgatctatgaccacgatatgatcggcacagacgatttaatcggagaaacaaagattgatctggaaaatcgattttactcaaagcacagagctatatgcggactacagagccagtatgaaatagaggggtacaacgcttggcgcgacaccagtaagccaacagagatactgacaaagctatgcaaggacaacaagctcgatgggccttactttcaccccggaaaaatccagattggcaaccaagtcttttctgggaaaacaatcttcacagaggaggataccgatgaaactgtcgaaagctacgaacacctcgctctgaaggtccttcacagttgggaagatataccagaggtgggctgcagactcgttcccgagcatattgagactcggccattgtaccacaaggataagcctggcatggagcagggcagactccagatgtgggtggacatgttccccaaggatatgccgcagcccggacccccagttgatatttccccaaggaggccaaagggttacgagcttcgagtcacgatatggaacacagaggatgtcatcttagaggacgagaacattttcactggccaaaagagctccgatatctacgttaagggctggttgaaagggctcgaggatgataaacaggaaaccgacgtgcactataacagcttaaccggcgaggggaattttaactggaggtttctgtttccctttcagtatctgcctgctgaaaaacagatggttataactaagagggaaaatatatttagtctcgaaaaaatggaatgcaaaacccccgcagttctcgtgcttcaagtgtgggacttcgagagactgtcgtcagatgacttcctgggcactctggagatgaacctcaactcatttcctcgcgctgcaaagagcgcaaaagcttgcgatttggccaaatttgaaaatgcctccgaggaaacaaaaatttccatattccagcaaaaacgggtccggggatggtggcctttttccaagtcaaaggagcttaccggaaaggttgaggctgaattccacctggttaccgctgaagaggccgaaaaaaaccccgtcggtaaggctagaaaagaaccagaaccactggccaagcctaacagacctgatacgtccttctcatggtttatgagtccatttaaatgcttatattacctgatctggaagaattacaagaaatacattatcatcgcctttatcctgattatcttgattatattcctggtcctcttcatctacactctaccaggcgcaatctcccgacgtattgtggtgggctctta

SEQ ID NO: 50277 - DNA, 189 bp, Artificial Sequence
  Description of Artificial Sequence: Synthetic coding sequence
atggaggaactggaaacaagcctgttccagacccgcaaagcccaccgtattgaacagatggtcgcacgatggctacggcgttcacgggactcttcagctcgtgccaaggtagcagcagctgatggtccagcaaggaatcctacccaaaccttgatacctgtgcggcatactgtcaagatcgacaagtag

SEQ ID NO: 50278 - DNA, 4737 bp, Artificial Sequence
  Description of Artificial Sequence: Synthetic coding sequence
atggaagagctggagacctccctgtttcaaactcgaaaagctcatcgcatcgagcagatggtggccagatggctccgcaggagtagagacagttctgccagagcgaaggtggctgctgccgatggccctgccaggaatcctacccagactctcatacctgtacgccacaccgtgaaaattgacaaggacactttgttacaggactacggttttcacatttctgagtccctccccctgacggtggtcgccgtgaccgccggaggctctgcccacggaaagctgttcccaggcgaccagattctgcaaatgaataacgagcctgctgaagacctgagttgggaacgtgctgtggatattttgcgcgaagctgaggactcattatcaataactgttgttcgctgcacatctggagtcccaaaatcctcatttctgaccgaggagaagcgagctaggcttaaaaccaatccagtgaaggtgcactttgcggaagaggttttaatcagtggccactcgcagggtaattctctactctgcatgccaaacgtgctgaagttatatctggaaaacggccaaacgaaagcgtttaaatttgaagccaataccactgttaaggacattattctgaccgtgaaggagaaactgtccatcagatccatcgagtattttgcccttgctctcgaggagcaatactctatatccaggcttcatttactgcatgaagaggaattgatccagcaggtggtggaaagggaggagagtcacgactaccgatgcctatttcgcgtctgttttgtgcccaaggacccactggatctccttaaagaggaccccgtggcattcgaatatttgtacctgcagtcatgtagcgacgttctccaagaaaggttcgccgtggagatgaagtgctctagtgcacttcgccttgccgcacttcacattcaggagcggatttatgcgtgcgcccagccccagaaaatctctttaaaatacattgagaaagactggggcatagagaacttcatctcccccaccctgttacggaatatgaagggtaaggacattaaaaaggccattagctttcatatgaaaaggaaccagaatcttctggagcctcgccagaaacagctgatctccgcagctcagctgcgacttaactatctacagattctgggggagctaaagacttacggagggagaatcttcaacgcgacactcatgctccaggatagggaatcctacatcgcgcttttggtaggagctaagtatggaatctctcaagttatcaatagcaagttaaatatcatgagcaccttggccgagtttgcaaatatcagccgagtcgagcttacggaggaatctgaaaaagtttcggtggtcaaggtttatctccaggacgtcaaggttctgaccctgctgctagagagtaactcagctaaggatttggcctgcctaatcgctggctactacaggttgctggttgatcccgtaaccagtatattcttgtggccgggaaataagcaacaggcccatagagtgtcagctgaagaggggtacgaaagccgtgcgtgttctgactctgaggagtccagcgaggtcgactgcgtgctcgaaccactgtcagatcgtcggctggttaaactggcaccttgccgttccttgatcaaggaggagcagcccccaggaaactccccaactcccgaggtcgccagaagagggccttcaacctgtggggctagctccacaacagattctgctgagagtgaggcttccgactccgcgaacaccgagtccaggggatatcggacttcgggatccagcgaatccatggacgccctggaggaggatgacttggacacatgcagtagcagcaggagcacgttctttcattttggttctccaggcctggctgaatctattgattcagactcacaggaagaacgaagtgggatagaaacatccggatttctgtgcttactggaccttgctcaacgggcaaatccccagtgccagaaaacggaattttccgagtccgccgctctggagacattcggctgggctcctgagctgtcaacagtgcggctggaccccaggctctatgagggttcgcacgcagattattattccttgtgcagctctgtgtctccagccagctacctgagtgacagttccgagtccacagcctcacgtcagggcggtgctcctcccgcatggggccaacagggatggaccgaggcccagccgtccagcatgctggaacctctggctctccatccacctctggcctttgaagacggaagttcagacgaagaatactacgacgcggcagacaagctcacgcctccgggtcctccttccgggccaagagatgtgagcaccgccgaaccctccgctacctcactgcagaacaaagcctcaacgagttctcctgagaattctttgccgtgtggaccggatggtaggcaacccagcaggcggggaggggttaagaagtacgctaaaacgctgagaaaacgcagatcattcctccagactgactatacatcacaggttagcttcccactggtgcccagcgcttccttagaaagcgttgacgatgtttgttactatgaccgagagccttacctggcactgggggcaccttcccctaccgtgtcatccctgcaggatatgcagggagagcccggactcttagaaaccaaagctctggggctgctcgcacccctccgagagaccaagtctacaaatccagcttcccgggtcatggaaatggagccagaaacaatggagaccaaaagcgtgattgactctcgcgtcagttcaatctctgcgatccggttccggatcgatccaaacaataaggaaaacagtggggttgtgcccgctgcatcttcctcagccagcaccccccactgtagtaaccccggtagttctggaccagacacagcacaagccaggccatcccagatactgccacttagccaggacttagatgggatcgcccctaaagagccgaccatagaacacggtgacagttctttctctctatcgtcaggtgaccctaaccctgaccgagcatgtctggcctcaaaccctgggctgaacaatgtttctcaaggcgatactctcgagctccagctcgaaccacatgtgcagctagaaatgggactcgagagtttctgtacaaatcatatccaagagacggccccaaagtacaccgagccactgcttagtccgagagacgagccaagatcagacgagtgcggaatcaaccccggagaaaaaatcgcaagtataccaactaaagaggagcctcagggtcagctcagtctcgagcgcgatagggaagtgacaaataaaaatgggacgaatgtgtttcaggaagagtctcgcaaggattccggggacagccccggtgatgtcagcaataacgtctctcaaaccctggatataagctcacccgcaggcaagatagttacctctctgagtttggatgcacccgtgaccggtaccgagcagatccctccccacccacctcgggaccctcagggtcaatcccgcgagcctcctggccagggctgtcaggcccaagagcagaaactattcgtggagctggacctcgatccagactttttcctcgggaaacaaaccgtaagccccgctgtgccccctgaaggtattaaggccgaagctccaaaccacgtcacagggcaagatattgctccacgcgatagtcctgagtgggtgtgctttaaccctgaaccttccttacccgagccactgccctgtccccaggaggatcctcatcttgagaccagcaatcactgcctgttgtccgagggcaagtcagacagcagctctatttgcctgagtgcagaaaaatctttcctatgcttcgcgccagagagtcacccggaagtgagtgctagtctgagagtggccacgtccctgggcttcgccggaatgaatgaaatggtcgcccctcgaatagggatggaccagtgcagttgccagttcagctatgcaacatgttttagaggaccgcagcccgagaccgaagaggaagatagagacctcgaggcacatccaatggcccctctcactagccctccctcagctgggagtccagtggtcctgccttggcggcctgcgagagcccacagctgcaccacggctccattgtcaaggaaatcccacatctggccggagtactgttcccgagcgctcagacagctgaaggccacccccgcttccacacccgagggatttatccagctcatggagtctctactcgagttgcaagacatattggagaccagctggggagtaggaaataagcatccacctgaaaaatgtacttggcatttcaccgagagtcgttcacggttgtgcatgggatctcagaaattgctgtctagctgccgacacgtcatacggatggaccagtcccctgaagagatgcagggcgctgtccgggatactttccaacacttggtgcagcttgccggtctgtgctttcaattcactgactgtagccgatgttcagccaggcacagggaggcagccggaaatctgcgcgacgtggtgtatacttaccatcaatttatcgaagccgctaaaagtacctgtgagcggggatatcacgatctctcggtgaagctgctggcgagacagtgtaccgccctgaccgcagcagttttctgtctgacccaaaagttccgggcttcgacggcactctag

SEQ ID NO: 50279 - DNA, 1905 bp, Artificial Sequence
  Description of Artificial Sequence: Synthetic coding sequence
atgccgaacgtcctcaagctataccttgaaaacggccagacaaaggcgtttaaattcgaagctaatactacagttaaagacatcatattgacagttaaggaaaaactatctatccgctccatcgagtatttcgccctggcgctggaggagcaatattccatttctaggctccatttgcttcatgaagaggaacttatacaacaggtcgtcgaaagagaagagtcacacgattatcgctgcctcttccgtgtgtgtttcgtgcccaaagacccgctcgatctcttgaaagaagacccggtggcctttgagtacctgtatctgcagtcatgttctgatgtactccaggagagattcgccgtagagatgaaatgttccagtgccttgcgactggctgctcttcacatccaggagcggatttatgcttgtgctcaacctcagaaaatttcccttaagtatattgagaaggactggggcatcgagaactttatttcacccacacttctgagaaatatgaaaggcaaggacatcaagaaagcaatatctttccacatgaaaagaaaccaaaacttactggaacccaggcagaagcagttaatttccgcggcacaactgcgcttgaactatctgcagatccttggagagctgaagacttatgggggacgaatctttaatgccactctgatgttgcaggacagagagagttatatcgccctgctggtgggcgcaaaatatggtatcagccaggtgataaattcgaagctgaacatcatgagcactctggcagagttcgccaatatttctcgagtcgagctgactgaggaaagcgagaaggtaagcgtagtgaaggtgtacctgcaggatgtgaaggtgctgactctgctgctggagtctaattccgctaaagatctggcctgtctgatcgccggatactatcgtctgctcgtggaccccgtcacctcgattttcctgtggccaggcaataaacaacaggcccatcgtgttagtgccgaagaggggtacgagagcagggcttgtagcgacagtgaggaatccagcgaggtggactgcgtcctggagcccctcagtgaccgacgactcgtgaaactcgcgccttgcaggtccctcatcaaggaggagcaaccacccggtaatagcccaactcctgaggtggccagaaggggaccttccacctgcggagcgtcatctacaactgatagcgccgaaagcgaggcctccgatagcgccaacactgagtccaggggctaccgaacctccgggtcaagtgagtcaatggatgcattagaagaagacgatttggatacttgctccagctcaagaagcaccttcttccattttggttcaccagggctggcagagtcaatagacagcgacagtcaagaagaaagaagcgggattgaaactagcgggttcctatgcctgctggatctggctcagagggcaaatccccagtgccagaagaccgagttcagtgaatccgccgcacttgaaacatttggatgggctccggagcttagtactgtcaggctcgaccccagactgtacgagggcagccacgctgactactattccctttgctctagcgtatcccctgccagctatctgagtgacagctccgaatccaccgccagcaggcaaggcggagcgcctcccgcatggggccaacaaggctggacagaggcccaaccttcttcgatgctggagcctctggcgctgcatccacccctggcatttgaagatgggagttccgacgaagaatattacgatgccgctgacaaactcacccctccgggaccccctagcggcgagccttccctggctggactgcagacgcggcaggccgcacctgagtgtctgcctggaattaaggcatggggacaggcatag

SEQ ID NO: 50280 - DNA, 4737 bp, Artificial Sequence
  Description of Artificial Sequence: Synthetic coding sequence
atggaagaattggaaacatcgctgttccaaacccggaaagcccatcgaatcgagcagatggtggctcgctggctgcgcaggagcagggatagtagtgcaagagcaaaggttgctgccgctgacggccctgccagaaaccctacacagaccctgattcctgtgagacacacggtcaagatagataaggacacactactccaggactacggctttcacatcagtgaatcactgcccttaaccgtggtcgccgtgacagccggaggcagtgcccacggaaaactgttcccaggggatcaaatcctccaaatgaataatgaaccggctgaagatctgtcctgggaacgggctgtagacatccttcgcgaagccgaagattcattgtctatcaccgtagttcggtgcacctccggagttcctaaaagttcctttcttaccgaggagaagagggccaggctaaaaacaaatcccgtgaaggtccatttcgcagaggaggtgttaatctccggccactcacagggcaactccctcttgtgcatgccaaatgtgctgaagctgtatcttgaaaatggccaaaccaaagcgttcaagtttgaagctaatacaacggtgaaggatataattcttaccgtcaaagaaaagctttctattcgctcgattgagtactttgccttggcactggaggagcagtatagcatctccagactgcatttgctgcatgaggaagaactgattcaacaggtggtggaacgcgaagagtcccatgactaccgctgtctattcagggtgtgtttcgttcctaaggacccactcgatttgctcaaggaggatcctgtcgcattcgaatacctgtaccttcagtcctgctcagacgttctgcaggagcgcttcgcagtggagatgaagtgctccagtgccttgcgcctcgccgctctgcatatccaagagcgcatttatgcatgtgcccagccccagaagatttctttgaaatatatcgaaaaagactgggggatagagaacttcattagcccaactttgctaagaaatatgaaaggcaaggacataaaaaaggccattagtttccatatgaagcggaatcaaaatcttcttgagcctcggcagaagcaactgatctcagccgctcaattaagactgaattacctgcagattctgggagagctgaagacttacggtgggaggattttcaacgctaccctgatgctccaggatcgagaatcctatatcgccctgttagtgggcgcaaaatacggtattagtcaagtgataaatagcaagctcaacataatgagtaccttggcagagttcgccaacatcagtagagtagagctgactgaggagtctgaaaaggtctccgttgtgaaggtatatttacaggacgtgaaggtcctgactcttttgcttgagagcaattcggccaaagacctggcgtgcctaatcgccggatattaccgcctcctagttgaccccgtgacgagtatcttcctgtggccaggtaacaagcagcaggcccatagagtgtccgctgaggagggctacgagagtcgcgcatgttccgactccgaggaatctagcgaggtcgattgtgtgctggagcccctgtctgatcggaggctggtgaagttagccccatgtaggagtttaataaaagaggagcaacctcccggaaactcgccgacaccggaagtggccaggcgaggacctagcacctgtggcgcaagctccactacggattctgcggagtcagaggcttctgattccgctaacactgaatcccggggttaccgtacaagcgggagttctgagtctatggacgctctggaagaggatgacctggacacatgctcttctagcagatccacattctttcattttggttcgccagggctcgcggagagtattgacagtgactcgcaggaggaacggagtggtattgagacatcaggtttcctctgtctgctcgatctagcgcaaagagcaaatccacagtgccaaaagacggagttttcggaaagcgcagccctggagacattcgggtgggctcccgagctctccacggtgcggttagatccacgcttgtacgaaggctcccacgcagattattactccctgtgctcctccgtgagccccgctagctatcttagtgattcttctgaatcaactgcctcgcgacaaggaggtgctccgcctgcctgggggcagcagggatggaccgaggcacagccctcatccatgttagagccactggcactccatccacccctcgcttttgaggacggatcaagtgatgaggaatactatgacgctgctgacaagctaacaccgcctgggcctccgtccggcccacgcgatgtatctacagcggaaccgtcggctacctcgttgcaaaacaaggccagtacgtcatccccggagaattccctgccttgcgggccagatggcaggcagccatctcgcagaggcggagtgaaaaaatatgccaaaaccctccgaaaaaggcggtcgttccttcaaaccgattacacctcgcaggtatcattcccactggtgccctccgcaagcttggagagcgttgacgatgtgtgctactatgacagagaaccttatctggcactcggcgcaccttcacccactgtaagttcactgcaagatatgcaaggggaaccaggactgctggaaaccaaagctttggggctgctagcccctttacgagagacaaagagcacaaaccccgcttctagagtcatggagatggaaccagagactatggagaccaaatctgtgattgacagtagagtttcatcaatctccgcgatacggttccggatcgatccaaataataaagaaaacagcggagtggtgccggcagcatcttcaagcgcttcaacgcctcattgctcgaatcccggttcgtctggccctgacacggcccaggctaggccgtcccaaattctgcccctgtcacaggacctcgacggcatcgcccctaaagagcccactattgaacacggtgatagtagcttctctctgagcagtggcgatccaaaccctgatcgagcttgcttggccagcaatccaggtctgaacaatgtctcacaaggtgatacgctagaattgcaactggagccccatgtacagctagaaatgggcctggaatctttctgcaccaatcatattcaagagacagctccaaaatataccgagcctctcctcagccctcgcgacgagccacgcagcgatgagtgtggcataaatccaggtgaaaaaattgcctcaatccccaccaaggaagaaccccaagggcaactatctctggagcgcgacagagaggtgacgaataagaatgggacaaacgtgtttcaggaggaaagcagaaaagattcaggcgactcgcctggagatgtttccaacaatgtgtcacagacactggacattagtagtcccgctgggaagattgtcacgagtcttagtctagatgcccctgtaactggaactgagcagatcccaccacacccccctcgagatccacaggggcagtccagggagccccctggccagggctgtcaggcccaggaacagaaactcttcgttgagttggacctggacccagacttttttcttggaaagcagactgtcagcccagcagtgccacccgaaggcattaaggctgaagctccaaaccatgtcaccgggcaggatatagctcctagagatagccctgagtgggtctgttttaaccccgagcctagtctgcctgaacccctgccatgccctcaggaggacccacacctcgaaaccagcaaccactgcctgttatctgagggcaaatcagattccagctcaatatgcctgtccgctgagaaaagctttttatgcttcgcacccgaatcccaccctgaagtctccgcaagccttcgggtagccacatccctgggatttgctggcatgaatgagatggtggcccctcggatcggaatggaccagtgctcctgtcagttttcttacgctacatgctttagaggccctcagcctgagaccgaggaggaagaccgagacctggaagcccacccaatggccccactcactagccctccctcggccggaagtcccgtagtcctcccttggagacccgcaagagcacactcgtgcactaccgctcctctgtcgcggaaatcacacatatggcccgaatactgttcaagggctctccgccagctgaaggccactcccgcatcgacacccgagggcttcatacagctaatggagagtctgctagagctgcaggatattttagagacctcgtggggggtgggcaataaacatccccctgagaagtgcacttggcacttcacagaatctcgatcaagactgtgtatgggctcccagaaactgctctcctcatgcaggcacgtcattcgtatggaccaaagtcccgaggagatgcagggagccgtccgggatacctttcaacatcttgtccagctggccggtctgtgcttccaattcacagattgcagtagatgttcagctagacaccgcgaggccgcaggaaacctgagagacgtcgtgtacacatatcatcagtttatagaggcagccaaatccacgtgtgagcggggttatcacgacctgagtgtcaagctgctagctcgacagtgcactgcactgactgcagcagtattctgcctgacacagaaattcagggcgtcaacggccctttag

SEQ ID NO: 50281 - DNA, 2046 bp, Artificial Sequence
  Description of Artificial Sequence: Synthetic coding sequence
atggccgaagttggcggagtcccaaaatcctcattcctcacagaagagaagcgagctcgcctaaaaactaacccggtgaaggtgcatttcgcggaggaggtcctgatatctggccactcccaagggaactctttgctttgcatgccgaatgtgctcaaactttacctcgagaacggccaaactaaggcctttaagtttgaggccaatactacggtcaaagatataatccttacagtaaaagagaaactctcgatccgttctatagagtattttgcgttagccttggaggaacagtactctatttcccggttacacctgttacacgaggaagagctgatccagcaagtggtcgagagggaggagtctcacgactatcgctgtctgttccgcgtgtgcttcgtaccaaaggacccactggacctcttgaaggaagaccctgttgcattcgaatacttatacctacagtcctgctcagatgtgctgcaggagcgttttgcagtggagatgaagtgttcctcagccctgcggctggctgccctgcacatacaggagagaatatacgcctgcgcccaacctcagaaaatctctctcaagtacattgagaaagactgggggattgaaaatttcattagtcccaccctactgcggaatatgaagggcaaagatatcaaaaaagccatttcattccacatgaagagaaaccaaaatttactcgaacctcgacagaagcagttgatctctgccgcacaactgcgactgaactatctacaaattctgggggaactgaagacttatggagggagaatcttcaatgccacactgatgctacaggatcgagagtcttacatcgccctgctcgtcggggcaaagtacgggatctcccaggttattaactctaagctgaacatcatgtcaaccctcgccgagtttgccaatatttccagggtggagctaacggaggaaagtgaaaaagtttccgttgtcaaagtgtacctgcaagacgtgaaagtgctgactctactgctcgagtcgaattccgcgaaagacctcgcctgtctgatagccggttattacaggctcctggtcgaccctgtgacgagcatatttctgtggcctggaaataaacagcaggctcatagggtcagcgctgaggagggctacgaaagtcgcgcatgcagcgactcagaggaaagctcggaggtggactgcgtgcttgaaccgttgtctgaccgtcgactggtcaaactggccccttgcagatctctgattaaagaagaacagccccctggtaactctcccaccccggaagtggccaggagaggtccatccacatgcggggcttcaagtacgaccgattccgccgagtctgaagcaagcgatagtgccaacacggagagtcgaggttaccggacgtcaggctcgtcagaaagcatggatgccctggaagaagatgatctggatacttgttcctcatcaaggagcactttttttcatttcggttcccccggactggccgagtctatcgactcagacagccaagaagagaggagcggtattgagaccagcggattcctgtgcctgctcgacctcgctcagagagccaatcctcagtgccaaaagactgaatttagtgagtcggcagctctggaaacatttggctgggctccggaactgtctaccgtgcggctcgacccaaggctgtacgagggcagccatgctgactactattcgctttgctcttctgtctcaccagcaagctacctaagcgacagctccgagagtaccgcatctagacagggaggagcacctcctgcttggggccagcaaggctggacagaggctcagcccagctcaatgctggagccgcttgccctgcaccccccactggcatttgaggatggctcttcggatgaagaatattacgacgctgctgacaaactgacgccgccagggcctccttcaggagaaccatcactcgcagggctccaaaccaggcaagcagcacctgagtgtttaccagggattaaggcttggggtcaggcctag

SEQ ID NO: 50282 - DNA, 1713 bp, Artificial Sequence
  Description of Artificial Sequence: Synthetic coding sequence
atgttgtctcgactgatgagtggatcgtcccgctccctagagcgggagtatagctgcacagtgcgtctgctggacgatagtgagtacacctgtaccatccaacgggacgcaaagggccagtatctctttgatctactgtgtcatcatctaaatctcctggaaaaagactatttcgggatccgctttgtggaccctgataagcagcggcactggctggaatttacaaaaagcgtggtgaagcagctaagatcacagcctccctttactatgtgcttcagggtgaagttctacccagccgacccagccgcactcaaggaggagatcactcgttacctggtatttctacagatcaaacgcgacctgtatcacgggagactgctctgcaaaaccagcgatgctgccctgttagcagcctatatcctgcaggccgagatcggtgactacgattcagggaagcatccagagggttactcttccaaatttcaattttttccgaaacattcagaaaagcttgaaagaaaaattgccgaaattcataagactgagctgagcggtcagactccagccaccagcgagctaaacttccttcggaaagcgcagaccctggaaacatatggggtcgatccacacccttgcaaggatgtgtccggaaacgcagcctttctggcgttcacacctttcgggttcgtggtattgcagggaaataagcgagtgcacttcatcaaatggaatgaagtgactaagctcaagtttgagggaaagacattctacctgtacgtgtcgcaaaaggaagagaagaaaattattttgacatacttcgctcccacccctgaggcgtgcaagcatctgtggaagtgcggaattgaaaaccaagccttctacaagctggagaaaagcagccaggtccgtaccgtatcatcatctaaccttttctttaagggcagtagatttcggtacagcgggcgagtcgcaaaggaagtgatggagtcgtccgctaaaatcaagcgcgagccaccagagatccacagggctggcatggtgccatcgaggtcttgtccctcaataacccatggccctcggctgtctagcgtgcctcgcaccaggcgccgagctgtgcatatctcgatcatggaaggcctcgagagcttaagagactcagctcacagcaccccagtgcgctctacttcacacggagacacatttctgccccacgtacgttcaagccgcacggactctaatgagagagttgctgtgatcgctgacgaggcttatagtcccgcagattcagttctccctactccggtggccgagcattccctggagctgatgcttctgagcagacagatcaatggggcaacttgttctattgaggaggagaaggaatcagaggcttctacccccacggccacagaggttgaagccctgggtggagaactgcgggcactgtgtcaggggcactcaggtcctgaagaggagcaggttaacaagtttgttctgtccgtgttgagactgttactggtgacaatggggttactgtttgtgctgcttctgctcctgataattctgaccgaatccgatctggatattgccttcttccgcgatatccggcagacccctgagttcgaacagttccactaccagtatttttgcccactgagaaggtggttcgcttgtaagatccggagtgtagtgtctctgctgatcgatacctag

SEQ ID NO: 50283 - DNA, 1245 bp, Artificial Sequence
  Description of Artificial Sequence: Synthetic coding sequence
atgtgcttcagggtgaagttttacccagcggacccggctgccttgaaagaggagatcacccggtatctggtttttcttcagattaagcgtgacctatatcacgggaggttactttgtaagactagtgacgccgctctgctggctgcctatattctgcaggctgaaatcggagactacgattctggcaaacaccccgaagggtacagcagcaaatttcagttctttccaaagcactctgaaaagctagaaagaaagatcgccgaaattcacaagacagaacttagtggacagactcctgccacctccgaactgaattttcttaggaaggcgcagacgctggaaacatacggtgtagacccgcacccctgcaaggatgtcagcggtaacgcggctttcctggctttcactcccttcggattcgtggtgctgcaaggcaataagcgggtgcactttatcaagtggaatgaggttaccaaacttaagttcgagggaaagacattttacctttacgaaaagaagatcatcctcacatactttgccccaactcctgaggcttgcaagcacctctggaagtgtggtattgaaaaccaggccttttacaagctggaaaagagttcccaggtccggacagtcagcagctccaacctgttttttaaaggctctcgttttcgatatagtggccgtgtggctaaggaagtgatggaatccagtgctaaaataaagcgcgagccacctgaaatccaccgcgcaggcatggtgccttcacgtagttgtccttccatcacgcacggcccaagattgagctctgtcccgcgtaccagacgcagagccgtacatattagcatcatggaagggctggaatctctgcgagatagtgctcactccacaccggtccgctccacatcccacggggacacctttttaccacatgtgcgcagctcacgcaccgattccaacgagcgcgtcgctgtcatagccgacgaggcatattcaccggctgactccgtgctgcccacacctgtggccgagcactcgctggagctgatgttgctatctcggcagataaatggcgcaacctgctccattgaagaagagaaagaatcagaggcttccacccccaccgcaacggaggtggaggccttaggcggagagctgagggccctttgccagggccattccggccctgaagaagagcaagccatggtctgcttgcagaacccgctctcgggcgaacctgcgcattag

SEQ ID NO: 50284 - DNA, 1869 bp, Artificial Sequence
  Description of Artificial Sequence: Synthetic coding sequence
atgaataaactgaacttccacaacaatcgagtgatgcaggatagaaggtctgtgtgtattttcttaccaaacgacgagtctctgaatatcattattaacgtaaagatactctgtcaccagttgctggtccaggtctgcgatctcctgcgcctgaaggactgccatctgtttggtctcagcgtgatccagaataacgagcacgtttatatggagctctctcagaaactttataagtactgtccaaaggagtggaaaaaggaagcgtccaaggtgcggcagtatgaagtgacttgggggatcgaccaatttggtccccctatgatcatccacttcagagttcagtactatgttgagaacggacggctgatctccgaccgcgcagcccgttactattactactggcatttgcggaaacaggtgttgcactctcaatgcgtgttgcgcgaggaggcttattttttgttagcagcttttgctctccaggcagatttgggcaacttcaagcgaaataaacactatggaaaatactttgaaccagaggcctattttccctcctgggtcgttagcaagcggggaaaagattatatcctcaaacatatccccaatatgcacaaagaccagtttgccctgaccgcatccgaggctcatctgaaatatatcaaagaagcagtccggctggacgacgttgccgtgcattattaccgactctacaaagataaaagggaaatcgaagcgtcccttacactggggctgaccatgcggggtatacagatcttccagaacctggatgaggagaaacagctcttatacgattttccttggaccaatgtcggaaaactcgttttcgtgggtaaaaaatttgagatcctaccggatgggttaccctcagctaggaaacttatatattacaccggatgtcctatgagaagcagacacctcttgcagctgctgagcaattctcatagactgtatatgaacctgcagcccgtgctgcggcacatccggaagttagaggagaacgaagagaagaagcagtatcgcgagtcctacatctctgataatttggatcttgacatggatcagttagaaaaaagatccagggcgtccggaagctctgcgggttcaatgaagcacaaaaggttgtcaagacactctacggcttctcattcttcctcccacacctctgggatcgaggcagataccaaaccaagagacactggccctgaagacagttacagcagcagcgctatacatcggaagttaaagacttgtagctcaatgacttctcacggttcttcccacacatctggcgtcgagtcaggtgggaaggatcgactagaggaggacctgcaggacgatgagatagagatgctggtggatgatccacgggacctggagcagatgaacgaggaaagcctggaagtgtccccagacatgtgtatctacatcactgaggatatgttaatgtctcggaagctgaatggccactcgggcttgatcgtgaaggagattgggtcctctacctcaagtagttcggaaacagtggtcaaattgcggggacagtccactgattctctccctcaaaccatctgccgcaaacctaaaacctccacagataggcacagcctcagtctggatgatatccgactctaccaaaaagattttctgcggattgccggtctatgtcaggacactgcccagtcctataccttcggttgcggacacgaactagatgaggaaggactctattgcaactcctgtctggcccagcagtgtataaacattcaagacgcctttcccgtcaaaagaacttccaaatatttcagcctggacttaacccatgatgaggttcccgagttcgttgtttag

SEQ ID NO: 50285 - DNA, 1845 bp, Artificial Sequence
  Description of Artificial Sequence: Synthetic coding sequence
atgaataagttaaactttcacaataatcgggtcatgcaggatagaaggtcagtgtgcattttcctgccgaatgacgaatcgctcaatataatcattaacgtgaaaatcctgtgtcaccaattactagtgcaggtgtgtgacttactgagactgaaggattgccacctgtttgggctgtctgttattcagaataatgaacacgtgtacatggaattatcccagaaactctacaagtactgtcccaaggaatggaagaaggaggccagtaaagggatcgaccagttcggtccccctatgatcatccacttccgggtgcaatattatgtggaaaatgggaggctgatctcagatcgcgctgcccgttattattattactggcacttgcgcaagcaggtgctgcactcacaatgcgtcctgagagaagaggcctattttttgctggccgcatttgcactgcaagccgaccttggcaactttaaacgcaacaagcattacggcaagtactttgaacctgaagcgtactttccctcgtgggtcgtatccaaacggggaaaagactacattcttaaacatattcctaacatgcacaaagaccagttcgcgctcaccgcctctgaggctcatctgaagtacattaaagaggctgtgcgactcgatgatgtggccgtgcactactaccggctatataaggacaagagggaaatcgaagcatcactgacacttgggttgaccatgcgagggatccagatcttccagaatctggatgaagagaagcaactgctttacgactttccttggacaaacgtcggaaagctcgtattcgtgggaaaaaaatttgagatcctgcctgacgggttgccctccgccaggaagctgatttactatacaggatgccccatgagaagccggcatttactgcagctcctgagtaactcacaccgactctatatgaatctccaacctgtacttcgccatatccgcaagctggaggagaatgaggagaagaagcaatatcgggaatcctatattagtgataacttggacctggacatggatcagttagagaagcggagccgcgctagcgggtctagcgctggctccatgaagcacaagagactctctcgacatagtacagcctcccactcttcttcacataccagcgggatcgaagcagacacaaaacccagagatacaggccctgaagactcatacagctcttctgccatacatagaaagcttaaaacctgttcttcgatgacgagtcatggcagcagtcacacctctggagttgagtctggcggaaaagatagactcgaagaagacctccaggatgacgagatcgagatgcttgtggacgacccaagagacctggaacagatgaatgaggagagtctggaggtttcgccagatatgtgcatttacatcaccgaggatatgctgatgtcgcgaaagctgaacggccatagcggattgatcgtgaaggagattggctcctcaacgtcttcgagttcagagacagttgttaagctgagaggtcagtctacagactctctgccacagaccatctgtcggaagcccaagactagtacagatcgacattctttgagtctcgacgatatacggctgtatcagaaggattttctccgaatcgcagggctctgccaggacactgcgcagtcatacaccttcggttgcggccacgaactggatgaagaaggactctattgtaactcatgtctggcgcagcagtgtattaacattcaagatgcatttcccgtgaagcggacttccaaatattttagcctggacctaactcacgatgaagtacccgaattcgtggtttag

SEQ ID NO: 50286 - DNA, 1845 bp, Artificial Sequence
  Description of Artificial Sequence: Synthetic coding sequence
atgaataagctcaactttcacaacaatcgtgtgatgcaagatagaagatccgtttgcattttcctccctaacgatgagtccctaaatataattattaatgtgaaaattttgtgccaccagctgctggtgcaggtgtgtgatcttctgagactgaaagactgtcacctttttggtctatcagtgatccagaacaatgagcatgtttacatggagctctctcagaagctgtataaatattgtcctaaagaatggaaaaaggaggcaagcaagggcatagaccagtttggcccacctatgatcattcacttcagggtacagtactatgttgagaacgggcgtttgatcagcgatcgcgcagctcgctactactattactggcaccttagaaagcaggtgctccattcacagtgcgttctcagggaagaggcttactttctcctcgccgctttcgcgctgcaggctgacctgggaaactttaagagaaataaacattacggtaaatattttgagccagaggcatattttccctcgtgggtggtgagtaaaagaggaaaagactatattcttaaacacattcctaatatgcacaaagatcagtttgcacttaccgcaagcgaggcacacttgaaatatatcaaggaagcagtgagactagatgatgtagctgtccattattatcgcttgtacaaagacaagcgtgaaattgaggcctccctgaccctcgggctgactatgcgaggcatccagatcttccagaatctagatgaggagaaacagttgctctatgactttccctggacaaacgtgggcaaattggtattcgtcggaaagaaattcgaaatcttgccggatgggctgccctccgccagaaagctcatctactataccgggtgtccaatgcgctctaggcatctgttacagctgctgagtaattctcataggttgtatatgaatctgcagccagtgctcagacatatccggaaactcgaagagaatgaagagaagaagcagtatagggaaagctacataagcgacaatctggatctggacatggatcagcttgaaaaacgcagcagggcatcaggctcctcagcgggatccatgaaacataagagactaagcaggcacagcacggcttcccattcgagctcccatacgagcgggatcgaggccgataccaaaccccgagataccggacccgaggatagttatagcagttccgccatccatcgcaaattgaaaacctgttctagtatgacgtcccatggatccagccacacaagcggggttgagtctggcggaaaggaccgcctggaggaagatctgcaagacgatgaaatagagatgctcgttgacgaccctagagacttggaacagatgaatgaggagtctctggaagtgtctccagacatgtgtatttacatcaccgaagatatgctgatgagccgcaagcttaacggccattctgggctaatcgtgaaggagatcggaagttcaacttccagttctagcgagaccgtggttaagctgcgcggacagtcaaccgacagcctgccccagactatctgccgaaaaccaaaaacatctaccgataggcattccctatctctggacgacattaggctctaccagaaggactttctgaggatcgcaggtttatgccaggataccgcccagtcatatacattcgggtgtggccatgaattggacgaagaaggcctgtattgtaactcctgccttgctcagcagtgcattaacatccaggacgcttttcctgtgaagcggacttctaaatatttctctttggacttgacgcacgatgaggtccccgaattcgtggtatag

SEQ ID NO: 50287 - DNA, 795 bp, Artificial Sequence
  Description of Artificial Sequence: Synthetic coding sequence
atggaccaattggaaaagcgttcgagagccagtggctctagcgcgggatcgatgaagcacaagagactgtcccggcactcaactgcatctcactctagtagccacacttctgggatcgaagccgacactaagcctagagacacgggacccgaagacagttattcgtcctccgccattcaccggaagcttaagacatgcagctctatgacgtcccatggatcatcccacacaagtggcgtggagtccggcggaaaggatcggttagaagaagatttacaggatgatgagattgaaatgctggttgacgacccacgtgacttggagcaaatgaacgaggaatccctggaagtctcccccgatatgtgtatctatatcacagaggacatgttgatgtccaggaagctgaacgggcacagcggactgatcgtcaaagagataggtagtagcacctcttcgtcttcagagaccgtggtgaagctcagagggcaatccaccgattccttgccgcagactatctgcagaaaaccaaagaccagtactgaccggcattccttatcactagacgacattagactctatcagaaggatttcctgcgcatcgcgggactttgtcaggatacagcacagtcctacacattcggctgcggtcacgaactggacgaagaaggtctgtattgcaactcctgcttggcacagcaatgcataaacattcaggatgccttcccagtgaaacgaacctctaagtatttctctttggatcttacacacgatgaagtccctgagtttgttgtgtag

SEQ ID NO: 50288 - DNA, 186 bp, Artificial Sequence
  Description of Artificial Sequence: Synthetic coding sequence
atgaataagctgaactttcacaacaaccgagttatgcaggaccgccgatcagtctgcatcttcctacccaacgacgaaagcttaaacattatcatcaatgtgaagattctctgccatcaattgttagtccaggtgtgtgatttgcttcgtttaaaggactgccatctgtttggtctctctgtttag

SEQ ID NO: 50289 - DNA, 3138 bp, Artificial Sequence
  Description of Artificial Sequence: Synthetic coding sequence
atgggtgaaatagagcagcgacctacgccaggatctcgcctcggggcacctgagaactccggaattagcacacttgagcgcggtcagaagccaccgcctacaccatcaggaaagctggtcagtattaagattcagatgcttgatgatactcaggaagccttcgaggtacctcagagagctccaggcaaagttcttctggatgcagtatgcaatcacctgaacttggtggagggagattacttcggcctggagttccctgatcataagaagattaccgtgtggcttgacctacttaagccaatagttaagcaaatcaggaggcctaagcatgtggttgtcaaattcgtggtaaagttcttccctcctgaccatacacagcttcaagaggagctcacaagatatctcttcgcccttcaggtcaagcaagatcttgcccaaggccgactcacatgcaacgataccagtgctgcactgctcatatctcatattgtccaatccgagataggggatttcgatgaggccttagaccgagagcacctcgctaagaacaagtatattcctcagcaagatgccctcgaggataaaatcgtggagtttcatcataatcacattggacagacccccgcagagagcgattttcagttgctggagattgctaggcgactcgaaatgtatgggatccgcctgcaccccgcaaaggatagggaggggactaagatcaacctggcggtggccaatactgggatactcgtctttcagggatttacgaaaatcaacgctttcaattgggctaaagtgcgcaagctgagcttcaagcggaaaagattcttgatcaagctcagaccagatgctaactccgcctaccaggacaccttagaattcttgatggctagccgagacttttgcaaatcattttggaaaatttgcgtggagcatcacgcattctttcggcttttcgaggaaccgaaacccaagcctaagcctgttctgttttctcgcggaagctcttttaggttttccgggaggactcagaagcaggtgcttgactacgttaaagaagggggacacaagaaggtccagtttgagagaaaacactcaaagattcacagcatcagaagtctggcttctcagccaactgagcttaattcagaagtactggagcagtctcagcagtctacaagcctcacttttggcgaaggcgctgaaagccccggaggccaatcttgtcgcaggggcaaggaacctaaggtctccgcaggagaacctgggtctcaccccagccccgcaccgagacgcagtccagcaggcaacaagcaagctgacggggcagcctctgctcccacagaagaggaagaagaggtggtcaaagaccgcacgcagcaatctaagccccagccccctcagccatccactggctcactgaccggaagtcctcatctcagcgaactttccgtcaacagtcaaggcggtgtggcccctgcaaatgttacactgagccccaacctgtccccggacactaaacaagcttcccctcttatctctccattgctgaatgatcaagcttgccctagaaccgacgacgaggacgagggcaggaggaagcgctttcccactgataaagcctactttatagctaaagaagtgagcacaacagagagaacttatctgaaggatctggaggtgatcacttcttggtttcagagtaccgtgtctaaggaggacgcgatgcctgaagctttaaaaagccttatctttcctaactttgagcctctccacaaattccacaccaatttcttaaaggaaattgaacaaagactcgccctttgggaaggtcgcagtaacgctcagattagggactaccagcggatcggcgatgtcatgctcaagaacatccagggcatgaagcacctggccgctcacctttggaagcactccgaggcattggaagctcttgaaaacggtattaaaagctcacgccgactcgagaatttctgccgggatttcgagttgcagaaggtctgttacctcccccttaatacctttctgctgagacctctccatcggttgatgcactataaacaggtgttagagaggctgtgcaagcaccaccccccttcgcacgccgactttcgagactgccgcgcagctctagccgaaattaccgaaatggtggcccagctccacggtaccatgataaagatggaaaattttcaaaaacttcatgaactgaaaaaggacctgattggtatagacaacctggtcgtgcccggaagagagttcattcggctgggttcactgtctaaacttagtggcaaaggacttcagcagagaatgttctttctgtttaatgacgtgttgttatacacatccagaggcctgactgccagcaatcagtttaaggtgcacggacagcttccattgtatgggatgacaattgaggagtccgaagatgagtggggggtgccccactgtcttacgctcaggggtcagaggcagagtatcatcgtcgctgcttcttctcgcagtgaaatggaaaaatgggtggaggacatccaaatggctatcgatttggccgaaaagtcgtcaagccctgctcccgagtttttagcatcatcccccccagacaataagagtcctgacgaagcaacagccgctgaccaggagagcgaggacgacctgagcgcctcccggacttctctggagcgccaggcaccacataggggaaacacaatggtgcacgtctgttggcacaggaacacctctgtcagcatggtggacttcagtatcgccgttgaaaaccaacttagcggaaacctcctccgcaaatttaagaatagcaacggctggcagaagctgtgggtggtttttacgaatttttgtctctttttctacaaaagtcaccaggacaaccaccccctggcttctctcccccttctgggctattctcttaccatcccaagcgagtccgaaaacatccaaaaagactatgtcttcaaactgcactttaagtcccatgtgtactatttcagggccgagtccgagtatactttcgagcggtggatggaggtgattcggagtgcaacatcttcagcgtctcggccacatgtgttgtcacataaagagtccctggtatactag

SEQ ID NO: 50290 - DNA, 390 bp, Artificial Sequence
  Description of Artificial Sequence: Synthetic coding sequence
atgggcgagattgagcagcggcctacccctggctcacggctcggagcccctgagaatagcggcatctcaacccttgagagaggccaaaagcccccacctacaccttcaggtaagctagtgtccatcaaaattcaaatgttagacgacacacaggaagccttcgaagtgcctatggtgagctccagctcattcctgaaagcaaccggaagcagctggactggatgggtactgcgttgtagcatgaagcctaagcaccattctcatttaattgagaaattcggcgaagataggatcctgacacacctaacagggagcattagttacaccaactgggccggttcccgttccctcgctgtgacagtaactgaggaactactgaacttattctag

SEQ ID NO: 50291 - DNA, 1083 bp, Artificial Sequence
  Description of Artificial Sequence: Synthetic coding sequence
atggccagccgagacttctgtaagtcattctggaaaatctgcgtggagcaccacgcatttttcaggttgtttgaggagcccaagccaaagccaaagcccgtgcttttctcacgaggatcttcctttcgcttttctggaaggactcagaagcaggtcctcgactatgttaaagaagggggacacaagaaagtccagtttgagaggaagcacagtaagatccatagtataagatccctggcctcccagcccaccgagctgaactcagaagtcttggagcagtctcaacagagcacgagcctgacctttggcgagggcgcagagtcgcccggtggacagtcttgtcgccgaggtaaagagcctaaagtatcggcgggtgaaccaggttcacacccgtccccagcccctcgaagatccccagccggaaataaacaggccgatggcgctgcgagtgctcctaccgaagaggaggaagaagttgtgaaggaccgcacccagcagagcaaaccgcagccaccccagccatcgactggatccctgacaggatccccccacctgtctgaactgagcgtcaactctcagggaggtgtcgcccctgcaaatgttaccctatctcccaatttaagtcctgataccaagcaggccagtcctcttatctctccactgcttaatgatcaggcttgcccccgaacagacgatgaagatgaaggcagacgcaagcggttcccaactgacaaagcctattttattgcgaaggaggtgtcgaccactgagcgcacctatctcaaagacctggaagtcatcacatcttggtttcaatcaaccgtgagcaaagaggatgcgatgccagaggccttgaagtctttaatatttcctaacttcgagccactgcataagttccacactaacttcctcaaggaaatagaacaacgcctagctctgtgggagggcagatctaatgcccagatccgcgactaccagagaatcggagacgtcatgctgaaaaacatccaggggatgaaggccggtgtccagtggagagatctgggtagcctgcagccaccccctcctcggtttaagccttag

SEQ ID NO: 50292 - DNA, 3231 bp, Artificial Sequence
  Description of Artificial Sequence: Synthetic coding sequence
atgggcgagatcgaacaaagacctacccctgggtctaggctgggcgctccggagaactcaggaatttctaccctcgaacgaggccagaagccccctcctaccccgagtggcaagttggtgtcaattaagattcagatgcttgatgatacacaagaggcctttgaggtgccacagagggcgcctgggaaggttctgctcgatgcggtatgcaaccatctcaacctggtcgaaggagactactttgggttagaattcccagaccacaagaagatcacagtctggctggatctgctgaagccgatcgttaaacagatccggaggccaaaacatgtggtggtcaagttcgtagttaaattttttccgccagaccatacgcagctccaggaggaactgaccaggtacttgttcgccctgcaggtaaaacaagatctcgcacagggcagactgacctgcaacgatacctctgcagccctgctcatatcacacatcgtacagtcggagattggggatttcgatgaggcccttgaccgtgaacatctcgctaagaacaaatacattccacagcaagatgccttggaggacaaaatcgtcgagttccatcataaccatataggtcagaccccggctgagagcgattttcagctgctcgagatcgccagaaggctcgagatgtacggcattagactacatccggcaaaagatagagagggaaccaaaattaaccttgctgtggccaatacgggcatcctcgttttccagggcttcactaaaattaacgcctttaactgggccaaggtgcgtaaactgtcctttaaacgaaagcggttcctgatcaaactccgcccagacgctaacagtgcctatcaggatacattggagttcttgatggcttcacgggatttttgtaaatcattttggaagatctgcgtagagcatcacgccttcttccgcctgtttgaggaacccaagccgaagcccaaaccagtgctgtttagccggggttcttcttttagattcagcggtaggacacagaaacaggtgctggactatgtgaaggagggaggacataagaaggtgcagtttgaaaggaagcattccaaaattcattcaatcagatcacttgccagccagcccacagagctgaatagtgaggtgctggagcaaagccagcagtccacttccctgacctttggagagggggcagagagtcccggaggccagagttgtagacgcggtaaggagcccaaagtatcggcaggtgaacccggatcccatccctctcctgcccctcggaggtcccccgctggtaacaagcaagcagatggggcagccagcgccccaacagaagaggaggaagaggtcgttaaagaccgaacccagcagtccaagccccagccacctcagccctccaccggatcactaaccggtagtccacatctgtccgaactgagcgtgaatagtcagggcggagtggctccagcaaacgtcacactatcccctaacctctctcccgacacaaaacaggcctctccactgatttcacctttgctgaatgatcaggcatgtccaagaaccgacgatgaggatgagggaaggcgaaagagattccctactgacaaggcttatttcatcgcaaaggaggtgagcacgacagagcggacttaccttaaagatttagaggtgattactagctggtttcagtctacagtttctaaggaggatgctatgccagaagcactgaaatccttaatctttcctaacttcgaacccctgcataaatttcatacgaatttcctcaaggagatcgaacagcggctcgctctctgggagggccgtagcaacgcccagatcagagactatcagagaattggagatgtgatgctcaaaaatatacagggtatgaaacatcttgccgctcacttatggaagcacagcgaggctctcgaggctctcgagaatgggattaaaagttcgagacgtttggagaatttttgtagggatttcgaacttcagaaggtgtgttacctccccctcaatacatttctactgcggcctctgcacagactgatgcattacaagcaggtattggaacgcctctgcaagcaccaccccccatcacacgccgatttccgtgattgccgggctgcgctagctgagataaccgagatggtcgcccagttacacggcacgatgatcaagatggagaactttcaaaaactgcacgaactgaaaaaggatctcattggcatcgacaatctcgtcgtccccggtcgacccggatctttcagcttgattaggacaccccacttagggcaagccaggaggatcccatgcgcccctgaacgacggccactgttgctggtgaaggagtttatcagactgggcagcttatccaagctgtctggtaagggtctccaacagcggatgttctttctattcaatgacgtgctgctgtacacctcaaggggactcaccgcaagcaatcagttcaaggtgcacgggcaactccccctttacggaatgaccatcgaagaatccgaggacgaatggggcgtaccccactgcctgactctaagggggcagaggcaaagtattattgttgcagctagctctcgctctgagatggagaagtgggtggaggacattcagatggctattgatctcgccgagaaatcctcatcacctgctcctgaatttttggcaagtagtccgcctgacaacaaatccccagacgaagcgacagccgcagatcaggagtctgaggacgacctctctgcttcgaggacttctctggagcggcaggctcctcaccgcggaaacacaatggtccatgtgtgctggcacagaaacacctctgtttctatggttgatttttctatcgccgtggagaaccagttgagcggaaatctgttaagaaaattcaaaaactctaacggctggcagaagctttgggttgtattcacaaacttctgtctgtttttctacaagagtcatcaggacaaccacccactagctagtctcccccttctgggatattccctgacgatcccttccgagagcgaaaacatccagaaagattacgtctttaaacttcacttcaagtctcacgtgtactacttccgagccgagagtgagtacaccttcgaaagatggatggaggtgattcgctctgctactagttcggcgtctagaccccatgtattgtcacataaagaatctctggtatactag

SEQ ID NO: 50293 - DNA, 462 bp, Artificial Sequence
  Description of Artificial Sequence: Synthetic coding sequence
taactttgtaagcaccaccctccgtctcatgcagacttcagggactgcagggccgcactcgcagaaatcaccgagatggtagcccaactgcatggcacaatgatcaagatggagaattttcaaaagcttcacgagctgaaaaaggacttgattggaatcgacaatctcgtggtgcccggtagggtcagttcttctgggcttactatgcactgcgccggatcaagaaaggaggcatctgaaggcctgacattcgaaccctttgaggagaggcctctgcaatccaaaatgtcctccttccatccaccaggtcgacaactagaaaaacacaacagtgtggtgtcaagtgagtccttatgcagcgaagaaattaagcaatcaagcgacctcatattctgttttttttccctgcgaggggacagcctgctgtatttgttcccttatcatatacctcagaagatttag

SEQ ID NO: 50294 - DNA, 555 bp, Artificial Sequence
  Description of Artificial Sequence: Synthetic coding sequence
tgatctctgactgggtcacctcatctgtcagaactctccgtgaactcccagggaggtgtggcccctgccaatgttaccctgagtccaaacttgagtcccgacacaaagcaagcatcgcccctgatcagtccgctgctaaacgaccaggcgtgcccaagaaccgatgacgaggatgaaggccgtagaaagaggttccccaccgataaagcatatttcattgctaaggaggtcagtacaaccgaaaggacctatcttaaggatctggaggtgattaccagttggtttcagtccaccgttagtaaggaggacgccatgccggaggccttgaagtcactaattttccctaacttcgagccactgcacaagtttcacaccaatttcctgaaggaaatcgagcagaggctcgcgctttgggagggccgtagcaatgcgcaaatacgagattaccaaaggatcggcgatgtgatgctgaagaatatacagggcatgaaagccggagtgcagtggcgggacctgggcagcctgcagcctcctccaccccgttttaaaccatag

SEQ ID NO: 50295 - DNA, 3165 bp, Artificial Sequence
  Description of Artificial Sequence: Synthetic coding sequence
atgggtgagatcgaaggcacctatagggtcttgcaaacggccggtatgcggcttggtgcccagaccccggtgggggtctccacactcgagcccggacagaccttgctgcccaggatgcaggagaaacacctccacctgagagtgaaactgctcgacaacaccatggagatcttcgatatcgaacctaagtgtgacggacaggtgcttctcacccaggtgtggaagaggctcaatttagtagagtgtgattacttcggcatggagtttcaaaatacccaatcgtattggatatggctggaacccatgaaaccaatcattcgccagatcagaaggcctaagaacgtggtcctccgtctagctgttaaatttttcccacctgacccgggacaactgcaagaggaatacacaagatatttgttcgctctccagctgaaaagggatctgctggaggagcggctcacatgtgccgacaccactgccgcactgcttacatcccatctgctgcagagcgagatcggtgactatgacgagactttagatagagaacacttaaaggtcaacgagtacctgcccggacaacaacactgcctcgaaaaaatattagaatttcatcagaagcacgtgggccagactcctgctgaatctgacttccaggtgctggaaattgccaggaaacttgaaatgtacggcatcaggttccacatggcctccgatcgcgaggggaccaagatccagctagcagtcagccatatgggagttttggtgtttcaggggacaactaagataaataccttcaactggagtaaggtgagaaaactctcttttaagcgcaagcgctttctcattaaattgcacccagaagtgcacgggccataccaggacacactggaatttctgttggggtctcgtgacgaatgcaagaatttttggaaaatttgtgtagagtaccatactttttttcggctcttggatcaaccaaagcctaaggcgaaggctgtgtttttctcaagaggatcgtcatttcgatattctggacggacccaaaagcagctggtcgattacttcaaagatagcggaatgaagcgcatcccttacgagaggagacactctaagacccacacatcagtacgggcactgacggccgatctcccgaaacagtctatcagcttcccagaaggactgaggactccagcaagcccatcctcagctaatgccttctacagcctgagtccctctacattggtaccgagcggactgcccgaatttaaggatagtagctctagcctgacagatccccaggtatcttacgtaaagtcacccgctgcggaacggcgtagcggcgctgttgccggaggccctgacacacctagcgcccagcctcttggacctccggcactgcagccaggcccaggactgagcactaaaagcccacaaccgagtccaagctcaaggaaatctcccctttctctctccccggcttttcaggtgcccctgggacccgctgaacagggtagcagcccattgctcagtccagtcctttctgatgccggaggcgcaggaatggactgtgaggaacccaggcacaagagagtccctgctgatgaggcctacttcattgtgaaggaaatcttggctaccgaacggacctatttaaaagatttggaagtgattactgtgtggtttcggtccgccgtggtgaaagaggatgctatgccggcaacactcatgacacttctgtttagtaatatcgacccgatatatgaatttcacagaggctttctacgcgaagtggagcagcgcctggccttatgggagggacccagcaaagctcacacaaaggggtcccatcagcggatcggggacatactgctcagaaatatgagacagttgaaggaatttacatcatactttcagcggcacgacgaagtactgactgagctggaaaaggctactaagagatgcaagaaattggaggccgtttacaaggagtttgagctgcagaaggtgtgttacttgcccttgaatacattcttgttgaaacccattcagcggttactccattatcgtctcctgcttaggcggctgtgtggccactattcccccggtcaccacgactacgcggattgtcacgacgctttgaaagctattacagaggttaccacaacccttcagcatattttgatcaggctggagaatctccagaagctgacggagcttcaacgagatctggtgggaatcgagaatctgattgcgccaggcagagaatttatccgcgaaggctgcctccacaagctgacgaagaagggcctgcagcaacgaatgtttttcttattctctgacatgctgctgtacacatcgaaaggagtagcaggtacgagtcacttccgaatccgcggattgctacctctacagggtatgttggtggaggaatccgacaatgagtggtccgtgccccattgctttactatctacgccgctcagaagaccatcgttgttgcagcgtcaactcgcctcgaaaaggagaagtggatgctggatctgaatagcgccatccaagcagctaagtccggcggtgacaccgctccagcgcttccgggacgcaccgtgtgcaccaggcctccccgttctccgaacgaggtgagtctcgagcaggaatccgaggacgacgcacggggtgtgagatctagcctggaggggcacggacagcatagagccaacaccaccatgcacgtgtgttggtatagaaatacctctgtcagcagggcagatcatagtgcggcagtggagaaccagctgtctggttatctgctgagaaagttcaaaaactctcatggctggcagaagctctgggtggtcttcactaatttctgccttttcttttataaaactcatcaagacgactatccccttgcgagccttcccttattaggttacagcgtatcaatcccccgtgaagcagacggcatacacaaggattacgtgttcaagttacaattcaagtcccatgtgtacttcttccgggcagaaagcaagtatactttcgagcgctggatggaagtcattcagggagctagctcatctgccggacgagcacctagcattgtccaggatggccctcaaccgtcatccggtctcgaaggcatggtgagagggaaagaggaatag

SEQ ID NO: 50296 - DNA, 1944 bp, Artificial Sequence
  Description of Artificial Sequence: Synthetic coding sequence
atgggggagattgagggcacatatcgggtgcttcaaaccgccggaatgaggctaggcgcacaaaccccagtcggggtgagcacacttgaaccgggacagacacttctacccagaatgcaggagaagcatctccatctcagagtaaagcttctagacaacaccatggaaatttttgatatcgagccgaaatgcgacgggcaggttcttttaactcaggtttggaagcggctcaaccttgtggaatgcgactacttcggaatggaatttcagaatacccaaagctattggatttggctcgagcctatgaagcccattattagacaaatccgcaggcccaagaacgtcgtgttacggctcgcagttaagttctttccgcctgatccaggtcaactacaggaagaatatacccgctacttgtttgccctgcagctgaagagagacctgctggaagaaagactgacttgtgcagacactactgccgcattgctcacaagtcacctgctgcagtctgaaatcggcgactatgatgagacgttggacagagagcacctgaaggtcaatgaatatctgcccggacaacagcattgcctggagaagattcttgagtttcaccagaagcacgtcgggcaaacccctgctgagtccgacttccaggtcttggaaatcgctcgaaagctcgagatgtacggaatacgcttccatatggcctctgacagagaaggcactaagatacagctcgctgtgagccatatgggcgtactggtgttccagggtactaccaagatcaacacctttaactggtcaaaagtgaggaagcttagcttcaagagaaaacgttttctgattaaactccatccggaggtgcacggaccctaccaggatactttggagttcctgttgggaagtagagatgagtgtaaaaatttctggaaaatatgcgttgagtatcataccttttttaggttgctggaccaaccaaagcctaaggcaaaggccgtttttttctccaggggttcaagttttagatatagtgggaggacacagaaacagctggtcgactacttcaaagactcagggatgaagcgcataccctatgagagaaggcactcaaaaacccatacctccgtgcgggctttaaccgctgacctgccaaagcagtctatctcctttccagagggcctgagaacgccagccagtccatcaagcgcgaacgccttctacagcctgtcaccgtccaccctggttcctagcggcctgccagaatttaaagacagttcgtccagtcttaccgaccctcaggtcagttacgttaagtctcccgcagctgaacgaagaagtggggcagtggctggagggccagatacaccatccgctcagcccctggggccaccggctcttcaacccggtcctgggctgtcaaccaaatctccccagccttcccctagctcaaggaagagccctttatctctctccccagcttttcaggtgccactggggccagcggagcaggggtcaagtccgctgctgtcccctgttctctcagacgcgggaggagctggcatggactgcgaggagccacgccataagagagtgccggcagacgaggcatactttatagttaaggaaatcctggcgaccgaaaggacttatctcaaggacctcgaggtgataactgtctggttccgatctgcggttgttaaagaagacgctatgccggctacacttatgacactgttattctccaacattgatccaatctacgaattccatcgaggctttctgcgggaagttgaacagaggcttgccctgtgggagggtccatctaaggcgcacaccaaaggatctcaccagcgaatcggggacatcctgctcagaaacatgagacagctgaaggtcttccagctgcacgaagggcacgtggcaggcgtcaccaaaatggaatag

SEQ ID NO: 50297 - DNA, 171 bp, Artificial Sequence
  Description of Artificial Sequence: Synthetic coding sequence
tagaagtcacatgtctatttttttagagctgagagtaagtacacctttgaacggtggatggaggtaatccaaggtgcttcctcatctgccggtcgggctccatctatcgtgcaagatggccctcagccctcttccgggctcgaaggcatggtaagggggaaggaggagtag

SEQ ID NO: 50298 - DNA, 405 bp, Artificial Sequence
  Description of Artificial Sequence: Synthetic coding sequence
atgggagagatagagggaacttaccgggtccttcagacagcgggaatgcggctgggcgcacagaccccagttggtgttagcactctggagccaggccagaccctactaccccgaatgcaggagaaacatctacacctccgcgtgaagttacttgataatacgatggaaatcttcgatattgaacctaagtgcgatggtcaggtcctcctgacccaggtatggaaacgtctgaatctggtcgaatgtgattattttggaatggagtttcaaaacactcagtcttactggatctggcttgaacctatgaagccaattatcagacagatccgcagacctaagaatgtagtcttacgattagcggtcaaattcttcccaccagatcctggccagctacaagaggagtag

SEQ ID NO: 50299 - DNA, 282 bp, Artificial Sequence
  Description of Artificial Sequence: Synthetic coding sequence
atgggcgaaatcgaaggaacttaccgcgtgttacagacagctgggatgcgtttgggcgcacaaactcctgtcggagtgagcactttggagcctgggcagaccctgttaccgagaatgcaggagaagcacttgcatctgagggttaaactgttagataataccatggagatatttgatatcgagccaaaatgcgacggccaggtgctgctcacgcaggtctggaagaggcttaacctggttgagtgcgattacttcggaatggaattccagaacactcagtag

SEQ ID NO: 50300 - DNA, 1917 bp, Artificial Sequence
  Description of Artificial Sequence: Synthetic coding sequence
atgggagaaatcgaaggcacttacagggtgctgcagacagccggtatgaggctgggcgcacagaccccagtgggcgtcagtacactcgaaccagggcaaacattgttgcccagaatgcaggagaagcacctacacctccgggtgaagcttctcgataatactatggaaatttttgacatcgaacccaagtgtgacgggcaggttttgctgacccaagtatggaaacggctgaatctggtggagtgcgattatttcggaatggaatttcagaacacccagagttattggatctggctggagcctatgaagccaatcatcaggcagattcgcagaccaaagaacgtggtcttgcgtcttgccgtaaagttctttccacctgatcctggacagctccaggaggaatataccagatacctgttcgcactgcaactgaaacgggacctcctggaggagcggttaacttgtgcagacaccacggctgccctcctcaccagccatctgcttcagtcagaaatcggcgactacgacgaaacactcgacagagagcatctcaaggtgaatgagtacttacctggccaacaacactgtctcgagaaaattctggagtttcaccaaaagcacgtagggcagactccggctgaaagcgatttccaggttctggagatcgcgcgaaaactggaaatgtatggaatccggtttcacatggctagcgaccgggagggcactaaaatccaacttgctgtgagtcacatgggcgtattggtgttccagggcacaacaaagattaacacgttcaactggagcaaagtaagaaagctcagctttaaaaggaagcgcttcctgattaaactgcacccagaggtgcatggaccttaccaggatacgctcgaatttctgctaggatctcgggacgaatgtaaaaatttctggaagatctgtgtggagtatcacaccttcttccggcttctagatcagcccaagccaaaggcaaaagcagtgttcttttcccgcggatcctcttttcgctactccggcagaacccaaaagcagttggttgattacttcaaagattctggtatgaagagaatcccctacgagcgtcgtcactcaaagactcatacgtccgtccgagctctcacggccgatttgccaaagcagagcatttcattccccgaggggcttcgcaccccggcaagcccaagcagcgccaacgccttttactccctcagcccgagcaccctggtcccatctggattgccagagttcaaagatagtagttcaagcttgaccgatccacaagtgtcatacgtgaaatcccccgctgccgagaggcggagcggagcagtggccggtggccctgacactccctcagcccagcctctggggcctccagctttgcaacctgggccaggccttagcaccaagagtccacagccttcaccttctagtcgcaagagccccctgtcccttagtcctgctttccaggtgcctttaggtcctgcagaacagggaagcagtcccctgcttagccccgtccttagcgacgccggaggagctgggatggactgtgaggagccacgccacaaaagagtgcctgcagatgaggcctacttcattgttaaggaaatccttgctaccgagaggacttatctcaaggacttggaagtgatcacagtgtggttcagatctgccgttgtgaaagaagatgctatgccagccactctaatgactctccttttcagcaatatcgatccaatctacgagtttcaccgaggattcttgcgggaggtggagcagagattggcactgtgggagggcccttccaaagcccatacaaaaggaagccaccagaggatcggtgacattcttttaaggaatatgaggcagctgaaggccgctcacgaatttaccacatag

SEQ ID NO: 50301 - DNA, 1155 bp, Artificial Sequence
  Description of Artificial Sequence: Synthetic coding sequence
atggccgctcagaacggcaatacatccttcactcctaactttaaccctccacaggaccacgcctcatccttgtcttttaatttctcctatggggactatgacctacccatggatgaggacgaggacatgacaaagaccagaactttcttcgccgcaaaaattgtcattggcatcgcattagccggaattatgctcgtttgcggtataggcaacttcgtcttcatcgccgctctcaccagatataagaaactcagaaatcttacgaacctgctcatcgccaatctcgcgatcagcgacttcctcgtggctattatctgttgtcctttcgagatggactactacgtagtaagacagctgtcatgggagcacggacacgttctttgcgccagcgtcaactatctgcggactgtgtccttgtatgtgagcacgaacgctctacttgccatagcgattgaccggtatttggccatcgtccatcccctcaagcccaggatgaattatcagacggcaagtttcttaatcgctctggtgtggatggtgtccattctgattgcaatccctagcgcttacttcgccaccgagacagtgctgtttattgtgaagtcccaggagaaaatcttttgtgggcagatttggccagtggatcagcagctctactacaagagttattttctgtttattttcggcgtggagtttgtgggccctgtggtgacaatgaccctctgttacgcccgaatttcccgcgagctttggtttaaggctgttccaggtttccagacagagcagatcaggaagagacttcgttgccgtcgcaaaaccgtgcttgtcctcatgtgtatcctgacagcctacgtgctgtgctgggctcccttttacggattcacaatcgtgagagatttttttcctactgtcttcgtaaaagagaaacactacctgacagcattttacgtggttgaatgtattgccatgtccaacagcatgatcaacactgtgtgttttgtgacagtgaaaaacaacacgatgaagtacttcaaaaaaatgatgttactgcattggagaccaagccaaagaggtagcaagtcatctgccgatcttgacctccgcactaacggcgtcccaactaccgaagaggtggactgtattcgcttgaagtag

SEQ ID NO: 50302 - DNA, 1668 bp, Artificial Sequence
  Description of Artificial Sequence: Synthetic coding sequence
atgctgtccagcacggatttcacatttgcctcctgggaactggttgttcgagtcgaccaccctaacgaagagcagcagaaggacgtgactttgagggtttcaggcgacctccacgtggggggagttatgctcaagcttgtcgaacagattaacatcagccaggactggtctgacttcgcattatggtgggaacagaagcactgttggctcctcaagacacattggactctggacaaatacggcgttcaggctgacgccaaacttctttttacccctcagcataagatgctacgcctgcgcctgcctaacctcaagatggtccgcctgcgtgtgtctttctccgcagtggtatttaaagccgtctccgacatatgcaagatcctgaatatccgcaggtccgaggaactgagcttgttaaagccctctggtgattattttaagaagaagaagaagaaagacaagaataataaagagccaatcattgaggacatcctcaatctggagagctccccgacggctagcggatccagtgtttcgcccggtttgtattccaaaaccatgaccccgatctacgatccaatcaatggaactccggcaagtagtaccatgacatggttcagcgatagccctctgactgaacaaaattgtagcatcctggccttcagccagcccccacagtcccccgaggcactcgcggatatgtaccagccccgatctctggtagacaaggctaagctcaacgccggttggttggacagcagtcggtccttgatggagcagggtatccaagaggacgaacaactgctgttgcggttcaaatattactcttttttcgatctgaatccaaaatacgatgccgttcgcataaatcagttgtacgagcaggcccgttgggcaatactgctggaggagattgactgcacggaagaggaaatgttaattttcgcggcactccagtaccatattagtaaactctccttgtccgctgaaactcaggattttgcgggagaatcggaggtagatgaaatcgaggccgcactgtctaacttggaggtgacccttgaggggggaaaagctgactccctgctcgaggatatcacggatatccctaaattagcggacaatcttaagctgtttaggcctaagaaactgcttccaaaggcgttcaagcaatactggttcattttcaaggacactagcatcgcatattttaaaaacaaagaattagagcagggcgaacctctggagaaactgaatctccgaggttgcgaggttgttcccgacgtgaacgtggctgggaggaagttcgggataaagctcttaattcctgtcgccgacggcatgaacgagatgtatcttcggtgtgaccacgagaatcaatacgcacaatggatggccgcatgtatgctggcctctaaaggcaagacaatggccgacagctcttatcagccagaggttctgaatattctctccttcctgcggatgaagaataggaactccgcatcccaagtagccagtagcctcgagaatatggacatgaacccagagtgcttcgtctcaccaaggtgcgctaaaagacacaagtctaagcagctggccgcaaggatcctagaagcccaccacctccaagcacccttccattcctacaggtctttaagccatctgtag

SEQ ID NO: 50303 - DNA, 441 bp, Artificial Sequence
  Description of Artificial Sequence: Synthetic coding sequence
atgttaagttccacagactttaccttcgccagctgggaactcgttgtgcgagtggaccaccctaatgaagagcaacaaaaagatgtgacgctacgggtttctggcgacttacacgttggaggtgtgatgttgaagcttgtggagcagataaatatttcccaagattggagcgactttgcgctttggtgggaacaaaagcactgctggctgctcaaaacccattggacgttggataagtacggggtgcaagcggacgccaagctgctattcactccacagcacaaaatgctccggcttaggctgcctaatctcaagatggtgagactaagggtatctttttctgctgtggtttttaaagcggtatctgacatctgtaaaattttaaatattaggcggtccgaggagctgtccttgctgaagccttccggggactacttctag

SEQ ID NO: 50304 - DNA, 1263 bp, Artificial Sequence
  Description of Artificial Sequence: Synthetic coding sequence
atggagcagggcattcaggaagacgagcagctactgctccggttcaagtattattcattttttgatttgaaccccaaatatgacgcagtgcggatcaatcagctttacgaacaggccaggtgggcaatcctcttagaagaaattgattgtaccgaggaggaaatgctgatttttgcagctctgcagtatcatattagcaagttgagcctgtccgccgaaacacaggatttcgcgggagagagcgaagttgatgagatcgaggctgcgttaagcaatctcgaagtaactctggagggtggcaaagcggactcactgctggaagatataactgatatccccaaacttgcagacaaccttaaactctttcggccaaaaaaactcttgccaaaagcttttaaacagtattggttcatcttcaaagatacatctattgcgtatttcaaaaataaagagctggaacagggagagccccttgaaaagctgaatctccgtgggtgtgaggtggtcccagacgttaatgtggcaggacggaaattcgggattaagctgctcattccagtcgccgatggcatgaatgagatgtacctacgctgcgaccatgagaatcaatacgctcaatggatggccgcttgcatgctggcaagcaagggaaaaactatggccgattcgtcataccagccagaagtgctgaatattcttagctttctccggatgaagaatagaaattcagcatcccaggtcgccagctccctcgaaaatatggacatgaaccccgaatgctttgttagtccacggtgtgcgaagaggcataagtccaaacagctggctgctagaatcctcgaagcacaccagaatgtcgctcaaatgccactcgtggaggcaaaactcaggtttatccaggcctggcagtctctgcctgaatttggcctgacgtattatcttgtgagatttaaaggctcaaagaaggatgatatcctcggcgtgagttacaacaggctgattaagatagatgccgcaaccgggatccctgtaacaacctggcggttcaccaacattaagcagtggaacgtgaactgggaaacacggcaggtcgtgatcgagttcgatcagaatgtgtttacagcatttacttgtctatccgccgactgtaagatcgtccatgagtatattgggggatacattttcctctctacacggtctaaggatcagaacgagacacttgacgaagacctcttccacaagttgaccggaggccaggactag

SEQ ID NO: 50305 - DNA, 552 bp, Artificial Sequence
  Description of Artificial Sequence: Synthetic coding sequence
atggcagcctcaatggcccgaggaggtgtatctgccagggttcttcttcaggctgccagaggcacttggtggaatagaccaggcggtacatctggctctggcgagggtgtcgcccttgggaccactagaaagttccaagcaacgggttcccgacctgccggtgaggaggacgctggcggtcccgaaaggccaggtgatgtggtcaatgtggtcttcgtggacaggagtggccagagaattccagtgagcggaagggtgggtgacaatgttctgcatcttgctcagcgtcacggcgtcgatctggaaggcgcttgtgaggctagtctagcttgtagtacttgccatgtgtacgtgtcagaagaccacctggatctgttgccccctcctgaggagcgcgaagatgacatgttggacatggcaccgctgctccaggagaactcacggctgggttgccagattgttttgacacccgaactggaaggcgcagagtttaccctgccaaagataactcgcaatttctacgtcgatggtcacgttcctaaacctcactag

SEQ ID NO: 50306 - DNA, 438 bp, Artificial Sequence
  Description of Artificial Sequence: Synthetic coding sequence
atgcatgtaatggccgcaagcatggccagagggggagtcagtgcacgcgtgcttctccaagccgctcgtggtacctggtggaaccgaccgggtggaacttcaggtagcggcgagggtgtggctctggggacgactcgtaaatttcaggccactggaagtcggccagccggtgaggaggacgcagggggacccgaaagaccaggggacgtcgtgaatgtcgtcttcgtcgaccgatcaggccagcgaatccccgtgagcggacgcgtgggagacaatgtgctgcaccttgctcagcggcatggagtagatctcgaaggagcctgcgaagccagcttggcgtgtagcacttgccatgtgtatgtaagcgaggaccatctggacttgctgcctcccccagaggaaagaaggacccgaggttgggctgccaggctctgctag

SEQ ID NO: 50307 - DNA, 552 bp, Artificial Sequence
  Description of Artificial Sequence: Synthetic coding sequence
atggcagggggacccccaaatacaaaggcagagatggaaatgtcactggcggaagagctcaaccacggacgccaaggggagaatcaggagcatctggtgatagccgagatgatggaacttgggtcccgtagccggggtgcatctcagaaaaaacagaagctcgagcaaaaagcggctgggtcagcctcggctaaacgtgtgtggaacatgaccgccactcgcccaaaaaagatggggtctcagttgcctaagcccaggatgctgcgagagagcgggcatggagatgctcatttacaggagtacgccggaaacttccaaggcatcagattccattatgatcgcaaccctgggaccgatgctgtcgctcagacctccctcgaagagtttaatgtactcgaaatggaggtcatgaggcgtcagctgtatgcggtcaaccgcaggcttcgcgcactcgaagagcagggtgcgacatggagacatcgtgaaacacttataattgcagtgctagtaagtgccagtatcgccaacctctggctctggatgaatcaatag

SEQ ID NO: 50308 - DNA, 1527 bp, Artificial Sequence
  Description of Artificial Sequence: Synthetic coding sequence
atggggtcctgttgcagctgccccgacaaggacaccgtgccagacaaccataggaataagttcaaagtgataaatgtcgacgacgatgggaacgaactgggatctggtatcatggaactgactgatacagagctcattttgtacaccaggaagcgcgacagtgttaaatggcactatctgtgcttgagaaggtatggatatgattccaacctgttttccttcgagagcggcagacggtgtcagacaggacaggggatttttgctttcaaatgtgctcgggctgaggaattattcaatatgctacaggagatcatgcaaaacaattctattaatgttgtggaagaacctgttgtggagcgcaataaccaccagacggaattagaggtgcccaggactccgagaacgccgacaaccccgggatttgccgcacagaacctgcctaacggctatccacggtatccatcctttggagacgcctcctctcacccatcatcaagacatccgtcagtgggctccgccaggttgcctagtgttggcgaagaatcaacccatccactgctagtagccgaagagcaggtgcacacttatgtgaataccacaggcgtgcaggaagaaagaaaaaaccgcaccagtgtccatgtgcctctcgaagccagagtttcaaacgcagaatccagcacccctaaagaggaacctagtagcatcgaagatagggatcctcagattttgctggagccggagggcgtcaagtttgtgctgggccctactccggtacagaaacagctaatggagaaagagaaactcgaacagctcgggcgagaccaggtgagcgggagtggcgcaaacaataccgaatgggatacaggctatgacagtgatgagcggagggacgcccctagtgttaataagctggtatatgagaacattaatggcctgagtatcccatctgcctcaggcgtgcgacgagggagattgacttcaacttctacaagtgacacccagaacatcaataatagcgctcagaggcgcaccgcactgctgaattatgaaaatctccccagtcttccccctgtttgggaggctagaaagcttagccgggatgaggacgataatctcggccctaagaccccgtccttaaacgggtaccacaacaatctggaccctatgcacaactacgtgaatactgagaacgtgaccgtcccagccagcgcccacaagatcgagtacagtcggagacgcgactgcacaccaacagtcttcaactttgacatcaggcgaccatcactagagcatagacagctgaattatatccaagtcgatttggaaggagggtccgacagcgataacccacaaactccaaagaccccaactactcctttgccacagactcctactcgtcggaccgaactctacgctgtgattgatattgaaagaacagctgctatgagcaacctgcagaaagcgttacctagggacgacggcactagcagaaaaacaaggcacaatagtaccgacctcccgatgtag

SEQ ID NO: 50309 - DNA, 1527 bp, Artificial Sequence
  Description of Artificial Sequence: Synthetic coding sequence
atggggtcatgctgcagctgtccagataaagatacggttcctgacaatcatagaaacaagttcaaggtgattaatgtagatgatgatggcaatgaactgggatctggaatcatggagctgaccgataccgagctgattctgtacactcgcaaaagggactcagtgaaatggcattacctgtgccttaggagatacggttacgacagcaacctgttttccttcgaatccggcagaaggtgccagacaggccaaggcatatttgcattcaagtgcgccagggccgaggaactgtttaatatgttgcaggagattatgcagaataactccatcaacgtcgtggaagagcccgtcgtcgagagaaacaaccaccagaccgaactggaagttccccgtactccacggaccccaacaacccctggctttgccgcacagaatttaccaaacggatacccaagatacccttcctttggggacgcctcatcgcacccatctagccggcacccaagcgttgggtccgccaggttgcccagtgttggcgaggagagtactcaccctctgctcgtcgccgaggaacaggtccatacatacgtgaatacgacaggagtgcaggaggaacgtaagaaccgtacaagcgttcatgtgccgctcgaggcaagagtgagcaacgccgaaagctcaacccccaaggaggagccgtcttctattgaagatcgggacccccaaatcctgttggaacccgaaggcgtcaagtttgttcttggtcccacccccgtccagaagcagttaatggaaaaggaaaaactagaacagttgggtagagaccaggtctcagggtctggtgccaacaatacggagtgggatacagggtacgactctgacgagcggagggacgcgcctagcgtgaacaagctggtgtatgagaatattaatggactatccattccctcggcttccggagtgcggcgtggcagactgacctcaacttctacgagcgacacacagaacatcaacaatagcgctcaaagaaggaccgctttgttgaattatgaaaacctcccaagcctgcctccagtttgggaagcgcgtaagctatccagagacgaagatgacaacctggggcctaagactccatccctgaacggttaccacaataatcttgaccctatgcacaattacgtcaacacagagaatgtaactgttcccgcaagcgcccacaaaattgagtactcaaggcgacgggattgcacccccacggtcttcaactttgatatacgcagaccgagtctcgaacaccgacagctgaattacattcaagtggatctggaaggcggaagcgattccgataacccacagaccccgaagactccgacgacaccccttccacagactccgacacgtaggactgagctttacgccgttatcgacatcgaacgaaccgctgctatgtcaaacctccaaaaggcgctgcctcgagatgatggcacttcccgaaaaactcgccacaactccaccgatctgccaatgtag

SEQ ID NO: 50310 - DNA, 111 bp, Artificial Sequence
  Description of Artificial Sequence: Synthetic coding sequence
atggggtcttgctgcagctgtccagataaggatacagttcctgataaccaccgtaataagttcaaagtgataaatgtagacgacgatgggaacgagctcggcagtgggtag

SEQ ID NO: 50311 - DNA, 123 bp, Artificial Sequence
  Description of Artificial Sequence: Synthetic coding sequence
atggggtcctgctgctcttgcccagacaaggacaccgtgcccgacaaccacagaaataaattcaaagtgattaacgtggacgatgatggaaacgaattggggtctgggattatggagctgtag

SEQ ID NO: 50312 - DNA, 102 bp, Artificial Sequence
  Description of Artificial Sequence: Synthetic coding sequence
atgggcagctgctgcagttgtcctgataaggatactgttcccgacaatcacagaaacaagtttaaggttataaacgtggacgatgatggcaatgaactgtag

SEQ ID NO: 50313 - DNA, 1527 bp, Artificial Sequence
  Description of Artificial Sequence: Synthetic coding sequence
atgggatcttgttgctcctgccctgataaggacaccgtccctgataaccacaggaataagtttaaggtgatcaacgtggatgacgatgggaacgaattagggtctgggattatggagctgaccgatacggagttgatattgtatacacgcaagcgtgattcagtgaagtggcattacttatgtttgcgtcgctacgggtacgatagtaatctgttttctttcgaatccggcaggagatgtcagaccggccaaggtatctttgccttcaagtgtgccagggccgaagagctgttcaacatgttacaggaaattatgcagaacaatagtatcaacgtggtggaggaaccggtggtggaaaggaacaaccaccagacagagcttgaggtgcctcggacaccacgaacccccacaaccccgggttttgctgcacagaatttaccaaacggctatccacggtacccttcatttggagacgccagttcacatccttcctctagacatccctccgtaggtagtgcccgtctgccttctgtgggagaggaatcaacccatccccttctggtggccgaggagcaggtgcatacctatgttaacacaacgggtgttcaagaggagcggaagaatcgtacaagtgtgcatgtcccattggaggctagagtgagtaatgcggagagtagcacccccaaggaagagccatcctcaatcgaggatcgggacccacaaatcttacttgagcccgagggcgtcaagtttgttctcggcccaacaccggtgcagaagcagctgatggagaaagagaagctcgagcagctaggcagagaccaggtctctggttccggggctaataacaccgagtgggatactggatacgactcagatgagcggcgtgatgcccctagcgtgaataaattggtttacgagaatataaacggcctttctatcccatcagcctcgggtgtccgccgaggacgcctgacgagtaccagcacctccgacacacagaatattaataactcagcccagcggaggacagctctgctgaattatgagaatctcccaagcctgccacccgtctgggaggcacgtaagctctcgagggacgaggacgacaaccttgggccaaaaaccccgtcgctaaacgggtaccataacaatctcgacccaatgcacaactacgttaacactgagaatgtgaccgtgccagcatcggctcataaaatcgagtatagtaggaggcgcgactgtactccaacagtctttaactttgatatccggaggccaagcctggagcatcgacaactcaactatattcaggtggatctggaagggggaagcgactcggataatccccagaccccaaagacgcccacgaccccccttccccagactcccacaaggcgcaccgaattgtacgctgtaattgatatcgaaagaaccgccgcaatgtccaacctccaaaaggcgttgccgagggacgacggaacttcgagaaagacacgccacaattcaaccgatctgcctatgtag

SEQ ID NO: 50314 - DNA, 33 bp, Artificial Sequence
  Description of Artificial Sequence: Synthetic coding sequence
atgggcagctgctgcagttgtcctgacaagtag

SEQ ID NO: 50315 - DNA, 39 bp, Artificial Sequence
  Description of Artificial Sequence: Synthetic coding sequence
atgggaagttgttgcagttgccccgacaaggatacatag

SEQ ID NO: 50316 - DNA, 1527 bp, Artificial Sequence
  Description of Artificial Sequence: Synthetic coding sequence
atgggatcatgctgctcctgtcccgataaagatactgtgcctgacaaccaccggaacaaatttaaggtgatcaacgtagatgacgatggaaacgaactgggaagtggaatcatggagttaactgacacagaacttatcctctacactaggaagagggacagtgttaaatggcactatctgtgcttacgtcggtacggttatgactcaaatttattctcttttgaatcaggcaggagatgtcagacaggacaggggatctttgcctttaagtgtgcacgcgcagaggagctctttaatatgctacaggagattatgcaaaataatagcatcaatgtagtggaggagcctgtggtggagcgcaataatcatcagactgagctcgaggtgccacgcactccacgtacacctacaactcccggttttgctgcccaaaatctgccgaacggctaccccaggtatccatcttttggcgacgccagtagccacccatctagtagacatcccagtgtaggcagcgcacgtctcccatctgttggcgaggaatccacgcacccgcttcttgtggcggaggaacaggtgcatacctacgtcaataccacgggggtgcaagaggaaagaaagaatcggacaagtgttcacgtacccttagaggctcgagtgagcaacgccgaaagttccacccccaaggaggaacccagttctatcgaagatagagacccccagatactgctggagcctgagggtgtcaagtttgtgctgggccctaccccagtccaaaaacagctgatggagaaggagaaactggagcagttagggagggatcaggtgtcagggagtggagcaaacaataccgaatgggatacagggtacgacagcgacgagagacgtgacgcccctagcgttaacaagctggtgtacgagaacatcaacggcctgtcgataccttccgctagtggcgtccgaagagggcgtctgacatctaccagcacatccgatacacagaatataaacaactccgcgcagaggcgaaccgcacttctgaactacgagaaccttcccagcctcccgcctgtttgggaggctcgaaaactgtcacgcgacgaagacgacaacctgggacccaagaccccctccctcaacggctatcacaataacctggatccgatgcacaactatgttaataccgagaacgtgacggtcccggcttctgcacataagattgagtactccaggagacgcgactgcacccctacggtgttcaatttcgacatcagaaggccttccctagaacacagacaactcaactacatccaagtggatcttgagggaggctccgacagcgacaatccacaaacgccgaaaacacctaccacaccccttccgcagactccgaccaggcggaccgaactgtacgccgtgattgacattgagcgtaccgccgctatgtctaacctccagaaggccttacccagggatgatggaaccagccgcaagaccagacacaattctaccgacctgccaatgtag

SEQ ID NO: 50317 - DNA, 276 bp, Artificial Sequence
  Description of Artificial Sequence: Synthetic coding sequence
atgggcagctgttgttcatgtcctgataaagatacagtccccgacaatcaccgaaacaaattcaaagttatcaacgtcgatgacgacggaaacgagcttgggagtggtatcatggagctgacagacacagagctcatcctttacacgcgcaaaagagattccgtgaaatggcactatttatgcctgcggagatatggctatgacagcaacctgttcagctttgaatccgggagacgttgtcagacaggacagggcatcttcgcttttaagtgttag

SEQ ID NO: 50318 - DNA, 552 bp, Artificial Sequence
  Description of Artificial Sequence: Synthetic coding sequence
atgggaagctgttgctcctgccctgataaggataccgttccggacaaccaccgaaataagttcaaagtgataaacgtggacgacgacggcaacgaactggggtcggggattatggagctaaccgatacggagctgatcctctacacacgaaagagagatagtgtgaagtggcattatctctgtctgagaagatatgggtatgactccaacctgttcagcttcgagagtggcagacggtgccaaaccggccaaggaattttcgcctttaagtgcgcacgggcagaagaattatttaacatgcttcaggaaattatgcagaacaactcgatcaatgtggtggaggagcctgtggtggaaaggaacaaccatcagacggaacttgaagtgcccagaacaccacggactcccaccacgccgggattcgccgctcaaaaccttccaaacggctatcccagatatccttctttcggagacgcatcgtcccatccaagttccaggcacccctcagttgggtccgcgaggctgccgtccgtgggcgaagagtctacttag

SEQ ID NO: 50319 - DNA, 1479 bp, Artificial Sequence
  Description of Artificial Sequence: Synthetic coding sequence
atgggaagttgttgttcgtgtctgaaccgggatagtgtgcccgacaatcacccaaccaaatttaaggtcaccaacgtcgatgacgagggagtggagctgggttcaggggtgatggagctgactcagagtgagctggtgctccatttgcacaggagggaagcggtgcgctggccttatctttgccttagaaggtatgggtatgattctaacctgttttcattcgagagtggtcgcaggtgtcagacagggcagggaatctttgcgtttaagtgctctcgggctgaggagatcttcaacttactgcaggatctgatgcagtgcaatagtatcaacgtcatggaggaacccgtaattattacacgtaactctcacccggcagagttagatctgccacgggctccccagcctcctaatgcattgggctacaccgtatccagctttagtaatgggtgccccggtgaaggacctcggttcagtgccccacggcgactaagtaccagtagcctgagacacccaagcttgggggaggaatcgactcacgcactgatcgctcccgatgagcagagccatacctatgttaacaccccggcttcggaggatgatcatcgaagaggcagacattgcttacagcccctgcccgaggggcaagccccattcctcccccaagccagaggaccagatcaaagggatcctcaggtatttctgcagccgggtcaggtcaaatttgtgctgggtcctactccggcaaggaggcacatggttaagtgtcagggcctctgtccatcactgcacgatcctccacatcacaataacaataatgaggctcctagcgagtgccccgcacaacccaagtgcacctatgagaacgttaccggcggactgtggaggggggctgggtggaggctgagtccagaagagcctggctggaacggtttggcccacagaagggccgctctcttgcactatgagaacttgcctccccttccacccgtatgggaatcccaagctcaacagttgggcggagaagccggtgacgacggcgactctcgtgacggccttacaccgagctctaacgggtttcccgatggagaagaagacgaaaccccgctccaaaagccaactagcactagggccgcaatccgctcccatggctccttccccgtaccgctcacccggagacgtggcagtcctagggtatttaacttcgattttcggaggcctgggccagaacctcccagacagctgaattacattcaagtggaactgaaaggctggggcggagacaggccaaagggaccccagaatcccagcagcccccaggccccaatgccgaccacccatcccgcaaggtcctcagattcgtacgccgtgatagacctcaagaagacagttgctatgagcaatcttcagcgagccctccccagggacgacggaaccgcgagaaaaacccgccataacagtaccgaccttcctctgtag

SEQ ID NO: 50320 - DNA, 1479 bp, Artificial Sequence
  Description of Artificial Sequence: Synthetic coding sequence
atgggtagttgttgcagctgcctgaatagagacagtgttcccgataatcacccaactaagtttaaagtgaccaacgtcgatgatgagggagttgaactcggctccggcgtcatggagttgacccagagcgaattagttctacatctgcatcgcagggaggccgtgcggtggccctatctgtgcctcaggaggtatggctacgactctaacttattctcattcgagtcaggccgtcgatgccaaactggacaaggtatttttgccttcaagtgctccagagctgaggagattttcaacctcctgcaggacctgatgcaatgcaattctatcaacgttatggaggaacccgtaattatcactcgcaactctcacccagccgaattagatttacccagggcccctcagccacctaacgccctaggatacacggtgtcctccttttcaaatggatgtccaggggagggaccccgttttagcgccccaagacggctgtctacgtcctccctccgtcacccatcactaggagaagaatctacccacgccctgattgcaccggacgagcagtcccatacctatgtgaacacccctgccagtgaagatgatcatcgtcggggtcgccattgcttgcagcctctacccgaagggcaggcccctttcctcccccaggccagaggtccagaccagcgggacccgcaggtgttcttgcagcctgggcaggtaaaatttgtactgggacctacgcctgcaaggcgccatatggtgaaatgtcagggcctctgtccaagcctgcacgatcccccacatcacaacaataataacgaggccccttccgagtgtccagcccagccaaaatgcacctacgagaatgtgactgggggtctctggcggggtgcaggctggagactctctcccgaagagcctgggtggaatggacttgcacatcggcgagccgctctgctgcactacgagaacctcccgcctctgcccccagtctgggaaagccaggcccagcagctcgggggagaggctggtgatgacggagattcccgggacggactgactccaagctcaaacgggtttccagatggcgaggaggatgagacaccactgcagaaacctacatcaactagagccgctatcaggagtcacggcagttttcctgttccgctgactagaagacgaggtagtccaagagtgttcaatttcgatttccgcagaccagggccagagccccctagacagctcaattacatccaggttgaactaaagggatggggcggagaccgcccaaaaggtccgcagaatcctagctcaccccaggcacccatgccaaccacacatcccgcaaggtcaagcgactcttacgctgtgatagacctgaagaagaccgtggccatgtctaaccttcagcgggcactgcccagggacgatggaacagcccgtaagacgaggcacaacagtaccgacctgcccctgtag

SEQ ID NO: 50321 - DNA, 111 bp, Artificial Sequence
  Description of Artificial Sequence: Synthetic coding sequence
atgggctcatgctgcagttgcctgaatcgtgattccgtgccagataaccatcccacaaagttcaaggtcacaaatgtcgatgacgaaggagtggaactgggatctggatag

SEQ ID NO: 50322 - DNA, 444 bp, Artificial Sequence
  Description of Artificial Sequence: Synthetic coding sequence
atggagaccccacgtcgagccagaagtccagtaagtccccagttcccaggccaggctgggtgctcagatacaatggggtcttgttgttcatgcttgaaccgcgactccgttccagataaccacccaacaaagttcaaggtcaccaacgtggacgatgaaggtgtcgaactcgggagtggggtgatggagctgacccagtcagagctggtgcttcacctccatcgcagggaggccgtgaggtggccctacctttgtctgagacgctatggatatgactccaacctgtttagtttcgaatcagggaggcgatgccagaccggccagggaatcttcgcattcaaatgttccagagccgaggagatctttaacctcctccaggacctgatgcagtgtaacagcattaacgtcatggaagaacccgtcatcataacccgaaactcatag

SEQ ID NO: 50323 - DNA, 3405 bp, Artificial Sequence
  Description of Artificial Sequence: Synthetic coding sequence
atgatgagcccaaatggatcagtcccccctatctatgtcccaccgggttatgccccacaggtaattgaagacaatggtgtgagacgcgttgtagtggtcccacaggctcccgagttccacccaggctcccacacagtcctccatagaagcccacatcccccactgccgggattcataccagtgcccaccatgatgcctcctcccccacggcacatgtactctccagttactggcgcaggggatatgacaacccagtacatgccccaataccaatcctcacaggtttatggtgatgtggatgctcacagcacgcacggccgatctaatttccgtgatgagcggagcagtaagacgtacgagcggctccaaaaaaaactgaaagaccggcagggcacgcaaaaggacaaaatgtcatctccacccagctcccctcaaaagtgccccagtcccatcaatgaacataatggcttaataaaggggcagatcgctggtggcattaacaccgggagcgccaaaattaagtccggaaagggcaaaggtggcacacaggtggataccgagatcgaagagaaagatgaagagaccaaggctttcgaggccctcctgagcaatattgtgaaacccgtcgcatcagacatacaggcccgtacagttgtgctgacttggagcccaccttcctccctaattaacggcgagaccgatgaaagtagtgtaccagagctatacggatatgaggtgctgatctcgagtacaggtaaagacggcaagtacaagtcggtgtatgtgggagaagaaacaaatattaccctgaacgatttgaaaccagcgatggattaccacgcaaaagtacaggcagagtacaatagtattaagggcaccccctcagaggccgaaatcttcacaacattatcctgcgaacccgatatccctaacccccctcgtatcgccaaccgtactaaaaactccctcaccctgcagtggaaggcaccctctgataacggtagtaaaattcagaactttgtcctcgaatgggacgaggggaaaggcaatggggagttttgtcaatgctatatgggaagccagaaacaattcaaaatcaccaagttgagccctgcaatgggttgcaagttcagattgagtgctcgcaacgactacggcacatcaggattctctgaagaggtgctttattatacatcggggtgcgcaccttcgatgcccgctagcccagtgctgacaaaggctgggataacctggctgtctttacaatggagtaagcctagcggaacacccagtgatgaaggaatcagttatattttagaaatggaggaagaaacatccggctatggcttcaagcccaagtacgatggcgaagacctggcttatactgtgaagaacctgaggagatccaccaaatacaagtttaaggttatagcatacaattctgaaggcaaatccaatccttcagaggtggtagagttcaccacatgtcctgataaacccggaatccccgtcaaacctagcgtgaagggcaagatccactctcatagcttcaaaattacttgggacccccctaaggacaacgggggagcaaccatcaacaagtacgtggtggagatggccgagggctctaacggcaacaagtgggagatgatttatagtggggcaacccgcgaacacctgtgtgatcgtcttaatccaggatgcttttacagacttcgcgtgtactgcatcagcgacgggggacagtcagccgtttctgagagcttgctggtccagactccagctgtaccacccggtccctgcctcccacctagactccaaggcaggccgaaggcaaaggagatccaactgaggtggggcccacccctggtcgacggcggatctcccataagctgttattcagtggagatgagtcccatcgagaaggatgagccacgcgaagtgtaccagggaagtgaagttgaatgtaccgtcagctccttgctccctggaaaaacctattctttccggttgcgggctgcaaacaagatgggcttcgggccattctcggaaaaatgcgacataactacagcaccgggacctcctgaccagtgcaaaccacctcaggtcacttgccgttctgccacttgcgctcaggtgaactgggaagttccattatctaacggaaccgatgtgaccgaataccggctggagtggggcggtgtggagggaagcatgcagatctgctactgtgggcctggcttgagctacgaaataaagggcttaagtcctgctaccacatactactgtcgtgtgcaagctctgagcgttgtcggcgctgggccatttagcgaggtggtcgcatgtgtaaccccacccagcgttcccggtatcgtcacgtgtctccaagagatctctgacgatgaaattgaaaacccgcactatagcccttctacctgtttggcaatcagctgggagaagccctgcgaccacgggtctgagatcttggcttacagtattgacttcggtgacaagcaatcgctaaccgtgggaaaagtgacgtcatacattatcaataacttgcagccagataccacataccgaatccgtatccaagcccttaacagcctaggagccggacccttcagtcatatgatcaagttaaaaactaaacctctcccaccagatccccctcggttagagtgtgtcgccttcagccaccagaatctcaagctgaagtggggagaggggacccccaaaacgctatcaaccgatagcattcagtatcaccttcagatggaggataagaacgggagattcgtcagcctgtatcgcggaccatgccacacttacaaggttcagcgcctcaatgaatctaccagttacaaattttgtatccaggcttgtaatgaggccggagaagggccactgagccaggaatacatctttaccacccctaagagcgttcccgctgcactcaaagccccaaaaattgagaaagtgaacgatcacatttgcgagatcacgtgggagtgcctgcagccaatgaaaggtgacccggtaatctattctcttcaggtgatgttggggaaagacagcgagttcaagcagatctacaaaggccctgattctagcttccgttatagttcgttgcagctcaactgtgaataccggttcagggtgtgtgctatccgtcagtgccaggactcccttggtcatcaggatctggttggaccttactctactaccgttcttttcatctcccagagaaccgagccccctgcctccactaatcgcgatacagtcgaatctacccgcacgaggcgagccctcagcgacgagcagtgcgccgcagtgatcctagtgttattcgcattcttctctatactcatcgccttcatcattcaatactttgtcataaaatag

SEQ ID NO: 50324 - DNA, 3429 bp, Artificial Sequence
  Description of Artificial Sequence: Synthetic coding sequence
atgagtggaccggcacaggtgcctatgatgagtccaaatggctccgtgccgcctatctatgtacccccaggctacgcacctcaagtgatagaggacaacggagtgagacgcgttgtcgtggtcccccaggcgcctgagttccaccccggatcacatacagtattacaccgctcccctcatcctcccctgcccggattcattcccgtccccacaatgatgcctcccccaccccgacatatgtattcacccgtaacaggggctggagacatgactacccagtatatgccacagtatcaatcaagccaggtgtacggagacgtggatgctcacagcacccacggcaggagtaattttcgcgatgaacggtctagtaaaacatacgagcgcctccaaaagaaactaaaggaccgacagggtacccagaaggataaaatgagctctcctccgtccagccctcagaaatgcccatcccctattaacgaacataacgggctgattaagggccaaatcgcaggcggtatcaacaccgggagcgccaagattaaatcaggcaagggaaagggcggtacgcaggtcgatacggagatcgaggaaaaggacgaagagacaaaagcatttgaggcattattgagtaatatcgtaaagcccgtggcctcagacatccaagccaggactgtcgtcttgacctggtctccccctagctctctgattaatggggagaccgacgaatcttctgtcccagagctttacggctatgaagtgctgatttcctctaccgggaaagatggcaaatataagtctgtctacgtaggagaggaaacaaacatcaccctcaatgatttgaagccggcaatggattatcacgcaaaagtgcaggcggagtacaactctatcaaaggtacgcctagcgaggccgagatatttacaacactgagctgcgaacctgacattcccaatcctcccagaattgccaataggaccaagaacagcctgactctacagtggaaagccccttcagataacgggtctaagatccaaaatttcgtgctagagtgggacgagggcaaaggcaacggggaattctgtcagtgttacatgggatcccagaagcagttcaaaataaccaaactatctccggcaatgggttgtaagttccggttatcggcccgtaatgattacggcacatccggcttctctgaagaggttttatattatacatccggctgtgcccctagtatgcccgcaagtccagtgctcacaaaagccggaatcacctggctaagtttgcagtggtctaaacccagcggcaccccatctgatgagggaattagttacatcctggaaatggaagaggaaacctccggctatggattcaagcctaagtacgatggcgaggatcttgcctacacagtgaagaacctccggagaagcactaaatacaagtttaaggtgatcgcatacaatagtgagggtaaatctaatccttccgaggtggtggagtttacgacatgccctgacaaaccgggtattcctgtaaaaccatccgtgaaggggaaaatccattctcattcttttaaaattacctgggatccgccaaaagacaacggcggagctacaattaataagtacgttgttgaaatggccgagggatctaatgggaacaagtgggaaatgatttatagcggcgctacaagagagcacctatgtgaccgccttaaccccggttgcttctaccgcctaagggtctactgtatcagcgacggaggacagtctgccgtctccgagtcccttttggtccagaccccagcagttccacccggaccttgcctacctcctagactccaggggcgtccaaaagccaaggagatacaactgcggtgggggcctcccttggtagacgggggatcccccatttcttgttactctgttgaaatgtcccccatcgagaaagacgaaccacgtgaagtctatcagggcagtgaagtggaatgtacggtgagctcccttctcccgggaaaaacgtacagctttaggctgcgtgcagccaacaagatgggatttgggcctttctccgagaagtgcgatatcaccacagcccctggtccaccggatcagtgtaaacccccacaggtgacgtgcagatctgccacttgcgcccaggtcaattgggaggtgccactgtccaacggcaccgatgtgaccgaataccggctggagtggggaggagttgaaggcagcatgcagatctgctattgtggacctggtctgtcatacgagattaaagggctctctcccgcaaccacttattattgtagggttcaggcactgtccgtcgtgggggcagggccattcagtgaggtggttgcctgcgtcaccccgcctagtgttccgggtatcgttacgtgtctgcaagagatttccgatgatgagatcgagaacccacattatagtccgtctacttgcttggctatttcctgggagaagccatgcgatcacgggtccgagatactagcatatagcattgattttggcgataagcaatcactgacagtcggaaaagtgactagctatatcatcaacaacctccagcccgatacaacataccgaatacgcattcaagctctgaactctttaggagcaggccctttcagtcatatgatcaaacttaaaacaaaacccctgccccctgacccacctaggctggagtgcgttgccttcagtcaccagaatctgaaactcaaatggggggaggggacacccaagacattgtccactgacagcatccagtaccacctccagatggaggacaagaacggtagattcgtatcgctctaccgtggaccttgccacacctataaagtgcagcggttgaacgaaagtaccagctacaagttctgtattcaggcctgcaatgaggctggggaggggcctctaagtcaggagtacatattcactactcctaagagtgttcctgctgccttgaaagcccctaagatcgaaaaagtaaatgaccacatctgtgaaatcacgtgggagtgtctgcagccgatgaagggggaccccgtcatctacagcctccaggtgatgctgggaaaggatagcgaatttaaacagatctacaaaggcccagatagtagttttagatattcctctttgcagctaaattgtgagtatcggttcagggtctgtgccatacgtcaatgccaggatagcttaggccatcaggacctggtaggcccttacagcactacagttctcttcatttcacagcgtactgaacctcctgccagtactaatcgagacaccgtcgagtctacccggacacgccgtgccctctccgatgaacaatgcgccgcagttatactggttctgttcgctttcttctctattctgatcgcttttatcatccaatatttcgtgataaagtag

SEQ ID NO: 50325 - DNA, 3597 bp, Artificial Sequence
  Description of Artificial Sequence: Synthetic coding sequence
atggcggagcaccctcctttgctggacacaacacagattctcagctccgacatatctctcctcagtgcccctatcgtctctgcagacggcactcagcaagtaatactggtgcaggtcaatcctggcgaggcttttacgatcaggcgagaagatggccagtttcagtgcatcaccggcccagcccaagttcccatgatgtctccaaacgggagcgtgccgcctatatatgtaccacctgggtacgctcctcaagtgatagaggataacggagtgaggcgtgtcgttgttgtccctcaagcaccagaattccatcctgggtctcatactgtgttacaccgctccccccaccctcctctaccaggttttatccctgtcccaacaatgatgcccccacctcctcgtcatatgtattctccagttaccggagcgggtgatatgacgacacaatatatgccccaatatcagtcaagccaagtgtacggggacgtggatgcccacagcacacacggccgttccaacttcagggacgagaggagctctaagacctacgagaggttacagaagaagctgaaggacaggcaggggacacagaaggacaagatgtcgtctcccccatcaagcccacaaaagtgcccttccccgatcaatgagcacaacgggctaattaaggggcagatcgccggaggcattaatactgggagcgcaaagattaagtccggcaaaggcaaaggaggaacccaggtcgacaccgagatcgaggaaaaggacgaagagacaaaggcctttgaggcactgctgtcaaatatagtgaagccagtcgcatcggatatacaggccagaacggtggttctgacatggtcccccccatctagcctgattaacggagaaactgacgaatccagcgttcccgagctgtacggttacgaggtgctgatttccagcactgggaaggacgggaagtataagtcagtatatgtgggggaagagacgaatatcacacttaacgatctgaagccagccatggattaccatgcgaaggtccaggcggagtataatagtatcaaggggacaccctccgaagcagagatctttaccaccctgtcctgtgagcccgacataccaaaccccccacgaatcgccaaccgcactaagaactccctcacacttcaatggaaagcgccttcagacaacggctctaagattcagaactttgtgttagagtgggacgagggaaaagggaacggtgaattctgtcagtgctatatgggctctcaaaaacagtttaagatcacaaagctgagtcctgccatgggctgcaaattccgactgagtgcgagaaacgactatggcacctcaggcttctccgaggaagtgttatattacacaagcggctgtgcccctagcatgccggctagccccgttctgactaaggctggaattacctggttgtctctgcagtggtccaagccaagtgggacacccagcgatgagggcatctcctatatcctagaaatggaagaggagacgagcggctacgggtttaaaccaaaatatgacggcgaggacttggcctacacagtgaaaaacctcagacgctctactaaatacaagtttaaggtcattgcttacaactctgagggcaagagcaaccctagcgaagttgtcgagttcacgacttgccctgataagcctggcatcccagtcaaaccttccgtcaaaggaaagattcactctcattcatttaaaatcacatgggaccccccaaaagacaacggaggtgccacaataaacaaatacgttgttgaaatggccgaaggcagtaatggcaacaaatgggagatgatttactcaggggctactagggaacatttatgcgatagacttaaccctggttgtttctaccgcctgagggtgtactgcatttccgatggcggtcagtccgcagtgtcagagtccctcctggtgcagacacctgcggtgccaccaggtccctgtcttcctcctcgcctgcagggacggccaaaagctaaagagatccagctgcgctgggggcctccacttgtagatgggggatccccgattagctgttacagcgtcgaaatgagcccaatcgagaaagatgaaccaagagaggtgtaccagggctctgaggtcgagtgtacggtgagctccctcctgcccggtaaaacttactccttcagactacgagcagctaacaagatgggtttcggaccattttccgaaaaatgcgatattaccaccgccccaggcccacctgaccagtgcaaaccaccccaagttacctgcagatccgcaacgtgcgcccaggttaactgggaggtacctctgtcgaatgggacggatgtgactgaataccgactcgaatggggcggtgtagaggggagcatgcagatctgctattgtggtcctggactgagttatgagattaaagggctcagcccggcaacaacatactattgccgcgtacaggccctcagtgtcgttggagccggtccatttagtgaggtggtcgcctgtgtcacgcctccctcagtgcccggtatcgttacctgcctacaggagattagcgatgatgagatcgagaacccccattacagcccttcaacctgcctggcgattagctgggaaaagccttgcgaccacggttctgaaattctggcttattcaatagactttggagataaacagagcctgaccgtggggaaagtgacctcctacattatcaataacctgcagcccgacaccacatacagaatcagaatccaggctctgaacagcctgggcgctggccctttcagtcacatgatcaagctgaaaacaaaacctctgccaccggacccacctcggcttgagtgtgtggctttttcccaccaaaacttaaaactgaaatggggtgaaggcaccccaaaaaccctgagcaccgactcaatccagtaccacctgcaaatggaagacaagaacggtaggttcgtttccctgtacagagggccttgccatacttataaggtgcagcgcctgaatgaatctacctcctataaattctgtattcaggcctgcaatgaggctggtgaggggccactctcccaagaatatatctttactacaccaaaaagcgtgccagccgctctgaaggcccctaagatcgaaaaagtaaatgatcacatctgcgaaattacctgggaatgcctgcagcccatgaaaggcgatcccgttatctattcccttcaagtgatgctgggcaaggattccgagttcaaacaaatctacaagggtcctgattcttcatttcggtacagcagtctgcagctgaattgtgagtacagatttcgcgtttgcgccattagacagtgtcaggacagtctcggccaccaggatcttgtgggtccatacagcacgaccgttttattcatctctcagcgcacagagcctcccgctagtaccaatcgcgacacagttgagagcacccggactagacgagcactgtccgatgaacagtgcgccgctgtgatactggtgctctttgccttcttttctatcttgatcgcgttcatcatccagtactttgtgattaagtag

SEQ ID NO: 50326 - DNA, 3597 bp, Artificial Sequence
  Description of Artificial Sequence: Synthetic coding sequence
atggcagaacacccaccgttactcgacacaacccagattctgagcagtgacatctctttgctgtcagctcctatagtgtcagctgacgggacacaacaggtcatcctcgtccaagttaacccaggggaagcatttacaatcaggagagaagacggccaatttcagtgcataactggacctgctcaagttccaatgatgtcccccaacgggagtgttccacccatctacgtcccacccggatatgcccctcaggtcatcgaggataacggcgtgcgtagggtcgtggtcgtgccacaagcgcctgaattccacccaggaagccacactgtcctccacagatctccacaccctccactccctgggtttattcctgtgcccactatgatgccacccccaccacggcatatgtactcccccgtgacaggagcaggggatatgaccacacagtatatgccgcagtaccagtcttctcaggtgtatggggatgtcgacgctcatagtacacacggcaggtcgaatttccgcgacgagcgctcttcaaaaacctatgagcggcttcagaaaaaactaaaagaccgccagggaacccaaaaagacaagatgtccagtccaccttcaagcccccagaagtgcccaagccctatcaacgaacacaacggattgattaaagggcaaatcgcaggcggaatcaacaccgggagcgccaagataaagtccgggaagggcaagggaggcacccaggttgataccgagatcgaggagaaagatgaggaaaccaaggcgtttgaggcactcctgagcaacattgtgaaacctgttgcatctgacatacaagcacgcaccgtggtcctgacatggagtcccccatcctccctgataaacggtgaaactgacgaaagttctgttcccgaattgtatggctacgaagtgctgatctcaagcacgggcaaagacgggaagtacaagtcagtgtacgtgggcgaggaaactaatattacactaaacgatttgaagccagctatggactaccacgctaaggtgcaggcggagtacaacagcataaaggggacaccctcagaggcagaaatatttacaacgctctcctgcgagcccgacattcccaatccacctcgtatcgccaaccgaacaaagaactcgctgacgctgcagtggaaggcccctagtgacaacggtagtaagatccaaaactttgttctggaatgggatgaaggcaaaggaaacggtgagttctgtcaatgttacatgggctcccagaagcagttcaaaattacaaagctttcgcccgcaatggggtgcaagtttaggttaagcgctcgtaacgactatgggacctccggtttcagtgaggaagttctgtattacacttctgggtgcgctccatctatgcccgcaagccccgtcctcaccaaagctggcataacctggttgagtctgcaatggagcaaacctagcggcacccccagcgatgagggcatctcttatatccttgagatggaggaggaaacgtccggttatggattcaaaccaaagtacgatggagaggacttggcctacaccgtgaagaatctcagaagaagtacaaaatacaagttcaaagtgatagcatacaattcagaaggcaagtcgaacccatccgaggtggtcgaattcacaacctgcccagacaagcccggaatcccagtcaagcctagcgtgaaaggcaaaatccacagtcactctttcaagattacatgggatcctcctaaggacaatggtggcgcaacgatcaacaaatatgtggtggaaatggccgagggcagcaatggcaacaaatgggaaatgatttactctggcgctaccagagaacatttgtgcgataggctgaatccaggctgtttttacaggctccgagtgtactgtattagcgacggaggccagtcggcggtgagtgagagcctcttagtccagacacctgcagtgccccctgggccttgcttacctccaagattacagggcagacctaaggctaaggagatccagttaaggtggggtccacctctcgttgatgggggtagtccaatttcttgttattccgttgaaatgtccccaattgagaaggacgagcctcgtgaagtgtatcaaggctccgaagtcgagtgtactgtgagcagtcttctgccgggaaagacctatagcttcaggctgcgggcagccaacaagatgggcttcggcccatttagcgaaaaatgcgatatcactactgcaccaggacccccagatcagtgcaagccccctcaggtcacctgtagaagtgcaacttgcgctcaggtgaattgggaagttcccttgtctaatggaaccgatgtcacagaatatcggttggagtgggggggtgtggaaggctctatgcagatttgttactgtggtcctggtctgagctacgaaatcaagggcctatctccggctaccacgtattattgtagagtgcaggcactgtcagtggttggagcagggcctttttcagaggtcgtggcttgtgttacgcccccaagtgtaccaggaatcgtgacatgtctgcaggagattagcgatgatgagatcgagaatcctcactactccccaagcacctgtctcgcaatcagctgggaaaaaccttgtgatcatgggagtgagatcctcgcctatagcatcgacttcggagataaacagtcgctgacagtcggcaaagtcacaagctacatcatcaataatctgcagcccgacaccacctatagaattcggattcaggctctcaatagtctcggcgcaggtccctttagccatatgataaagctcaagaccaagcctctccctccagatcctcccagacttgagtgtgtagccttctcgcaccagaatttgaaacttaaatggggggaggggacccccaaaacgctctccaccgactctatacagtaccacttgcagatggaggataagaatggccgattcgtcagcctctacagagggccatgccacacctacaaggttcagagacttaacgaatccactagctacaagttttgcatccaggcatgcaatgaagctggagagggcccactgagccaggaatacatattcaccacgcccaagtccgtacccgcagctctcaaggcccctaagatcgagaaggtcaacgatcacatctgcgaaatcacttgggagtgtctccaacctatgaaaggggatcccgtcatttacagtctgcaggtcatgctgggcaaagattcagaatttaaacagatttacaaaggccctgattctagctttcgatacagcagtctgcagttgaattgcgagtacaggttcagagtctgcgccattcgacaatgtcaggatagtctcggtcatcaggatttagtgggcccatactccaccaccgttcttttcatcagccagaggactgaacccccagctagtactaatagggatacggttgaatctactagaaccagacgggcactgagcgatgagcagtgtgccgctgtcattctagtgttgttcgcgttcttctcgattcttatcgccttcatcattcagtacttcgtcataaagtag

SEQ ID NO: 50327 - DNA, 2055 bp, Artificial Sequence
  Description of Artificial Sequence: Synthetic coding sequence
atggccgaacatccccctttgctcgacaccacgcagattctcagttcagatatcagtctgctctctgcccctattgtgtcagccgacggtacccagcaggtgatcctggttcaggtgaatccaggtgaggcctttaccatcagacgtgaagacggacagttccaatgtataactggccctgcccaggtgcctatgatgtctcccaacgggtctgtacccccaatatacgttcccccaggatatgcacctcaagttattgaagataacggggtgcggagggtggtggtggtcccccaggcccctgagtttcaccctggctcgcacaccgtactgcacagaagtccccaccccccattgcccggattcatacctgtacctactatgatgcctccaccccctcggcacatgtacagccccgtgacaggggctggggacatgactacccagtatatgccgcagtaccagtcctcccaggtatatggagacgtggacgctcacagcactcatggtaggtccaatttccgggacgaaaggtccagcaagacgtacgaacggctgcagaaaaagctaaaggataggcagggcacacagaaggacaagatgtctagccctccctcttctccccagaagtgtccttcccctatcaacgagcataatgggttgatcaagggacaaatcgcaggcggaatcaataccggcagcgccaaaatcaaaagcggaaagggcaaaggtgggacacaagttgatactgaaattgaggagaaagatgaagagacaaaagcctttgaagccctactgtcaaacatagtgaagcccgtcgcatcagacatccaggccagaaccgtagtgctgacatggagtcctcctagttccttgatcaacggggaaaccgacgaaagcagtgttcctgaactttatgggtacgaggtgcttatatcaagcaccggaaaggacggaaagtacaagagcgtgtatgttggggaagagactaacattactctgaatgatcttaagccggctatggattatcacgcgaaagttcaagctgagtataacagtattaagggaacaccctccgaagcagaaattttcactactctgtcatgtgaacccgacattcctaaccctccccgaatcgccaacagaacaaagaatagtctcacccttcaatggaaggccccatcggacaacggttcaaagatccagaatttcgtcctggaatgggatgaaggtaaaggaaatggcgaattctgccagtgctacatgggcagccagaaacaattcaagatcaccaaattaagtcctgcgatggggtgtaagttccgcctgtctgccaggaacgactacgggaccagcgggtttagcgaggaagtgctgtactacacatccggctgtgccccatccatgccggcaagtcccgtactgactaaggctggcataacctggctgtctctgcagtggtctaagcctagcggaacgccttcagacgaagggatttcctacattctggagatggaggaagagacaagcggctatggttttaagcccaagtacgatggggaagacctggcatataccgtgaaaaatctacgtcgatccacaaagtataagtttaaggtaatcgcttacaacagcgagggaaagagcaacccgtccgaggtagtagagttcacaacatgccctgataagccaggtattcccgttaaaccctcagttaagggaaaaatacattctcacagttttaaaataacctgggatccgcctaaagataacgggggagctacaattaataagtatgtggtcgagatggctgagggcagcaatggaaataaatgggaaatgatttactcaggtgctacaagggaacacttgtgcgatcgcctaaatccagggtgtttctatagactgcgggtgtactgtatctcagacggtggccagtcagctgtgagtgagagcctgttagtgcaaacgcccgcagtaccgcctggtccgtgcctcccaccgcgacttcaaggtcggccaaaggccaaagagattcaaacccccagcggatag

SEQ ID NO: 50328 - DNA, 675 bp, Artificial Sequence
  Description of Artificial Sequence: Synthetic coding sequence
atgaatattgaggttggcaatatttcgtacacgggggctatcattagttggagcagcagcgaaccctgtctcgaagactactatcacattatgtatcgacctaattggaacagcatattttccggttacctccgctatagtttccaccacgaggagaaggtccctcgtactatttcgtctgtcgtgttggagcatctggccccaagcacactatactttctttgtatcagctgcaagaaagccgcatttccatacaggcactattgtacaatgttccatacgctggacaagagccccctggccccaggctcaagccttgtagatcctcagattagcctgtgggtgctcatggcaattctgttagcctgtttcacagccgtgctcgccttcatttgtctgcagttttggtgcgtccgatgtcatgagcctagatggtcctacagggctggtcatatggaggaagccaatgggctggtgcggtggcccgaagaagcacctgatctcggacagcgtgaagaagatctccagggccttccactcgtggagatgccaagaaaaaacagtcgagacggcgctgagctggatcccgaagctaaccaggacgcccctgatgccggtgctctacagcgcggaggtggcgaccccccagcaattctgccgcattgtggggaatag

SEQ ID NO: 50329 - DNA, 543 bp, Artificial Sequence
  Description of Artificial Sequence: Synthetic coding sequence
atgaatatcgaagtggggaatatttcctacaccggggcaatcatttcatggtcgagcagcgaaccgtgtctcgaagactattaccatatcatgtatcggcctaattggaatagcattttctccggctatctgcgctactctttccatcatgaggaaaaagtgcctagaacaatctcttctgttgtactcgagcatctcgctccctctacactatacttcctctgtattagttgtaagaaggcagcgtttccctaccggcactattgtacaatgtttcatactctcgacaagtcccctctggcccctggctcgagtttggtggacccacagatctctttgtgggtgcttatggccatcctgctggcgtgcttcactgccgttctcgcctttatttgtttgcagttttggtgtgtacgttgccacgaaccacgttggagttaccgggctggccacatggaagaggcaaatggcctggtgagatggcccgaagaagcacctgatctgggacagcgcgaagaagaccttcaggggctccctctttag

SEQ ID NO: 50330 - DNA, 10401 bp, Artificial Sequence
  Description of Artificial Sequence: Synthetic coding sequence
atggagttgtatctgggagcttgctcaaaacccgctaaggtggcagtgactaagaccgtggcatctgttttagccgcagatacccagcagtgtcgagacggcgtgcacaagacacacttcgctggcgtgggccctgctcagctactggatctgccattgggcgtgaagttgccagtcattccaggctctaacgccgttttttacactaccaactttggagaaaagctgtttcggccttcgtatgggtttaatctaacagatccgtactgcagacttctcgagaaccaatacaagtccctccacgaccctcacttgaaagcctattacaagcgaaaggacattcttaaacggttaaaaaaaggcggatatatcacaagtaataacaaggttgtctgcacgctgagggaacttaacaagtatcggcagtatttaacatctctaaagctggacttcgagcggaattatatcaaagagcagcgcattttggctaagcaactgcataacattcccgagaacaatcagatccctcagcactgcgatgtcgcgcaggtgcagaattggttactcaaggaaggcaccgagtcaatcaaagaccaggagcgactgatgaggcacaggtacctggatatgatatcccgcaagctggagcagctggaacggaccgcagaggagcagaggctgtttctgatggacagggaagagaggcggcagcgggagcatactaggcgcaaacttacactccgtcggaagatcgaagaggagtggaaaaccaaggaaatgcttcttttgacgcgtatggccgaggacgtaaagagagaggagcgaatagaagagcagcagcatagaaaccgcgaggagtctgatcgcaaaaagcaagatttactggaaaaaaaaatggcctatcatctccagaagatgcaggacactggatttaacggtgaggacatcgggaagaatacctttaaatacaggggacaggatgggactcacgcttcaccaaagaataagaaaaaaacgagtgaagatattatgctggtttatccagcgggagaccagaatacatataaagagacccatggccataccgcgaacgccgctcatcaaagacagaatagttccaacaactttactaagaaaaacagcgcctcagtggtgtatcaggcagatgttcaggacaatggtatcaatcaaaagagagatgggatggtgtctaagaactctagcatctttgacgaccggggagggattaacataagcggccaaggatccataatcagtgctcaagtcagccccactcggaattttagccgcgtttcccaggccttccttgatccaagcaaggaagagaaggaaaccaatgccgactgggacgggcgacccacaaagcgcagctcttacctatgcgagtctggacctcaggcccacgcaacggacccaggcattttctccagccctgtttatacaaatatgcaacagaacctgctgcagaattgcctgcaggagaaagtaacctcagaggaactcaatatcataatccagaatgtgatgacttgggtcgtcgcaacagtgacgagcattttgtacccagctatcaccaaatacgagaagcgccttcagaacaacacctacccagttagtgacgattcaattctgagttcggattcttccagtttctgcagtacctgtagcgaagatttcacttaccgttcctacacgagtgccaccactaagacatttcaggcagagccttgtgcctttgtggtcgacacctcagttaggagacctaccacacctatcaaaccgccacccgctcacgtagagaaaacagtggtcggaaagacctgtcacatcaaggggcagtccattatctcaaagcacaagtataacaaaacgaatttactttatagttaccctaagctccgatcctgcaagtctgactctcacttgctggcctctttcgagaccggtactaaaaaatccaaggatgccacgaccgagactgattctttaggatcttctttgcactgcgataagactgccaaagcgatggacgagatgaagaacttaaaaaatgtcttcgtgaactttaagtgctatctcaaaggggaaacggaagttatcctggagagtatcctgagggaaataatgagcgatttgacacaggccattccctccctctcctcagttactgctgaagtgtttgttgagcagtgtgagcgagagaaagagatcttactttccaacgcccatattccctcagtagcttcggagattgtggagaatatgttagaaaagctcgaatcagcggtggaaaagaaatgcgtggagatgttcagccaggacctgtccgtggatattaagcccagcctggccgctagtgacgaacttctcacgtccagtaacggtaaacctcttaaaaatagtatgccacatactttggaccccatgtgcgacatcgccgaggatatggtccatgccatcctggaaaaactgatgactctcgtctctttcaaacagaatgaatttttgcacctcaaagacaccaataaactgtcatgtcaacagcacaaaacggaccctatctgcatgttcctccaaagagctggcaaaaataagagttcactggagagcgatgaagccagcctgatcgttaacgaggaggtacagaatctgatcagcaatatatttagtcagagctcactcgtggcatatatagaggaggccattaacgcaatcttgggatacatccagactgaactcaacaatgaacgcatcatagctagtgaggagaccgtggtgctgctgcaactgctggaggatatcctgttccagcttcaccaagaaccagtgaatgagagctttcagaagtcgaggcagccaagaataagctcgcctagcgatactaaagagaagtacaggctaacgggcacccggttatcgaacagccctcgctccggccgacccttcccaccgattaacgtgccaggcatggtgctgtacagtgacgacgaaaacgaggagatcgataatatcgtcaaaaatgtgctggactcaacgttcaaggatgaaaaagtgaagtcgcaggagcagattcctaatcattggttcacaaaagggaacacttgtttcgagtgcaaacgaaatattaagccacctaccaagcctggttctcgaagcaaggcggcattccacgattgggagctcaagactgagccaccatccacgaatcatgaggatattctcaagaaaaaactcagctccaacaaagatatctccacctttagccaagaccagaaacatcaaatcgagaaagccagcgaaaacatcgttacctccattcttaaggaaatgctgaaagacatttccagcgtcccgttcggccatctagacagcaaaactggctccgaggcctccgtgctggtctctgagaaaccccaggggctatctcaccaggagtggatcgatcaaatgttttctgtctccgagatttccaccgttgcgcaggaaattactgattcggtgttgaacatcttgcacaaggccagtaactatattagtaataccacgaagtcaagcatcagcagctcagtccaccagataagtctccataattccgacaccgagcatattgtaaaagaggcgcctaacaaatatcctctgaaaacgtggttcgatagtgagaagaagatgaagtacctatcattgttcgatgtcgatcccgagaagcccccatggttgaagtcaggcaaatccgagcctaagccagtcgacgatatcaatgataaaataatcaggacaatatttaagaggctgaagagcttcatctgtcccaagcttcacatgggatttaagtcctccctgaggagccagttgtccaagtataccgctaagatcgtgaacatcgtgctttgtgcgatacaaaacgagctcgaacttcacaaggagaatctgaatttgcgcgagattgaccacacaaagtccctcactgacaaaggattcttcgcgaatactgataagaaattggagtctctggtgaccagcattgacgacgatattctggcaagtcctctcctgacctgcatctatgatatgctgctcagcagcgagaacgcgcaccagagatccatcagcctgtcttccaggaagccaaaaagcgctacagactccgtggacgtccaatccattctccctaatcgccaggacaaaaagagttttcataagtatttagctaccccctgtacacatcattcagtcaacggcggaaatcacataaaggagaacgccaaacttcaagttctcgaacgcatcggagagaccttacacgaaatgctgtccaagcttctaggcacacatttacatagtcagctcagctgttctcagcagtctcgcgagatgacaaacaagaatcagaaaatggcggctgctctacagagcaatatacagttgatctctaaagctatcctggactatatcctcgccaaactctgtggagtggacatggacacgtctttcgcaagctgcgggctcaaagctatctctgaatcactcgatatcgataatccatcctttgcgtccataattgagaaaatggccaagtccactaagattatctcctcaatcgtcagccgtcgcgttcaggaagataacaaagaggagaccaaaagcaaagccaagccagttgcacccgtgtcctcaaagacgcctagtacaaaagagatgcacccaaacaagttaaaggcagtcgccagtgatattttaaacatggtttttgccaaactggagggcttcgccaacggccatttggagatcctcggcgcaatcaacgatgggaacaagaagagcaacaaaattggctgggagtatgagagcaccaatatctcacgcgacacccatgaggcaagctttctgtccgccctgtatatgcacgcgaaaaaagtgtcatcagcaatactcaaggtgatccaaaccgagctcaacgtcacatcttcagatctcaaaactagcgtcgagaatcccccaccagaaacccaaatcctgaagtacgttgtaaagttaattctagacgcagttagctcggacatgtttaatgagatggagtcagaaggaggaggaatcgaaacttacaggtacaggcctacctacggatccctgccaggaggtgctgaatccgattctttcttggaagacgatgcatacaccgctaaaaaaattattgatgaaagatctccccagcgtgaggaggtgaaaactcggtcattaaagcagtgggcactggaaaaaactcttaacaaaatcgaagttaagcttaaggagcctcacatcagccctattgccccaattattcgaaacatactgaatgaaattttccagtccaccttaatcaaccagttaaatgttcttagtctctctcactccaatttcaacggcatgcctcataatgtggatgaacctactccacagactagcgtgcagttcatggacaagatgatggatcctctgctgagtgaggctgacattacgattgtgacggacaacatcgtgaggacggtcttccacaaactatatagcgccgctatgacagaaagaaatgtaagagaaaaccggtacaagactattaccttctcagcaaatgtgtcttcacatgagcatacctacaaggggaaatcctcagttacagcactagacgagaacccctgcacatttcagtccaggttctctgtcgccgataaggagacaaaagtgaatttggccgaggacattgtgcaggccattctgactaacctcgagacgtttgcaacttccaaagtgaaaagcctgttctactctcaggttaactttacagtaccggtcgctctgccaatacagcaggaccacagtacccttagcaaagcattatcggctaaagattcatacagcgatgaacagttctcctgctgttctgtggaccacactaagtctggtaagaccaacctgtgtcagttgagcttgtccaaacttaatacctatgccctgcaggtggctcgacgcaacttacaggggatcaaacaggagctggataaggaaagagaaaaccctttcctaacacacgacatcggcatctcggagagtatcgcctcgcagattgttaacgcactacttgacattatttctagaaaggggaagtgcgataaaaactcctccgataaggaaatcgacctcgaccagcagaagggcgttatcgaaaagctgctgaatgaaaccaagtatcgtaaagtgctgcagctgcaaatacaggatacgatcgaaggaatactctgcgatatctacgaaaagaccctttttcagaacaacctgagtttcgccacacctacgctgaagtgcagcatcgctgataagcatagcgaagagaatagtgagatgtttatggagggcgctaacaagatcattcctaagctgtccgtaccaaaatccgatgtcatactgatctccaacgacattgtcaacattgtgttgcacaatttaagtagcgctgccactttagtgatcaacgccaagaacccgacgagtgcgagactccctctcaccttctgtgacacattcccaaagattgactgtcagcaaccattgaagggaagcaagaccgagcgcaaaaccgagcgctttagttatagcaggaaccagaaatcagcttatgcagatgataaccagattactgtggttgaaaaggaggacacacagaagagcgccactgatagctgtgaagagaacgctaatttcatcaccaagaccatctttaagcgcttggaatcatttgccactgaacgcatcgatagccttatcaccttggccttccagtccaaggaaaagtccttcgtgatccccgagctggagaattgtaagcaaaatgactccatcttctatgacagttcgcaagtagaatctgacgtaaatgtgctcaagatctccgcgactgagactatactttcacaagaattaacagacttcacctttgtcggacgcagagagaaacttggaagtaccattcatctgtcacaggctaggctcaaaacctatgcagacgtcattgcatccgccatcctgaaactcatcaaaaacgacctggatctggagatccagaaaatatacccatatcagaacaacatactgttccaggaaaatatcatagtttctgagattgtagactctatgctcaagatgctagatgataagcgatctgtcaaggaaatctgctttaattctaaagaaaactcaaatttcagccagctggctctgagcaacgagatcttattgggtcacaaagagaaagaacgctccacaaagcagagcttatttactaagtacccactcgaacagaatcagatgattctggagaacaagagacagatcatcgtgcttgaagagatcttcatgcgaaacggtgaaagtaagaacaaggagaaaggcgaacttttgatcgctgtcgaggagttgttaaataaactgtaccagagagtccgagaggttacgggccatctgccccctctcaacgagacagcaaattttatcagcaactccaagatcaaaacctcagataccacacaaaagaacagttttcagagtcatattaacagtgtggccaatgatatagtagaatctgtcctcggcaaaatgtacttggtcgtggtgacatctctctacgagaacaacaaaagccgtactgaggtagaaatttcagatcataacgactctttactgatgaagcccttgcgtttcagagagaccaagcaagcgggaaagatctctaattctccgaggtatgctatctctcaggcttatagctacgtggactctcagaatataagtgtcatggaaaataccttgctcccttacctccctctgcaggtgaagaaagatctgatccagatggtgctcaataaaattacgaattttgtttcccttcccctgaaggtttctccgaaagataaccctaaaccctgtttcaaggcccacctaaaaactaggtctaaaataaccacgctgcccaaatttactaagaaaacccacttaggtctgtctgcagccaaggcaaaaagcaagactaaactgggaccaggtgagaagaccctgaaagactccagatctaaaaccgccattggtctcagccacataatgtccgcaggggatgcgaagaatctgttggacacaaaactgcccacttccgaactaaagatttacgcaaaggatatcattatcaatatcctggagactatcgtcaaggagtttggtaaggtgaaacagaccaaggccctgccttctgaccagattatagccgctggtaagatcgtcaataccgtgctacaggagctctatgtcaccaacaactgcaacctcgcatacccaatgaagtcatcacacttgcggctttctcaggggaatataggcaccgggtccttgcctaagcagcaagcatgtttttatctcgagaacgtgtcgagccagcttgagcatatatttcctagagagggtatatttaaaaagctgtttgacaaatggcagaccgaatcaaatgacaaggaaaacgagaaatgcaagttgctgatgatcgccgagaacgttcttacggagatctccatcaaagccaaggagctggagtacagcctgtccctgctgaatctcccaccacttgagaactgtgagagccggttttacaatcactttaaaggagcctcgacgcgggctgaggacaccaaagcacaaatcaatatgttcggtcgcgaaattgtcgaaatgctgctcgagaaactacaattgtgctttctatctcagatcccaacacccgatagcgaggagacgctgtcgaacagtaaagagcacatcactgcaaagagtaaatatggcttccctaacaagcattctctgagcagcctgccaatttacaacactaagacaaaagatcagataagcgtgggctcttccaatcagatagtgcaggagattgtggagactgttctgaacatgttggaatcattcgtggatctgcagttcaagcacatctcaaaatatgaattttcggaaatcgtgaaaatgcccatcgaaaatctgagttcgattcagcagaagcttctcaacaagaaaatgctgcctaagttgcagcccctaaaaatgtttagtgacaagtcagagtccaacacgatcaacttcaaggagaatatccagaacatccttctgagagtccattccttccattctcaactactaacctatgctgtgaacatcattagcgacatgctggcggtgatcaagaacaaactggataatgagatttcccaaatggagccttcatcaatttctatccttaaagagaacatcgtcgctagcgaaattattggcacactgatggaccaatgcacatactttaatgagtctttgatccagaacttgagccgcgagagcctgtttcaaggtgcagaaaacgcctatacggttaatcaggttgagttggccactaatatgaagatgttcacctctaaactgaaggaagggagtcttgggataaatccttcccaggtgagcaagacaggcttcgtgttctgctctgatgaggatatgaaagagaagtaccgggtgtcctcagatctccccacgtctgtgcgctcttcagtggaggatactgtaaagaattctgagcccaccaaaagacctgattcagaaaccatgccttcatgttcaacaaggaataaggtgcaagatcataggccgcgagaatccaatttcgggtcttttgaccaaacaatgaaaggcaattcttacctgccagaggggagcttcttacagaagcttttgaggaaggcgtccgacagtacggaggctgctctaaaacaggtcctgtcttttatagagatggggaaaggtgagaacctgagggtcttccactacgagaatctgaagccagtcgtggaaccaaaccagattcagacaacaatttcgccactgaagatttgcctggccgctgaaaacatagtgaacaccgtgctgtccagctgcggttttccatcccaaccccacactaatgaaaatcgggaaatcatgaagccgttctttattagcaaacagtcttccttgagtgaggtcagcggcggtcaaaaggataatgagaagagtctgctgcgcatgcaggacaaaaagattaactacattccagaagaggagaacgagaacctagaggcatcccgggaggacagcagcttcctccagaagctgaagaaaaaagagtaccccaaaatcgaaacagtgaaggaggtggaggcattcacctttgcggatcatgaaatggggtccaacgaagtgcatctgattgcgcgacacgttacgacctctgtcgtgacctatttaaaaaatttcgagaccaccgggaaatgctat

SEQ ID NO: 50331 - DNA, 20990 bp, Artificial Sequence
  Description of Artificial Sequence: Synthetic coding sequence
atgaagttccagctgtggtctagccagatccgccctctaggcccaatcttcccagcacttcgggctctctatgctctcgccagagccgcaccacaagaggccactgccctgttaggcccactaccactggaagcctggaacgccggagggggtgccgaagtggtcggactttggccatttctggttcgtagcgggcagagggacaacggagtattggaaaaggaaagcggagctggtgaggagggggctgaaggcgcagtaccagctatggaactttatctgggcgcttgctccaagcccgctaaagtggccgtgacgaaaaccgtggccagcgtgctggcggcagatacacagcaatgcagggacggtgttcacaagactcacttcgcaggcgttgggcctgctcagttactcgacctacctctgggggtgaaactgcctgtcattcccggtagtaacgcagttttctataccaccaattttggtgagaagctcttccgccctagttacgggttcaacctaaccgacccatattgtagactccttgagaaccagtacaagtcgctgcacgatccacacctgaaagcctactacaagaggaaggacatacttaagcggctcaagaagggtggatacatcacaagcaataataaggtggtgtgcaccctaagagaattgaacaaataccgccagtatctgactagtctgaagctggactttgagagaaactatattaaagagcagcgcattctagccaaacagctgcacaatatcccagagaacaaccaaatccctcagcactgtgacgtggcccaggtacagaattggctactcaaggagggaacagagagtatcaaggaccaggagcgcctcatgcggcatcggtatctggacatgatctcccggaaactggaacaattggagcggaccgccgaagagcagcgcctgttcctgatggatcgggaagagaggagacaaagggaacacacgcgtagaaagttgacattgaggagaaaaatagaagaagaatggaaaacaaaagagatgctccttctgactcggatggctgaagatgtgaagcgtgaagaaaggatagaagagcagcagcacaggaatagggaagaaagcgacaggaaaaaacaggacctactggagaaaaagatggcctatcatctccagaaaatgcaggacaccgggtttaacggcgaggacattggaaagaacacctttaaataccgtggacaggatggcacacatgcctcccctaagaataagaagaagacttctgaagacattatgcttgtgtaccccgcaggcgaccagaatacctataaggaaacacacggccacaccgctaacgccgcacaccagcgtcagaatagttccaacaactttaccaaaaagaattcggcctctgtggtgtaccaagccgacgtacaggataatggtattaaccagaaacgggatgggatggtgtcgaaaaatagttcgatcttcgacgacagaggaggcatcaatatttccggacaaggttctataatttccgctcaagtgagccctactagaaacttcagccgcgtctcccaggccttcttagatcctagtaaagaggaaaaggagaccaatgctgattgggacggtagacctactaaaagaagcagttacttgtgtgaaagcggcccacaggcacacgcgacggatcccggaatcttctcctcccccgtttatacaaatatgcagcaaaaccttctgcagaattgcctgcaggaaaaggtcacatcagaggagctgaacatcatcatacaaaacgttatgacctgggttgttgcaactgtgaccagtattctctatcccgctattacgaagtatgaaaaacgcctccagaacaacacctatccagtctccgatgactctatcctcagctccgacagtagcagcttttgttcaacctgttctgaggacttcacataccgtagttatacctccgcaaccactaaaacattccaagccgagccctgcgccttcgtggtcgatacctctgtgcgcagaccaacaacccccataaagcctccacccgcacacgtggagaaaacggtggtcggaaaaacctgccacatcaagggacagtctattattagtaaacataaatacaataaaacgaatctgctgtactcctaccccaagctgcgctcttgcaaatcagacagtcacttgctcgcttcattcgagaccggtaccaaaaagtccaaggatgccactaccgagaccgatagcctcggctcatcactgcattgtgataaaactgcgaaggctatggatgagatgaagaacctcaaaaacgtctttgtcaacttcaaatgctatctgaagggtgaaaccgaagtaatcttagagagcatcctgcgggagataatgagtgacttgacccaggcgattccatccctgagtagtgtcacagccgaggtgttcgtggagcagtgtgaaagagagaaagaaatactactcagcaatgcgcatatcccaagcgtggcgagtgagatcgtggagaacatgctggagaagttagaaagcgcagtggaaaagaagtgcgtggaaatgttttcacaagacctgtctgtagacattaaaccatccttggccgctagtgacgaactcctgacatctagcaatggcaagcctctgaaaaactctatgcctcacaccctcgaccctatgtgtgatattgctgaagacatggtacacgcaatcttggagaaactcatgacccttgtcagttttaaacagaacgagtttctccacctcaaagacactaacaagctgtcatgtcagcagcataaaacggacccaatctgcatgtttctgcagagggccggaaagaataaatcttcactcgagagcgatgaagctagcctaattgtaaatgaagaggtccagaatctaatatcaaatattttctcccagagttccttagttgcctatatagaggaagcgatcaacgcaatattggggtacattcaaactgaactgaacaacgagcgcatcatcgcatctgaggaaactgtagttcttctccagctgctggaagacatactctttcaactgcatcaagagcctgtcaatgaaagcttccagaagtcacggcaacccagaataagttcaccttccgacacgaaggaaaaataccgactcactggcacacgattgtctaactcgcctagatccggcaggccatttccccctatcaacgttccaggcatggttctgtacagcgacgatgagaacgaagagatcgacaacatcgtgaaaaatgtgctcgattcaacgtttaaagatgagaaggtcaagtcacaggaacagataccgaatcattggttcacaaagggtaacacatgttttgagtgtaaaagaaatataaaaccgcctaccaaaccgggatctcggtccaaggcagccttccatgattgggaactgaaaacagaacctccctctacaaaccacgaggatatactaaaaaagaagctgagctccaataaggacatctctactttctcacaggatcagaaacatcaaatcgaaaaggcgtccgaaaatatcgtcacttcaattttgaaggagatgcttaaggacataagcagcgtaccattcgggcacctagacagcaaaaccggatcagaggcctctgttctcgtgagtgagaagccacaaggcttgtcccaccaggaatggatcgatcaaatgtttagcgtgtccgagatctcaacagtggcgcaggaaatcaccgactccgtcctcaatatacttcacaaagcatctaactacatatccaacacaacaaagagctctatttcatcttccgtgcatcagatttccttgcataacagtgacaccgagcacatcgttaaggaagccccaaataagtatcccttaaaaacgtggtttgactccgagaagaagatgaagtatctttcactctttgacgtggaccccgaaaagcctccatggttaaaaagtggcaaatcagaaccaaagccagtggacgacataaatgacaaaataatacggactattttcaagaggctcaaaagcttcatttgcccaaagctccacatgggctttaaatccagcctgcggtctcagctgagcaaatacactgccaagatcgtgaacatagtattgtgcgccatccagaatgaactggagctccataaagaaaacttaaatcttcgggaaatcgatcacacgaagagtctgaccgataaagggttttttgctaatacggacaaaaagctcgaatcactggtcacaagcattgatgatgacatactagcctctcccttgctaacatgtatctacgatatgctgctgtcttccgagaatgcccatcagcgaagtatatctctgtccagtcgaaaacccaagagtgcaactgactcagtggatgtgcaaagcattctcccgaatcgacaggataagaagagcttccacaagtatctagctactccatgcacacatcacagcgtgaatggcggaaatcacattaaggaaaacgccaaactgcaggtccttgaacgtattggcgagactctgcatgaaatgctctccaaattacttggaacacatctgcattcccagctatcatgctcccagcaatcgagggagatgacaaacaagaatcaaaagatggcagctgccttgcaatctaacatccaattaattagcaaggccatcctagattacattttagcgaaactttgcggcgtcgatatggacacctctttcgcaagttgtggcttaaaggctatttctgagtccctggatatcgacaacccttcgtttgccagcattatcgagaaaatggctaaatccactaaaatcatttcctcaatcgtaagccgacgagtgcaggaagacaataaagaggagacaaaatctaaggccaagcccgtcgcgcctgtcagctctaagaccccctccacaaaggagatgcatcccaacaagctgaaagcagttgcttccgacattctcaacatggtattcgccaagctggagggctttgctaacgggcacttggagatccttggtgctatcaacgatgggaataagaaatccaataagatcgggtgggaatatgagtctaccaatatcagtcgtgacacccacgaggctagcttcttgtccgccttgtacatgcacgctaaaaaagtttcctcagcaattctcaaagtgatccagaccgagttgaacgtcacatcaagcgatctgaagactagtgtagaaaatccccctccagagacacagattctcaaatacgtcgtaaagttaattctcgatgcagtgtcttctgatatgtttaacgagatggagagtgagggcggaggaatcgaaacgtataggtatcggcctacctacggtagcctccctggaggagccgaatccgactccttcctcgaagatgacgcctataccgcaaaaaaaatcatagatgaacggtcaccacagcgtgaagaagtaaaaactcggtccctgaagcagtgggctctagagaagacactgaataagatcgaggttaagctaaaagagccgcacatctctccaatcgctccaatcatacggaatattctgaatgagatattccagagtaccttaattaaccagctcaacgttctgtccctgagccactccaacttcaacggaatgccccacaatgttgatgagccgacaccacagacttccgtccagttcatggataaaatgatggacccgctcctttccgaggcagatataacaatagtgaccgataacattgtgcgcacagtgttccacaaactttactctgccgcaatgactgagaggaacgtgcgggagaatagatacaagacgattacgttttctgccaacgtatccagccatgagcatacttacaaaggcaagtcttcagtcaccgccctagatgaaaacccttgcaccttccaaagcagattttctgtcgccgacaaagagaccaaagtgaatctggctgaagatattgtgcaggcaatactcacaaacctcgagacttttgcgacctctaaagtaaaatctctgttctacagtcaggtgaatttcactgttcccgtagccctacctattcagcaggaccattctaccctttctaaggctctgtctgccaaagatagttacagcgatgaacagttcagctgctgttctgttgaccacacaaagtcaggaaaaaccaatctgtgccagcttagtctgtcgaaattaaacacatacgcactgcaggtagcccgtagaaacctccaggggatcaaacaggagttggacaaagagagggagaatccattcctgacacacgacattgggattagtgagtcgatcgcgtcccagatagtgaacgcactgctggacatcatttcccggaagggaaagtgcgataagaacagtagcgataaggaaatcgatctggaccagcagaagggcgtgatagagaagctgttaaatgagacaaaatatcgtaaggtgcttcagctgcaaatacaggacactattgaaggaatcctctgcgatatctacgagaaaacactcttccagaataacttaagcttcgcaacccccaccctgaagtgtagcatcgccgacaagcacagcgaagaaaattcggaaatgttcatggagggcgctaacaaaataattcccaagctgtctgttccaaagagtgatgtcatactgatcagtaacgatattgtgaacatcgttcttcataacctcagttcggcggctacacttgtcatcaacgccaagaatccaactagtgctaggttgccactgacattctgcgatactttccctaaaatcgattgtcagcagcctctgaagggaagcaagactgaacgcaaaaccgaaagattttcttactcccgtaaccagaagtcagcatacgccgacgataaccagattaccgtggtggagaaggaagatacccagaaatccgccacagatagctgtgaggagaatgccaattttatcacaaaaaccattttcaagcgactcgaaagcttcgctacagagcgcatcgactccttgattacactggcgttccaatctaaagagaaatcatttgtgatcccggagctggagaattgcaagcagaacgattcgattttttatgattcgtctcaagttgaaagcgatgtgaacgtactgaaaatttccgcaacagagactatcttgtcccaggaattaaccgatttcacctttgtgggcagacgcgagaagctgggctccactatacatcttagtcaagcccgattgaagacttacgcggacgttatcgcgtcagcaatccttaaattgatcaaaaatgatttagacctggagatccaaaagatatacccttatcagaacaacatcctgttccaggaaaatattatcgttagcgaaattgtcgactccatgctgaaaatgctagacgataagaggagtgtcaaggaaatctgtttcaactccaaggaaaacagcaacttctcccaactggctctcagtaacgagatacttctcgggcacaaggaaaaggaaagatctaccaaacaatcccttttcaccaagtaccccttggagcagaatcagatgatcctggaaaacaagcgccaaatcattgttcttgaagaaatctttatgcgcaatggtgagagtaagaacaaagaaaagggcgagctgctgatcgcagtggaggagctgctcaataagctctatcagcgggttagagaagtaactggccacctgcctccacttaacgaaactgctaacttcatctccaactctaagatcaaaaccagcgatacaacacagaagaactccttccagagccacattaacagcgttgccaatgatattgtagagagcgtgttggggaaaatgtaccttgttgttgtgacatctctttacgagaacaacaaatcaaggaccgaggttgaaatctccgatcacaacgatagtctgctgatgaagccactgcgcttcagagaaaccaagcaggctggaaagatttccaacagtcccaggtatgcaatttcccaagcatactcgtacgtggactcacaaaacataagcgtgatggaaaacacactgctcccatatctacctctgcaggtgaaaaaggatctcatccagatggtcctgaataagatcaccaactttgtttcgctaccactgaaggtttcgccaaaagacaatcctaagccgtgcttcaaggcccacttgaaaaccaggagcaaaattactacactgccaaagtttacaaagaagacccacctcggcttgtcagcagctaaggccaagtccaaaacaaagctgggaccgggtgaaaagaccctgaaggactcgcggtcaaaaacagctatcgggctgtctcacatcatgtcagctggagatgcaaaaaacctgctggacaccaagctccctacctccgagctgaaaatctatgcaaaggacattattatcaacattctggagactatcgtaaaggaattcgggaaggtgaaacaaaccaaagccttacccagtgaccaaatcatcgcagcgggaaagatcgtcaatactgtcctacaggagctttatgtcaccaacaattgcaatctggcctatcccatgaaaagcagccatcttagactcagccaaggaaacatcggaaccgggagccttccgaaacagcaggcttgcttttaccttgagaacgtgagttcccagctcgaacacatttttccacgcgagggtatttttaaaaaactctttgacaagtggcagaccgagagtaacgataaagagaacgagaaatgcaagttgcttatgatcgccgagaacgtgctcaccgagattagcataaaggcaaaggagctcgaatattcactctcgcttttaaatcttcccccactagagaactgcgagagccgattttacaatcatttcaagggggcttcgactagagccgaggataccaaagcccagatcaacatgttcggcagggagattgtggaaatgctgcttgagaaactgcagctctgcttccttagtcagatcccgacccctgacagcgaggaaacactctcaaactctaaggagcacatcactgctaagagtaagtatggatttcctaataagcactcactttcatcactgcccatctacaatactaagactaaggaccagatctcagttggcagtagtaatcaaatcgtgcaggagatagtggaaactgtgcttaacatgctggagagtttcgttgacctgcagtttaagcacatcagcaaatacgagttctctgaaattgttaagatgcccatcgaaaatctttcttccatccaacagaagctattgaataaaaagatgctgcctaagctgcagccacttaaaatgttcagcgataagtctgagagcaacactatcaactttaaagaaaatatacagaatattcttttgcgagtgcacagtttccatagccagctcctaacatacgcagtcaatattataagtgacatgctggcagtcataaaaaacaaattagacaacgaaatcagtcaaatggagcccagcagcatatcaatccttaaagagaatatcgtggcaagcgagataataggcacacttatggaccaatgcacttatttcaacgagtccctgattcaaaatctgtctcgtgaatccctcttccagggggcagagaatgcatacactgtcaaccaggtcgagctcgcgacgaacatgaagatgttcacttcgaagttgaaggaaggttcactcggcatcaatcccagccaggtttcaaagacgggatttgtgttttgctccgacgaggatatgaaagaaaagtacagggtgagcagcgatcttccaacctccgtacgctcatctgtcgaggatactgtaaagaatagtgaacctactaagcgcccagatagcgagactatgccttcttgtagtacacgcaacaaggtacaggaccaccgtccaagagaaagcaatttcggctcctttgaccagacaatgaagggtaactcttatttgcctgaaggcagcttccttcagaaacttctgcggaaagcaagcgactctacagaggccgcacttaaacaggtgctcagctttattgaaatggggaagggtgagaacttgcgcgtcttccattatgagaacctgaagcccgtggtggagcccaaccaaatacagaccaccatctcgccgttaaagatctgcctcgcagcggagaacattgtcaacacagtcctgtcctcctgcggtttcccaagccagcctcacacgaacgaaaatagagagattatgaagccctttttcattagcaagcaaagttcactttccgaagtgtccggtggccaaaaagataacgagaagtccttgctccgtatgcaggataagaaaatcaattatatccccgaggaagagaatgaaaacttggaggcctcacgagaagatagctccttcctgcagaagttgaaaaagaaggagtatcccaagatcgaaaccgttaaggaggtggaagctttcacctttgccgaccacgagatgggtagtaacgaagtccacctgatcgccagacacgtcaccacttccgtggtgacctaccttaagaattttgagactacggtgttcagtgaggagaagatgtccgtgagcacatggagcaggaagaagtacgagtccaaacagtttctgcggaacatctatgacgactccagcatttaccagtgttgcgagcacttgacagagagtgttctgtaccatttaacaagtagcatctcagacgggactaagaaaggaagggagaaggaaaaggcctgggagatacaagaagccaccttcagcaagatcatatccatccattcccaggtatttgagagcaggagtattagcatcggggaactggctctgtgtatctcagagataatcattaaaattctgttcaacaataaaatcattcaggcagacattgcacagaaaatggtagcgatccccacaaaatatacctactgtcccggaattgtttcaggagggtttgacgacctgtttcaggatctcttggtcggggtgatacatgtgctatcaaaggagatagaggttgattaccacttcgaatccaatgtccgcaacaagagcttctcgatgcaccgcaataattcagtgccactgtgcaacaaaatcaatagacaggccagcccacgtgactggcaattcagtacccagcagatcggtcagttgtttcaaaaaaacaaactgagctacctggcatgtaagcttaatagcctggttggcaacctgaaaaccagtgagagtaaggaggtcgttaacaaagtgtttaacatcgtaagcgatctattctccccggatgagtgtctggacactgggatggactccggcaagattcagagaacgtacttttattcttcaaataacgaacagcctaattccatcctcaccaataacctccagctgtcctccaagtctgtgttcttactaaatgttgtgtgcgagaaactaatcaggatcctgctggaggagtgtaccagcacagcattcccagacaagggttccgtttctgaagaaactagtgccgaagagtgccagctgctgaagatgctgcagtcagttgaggacgggaagtccgactacagaaaggggggtatggactgtgaatgtttgcaggtggactatatgtctgatcttctggagaacgtagccgagatagaccaggacctgcttactagtgattccatgctgactattatcagccactccctggtaaaatccttaatggataaattgtctcactctatccaacaggcacccgaaagcctccccttcgcaaataagcatctgaactatagaacccgagagatccagtcatcttttatcaaagccagaaaatcagagctcattgagctaggacagtccaagtctagccttgagctccgcagctacgactccaatagcttaaccgtttctctaaataaccctagcgtggtgtcatcaaaaattcaggccccttttaataaacattgtgccgtgaaaagctcatcagtgagtccatttgagaggcaaagaacaaaggagatggataaggtcgccatccacaacaagctgcaccaagaaggcatatacgccggagtctacagcgccacatttctcgaagggataatatccgaactgttctttaaccttagtatgagtctttggggtaaaaacaagaacatcaccgtcagctggctgaacgagatgaacacacttttcgtgaacaacgttgtgaacgaattcaacaatgcacaagtgactgtcctccgcaatgccgaagagcggctgtgcttcccacctgtacacacagagacggtgagtaaaattgtagactcagtgtactacgacgtgcttcagcaatacgagctgaaagtggcctgcggtaataatccggtctatgataatgcttctattgcggaacaaatcaccaacgggatactactagaaatactggattacaaactgccatcatgttttaaggagcacttaattccccactcttactatcctctgaaaccagaaattatacttcaaaaactgcagtccaacctcacggaatttacaagtctgccgaggtcctccagcgattattctacaatgctgagccactcattcctggaggacgtgatccggcgtctgttgtctcagttaattcccccaccaataacatgctcaagcctgggaaagaaatatttaatgtcttccgactttaacgagatgtctacctgcattataaacaaagtgatgagcgctatctccaaacacaagatttggttcactatctacgacaaccaatacctgtacaccggcaagaacttgcagaagatggtggacagcgtgtactgcaacatattacaaatgagcgactcgctcgtgagcatacagaagtccatcgtgagcaggtctcctatcatgattgaccagattgcctcctttattatccaggagataatcgaaaaccacctacagccttttctcagcggcgaagttttgtgtcacccaagaactccactggatcccgtctctactattgtgacgcaggtcttatccgaggtaatagagtcgcacagacctcagaagcagtctccactggatatccacttggatagctttgtgagagagattgttgccagacttctgtcaaagattttctcccccaagcataacacagagatcgagctcaaaaacatgactcagaggatcgtgaacagcatcaacaggcattttaacaaggctaaaatccacatcctttacgatgacaaggagcaggccttcttttcctttaatacggacatcgtcgatgaactcgctactagcgtgtaccggaacgcactcaaacaacacggcctggatcttgctgtggataaagaaagcgaggatagcgggatatttgtagagaacattaccaacctcatagtcgctgccatttcggattaccttctgcaccctctgttttctggcgacttcagcgcttcaacatatagcaattccgtggcggaaaacatagtgcaagacatattatcaaacatcagcaaaagtaccgaaccatctcagtccgtgcctctctacaacactctgttaccatacacatttctggaggatatgatcagggttttactatctaaactgttctcatcggcctccagccttgtgctgaacagggatacccaaaaggatatttcccgcgtgaacttcaacgatatcgcctccaaccttgtcagcgatatcagaatgaaggtctcccaacatgagattaggttttccaaagaggaagaagaaactaagtttatttatagcgaggatgacattcagcacttagtggacagtgtgtttgccaatgtcgtgcagactagcgggagtcaagagtcggcagttcaaaatatcacaagctctaatgatatcttgatcgaccgcatagcaggctttattatcaaacatatatgtcagaagcatctgcaaccttttgtctctggtaagtctctctcatcatccgacacgtacttcgacgacgaacggaggcagcttttctacactagcgtgtattcaagcactttcctcgaagatgtgatcagcggggtgctgaggaagattttccacagggtagtagggatcgtgcagaccaaatctatccgagacagcgaggacgaactgttcgaaaaagccgaggaactcatccaccttattactggggagttttccaaggcccaggtctcaattattgacaacacagaagaacgactttgcctgcctccagtcgaacgcgacgtcgtaaaaacaatagtggatatggtgtactccaaggttttgcaggaatacgagatggaagtcgtgccaaataaggattttctcaatgacacgaagacactcgctgctcgtattacaaatataatcctggccgagatctttgattttcagatacatccagacctgatagccaatttgcccttcaaatcgcacagcaagctgtcagctaatgtactcattcagagggtccagtatgatatttccaaatcccggttccaaagacaggcctcgactatgtacacaaccatgctgtcgcattcccacctggaaaagatcgtgactcagctgaccagtcagatcagcccactcaacactagtgccgagcagtcagacacgactaagtccgacctctctaatacagtaataaagcttataaacgaaatcatgtcaatcatatctaagcacgagatttgcataatcaaatatggaaataagaaacagtctatgatttcagccaaagacatccaatccatggtggatagcatatatgcggacctgagccactcaaacatctaccagagcatcaccaaagacaagaaatccatttctgacatcccggtatcgaagatcgcctcattcattatcaaagagatcttcaatcaccatattcagtcctttctcagcgaagacaaaacgctgctactcgctgctgtggaccagacttacaaactgaaggcgatcgaccccaaacaacgcgaactgagtttcatcgtgaactcatccgtcttccttgaagaagtgatcagcgaactcctatgtaagattctgtacgcattctcccataatatgttggtcaccgagaatcctgaccgggtgaaactgaaactgacccggatcgtcacaactctagtgaatagcatagtgctggaatttacaacctctgagattttggtggcagataatttcgacaaaaacctttgcttcagtgagcgctataaggaaatggtccagaaaatcgtaaattctgtttatgggaaagtactagaccaatacaagagcttaattcagatccacagggtgattcaaagcgataccatctgtttcgggagaaaaatttattacctgctcttggaggaaatttacgactaccaagtgcagtctctagtgagtggcgagctggaatcatcttcgtattcatacccacaagctgacaacatcattaggaacgttcttaatatcataactaaggactcccatgccctgcccccttacattacagtgttaccccatagcctgcttgaggatatggtgtatcgcctcctcggccacgtgtttccatcgacacataccgagaacgaactgaaggagaagaaatttccgccagacgacgaattcgttgaagctgcctcaaagctgacagacgaaatcattaaagaaatttctgagcatgaaatccgtctctctatggccgaggataacgctgagtccatgcagctcgaacccatcgagaaccttgttgattctatctgtaacaatattctcaaaacaagtgaatttcaagcggaggtgcagaaagatgcagataaaaaagggtgttcttttttgtcaaagctggccggatttattatgaaagagattatgtaccaccacttgcagccgtttctccacggcgaagagagttcattttctgatttgtccgactatgaccacgtgtctgagctggcaaaatctggaaaagaaaaaacccagcccagcctctattctgccacctttctggaagatatcatcattgacttggtccacaaattttgtagtctcctcattatcaccgaggacagcaagaagaacgagatggccgagctcgacattatgggtttggctctcaagctagctaattctctgatccgcgagttcaaaaagagcgacatcaaggttctcccgaatgccgaaaagatgttttctttcccacccatcgataaagaaaccgtcgacaagatcagcaattttgtctacgaacagtttatcgagaagtgtacctcacacgatatccagaaaggggacgagtctaatatagccatcgggatgatcgccgcactaactcagaaagctatctccgcctttagaattcaaccattgttttcgggagattggagctccacctttttctccttccttaatccggacaatataactcagagggtacagcaccttccacagaacacattcacccagataagtcggtgtgccaaagagaaccaactgagtttacctgaccagtcttataaggatacctcatccacccccgactgtaaaaacatgatgtcgacccttgaaatcaatcgtggaaccatgaacaggaagaaatctttcaagacgaaggacactagcgtaaagaagggggacattcagaaccctgtcctgtccagcatcaacgctatcatgaaatctggaatgatcaacctgacgtctgggcttgcaacgggcgtaaccaacaagaaagaggtcgatgaaaataaagtcggcatctgcacccagaagcactccgagaatgtatcgaaagtgacatcgaccacaaccgttaagtcaaaagacacccaggaaccaaatttatctgagacgttcaataacaacgagatagaaaagaagcgcaacctgatccctactgacaagaagggcaaagatgatgaaatttacacacacttttcactgattatcgatgacacggagtacgagaaggaggttctcggaagcgactccgagataggctacaaaaagaagatagataatgctcgtgaatcatcctttaaaaaggatgacaagctgttccagctcagtagcctgaaaagtaaaaggaatctcgggacaacgacagatacactggagattaggatcaggacctcaagcaacgagggacgaagggactcacccacccaaacatgcagggacgaggagcaccacagtgactatgaacacgtgcagaacgtgatcgagaacatcttcgaagatgtactggagcttagttcttcccctgaaccagcttattatagcaaactttcttacgatcaaagcccgcctggagataacgtgctgaacgttattcaggagatctcaagagactctgcccaaagtgttactactaaaaaggtttcctcctcaaccaacaaaaatatctcagctaaggagaaggaggaggaggaaagggagaaagagaaagttcgggaggaaattaagtctgagccatctaaacccgatgaccctcagaatcagcgggagtcaaagcctggtattttcccagccaaattcctggaagatgtgatcacagaaatggttaagcagcttatcttttcttcaatcccagaaacccagatccaagaccgatgccaaaacgtctcagataaacaaaaccaagcgaaactttacgacaccgctatgaaactgattaacagtttactgaaagagttctctgatgctcaaattaaggttttccgacccgataaggggaaccagttcccgggagggaaggttagcagtgtgccgaaagtgcccccaagatacaaggagcccacgacagatgaggcaccttccagtatcaagattaagagcgccgataagatgccgccaatgcacaagatgatgcgcaagccctcaagtgataagattccttccattgataaaaccctcgtaaacaaagtcgtgcactcaagtgtgtgtaacatcctgaatgattacggcagtcaggactccatttggaagaatattaacagtaatggggagaatttggcgaggagactgaccagcgctgtgatcaacgagatctttcaacggcaagtcaatttaatcttctgtgacgaggtgtcagtatcagcctgtctgcctctagagtccaaggacgttgtcaagaaagttcaaaagctagcacagactgcctccaaagaatgtcaaaccagttcaccatacactatcattttacctcacaaattcctggagaacgtgatctctgccttgttctcgaagattttcagcaccataagctccacaaagacaaaggagcctgaggacaacctgagtaccgaactgaattttctccagatgaagttagttagcgctgtcgccacagaaatctcccaggataagtatatgaccattcagtatgtggaaaccttacagagtgacgatgacgaaattatccaactggttgtgcagtccgtttataacaacctcctgccccagttcggctctcaggaaatcatccagaattgtgtaacgtccggctgtaaaatcctcagcgaaaatatcgtggacctcgttctgagggaagtagctagtaaccaactgcagtcttacttctgcggggagctgaccccccatcagtgcgtagaagtggagaacattgttgagaagatactgaaggacgtatttcaaacaactgatgtccctctgcccaagccaagtcacgcagataagctgtcatacaacatcattgaggagattgccgtgaagttcttatcaaagctgctgtctatatttccaaaagttcataaggagaggacgaagtcattggaaacagatatgcagaagatcacttccaaggttctgaactcagtgcaggagttcataagtaagtcaaaaataaagctggtgccccctactaaggagtcaccaaccgtccctgtggcagataacgcgacgatcgaaaacattgtcaactccatttacacctccgttttaaagcattctggctcctatacctctgttttcaaggatctgatgggcaaatctaacgtgctgtccgatactattggattcctaatggttaatgcaatctcgaattccgaatttcagcctcaggtcgaggaagaggtcagcaattctgagctcgtgctagaggcagtgaagattatggaaaaagtgatcaaaattattgatgagttaaagtccaaagaaaagagttccagcaggaaaggccttaccctggatgccaagctgctggaggaagttttagctctcttcctggccaaacttatcagacttccctctagcagcagcaaggacgagaaaaatctgagcaaaaccgaactaaacaaaattgcatcccagctgtccaaattggtgaccgctgagatctcacgcagttccatctctctaattgcgagcgatcccgaggagcattgtttgaatcctgaaaacaccgagcgtatctatcaggtggtggactccgtgtactctaacatcttgcagcaatcggggacaaataaggaattctactacgacatcaaagatactaacactgcgtttcctaaaaaggtggcctctctgattattgacggggtgtcaagttttccccttgacaccatcaactctacaatttccaacgcagacctcagcggtgagcttgacgtgaataggatcgtgcaaaaggctcaggagcatgctttcaatgtcattccggaactagagcaggaaaagctggatcagaatttatccgaagaagaatctccaataaagattgtgccccatgtgggaaagaagcctgtcaagatcgacccaaaaataatctctgagcatctggctgtaattagcatcaaaacacaacccctggaaaaactgaagcaggaatgcctgaaacgcactggacactctatcgctgagctgagacgggcttctatcagcggaagaaactactcactagggtcacccgaccttgagaaacggaaaactgaaagacggacgtcgctggacaagacaggcagattggacgtgaagccactggaggccgtggctcgaaatagtttccaaaatatcagaaaaccagacattactaaagtggagctgcttaaggatgtccagtccaaaaacgatttaattgttcgattagtggctcacgatatcgaccaggtctacctggagaactacattaaagaagagcgggactcagacgaggatgaggtcgtgctgacccagacatttgcaaaggaggagggcattaaagtcttcgaggatcaggtcaaggaagtcaagaaacccatccagagtaaactgtcccccaaaagtactctgagtacaagctctctgaagaagtttttatccctctctaagtgttgtcagactacagcttcggccaatatcgaatcaaccgaggccatcagcaaccaggtgatcgagagcaaggagacgcacgtaaagagggccgtggccgaacttgatatggcgactccaaagacaatgccagagacagcatcttcatcctgggaggaaaaaccccagtgcaagaaggaggagaaaaacttggtgacggaaccgacccattactttatccatcgcatcatgagctcaagctcttacaaccaggaagatttaatttcgagcactggcgaggcagaggattgccactcagatccgtcagccaaaatcttggaagagagcagccaagagcaaaagccagaacacggcaatagtgtcaaattcatcacaatttttgagaggagtaaggacgtgctcgggagtgctaacccgtctaaggaggtcatctctgagacacccaagcctgatgtttccaagcagggtagtaaaatgctgactaagatgtcttcgactctctctaaggtcttcagtcagtgtaatactaacatctcgcggtcatcttccccagcccatcaggatgagcacta

SEQ ID NO: 50332 - DNA, 20724 bp, Artificial Sequence
  Description of Artificial Sequence: Synthetic coding sequence
atggagctgtatctgggagcttgtagcaaacctgcgaaagtagccgtcacaaaaaccgttgccagcgttctcgcagctgacacgcagcagtgtagggacggggtccacaagacccacttcgcaggagttgggcctgcccagcttttagaccttccactgggggttaaactgccagtcattcccggaagtaacgctgtcttttacaccactaactttggcgaaaagttattccgcccttcatacggattcaatctgaccgatccttactgtcggctgcttgaaaaccaatacaaatcactgcatgaccctcacctgaaggcatattacaaaagaaaagatatcctgaaacgtctgaagaaaggcggttatattaccagcaataataaggtagtctgcaccctgagagagctgaacaagtaccgccagtatctcaccagcctgaagttagatttcgaacgtaattacatcaaagaacaacggatcctggctaaacaactccacaacattcctgagaataaccagatcccccagcattgcgatgttgcccaagtgcagaattggctcctcaaagagggcacggagtcaattaaagaccaggagcgcctgatgcgccaccggtacttggatatgatatcacgcaagttagagcagctggagcgcaccgccgaagaacagcgtctgtttctcatggatcgtgaagagcggagacaaagggagcacacacgccgtaaattaactctgcgcaggaaaattgaggaagagtggaaaacgaaggaaatgctgttgctgacccggatggccgaggacgtgaagagggaggagcggatcgaagagcagcagcatcgaaatcgggaagaatctgatcgaaagaaacaggacctgctggaaaagaagatggcttatcacctccagaagatgcaagacaccggattcaacggagaggacattggcaaaaacaccttcaagtaccggggacaggacggcactcacgcgagtccaaaaaacaagaaaaagacttctgaggacataatgctggtataccccgctggcgaccagaacacctataaagagacacatggccacactgcaaacgctgcgcaccaaaggcagaatagctctaataactttactaagaagaatagcgccagcgtggtctaccaggccgatgtacaagataacggcatcaaccagaaacgcgatgggatggtttcaaaaaacagtagcatcttcgacgaccggggtggcatcaacatttctgggcagggctctatcatcagcgcacaggtgagtcccacacgaaacttcagcagggtctcccaggcttttcttgatccctccaaggaagaaaaggaaaccaacgccgattgggacgggaggccgactaagcgtagttcatacctctgtgaatccggacctcaggctcacgcaaccgatcctggtatctttagcagccccgtctatacgaacatgcagcaaaacctgctgcaaaactgcctacaggagaaggttacgtcagaagagttgaacattataattcagaatgtaatgacttgggtggtggcaacagtcactagcatactgtaccccgctatcacgaagtatgagaaaagactccaaaacaacacttaccccgtatcagacgattcaattctcagctctgactcctcctccttttgtagcacgtgtagcgaagacttcacatatcgttcatacacatccgcgaccaccaagacctttcaggcagaaccatgtgcctttgtggtggacacatctgttcgacggccaaccacaccaatcaaaccccctccggctcacgtggaaaagaccgtggtcgggaagacctgccatattaaggggcagtccatcatttccaagcataaatataacaagacaaacctgttatatagctatccaaaactacggtcatgtaagtcagattcccaccttcttgcctcttttgagacaggaacaaaaaagtctaaggatgcaactacggagacggactctctgggtagctctctgcactgtgataaaaccgctaaggccatggacgaaatgaagaacttaaaaaacgtgtttgtcaacttcaagtgttatctgaagggagaaacagaagtgattctagagtccattttgagagagattatgtcagatctgacgcaagctatccccagcctctcttccgtgactgcagaggtttttgttgaacagtgcgagcgtgaaaaggagattcttctctccaatgctcatataccatccgttgcgagcgagattgtcgaaaatatgttagagaagctggagtctgcagtggaaaagaagtgcgtggagatgtttagtcaggatctgtcagtggacatcaaaccatctcttgccgcatctgatgagctgctgaccagttccaacggaaaacccctgaagaacagcatgccccatacccttgaccctatgtgtgatatcgcagaggacatggtccacgccatcctggaaaagcttatgaccttggtgtctttcaagcagaatgagttcttacatctgaaggataccaacaaactgagctgtcaacagcacaaaactgaccctatctgcatgtttctgcagagagccggaaaaaacaagagcagtcttgagtccgacgaggcaagcctcatcgtgaacgaagaagtccagaaccttatcagtaacattttttctcagagttccctggtggcctatatagaggaggccattaacgccatacttggctacattcagaccgaactcaataatgagcggattatcgcatccgaagagaccgtggtattgctacaactcctggaagacatcctgtttcaactgcaccaggaaccagttaatgagtcattccagaaaagtagacagcctcgcatatcatcaccttccgatactaaggaaaagtatcgtctgaccgggacgcggctctcgaattccccaagatccggccgacccttcccccctatcaacgttcccggtatggtgctgtacagcgacgatgagaatgaagagattgataacattgttaaaaatgtgttggactccacttttaaggacgagaaagtcaagagccaggaacagatccctaatcactggttcacaaagggcaacacttgttttgaatgtaagagaaatattaagcctccaacaaagccaggttccaggagcaaggccgcattccacgactgggaacttaaaaccgagccaccctccaccaatcacgaagacatccttaaaaagaaactcagtagcaataaggatatttccaccttctcccaagaccagaaacaccagattgagaaggcctctgaaaacatcgtcacatccattctgaaagagatgctcaaggacatcagtagcgtgcccttcgggcacttggatagtaaaacggggtcagaagcgtccgtacttgtgtctgagaaaccacagggcctcagccaccaagagtggatagaccagatgttctctgtgagcgagatcagtaccgtcgcacaggagatcacagattctgttctgaacattctccacaaagccagcaattatatatcaaataccactaaaagctcaatctcctcttcggtccaccagatttccttacacaactctgataccgagcatatcgtcaaagaggcgccaaataaatatccactgaaaacatggttcgacagcgagaaaaagatgaaatacctcagtctgtttgacgtggatccggaaaagcccccatggctgaaaagcggcaaaagcgagcccaagccggtggacgacatcaatgataaaattatccggaccatcttcaagcgcctaaaaagttttatctgcccgaagttgcatatgggattcaagagctccctgcgtagccagctcagcaagtatacagcaaaaatcgtgaatattgtcctgtgcgcgatccaaaacgagctggagttgcataaagagaatttgaacttgagagaaattgatcacactaagagcctaaccgataagggattctttgctaacactgacaagaaactggagagtctcgtcacctccatagatgatgatatccttgcgtccccactgttgacttgtatttacgacatgctacttagttctgagaatgcccatcaaagatcaatctccctcagcagtaggaagcccaaatctgcaaccgactctgtggacgtccagagcattctccctaaccgacaggataagaagagcttccacaagtatctcgccacaccctgtactcatcactcagtgaatggcggaaaccatatcaaagagaatgccaagctgcaggttctggagcggattggagagacattgcacgagatgctgtcaaagctgctgggcacccatctgcattcccagctgagttgttctcagcagtctcgggagatgacaaacaagaaccagaaaatggccgcagcattgcagtctaacatacagctgatttcgaaagccattctagattacattcttgccaagttgtgcggagtcgacatggataccagctttgcttcatgcggccttaaagctatctcagaaagcctggatatcgacaatcctagctttgctagcatcatcgaaaaaatggccaagtcaacgaagatcatatcgtctatcgtctcaagacgggttcaggaagataataaggaggagaccaaatcgaaggcaaaaccagtggcacccgtgtcttccaagactcccagtacgaaagagatgcatcccaataagctcaaagccgttgcttcagacatcctgaacatggtgttcgccaagctggaggggtttgctaacggtcatctggagatcctgggagctattaatgacggtaataagaaaagtaacaagataggttgggagtacgagagtaccaacatatcccgggatacacatgaagcctcattcctgtctgccctctacatgcacgctaaaaaggtttcatcagcaatcctaaaagttatccaaacagaactgaacgtgactagtagcgacctaaagaccagtgtcgagaaccctccccctgagacccagatcctgaaatacgtcgtgaagctgatcctggacgcagtttctagtgacatgttcaacgagatggagtcagaaggcggtggcatcgaaacatatagataccgacccacgtacggctccctccccggaggcgctgagtccgactctttcttggaggacgacgcctacaccgccaaaaagattatagatgaaagatctccccagcgagaggaagttaagacaagatccctgaagcaatgggccctggagaaaactctcaacaaaatagaggtgaagttgaaagaacctcatattagccctatagctcccatcatcagaaacattttgaatgagatatttcagagcacacttattaaccagctcaacgtcctttctctgtcccactctaatttcaacgggatgccacacaatgtggacgaacccacccctcaaacgtccgtacagttcatggacaaaatgatggacccactgctgtccgaagccgatattacaatcgtgacagataatattgtacgtaccgtatttcacaaactgtattccgccgcaatgacggagcgcaacgttcgagagaatcgttataagactatcaccttttccgcgaacgtttccagtcatgaacatacgtacaagggtaaatcctcagtgacagctttggacgagaacccttgtacgtttcagtctcgattttcagttgccgacaaggaaacgaaagtcaatcttgctgaggacattgtgcaggctatcctgacaaaccttgagacctttgccacgtccaaagtgaagtcactgttctatagccaggtgaattttacggtccccgtcgctctccctatccagcaagatcattccaccctctccaaagcactgagcgcgaaggactcttactccgacgaacagttctcgtgttgttcagtggatcatacgaaaagcggaaaaaccaatctgtgtcagttatccctatccaaactgaacacttacgcacttcaggtcgcaagacgaaatttgcagggaataaagcaggagctggacaaagaacgcgagaaccccttcctgacgcacgacattgggatcagtgagtcgatcgcatctcagatcgtcaatgctcttctggacattatctctagaaagggcaagtgtgacaaaaacagttcagacaaggagattgaccttgaccaacagaagggagtgattgaaaagctgctaaatgagacaaaatacaggaaagtactgcaactccagattcaggataccatcgagggcattttgtgtgacatttacgagaagaccctgttccagaacaacttatcatttgccacacctactctgaagtgcagcattgcagacaagcacagcgaggaaaatagcgagatgtttatggaaggagcgaacaagataatcccaaagttaagcgtacccaaatccgatgtgatcctaatcagtaacgatatagttaacatagtgctgcataacctctcatccgctgccactctcgtgattaacgctaaaaatcccaccagtgcacgactcccgcttacgttttgtgacacatttcccaaaattgattgccagcagcctctgaaaggatctaaaacagaacgcaaaaccgaaaggtttagctacagccgaaaccagaagtccgcttacgccgatgacaaccagatcacagttgtggaaaaagaagatacccaaaaaagcgcaaccgactcatgtgaggagaatgctaactttatcactaagaccatttttaaaaggctggagtcatttgccactgaaagaatcgactcgttaatcaccctggctttccaatcgaaggagaagtcttttgtgatcccagaattagagaattgtaaacagaatgattcaatcttctatgatagtagccaggtggagtccgacgtcaacgtattgaagatctccgccactgagacaatcctgtcacaagagctcacagattttaccttcgttgggagacgggagaagctgggcagcactatccacttgagtcaagcacggctcaagacatacgctgacgtcatagccagcgcaattctgaaactcatcaagaatgacctcgatctcgaaatccaaaagatctatccctaccagaacaacatcctgttccaggagaatatcatcgtgagtgagatcgtggactcgatgctgaaaatgctggacgataaaagatccgtgaaagaaatttgctttaattctaaggagaattccaatttcagtcagctcgccctgtcgaacgagattcttcttggccacaaggaaaaggagcgttccactaaacagtccctcttcacgaagtacccactggagcaaaatcagatgattttggaaaacaaacgccaaattatagtcctcgaggaaatctttatgcggaatggcgagtccaagaataaagaaaagggtgagctgctcattgctgtggaggagttactcaacaaactctaccagcgggtgcgcgaagtgacaggccatttaccccctctgaatgagaccgccaattttatctctaattctaagatcaaaactagcgataccacccagaagaactcttttcaaagtcatatcaatagcgttgcaaatgacatagtcgagtccgtgttaggaaagatgtaccttgtagtggtgacatctctttacgaaaataataagagcaggactgaagtcgagatcagtgaccataatgactccctgctgatgaagcccctgcgatttagggagacgaaacaagcaggtaagatctccaattctccaaggtatgccatttcccaggcatatagctacgtggattcccagaacattagcgtcatggagaatacactactgccatatctcccactgcaagtgaagaaggacttgattcagatggtgctcaacaagatcaccaactttgtatcactgccactgaaagtttcccccaaggacaaccccaagccctgctttaaggctcatttaaagacccgcagtaagatcaccaccctcccaaagttcacaaagaagactcatctgggcctgtctgcggcaaaggccaaatcaaagactaagctcgggccaggcgaaaaaaccctgaaggattcaaggtctaagaccgcaattggcttatctcacatcatgagtgctggcgatgccaaaaacttgttagacacaaaactcccaacttcagaactaaagatatatgcaaaagacataattatcaatattctggagacaattgtgaaggaattcgggaaggttaaacagacaaaggctctaccgtcagatcagattattgccgctggaaagatcgtcaataccgtgcttcaggagctttatgtgacaaacaattgtaacctggcatatcccatgaagtcatctcatctgaggctatcccagggcaacatcggaacaggcagccttcccaagcagcaggcatgcttctatctcgagaatgtaagttcccagttagaacatatctttccccgagaggggattttcaagaaactcttcgataagtggcagaccgagtctaacgataaagaaaacgaaaagtgcaagctgctgatgatcgccgaaaatgtcctgacagaaatctcaattaaggctaaggagctagagtactcactaagcctgctgaacctgcctcccctcgaaaactgtgagtccagattctataatcactttaaaggagccagtaccagagctgaggacactaaggcccagattaacatgttcggacgcgagatcgtggagatgcttctggagaaacttcagctgtgcttcctgtctcaaattccaacacccgatagcgaggagaccctgagtaacagcaaagaacacattactgctaaatcgaagtacgggttcccaaacaagcactctttaagctctttgcctatttacaacaccaagacgaaggaccagatctcagtgggttccagcaatcagattgtacaggaaattgtagaaacagtcctgaatatgcttgagtcattcgtggatttgcaattcaaacatatctctaaatacgaattcagtgaaattgtgaagatgccgatcgaaaacctatcctccattcagcagaagttgttgaataaaaagatgctgccaaagctccaacctctaaaaatgttttctgacaaatccgagtcaaatacgatcaattttaaagaaaatattcagaacatcttgctgcgggtgcatagtttccactcacagctgctcacctatgctgttaacatcatttccgacatgctggccgtcattaagaacaaactggataatgagatctcacagatggagccctcctccatctccattctaaaagagaacatcgtcgcgagcgagatcataggtactctgatggaccaatgtacatatttcaatgagtctctgattcagaacttgtctcgggagagcctctttcaaggagctgagaatgcctacacggtgaatcaggtcgagctggcaacaaatatgaagatgtttacgtctaaactgaaagaaggatctttgggtattaatccttcccaagtctctaagaccggattcgtgttttgtagcgacgaggacatgaaggagaagtacagagtcagctctgacctgccaacatcagtgcgctcttccgttgaggacaccgtaaagaactccgaacccacgaaacgcccagattctgaaacaatgccatcttgcagtacacggaacaaagtgcaggatcaccggcctcgagaatccaatttcgggtcctttgatcagaccatgaaggggaatagctatttgccagagggaagttttctgcaaaaattgctacgaaaggcatccgacagcactgaggccgctttgaaacaggtgctgtcgtttattgagatgggtaagggcgaaaatctccgcgtttttcattatgagaacctcaaacctgtggtggaaccaaaccagatccagaccacgatttctcccctgaaaatatgcttagccgcagagaatattgtgaacacagtgctctccagttgcgggtttcctagccagccccacaccaatgaaaatcgtgaaattatgaagcctttcttcatcagcaaacagagcagcctctccgaggtgagcggcggtcagaaagacaacgaaaaatctctcttgcggatgcaggacaagaagatcaactacataccagaggaggaaaacgaaaacctggaggcttccagagaagatagctccttcttgcagaagttgaagaaaaaggaatatcccaagattgagactgttaaggaggtggaggcttttacgttcgctgaccatgaaatgggcagtaatgaagtacacttgattgctcggcatgtcacaacctccgtcgtcacatacctgaaaaacttcgagaccaccgtgtttagtgaggagaaaatgtccgtcagtacatggtctcgtaagaaatatgagtcgaagcagttcttaaggaatatctacgatgatagcagcatctaccagtgctgtgaacacctcaccgagtccgtgctctatcacttgacatcatctataagtgatggtacaaagaagggtcgggaaaaggagaaggcttgggagattcaagaagcaaccttctctaaaatcatctccattcactcgcaagtgttcgagtcaagatccatatctataggggaattggcactatgcatttcggaaataattatcaagatcctcttcaacaacaaaataattcaggctgacattgctcagaagatggtggctattcctacgaagtacacttactgcccgggaatcgtatctgggggtttcgacgacctgttccaggatctcctggtcggggtgattcacgtcctgtctaaagagattgaagtggattaccactttgagagcaacgtgcgtaacaaatcttttagcatgcacaggaacaattctgtgcccctgtgtaacaagattaaccgccaggcctcaccacgggactggcagttttcaacccaacagatcggtcagcttttccagaagaataagctctcatacctggcctgcaagctcaactctctcgtcggcaatctgaaaacttcggaatctaaggaggtggtgaacaaggtattcaatatagtgagtgacttgttttccccagatgaatgccttgacactggaatggactctgggaagatccagagaacctacttttacagttcgaataacgagcagcctaactctatactgactaacaatctgcagctctcttcaaaaagcgtatttctgctcaatgtcgtgtgtgagaagctgattagaatacttctggaagaatgcacgagcactgcctttcccgacaagggatcagtgtccgaggagacctcggcagaggaatgtcagctgctgaaaatgcttcaatcagtcgaggatggaaagagcgattatcgaaaggggggtatggattgcgaatgtcttcaggtcgattacatgagcgatctgcttgaaaatgtcgccgaaatcgaccaagacctcttgacctcggattcaatgttgaccattatctcccactcacttgttaaaagccttatggataaactctcccattctatccaacaggcaccagagagcttgccctttgcaaacaagcatctgaattaccggactagagaaatacagtccagttttattaaagctcggaagtccgagctgatcgaattgggccagtccaagagcagtctcgagttgcgcagctacgattccaactcactgaccgtttcactcaataacccatctgtagtcagctcaaagatacaggctccatttaacaagcactgcgctgttaagtcgtcctccgtttcgccatttgaaagacagcggacaaaggaaatggacaaggttgcaattcacaacaagctgcatcaggaaggaatttacgctggagtgtactcagctacctttctcgaaggaattatttccgaactgttttttaacctgagcatgtcgctgtggggcaagaataagaacatcaccgtatcttggcttaacgagatgaacactctgttcgtgaacaacgtggtcaatgagtttaataacgcgcaggtcactgtgctccggaacgccgaggaaaggctgtgttttcctcccgtgcacactgaaacagtgagcaaaatagtggattccgtgtactatgacgtacttcagcagtatgaactgaaagtggcatgtggaaacaaccccgtttacgataacgcctccatcgctgagcagatcactaacgggatcttgttggagattctggattacaagcttccatcctgtttcaaggagcacctgatcccacacagctactacccccttaagccggaaatcattcttcagaagttgcaatccaaccttacggagttcaccagtctcccccgaagttccagcgactacagcacaatgctctcccattcatttcttgaagacgtgataaggaggctgctctctcaactcatcccccctcccatcacttgctctagcctcggcaagaaatatttgatgagctccgactttaacgaaatgagcacttgcatcatcaataaggttatgtctgcaataagcaaacataaaatatggtttacaatatatgataatcagtatctgtacactggaaaaaatctccagaaaatggtagatagcgtgtattgtaacattctgcagatgagcgactccttggtctcgatacagaagagcatagtgagccggtcccctataatgatcgatcaaatcgctagttttattattcaggagattatcgagaaccatcttcagccttttctctcaggcgaagtgctctgccatcctcgcaccccactggatcccgtgagtactatcgttactcaggtgctgtcagaggtgatagaatcccacagacctcagaagcagagcccattggatatccatctggattcttttgtgcgagaaatcgtcgcccgattgctgagcaagatattttctcccaagcacaatacagagattgaattgaaaaatatgacacagagaattgttaactcaattaaccgccacttcaacaaagctaagatccatatcctgtatgatgataaggagcaggcttttttttcctttaacaccgatatcgtcgatgagttggccacctctgtgtacagaaacgctctgaagcaacacggattagacctcgccgtagacaaagagtcagaggactctggcattttcgtcgagaatataacgaacttgattgttgccgctatatctgactatctgctgcatcctctcttcagcggagacttcagtgcctcaacatatagcaatagtgtcgccgaaaacatcgtgcaggacattctatccaacatcagtaagtctacagaaccttctcaatccgtgcctttgtacaacactctgcttccatatacgttcctggaggacatgatcagggtgctcttgagtaaattgttttcctctgcctcatctctggtgctcaatagagacacccagaaagacatatcccgagtaaacttcaacgatatcgctagcaatctcgtgtccgatataaggatgaaagtatctcagcacgagatacgttttagtaaagaagaggaagaaaccaagtttatctattctgaggatgatatccagcatctcgtggacagcgtattcgcgaatgtggtgcagacaagcggctctcaggagtcggccgtgcagaatattacaagctccaatgatatacttattgacagaatcgccggttttatcattaaacacatctgccagaaacacctccaaccttttgtgtctggaaagtctctcagttcaagtgacacttatttcgacgacgagcggaggcaactgttctatacttctgtatactcatcaaccttcctggaggacgttatatcaggggttctccgaaagatcttccacagagtcgtgggtatcgtccaaaccaagtcaatcagagactcagaggatgagttgttcgaaaaagcagaagagctgatacatttaatcaccggcgaattctcaaaggcacaggtgagcattattgacaacaccgaggagcgcctctgtcttccaccagttgagagggatgtcgttaagactatcgtggatatggtgtatagcaaagtcctgcaggagtacgaaatggaggtggtgccaaataaagacttcttaaatgacaccaagacattagcggcacgaataaccaatatcattctggcagaaatcttcgactttcaaatacatcccgatctgattgccaatctgccttttaagtctcactccaaactaagtgcaaatgtgcttatccaacgggttcaatatgacatcagcaagtccaggttccaacgccaggcttccactatgtacacaaccatgctttcgcactctcacctggagaagatcgtaacccagctgacatcccaaatctcgccccttaatacctcggctgagcaaagcgacactactaagagcgatctcagcaacaccgtcatcaagctcattaatgaaataatgagtatcatctctaaacatgaaatctgcattatcaagtatggtaacaagaagcaatctatgatctcggctaaagatatccagagcatggtagacagcatatatgcagacctttctcattccaacatatatcagtccattaccaaggacaaaaaatccatatccgacatccccgtgagtaagatcgcaagttttatcattaaggaaatcttcaatcatcacattcagagcttcttatctgaggacaagactttactgctagcggcagtggaccagacctacaaattaaaggctatagaccccaagcagcgcgaattgtcgtttatcgttaactcttctgttttcctggaggaagtcatttccgagctactatgtaaaatactatacgctttctcacataatatgctggttactgagaatccggaccgcgtcaagctgaaactcacccgaatcgtaaccacactggtaaacagtatcgtgctggagttcactacatctgagatcctggttgctgacaactttgataaaaacctgtgcttcagcgagcgctataaagagatggtgcagaaaatcgtcaactccgtctacgggaaagtgctggaccagtacaagagtctgatccagatccatcgcgtcattcagtccgacacaatctgttttggccgaaagatctactatcttctgctcgaggaaatctacgattatcaggtgcagtcgctggtgtctggcgagttggagagcagctcatactcttaccctcaagctgataacatcatcagaaacgtactaaacatcatcaccaaagacagtcacgccctgcctccctacatcacagtgttgccgcattcacttctggaggatatggtctaccgcctacttgggcacgtcttcccctctacgcacaccgaaaacgaattgaaggagaagaaatttccccctgatgacgagtttgtggaggccgcatccaagctgactgacgaaatcattaaagagattagcgagcatgagatacgcctgtctatggctgaggataatgcagaatcaatgcagctggagccgatcgagaatctggtcgactctatttgcaataatatactcaagacctccgagtttcaggccgaagtacaaaaagacgccgacaagaagggttgttccttccttagcaaactcgccggatttatcatgaaagaaataatgtatcaccacctgcagccttttttgcatggcgaagaatcatcattcagcgatttgtctgattacgaccatgtgagcgaattggctaagtccggaaaagagaaaacacagcctagcttatattccgccacctttctggaggacataatcattgacttggtgcataagttttgttcgctgttaatcattaccgaagacagcaagaaaaatgagatggcagaactggacattatgggccttgcactcaaacttgccaattcactgatccgggagttcaaaaaatccgacatcaaagtgctgcctaatgccgagaagatgttctccttcccccctatcgacaaagagactgtagacaagatctctaacttcgtgtatgagcagtttattgagaagtgtaccagccacgatatacaaaaaggcgatgagagcaatatcgctatcggcatgattgctgctctgacccaaaaagctatcagcgcgtttaggattcagcccctgttttccggcgactggtctagtacttttttcagcttcctcaatccagataacatcacacagcgtgtgcagcacctgccacagaatacctttacccagatatcaaggtgtgcaaaagaaaatcagctaagcctccccgatcagagttataaagatactagctcaacacctgactgcaaaaatatgatgagtactctggagattaatagggggacaatgaaccgcaagaaaagttttaagacaaaagacacttcagtgaaaaagggggacatccagaaccccgttctgtcgagcatcaatgcaatcatgaagtctgggatgattaacctgaccagtggcctggcaactggcgtcacaaataagaaggaggtggacgagaataaggtaggcatatgtactcagaaacactctgagaacgtttccaaagtcacctctacaacgacggtcaaatctaaggacacacaagagcctaacttgtcagaaacattcaataataatgaaatcgaaaagaaacgcaatctgattcccaccgacaagaaaggaaaggacgacgaaatctacacccacttctcactgatcattgacgatacagaatatgaaaaagaggtactcggtagcgactccgaaattgggtacaagaaaaagatcgacaacgcacgcgaatcctcttttaaaaaggacgataagctattccaactatcctcactaaaatctaaaagaaatctgggtacaacaaccgacacactcgaaattcgtatacggacaagtagcaacgagggtcgcagagattctccaactcagacctgcagagatgaggagcaccacagtgactacgagcacgtccaaaatgttatagaaaacatcttcgaagatgtgcttgaactgtcctccagcccagaacccgcatactactctaaactgtcgtacgatcaaagtccgccaggagacaacgtgttgaacgtgattcaggaaatctcccgggactcagcccagagcgtcaccaccaaaaaagtatcttcttctacaaacaaaaacatttcagccaaggagaaagaagaggaggagagggagaaagagaaggttagggaagaaattaaatcagaaccctcaaaacccgacgacccccagaatcaaagagagagcaagcccggtatctttcccgctaagttcctggaggatgtgatcacagagatggtgaaacagcttatcttcagcagcattcctgaaactcagatccaagatcggtgccagaatgtttcagataagcagaaccaagccaaactctacgacaccgctatgaaactgattaatagtctgttgaaagaatttagtgacgcacagatcaaagtctttaggcccgacaaaggtaaccagttcccaggtgggaaggtaagttctgttccgaaagtgcccccacgttataaggaaccgaccaccgacgaggctccgagctctataaagatcaaaagtgctgataagatgcctcccatgcataagatgatgaggaaaccctcttctgacaagattcctagcattgacaaaacactggtgaataaagtcgtacactcaagcgtgtgtaatatactgaatgactacgggtcacaggattctatctggaagaatattaactcaaatggtgagaacctcgcaaggcgcctgacctccgctgtgatcaacgaaatcttccaacggcaagtcaacctgattttttgcgacgaagtctctgtatcagcatgtttacccctggagtcaaaagatgtggtgaagaaggtacagaagcttgcccagaccgccagcaaagaatgtcagacatccagtccatataccatcattctgcctcacaagttcctggagaacgtgattagtgcccttttcagtaagatctttagcactataagctcaacaaagaccaaggaaccagaggataacctctctacggaactaaacttccttcaaatgaaactggttagcgctgtcgccaccgaaatttcccaagacaaatacatgacaatccagtatgtagaaaccctgcaaagtgatgatgatgagattatccagctcgtggttcagtccgtgtacaacaatctcctcccccagttcggcagccaggaaattatacagaattgcgtgacaagcgggtgtaaaatcctttctgagaacatcgttgacctggtcctgcgcgaagtggcaagcaatcaactgcagagctacttttgtggggagctgacgcctcaccagtgcgtcgaggtagagaacatagtggagaagatccttaaggacgtgtttcagacaacagacgttcccctgccaaagccctcacatgcagacaaactaagttataacattattgaggagatcgccgtgaaatttctgtccaagctgctctctatattcccaaaggttcataaggaaaggaccaagtctttggagacagatatgcagaaaatcacttcaaaagtgctcaactctgtgcaggaattcatcagtaaatccaagatcaagctggtgcccccaaccaaggagagtccaactgttccagtagctgacaatgctactattgaaaacatcgtgaattcaatatacacctctgttctgaagcattcaggttcctacactagcgtgtttaaggatctcatggggaagtcgaatgtgttgagtgataccattggatttctcatggtgaacgctatttcaaattcagagtttcagccccaggttgaagaggaggtcagcaacagcgagctggtcttagaagccgtgaaaattatggaaaaggtgattaaaataatcgatgagttgaaatctaaggaaaaaagtagtagccggaagggcctcaccctggacgcgaaactcctggaggaggtgttagccctctttctagcgaagttgatcagactgccttcaagctcttccaaggatgagaagaatctcagcaaaaccgagcttaacaagattgcttcacagctatcaaagctggtcactgccgagatcagccgttcttccattagcctaatcgctagcgatcccgaggaacactgcctaaatcccgaaaatacagaaagaatctaccaggtggtcgattccgtctactccaacatcttacagcagagcgggacaaataaagaattttattacgatattaaagacaccaacaccgcctttcctaaaaaagtggcctccctcattatcgacggcgtgagcagcttcccactcgataccataaactccacgatctctaatgctgatctaagtggtgaattagatgtgaaccgcattgtgcagaaggcacaggaacatgcttttaatgtgataccagagttggagcaagaaaagctggatcagaatctatctgaagaggaatcaccgataaagattgtgcctcatgtgggtaagaagccggtaaagatcgacccaaaaataatctctgagcatttggctgtcatcagtattaagacacagcctctcgaaaagcttaaacaggagtgccttaagcgcacaggacacagcattgctgaacttaggcgcgcaagtatcagcggcagaaactactccctgggaagcccggatctggagaagcgcaagacagaacgacgcacttcccttgataaaactggtcggctggacgtgaaaccactagaggctgtggctcgcaacagctttcaaaatataagaaagcctgacattactaaagtggaactacttaaggacgtgcagagtaagaatgatcttatcgtacgcctggtggctcacgatattgatcaagtatatctggaaaactacattaaggaggagcgtgattccgatgaggatgaggttgtgctgacacaaacattcgctaaggaagaaggaattaaggtatttgaagaccaggtgaaagaagtgaagaagccaattcagtctaagttaagtcccaaaagcacactctccacttcttctctcaagaagttcctgtcgttgtcaaaatgttgtcaaaccacagccagcgctaacatcgagtctaccgaagcaataagcaaccaagttatcgaaagcaaggagacacatgtcaaacgcgctgtggccgaactggatatggcgactcctaagaccatgcctgagactgcgagctctagttgggaagagaagcctcagtgtaagaaggaggagaagaacctcgttacagagccgacccactactttatacaccgaattatgtcctcttcctcctacaaccaggaggatttgatttcttctacgggcgaggctgaagactgtcattcagatccttcagccaagattttggaagagtcatctcaggagcaaaaaccagagcatggtaattccgtcaagtttatcactatctttgagaggtccaaggacgttctggggtccgccaatccttccaaggaagtgatatccgaaaccccaaagccggacgtgtccaaacagggctcaaaaatgctgactaaaatgtcttcaacactctccaaggtattttcacagtgcaatacaaacatctcgagatcctcatcccccgctcatcaggacgaacactac

SEQ ID NO: 50333 - DNA, 411 bp, Artificial Sequence
  Description of Artificial Sequence: Synthetic coding sequence
aaggaccaggaacggttgatgaggcatcggtaccttgacatgatctccaggaagttggagcaactggagaggaccgccgaagagcagcgcctgtttttaatggaccgggaggagcgcagacagagggagcatactagacggaagctgacgctgcgtcgcaaaattgaggaggagtggaaaactaaggaaatgctgctcctgacccggatggctgaagatgtgaagagggaggaacgtattgaagaacagcagcatcgcaatagggaggagtcggaccggaagaagcaggatctgctggagaagaagatggcttatcaccttcagaaaatgcaggacaccggttttaatggagaggacatcggcaaaaataccttcaaataccggggacaggatggtacccatggagagtag

SEQ ID NO: 50334 - DNA, 393 bp, Artificial Sequence
  Description of Artificial Sequence: Synthetic coding sequence
atgcggcaccggtatctagatatgatctctcgcaagctcgagcagctcgaacgcaccgccgaggaacagcgcctgttcttgatggacagagaggagagaaggcagagagaacatacccggaggaagttaaccctaaggcgcaagatcgaagaagaatggaaaacgaaagaaatgctcctgttgacccgaatggccgaggatgttaaacgggaagagaggatcgaagaacagcagcaccgcaaccgggaggaaagtgatcggaagaagcaggacctgctggaaaaaaaaatggcctatcatctacagaaaatgcaggacaccggctttaacggagaggatatcggtaagaacacttttaagtatcgaggtcaggatggaactcatggagagtag

SEQ ID NO: 50335 - DNA, 1377 bp, Artificial Sequence
  Description of Artificial Sequence: Synthetic coding sequence
atgatgctcattcccatggcctcagtgatggccgtgacagagccaaaatgggtgagtgtctggagcaggtttctgtgggtgaccctgctgagcatggttttgggatcactgttggccttgctgttacccctgggagctgttgaggagcagtgtttggcagtcctgaaaggactgtaccttctgcggtctaaaccggatcgcgctcagcacgccgctaccaagtgcacaagcccaagcaccgagctgtcaatcactagcaggggagctacactgctcgtcgccaagaccaaagcttccccagccggaaagctcgaagcgagggccgcactgaaccaagcactcgagatgaagcgccaaggcaagcgtgagaaggcccagaagttgttcatgcacgccttaaagatggacccggatttcgttgatgctctgactgagtttggcatcttttcggaggaagataaagacattatacaggcagattatctgtacactagggccctgacgatttctccttaccacgagaaagcgctggtcaatcgggatcgcacgctcccgctggtggaggaaatagatcagagatactttagtattatcgattccaaagttaagaaagtgatgtctataccaaaaggtaatagtgccctcagacgcgtgatggaagaaacttattatcatcacatataccacactgtcgctattgagggaaatacccttactctgagcgaaatacgtcacattttggagacaaggtacgccgtgcccggaaaaagcctggaagagcagaacgaggtgatcggcatgcacgccgctatgaagtacataaatacaacattagtatcacgcatcggatccgtgacaataagtgatgtgctcgaaattcacaggcgcgtgctaggatacgtcgacccggttgaggccggacggttcaggactacgcaggtgttggttggtcaccacatacctccccacccccaggatgtggagaagcagatgcaggagtttgttcagtggctaaatagtgaggaagccatgaacctgcatcctgtggagttcgccgctcttgctcattacaaactggtgtacattcacccttttatcgatggaaatggacgtactagtaggctcctgatgaatctgatcctcatgcaggcagggtacccgcctattacaatccgcaaggagcagcgcagtgattactatcacgtacttgaggctgctaacgaaggagacgtgcggccattcatcagatttattgcaaagtgcaccgagacgaccctggacacactgctgtttgcaaccactgagtacagtgtagccctgcccgaagcccagcccaaccactcgggattcaaggagacactgcccgtgaagccttag

SEQ ID NO: 50336 - DNA, 831 bp, Artificial Sequence
  Description of Artificial Sequence: Synthetic coding sequence
atggcctcgaaaccagaaaagagggtcgcctcctccgtcttcatcacattggcaccacctaggagagacgtggcggtcgcagaggaggtacgccaggcagtgtgcgaggctcgccgaggcagaccctgggaagcacctgctccgatgaaaacccccgaggccggtctggccggtcggccttcaccatggaccaccccaggaagagcagccgctacagtgccagcggcacccatgcagcttttcaatggagacatatgcgctttctgccataaaacagtgtcgccccgtgagctcgctgtggaagcgatgaagcgccagtatcatgcccagtgttttacgtgtcgcacatgccggcgtcagctggcgggacagtccttttatcagaaagacgggagaccgttgtgcgagccttgctaccaggacactctggaaagatgtggtaagtgcggcgaggtggtaagggaccacattatcagagccctgggccaagcctttcatccatcttgcttcacatgcgtcacgtgtgcaagatgtattggcgatgagagttttgctctggggtcgcagaatgaggtttactgtctggatgatttctatcggaaattcgcccctgtgtgctccatatgcgaaaatccaatcatccctcgggacggtaaggacgcttttaagattgagtgcatggggagaaacttccatgaaaattgctatcggtgcgaggattgccggattcttttaagcgttgagccaactgatcaggggtgctaccccttgaataatcatctcttctgcaagccctgtcacgtgaaacggagcgctgccggatgctgttag

SEQ ID NO: 50337 - DNA, 1122 bp, Artificial Sequence
  Description of Artificial Sequence: Synthetic coding sequence
atggcgagcaaacccgagaaacgcgttgcgtcctcggtgtttatcaccctcgcgccacccagaagagatgtggccgtggcggaggaggtgcggcaggcagtgtgtgaagctaggcgtggaaggccttgggaggccccagcccctatgaagacacccgaggcagggttggctggcaggccatctccctggacgacccctggccgagcggcagccaccgtgccagccgctccgatgcagctcttcaacgggggatgtccacccccacctccagtgctcgatggcgaggacgtgctgccagatctcgatctcctcccgcctccgcctcctccccctccggtgctgcttccctccgaggaggaggctccagcccctatgggtgccagtttaatagccgacctagaacaacttcacctgtcgccacccccacctcctccacaggcccctgccgagggaccttccgtccagcctggcccactcagacccatggaggaggagctgccaccccctcctgcggagccagtggaaaaaggtgctagcaccgacatttgtgccttctgccacaaaacagtttcacctagagagcttgctgttgaggctatgaagaggcagtaccatgcccagtgtttcacatgtcgcacctgcaggcgacagctggccggacaatccttctaccaaaaggatggcaggccactctgcgagccctgctaccaggatactctggaacgttgtgggaaatgtggagaggtggtgagagatcacatcattagggccctgggacaggcctttcatccatcttgctttacctgcgttacctgcgcaaggtgtataggagacgagtcattcgccctgggatcccagaacgaggtgtattgtctggatgacttttaccgtaagtttgctcctgtttgcagcatctgcgaaaaccccattataccgagagacggcaaggatgcttttaagattgaatgtatgggcaggaacttccacgagaactgctataggtgcgaggactgccgtatcttgctgagcgtggaaccaaccgatcaggggtgttaccccctaaacaaccatctgttctgcaagccatgccatgtgaagagaagtgctgctggatgctgctag

SEQ ID NO: 50338 - DNA, 1122 bp, Artificial Sequence
  Description of Artificial Sequence: Synthetic coding sequence
atggcctctaagcccgaaaaacgggtcgcctcttccgtgttcatcaccctggctccccctaggagggacgtggccgtggcggaggaagtgagacaagctgtttgcgaggcaaggagaggacggccttgggaggccccagcacctatgaagacacctgaagctggcctggctggtcgcccaagcccctggacaactccgggtagagctgcggctactgtccctgccgctcctatgcagctattcaatgggggatgtccacctcccccacctgtattggacggagaggacgtcttgcccgatcttgaccttctgccccctcccccaccgccacccccagtgttgctccctagcgaagaagaagcccctgctccgatgggagcatccctgattgctgaccttgaacagttgcacctgagccctcccccacctccgccacaggcccctgcagagggtccttcagtgcagcctggacccctccgcccaatggaggaggagctgccccctcccccagctgaacccgtcgagaagggagccagtacagatatttgtgcattctgccacaagacagtgtcccctagagaactggccgtggaggccatgaagcgacagtatcatgcacagtgtttcacctgccgaacttgtagacggcagctggccggtcagagtttctaccagaaggatggtcggcctctttgcgagccctgctatcaggacactcttgagcggtgtggaaaatgcggtgaggtagtcagggaccatatcatccgggcactcggacaggcctttcatcctagctgctttacctgtgtaacatgcgccagatgcataggagacgaatcttttgccctcggatcacaaaatgaggtgtattgtttagatgatttttaccggaagtttgctcctgtgtgctctatctgtgagaacccaataataccaagggacggcaaagatgccttcaagatcgagtgtatgggcagaaattttcacgagaactgttatcggtgcgaggactgccgtatcctcttgagcgtggaacccaccgaccaaggttgttaccctttgaataatcacctcttctgcaagccatgtcacgtgaaaagaagtgcagccggatgctgctag

SEQ ID NO: 50339 - DNA, 831 bp, Artificial Sequence
  Description of Artificial Sequence: Synthetic coding sequence
atggcctccaagcctgaaaaacgggtcgcaagcagcgtctttattaccctcgccccacctcgtcgcgacgtggcagtcgcggaagaggtaaggcaggccgtatgtgaggcgagaagggggagaccctgggaggccccagcacctatgaagacacctgaagcagggctcgctgggagaccaagcccgtggaccacccccggtcgggctgccgcaaccgtacctgccgcacctatgcagcttttcaacggggacatctgcgctttttgccacaaaacggttagtcctcgggagttggctgttgaggcaatgaaaagacagtaccatgcccagtgtttcacgtgtaggacttgtagaaggcaactcgccggtcagtccttctaccagaaggacggtcggcctctgtgtgagccatgttatcaagacaccctggaacggtgtggcaaatgcggagaagtagtccgtgaccatattattcgggctcttggccaagcatttcatcccagctgcttcacatgtgtgacctgtgcacggtgcatcggtgatgagagttttgccctgggctcacagaatgaagtttattgtctcgacgatttctatcgcaagttcgctcccgtgtgcagcatctgcgagaacccgataatccctcgcgatggcaaggatgctttcaaaatcgagtgcatgggacgaaacttccacgagaactgttaccggtgtgaggactgcaggatcttattaagcgtggaaccaacagaccaaggctgttaccccctgaataaccacttgttctgcaagccctgtcacgtgaaacgcagtgccgcaggatgttgctag

SEQ ID NO: 50340 - DNA, 54 bp, Artificial Sequence
  Description of Artificial Sequence: Synthetic coding sequence
atggccagcaaaccagagaaacgagtagccagctctgtcttcatcacactgtag

SEQ ID NO: 50341 - DNA, 315 bp, Artificial Sequence
  Description of Artificial Sequence: Synthetic coding sequence
atggcttccaagcccgaaaaacgggttgcttcatccgtcttcatcactctggcacccccacgcagggacgtggctgtggccgaagaggtacgtcaggccgtgtgcgaagcccgaagaggaagaccctgggaagcccctgcaccaatgaaaactccagaagctggcttggcaggacggcctagcccctggactactcccggacgcgctgccgctactgtgcccgcagcaccaatgcagctgttcaacggtggctgccctccgccaccccctgtactggacggcgaggacgtcttgcctgatcttgatctgctgtag

SEQ ID NO: 50342 - DNA, 1125 bp, Artificial Sequence
  Description of Artificial Sequence: Synthetic coding sequence
atggcttcaaaacccgagaagcgagtggctagctctgtttttataacactggcccctcctagaagagacgttgccgtggctgaggaagtgcgtcaggccgtgtgcgaagccagaagagggaggccttgggaggctccagctccgatgaagacacccgaggctggactggctggcagaccatctccctggacaacacccggtcgggcagccgctacagttcccgctgcacccatgcagctcttcaacgggggttgccccccaccgccacctgtgcttgacggcgaggatgtactgcctgatctggacttactcccccctcctcctccgcctccacccgtcttgcttccctctgaggaagaggcccctgctcccatgggagccagcctgatcgctgatctcgagcagctgcacctgtctccccctccacctcctccccaggccccagccgagggcccttccgtgcagcctgggccactacgaccaatggaggaagagcttccgcctcctcctgcagaacccgtggagaagggcgctagcaccgatatatgcgcattctgtcacaagacagtctctcctcgtgaactggctgtcgaagctatgaaaagacagtaccacgcccagtgcttcacctgtaggacatgcagaagacagctggctggccaaagcttttatcaaaaagatggccgtcccctatgtgagccttgctaccaggataccctcgagcgctgcgggaagtgcggggaggtcgtgcgggaccacattatcagagctctgggtcaggctttccatcccagctgttttacatgtgtaacgtgcgccaggtgtataggtgacgaatctttcgcactggggtcgcagaatgaggtctattgtctcgatgatttttatcgatatgagaagggactctgcacaggctggggcgcagggacaggtagggaccctagccgtgttaaagagctgtctctgtccccagggtgctgggctagagtgagctgcctgctggtatactacaaggagtactatagagctggactcggagctgtggcccatgcatgcaacccgagcacccttggaggaaggggtgggtggatcactaggagtggggatcgggatcatccaggttag

SEQ ID NO: 50343 - DNA, 438 bp, Artificial Sequence
  Description of Artificial Sequence: Synthetic coding sequence
atggccagcaagcccgagaagagagtagcctcatccgtctttattacgctggcgcctccacgccgtgatgtagcggtcgccgaggaagtgcggcaagcagtgtgcgaagcgcgtcggggacgaccttgggaggcacccgcacctatgaagacacctgaagcgggtcttgcaggccgtccctccccctggaccacccccggaagagccgcagctaccgtacctgctgcccctatgcagctgtttaacggaggctgccctcctccccctccggtattggatggcgaagatgtccttcccgacttagacttgctccccccaccgcctcctccccctccagtcctcctgccctctgaggaggaggccccagcccctatgggcgcttcacttattgcagatctcgaacaactgcatctgtctcccccaccaccccctccgtag

SEQ ID NO: 50344 - DNA, 93 bp, Artificial Sequence
  Description of Artificial Sequence: Synthetic coding sequence
atggcttctaaacctgaaaaaagagtcgcctcctcggtgtttattactctggcgcctccccgaagagatgtggccgtagccgaagaggtctag

SEQ ID NO: 50345 - DNA, 96 bp, Artificial Sequence
  Description of Artificial Sequence: Synthetic coding sequence
atggcctcaaaaccagagaaaagagtcgcttccagtgtttttataacactggccccaccaaggcgcgacgtcgctgtcgccgaggaggtcagatag

SEQ ID NO: 50346 - DNA, 435 bp, Artificial Sequence
  Description of Artificial Sequence: Synthetic coding sequence
atggcaagtaaaccagagaagcgtgttgcctcatccgtcttcatcactcttgctccaccgagacgggacgtggccgtggccgaagaagtgcgacaggccgtctgcgaggctcggcgagggcgtccctgggaggccccagcgccaatgaagacgccagaggctggcttggccggtcggccaagcccatggactacacccggacgagctgctgccaccgtaccagcagccccaatgcagctattcaacggggatatatgcgccttttgtcataagactgtctcacctcgagagctagccgtcgaagcgatgaagagacagtatcatgctcagtgcttcacatgtcgcacctgccggcgacagctggctggacagtctttctaccagaaagacggccgacccctgtgtgagccttgttaccaggacacgctggagtag

SEQ ID NO: 50347 - DNA, 105 bp, Artificial Sequence
  Description of Artificial Sequence: Synthetic coding sequence
atggcgtctaaacccgaaaagcgggttgcctctagtgtgtttattaccctcgccccacctcgcagggacgtggcagtcgcggaagaagttcgacaggccgtgtag

SEQ ID NO: 50348 - DNA, 237 bp, Artificial Sequence
  Description of Artificial Sequence: Synthetic coding sequence
atggcgagcaaaccagagaaacgagtggcctctagtgtgtttatcaccctggccccacccaggagagatgtcgccgttgctgaggaggtgcgtcaagctgtgtgcgaggcgcgtcgcggaagaccctgggaggcgcctgctcctatgaagacccctgaagcaggcttggcgggaaggccctccccttggaccactcccggacgggctgcggcaactgtgccagctgcccctatgtag

SEQ ID NO: 50349 - DNA, 45 bp, Artificial Sequence
  Description of Artificial Sequence: Synthetic coding sequence
atggcctccaagccagagaaaagagttgccagtagcgtattttag

SEQ ID NO: 50350 - DNA, 300 bp, Artificial Sequence
  Description of Artificial Sequence: Synthetic coding sequence
atgtgcgtgggcgagaagcggcgagctataattccgtcacatctggcttacggtaaacgtggcttccccccatccgtccccgcagacgctgttgtgcagtacgacgttgagctgattgctcttatccgggctaactattggctcaagctagtcaaagggatactgccgctggtgggcatggccatggtccccgctctcctcgggctgataggctatcatctgtatcgcaaagccaaccgtccgaaggttagcaagaagaagctgaaggaggagaagcgcaacaagtctaagaaaaagtag

SEQ ID NO: 50351 - DNA, 441 bp, Artificial Sequence
  Description of Artificial Sequence: Synthetic coding sequence
atgaccctgagaccctccctgttgccccttcatttgctgctcctcctcctgctgtcagctgctgtgtgtcgggcagaggccggactcgagactgagtctccagtgcgaacgttgcaagttgagacactggtcgaaccccctgagccttgtgcagaacccgctgccttcggagacacgctgcacattcattacactggttctctggtcgacgggaggatcatcgataccagcctcacccgagacccactggtcatcgagctgggccagaaacaagtgattcctgggttggaacagtccctgcttgatatgtgcgttggagagaagcggagggctattatccccagccacctggcttatggtaaacgcggtttccccccatcagtgccaggcactaaggataatctcatgaggccccctggcatgacctcttctagccagtag

SEQ ID NO: 50352 - DNA, 606 bp, Artificial Sequence
  Description of Artificial Sequence: Synthetic coding sequence
atgaccctgagaccgagtctcttaccactgcatttattactgctattgctccttagtgcagcagtttgccgtgccgaggccggtctggagacagaaagccccgtgagaaccttacaggttgagactctggtcgaaccacctgagccatgcgccgaacccgctgcatttggagacaccctccacatccattataccggtagtctcgtggacggccgaatcatcgatacgagcctgacaagggaccctctggttattgagctgggtcagaagcaagttattcccggtctcgagcagagcctgctggacatgtgcgttggtgagaaaagaagagctatcattccaagccatctagcctatggaaaacggggatttcccccaagtgtgccggctgacgcagtcgtccaatatgatgtggagctgattgcactgattcgcgcaaattactggttgaagcttgttaaggggatactgcctctggtcggcatggcaatggtgccggcactgttagggctcattggctatcatctgtatcggaaggccaatcgcccaaaagtctccaaaaagaaattaaaagaagaaaagagaaataaatctaaaaagaaatag

SEQ ID NO: 50353 - DNA, 948 bp, Artificial Sequence
  Description of Artificial Sequence: Synthetic coding sequence
atgcgcgcaggacagcagctagcctctatgcttcgatggacaagagcgtggcgcctgcctcgtgaggggctcggacctcacgggcctagtttcgctagagtccccgtggccccttcttcatcgagcggaggcagggggggtgccgaacctcggccattgcccctgagctatcggctgttagacggggaggctgcactccctgcagtggtctttctgcatggactctttggaagtaaaaccaatttcaactcgatcgcaaagatacttgcgcagcagacaggtaggcgcgtcctcaccgtggatgctagaaaccatggtgacagcccccactcacctgatatgtcttacgaaattatgagccaggatttgcaggatttgctgccccagttgggtctggtcccctgcgtggtggtcggccattctatgggtggaaaaacggccatgttgctggcacttcagaggccagagctcgtagagagattgatagcagtcgacatcagccctgtggaaagcactggtgtatcccacttcgcaacctatgtggctgcaatgcgggcaataaacatcgctgacgaacttcctaggtcgcgggcacggaagctggccgacgagcagctgtcaagtgttatccaagacatggctgttcggcagcatctactgaccaacttagtggaagtggatggacgttttgtctggcgtgtcaatttggatgccctcactcagcacctagacaaaatcttggctttccctcagcggcaagagtcttacctcgggccaaccctgtttctgctagggggaaacagccaattcgtgcacccttcacaccatccggaaattatgcggctttttccgagagcccagatgcaaactgtgccgaacgccggacattggattcacgctgatcgcccacaggactttatcgcggcaatacgtgggttcttggtgtag

SEQ ID NO: 50354 - DNA, 1713 bp, Artificial Sequence
  Description of Artificial Sequence: Synthetic coding sequence
atggcttttcggggatggcgccctccacctcctccactgctgctgctcttgctgtgggtcacaggccaagccgcaccagtcgcgggtctgggttctgatgctgaattacagattgagcgccgttttgtaccagatgagtgcccaagaacggtgaggtcaggggatttcgtgcgatatcactacgtcggaacatttcccgatggtcagaagtttgactcctcctacgacagagatagcacattcaatgtctttgtgggcaaagggcagctcattaccgggatggaccaggctttggtcggcatgtgtgtgaacgaaaggaggttcgtgaagattccgcctaagcttgcatatggaaatgaaggtgttagtggtgttattccaccgaactccgtcctacacttcgatgtgttgctcatggatatatggaattcagaagatcaggtccagatccacacgtacttcaagcctccgtcttgtcctagaacaatccaggtcagtgactttgtgcggtatcactacaatggtactttcctcgatggcacactcttcgactcttcacacaacaggatgaagacttacgacacatacgtcgggataggatggctcataccaggcatggacaaaggtctacttggtatgtgcgtcggcgaaaagcggattatcacaatcccgccattcttggcatatggggaggacggcgatgggaaagacatcccaggacaagcctcactggtgtttgatgtggcattactagaccttcacaacccgaaagatagtatctcaattgagaacaaggtggtccccgaaaactgcgagaggatttcacagagtggggattttctgcgctaccactataatggcacactgctagacggtacgctttttgattcgtcttactcccgcaacaggacattcgacacctatattggtcaggggtatgtgatccccggaatggacgaaggtttactgggggtttgcatcggggaaaaaaggcgtatcgtggtcccccctcatttgggttatggcgaggaaggacgagggaacattccaggatccgccgtgctcgtatttgacattcatgtgattgactttcacaatccatcagacagtataagcatcacctcgcactacaagccccctgactgtagcgtgctgtccaagaagggtgattacctcaagtaccattataacgcttcactgttggacgggactttactcgatagcacgtggaacctcggcaaaacatacaatattgtgctgggcagcggccaggttgtcctgggtatggatatgggactcagagaaatgtgcgtgggggagaaacgtactgtgatcatcccaccccatcttggttacggcgaagcaggcgtagacggagaagtcccaggttcagccgtgctggtcttcgatatcgaactcctggaactggttgctggccttccagagggatatatgttcatctggaacggggaggtgtccccaaatttgttcgaagaaattgataaggacggcaatggagaggtgctgttagaagagttctcggagtatatccacgcacaagtcgcctccggtaaagggaagctggcccctggattcgacgccgagctcattgtaaaaaacatgttcactaatcaggatcgaaatggggatggcaaagtgactgccgaagaatttaagctgaaagatcaggaagcaaagcatgatgaactatag

SEQ ID NO: 50355 - DNA, 1017 bp, Artificial Sequence
  Description of Artificial Sequence: Synthetic coding sequence
atggcaggcaaggacattccaggccaagcctctctcgtatttgacgtggccctcctggacctgcacaacccaaaagattccatctccattgagaataaggtcgtgccagaaaactgcgagcgaatcagccagtcgggcgacttcttgagataccactacaatggtactctgcttgacgggaccctgtttgactcatcctactctcggaatagaacctttgacacatatatcgggcagggctacgtaatcccaggaatggatgaggggctgcttggggtctgcattggagagaaaaggcgcattgtcgtccctccacatctcggctacggggaggaaggaagaggcaacattcctggaagcgccgttctggtctttgatatccatgtcattgattttcataacccatctgactcgatcagcatcactagccactataagccccctgattgcagcgtgctgtctaagaaaggcgattatctaaagtatcattacaatgcctccctcttagacgggaccctgctcgactccacctggaacctcggcaagacgtataatattgtgctgggcagtgggcaggtagtgttaggaatggacatgggattgcgcgaaatgtgtgtgggcgagaaacgaacggtgatcatacctcctcacttgggatacggtgaggctggggtggatggcgaggttccagggagcgccgttcttgtcttcgacattgagcttttggaattagtggcagggcttccggaagggtatatgttcatctggaatggcgaggtgtccccaaatctcttcgaagagatcgacaaggatgggaacggagaagtgcttctcgaggagttttccgaatacatacacgcccaggtggcatcaggaaagggcaagttagccccaggctttgacgctgagctaatcgtgaagaatatgtttacgaaccaagatagaaacggagatggcaaggtgaccgcggaagaattcaagctgaaagaccaggaggccaaacacgacgaactatag

SEQ ID NO: 50356 - DNA, 1872 bp, Artificial Sequence
  Description of Artificial Sequence: Synthetic coding sequence
atggctttccgcggatggaggccaccaccaccgcctctacttctgcttctcctctgggtgaccggccaggccgctccggtggccggactggggagtgatgccgaactccaaatcgaaagacggtttgtccccgacgaatgtcctcggacagtgcggtctggagacttcgtgaggtatcactacgttggaacctttcccgatggccagaagttcgattccagatactgggacacggccgaagataaagccgataagagcccgtgtccccaagtaagggttggcgtgaacacatccccctcctgtagactgaagcaaaaaggggtcggcatctattggaaagatctgcagtttctcgttcgggtacaaaatcacggtctgagttatgatcgtgatagcacattcaatgtatttgtcggcaaaggtcaactgattacaggaatggaccaggccctcgtcgggatgtgcgtgaacgagaggcgctttgtcaagattccccctaaactggcttacggaaatgaaggcgtcagcggggtcatccctcctaactccgtcctgcacttcgatgtgctgttgatggacatttggaacagtgaggatcaggttcagatacacacatactttaaaccaccttcctgcccaaggaccattcaagtgagcgacttcgtgagatatcattataatgggactttcctggacggcaccctttttgactcgagccataacagaatgaaaacctatgatacatatgtcggaatcggctggctgattccaggcatggacaaggggttgctcggaatgtgcgtgggagagaaacggatcattacaatccctcccttcttagcttatggtgaggatggcgatgggaaagatatcccaggacaagctagtcttgttttcgacgtggcactcctggaccttcataatccaaaggactcaatcagtatcgaaaataaggtggtgcctgagaactgtgagcggatctcccaatccggggactttctgcggtaccactataacgggaccctgttagacggtactctgttcgacagtagctattcccggaatagaacgttcgacacgtacatcggtcaagggtacgtgatacccggtatggatgagggtctgctgggggtgtgcattggcgaaaagaggcggatcgtggtcccccctcatcttgggtatggcgaggagggcagaggaaacattcccggatccgctgtcttggtgtttgatatccatgtgatcgacttccacaacccttctgattctatctctatcacaagccactataaaccgcctgattgttccgtattgtcgaaaaagggagattatctcaagtaccactataacgcgagtctgctggacggcaccctcttggactctacctggaacctggggaaaacatacaacatcgttctgggttccggtcaagtggtgttaggaatggatatgggtctgcgtgagatgtgtgtgggggagaaaagaacagttatcatacctccgcatctgggctacggggaagctggagttgatggagaagttccaggaagcgccgtgctggtctttgatatcgagctgctagagttagttgcgggattacccgaagggtatatgttcatttggaatggggaagttagccctaatctctttgaagaaatcgacaaggatggtaacggggaagtgctattagaggagttttccgagtacatacatgcacaggtggcttccgggaaagggaagctcgcgcctggcttcgatgccgagctcatagtgaagaacatgtttaccaaccaagaccgcaatggagatggaaaagtgaccgcagaggagttcaaacttaaagatcaggaggccaagcacgacgaactctag

SEQ ID NO: 50357 - DNA, 1299 bp, Artificial Sequence
  Description of Artificial Sequence: Synthetic coding sequence
atggatatctggaactcagaggaccaggtgcaaattcatacttattttaagcctccatcttgcccacggactatccaagtgtccgactttgtgcgctatcactataacggcacattcctggacggaacactgttcgattcttcccacaatcgcatgaagacctatgatacctacgtgggaatcggatggctgattccgggtatggataaaggcttgcttggcatgtgcgtgggagagaaacggattatcactattccacccttcttggcttacggggaggacggagacggaaaggacattcccggtcaggcttctctcgtctttgacgtcgctctccttgatctacacaacccaaaggatagtatttccattgagaataaggtggttccagaaaactgcgagcgcatttcacagtctggcgatttcttgcggtaccactataacggcaccctgttagatggaactcttttcgacagctcatactccaggaaccgaacctttgatacctatattgggcaagggtatgtgattcccggtatggatgaagggctcctgggcgtctgtatcggcgaaaaacgccgaatagtggtgccccctcacctcgggtatggcgaagaaggacgcggaaacataccgggaagcgcagtattagtgttcgatattcatgtgatcgacttccataacccaagtgactcaatatccatcacttcccattacaaacccccagattgtagtgtgctctccaagaagggagactatctgaaataccactacaatgcctccttacttgatggaaccttgctggacagtacatggaatctgggaaagacttataacatcgtcctagggagcggccaggtggtcctggggatggatatgggtttgcgtgaaatgtgcgtcggagagaagcgcacagtgatcatcccaccccacctcgggtatggcgaagccggagtcgacggcgaggtgcctggcagtgcagtgttagtatttgatattgaattattggagttggtcgctggattacctgagggatatatgtttatttggaacggcgaagtcagtcctaatctgtttgaggaaatagacaaagacggaaatggggaagtgctgcttgaagaattttccgagtatattcatgcgcaggttgcctccgggaaaggaaagcttgcaccgggatttgatgctgagctgattgtaaaaaatatgtttacaaatcaggacaggaatggcgacggaaaggtgactgcggaggagttcaagctgaaggaccaggaggctaagcatgacgaactttag

SEQ ID NO: 50358 - DNA, 1989 bp, Artificial Sequence
  Description of Artificial Sequence: Synthetic coding sequence
atggagggcactcactgtactcttcagcttcataaaccgatcacagaactttgctatataagcttttgcttgccaaagggagaggttagaggatttagctacaaagggaccgtgacactggatcgcagcaataaggggttccacaactgttatcaggtgcgggaagagtccgatatcataagcctgagccaggaaccagacgaacaccctggggacattttcttcaagcagacgcccactaaggacatcctaaccgagctgtacaaactgacaaccgaacgggagcgcctgctcaccaatctactgtcctccgaccacatactggggatcactatgggcaaccaggagggcaaactgcaggagctgagcgttagcctggccccagaagacgattgctttcaatcagcaggtgattggcagggggagctgcccgtgggacccctgaataaacgctctacacatggaaacaagaaacctcggagatcgagcggtcgcagagaaagctttggggcattgccacagaaacgaacaaaacgaaaggggagaggaggccgtgaatctgcccctctgatggggaaagacaagatctgttcctctcacagcctgccactaagtcgcactagaccaaacctctgggttctagaggaaaaggggaacctgctgcctaatggagctttagcttgttcgctgcagcggcgagaatcatgcccacccgatattccaaagacccccgacaccgatctggggttcggatcatttgaaaccgccttcaaggacactggcctgggcagagaagtcctccctcccgattgtagcagcacagaagcaggcggagatgggatacggagacctccctctggcttggagcatcaacagacgggactgtccgagtctcatcaagatcctgaaaaacatcccgaggctgaaaaagacgagatggagaagcccgcaaagagaacatgcaaacagaaacccgtgagcaaagtggtggcaaaagtccaggatttgtcttcccaggtgcagcgggtcgtgaagacacattcaaaggggaaggaaacaatagcaattcgtcccgcagcgcatgctgagtttgttcctaaggccgacctgctgaccctgcccggtgccgaggctggagctcacggttccaggcggcagggaaaagagagacagggcgacagatcaagccagagtccggctggcgagacagccagtatatcgtccgtgagtgcctctgccgagggtgccgtaaacaaggtccccctgaaagtaatagaaagtgagaaattggatgaggcacccgagggaaagcgtctgggttttcccgtccatacctcagtgccacatacacggccagagacgcggaacaaacgcagggcagggcttccactaggcggtcataaaagcctatttttggacttgccccacaaagtgggacctgatagcagccagccacgaggcgataagaaaaaacccagtcctccagctcccgctgccctgggcaaagtctttaataatagcgccagccagagcagtacacacaagcagaccagtccggtgccctccccattgtcgcctcgcctcccgtctccacaacagcaccaccggatcctaagactccccgcactaccaggcgaaagggaagcggcactgaacgatagcccatgcagaaagtcccgggtgttcagtgggtgcgtaagtgccgatacgctcgagcctccctcatctgctaaggtgactgaaacaaaaggtgccagcccggcttttctccgcgcaggccagcctcggttagtgccgggagagacgctggagaaatcccttgggcctgggaagacaactgcagagccacaacaccagtcgcctccagcatttcactgggacctgcagcagcacttccaagagcccgtcatccggaccgtatccatctcctgtgcaagtaatttgattaaagaggaggctggaaagggaaaagagtcacgatcgggctag

SEQ ID NO: 50359 - DNA, 3591 bp, Artificial Sequence
  Description of Artificial Sequence: Synthetic coding sequence
atggaaaacgtggacaactctctggatggcagtgatgttagcgaacctgctaagcccgaggcaggtctggaggttgctcagtctattcttagcaaatttagtatgaagtcactgttcgggttcacaagtaaacttgaaagcgtcaacccagaggaagaggatgcagtcttgaaggctttccactctttggatgttaacccgacatctcaacaggatgacagttcgaatggactggaccctcaagaggctgggagtcgggtatcaccggacttgggaaatgatgagaaaattgcttctgtcgaaacggagagtgagggctcgcagcgtaaggaggctgggacctccctgctcgctcaggaactgttgcctctctctactctcaaagggacaaaagatgatgtcatttgtgtgcgtggcacattagtccacacaacaagcgactcagacagcgacgatgggggtcaggagccggaggagggttctagcacaaatggacccaagtccccctcaggtgtcctgagtgagccatcacaggaatcgaaggagaatcctgggggatttcgagaaaacactgttacaggcgagatgaatggcgctgagttatgcgcggaagatcctcagcggatcccgcctgagatgtcttctaaactggaggcaggcaacgggggactccagactgagaggcggccttcccaggaccaggtgggtgaggaggggagtcaggacctcccagccgtcaccaatcagaactcgtctgtcggtatcaccgagagcgctagctccaaaaaagaggtctccggcgaaaaaagttttcaactgccagcttttttctctggactacgcgttctcaagaaaggtgccacagcagaaggaggagaaactatcaccgaaatcaagccgaaagatggagacttggctctgctcaaactaactcagccggttcagaagtctctcgtgcaggctgggctccagactgtgaaaagcgagaaaaaggcaaccgacccgaaagctacacccacgcttctcgagcaactctctctgctgctaaacattgacatgcccaaaacagagccaaaaggcgctgatcctgagtcccctagacgcgaggaaatgggttgcaacgctgatcaggaatctcagagcggacccggagtgcctcaaacccagggaggggaagtcaaaccgaaatctcctgagacggcactggaggcatttaaggctttgtttatacgtcctcccaggaaagggacgacagctgacacgtcagagctcgaagccttgaaacggaagatgaggcacgagaaggagagtttacgcgcagtatttgagaggtcaaactctaaacccgcagatggcccatcggactccaagtcccctgatcattctcttaccgaacaggatgatcgcacaccaggccgtctgcaagccgtctggcctccgccaaagactaaggacacagaggagaaagttgggttgaagtacacggaagctgagtatcaagctgctatactgcatctgaagcgagaacacaaagaagagatagaaaacctgcaagcacagttcgagctgcgggcatttcatatacgcggtgaacatgcgatgatcacggcccgactggaggaaaccatcgagaacttaaagcacgagctcgagcatcggtggagaggcggatgtgaggagcgcaaggatgtttgcatctcaaccgatgacgattgcccccctaagacattccggaatgtttgcgtccaaactgatagagagacctttcttaaaccttgtgagtcagagtcaaagaccaccaggtctaaccagttggttcccaaaaagctgaacatctcctccctatcccagctgtctccgcctaatgaccacaaggatatccatgccgctcttcagcctatggagggcatggcctctaaccagcagaaggccttaccccctcccccagcctctatccccccacctccccctctgcctagcgggctaggttcattaagtcctgctcccccaatgccacccgtaagcgcgggacctcccctacccccaccgcctccgcctccgccacctctgcctcccccatctagcgccggacctcccccaccccctcctccccctccgctgcctaatagccccgctccaccaaatccaggaggccctcctcctgcccctccaccacccggactggctccgccaccacctccgggtctatttttcggcttgggttcatcatcctcccagtgccctagaaagccagcaatagagccttcatgtccaatgaaacccttgtactggactcgaattcagatctcggaccgtagccagaacgctaccccaacactttgggactcactggaagagccagacatcagagaccccagtgagttcgaatacctttttagcaaggacacgacccagcagaaaaaaaagcctctcagcgaaacgtatgagaagaagaataaagtaaaaaaaatcataaagctgctggatgggaagcgttctcagaccgtgggaattctcattagctctctccacctcgaaatgaaagacattcagcaagccattttcaatgtggacgacagcgtggtggacctggagaccctggctgcactgtacgaaaatcgcgctcaggaggatgagctggtaaaaatccgaaaatattatgaaacctccaaagaagaggaactgaaattgcttgataagcccgaacaattcctgcacgagttggcacagatccccaacttcgctgaaagggcacagtgcatcatttttcggtctgtattttccgaaggcataactagcctccaccgcaaagtggagattataacacgtgcttctaaggacctgctgcacgtgaagtcagtgaaggatatcctcgccttgattttggctttcggtaattatatgaacggtggcaatcgcacccgtgggcaagccgacgggtatagcctcgagattctgcctaaactgaaggatgtgaaaagccgcgacaacggtattaatctcgtggattacgtggttaagtactacctgaggtattacgatcaggaggcaggaacagaaaaatccgtgttccccttgccagaaccccaggacttttttcttgcatcacaggtcaaattcgaggatctgatcaaggacctccgcaagctgaagcggcagttggaggctagcgaaaagcaaatggtggttgtgtgtaaagaaagtccaaaggaatatctgcagccctttaaggacaaactggaggagttctttcagaaagccaagaaagaacataagatggaggagtcacatcttgagaatgcccagaaaagtttcgagacgacagtgaggtattttggaatgaaacccaagtccggggaaaaagagatcacaccttcatacgtgttcatggtttggtatgagttctgctccgacttcaagacaatttggaagagggagtctaaaaacatttcgaaagagcgcttgaaaatggctcaagaatctgtgtcaaaattgactagcgaaaaaaaggtggaaaccaagaaaattaaccctacagcaagcctgaaggagcggctgcggcaaaaagaagcctctgtcacaaccaattag

SEQ ID NO: 50360 - DNA, 1512 bp, Artificial Sequence
  Description of Artificial Sequence: Synthetic coding sequence
atggagaatgttgacaatagcctcgacgggtcagacgtttccgaacccgctaaacctgaggccggtttggaggtagcccaaagcatcttaagcaagttttcgatgaagtccctgttcggctttactagcaagctcgagtccgtgaatcccgaggaggaagacgcggtgttaaaggccttccactcactcgatgttaaccccacatctcagcaggacgactcatccaatggcctggatccgcaggaggcaggtagccgagtatcacctgatctcggcaacgacgagaaaattgcctctgtcgagaccgagtccgagggaagtcaaagaaaagaagcagggacaagtcttctcgcccaggagttattgccactgagcaccctcaaggggacgaaagatgacgtcatctgtgtacggggaacactggtgcacactactagcgacagtgacagcgacgacgggggtcaggaacctgaggaaggatccagtaccaacggccctaagagcccctcaggtgtgcttagcgagccttcgcaggagtccaaggaaaatcctgggggatttagagagaatacagtgaccggagagatgaacggcgctgagctgtgcgcggaggacccccaacgaatccctccagaaatgtcttcaaagctggaggccggtaacgggggtcttcagactgagaggcgtccttcacaagatcaggtcggagaagaggggtctcaagatttgccagccgttactaaccagaactccagcgtggggattactgaatccgctagtagtaaaaaggaagtgtccggcgagaaatcttttcagctcccggcattttttagtggtctgcgagtcctcaagaagggcgctactgcagaaggcggagaaactattacagagataaagccaaaggatggagacctggctctgttgaaactgacccagccagtgcagaagtcgcttgtgcaggcgggattgcaaacggtaaaaagcgagaagaaggctaccgatcctaaggctacacccactctgctggaacagctctctcttctgcttaacatcgatatgcctaaaacagagccgaagggtgcagacccagagagccctagacgggaagaaatggggtgtaatgccgatcaggaatcacaaagcggacctggcgttccccaaacacaaggaggggaagtgaagccaaagagtccagagactgctctcgaagcgtttaaggccctgtttatcagacccccaagaaagggaacaaccgccgacacatcagaactcgaagcactgaagagaaaaatgcggcatgagaaagaatccctacgcgcagtatttgagaggtctaatagcaaaccagcagacggcccatctgactcaaaatcacccgatcattcattaactgaacaggatgacagaacgcccggtcgcctgcaggccgtttggcctcccccaaaaacgaaggatacagaagagaaagtgggactgaagtacacagaggctggaaacgtgaagggtagctag

SEQ ID NO: 50361 - DNA, 4260 bp, Artificial Sequence
  Description of Artificial Sequence: Synthetic coding sequence
atggaggggactcactgtaccctgcaactccacaagcccatcactgagttgtgctacatcagcttttgtctgcccaaaggagaggtgcgcggtttctcatataaagggaccgtgaccttagatcgttctaacaaaggcttccacaactgctatcaggtaagagaggaaagcgatattatcagcctgtctcaggagccggacgagcatcccggagatatatttttcaagcagacccccaccaaggatatcttgaccgaactttacaaactgacaacagagcgggagcggctgctcaccaatctgctcagttctgaccacatcctgggcatcacaatgggtaaccaggaaggcaaacttcaggagctgtctgtgtcactagccccagaggatgactgcttccagagcgccggtgattggcagggcgaattgcccgtaggccctctcaacaaacggagcacacacggcaacaagaaacctcggcgtagttccggcagaagagaaagtttcggtgccctgccccagaagagaaccaagagaaaagggaggggcggtcgagaatcagcccctttgatgggaaaagataaaatttgctcttcacacagcttgccacttagccgcacccggcctaacctgtgggttctggaagaaaaaggaaatctgctgcctaacggcgcactggcctgttcattacagagacgcgaatcttgcccgccagacataccaaaaactcctgacacagatctggggttcggctccttcgagacagcattcaaggacaccggattggggagagaagtgctgccccctgattgcagtagtaccgaggccggtggagacggaatccgtcgtccaccatctggcttagaacaccagcagacaggactgtcggagtcacatcaggacccggaaaagcacccggaggctgaaaaagacgagatggagaagcctgccaagcgcacctgtaagcagaaaccggtttctaaggtggtggctaaggtgcaagacttgagcagccaagtccaacgagtcgtgaagacccattcaaagggtaaggagacaatcgccatccggcctgccgctcacgccgagtttgtccctaaggccgacctgttgactctccccggagccgaggccggtgcccacggatctcggagacaagggaaggaaaggcagggcgatagaagttcacagagcccagcgggagaaactgccagcatctcatccgtgtctgcatcagcagaaggcgctgtcaacaaggtccctctgaaagttattgaaagtgagaagttggatgaggccccagagggcaaacgcctagggtttcctgtacatacctctgtgccccacactcgacccgagactaggaataagaggcgcgctgggctcccactgggagggcataaaagtcttttcctggacctcccccataaggttggcccagatagtagccaacccagaggcgacaagaagaagccctcaccccctgcccctgctgccctgggaaaggtgtttaataattcggctagtcagtcgtctacccataagcaaacctcacctgtaccatctcctctgtcccctcgacttccgtctccccagcaacaccaccgaatattgagattgcccgctctccccggagagcgcgaggccgctcttaatgatagtccctgtcgaaagagtcgcgtgttcagtgggtgtgtatctgccgataccctggagcccccttcgagtgctaaggttacagagaccaagggcgcttcccctgcttttctcagagccggacagccaaggctagtccccggtgagactctcgagaagtcccttgggcctggaaagaccactgctgaaccgcaacaccagagcccccctggcatctctagcgaaggattcccgtgggatggcttcaatgagcagactccaaaagacttgcctaaccgcgacggtggtgcatgggttttggggtaccgtgcaggaccagcctgccctttccttctacacgaagagagagagaaaagtaaccgaagcgagctgtatttggacctccaccctgaccacagcctgaccgagcaagatgaccggacaccaggcaggctacaggctgtctggcctccacctaaaactaaagatactgaagagaaggtcggactcaaatacacggaggccgagtaccaggccgctatcctccatctgaaacgggagcataaggaggagatcgaaaatctccaggctcagttcgagctgcgagcgttccacatacggggtgagcacgcgatgattaccgcgagactcgaggagacaatcgagaacctgaagcacgagctggaacatagatggagaggcggttgtgaggagcgcaaggacgtctgtattagtaccgatgacgattgtcccccaaaaacatttcggaacgtgtgtgtccagactgatcgcgagacatttctcaagccctgcgaatccgaaagtaagacgaccaggtccaaccaactggtaccaaaaaagctcaatatctcatcattgagtcagttgagtcctccaaacgatcacaaagatattcatgccgcactgcagcctatggaggggatggcatccaaccaacaaaaagcgcttccacctcccccagcttccattcctccgcctccgcctctaccttccggactgggtagcttgtcccccgcaccccctatgcctccagtgagtgctggtcctcctctgccccctcctccaccgcctccacctccccttccacccccttcttccgcagggcctcctccccctcctccacctccaccactcccgaacagccccgctccccctaaccccggaggaccacccccagcgccacccccacctgggctcgctccccctcctccaccagggttgttctttgggctgggctctagctcatctcagtgtcccaggaagcctgcaatagaaccatcatgccccatgaagcctctgtattggactagaattcagatctcggacagatcacaaaacgcgactccaactctttgggacagcctggaagaacccgacattcgagatcctagtgagttcgagtatctgttctccaaggacactacgcaacagaagaagaagcctctgagcgaaacatatgagaaaaaaaataaagtgaagaagatcatcaaactcctggatggcaaacgaagccagacagtgggaatacttatctcatctctccacctagagatgaaggatatacagcaggccatatttaatgtggacgactccgtcgtggatttggaaaccctggcggctctgtacgagaatcgggcacaggaggatgagctggtgaagatcagaaaatattatgagactagcaaggaggaagagctgaaacttctcgataagcccgagcagtttcttcatgagctggcacagattccgaactttgcagaacgggctcagtgtatcatcttcagaagcgttttctctgaaggcatcacctccctgcacaggaaagtggagatcatcactcgcgcttccaaagaccttttgcacgtcaagtctgtaaaggatatactagcgctaatcctcgcattcggcaattatatgaatggcggaaaccgaacccggggacaggcagatggttactcactggagatcctgccaaaattgaaggatgtcaagtctagggataacggaatcaatctggttgactatgtcgtgaagtattatttgagatactacgaccaggaggccggtaccgagaaatccgtgtttcctttaccagaacctcaggactttttcctggcaagccaggtgaaattcgaagatcttatcaaggacctaaggaaacttaagagacagctagaggcctctgagaaacagatggtcgtggtgtgtaaggaatctccaaaggaatacctgcagccgtttaaagacaagctggaagagtttttccaaaaggccaaaaaggaacataaaatggaagaatcacacctggaaaatgcgcagaaatctttcgagacgactgtgaggtatttcggcatgaagcctaaatctggcgaaaaggaaatcaccccttcttatgtatttatggtgtggtacgagttttgctcagactttaaaaccatttggaaaagagaaagcaagaatatttcaaaggaacgccttaagatggctcaggaatccgtctcaaagctcacgtccgagaagaaggttgagaccaagaaaattaaccccactgctagtctgaaggagcgcctgcgtcaaaaagaggcaagcgttacgacaaactag

SEQ ID NO: 50362 - DNA, 768 bp, Artificial Sequence
  Description of Artificial Sequence: Synthetic coding sequence
atgtcgtcccatcgtcgcaaagctaaaggccgaaatcgacgcagccatcgagccatgcgggtggcccatttagaacttgccacctatgaactggcagcaacagaatcaaatccggagtcaagtcatcccggatatgaggcagctatggccgaccgcccacaacctggctggcgagagagcctgaaaatgagggtctctaaaccattcggaatgctcatgttgtctatttggatcttgttatttgtctgctactatttgtcatattacctctgtagcggatccagttattttgttctggcgaacgggcacatactgcctaactccgagaacgcacacggccaatcacttgaggaggactctgcccttgaagcgctgcttaacttcttcttccccaccacttgtaacctccgcgagaaccaagtagccaagccatgtaatgagcttcaggatctctccgaatccgaatgcctcaggcacaaatgttgtttttcaagcagcgggacaacaagctttaagtgtttcgcacccttccgcgatgtgcctaagcagatgatgcaaatgttcgggctgggggcaatatcactcatccttgtgtgcttgcctatttactgccgatcccttttctggaggtctgagcccgcagacgacctccagagacaggacaatagagtggtgactggtctgaagaaacaacgtaggaaaagaaagcgaaaatccgagatgctccagaaggccgcaagaggacgcgaggaacacggcgacgagtag

SEQ ID NO: 50363 - DNA, 903 bp, Artificial Sequence
  Description of Artificial Sequence: Synthetic coding sequence
atggacctcccgcctcagcttagcttcggactatacgtagccgctttcgctcttgggttccccctgaatgttctagccataaggggagcaaccgcccatgccaggctccggctgacaccgtccttagtatacgccctgaacttgggctgcagcgacctgctactgactgtctccctgcctcttaaagcagttgaggctctcgcctcaggggcatggcccttgcctgctagcctgtgtcctgtttttgctgtcgcccatttttttccactgtacgctggcggtggcttcctggccgcattgtctgctgggagatacctcggggctgcatttccgctcggttaccaagcttttaggaggccctgctactcttggggtgtctgcgccgcaatctgggccctagtgctgtgccacctcggcctggtgttcggtctcgaggctcccggaggttggctcgaccattccaacacgtccttaggcatcaatacgccagttaatggctctccggtgtgcctagaggcatgggatccagcttcggccggacccgctcgtttctccctcagtttgctcctttttttcctgccacttgcaataactgcattctgttacgtcgggtgcctcagggcgttggcacggtccggtctgacacataggcggaaactgcgggctgcttgggtggccggtggggcactcctgaccttactcctgtgcgtggggccatacaacgccagtaacgtggcatcctttctgtaccctaatttgggtgggagctggaggaagcttggcctgatcactggtgcctggagcgtggtcctgaatccactcgttacaggctacctcgggaggggacccggactgaagaccgtttgcgctgcccgaacccaaggtggcaagagtcagaaatag

SEQ ID NO: 50364 - DNA, 993 bp, Artificial Sequence
  Description of Artificial Sequence: Synthetic coding sequence
atgttacccgattggaaatccagcctcatcctgatggcatacataattatttttctcacggggctacctgctaacctgcttgccctgagagcttttgttggcagaatccggcagccccaacccgctcccgtgcacatcctcttgttatctctaactcttgctgatcttttgttgttgctccttctgcccttcaagatcatcgaggctgcatccaacttccgctggtatttaccaaaggtggtgtgcgctcttacctcatttggcttttacagttctatctactgctccacatggctgctggccggtattagtatcgaacgctacttgggtgtcgccttcccagtgcagtataaactcagtcggaggccactctacggagtaatcgccgctttagttgcttgggtcatgtctttcggccattgtaccatcgtgatcatagtgcaatacttgaacaccacagaacaagtgcggagcggaaatgagattacctgctatgagaacttcactgacaaccaactcgatgttgtcctgcccgtaaggctcgagctctgcctggtcctgtttttcattcctatggccgtaacaatcttctgctactggaggttcgtctggataatgctgtcacagcctctagtcggtgcacagagaagacgacgagccgtgggactcgccgtcgtaacccttctcaactttctcgtgtgcttcggcccatacaacgtgagccaccttgtgggatatcaccagaggaaatcaccatggtggcggagcatcgctgtggttttctcaagtctaaacgcttccctggacccactcctcttttatttcagctcctccgtcgttcgccgagcgtttggacggggactgcaggtactcagaaatcagggtagcagtctgttgggccgaaggggaaaagacacagcagaaggaactaatgaggatcgcggtgtggggcagggagagggaatgccttcgagcgacttcacgaccgaatag

SEQ ID NO: 50365 - DNA, 1041 bp, Artificial Sequence
  Description of Artificial Sequence: Synthetic coding sequence
atggacacgggaccggaccagtcctacttcagcggcaaccattggttcgtcttcagcgtgtatctattaacatttctcgtcggtctgcctctgaaccttcttgccctcgtagtgttcgtgggtaaattacagagacgccctgtggctgtcgacgtgctgttgctaaacctgactgcctcagatttactgctgctgctctttctgccattccgaatggtggaggcagccaatggaatgcattggcctttgccttttatcttatgtccattgagcggattcatttttttcactacaatatatttaaccgccttgtttctcgcagcggtgagtatcgagcggttcttgtccgttgcccatcccttatggtacaagactcggccaagactgggtcaagccggtctcgtcagcgtcgcttgctggttactcgcatctgcccactgcagtgttgtatatgtcatagagttctccggagacatttcgcactcacaagggacaaatggtacgtgctacctggagtttcgcaaggaccagctggccatcctgctgcccgtgaggctcgagatggccgtagtcctgttcgtcgtgcctcttattattacgtcctactgctatagccgccttgtctggattcttggcagggggggtagccaccgtaggcaacgcagggtggccggacttctggcagccacactgctgaatttcctggtctgcttcggtccatacaatgtgtcacatgtagtagggtatatttgcggagagtcgcccgcttggaggatctacgtgactctgctcagcactctcaacagttgtgtggacccgtttgtgtactacttctctagctccggcttccaagctgacttccatgagctgcttagacgcctgtgtggcctatggggccagtggcagcaggagagttccatggaactgaaggagcagaagggtggcgaggagcagagagccgatagaccagcagaacgaaagaccagtgagcacagccagggatgcgggaccggtgggcaagtcgcatgcgctgagtcttag

SEQ ID NO: 50366 - DNA, 1758 bp, Artificial Sequence
  Description of Artificial Sequence: Synthetic coding sequence
atggctcggcctgatcccagcgctcccccttcccttctgttgctcctcctggctcagttggttggtcgggctgcagctgcgagcaaggcacccgtttgccaagagattacagtgcctatgtgccggggtattggctataacctcactcacatgcctaatcagtttaatcatgatacccaggacgaggccggtctagaggttcaccagttttggccccttgtggaaatacaatgctctcctgatttacgcttctttctctgttcaatgtatacccctatatgccttcctgactatcacaaaccactacccccttgcagatcagtatgcgagagagccaaagcgggttgctccccgctgatgcgacagtacgggttcgcctggcccgaacggatgagctgtgaccgcttgccagtgctgggaagggacgccgaagtgctttgcatggattataataggtcagaagccactaccgcgcctccgagaccatttcctgcaaaaccaaccctacccggacctcccggagccccagccagcggtggcgagtgccccgctgggggaccttttgtgtgcaagtgtagagagccattcgtccctatactgaaggagtcacaccctctctacaataaagttaggaccggccaggtccccaactgcgccgtgccttgttatcagcctagcttctccgccgacgagagaacttttgccaccttttggatcggactctggtctgtgttgtgcttcattagcacctcaaccacagttgctaccttcctcattgatatggaacggttcagataccctgaacgacctatcatttttctctctgcctgctatctctgtgtgtcattgggatttcttgtacgcctcgtggtcggccatgcatcggtcgcatgtagtcgggagcacaaccacatccactatgaaaccactggacctgctctttgtaccatcgtgttcctcttggtgtacttttttgggatggcatctagtatctggtgggtcatcctaagcttaacgtggttcctagccgctgggatgaaatggggcaacgaagcaatcgccggatacgcacagtatttccacttagcagcctggttgattccttcggtcaaaagtataacggcgctcgcactgagcagcgtggacggcgacccagttgccggtatttgctacgtaggcaatcagaacctgaactccctacgcggatttgtcctgggacccctggtgttgtacctgctggtaggcactctcttcttgttagctggcttcgtgagcctctttcgcatcagatcggttataaagcaaggcggaaccaaaaccgacaagctggagaagttgatgatcaggatcggaatatttaccctcttatacactgttcctgcctcaatcgtggttgcctgctatctgtatgaacagcattatcgagagtcctgggaggctgcattgacatgtgcctgccctgggcatgatactggccaaccgagagcaaaaccggaatactgggtactcatgcttaaatactttatgtgtctggtggtaggcattacatcaggtgtgtggatttggtctggcaaaacagtggaaagctggcgcagatttacgtcaagatgctgttgtaggcctcggcgtggccacaaaagcggcggtgcaatggctgctggcgactaccctgaggccagcgcagctctcacaggcaggactggacctccaggcccagctgccacataccataaacaggtcagtctctctcatgtatag

SEQ ID NO: 50367 - DNA, 2313 bp, Artificial Sequence
  Description of Artificial Sequence: Synthetic coding sequence
atgtccaagtgccggaagaccccagtgcagcaacttgctagtcctgctagctttagcccggacatattggccgacatcttcgagctgttcgctaagaatttttcttacggcaaaccactcaataacgaatggcagcttcctgatcccagtgagatctttacttgcgaccacacagaattaaacgcctttctggaccttaaaaattctctgaacgaagtcaaaaatttgttatctgacaagaagctggacgagtggcatgaacacacagcgttcaccaacaaagctgggaaaatcatctcgcatgtccggaagagtgttaacgccgagctgtgcacacaagcctggtgcaaattccacgagattctctgctcattcccactgatcccacaggaggcttttcagaacggcaagctcaacagtctccacttatgcgaagcaccaggggcatttatcgcctcacttaatcattacctcaagagtcaccggtttccatgtcactggtcctgggtcgctaacaccctgaacccataccacgaagccaatgacgatttaatgatgattatggacgaccggctgatagccaacaccctgcattggtggtattttgggcctgataacacaggggatattatgaccctaaagtttctgaccggactgcagaacttcatcagctcaatggcaaccgtgcatttggtcaccgcggacggtagcttcgattgtcaggggaaccctggcgagcaggaggccttggtgtcaagcctccactattgcgaagtagtgacagctctcacgacacttggcaatggcggtagcttcgtcctcaaaatgttcacaatgtttgaacattgctctatcaacctgatgtatctattaaattgctgtttcgatcaggtacacgtgttcaaaccagccacttcaaaggccggtaatagcgaggtttatgtggtatgtttgcactacaagggacgtgaagcaattcaccctcttctttcgaagatgacactgaactttggaacggaaatgaaacgaaaagccctcttcccacatcacgtaatcccggactctttcctgaagaggcatgaagagtgctgcgtgtttttccacaagtatcaactggaaaccatcagtgaaaatattaggctcttcgaatgtatgggaaaggccgaacaggaaaagctgaacaacctgcgtgactgcgccattcaatacttcatgcagaagtttcagttaaaacatctgtccagaaataattggctcgttaaaaaatccagcattggttgcagtactaataccaaatggttcggccagagaaataagtatttcaagacttacaatgagaggaaaatgttggaagcgctgagctggaaagacaaggtcgcaaaaggatactttaattcttgggctgaagagcatggcgtttatcacccaggtcagtcttccatcttggaaggcacagcgtccaacctggagtgccacctgtggcacatcctcgaaggaaaaaaactgccgaaagtcaagtgctctcctttctgtaacggggagattctgaagactttgaacgaagctatagaaaagtccctgggaggtgcttttaatctcgactccaaattccggccaaaacagcaatactcttgctcatgtcacgtgttttctgaagagttaatcttttccgaactatgttctcttacagaatgcctccaagatgagcaggtggtggtgcccagtaaccaaatcaaatgcctgctggtcggattttcaaccctacgaaacatcaaaatgcacatcccgttagaggttcgtctgttagaatcagccgaactcacaacgttcagttgtagtctgctgcacgacggcgatcctacctaccagagattatttctggattgtctgctccattctctgagggagttgcatacaggggacgtaatgattttgccagtcctctcttgctttactcggttcatggctggactgatttttgtcctccattcttgtttccggttcatcacatttgtttgcccaacaagctcggaccctctccgcacatgtgccgttcttttgtgcgtggggtaccaagatctgcctaatccagtgtttcgctatttacagtcagttaatgagctactcagcaccctcttgaactcggactctcctcaacaagtactccaatttgttccaatggaggtgctccttaaaggtgcactgctggacttcctgtgggacctcaacgccgcaattgctaaaaggcacctccatttcattattcaacgggaacgcgaagagatcattaactctctccaactgcagaactag

SEQ ID NO: 50368 - DNA, 2313 bp, Artificial Sequence
  Description of Artificial Sequence: Synthetic coding sequence
atgagcaaatgccgtaaaaccccagttcaacagctggcctctcctgcctccttttcaccagacatacttgctgacatcttcgagctgtttgcaaaaaacttctcatatggtaaacccctgaacaacgagtggcagctgcccgatccatcagaaatcttcacatgcgaccacaccgaactgaatgccttcctcgatctgaagaattctcttaacgaggtcaaaaatctgctctctgataaaaaacttgacgaatggcacgagcacactgcgttcactaacaaggccggtaagattataagccacgttcgaaagtcagttaacgccgagctctgcacccaggcatggtgcaagttccacgagattctgtgctccttcccactcatcccacaggaagcattccaaaatggcaaactaaattctctacacctgtgtgaggccccaggggcttttatcgcttcattaaaccattacttaaaatcccatcgcttcccttgtcactggtcctgggtggccaacacgcttaacccatatcacgaggcaaatgatgatctcatgatgattatggacgacaggctaatcgctaatactctgcactggtggtattttgggccagataatactggtgatattatgaccctcaagttcctcactggactacagaacttcatcagctcgatggctaccgttcacctcgtgaccgcggacggatctttcgattgccaaggcaatccaggagagcaggaggcactcgtgtccagtctacactactgtgaagttgttaccgctctaacaaccctcggaaatgggggatcctttgttttgaagatgtttaccatgtttgagcattgcagcattaatctgatgtacctcctgaactgctgttttgatcaggtgcacgttttcaaacccgcaacctccaaagccggaaatagtgaggtctacgtggtgtgtcttcactataaggggcgagaggccatacaccccctcctctctaagatgaccctgaactttggaactgaaatgaaacgcaaagcattattccctcaccacgtgatccctgattctttccttaaaaggcatgaggaatgttgtgttttttttcacaagtaccagctggagaccataagtgaaaacatccgcctctttgagtgtatggggaaggctgaacaagagaaactcaacaacctgcgtgactgtgccattcagtatttcatgcagaagttccagctcaaacacctgtctaggaataactggctggtgaaaaagtcttcaatcggttgctctaccaacacaaaatggttcgggcagcggaataagtactttaaaacctacaatgagaggaagatgctcgaggccttatcgtggaaagataaggtcgcaaagggatactttaattcatgggctgaggagcatggcgtatatcatccagggcagagcagcattctggaaggaactgcaagtaacctggaatgccacctgtggcatatcctcgaaggcaaaaagctgcccaaggtgaagtgttctcccttttgtaacggggagatactgaagactcttaacgaagcaatcgaaaaaagcttgggtggtgcattcaatctcgactcaaagtttagacccaaacagcaatatagctgttcatgccacgtgtttagcgaggagctgatctttagtgaactatgttccttaacggagtgcctccaggacgagcaagtggtggtcccatcaaatcagattaagtgtctgctggtcggttttagcaccttgcggaacataaagatgcatattccacttgaggttcggctgcttgagagcgccgagttaactacgtttagctgctctctgcttcacgacggagaccccacataccaaagactgtttctcgactgtctcctccactccctcagagaactacacaccggcgacgttatgatcctgcccgtgctgtcttgttttacaaggttcatggccggtctgatattcgtcctgcattcttgctttaggtttatcactttcgtatgccccaccagttccgacccactgcgaacctgtgccgtcctactatgcgtgggctatcaggacctgccaaatccagtttttcggtatctacagagcgtgaatgaattattgtcaaccctcttaaactctgattctccgcagcaggtgctccaattcgttcctatggaagttctgttgaagggtgcactgttggactttctctgggatctgaatgcagccattgcgaagcgacacttacatttcataatccagagagagagagaagaaattattaactccctgcaattgcaaaattag

SEQ ID NO: 50369 - DNA, 1440 bp, Artificial Sequence
  Description of Artificial Sequence: Synthetic coding sequence
atggtccgcattcagaggaggaagctactggcctcatgtctctgtgtcacggccactgtcttcctgctggttactctgcaagttatggtggagctgggcaaattcgagcgaaaggaattcaagagctcatccctgcaggacggccatacaaagatggaggaagctcccacccacttgaactccttcctgaagaaagagggtttgacatttaataggaaacgtaagtgggaactcgattcctaccccattatgttgtggtggagtccgctgaccggcgagaccggaagactggggcagtgcggagcggacgcatgcttctttactatcaataggacatacttgcaccaccatatgacgaaagctttcctcttttatggaaccgacttcaacatcgatagtttgcctttgccgcgtaaggctcaccatgactgggcagtgtttcacgaggaaagccccaagaataattataaactgtttcacaaacctgtgatcacactgttcaactataccgcgaccttttctcgacactcccatctgcccctaactacccagtacctggaatctatcgaggtgttaaagtcattaagatatttggtcccattacagagcaagaacaagctgagaaagcgcctggccccattggtgtatgttcagagtgactgcgatcccccaagtgaccgggattcatacgttagagaattgatgacatacatcgaggttgatagctatggtgagtgcctccgtaacaaagatctaccacagcagctcaagaatcccgcatcaatggatgcagacggtttctaccgcataatcgctcagtacaaatttatactggcattcgaaaatgccgtgtgcgacgattacattacggaaaaattttggcgcccactgaaactgggcgtggtgcccgtctattatggatcaccctccataaccgattggctgccctctaacaagagcgcgattttggtgtctgagttttcccatcctcgggaactggcgtcttatatccgccgtctcgactccgacgatcggctttacgaagcgtacgttgaatggaaactgaagggcgagatatctaaccagcgtctactcaccgcactacgcgagcgtaagtggggtgttcaggacgtgaatcaggataattatatcgacgccttcgaatgcatggtttgcacaaaggtatgggccaacattcgcctccaggaaaaaggcctaccacctaagcgatgggaggccgaagatacccacctgtcctgccccgaaccgactgtcttcgccttttctcctctgagaactccgccactgtcctctcttcgagagatgtggatttctagctttgagcagtccaaaaaagaggcccaagccctccgctggctggtcgatcgcaatcagaacttctcctctcaggaattttggggactggtgtttaaagactag

SEQ ID NO: 50370 - DNA, 1074 bp, Artificial Sequence
  Description of Artificial Sequence: Synthetic coding sequence
atggggatcggccagttgccgcactatgctttagtggtgccagccgatgggggagactgggaagtacgtcctatgtggagcaggtgtctgttccttcaccatcagcccgaccttcctccctcaagtcatgatcagtccattcccctgttgtggagccaggaggaatcccccccactcgcagaaaatgatggcaccgattttaatatcgattccttgcctctgcccagaaaggcacaccacgactgggccgtgttccatgaggaatcaccaaagaataactacaagctgtttcacaagcccgtcattacactcttcaattacactgccaccttctccagacattcgcatctcccgttgaccactcagtaccttgagtccatcgaggtcctcaaatctctgcgatacttggtgccactgcagagtaagaataaattgcgtaagcgactggctcctctagtttacgttcaatctgattgcgatccaccaagcgatagagactcatatgtcagggagctcatgacatacatcgaagtggacagctatggggaatgcctccgaaacaaggacctccctcagcagcttaagaaccccgcttccatggatgccgatggattctaccgcatcatcgcacaatataagttcatcttggccttcgaaaacgccgtgtgcgacgactacattaccgagaaattctggcgtcctctcaagttgggtgtggtgcctgtgtactacgggtctccttcaataaccgattggttgcctagcaataaatccgctatcctcgtcagcgagttcagtcacccgcgagaactggcttcatatattagaaggctcgactcggatgaccggctctacgaggcatatgtggagtggaagttgaaaggggagatcagcaatcagcggttgttgaccgctttacgggagagaaaatggggggtccaggacgtgaatcaagacaactacatcgacgccttcgagtgtatggtgtgcactaaggtgtgggcaaatattagactgcaagagaaggtgtctaaatctaaggtagggatcgagcctgccggatggccgtcttag

SEQ ID NO: 50371 - DNA, 1566 bp, Artificial Sequence
  Description of Artificial Sequence: Synthetic coding sequence
atggtgcgtatccagaggcggaaattactcgccagctgcctgtgtgttacagctaccgtgtttttgctagttacgcttcaggccttggatactgtagagaaccttatgaaagtaacaggaccacctcagggtgtaaccgactccatgcagtgtttcaatgatcaaaggcctctgtccaatactcggtccagtgagcacattaaggaagtgatggtggagcttgggaaattcgagcgtaaagaatttaaatctagttcactgcaggatggccacaccaaaatggaggaggccccaacacacctgaattcatttttgaagaaagaaggcctgaccttcaacaggaaaaggaaatgggagctggattcttaccctatcatgctctggtggtcccccttgaccggcgaaactggacgactcggacagtgtggcgcagacgcttgcttctttacaataaaccgaacatatctccaccatcatatgactaaggcatttcttttctacggcacagatttcaacatcgactctttacccctccccaggaaggctcatcacgattgggcagtctttcacgaagaatcacccaagaacaattacaagctcttccacaaaccagtgattaccctgttcaactatacagccactttttctcggcactctcaccttccgctaaccacacaatatcttgagagcatcgaggtgttgaaaagcctgaggtatctagttcctctccagagcaaaaacaaattgcggaagaggctggcgccactagtttacgtgcagtccgactgcgacccaccctcagatcgggactcctacgtgcgtgagttgatgacgtacatcgaggtagatagttatggtgaatgcctccgaaataaggatctcccacagcagttgaagaatcccgcttctatggacgctgacgggttttacaggatcattgcccagtacaaatttatccttgcatttgaaaacgcagtatgtgatgactacattaccgaaaagttctggaggcccctgaaactgggggtggtccccgtctattacggttcacctagtatcacagattggctcccatcgaacaaaagtgcaattctagtcagtgagttcagccatccgagggagctggcatcatacatacgcagacttgactctgacgaccggctctatgaagcatacgtcgagtggaagctcaaaggcgagatcagcaaccagcgactgctgacggctttgagagagcgcaagtggggggtacaagatgtcaaccaggacaattatatcgatgcgtttgaatgtatggtatgtaccaaggtgtgggcgaatattcgcctccaggaaaaaggcctcccacccaagagatgggaggcggaggacacacacttatcctgccccgaacccacagtgtttgctttctctcctttgagaactccaccactctcctccctccgtgagatgtggataagtagcttcgaacagagcaaaaaagaggcacaggctctcaggtggctggtcgacaggaaccagaacttctccagccaggaattctgggggctcgtatttaaagattag

SEQ ID NO: 50372 - DNA, 1479 bp, Artificial Sequence
  Description of Artificial Sequence: Synthetic coding sequence
atggccgctggacccattcgggtcgtgcttgtgctgctgggggttttgtccgtgtgtgccgctagtggacatggtagcgttgccgagcgagaagcgggtggtgaggccgagtgggctgaaccatgggatggtgccgtgtttaggccacctagtgccctcggggcagttggtgtcactagatcctcagggacacctcgcccaggtcgagaagaagccggtgacctgcccgtgctgctgtggtggtctcctggtctgttcccacacttccccggtgactctgagcgaatagagtgcgcccgaggagcatgcgttgcttcccggaatagaagggcgcttcgagattctcgcacccgggcactcctgttttacggcaccgactttagagcctcagctgcgccactgccacgactggcgcatcagagctgggccctgctgcatgaagaatcccctctgaacaactttttgctctctcatgggccagggataagactgttcaacctgaccagtacattcagccgccatagcgactatcccctgagtctgcagtggctgccaggaacggcttacctgagaagacctgtgccacctccaatggagagagcggagtggcgccgtagaggatacgcgccactcctgtatttacaaagccactgtgacgttccagcagaccgcgatcggtatgtacgggagctgatgaggcacatccctgttgattcttacggcaaatgtctgcagaacagagagttgcctacagcacgactgcaggatacagccactgccacgactgaggaccctgaactactggctttcctcagccgttacaaattccatctcgctcttgagaacgctatctgcaacgactacatgactgaaaagctgtggagacccatgcacttaggcgcagttcccgtatatcggggatccccaagcgttagggattggatgcctaacaaccacagtgtgatcttgatagatgatttcgagtcacctcaaaaattggctgaatttatcgatttcttagataaaaatgacgaagagtacatgaagtacctcgcctataaacagcccggtggcatcactaaccagtttctcctggactccctgaagcatcgagaatggggggttaatgacccccttctgcctaactacctgaatggttttgagtgttttgtgtgcgattatgagcttgcgcgtctggatgccgagaaggcgcatgcagctagtcctggcgatagccctgtgtttgagccacatatcgcccagccatcccatatggactgtcctgtgcccacaccagggtttggaaatgtggaggagattcccgagaatgatagttggaaggagatgtggcttcaagactattggcagggcctggaccagggagaagcacttacggccatgatacacaataatgaaaccgagcaaaccaaattttgggattatctccatgaaatttttatgaagaggcaacacctttag

SEQ ID NO: 50373 - DNA, 1431 bp, Artificial Sequence
  Description of Artificial Sequence: Synthetic coding sequence
atggccgctggcccaattcgagtggtccttgtgctcctgggcgtcctatccgtttgtgccgcttccggtcacgggtctgtagctgaacgcgaggcgggtggggaagccgaatgggctgagccgtgggatggagccgtgttccgcccaccttccgctcttggcgcagtgggggtcacaagatcttccggtaccccccgacccggtagagaggaagccggtgatcttcccgttctgctctggtggtctcctggcctgtttccccatttcccaggcgactccgaacggattgaatgcgccagaggcgcttgcgtagccagcaggaataggagggctctaagagacagtcggacaagagctctgctgttttacgggactgacttccgagctagcgccgcacccctgcccagactggctcatcagtcttgggctcttctccacgaggagtctcccttgaacaatttcctgctgtcccacgggccaggaattaggctattcaacttgactagcacctttagtcggcactctgactaccccctatcgctgcagtggctgcctggcactgcgtatctcaggagacccgttcctcccccaatggagcgcgcagagtggcgtagacggggatacgcacccctcctgtacttacaatcccactgcgacgtgccagctgacagggatagatatgtgcgcgagttaatgcggcacattccagtggattcctacggtaaatgcctgcagaatagggagctccctacggcccgacttcaggacacagcaaccgctactaccgaagatcctgagctactggcctttctctcgcgatataagtttcacctcgctttggagaacgcaatctgtaacgactacatgacagagaagctctggagacccatgcacctgggcgcagtgcccgtttaccgcggatctcctagtgttagagactggatgccaaataatcattcagtgatacttatcgatgacttcgaatccccacaaaagctcgcagagttcatcgacttcctggacaaaaacgacgaggaatatatgaagtacctggcctataaacagccaggcggaatcacaaaccagtttctactggatagtctgaagcatagagaatggggggttaatgatccactgctgcccaattacctcaatggcttcgaatgctttgtatgtgactatgaactggcccgacttgacgccgagaaagcccatgccgctagccctggggactcccctgtcttcgagccacacatcgctcaaccgtctcatatggactgccctgttccaacacctgggtttgggaacgtcgaggagatcccagagaacgactcctctctggtgcaggttcgagaccattgtatctgtttgaggttcctgtggcctcactctgaaaaagggagaacacataattacgctgccgtcccgtag

SEQ ID NO: 50374 - DNA, 570 bp, Artificial Sequence
  Description of Artificial Sequence: Synthetic coding sequence
atggagacgtcggccccaagagcagggtcccaggtagtggccacaactgccaggcacagtgctgcgtacagggccgatccacttcgcgtctcttccagagacaagcttactgaaatggccgcttcaagtcagggaaattttgaggggaactttgaaagcctggacctggcagagttcgcaaaaaagcaaccgtggtggcgaaagttgtttggtcaggaaagtggaccgagcgcagagaaatatagcgtcgccactcaactgtttatcgggggagtgacaggctggtgcaccggatttatctttcagaaagtgggcaaactagctgccactgccgtcgggggtggattcttcctgttgcagctcgctaaccacaccgggtatataaaggtcgactggcagagggtggaaaaggatatgaagaaagctaaggagcagctaaaaatcagaaagagcaatcaaatccccaccgaagtgaggtcaaaggccgaggaagtggtgtcatttgtaaagaagaatgtcctggtaacgggcggtttcttcgggggattcttactaggtatggcctcatag

SEQ ID NO: 50375 - DNA, 1569 bp, Artificial Sequence
  Description of Artificial Sequence: Synthetic coding sequence
atggccctgaccgaaacacagcctcagttgcttagcgctgacctggtgctggccctccaggtgcttatgctctgggaaatgacagaagcaaacaaggtcttgaaaagacggcaacacccccaaaggtcacattgtattagctctaagattctggagtcatacccgggagagaagcctctgaccaagtcccttcagagaggcgaggaccctcaattcgatcaggtaatttcttcgatgtcttcactgtcggagtactgcttgccttctattctgagaacactgttcgactgcgatgaacagcagcgcgattacttgatggagcgcagggaccttgccattgactttatctttagcctggtcctgatcgaagttcttaagcaagggagcttaacctgcctgattattccttacctgggcacgcttgtcccgaccctggccatctgtattctgtggcagacatgcatgcagaaatcactggagtgctggcacaaaccctcaaaattccccgctgtcaaaaaaaagttcatggctgagttaaaggaactgagacacaaagaacagaatccttacgttgttcagtccattatttctctgatcatgggcatgaagttttttagaataaaaatgtacccagtcgaagacttcgaagcctctctgcagtttatgcaggagtgtgcacactactttctcgaggtaaaggataaggacattaagcatgccctagcgggacttttcgttgagattctggtgccggttgcagccgcagtgaaaaatgaggtcaacgtaccttgcctgagaaacttcgtcgagtccttatatgataccactctggaactgagctctagaaaaaagcattctctggcgctctatccactggtcacttgcctgctgtgtgtctcacaaaaacagttatttctaaacagatggcatatatttctcaacaattgtttgagcaacctcaaaaataaggaccccaaaatggcacgcgttgcacttgaaagcctttataggctcctgtgggtttatatgataaggatcaaatgcgagtctaacacagctacccagagtaggctgattacaataataactactctgttccccaaaggatcaagaggagtggtccctagggacatgcctcttaacatttttgtgaagattatccagttcatcgctcaggagaggctcgacttcgccatgaaggagataattttcgatttcctctgcgttggaaagcctgctaaagctttcagcttgaaccccgagagaatgaatatcggcctcagagccttcctggtgattgctgattcattgcagcagaaggacggcgaaccacccatgcctgtgacgggcgctgtactgccttcgggaaacacccttcgcgtgaagaagacttacctgagtaagacactgacagaagaggaagccaaaatgattggcatgagtttgtattactcccaagtaaggaaggctgtcgacaacatcctgcgccatctcgataaggaagtgggcagatgcatgatgctgaccaacgtgcagatgttaaataaggaaccggaggacatgatctag

SEQ ID NO: 50376 - DNA, 588 bp, Artificial Sequence
  Description of Artificial Sequence: Synthetic coding sequence
atggaatctctggcacagctggagttatgccagagattgtacaaactacatttccaattactattacttttccagtcttactgcaagctgatcgggcaggtacatgaggttagctctatgccagaattgctgaatatgtcccgagagctcagcgatctgaaaaagcacctaaaagaggcaagcgctgttatagccgctgaccctttgtactctgacggcgcttggtccgaacctacatttacttctacggaagccgcaattcaaagcatgctcgagtgtttgaaaaacaatgaacttggcaaagctttgagacagattagagaatgcagaagcttatggcctaacgacatcttcgggagtagttcggacgacgaggtccagaccctgttgaacatatattttcgtcatcagaccctgggtcaaaccggcacttacgccctggtaggcagcaaccaatcgctgacagagatctgtaccaagctgatggagctcaacatggagattcgcgacatgattaggagggcccagtcatatcgggtgctcactacatttttacctgacagctctgtgtccgggacctccctgtag

SEQ ID NO: 50377 - DNA, 1278 bp, Artificial Sequence
  Description of Artificial Sequence: Synthetic coding sequence
atggccgtgacgcgttctaccagcagcaccagttcgggctctaactctaacgtgctggtgcccgtctcctggaagagaccacagtattcccagaagaggaccaaggagaaactcgtacatgtgcttagtctctgcgggcaggaggttggactgtctaaaaatccctccgtgatcttctccagctgtggcgacctggatctgctggagcaccaaactagtctcgtatcgtccgaggacggcgctagagagcaggaaaacatggacgataccaactctgagcagcaattccgggtctttagagactttgattttctagatgttgagctcgaggacggggaagggttaaggggcgagtctatggacaatttcaactggggagtacgacgccgatcactcgattctctagacaaatgcgatatgcagatcctggaggaacgacaattgagtgggtccactccctccctgaataaaatgcatcacgaagatagtgacgagtcaagcgaagaagaggacctcaccgcctcgcaaatcctcgagcatagcgaccttatcatgaccctttccccttcggaagagacaaatccgatggagttactgacaacagcctgcgactctacaccagcggagccccattctttcaacacacggatgtcctccttcgacgccagtctgcccgacatgaacaaccttcagatctccgaaggatccaaggccgaggcagtgcgagaggaggaggacaccacagtccatgaggatgatctgtccagttcgatcaatgaactgccagcagcattcgaatgctcagactcgttctcacttgatatgacagagggagaggagaaaggcaatcgcgctctcgatcagttcacgcttgcttcatttggagagggtgatagaggagtgtcaccaccgccatcaccgtttttttctgccatactggcagccttccagcctgctgcctgtgatgacgctgaggaagcctggcgctcgcatatcaaccagctaatgtgcgatagtgacggctcttgcgctgtctacaccttccatgttttttcaagcctatttaagaacatccaaaaacgcttctgcttcttgacttgcgatgcggcttcttacctgggggacaatctgcgtgggatcgggtcaaaattcgtctcctcctcccagatgctaactagctgttccgagtgccgcgctcaggtccaatgcgtgagaactgccaggatatttggatacttgcagcagcaagaacgcggacatacattgtgcaaactgtag

SEQ ID NO: 50378 - DNA, 9041 bp, Artificial Sequence
  Description of Artificial Sequence: Synthetic coding sequence
atggcctcccagcaggacagtgggttcttcgaaatatctattaaatacctgctaaagagttggtctaacaccagccccgttggaaatgggtacattaaacccccagtcccaccggcaagtggtacccatagggaaaaaggccctcctacaatgctcccgattaacgtggaccccgactccaagccaggcgagtacgtgttgaaatctttgtttgtgaactttaccactcaggcggaaaggaagatccggataataatggccgagcctctcgagaagcccctaacaaagtccctacagcggggagaggatccccagttcgaccaggtgatttcaagcatgtcttcgctgagtgagtactgtttgccctcaattcttcggacactcttcgattggtacaaacgccagaatgggattgaggacgagtctcatgagtacaggcctcgcactagcaataagtcaaagtcggacgagcagcagcgcgattatctgatggagcggcgagacctggccatcgattttatcttctcccttgtcctcattgaagtgctcaagcaaattcccctgcatccagtcattgattccctcattcacgacgtgattaacttagcttttaaacattttaagtataaggaaggatatctcgggcctaataccggcaacatgcatattgtggcagatctatatgccgaggtgattggagtgctagcacaagctaagtttccggcagtgaagaaaaagtttatggcagaactcaaagagctgagacacaaggagcaaaacccttacgtggttcaaagtatcatctctcttattatggggatgaagttctttaggatcaaaatgtacccagtcgaggatttcgaggcctctcttcagttcatgcaggaatgcgcacattacttcttagaggtgaaggataaggatatcaaacatgctttggccggactgtttgtcgaaattctggtccccgtagcggcagccgtgaaaaacgaagtaaatgttccctgtctcaggaactttgtggagtctctctatgataccaccctggaactaagcagtcggaagaagcacagcttagcactttatcctttggtgacttgtctattatgtgtgagccaaaaacagttattcctaaatagatggcacatcttcctcaacaattgcctctccaacctgaagaacaaggatcctaaaatggcaagagttgccttggaatccctgtaccgccttctatgggtttacatgatacgcattaagtgtgagtccaacaccgccacccagtcaagactcatcaccatcattacaactctttttcctaaagggtctaggggagtggtacccagggacatgccccttaacatttttgtcaagattattcaatttattgctcaggagaggctagacttcgcaatgaaggaaatcatctttgactttctttgcgttggaaagcccgcaaaagcattctctctgaatccggagcgtatgaatattgggctgcgcgctttccttgtgatcgctgactccctgcaacagaaagacggagaaccaccgatgccagtcaccggggcagtacttccttccgggaatactttgcgggtgaaaaagacatatctttcaaagacactaacagaagaggaggctaaaatgattggtatgtctctctattacagccaggtccgcaaagccgtggacaacatccttaggcatctcgataaagaagtgggacgttgcatgatgctcacaaatgtgcagatgctcaacaaggagcctgaggatatgatcacaggcgagcggaagcccaaaatcgacttatttcgtacctgtgtcgcagccattcccaggctgctgcctgacggcatgtcaaagctggagcttattgatttgcttgcccgactctcgatccacatggacgatgaactgaggcatatagcgcagaatagtctgcagggactactagttgatttctccgactggagagaagacgtcttattcggttttactaatttcttgttgagggaagtcaacgatatgcatcatacactcctcgactccagcttgaagttgctgctccaattgctgacccagtggaagctggttattcaaacccaggggaaggtgtatgagcaagcgaataaaataagaaactcagagttaatcgccaatggttcttctcatcggatccagtctgaaaggggaccccattgctccgtgctgcatgcggtggaaggtttcgccctcgtgctgctctgctcttttcaggtcgcgacacgtaaactcagtgtcctgatcctgaaggaaatcagagccctgttcatcgcactcggacagcctgaagacgacgatagaccaatgatcgacgtgatggaccagctttctagcagcatacttgagtccttcatccacgtcgctgtgtcagatagtgctaccttacccctcacccataatgtggatctgcagtggttggtagagtggaacgctgttctggttaacagccattacgatgtaaagtctccgtcccacgtatggattttcgctcagtctgtgaaggatccatgggtcctgtgtctgttttcatttctccgtcaggagaacctccccaagcattgtccaacagcccttagttatgcctggccttacgcgtttaccagattacagagtgtgatgcctcttgttgatccgaactctccgatcaatgcaaaaaagacatctactgcgggttcaggcgacaactatgtcacactgtggcggaattatctgattctatgcttcggcgtggccaagcccagtatcatgtctccagggcacctgcgggcttccacccctgaaatcatggctactacacccgacggtacagtctcatatgacaataaagctattggaacaccatcagttggtgttctgctaaaacagctcgttcctttgatgcggctggagagcatcgagatcaccgaatctctggtgctggggttcggaagaaccaattcgctcgtattccgcgagctggtggaagagctccaccccttaatgaaagaggccctggaaaggcgtccggaaaataagaagcgaagggaacggcgtgacctgctgcggcttcagctgctccggatcttcgaactgctggcagacgccggagtgatttcagattcgaccaatggcgcactcgagcgcgacactctcgcccttggtgccctctttctcgaatatgtggacctgacacgtatgctcctggaagctgaaaacgataaggaggttgaaatactgaaggatatccgggctcacttcagcgccatggtggccaacctgatacagtgcgtccctgtgcatcacagacgattcctgtttcctcagcagtcactgagacatcatctctttattctcttctcccaatgggcaggtccgttctccatcatgttcacacctcttgacaggtatagcgatcggaatcatcagattacgcggtaccagtactgtgccttaaaggcaatgtccgcggtactgtgctgcggccctgtgtttgacaacgtgggcctgtctcccgacgggtacctttataagtggctggataatatcctcgcgtgccaagatctcagagtccaccagttgggctgtgaggtggtggtcctattgcttgagctgaaccccgaccagataaatctgtttaattgggcaatcgatcggtgttatacaggatcttatcagctcgcctctggctgctttaaggctatcgccaccgtctgcggttcacggaactacccttttgacatcgtgactctgttaaacttggtgctctttaaagcaagtgatactaaccgcgagatatatgaaatctccatgcagctcatgcaaatcttagaggcgaaactctttgtttactctaagaaagttgcggagcagcgcccaggaagtatcctttacggcacccatggaccactgccgccactgtactccgtatcgttagctctccttagttgtgagctcgccaggatgtaccctgaactaaccctccccctcttttccgaggtgagccaacggtttcccactactcaccccaacggtcgacagattatgcttacctacctgctcccatggctgcacaacatcgagctcgttgacagtcgactgctgctcccagggtcctcaccatcatcgccagaagatgaggtgaaagaccgtgagggcgatgtgaccgccagccacggtctccggggaaatggctggggctccccggaggccacatcacttgtcctgaataacctgatgtatatgactgctaagtatggggacgaggtgccaggccctgagatggaaaatgcctggaatgcattggccaataatgagaagtggtccaacaatttgcgcattacactccagttcttaatctccctgtgcggcgtgtcatcggataccgtcctcctcccctatatcaagaaggtagccatctatctatgccgaaataacaccatccagactatggaggaactgctgtttgagctgcagcagacagaacccgtaaacccgattgtgcaacactgtgataacccaccattctatcgattcaccgcatcttcgaaggcttccgctgcagccagcggaacgacctcctctagcaatacagttgtcgcagggcaggaaaattttccagacgccgaagaaaataaaatactgaaggaaagtgacgagagattttcaaatgtgatccgagcccacacacgcctggagagtagatactcaaactcgagtggcggaagctatgacgaggacaaaaacgaccctatcagtccctataccgggtggctgctgactatcactgaaaccaagcagccccaaccgctgccaatgccctgcaccggcggttgttgggccccacttgtggactacttgcccgaaacaattacgcccagaggtcctttacacagatgtaatattgctgtcatctttatgactgagatggtcgtagaccacagtgttagggaggattgggctttacacctccctctgctccttcatgctgtgttcttgggtctggaccactatcggccagaggttttcgaacactcaaagaagctcctgttgcacctgctcattgccctgtcgtgtaattccaattttcactccatagcgtcggtgctgctgcagacccgggagatgggggaagccaagactctaactgtgcagccagcataccaacccgaatatttgtacactggcggttttgactttctccgcgaagaccaatccagtccggtgcccgatagtggactgtctagttcaagtacatcttcctctatttcactcgggggttccagtggcaatttacctcagatgacccaggaagtcgaagacgtggatacagctgctgagactgatgagaaggctaacaagctaatcgaattcctgaccacccgggcatttgggcctctgtggtgccatgaagatatcacccctaagaatcaaaattctaagagcgctgaacaactgacaaattttctgcgccatgttgtttctgtattcaaggactcaaagtctggattccatctggagcatcagctgtccgaggtcgcactgcagaccgctctggcctcctcttcccggcattacgccggacgcagcttccagatattcagggcccttaagcagccattatcagcacacgcgctttcagacctgctttctcgcctggtggaagtgataggggaacacggcgacgaaattcagggctacgtgatggaagccttactgacattggaagctgcagtggataatctctctgactgtctgaagaattctgatctcttgacagtcctctccaggtcgagtagcccggacttgtctagctccagcaagcttactgcctcgagaaagagtaccggccagctcaacatgaatccgggaactacgtcagggaacaccgcaaccgctgagcggtctcgacaccagcgcagttttagcgttcccaagaaattcggcgtcattgaccgctcctccgacccgccacgctcagccacactggaccggatccaggcctgtacacaacagggtctaagctccaagacacgcagtagcagtagcttgaaggacagtttgacagatcccagccacataaaccatccaactaacttactcgcaaccatcttctgggttactgtagccttgatggagtccgacttcgaatttgaatatttgatggcacttcggctgctgagtagattactagcccatatgccattggataaggccgagaacagggaaaagctagagaagctccaggcccagctgaagtgggctgacttttccggccttcagcaattgttgttgaaaggtttcactagcctgaccacaacagatctgacgctgcagctgttctccctgttgaccccagtgtctaagatttcgatggtagatgccagccacgccattgggtttcccttgaacgtgctctgcctgttgccacaactcattcagcacttcgaaaacccaaaccagttctgtaaagatatcgcggagaggatcgcccaggtatgcctggaggagaaaaatccaaagctttcgaacctggcacatgtcatgacattgtacaagacacactcttatactcgcgattgcgcaacctgggtcaacgtagtgtgccggtacctacatgaagcctacgctgatataacactcaacatggtgacatatttagctgaactacttgagaaaggactcccttccgtgcagcaacccctgctgcaggtgatctactccctgctgtcatacatggatctttccgttgtccctgtgaagcaattcaacgttgaggtacttaagactatcgagaaatacgtgcagagtgtacattggcgtgaagcactcaacatcttgaagcttgtggtatcccggtctgcatcgcttgtgctaccctcataccagcatagcgacctgagtaagattgagattcaccgtgtttggacctccgcctcaaaggagctgccaggaaaaaccctggatttccactttgacatatcggagacacctattatcggcagacgttacgacgagctgcagaattcgtccggacgggacggcaaaccccgtgctatggccgtgaccaggagtactagctccacatccagtggttccaactctaacgtcctggttccagttagctggaaacggcctcaatacagccagaaacggaccaaagaaaaacttgttcacgtcctcagcctttgtgggcaagaagtggggctgtctaagaacccatccgtgattttcagcagttgtggcgacctcgacttactggagcaccagacctccctagttagctcagaggacggcgctagagaacaggagaacatggacgatacaaacagcgaacaacagtttcgcgtgtttcgagactttgactttctggatgtggagctcgaagatggagagggtgaatctatggacaattttaattggggggtccgccgtaggtccttagactccttggacaagtgcgacatgcagatcctagaggagcgccagctgtctggctctactccatcactgaacaagatgcatcatgaggacagcgatgaaagtagtgaagaagaggacttgactgcctctcagatccttgaacactcggacctgatcatgactctttcgccctcagaggaaacgaacccaatggaacttttgaccacggcctgtgattctactccggcagaacctcattctttcaatacccgcatgagtagcttcgatgcgtctctcccagatatgaataatctgcagatcagtgaagggagtaaggccgaggcagtgcgcgaggaagaggataccacagtacatgaggacgatctgtcctcatccatcaacgaacttccggctgcatttgagtgctccgatagcttttcattggacatgaccgagggtgaagaaaaaggcaatagagcacttgatcagtttaccttagcatccttcggagagggtgataggggagtgagtccccctccatccccattttttagtgcaatcctggctgccttccagccggcagcatgcgatgatgccgaagaggcatggagatcccatattaatcagctcatgtgtgattcagacggcagctgtgccgtgtacacttttcatgtgtttagttcattgttcaaaaatatccagaagagattctgtttcctgacttgcgatgccgcatcctacctgggggataatctgcgtggtattggctctaagtttgtctcctcaagtcagatgctgactagttgctccgaatgccctacactgttcgttgatgcagagacactcttatcatgtggcctgctagataagttgaaattttcagtgctggaattacaagaatacctggatacctataacaaccggaaggaggcaacactatcttggctggctaattgcaaagcaactttcgctggcggaagcagagacggagtcataacatgtcagccaggagacagtgaagaaaaacagctggagctgtgccagcgactatacaagctacacttccagctgcttttgctgttccagtcttactgtaaactcattggacaggtgcacgaagttagttcaatgccagaactgttaaatatgtctcgggagttgtccgacctgaagaaacatctcaaggaagccagcgcagttatcgcagcagatccactgtactctgacggcgcatggtctgagccaaccttcacttccacagaggcagcaattcaatctatgctcgaatgtctcaagaataacgagctagggaaggcgctgcggcagataagagagtgccgaagtctctggcccaatgacattttcggcagtagctcggacgacgaagtacaaaccctgctcaacatctatttccgtcatcagactttggggcaaaccggaacttacgccctggtcggaagcaatcaatccctgactgagatttgcactaaacttatggagctgaacatggaaatacgcgatatgatacgccgtgcccagtcataccgggtcctgaccaccttcttgcctgatagctcagtatcagggacctccttata

SEQ ID NO: 50379 - DNA, 3849 bp, Artificial Sequence
  Description of Artificial Sequence: Synthetic coding sequence
atgtccgccgttctatgctgtggcccagtattcgataacgttggcctcagccctgacggctacctatataaatggctggacaatatcctggcctgtcaagacctaagagttcatcaactgggttgtgaggtggtcgttctgctcctcgaactaaacccagaccaaattaacctgttcaactgggccatcgaccggtgctacactgggtcataccagctggcctcgggctgtttcaaggccatcgccacagtctgcggatcacggaactatccttttgatatagtaacactgttgaacctcgtcctgttcaaggcaagcgacacaaaccgggagatttacgagatctctatgcaactcatgcaaatcctggaagccaagctgtttgtctactccaagaaggtggctgagcagcggcctggcagcattctgtatgggactcatgggccactgccccctctgtacagtgtgagtttagccctgctcagctgtgagcttgccagaatgtatccagagctgactctgccattattctctgggaagccagccattccacataacacccctcagagagcccctgatcacgcttatctgcccgcagcattggcagcccagcatcgcgctggaggccaacaggcaccacctcccggttctcctagtagccctgaagatgaagtcaaggatagggaaggtgacgtgactgcctctcacggcctccgtgggaacggctggggcagtcccgaagcgacgtccctggtattgaataacctgatgtatatgactgctaaatacggtgatgaagttcctggccctgaaatggaaaacgcttggaacgcccttgccaataacgagaaatggtcaaacaacctgagaatcacgctacagttcctgatcagcctgtgtggagtgtcgagtgatacggtgctgcttccctacataaagaaagtggcgatatacctctgccgcaacaacacaattcagacgatggaggaattactcttcgagctgcagcagacagaaccagtgaatcccattgtgcagcactgtgataatccgccattctatcgctttacagcatcttcaaaagcgtccgccgctgccagtggtacaaccagttccagcaacaccgttgtcgccggtcaagagaatttccctgacgctgaagagaacaagatcttaaaggagtctgacgagcggtttagtaacgtgatccgagcgcacaccaggctggagagccgttacagcaacagctccgggggttcctacgacgaagacaagaatgatcccatctctccttacacaggctggttgctcacaattacggaaacgaagcagccacaaccactgcctatgccctgtacaggaggctgctgggccccacttgtcgactatctcccagagaccataactcctagggggcctcttcaccgttgcaatattgctgtgatctttatgactgagatggtcgtcgatcattctgtgagggaggactgggctttgcatctgcccttactgctacatgccgtgtttttggggctggaccattatagacctgaagtattcgagcacagtaaaaaactgcttttgcacttacttattgcactgtcatgcaatagcaacttccactcaatcgcttcagtgctactgcagacccgagagatgggggaggccaagactctcaccgtccaacctgcttatcagccagagtatctgtataccggagggttcgacttcctgagggaggatcagagcagtcccgtccccgatagcgggctgagctcatcctctaccagcagttcaataagccttggaggctcctcaggaaacctgccccagatgacacaggaggttgaggacgttgacactgccgctgagaccgatgagaaggctaacaagctgatcgagttcctcactactagagctttcggaccgctgtggtgccacgaagatatcacacctaagaatcagaatagtaaaagcgctgagcagcttactaatttcctgcgacacgttgttagcgtctttaaggatagcaagagcggcttccacctagaacaccaactgtctgaggttgccttgcaaaccgctctggcctcttcatcaaggcattacgccggaagatcttttcagattttccgggctcttaaacagcctttgtccgcacatgctctgagcgacttgttgtctaggctcgtggaagttattggggaacacggcgacgaaattcaaggttatgtcatggaggccctcctgaccctggaggctgccgtggataacctgtccgactgtctgaaaaactcggatctgttgacagtgctgtccaggtccagttcccccgacctcagctcatcctccaaactcacagcatcccgtaagtcaacgggtcaattgaacatgaaccccggaaccacatctgggaatactgctaccgccgaacgaagcagacaccagcggtcctttagcgtgcctaaaaagttcggagtgatcgatcgctcgagcgatcctcctcggtccgctacactggacagaatccaagcatgcacgcaacagggactcagctcgaaaactaggagctcctcatcactcaaagattcgctgacagatccctcccacataaaccatcccactaatctcttggcgaccattttttgggtgacagttgccctgatggagtcagactttgagttcgaatacttgatggccttgaggctgcttagcaggcttctcgctcacatgcctctcgataaggccgagaatagagaaaaattagagaagcttcaagcccagctgaagtgggccgacttcagcggactccaacagttgttactgaagggctttacatccctgactacaaccgatttaaccctccagctgttctccctcctgacaccagtgtctaagatcagcatggtggacgcttcacatgccatagggtttccattgaatgtgctatgtctgctgccacagctgatccagcattttgaaaatcccaaccagttttgcaaggatattgccgaaagaatagcccaggtctgcctcgaggagaaaaaccctaaattgagcaacctcgcacatgtgatgactctctataagacccatagttacactcgggattgtgccacctgggtgaatgtcgtctgtagatatcttcacgaagcttacgcggatattactctgaatatggtgacatacctcgcagaactgttagaaaaaggcttgcccagtgtacaacaaccattgctccaggtcatttattcactccttagttacatggatctttcagtggtgcccgtgaagcagttcaatgtggaagttctgaagacaatagaaaaatacgtacaacactcagacttgtctaagatcgaaatccaccgcgtgtggacttccgcctcgaaagagttgcccggtaagactctcgacttccactttgacatttcagaaaccccgatcattggccgacggtatgatgagctgcagaactcgtcaggcagagacggcaagcccagggccatggctgtgactcgcagtacctcatcgacaagttctggctccaattccaacgtgctggtgccagtttcctggaagcgccctcagtacagccagaaaagaactaaggagaaattggtccatgtgctatcactgtgtggccaggaggtcgggttatccaaaaatcccagtgtgatatttagttcttgcggagatctagatctgctcgaacaccagacctctctcgtttcctcagaagacggcgcacgtgagcaggaaaatatggacgacaccaacagcgaacaacagtttagagtgttccgcgacttcgacttcctcgatgtggaactcgaggatggagagtag

SEQ ID NO: 50380 - DNA, 453 bp, Artificial Sequence
  Description of Artificial Sequence: Synthetic coding sequence
atggagatcactactgcatgttggcgcaggtcgtgcgttatttctttcatcaaaggtttggcatctcccgtaggcaacgggtatatcaaaccccctgtgcctcctgcttcaggcacccacagagaaaaggggccacccacaatgctgccaattaacgtcgatccggactctaaacctggggagtacgtgttgaaaagcctcttcgtgaactttacaacacaggccgaacggaaaattaggattataatggctgaaccgctggaaaaacccctcactaagtcactgcaacggggagaggatccacagtttgaccaggtgatctcaagcatgagctcactgagcgagtattgccttccgtccatccttcgcacactttttgactggtacaaacggcaaaatggcattgaagatgaaagccatgaatatcgccctcgcacgagtaacaagagctag

SEQ ID NO: 50381 - DNA, 1152 bp, Artificial Sequence
  Description of Artificial Sequence: Synthetic coding sequence
atgacagaaggagaagagaaggggaaccgcgctcttgatcaatttaccctggcttcattcggagaaggcgaccgcggagtctcgcctccacctagtccatttttctctgctatactagccgcttttcagcccgctgcttgtgacgatgcggaggaagcttggcgttcccacatcaatcagctcatgtgtgattctgacggaagttgtgccgtctatacctttcatgtgttcagctccctgttcaaaaacatccagaagagattttgttttctcacttgtgatgctgcttcgtaccttggggacaacctgcgtggcataggttccaagtttgtgtcatcctcgcagatgctgacctcttgctccgaatgtccaacgttgtttgtggacgccgagaccctgctatcttgcgggctcctggacaagttgaaattctctgttttggaactccaggagtatctcgatacctacaacaaccgcaaagaagcgactctctcctggctggccaactgtaaggcaactttcgccggtggaagcagagatggcgtcatcacttgccagcccggtgacagcgaggagaaacagctcgagctgtgtcagcgcctgtacaagctacacttccagctgctgctcctgttccagagttactgcaagctgataggccaggttcacgaggtctcttcaatgcctgaattattgaacatgagtcgcgagctgtcagacctaaaaaagcacttgaaggaggcctctgctgtgattgctgctgatcccctgtatagcgacggcgcttggagtgagcctacgttcactagcacagaggccgctatacagtctatgctggaatgcctgaagaacaatgagttaggtaaggcattgagacagattcgggaatgcaggagtctgtggccaaacgatatctttgggtctagcagtgacgatgaggtacagacactcctgaatatctactttcgacaccaaaccctaggtcaaaccgggacatatgccttggtaggctctaaccagtccctgacagaaatttgtaccaaactcatggagctgaacatggaaatacgcgacatgattagacgagctcagtcatatcgcgtgcttacgactttcctccctgactcctcagtttccggaaccagtctttag

SEQ ID NO: 50382 - DNA, 270 bp, Artificial Sequence
  Description of Artificial Sequence: Synthetic coding sequence
atggagagagtcacactcgcgctcctgctgctggccggtctcacagccttggaggctaacgatccattcgccaataaagacgatccattttactatgactggaagaatctacagctgtccggcttgatctgtggtgggttgctggcaatcgccggaattgcagccgttctgagcggcaagtgcaaatgcaagtctagtcagaagcagcacagtccagtccccgagaaagctattcctctcattacgccaggaagcgccacaacttgttag

SEQ ID NO: 50383 - DNA, 270 bp, Artificial Sequence
  Description of Artificial Sequence: Synthetic coding sequence
atggagcgagtcaccctggctctacttctacttgctggcctgacagccctggaggccaacgacccgttcgccaacaaagatgatccattctattatgattggaagaatttacaactgtctggcctcatctgcggtgggcttctcgcaatcgccggaatagcagccgtcctgtccgggaaatgcaagtgcaaatcttcacagaagcagcattctcccgtccctgagaaggcgattcctctgatcactccgggaagcgccacaacctgctag

SEQ ID NO: 50384 - DNA, 2340 bp, Artificial Sequence
  Description of Artificial Sequence: Synthetic coding sequence
atgttaaccaatcttagaatattcgcaatgagtcaccagactataccttccgtgtacatcaacaatatctgctgctacaagatccgggcttccctcaaaagattgaagccgcatgtcccacttggacgcaactgcagtagcctgccagggctgatcgggaacgacataaagtctctgcacagcattattaaccctcctatcgcgaagatccgtaatatcggcatcatggcacatattgacgcaggaaaaaccacgactaccgaacggattttgtattattctggatacacgcgaagcttaggagacgtggacgacggcgatacagtaactgatttcatggctcaggagcgggagcgcggtattaccatccagtccgctgccgtgaccttcgattggaagggctacagagtgaaccttatcgatacgcccggtcatgtcgatttcacactggaagtagagcggtgccttcgcgtcttagatggggctgtggccgttttcgacgcatctgcaggagtggaagcacaaactctcaccgtgtggaggcaggctgataaacataacatacctcggatctgtttcctgaacaagatggataaaacgggcgcatcttttaaatacgcagtcgagtctattcgggaaaagctaaaggccaagccactcctgctgcagttgcccatcggcgaagcaaaaacttttaaaggcgtggttgatgtcgtgatgaaagaaaaactgttatggaattgtaactctaacgatggaaaagacttcgaaagaaaaccactgctggagatgaacgaccccgaattattgaaagaaaccaccgaagccaggaacgccttaattgagcaggtggccgatctggacgacgagtttgctgatctagtgctggaggagtttagcgagaactttgatttacttcctgctgagaaactgcaaactgctatccaccgcgttaccctggcccagactgccgtgccggtcctctgcggctccgctctcaagaacaagggcatccagccacttctggatgctgtgacaatgtatctcccctcaccagaagaacgaaattacgaattcctccagtggtataaagatgacctgtgtgctctcgcatttaaggtccttcatgacaagcagagaggaccactggtcttcatgcggatctacagcggcacgatcaagcctcagctggcgatccataacattaacggcaactgcactgaaaggatcagccgcctgttactgccattcgccgatcagcatgtagaaatcccatcactaaccgccggaaacatcgccttaacagtgggactgaagcatacagctacaggggacactattgtgagctcaaaatcttcggcactggccgctgcccgtagggcggagcgagagggcgagaagaagcacaggcagaataatgaggctgaacggctattacttgccggagttgagattcccgagccagtcttcttttgcaccatcgagcctccctccctaagcaagcaaccggacctggagcacgccctgaagtgtctccagcgcgaagacccctctctcaaagtcagattagatcccgactccgggcagacggtcttgtgcggcatgggagagctacacatcgagatcatccacgacagaattaaacgagaatacgggttggaaacatatctgggacctctacaggttgcgtatagggagacaattctgaactctgtgcgtgccacggacaccttggataggacccttggcgacaagaggcacctggtcaccgttgaggtagaggccagaccaattgagacgtcgtcagtgatgcccgtgatagaatttgagtacgctgagagtatcaatgagggcttgctcaaggttagccaggaagccatagagaacggcatccatagtgcttgcctgcagggccctctgctaggctccccaatccaggatgtggctataactttgcattctttgaccatccacccgggaacatccaccacaatgatttccgcctgcgtaagtaggtgcgtgcagaaggccctgaaaaaagcagataagcaggttctggagccccttatgaacctagaggtcaccgtagccagggattatctgtctccagtgctagccgatctcgcacagaggcgaggtaatattcaagagattcagacacgacaggacaacaaagtagtcatcggattcgtgccacttgctgaaataatggggtatagcaccgtcctgcggacgttgacctccggatccgcaacattcgctctcgagttgtccacctatcaagccatgaatcctcaggaccagaataccctactgaatagaagatccggattaacctag

SEQ ID NO: 50385 - DNA, 2199 bp, Artificial Sequence
  Description of Artificial Sequence: Synthetic coding sequence
atgttaacaaatttacggattttcgcaatgagccatcaaacaatcccttccgtctatatcaataacatttgctgctataagatccgtgctagcttgaaacgactaaaacctcatgtccctttgggtagaaactgcagttccctcccagggctgattggcaacgatatcaaatccctgcattccattattaacccaccgatcgccaaaatccgaaacatcggaattatggcgcacatagacgcgggaaagacaactaccactgaaaggattttatattatagtggttacacacggtctttgggtgatgttgatgatggagacaccgttaccgatttcatggcccaagagcgcgagagaggcatcactatccagagcgctgcggtgacctttgattggaagggctatcgggtgaatctgatcgatacacctggacacgtggatttcactctcgaggttgaacggtgtcttcgcgtgctggatggggctgtggcggtcttcgatgcctcagctggagtggaggcccaaactctgaccgtatggagacaggcagacaagcataatatacccagaatttgtttcttaaacaaaatggacaagacaggagcctctttcaaatatgctgtcgagtctatccgcgagaagctgaaagcgaagcccctccttctgcagctgcccattggagaggcaaaaacttttaagggcgtggtcgatgtggtgatgaaagagaagctgctgtggaattgcaactctaacgatggtaaagacttcgagcgaaaacccttgctggagatgaatgatcctgagctcctaaaggagacgactgaagctagaaatgccctcattgagcaggtggccgacctggacgacgagttcgctgacctggtgttagaagagttcagtgagaatttcgacttgctcccggctgaaaagctgcaaacagcaattcatagagtgacacttgcgcagacagccgttcctgtgctttgcggcagtgctttgaaaaacaagggcattcaacctctcctggatgccgtgaccatgtacttgccctccccagaggagcgaaattacgaattcctggagcgaatctctcgtttactcctccctttcgccgatcagcatgtggagatacctagtcttactgcaggcaacatcgcgctgacagtgggcctgaaacacaccgccacgggcgataccattgtgtcgagcaagagctctgcccttgctgccgctagacgcgctgagcgcgaaggggagaaaaagcatcggcaaaacaacgaggcagagcgtttgcttctcgccggtgtcgaaataccggaacctgtgtttttctgcacgattgagcctccatcactgtcaaagcaaccagatctcgaacacgccctgaaatgcctacaacgagaggacccctccctcaaggtgcggcttgatcctgacagcggtcagactgtattgtgcggcatgggcgagttgcatattgagattatccacgaccgaattaagcgtgaatatgggttggagacataccttggtccactccaggttgcttatcgggaaaccatcctgaacagtgtgcgggctaccgacacattggacaggacgctaggggataagagacatctggtgactgtcgaggtggaggctagaccaatcgagacctccagcgtcatgcctgtgatcgagtttgaatacgcagagtccatcaacgagggcttattaaaggtcagtcaagaagctatagagaacggcattcactctgcctgcctgcagggtccgttgttagggtcacccatccaggatgtggcaatcaccttacatagcctgactattcatcctggaacttctacaactatgatcagcgcttgtgtctcccgctgtgttcagaaggcactgaagaaagccgataagcaggtgctcgaacccttgatgaacttggaggtcaccgtagcacgggactatctgtcccccgtgctcgcagatctcgctcagagacgcggtaacatccaagagattcaaacacgtcaagacaacaaagtggtcattggatttgtacctctggccgaaattatggggtattccactgttttgagaaccctgacctccggaagcgcgacttttgcgctcgaactttccacatatcaggcaatgaatcctcaggatcaaaacacactgctgaaccgcagatctggccttacgtag

SEQ ID NO: 50386 - DNA, 1542 bp, Artificial Sequence
  Description of Artificial Sequence: Synthetic coding sequence
atgctgactaatctgaggatctttgctatgtcccatcagacaatcccatccgtttatatcaacaatatctgttgttacaagatcagagcgtcattgaaaaggctcaagccccatgtacctctgggcagaaattgctcctctctgcccggtttaatcggcaacgatatcaagtccttacacagcattatcaatcctcctatcgctaagataaggaacattggaattatggcgcacattgacgctgggaaaaccaccaccacagaacgtatcctctactattccgggtatacgcggtctctcggggatgtcgacgatggcgataccgtgacggacttcatggcccaggaaagggaacgtggtattaccatccagagtgcagcggtaacattcgactggaaagggtaccgcgtgaacctgatcgatactcccggacacgttgatttcaccctggaagtagaacgctgcctaagggtcctggatggcgcagtagctgtgtttgacgccagtgcgggagtcgaggcacagaccctcaccgtatggaggcaggctgataaacataatattcctcgcatctgttttctgaataagatggacaagaccggggcttcttttaaatacgcagtcgagagcatccgcgaaaagctgaaggcgaagcctctgctcctccagttgcccatcggggaagcgaagacatttaaaggagtggttgacgtggtcatgaaggagaaattgctctggaactgtaacagtaatgatggcaaagatttcgagcggaagcctctgttagaaatgaatgaccctgaactgctcaaagaaacaaccgaagcccgaaacgctctcatcgaacaagttgctgatctagacgacgagtttgccgatttagtcttggaggagttcagtgaaaatttcgacctgcttccagccgagaagcttcaaacagcaattcaccgggtcactttagcgcaaaccgcggtgcctgtcctttgtggttcagccctgaagaacaagggcatccaacccctcctcgacgccgtcaccatgtacctcccttcccctgaggaacgcaactacgaatttctgcagtggtacaaagacgacttgtgcgcccttgcatttaaggtgctccatgacaaacagagaggtcctcttgtgttcatgcgcatctactctggtactataaaacctcagttggcaatacacaacattaacgggaactgcactgagaggatttcaaggctcctcctgccttttgcagatcagcatgtcgagattccctccctgactgccggtaacatcgccctgactgttggcctgaaacatactgccactggagacaccatcgtgagttccaagagctctgcccttgccgcagctaggcgggctgagcgcgagggggaaaagaaacacaggcagaataatgaagccgaaagactgcttttggctggagtcgaaatacccgaacccgtgttcttctgcactatcgagcctcctagtctctccaaacaaccaggtatcaacggcctgtcagtctctaccaactag

SEQ ID NO: 50387 - DNA, 2340 bp, Artificial Sequence
  Description of Artificial Sequence: Synthetic coding sequence
atgctaactaatttgagaatctttgctatgagccaccagaccatcccttccgtttacatcaataatatctgttgttataaaatccgggcatcccttaagagactcaagccgcatgtcccacttggacggaactgtagctccctaccaggacttattggcaacgatattaaatcactgcacagcataatcaacccacctatagctaagatccgcaatatcggcatcatggctcatatcgacgctggaaagaccacaactaccgagaggattctgtactactctgggtatacaaggtcacttggggatgtagacgacggggatacagttactgattttatggctcaggagagggagagaggcatcacgattcagtctgctgctgtgacgtttgactggaagggctatcgcgtgaatctcattgacactccgggacacgtggattttactctggaggtggagagatgtctacgggtcttggatggagccgtcgccgtcttcgacgcatccgctggcgtggaagctcaaacgctgacggtgtggagacaagcagacaaacacaacataccccgaatatgtttcctgaacaagatggataaaacgggagccagctttaagtacgcagtggagtccatacgagaaaagctgaaagccaagccactactcctacaactccccatcggcgaagccaagactttcaaaggggtggttgacgtagttatgaaagaaaagctgctgtggaattgtaactcaaacgatggaaaagattttgaacgtaagcccctgctggagatgaacgaccccgagctgctgaaagagaccacagaagccagaaacgctcttattgaacaggtggccgacctagatgatgaatttgcagatctggtcctggaggaattttcggaaaatttcgatcttctccctgccgagaaactgcagactgcgattcaccgggttaccctggcccagactgcagttcccgtgctttgtggaagtgcgttgaagaacaagggcatacagcccctcctcgatgccgtgacaatgtacctcccttctccggaagagcgcaattatgagttcctccagtggtataaggacgatctgtgtgcactcgcgtttaaagtgctgcatgataagcagaggggccctctggtgtttatgagaatttatagtggcacgatcaagccccagctggcgattcataacatcaatggcaattgcacggaaagaatcagtcgcctactgttgcccttcgccgatcaacatgtcgaaattccgtctctgacagccggtaatattgctttaacagtaggactgaaacacactgccactggagacacgatagtgtcctcgaaaagctcggcactggccgctgccagacgagccgagcgcgagggggaaaagaagcaccgtcaaaacaacgaagcggaaaggttattgcttgccggagtggaaatacccgagcccgtctttttttgcaccattgagccaccaagcttgagcaagcagcctgatttagagcacgcgctcaaatgtttgcaaagggaggaccctagtttaaaagtgcgcctggatcccgattccgggcagaccgtgctgtgcgggatgggagagctgcacatcgagatcattcatgatcgtataaaaagagagtacgggttggagacctatcttggacccctgcaagtagcctaccgtgagacaatcttaaactctgtaagagcaaccgacactcttgacaggaccctaggagacaagcgccacctggtgacagtggaggtggaggccaggccgattgaaacctcaagcgtcatgcctgtcattgaattcgagtacgcagagtcgatcaatgagggcctcctcaaggtctcccaggaggcaattgagaacgggatccactctgcctgtctccagggcccactgctgggatctcccatccaggatgtggccatcaccctgcactcattgaccattcacccgggtacaagcactacaatgatctcggcttgcgtgagccgatgcgttcaaaaagccctgaagaaggctgacaaacaagtccttgagccgctgatgaatctcgaagtgacagtcgccagagattacctgagccccgtgttggcagacctggcgcaacgacggggtaatatacaggagatacagacgcgacaggataataaggttgtcatagggtttgtccccctcgccgaaatcatgggatactcaactgtgttgcggacgctgacctccgggtcagccacattcgccctcgaattatccacataccaggcgatgaatccccaggaccagaatacactacttaacaggagatcagggctgacatag

SEQ ID NO: 50388 - DNA, 1806 bp, Artificial Sequence
  Description of Artificial Sequence: Synthetic coding sequence
atgctgaccaacctgcgcatcttcgctatgagtcaccagacaatcccctccgtgtacattaataatatttgctgctacaaaattagggcaagcctgaaaagactcaagcctcatgtgcccctgggcagaaactgcagcagcctccccggtcttattggcaatgatatcaagtccctgcacagtatcataaatccgccaatcgccaaaattcggaacatcgggattatggcccatatagacgcgggaaaaacaacaacgaccgaaaggatcttgtattactcaggatacacccgcagtctaggtgatgttgatgatggagacaccgtgaccgacttcatggcccaggaaagggagagaggcatcacaatacagtcggcggcagtaactttcgattggaaagggtaccgggtcaacctgatagacaccccgggtcacgtcgattttactctggaggtggagagatgccttcgggtgttggacggagccgtggccgtgttcgacgcaagcgcaggtgtcgaggcccagacacttaccgtctggaggcaggcagacaaacacaatatccctcgcatttgctttctcaacaagatggataagacaggcgcaagctttaagtacgctgtagagtccatccgcgagaaactcaaggcaaaacctctcttactgcaacttcccattggggaggcaaagacgtttaaaggcgtggtggacgttgtcatgaaagagaagttgctctggaattgtaatagcaatgacggaaaagactttgaacgaaaaccactgctggagatgaacgatcccgaactgctaaaggagacaactgaggccagaaacgccttgatagagcaggtggctgacctcgacgacgagttcgccgacctcgtgctcgaggagtttagcgaaaacttcgatttacttcctgccgagaaactgcagaccgccattcatcgcgtaactctggcacagaccgccgttccagttctttgcggatccgccctgaagaacaaagggatccagcccctactcgatgcggttaccatgtacctgcccagccctgaagaaagaaattacgaattcctgcaatggtacaaggatgatttgtgtgccctggccttcaaagtcctccacgacaagcagcgtgggccactggtgtttatgaggatatattccggcacaataaagccccaactggccatccacaatattaacggtaactgcaccgaacgtatttcgcggctgctgttaccatttgctgaccagcatgtggagatcccctctctgacagcagggaacatcgctctgactgtgggactgaaacacacagctacaggggatactatcgtgtcaagtaagtcaagcgccttggcagctgccaggagggccgaaagggagggagagaagaaacacagacaaaacaacgaagcagagcggcttctcctggccggtgtggagatccccgagcctgtcttcttctgtacaatcgaacccccttctttgagcaagcaacccgatctagagcatgccctgaaatgtctgcagcgggaagatccaagcctgaaagtgcggttagacccggactcagggcaagtcgctcaacgacggggtaatatccaggagattcagactaggcaggacaacaaagtggtaatcgggttcgtgccacttgccgagattatgggctacagcactgtccttcggactcttacttcaggttcggccaccttcgcacttgaactttccacctaccaggccatgaacccacaggaccaaaacactttactcaatcggagatctggcctgacttag

SEQ ID NO: 50389 - DNA, 948 bp, Artificial Sequence
  Description of Artificial Sequence: Synthetic coding sequence
atggcgtccgctgtgctttctagcgtgccgaccacggcatctcggtttgctttattacaggtggactctgggagcggcagtgatagtgaaccgggtaagggtaaaggccgaaacactggtaaaagtcaaacattaggaagcaaaagtacaaccaatgaaaagaagcgggaaaagcgaagaaaaaagaaagagcagcagcagtccgaggcaaacgaactccggaacctggccttcaaaaaaatccctcagaaaagcagccacgccgtttgtaatgcccagcacgacctccctctcagcaaccctgttcagaaggacagccgagaggagaactggcaggagtggagacagagggatgagcagctgaccagtgagatgttcgaggccgacctggagaaagcgctactccttagcaaactcgagtatgaggagcacaagaaagaatatgaagacgccgaaaacacctcaacacagagcaaggtaatgaataagaaagataagagaaaaaatcatcagggcaaagacagacctctcaccgtttcactgaaggacttccactcagaagatcatatctctaaaaaaacggaggaggttgtgctgaaagatggcaggatagagcgcctgaaactggaactcgagcgtaaagacgctgaaattcaaaaactcaagaacgttatcacccaatgggaagctaaatacaaggaggtcaaggccagaaacgcacagctgctcaagatgctccaggagggtgaaatgaaggacaaagcagagatcctgctgcaggtagacgaaagccagtcaattaagaacgagctgacgattcaggtgacttccctccatgcagcgttggagcaggaaagatcaaaggttaaggtcctgcaggccgaactggccaagtaccaaggcggtagaaaaggaaaacggaacagtgagtcagatcagtgccgctag

SEQ ID NO: 50390 - DNA, 1101 bp, Artificial Sequence
  Description of Artificial Sequence: Synthetic coding sequence
atggcttcggcagtgctgagttctgtgccaacgactgctagtcgctttgccctgcttcaggtggattcaggatctggaagcgacagcgagcccggaaagggtaaaggccgtaacacagggaagtctcagacgctgggtagcaagagtaccaccaacgaaaagaagcgtgaaaagcgcagaaaaaagaaggaacaacagcagtcagaggcaaatgagctgagaaatctcgcttttaaaaaaataccccagaaaagcagccacgcagtctgtaatgcccagcatgatctgccactgagcaacccggtccagaaggactcaagagaagagaattggcaggaatggcgtcagcgagacgaacagctcactagtgagatgttcgaggcagacctcgagaaggccctcctactgagcaaactggaatatgaagagcacaaaaaggagtatgaggacgctgagaacacgtctacccagtcgaaagtcatgaataaaaaagataagcggaaaaatcaccagggcaaggaccggcctctcacggtgtcactgaaggactttcattccgaggaccacatctctaaaaaaaccgaggaactgtcatcgtcacagaccctcagccatgatgggggattctttaatagattagaggatgacgttcacaaaattcttatccgcgagaagcgcagagaacaactgactgaatataatggtaccgataattgcaccgctcacgaacataaccaggaggtcgtcctaaaagatggcagaattgaaaggctaaaactcgaactagagcgaaaagatgctgagatccagaagttaaagaatgtgataacccaatgggaagcaaagtacaaggaggttaaggctaggaacgcacagcttctgaaaatgctgcaggaaggggagatgaaggacaaggccgaaatattgctccaggttgacgagagtcaatccattaaaaacgaacttacaattcaagtcacttccctgcacgctgctcttgaacaagaaaggagtaaggtgaaagtcctccaggcagagctcgcaaaataccaaggcggaagaaaggggaagcgcaactctgagtccgaccagtgccggtag

SEQ ID NO: 50391 - DNA, 381 bp, Artificial Sequence
  Description of Artificial Sequence: Synthetic coding sequence
atggccagtgcagtgctctcttccgtcccaactaccgcatcacgtttcgccctgttgcaagtggacagtgggtccgggtcagactctgagccagggaaaggtaaaggcagaaacaccggaaagtctcagactttggggagtaaatctaccaccaatgaaaagaaacgcgagaaacgtaggaagaaaaaggagcagcaacaatctgaggccaacgagttacgcaatctagccttcaaaaaaattccccaaaagagcagccatgccgtgtgcaacgcccagcatgacctgcctctcagtaatccagtccaaaaagattccagggaggaaaattggcaggaatggaggcagcgtgatgagcagatgggatctaggaggcaatag

SEQ ID NO: 50392 - DNA, 165 bp, Artificial Sequence
  Description of Artificial Sequence: Synthetic coding sequence
atggcctccgccgtcctctcttccgtgcctaccacagccagcaggttcgccctgcttcaggtcgattcagggagcggaagcgacagcgaacctgggaaaggcaagggccgaaacactggcaagagtcagaccctgggctcaaagtccacaacaaatgagaagtag

SEQ ID NO: 50393 - DNA, 3027 bp, Artificial Sequence
  Description of Artificial Sequence: Synthetic coding sequence
atggacacagcggaggaccctgcttggctacagctcctacagaaagatagctcgcctcctggcccaagacccacagcgttcttttgtccgcaggacggcagcttgggtgcaggatcgtcagccatgcgcgattactgcccgagccagcaaaaagcctcaccagcccctcccaggcatacaccggatcagagcccgggtatggaaagccggcatagatcaccatctggggctggagaaggggcttcctgctccgacggacccaggggatcattagcctgcccatctcccacatgcttctccccacaggagtcaccttcaaaggagaccctggaagctcacggagcctcgatttccggaactcccgaagccacaacgagcggaaaaccagagcccgtcagcagtgtaaaaaccgagccgaagagcagtgatgacaggaaccctatgttcctagagaaaatggacttcaagagcagcaagcaggcagactccacttccattggaaaagaagaccccggaagctcccggaaagccgacccaatgtttacaggcaaggctgaaccagaaatcctcggcaaaggagatcccgttgccccaggcagaatggatcccatgacggtccgcaaagaggatctgggctcactgggcaaggtggatccattgtgcagctccaagacctacaccgtatcaccacggaaggaagatcccggtagcctgcggaaggtggacccggtgtcctcagataaagttgatcccgtgtttccgaggaaagaggaacctagatacagcggcaaagaacatcccgtgtcgtccgaaaaggtggcgccaacatccgctgagaaagttgatctggtactcagtggtaagagagatcccggtccaagcggtaaagctgacccaatgcccctagagtctatggacagcgcctccacagggaagacagagcctgggttgctcggcaagctcattccaggatcatctgggaagaacggacccgtgagttctgggacaggcgcacctggtagccttggtcgtcttgatccaacttgtctgggtatggccgaccccgctagcgtcggcaatgtggaaactgttcccgcaaccaaagaagacagccggttcctgggaaaaatggatcccgcttccagtggtgaggggcgtcccgttagcgggcatacagacaccaccgcctctgccaagacggacctgacctcgctgaagaatgtagatcctatgtccagtgggaaggtcgatccagttagtctcgggaagatggacccaatgtgttccggtaagcccgagttactgagccccggtcaggctgagcgtgtgagtgtagggaaagcagggacggtttcaccaggcaaggaggatcctgtgtcttcccgacgagaggaccccatcagtgccggatctaggaagacctccagcgaaaaagtgaatcccgagagtagcggcaagacgaacccggttagttctggccctggcgatcctcggtccctaggcacggctggacccccaagcgctgtgaaagcagaacccgcaacaggaggtaaaggggaccctctcagctccgagaaagccggactcgttgccagcggaaaggctgcccctactgcctctgggaaagccgaacccctcgctgtgggaaaggaggacccggtgtccaaagggaaagcagatgccggaccctcgggacagggggactctgtcagcattgggaaggtagtgtcgacccctggcaaaacggtgcctgtaccgtcaggaaaggtcgaccctgtctcccttggcaaagccgaggccattcctgagggaaaggttggcagcctgcccctggaaaagggctccccggtgaccaccactaaggctgaccctcgggcatccggaaaagcgcagcctcagtctggaggcaaagccgaaacaaagctaccagggcaagaaggggctgccgcacccggagaggccggtgcagtctgcttgaagaaggaaaccccacaggcttctgaaaaggtggatcccggaagctgtaggaaggcagaacccctggccagcggcaaaggcgagcccgtgtcacttggtaaagccgactccgctccaagcaggaaaactgagtccccctcacttggcaaagtggtccctctctcgctagagaaaactaaaccttcatctagttctaggcagcttgaccggaaggcactgggaagtgcccgatcacccgaaggtgctagaggcagcgagggacgagtggaaccaaaggccgagcccgtctcatccaccgaggcttcatccctgggccagaaagatttggaggctgccggagccgagcgctccccatgtcctgaggcagcagccccaccccctgggccacggactagggataacttcaccaaagctccttcatgggaggcctcagcaccccctccccctagagaggacgcagggacacaagccggagcacaagcgtgtgtgagtgtcgccgtaagccctatgtccccccaggacggggctgggggttctgctttctcattccaagcagccccacgtgccccatcaccccctagccggagagatgctggtttgcaggtgagtctgggagccgctgagactcggtcagtagcgacaggccctatgacaccgcaagctgcagctcccccagctttccccgaggtgagggtccggccaggctccgctttggccgctgctgtggcaccgcctgagcctgcggagcctgttcgtgatgtctcttgggatgagaagggcatgacttgggaagtgtatggcgctgctatggaggttgaggtcctggggatggcaatccaaaaacacctagaacgccaaatcgaggaacacgggcgacagggagcgccagctccacctcccgcagccagggccggaccgggaagatctggctctgtacgtactgcccctcccgatggggcagccaaacggccaccaggtctcttccgggctttacttcagtcggtgcgaaggccgcgatgctgtagtagagccggtccaacagccgaatag

SEQ ID NO: 50394 - DNA, 2397 bp, Artificial Sequence
  Description of Artificial Sequence: Synthetic coding sequence
atggatactgccgaagaccccgcttggttgcaactccttcagaaagattcctctcccccaggacctcgccctacggcctttttctgtccgcaggacggcagtctgggtgccggtagcagtgcaatgcgagattattgccccagccaacagaaagcctctcccgctccccctcgccatacgcccgatcagagtccgggaatggagagcaggcaccgctctccctcgggcgctggagaaggcgcttcctgttctgatggtccacggggatcccttgcctgtccatcacctacatgctttagccctcaggaatccccttcaaaagagaccctagaggctcatggggcttctatttccggcacacccgaagctactacgtccggcaaacccgagcccgtgagttctgtaaagaccgagcccaagagctccgacgacaggaaccccatgttcctggagaaaatggatttcaagagcagtaaacaggccgacagcacatccattggcaaagaagacccaggctcttcccggaaggccgaccctatgttcactggtaaagcagaaccagagattttgggcaagggcgatcctgttgctcctggaagaatggaccctatgacagtccgcaaggaagatttaggtagcctgggtaaagtggatcccctatgttcctctaaaacatacaccgtgtcgcccagaaaagaggatccaggatccttgcggaaagttgaccctgtctccagcgacaaagtggacccggtctttcctcggaaagaggagccgaggtattctggaaaggagcacccagtttcatcagagaaggttgcgcctactagtgccgagaaggtggacctagtgctgtcgggtaagagggatcctgggcctagcgggaaggcagatcccatgcccctcgaatccatggacagtgccagcactggcaagacagagcccggacttctgggtaagcttataccaggcagttctggaaaaaacggacctgtttcttcaggtactggcgctcccggttctctgggcagactggatccgacatgtctcggcatggccgaccctgcaagtgtgggcaatgtggaaacggtgcctgctacaaaagaggactcacgcttccttggtaagatggatccagcctcctctggggaagggaggcccgtttcaggccacaccgataccaccgcaagtgctaagactgacctgacttcccttaaaaacgtggacccgatgtccagtggaaaagtagatccagtttccctgggaaaaatggaccccatgtgcagtggcaaacctgaactgctgtctcccggtcaggctgagagggtatccgtggggaaggctgggaccgtgtctccaggcaaggaagaccctgtgtcaagccgtcgtgaagacccaatttccgcgggtagccgcaagaccagtagcgagaaggtgaatcccgagtctagcgggaagaccaatccagtaagcagcggaccaggcgaccctagaagcctggggaccgccggtccgccatcggcagtgaaggctgagcccgctaccggcggaaagggtgatcctttgtccagcgagaaggcaggcctggtggccagtggcaaagctgcccctacagcctcgggcaaagcagagccccttgcagtggggaaagaggaccctgtcagcaaaggtaaagcagatgcgggaccttcggggcagggcgactctgtgtccataggcaaggtagtttccacccctggaaagactgtccctgtccccagcgggaaggtcgatccggtgtcattggggaaagccgaggccattcccgaaggaaaggtggggagcctcccccttgagaaaggctcacccgtcacgacaacaaaagcggatcctagggcttccggaaaggctcagccgcagtccggcggtaaggccgagacaaagctgcccggtcaagagggcgctgctgctcctggggaagcaggagccgtgtgtctcaagaaagagacaccccaggcatccgagaaggtcgaccctggaagttgtcggaaagcagagcctctggccagcggaaagggagagcctgtgtccctgggcaaagcggacagcgcaccgtcccggaaaactgagagccccagcctcggcaaggtggtgcctctatccctagagaagaccaaacctagcagctcctcacgtcagctagaccggaaagccctaggctcggccagatcccctgagggagcacgcggttcagaagggagacaggctagtgccaggcctgtccctcgcgcagctgccgagtgtgcccctgccgctgtgttgctggccggtggcacgcatgggcgagtgatctgcccccactttgtccgcccaagcttccgtccctcccaagccccattcctgatcactggaccttag

SEQ ID NO: 50395 - DNA, 1659 bp, Artificial Sequence
  Description of Artificial Sequence: Synthetic coding sequence
atggccgcacttgccccagtgggaagccccgcaagtcgaggccctagactcgcagcaggtctgaggctcctgccgatgttgggcctcttacagttgttggcggagcctggactagggagagtgcaccatctggctttgaaggacgacgtgaggcacaaagtgcacctgaacaccttcggattttttaaggatgggtatatggtggtgaacgtgagcagcctgagtctgaacgaacctgaagataaagacgtgacaatcggattcagcctggaccgcacaaaaaatgatggtttctcctcttatctggatgaggacgtaaattactgtatcctaaaaaaacagtcagttagtgtcacactgctgattcttgatatctctcggtcagaggtgagagtcaagtccccccctgaagccggaacacaactgccaaagattatattctccagggatgaaaaagtgctgggacagtcccaagagcccaacgtgaatcctgcttccgctggaaatcagactcagaaaacccaggacggaggtaaatcaaaacggtcaactgttgacagtaaggctatgggggaaaagtcatttagcgtccacaataacgggggtgcagtaagcttccagtttttctttaacatctcaactgacgatcaggaaggattgtattctctgtattttcataagtgcctgggaaaggagttgcccagtgacaagttcaccttttctttagacattgaaataaccgagaaaaaccctgactcttacctgagcgccggagagatacctctcccaaagctgtatattagcatggcttttttcttctttcttagcggaaccatttggatccacatccttaggaagagaagaaatgatgtgttcaaaattcactggttaatggcagccctccccttcaccaaatcactctctcttgtgttccatgccatagactaccactacatatcatcacagggcttccctatcgaaggatgggctgtggtctattacataacccacctactgaaaggcgcacttttattcataaccatcgcactgattggcacaggatgggcgttcattaagcatattctttccgacaaggacaaaaagattttcatgatcgtgatacctctgcaggtcttggctaatgtcgcttatattataatcgaaagcacagaggagggaaccactgaatacggcctttggaaggactctctcttcttagtagatcttctgtgttgtggtgctatcctttttcctgtggtttggtcgattcgacatttacaggaggctagcgccacagacggaaaggcggcaatcaatttagctaaattgaaactgttcaggcactattatgtcctcatcgtgtgttacatctactttactaggattattgcattcctgctgaaattggcagtgccttttcagtggaaatggctgtatcaattgctcgacgagacagccaccttagtgtttttcgtgttaacaggctacaaatttaggccggcaagtgataacccgtacttgcagctgtcacaggaggaagaagacctggaaatggagtctgtggtcactactagcggcgttatggagtccatgaaaaaagtaaaaaaggtcaccaatggctccgtggaacctcagggagagtgggagggcgctgtgtag

SEQ ID NO: 50396 - DNA, 1803 bp, Artificial Sequence
  Description of Artificial Sequence: Synthetic coding sequence
atggcagccctagcgcctgtgggttcacccgctagtcgaggtccccgactggcagctggactgaggctgctacctatgctcggcctgctccagttgttggcggagcccggactgggacgggtgcaccacctggcattaaaggatgacgttcgccacaaagtacacttgaatacatttgggttcttcaaagacggatatatggtcgtgaatgtgtcctccttaagcttgaacgaacccgaggacaaagacgtaaccattggcttctcccttgaccgcaccaagaacgatgggttctcttcttacttggacgaagatgtgaattattgcatactgaaaaagcaaagtgttagtgttactctcctcatactcgacattagtagatccgaggttagggtgaagtcaccccctgaagccggaacccagctccctaagataattttttctagagatgagaaagtactcgggcaatcccaggagccaaatgtgaaccctgcttcagctggaaatcagactcagaagactcaggatggagggaagtccaaacggagcaccgtggactctaaagccatgggtgagaagagcttcagtgtccacaacaacggcggtgccgtgtcctttcaattttttttcaacatttcaaccgacgaccaagaggggctgtactctctgtactttcacaaatgcttaggcaaggaattaccttctgacaaatttacgttctcgctggatattgagattactgaaaagaacccagacagctatctgtcagcaggggaaatccctctcccgaaactgtatatcagcatggcattctttttcttcctgtcaggaacaatctggatccatattctgaggaaaagaagaaatgacgtcttcaaaattcactggttgatggctgccttgccgttcaccaagtccctcagtctcgtgtttcacgcaatcgattaccactatattagctcccagggtttccccattgaaggttgggccgttgtctactatataacccatttgctgaagggagcccttctgtttataacaattgcactgattggtactgggtgggcctttataaagcatattctctcagacaaagacaaaaagattttcatgatcgttatcccacttcaggtgcttgccaatgtggcctatatcatcattgagagcacagaggaaggtaccacagagtacggtctgtggaaagacagcctgtttttagtcgacttactatgctgcggtgctatcctctttcctgtggtttggtccatcagacacctccaggaggccagcgccacagatgggaaaggcgattccatggggcctctgcaacagagggccaaccttcgggcaggaagtcggatcgagagtcaccacttcgcacaggctgatctggagctactcgccagcagttgcccacccgcatcagtgagccagcgtgccggtatcacggctgctattaatctggctaagcttaaacttttccggcattattacgtgctgatagtctgctacatttactttactcgtattattgcatttctcctgaagctggccgtgccctttcagtggaaatggttgtatcaactgttggatgaaaccgctacgcttgtgtttttcgtgctaaccgggtacaagttccgacccgctagtgacaacccttacctgcagctgagtcaggaggaggaagaccttgagatggaaagcgtggtgaccacaagcggcgtcatggagagcatgaagaaagtgaagaaagtcaccaatggaagtgtggaaccacagggggaatgggaaggggctgtgtag

SEQ ID NO: 50397 - DNA, 1716 bp, Artificial Sequence
  Description of Artificial Sequence: Synthetic coding sequence
atggcagccctcgctcctgtcggctcacctgcctccagggggccacgactggcagcaggactgcggttgcttcccatgctgggactgcttcagctcttggctgaacccggacttggccgtgttcatcacttggcattaaaggacgacgttcgacacaaggttcacctcaatactttcggattttttaaagatggctatatggtggtgaatgtctctagcctgtcactgaacgagcctgaggataaggatgttacaataggcttctcactggatcggacgaagaatgacggtttttcttcatacctggacgaggatgtcaattactgtattctcaagaaacagtctgtgagtgtgacgctgctcatcttggacattagtagatccgaagtgcgggtcaagagccctccagaggctggcactcagctgcccaaaatcatcttcagccgtgacgaaaaagtattagggcagtctcaggaacctaacgtcaacccagcatctgctgggaatcagacccagaagactcaggacggcggtaaatctaagcgaagcaccgttgattccaaagccatgggcgagaaaagtttttccgtacacaataacgggggtgcggtctcatttcagtttttttttaacatttctacagatgatcaagaaggattgtactctctctatttccacaaatgtttaggtaaggagctcccgagcgataagtttacatttagcctggatatcgaaatcacggagaagaaccccgacagttacctttccgctggggagatccctctgcccaagctgtatatctctatggcattctttttctttctcagtgggacaatttggatccacatcctgcgcaaaaggcgaaatgatgtgtttaaaatccactggcttatggccgcactcccatttaccaagagtctgagcctagtgtttcacgcaatcgactatcactacatcagctcacaggggttccctattgaaggctgggcggtggtttactatatcactcaccttctgaaaggtgctcttctattcatcacaatcgctctcattggcaccggctgggctttcatcaaacacatcctgtcagacaaggataagaagatttttatgatcgtcatccccctgcaagtgctggcgaacgtggcgtacataatcatcgaaagcaccgaagagggtaccacagagtatggcctctggaaagatagcctgttcctcgttgaccttttgtgctgtggcgctatcctgtttcccgtcgtgtggagtatcagacatcttcaggaggcctctgcaaccgacggaaagggcgactcgatgggccctttgcagcagcgagccaatcttagagctgggagcaggatagccgctatcaacttggcgaaactcaagttatttcggcactactacgtgctaatcgtgtgctacatctattttactaggatcatcgccttcctccttaagttagccgtgccctttcagtggaagtggctatatcagctgctggatgaaactgcgaccctggtgtttttcgtcctcactggctataaattccgcccagctagcgacaacccttacttgcagctgagtcaagaggaggaggacttagagatggaaagtgttgttaccacgagcggggtcatggaatccatgaagaaggtaaagaaggtcactaacgggtccgtcgaacctcagggcgagtgggagggcgcagtgtag

SEQ ID NO: 50398 - DNA, 1140 bp, Artificial Sequence
  Description of Artificial Sequence: Synthetic coding sequence
atggcagcgttggctcccgtgggcagtcccgcaagcagggggccaagactggcagcgggtttaagacttctgccaatgcttggactacttcaactgttggcagagcctggactgggcagagtacaccacctggccctgaaggatgatgttagacacaaagtgcatctgaacacgttcggattcttcaaggacggatacatggtggtcaacgtcagcagtttgtccctaaacgaacctgaagataaggacgtgaccatcggcttttcactcgacaggaccaaaaacgacggatttagctcctacctggacgaagacgtaaactactgcatcctcaaaaagcagagtgtgagcgtgactttgcttatcctagacatttctcggtccgaagtccgagtcaagagtcccccagaagccggtacccagctgcccaagataattttttctcgggacgaaaaggtgctgggccaatcccaggagccgaacgttaacccggcaagtgctggcaatcagacacaaaagacacaggatggcggaaaatcaaagaggagtacggtggactcaaaagccatgggtgagaaaagttttagtgtgcacaacaacgggggtgctgtaagcttccagttcttttttaatatttcgactgatgaccaagagggactttattccttatattttcataagtgcctgggtaaggaactccctagtgacaaattcaccttttccctggacatcgaaataaccgagaagaatcctgactcctacctttctgcgggagaaatccctctcccgaagctgtacatatctatggccttctttttcttcctatcgggaacgatatggattcacatcctcagaaagcggaggaatgacgttttcaagatccactggctgatggccgctctgcccttcaccaagtcactttccttggtatttcacgctattgattaccattatatttcatcacagggctttccgattgagggatgggctgttgtgtactacatcacgcatctcttaaagggtgctctgctgttcattaccattgccttgataggcaccggttgggctttcattaagcacattttgagcgataaggataaaaagattttcatgatcgtcattccactgcaagtcctctag

SEQ ID NO: 50399 - DNA, 1632 bp, Artificial Sequence
  Description of Artificial Sequence: Synthetic coding sequence
atggccgtaagcgagaggagaggactgggaaggggcagccctgctgaatggggccaacggctgttgttagttttgcttctggggggatgctccggcagaatccaccaattggccctgactggggaaaagcgagctgatattcaactgaactccttcggattttacactaatggaagtttggaagtggagcttagtgttctacgcctggggctgagggaagctgaggagaaatctctgttagtcggcttcagtctaagccgcgtgagatctggccgagtgcgcagttactccacaagggactttcaggactgcccactccagaaaaattcaagcagctttctcgtcttgtttctcattaacactaaggatctccaggtccaggttcgcaagtatggcgagcagaaaaccctgtttatctttcctggcttgttgccagaagccccttccaaaccgggattgcccaaaccgcaggccactgttcctcgaaaggtggacgggggaggtacaagcgccgcaagtaaacccaaaagtacacccgctgtaatccaggggcctagtggaaaggataaagacttagtgctaggcctcagtcatctgaacaacagctacaacttttcgttccacgtagtgatcgggagtcaggctgaggaggggcagtattcgctcaattttcacaactgcaataattccgtgcctggcaaggaacacccatttgacatcacagtcatgatcagggagaaaaatcccgacgggttcctgtccgccgcagagatgcccttattcaagctctatatggtaatgagcgcatgttttttagccgctggaatcttttgggtatctatcctgtgtcggaatacttattctgtgttcaaaatacactggcttatggcagccctcgctttcaccaaaagcatatcccttctttttcatagcataaactattatttcattaactcgcagggacatccaatcgagggcttggccgttatgtattacattgcccacctgttgaagggagcactgctgtttatcacaattgccttgattggttcgggctgggcgtttataaagtacgtcctgtccgataaggagaaaaaagtattcggaatcgtgatcccgatgcaagtgctcgctaatgtagcctatatcattattgagtctagagaggaaggggcttccgattacgtcctttggaaggagatactgtttctggtcgaccttatttgttgtggcgcaatattgtttcccgttgtctggagcatacgccacctgcaggacgcctccggaactgacggcaaagtcgccgtcaacctcgcgaaactcaaactgttccgtcattactacgtcatggtgatctgttatgtgtatttcacaagaatcattgccattttacttcaggtggctgtcccattccagtggcaatggctctaccagctgctggtcgagggtagcacgctggccttcttcgtcttaactggatacaagttccagcctacgggtaataacccttatttgcagcttccacaggaagatgaagaggatgtccagatggaacaggttatgacagattctgggtttagagaggggttaagcaaagtaaataaaacggcctccggtagggagcttctctag

SEQ ID NO: 50400 - DNA, 906 bp, Artificial Sequence
  Description of Artificial Sequence: Synthetic coding sequence
atgattagagaaaaaaaccctgatggcttcctatccgccgcagaaatgcccctttttaagctgtacatggtgatgagcgcttgtttcctggcagctggaatattctgggtgtctatcctgtgccgtaacacctactccgttttcaaaattcactggctgatggcagccctcgctttcaccaaatcgatctcactcctgttccattccatcaactactactttatcaactcccaaggacatcccatcgaggggctggctgtcatgtactatattgcacatctacttaagggggctttactcttcatcactatcgccctgatcgggtctggatgggcctttattaaatacgtgctaagcgacaaggaaaaaaaggtcttcggcatcgtaatccccatgcaggtgttggcgaacgtcgcttacattatcatcgaatctcgcgaagaaggggcttctgattacgtactatggaaggaaatcctgttcctagtcgatctgatatgctgtggcgcaattctgttccccgtggtgtggtctattcgacacctccaggatgcttctgggaccgatgggaaggtagcagttaatctggccaagctgaaactgtttaggcattactacgtaatggtcatttgctatgtatacttcaccaggataatcgccattctcctccaggtggctgtgccttttcagtggcagtggctctatcaactgctggtagaaggaagcacactcgcatttttcgttctcacgggatacaagtttcagcccaccggcaacaacccatacctacagctgccccaagaggatgaagaagatgtccagatggaacaagtcatgactgattctgggttccgcgaagggcttagcaaagtgaataagaccgcaagtggaagagagttgctgtag

SEQ ID NO: 50401 - DNA, 2142 bp, Artificial Sequence
  Description of Artificial Sequence: Synthetic coding sequence
atggacatttcaatccagcgtaacggcagcattgtagcaggctacgaagtcgtcggctcctcctcagctagtgaactcctgtccgccatcgaacacgtagctgagaaggctaagacagcattacacaagctctttcccttagaggacggttcttttcgcgtgtttggaaaggctcagtgtaacgatatagtttttgggtttgggagcaaagacgacgagtatacccttccatgctcgagcggctatcggggaaacatcaccgctaagtgcgagtccagtggctggcaggtaatccgcgagacctgcgtgctgagcctactggaggagctgaacaaaaatttcagcatgattgtgggtaatgcaaccgaagctgcagtgagctcattcgtgcagaacctgagcgtgattatcaggcagaatccaagtaccactgttgggaatctggcctccgtggtgagcatcttgtcgaatatcagcagcctgagtctggcgtcccatttccgagtatctaactctacgatggaagatgtcatcagcattgctgataacattctgaactctgcctcagtgacaaattggacagttctgctcagggaggagaaatatgcgtctagtagacttcttgagaccttggagaatatttcaacactggttccgccaacagcacttccactgaacttctcccggaaattcatcgactggaaaggcatcccagttaataagtcgcagctgaagagggggtactcctaccaaatcaagatgtgccctcagaacaccagtatcccaatccgcggaagggtgctgataggatccgaccagttccaacgttccctgcctgaaactattatttccatggcctcactgaccctcggcaacatactgcccgtgagcaagaacggcaacgctcaggtcaacggtcccgtaatctccacagttattcagaattactccattaacgaagtctttctgttcttctcaaaaatcgagtccaatctctcccagccccactgcgtgttctgggatttctcccacctgcagtggaatgacgccggatgccacctcgtcaacgaaacccaagatatcgtgacctgtcagtgcacacatttaaccagttttagcatccttatgtccccttttgtgcctagtaccatatttccagtggtgaaatggattacatacgttgggcttggcatctccattggcagtctaatcttgtgcctgatcatcgaagctcttttctggaaacagattaaaaagtctcaaacatcgcatactagacgtatttgcatggtgaatatcgccctgagcctgttaatcgccgatgtctggttcattgtgggagctactgtggatacaaccgtgaacccaagcggcgtgtgcacggccgcagtgtttttcactcacttcttctatcttagcttgttcttttggatgttaatgttaggtatcctccttgcctacagaattatcttggtatttcaccatatggcccagcacctaatgatggctgttggcttctgcttgggatacggctgtcccctcatcatctcggtgatcacaattgctgtgacacagccttccaatacatacaaacgcaaagatgtctgttggctcaattggtcaaatggatccaagcctctgttggcctttgtggtacccgctctggcgatcgtggctgtgaactttgtcgttgtcctcctggttctcaccaagctgtggagacctaccgtgggcgagcgcttatctcgggacgataaggctacaattattcgggtgggaaaaagtttgctgatcttgacccctctgcttggtctcacctgggggttcggcatcggcaccattgttgactcacaaaatttagcttggcatgtcatttttgccctgcttaacgccttccagggatttttcatcctgtgttttggtatcttactcgacagcaaactgcgccaactgctgtttaataagctgagcgccctaagttcttggaaacagaccgaaaaacagaattctagcgacttgtcagccaagcctaaattctctaagccatttaaccccttacaaaataaaggtcactacgccttcagtcacaccggggattcgtccgataatattatgttgacccagtttgtttcgaacgaatag

SEQ ID NO: 50402 - DNA, 657 bp, Artificial Sequence
  Description of Artificial Sequence: Synthetic coding sequence
atgaaggtgggagtgctgtggttgatttctttctttaccttcactgatgggcatggtggtttcctagggaaaaatgacggcattaagactaagaaagagctaatagtaaacaagaagaaacacctgggcccagtggaagagtatcagttactgctgcaggtgacgtaccgcgacagcaaggaaaagcgtgatctgagaaattttctgaaactcctcaagcctccgctgctttggtcacatggccttatcagaataattagggcaaaggcgactaccgactgtaacagccttaacggagtcctacagtgcacctgtgaagactcatatacctggtttcccccttcctgccttgatccacagaactgttacttgcacaccgctggcgcactgccctcttgtgaatgccacctcaataacctctcgcaatccgtgaatttttgtgagagaacgaagatctggggcaccttcaaaataaacgaacgcttcactaacgaccttcttaattcttcttctgccatatactccaagtatgcaaatggtatcgagatccagctgaagaaggcatatgagcgaatccaggggtttgaatcggttcaggtgacacagtttcggatgagcctactttcacctaagctggagtgtaatggcaccatctag

SEQ ID NO: 50403 - DNA, 1890 bp, Artificial Sequence
  Description of Artificial Sequence: Synthetic coding sequence
atgaaagtaggcgtgctgtggcttatctctttcttcacattcacagacggtcatgggggattcttaggtaagaatgatgggatcaagacaaaaaaagagctgatagtcaacaagaagaaacacctgggacccgtggaggagtaccagctgttgttgcaggtaacgtatcgagattccaaggagaagagagaccttaggaatttcctgaaactcctgaagccccctctgctgtggtcacatggtctgatcagaatcattagggctaaggccactactgattgcaattctctgaatggcgtgcttcagtgtacatgtgaggactcttacacatggtttcctccatcttgcctcgatccgcagaactgttaccttcacacagctggcgctcttcccagctgcgagtgccatctgaataacctgtctcagtcggttaacttttgtgagcgcaccaagatctggggcactttcaaaatcaatgagaggttcacaaatgatctcttgaactcttctagcgcgatttacagcaagtacgcaaatggtatcgaaatacagctcaagaaggcatacgagcggattcaggggtttgagtcggtgcaagttactcagttccgcaacggttctatcgttgccggttatgaagtagtggggtcctcctccgcttccgaactgttatcagctatcgagcacgtggccgaaaaggctaagacagctctgcataagctgtttcctttggaggatggcagcttccgagtgtttgggaaagcacagtgcaatgacatcgttttcggctttggctccaaggatgatgaatatacacttccctgctcttcgggttatcggggtaacattacggctaagtgcgaaagcagtgggtggcaggttattcgggagacatgtgtgctgtcactcttagaagaactgaacaaaaatttctctatgattgtcggaaacgccactgaagcagccgtgtcatcatttgtccagaacttgtctgtgatcatcagacaaaaccctagcactacagtcggcaatctggccagtgtggtgtctattctgtcgaatatcagttccctctccttggcaagtcacttccgcgtgtcaaactccacgatggaggacgtgatctccattgccgataatatacttaattccgcttctgtaacaaattggaccgtcctcctcagggaagagaaatacgcctcgtcgaggctgctggagaccctcgagaacataagtactttggtgccccctaccgcgcttccactcaactttagccgcaagttcatcgattggaaaggaatcccagtaaacaagtcccagctgaaacgagggtactcatatcagatcaagatgtgtccacagaacaccagcattcccatccgcggacgcgtgctgatcggctcagaccagtttcagcgctctctgcctgaaacaataataagtatggcctcccttactctgggaaatatactgccagtgagtaagaatggaaatgcccaggtcaatggcccagtaatttctacagtgattcaaaactattccatcaacgaagttttcctgtttttcagcaagatcgagtccaacctgtcccagccccactgcgttttctgggatttctctcatctgcaatggaatgacgccggttgccacctcgtgaatgagactcaggatattgtaacctgtcagtgtacacacctgacttccttttcaattctgatgtccccatttgtaccatctaccatctttccggtggtgaagtggataacctacgtcggtctgggaatcagcatcgggtcactgatcctttgcctaattatcgaagcgcttttttggaagcagattaagaaaagccagacctctcacactaggcagcggaaaaaaaaacagtag

SEQ ID NO: 50404 - DNA, 2733 bp, Artificial Sequence
  Description of Artificial Sequence: Synthetic coding sequence
atgaaggtcggggtgctgtggctcatttcatttttcacattcacggacggacatggtggttttctgggaaagaacgacgggattaagaccaaaaaagaactcatcgtgaataagaagaaacatctcggcccagtggaggagtaccagctgctgctgcaggttacttaccgggattctaaagagaagagggatcttcggaattttctgaagcttctgaaaccacctctcctgtggagtcatggcctgattagaattatcagagccaaagcaactaccgactgcaactccctcaacggagtgctgcagtgtacctgtgaggattcgtacacgtggtttccacctagttgtttggatccccagaattgctaccttcacaccgctggtgcactcccgtcttgcgaatgccaccttaacaacttgagccagagcgtgaacttctgtgagagaactaaaatctggggcaccttcaaaatcaacgaacgattcactaatgacctgttgaatagtagctctgccatctatagcaagtatgccaatggaatcgagatccaactcaagaaggcctatgaacgaattcaagggttcgaaagtgtgcaagttacacaatttcgcaacggttcgatcgtggccggttacgaagtggtcggatcctccagcgccagcgagctcttgagcgcaattgagcatgtggcagaaaaggcaaagaccgcgctccacaaactctttcccttggaggatggatctttccgcgtgttcggtaaagcccagtgtaatgacatcgtttttggctttggctcaaaggatgatgaatatacactgccctgctcaagtggataccggggaaatatcacagcaaaatgtgaaagctctgggtggcaggtaattcgagaaacttgcgtgctgagtctgctggaagagcttaataagaatttcagcatgatcgtgggaaatgctacagaagcggcagtctccagtttcgtgcaaaatctctccgtgattattcggcaaaatccaagcacaacagtcggcaatctggccagcgttgtatccatcctgtcgaacattagcagtctgtccttggcctctcatttccgtgtctcgaactccaccatggaggacgtcattagtatcgcagacaatatcctaaacagtgcctcagtgacaaactggaccgtactcctgcgagaagagaagtatgcttcctcaaggcttttggagacattagagaatatctctactttagtccctcctaccgcattacctctgaatttttcgcgaaagttcattgattggaagggcattccagttaacaaaagccagttaaagcgaggttacagctatcagattaagatgtgtcctcagaacacctccatacccatacgcggtagagtgttgatcgggtcggatcagtttcagagatctctgcctgaaaccattatctccatggcaagcctcactttgggtaatattctgcctgttagtaagaacgggaacgctcaggtcaatggccctgtgatctcgacggtgatccagaactacagtatcaatgaggtgttcttattcttctctaagattgagtctaatctaagtcagccgcattgtgtattttgggatttcagccacttgcagtggaatgacgctggttgccatcttgtgaatgagacccaggacatagtgacctgccagtgcacgcaccttacctccttttccatcttgatgagccctttcgtgccttcaacaatattcccagttgtcaagtggatcacctatgtgggcctgggaattagcattggatctctgatcctgtgtctgattattgaggcactattctggaaacagattaaaaagagtcagactagccataccaggcgcatctgtatggtgaacatcgctcttagcctgttaatcgcagacgtgtggtttatcgtgggcgctactgtggatactaccgtgaatccgtctggggtgtgtaccgcagccgtgttctttacgcactttttttatctgagtttattcttctggatgttgatgttgggcattcttctggcctacagaattatcctcgtcttccatcacatggcccagcacctgatgatggcagtgggattctgcctgggatatggttgtcccttgatcattagtgtgatcacaattgccgtcacccaaccaagcaatacttataagcggaaagacgtgtgctggctgaactggagtaacggctctaaacccctgcttgcctttgtcgtccccgcattagcgatcgtagcagttaacttcgtggtagtcctgctggtgctgaccaaactctggcgacctactgttggcgaacggctttcacgggatgacaaggcgacaataatccgcgtcgggaaaagtcttctgattctaacacccctattgggcctcacctggggatttgggatcggcaccatagttgactcacagaacctcgcctggcacgtgatattcgcattgctcaacgcttttcagggcttcttcatcttgtgttttgggattctcttagacagcaaattgcgacagttgctgttcaataagctcagcgcacttagttcttggaagcaaacagaaaaacagaatagcagtgatttgagcgccaaaccaaagttcagcaaaccattcaaccctctccagaacaagggccattatgccttttcccacacgggcgattccagcgacaacatcatgctgactcagtttgtatctaatgagtag

SEQ ID NO: 50405 - DNA, 2127 bp, Artificial Sequence
  Description of Artificial Sequence: Synthetic coding sequence
atggggcttacagcctatgggaataggcgtgtacagcctggtgaacttcctttcggggcaaatctgaccttgattcacactcgcgcacagcccgtgatctgttcgaaactccttctgacaaagagggtgagcccaatttcttttttcctgagcaaatttcagaatagttggggagaggatgggtgggtccagcttgaccagttgccctcccccaatgcggtctcatccgaccaggttcactgctccgctgggtgcacacatcggaaatgtggctgggctgccagcaagtctaaagagaaggtgcctgcacgaccccatggcgtgtgtgacggagtgtgtacagattattctcagtgcacacagccttgcccacctgatacccagggtaacatgggattcagctgtcggcagaaaacgtggcacaagattacagacacatgtcagacgttgaatgctctgaatatcttcgaagaggattcacgactggtgcagccttttgaagacaacatcaaaatatcggtgtataccggcaagagtgaaacaattactgacatgcttctgcagaagtgtcctaccgacctgagctgtgtgatccggaacatccagcagagtccttggattccagggaacatcgcagtcatcgtgcagctcctgcacaacatttcaactgccatttggactggcgtggacgaggctaagatgcaatcttattccacgattgcaaaccacatcctaaactcaaaaagtatcagtaattggacctttatccctgataggaactcttcctacattctcctgcacagcgtcaattccttcgccaggaggctgttcatcgacaaacaccctgtggatataagcgacgtgttcatacataccatgggcacgaccatttcaggcgacaacatcggcaagaattttaccttcagcatgcgaattaacgacacatctaatgaagttacgggtagagtactcatttccagggacgaactgagaaaagtcccgtcccccagccaggtaattagtattgcatttcccactataggcgctatattggaagcaagcttactcgagaatgtaactgtgaacggcctcgtcctgtccgccatactgcctaaagagctcaagcgcatctccctcatattcgaaaaaatctccaagtccgaggagaggcggacccagtgcgtgggttggcattccgttgaaaatcggtgggaccaacaggcatgtaagatgattcaagaaaacagccagcaggccgtgtgcaagtgcagaccctccaaactctttacctccttcagtatcctgatgtccccgcacatccttgagtctctgatcctcacctatataacatatgtgggcttaggcattagtatttgctccctgatcctatgtctgagcatcgaagtgttggtctggtcccaagttacaaaaacggagatcacttacctgagacacgtctgtattgtaaatatcgccgctacacttctgatggcggatgtttggtttattgtggcttcttttctgagcggccctatcacgcatcacaagggatgcgtggctgcaacctttttcgttcactttttttatctgtcggtttttttttggatgctggctaaagccctgctgatcctctatggcattatgatagtgtttcatactctgcctaagagtgtcctcgtggcaagcctgtttagcgttgggtatggttgcccactggccattgctgccatcaccgtggcagccaccgagccaggcaagggctacctgcgccctgagatctgttggttgaattgggatatgactaaagcactactcgcctttgtgatcccggcactggctatagtcgtcgttaatctgattaccgttaccctggtgattgtgaagacacagcgagccgctatcggtaacagcatgttccaggaggtccgcgcaatagtcagaattagtaagaatatagctatccttaccccactacttggactcacatggggattcggagtggctacagtcatagacgaccgttctttagcatttcatattatcttttccttgctgaatgccttccaagtcagcccggatgcatccgatcaagtccagtccgagcgaatccacgaggatgtcctttag

SEQ ID NO: 50406 - DNA, 1929 bp, Artificial Sequence
  Description of Artificial Sequence: Synthetic coding sequence
atgacgcacatcctgctactgtactacctcgtttttctgctgcccaccgagtcatgcaggaccttgtatcaggcggcatctaaaagcaaggagaaggttcccgctagaccccacggggtctgcgacggggtctgcaccgattattctcagtgtacacaaccctgtccacccgatacacaaggtaacatgggctttagttgtcggcaaaagacatggcacaaaatcactgatacatgccaaactctgaatgcactaaacatcttcgaagaggactcccggttggtgcagccgtttgaagataacattaaaatctcggtgtatactggcaagtcggagacaatcacggatatgctgcttcagaaatgccccaccgacctcagctgtgtgatccgcaacattcagcagagcccttggatccccggaaatattgcagtgatagtccagcttctgcataatattagcactgccatctggaccggggtcgacgaagcaaagatgcaaagctactccacaattgctaaccatatccttaactctaagtccataagtaattggacattcatacccgataggaacagttcatatatattactccatagtgtgaatagtttcgccaggcgcctcttcattgataaacaccccgttgacatcagcgacgtgtttatccatacgatgggaaccactatcagcggagacaatataggcaagaattttaccttttctatgcgcatcaacgataccagcaacgaggtgacaggacgcgtgctgattagcagagatgagctcagaaaggttcctagcccatcacaggtgatttccatcgcgttccctaccatcggcgctattctggaggccagccttctggagaatgtcacagtgaacgggctggtgttaagtgcaatactgcctaaagaattgaaaaggatcagcctcattttcgaaaagattagcaaatctgaggagagaagaacccaatgtgtgggttggcattcagtggaaaaccgctgggaccaacaggcctgtaagatgatccaggaaaattcgcagcaggctgtatgcaagtgtcggccatcgaagctgttcacttcattttccattctgatgtcaccacatatcctcgagagcctaattctgacatacattacgtacgtaggactagggatcagcatctgctctttgatcctatgcctcagtatcgaggtgctggtgtggtcacaggtgaccaagacagagatcacttaccttaggcatgtgtgcattgttaacatcgcagctacattgctgatggcggatgtctggttcattgtggcctcatttctgagcggacccatcacacaccataagggttgcgtagcagcaacatttttcgtgcattttttctacctatctgtcttcttctggatgcttgcgaaggcactgctaatcttgtatggtatcatgatcgtgttccataccttacctaagtccgtactagttgcgagtctattcagtgtgggctacggatgcccgctggctatagccgctattactgtcgcagctactgaacctggcaagggataccttaggcctgagatttgttggctgaattgggatatgaccaaggctctgctagcttttgtgatcccggcactggccatcgtggttgtgaatttgatcacagttaccctggttattgttaaaactcagagagcggctatcggaaacagtatgtttcaagaggtgagagctatcgtccggatctcaaagaatatcgccattctcacacccctcttgggactgacatggggctttggcgttgccactgtcatcgacgaccgttcactcgcgttccacattattttctccttgctgaacgcctttcagggattctttattctggtatttggtaccattctggatccgaagattcgcgaggcgcttaagggatag

SEQ ID NO: 50407 - DNA, 1929 bp, Artificial Sequence
  Description of Artificial Sequence: Synthetic coding sequence
atgacacatattctactgctatactatctggttttcctcctccccacagagtcttgcaggacactctaccaagccgcaagtaagtccaaagaaaaggtacccgcacgaccccacggcgtgtgcgatggagtctgcacggactattcacagtgcacccaaccctgtccaccggacacacagggcaacatggggtttagttgtaggcagaaaacctggcacaagattacggacacatgccagactctgaatgccttaaacatattcgaagaggacagtaggttggtacagcccttcgaagataatatcaagatcagtgtttacaccggcaagtcggaaaccattaccgacatgctgttgcagaaatgcccaaccgacctgagctgtgtcatccggaatattcagcagtctccttggattccaggaaacattgccgtaattgtgcagctgctgcacaatatcagtacagccatttggacaggagttgatgaagcaaagatgcagagctacagtactatcgccaaccatatactaaattcaaaatctatatccaattggacattcattcccgaccggaactcctcatatattctgctacattctgtaaatagttttgcccgacggctctttattgataagcacccagtcgacattagcgatgttttcattcacactatgggaacaactatcagcggcgataacatcggtaagaatttcacttttagtatgagaattaatgatacttccaatgaagtaactgggagagtgttaatcagccgcgacgagctgcgaaaagtgccttccccatctcaggtgatttcaattgcattccccaccatcggagcgatcctggaggcttcattgcttgaaaatgtcaccgtgaatgggttagtgcttagtgccatattacctaaggaactcaagagaatttctttgatctttgaaaagataagtaagtccgaggaaagacgtacccagtgtgtgggctggcactccgtggaaaatcgttgggatcagcaggcatgcaaaatgatacaggagaacagccagcaggccgtgtgtaaatgccggcctagcaaactgttcacttcattctcaatactgatgagtccccacattctcgaatcattgatcctgacttatattacatacgtgggcctgggaatatcgatatgttccctgatcctgtgtctgagtatcgaagtccttgtctggagccaagtcactaaaacagagattacgtacttgaggcacgtttgcattgtgaacatcgctgccactcttctaatggccgatgtctggttcattgtggctagctttctaagtggccctatcacccatcataaaggctgtgtggccgctactttcttcgtccacttcttctacttgtccgtgttcttttggatgctggccaaggcattgctcatattgtacggcattatgatcgtttttcatacgctaccaaaatctgtgctggttgcatctctgttcagtgtgggatatggatgcccactggccatcgctgcaatcacagtggccgcaaccgagccaggcaaaggctacctgcgtcccgaaatttgttggctaaattgggatatgacgaaggcactcttagcgttcgtgatcccagcactggctatagttgtagtaaacctcataactgttacgcttgtgattgtgaaaactcagagagcagccattggtaactctatgttccaggaggttcgcgctattgtgcggatctctaaaaatatcgctattctgactccccttctggggttgacctggggctttggagtggccactgttattgacgatcggagcctggcattccacataattttcagcctgctaaatgcgttccagggattctttatcttggtgtttggcaccatactggaccctaagatccgtgaggcactgaaaggctag

SEQ ID NO: 50408 - DNA, 8415 bp, Artificial Sequence
  Description of Artificial Sequence: Synthetic coding sequence
atggacgacaactctagatactggatggctttttcttacatcacaaacaatgctttactggggcgagaggacatcgacctaggcctcgctggcgaccatcaacagctgattctgtataggcttggcaagacattctcaatcagacatcacctggcctcttttcagtggcacaccatatgcctcatctgggatggggtgaaagggaaattggagctattcctgaataaggaacggattctggaggtgacggatcagccacataacctgacgccacacggaaccctgttcctgggccatttcctcaagaacgaatcatccgaagtgaagtcaatgatgaggtcctttcccggtagcctgtactactttcagttgtgggaccatatattagaaaacgaagaatttatgaagtgcctcgatggaaatattgtttcgtgggaggaagatgtttggctcgtgaataagatcatccctacagtcgatcgaacccttcggtgctttgtgccagagaatatgaccatccaggaaaagagcactaccgttagtcagcagatcgacatgacaacaccaagccagattaccggtgtgaagcctcagaacacagcacattcttctactctgctgagccagagcatcccaatcttcgccacagattacacaactatctcttactcaaacaccacctcacctccactggaaacaatgaccgcccagaaaattttgaagacactcgtcgacgagaccgctaccttcgccgtggatgtgcttagcacttcaagtgccatatcacttccaactcagtctatctccattgacaacactaccaacagcatgaaaaagacaaaatccccatctagcgagagcactaagacaaccaaaatggtggaagctatggctactgagatctttcagcctccgacaccctccaacttcctttccacttcgcggtttacgaagaactccgtggtttcaactacaagcgctataaaatctcaaagcgcagtgacgaagacgactagtctgtttagcaccattgagtcaacatccatgtctaccactccgtgtcttaaacagaaaagtaccaatacaggcgcattgccaatctccaccgctggccaagagtttatagaatcaacagctgcaggaactgtgccctggtttaccgtggaaaagaccagtcctgcaagcacccacgtgggtacagcatcgtcatttccgccagagccggtgctcatcagtaccgccgctccggtggatagcgtgttcccacgaaatcaaacagcatttcctctcgcaaccaccgacatgaaaattgcctttaccgttcattcccttacactccccacacgcttgatagagaccacccccgctccacgtacagccgagaccgaactgacatcaacaaattttcaggatgttagcctacccagagtggaggacgcaatgtctacatcaatgagcaaggagacctcaagcaaaacattttctttcctcacttcgtttagctttaccggaaccgagtcagtacagaccgtgatcgacgccgaggccacacgcaccgccttaacacctgagattacccttgcctctactgtggctgagactatgctatcctcaaccatcacgggccgagtgtacacccaaaacacaccaaccgccgatgggcacttactgaccctgatgtccacacgttcggcgtccacctcaaaagccccagaaagtggacccacctctaccacggatgaggccgcacacctgttctcttctaacgaaacgatatggacttctaggcctgatcaagcgcttttagcatcaatgaatacaaccactattcttacatttgtaccaaatgaaaattttacaagcgctttccatgaaaacacgacctataccgaatatctttcggccaccacaaatattactccactcaaggcgtccccggagggcaagggtaccaccgccaacgatgcgactaccgccagatacacaactgctgtgtcaaagctgacgtctccatggttcgctaatttttctatagtgtctggaaccacctcgattacaaacatgccagagttcaaactcactaccttgctcctcaaaacaattccgatgtcgaccaaacccgctaatgagcttcccctgacaccacgcgaaaccgtcgtgccaagcgtggatattatttctaccctggcgtgtattcagcctaacttcagcaccgaagagagcgcgtctgagactacacagactgaaatcaacggggctattgtgttcgggggtactacaacgccagtgcccaagtccgccaccacacagcggttgaatgccacggtcactcgcaaagaagccacatcacattacctaatgcggaagtcaaccatcgctgcggtggccgaagtctcgcccttcagcacaatgctcgaagtcactgacgaaagcgcacagagagtcactgcctctgtgactgtcagcagcttccctgacatagaaaagctgagcaccccacttgacaataaaactgccaccacagaagtcagggaatcgtggctgctgactaaacttgtgaagactacaccacgatcttcttataatgagatgacagagatgttcaacttcaaccacacctacgttgcccattggacttccgagacctctgaaggcatttctgcaggcagccccaccagtggaagcacccatattttcggggagccgttgggtgcttccaccactaggatatccgagacttccttctctactaccccaaccgaccgtactgcaacttccctctccgatggaatcctcccaccgcagccaacagcagcccacagctctgcaacacctgtccccgtgacccacatgtttagtctccccgtcaacggatcctccgtggttgcagaggagaccgaggtcacgatgtccgaaccttctactctcgcacgggctttcagtacttccgtgttgagtgatgttagcaacctgagctccactaccatgaccactgctttagtgccaccactcgaccagaccgcctctaccactattgtgattgtcccaacgcacggagatttgatacgcaccacttctgaggccacggtgatctccgtaagaaaaaccagtatggctgtcccctcactgacggagacgcccttccactccctccgattgtccacccctgtaacagccaaagcggaaaccacactgttcagtacttcggtcgacaccgtgacacccagcactcataccctggtatgcagcaaaccaccaccggacaatattcctcccgcatccagtacacatgtcatctcaactaccagtactccagaggcaacccaaccaatctcccaagttgaagaaaccagtacctatgcactgtcgtttccatataccttcagcggcggaggcgtggtggcctccctggcgaccgggaccacggaaacttcagtcgtagatgagactacaccaagccacataagtgcaaacaaactgaccaccagcgttaattctcacatatcatccagcgctacctacagggtacacactccagtatccatccagctcgttacaagtaccagcgttctctcttccgataaggatcagatgactattagcctcggtaaaaccccaaggacgatggaggtgaccgagatgagtcccagcaaaaactcctttatcagctacagcaggggcacgccatcccttgagatgacagacacaggatttccagagacgactaagatttcatcacaccagacccatagcccgtctgaaattccactcggaactccatccgatggaaatctcgcctcttctcccacgtccggctctacacagattacccccacccttaccagttcaaatactgtcggggtgcacattccggagatgtctacaagtctggggaagaccgcactgccgtcccaggctctgaccatcactaccttcctctgtccagagaaagaatccaccagcgccctgccagcctacactccaaggaccgtcgagatgatcgtgaatagcacttatgtgacacacagcgttagctatggacaggatacatcctttgtcgatacaactacaagttccagcacacgcatcagtaaccccatggacattaacactacctttagtcatctgcactcgctccggacccagccggaggtgacgagcgtggctagtttcatcagcgaatctactcagacgttccctgagagcctgtcgttgtctacagccggtctgtacaatgatgggttcacagtgctatcagatagaattacaaccgcgttctccgtccctaacgtccctacaatgctgccgagggagtcatctatggccacatccacacctatttatcagatgagttctctgccagttaacgtgacagcattcacaagtaagaaagtgtccgataccccacccatcgtgatcacgaagagttccaagacgatgcacccgggatgtctaaagtcaccatgtacagctacatctggacctatgtcagagatgtcaagtattcccgtgaataattccgcctttacaccggctactgtatcctctgacacatcgacccgcgtagggctcttctctacgctactctcttcggtgactcccagaaccacaatgactatgcaaacatctaccctggatgtcacccccgtgatatatgcaggcgctacatccaaaaacaaaatggtcagttccgctttcaccaccgagatgattgaggcgccttcccggatcaccccgaccacctttctgagtccaacagagcccaccctacctttcgtgaagaccgtccctactactattatggccggaattgtgacgccattcgtggggacgacagccttttcgcccctctcctccaagtcgacaggagctatctcttcaatcccgaagaccacctttagcccgttccttagcgcaacacagcaaagcagtcaggcggatgaggctacgaccttagggatactaagcggcattacaaacagatccctgtccactgtgaacagcgggactggggtagccctgacggacacatactcccggatcaccgttccagaaaatatgctgagccctactcatgccgatagccttcacacttcttttaacatccaggtctcaccatctctaacaagcttcaaatctgctagtgggccaaccaagaacgtgaagactaccacaaactgttttagctccaatacgagaaagatgaccagcctcctggagaagactagcctcactaattatgccacaagtcttaacacccctgtttcgtaccctccttggactcctagttcggccaccttaccctctctcacctcatttgtctactctccccattcaaccgaggccgagatctccactccgaaaacctcacctcctccaacaagtcaaatggtagaattcccagtgctggggacaaggatgactagctccaacacccagcccttgttaatgacctcctggaacatccctacggccgagggaagtcaattccccattagcacaaccatcaatgtaccaacctcaaatgagatggagacagaaactctgcaccttgttcccggtcccctgtctacgtttactgcttcacagactggattagtgtctaaagatgtgatggccatgagtagtatccccatgtcaggcattttgccaaatcacggtctgtccgagaatcctagcctaagtaccagcctcagggccatcaccagcacactggcagacgtcaagcacacctttgagaaaatgacaacctcagtcacccctgggacaacactgccgtctattctgtccggggcaacaagcggtagcgttatatccaaaagtcccattctcacatggctgcttagttctttacccagcggctccccaccagctactgtgagcaatgcccctcacgtgatgacctcgagcacagtggaagtatccaagagtacctttcttacaagcgacatgatctctgctcatccctttactaatctgaccactctgccctcagcaacgatgtccaccattttgacaaggactatacccacccccactttagggggtatcactactggcttcccaacctccctgcccatgagcataaacgtcacggatgacatagtgtatatctcaactcatcccgaagcttcatcgaggactacaattacggcgaacccgaggactgtgagccatccttccagcttctcccgcaagaccatgtccccatccaccaccgaccacactcttagcgtgggcgcaatgcccttgccttcgtccacaattacctcaagctggaatagaatccccaccgcaagctcccctagtaccctgattatccctaaaccgaccctggattcacttctgaatataatgactacaacaagtacagtcccaggagcttcattcccacttattagtaccggagttacttacccctttacagccactgtctcgagccctatctcttctttttttgagaccacatggctagactctactccctcatttctgagtaccgaagcctcgaccagccccaccgcaactaaatctacagaaccagggaattgtaaggccgacgagacagcttcaaaatataaaggtacatataagtggctgctcaccaacccaaccgaaaccgctcaaacccgttgtatcaaaaatgaggatggtaacgcgactaggttctgttcgattagcattaatactggtaaatcgcagtgggaaaagccgaagtttaagcagtgcaagttgctgcaggagctgcccgacaagattgtcgatctggctaatatcacaataagcgacgaaaacgcagaagacgtcgcagaacatatactgaaccttataaacgaatccccggctctcgggaaagaagagactaagattattgtgagtaagatttcagacatttcacagtgtgacgagattagcatgaacctgacacatgttatgctgcagatcattaacgttgtgttggaaaaacagaataattcggcaagtgatctgcatgaaatttcgaacgaaatcctgaggatcattgaacggacaggtcataaaatggagttctccggccagattgccaatctcacggtagcgggtttggcactggcagtgctgcgaggggaccacaccttcgacggtatggcattctctatccactcctatgaggaggggacggacccagaaaccaagaatgttacgaaggcgttgacgacgtacgtcgtgagcgcctcgatcagcgatgacatgttcatacagaacctggccgatcctgtcgtgattacactgcagcacatagggggaaatcagaattatggacaggtgcactgcgccttttgggacttcgagaataacaatgggctgggaggctggaattctagtggctgcaaggtgaaggagacaaacgtaaactatacgatctgtcagtgtgatcacctgacacactttggtgttctgatggaccttagccggtctactgttgactcagtaaatgaacagatcctggctctgattacttacaccggatgcggcataagcagtatcttcctgggggtcgccgtcgtcacttacattgccttccataagttgcgcaaagattatccagccaagattctgatcaacctgtgtaccgctttattgatgctgaacctcgtgttcctgatcaactcctggttaagctctttccagaaggttggtgtttgcatcacggcagccgtagcactgcactacttccttctggtgtcttttacctggatgggacttgaggcagttcacatgtacctcgctctggtgaaggtattcaatatctacattcccaattacatccttaaattctgcctagttggctgggggattccagctattatggtcgcgatcaccgtgtcagtcaagaaagatctttatgggaccctgagccccacaacccctttctgttggatcaaggatgactctattttctacatttccgtcgtggcgtacttttgccttatctttctgatgaatctgtcaatgttttgcactgttctggtgcagctgaatagtgttaaatcgcagattcagaaaaccaggcgtaaaatgatcttgcatgacttgaagggtactatgtctctgacattccttctaggattgacctggggctttgccttttttgcttgggggccaatgaggaacttcttcctgtacctgttcgccatcttcaatactctgcaagatggctcttccagatgccagattaaggtagggtacaaacaagaaggtctgaaaaagatctttgagcataagctattaactccctctctgaagtcaacagccactagcagcacatttaaatccttgggctctgcccagggcacaccctccgagattagctttcctaatgcacccgagctcagcgccctgcatgtggtggcttctgaacccacaaccggctac

SEQ ID NO: 50409 - DNA, 9242 bp, Artificial Sequence
  Description of Artificial Sequence: Synthetic coding sequence
atgaaagagcacatcatttatcagaagctgtacgggctgatcttaatgagcagcttcattttcttgtctgatactctgtcccttaaagggaagaagctggacttctttgggaggggagatacgtacgtaagcctgatcgacaccatcccggaactgtcaagatttaccgcatgcattgatttggtgtttatggatgacaacagtagatactggatggctttttcctacattaccaataatgcgctgctcggacgtgaagatatagacctggggctagcaggagaccaccaacaattgatcctctacaggcttggcaagaccttctctatccggcaccaccttgccagcttccagtggcataccatctgtctcatttgggacggggtaaaagggaaacttgaactgtttctgaacaaagagcggattctggaggtgacagatcaaccccacaacttgacccctcacggaacactgtttctgggtcacttcctgaaaaacgaaagctctgaggtgaaaagcatgatgcgctcatttccaggaagtctttattattttcagttatgggaccacatcttggaaaatgaggaattcatgaaatgtctggatggcaacatcgttagctgggaggaggacgtgtggctcgtcaacaaaatcattccaactgtagatagaacccttagatgcttcgtacccgagaacatgacaatacaggagaaatctacaactgtatcacagcagatcgacatgaccacaccgtctcagattactggggtgaagccacaaaatactgcccactcgagcactctgctgagccaaagtattcctatcttcgccacagactacacaactatctcttactctaacaccacttcccccccactcgagacaatgacagcccaaaaaatattgaaaacgctggtagacgaaactgctacctttgccgtcgatgttctgtccaccagtagcgccatcagtctgcctactcagtcaatctccatcgataacacaacaaacagcatgaagaaaacgaagtccccatcatcagaatcaacaaagacgacgaaaatggtggaagcaatggcgacggaaatcttccagccaccaacccccagcaattttctttcgaccagtcgtttcaccaagaattctgtagtctccactacttccgccataaagtctcagtctgctgtaacaaaaactacaagcctgttctccaccatcgaaagtacaagcatgtccactaccccctgtctcaaacagaagtctaccaacacaggggctcttccgatttcaactgccggacaggaattcattgagagcacagcagcaggaacggtcccatggttcactgtggagaagacttccccggcatcaacccacgtgggcactgcgagttcttttccgccagaacccgtgctgatctccacagcagcccctgtcgactcagtgttccctagaaatcaaaccgcgttccccctggcgactaccgatatgaagattgcctttaccgtgcacagcttgacactgccaacacgactgatcgaaaccactcccgcaccacgcacggcagagacggaattgacatcaactaacttccaggatgtgtctctcccacgggtggaagacgcaatgtctacgagtatgagcaaagagacatcatctaagacgtttagttttctgactagctttagtttcacaggaacggaatctgtccagacagtgatagatgccgaggcaaccagaaccgctctgacccctgaaattaccctcgccagtactgttgcggagaccatgctgtcttctacgattaccggcagggtgtatacacagaatacacctaccgcggacggtcatttactgaccctgatgagcaccaggtccgcatccacatcgaaggctccagaaagcgggcctacctccacaaccgatgaagccgctcacttgttcagcagtaacgaaaccatctggacctccagaccagaccaggccctgctggccagtatgaacaccacaactattctcaccttcgttccgaacgagaactttactagcgcctttcatgagaacaccacctacacagagtatttatctgcgaccacaaatatcacgcccctcaaagcttctcccgaaggtaagggcaccaccgccaacgatgcgacaacagctcggtatactacagcagtatctaaattaacctcaccctggtttgcaaacttcagcattgtgagcgggacgacctcaattaccaatatgccagagtttaaattgaccacactcttacttaaaacaatccctatgtcgacgaaacctgcaaacgagctgcccctaaccccgagggagactgtggtcccgtctgtagatatcatcagtacgctcgcctgcatccaaccaaattttagtacagaagaaagcgcctctgaaactacccagacggagatcaatggggcaatcgtgttcggaggcaccactacccccgtgcctaagagcgctaccacccagcgactaaacgctaccgttacgcggaaggaggcaacaagccactaccttatgcgcaagtctaccattgcagcggtcgccgaggtgtccccctttagcacaatgcttgaggtgactgacgaatctgcacagagagttaccgcaagcgtgacagttagcagctttccggatatagagaagctttctacgcctctagacaacaaaaccgctaccacagaggtccgcgagagctggttgttgaccaagttggtcaagaccacccccaggtcctcttataacgagatgacggagatgtttaacttcaatcacacatacgtggcccattggacctctgagactagtgagggcatttcagcagggagcccaacatccggctccacccacatattcggcgaacccctgggtgcttctaccacaagaatttctgaaacttcattcagtaccacccctacggataggacagcaacctctctgagcgacggtatcttgcccccacaaccaaccgccgctcactcatccgccactccagttccagtgactcacatgttctcacttccggtgaatggctcttctgttgtggccgaagagactgaggtaactatgtcagagccttcaactcttgcccgtgctttctctactagtgtgctcagcgatgtgtcaaatctgtcaagcacaactatgactacagcgctggtgcctcctctggaccagactgcctctacaaccattgtaatagtgcctacccacggcgaccttatcaggacaactagcgaggccaccgttatcagtgttcgcaaaacaagtatggccgtccccagcctgacggagacccctttccacagtcttcgccttagtacccccgtgacggcaaaggcagagaccaccctgttctctacttctgtcgatacagtcaccccaagcacacataccctggtctgttcaaagccgccacccgacaatattcccccagcttcgtcaactcacgtgatctctaccaccagcacccccgaggctacacagccaattagtcaggtagaggagacaagtacatatgccctgtcgtttccatacaccttctctggcggtggcgtggtggctagcctggcgactggaactacggaaaccagcgtcgtcgatgaaactacacctagtcacatttccgctaacaagctcactacttccgtcaacagccacattagctcgtcggcgacttacagggtgcatacacccgtctcaatacaactggtcactagtaccagcgtgctgtccagcgataaagatcagatgactatctctctcggaaagactcctaggacaatggaggttaccgagatgagtcctagtaaaaatagcttcatctcctacagccgtgggactccaagcctcgagatgacggacacaggatttccagaaacaacaaagatctcctcacaccaaacccacagcccatctgagattcctcttgggactcccagcgacgggaatctggcgtcctccccaacaagtggttcaacgcaaatcacccccaccttaacctcctcaaacacagtgggagtgcacatcccagaaatgagcacctccctgggtaaaactgccttgccctctcaggccctgaccatcactacgttcctttgtcccgaaaaggaatctacctcggcgttgcccgcatacactcctcggacagtcgagatgatagtgaattcaacctacgtcacacactccgtctcttacggtcaggatacatctttcgtggacacaacaacctcaagctcgacccgcattagtaacccaatggacattaatacaactttctctcacctgcattctctccgtacacagcccgaagtgacttccgtcgccagttttatctcagaatctactcaaacttttcctgaatcgctgtccctgtccacggcaggactgtacaatgatggttttacagtcctgagtgaccggataacaactgccttcagcgtgcccaatgtgcccaccatgctgcctcgggaaagtagcatggcaactagtacccccatctatcagatgagttctctgcctgtgaatgtgacagcgtttacgtctaagaaggtcagcgatacacccccaatcgtgatcacgaagtcctctaaaacaatgcacccaggatgtctgaaatccccttgtaccgcaacctcaggcccaatgagcgagatgtcttccattcctgtgaacaacagtgcattcaccccagcaacagtatcatcagacacgagtacccgcgtgggtcttttctccactctcttatcaagcgtcacaccccgtaccactatgacaatgcaaaccagtacacttgatgtcacccccgttatttacgctggcgcaacctccaagaacaagatggtaagctcagcgttcacaaccgagatgatcgaggcgccatcccggataacccccacaacatttctgtcaccaacagaaccaaccttacctttcgtcaaaacggtacctactacaatcatggctggcatcgtgactcccttcgtcggcaccacggccttctctcctttgagcagcaagtcaaccggagcaatatcctcaatcccaaagaccacatttagccctttcctttctgcaacccagcagtctagccaggccgacgaggcgacaacactgggcatacttagcgggatcaccaatcggagcctgagcactgtcaactcagggaccggagtagcgctcaccgacacatacagtaggatcactgttcccgagaacatgctcagccccactcacgccgattccttgcacacctcatttaacatccaggtttccccatccctcacttccttcaagagcgcttctggacccacaaaaaatgtgaagaccaccactaactgtttctcctcaaacaccagaaaaatgacgtctctcttagaaaaaacctctctcactaattacgctacctctctaaatactccggtcagctaccctccatggaccccatcttcagccaccctcccctctctgacaagtttcgtgtactccccccacagcactgaggccgaaatttccacacctaaaacaagtcccccacccacaagtcagatggtcgagtttcccgttctaggtacaaggatgacttctagtaatacccagccactgttaatgacttcgtggaacatacctactgctgaaggatctcagtttcctatcagcactacaataaacgttcctacaagtaacgagatggaaacggaaaccctacacttagtacctggccctctttccacattcaccgcgtcgcagactgggttagtaagcaaggacgtaatggctatgtcatctatcccaatgtctggcattttaccaaatcacggactttcagagaatccttccctgtccacaagcctgcgggctataacttctaccctcgcggacgttaagcacaccttcgagaaaatgactacctcggtaacacccggaactactctcccctctatcttgtctggcgcaacctcaggctccgtgatatcgaagtcccctatcctgacttggcttctgtcctctctgccaagtgggagtccccctgccaccgtgtctaatgctccgcacgtgatgacctccagcactgtcgaggtttcaaaaagcacttttctcacctccgacatgatttcagcccaccccttcaccaatctgactactctaccttcggcgactatgtcaactatcttgacgcgcacaatcccgacacccacactgggaggcattactaccggattccccacatccctgcccatgtctatcaacgtcaccgatgacatcgtgtacatctctacacacccggaagcctcgtctcgcacaacaataacggcgaacccgagaacagtaagccacccctccagtttttcccgcaaaaccatgagcccttctaccaccgatcatacattatcagtgggcgctatgccattacctagctcaacgataacttcttcgtggaaccgcatccccactgctagctcccccagcacacttatcattcctaaacccacactggactccttgctgaacatcatgacaactacttcaaccgttccaggagcgtctttcccactgatcagtacaggggtaacatacccctttacggcaacagtgagctcacccatttcatcctttttcgagacgacctggctcgactccacccctagctttctgtctactgaagcatcgacatcaccgacagccacgaaatcaacagtgtcattctataacgtcgaaatgtccttttcagtgtttgtggaagagcctaggatccctattacatccgtgatcaacgagttcacagaaaacagcctgaactcgatctttcaaaatagcgaattcagcttggccacactcgagactcagatcaagtctcgcgacatctcagaggaggagatggttatggatcgagctattctcgaacaaagagaagggcaggaaatggctaccattagctatgtgccttattcttgcgtttgtcaagttattattaaggcctcctcctcactcgcatctagcgagctaatgcgaaagataaagtcgaagatacatggtaacttcacccacggcaacttcactcaagaccagctgacattacttgtcaactgtgaacatgtcgccgttaaaaaactcgaacctggcaactgcaaagctgatgaaaccgcctcaaaatacaagggaacctataagtggctactgacaaatcccactgaaacggcacagacccgttgtattaaaaacgaggatggtaacgcaacacggttctgctctatttcgattaacactggaaaatcccagtgggagaagccgaaattcaagcagtgcaagctgctccaggagctgccggacaagattgtcgacctagctaacattactatctccgacgagaacgccgaggacgtagccgaacatatccttaacttaataaatgagtcccccgctctgggaaaggaagaaaccaagattatcgtatcaaagattagcgacatatcccaatgtgacgagatctcgatgaaccttactcacgtgatgttgcaaatcattaacgtggtcttggagaaacagaacaactcagctagcgacctgcatgaaatctctaatgagatattgagaattatcgaacgcactgggcataagatggaattttctggacagatcgcaaatctgaccgtggcgggtctcgctctggccgttctgcgcggagaccatacgttcgacggtatggcatttagcattcattcctacgaggagggaactgatcctgaaatttttctgggcaacgtgccggtggggggtatcctggcctccatctacctgccgaaaagtctcacagaacgcatccccctcagcaacctgcaaaccatactgttcaatttttttgggcagaccagtctgttcaaaaccaagaacgtcacgaaggccctgactacatacgttgtcagcgcatctatcagcgacgacatgtttatacaaaatttagccgaccctgttgtgattaccctgcaacatataggtggcaaccagaattacggacaggttcactgtgctttttgggattttgagaataacaacggactcggcggttggaactcatcaggatgcaaggtgaaggagacaaacgtgaattacacgatctgtcagtgcgatcacctcacccatttcggtgtactcatggatctgtctcggtcaaccgtggactccgttaatgagcagattttggcgctgattacttatactggatgcgggatttccagcatcttcctaggcgtcgcggtagtcacttacatagcatttcacaagctgcgaaaggactaccctgccaaaatcctcattaatctgtgcacagcactactgatgttgaacctggtatttttaataaacagctggctcagctcctttcagaaagtgggggtgtgtatcacagcggctgtcgctctgcattactttttacttgtgagctttacctggatgggtcttgaagcagtgcacatgtacctcgctcttgtgaaagtttttaacatttacatccccaactatatccttaagttctgtctggtggggtggggaatacctgccatcatggtggccatcactgtatcagtcaagaaagatttgtacggcaccctcagccccacaacaccattttgttggatcaaggacgactctattttctatatcagcgtggtggcctatttctgtttaattttcctgatgaacttatccatgttttgtaccgtgctcgtccagctcaactcagtcaagtcgcagatccagaaaacccgcaggaaaatgatcctccatgacctcaaggggacaatgtccttaacttttttattgggtctgacctggggcttcgcgttcttcgcctggggacctatgcggaatttttttttatacctttttgccatatttaatacactacagggcttttttatctttgtctttcactgcgtcatgaaagagtcggtgcgggaacagtggcaaatccacttgtgttgcggatggctgaggttggacaatagctcagatggtagttcccggtgtcagataaaagtgggctacaaacaggaaggactgaagaaaatttttgagcataagctcctaacgccatctttgaagtcgacagcaacctcctctacattcaaatccctcggctctgcccagggaacaccatctgagatctccttccctaatgatgacttcgacaaggacccttattgtagctctccgta

SEQ ID NO: 50410 - DNA, 9242 bp, Artificial Sequence
  Description of Artificial Sequence: Synthetic coding sequence
atgaaagagcatattatttaccaaaagctctacgggctgattctaatgagttctttcatattcctctccgacacacttagcctcaagggaaaaaagctggatttttttggaagaggtgacacttatgtgtccttgatcgacacaatacctgagctgagtcggttcacggcctgtatcgacctcgtattcatggacgacaatagccgatattggatggcattcagctacatcaccaataacgcattactcggaagggaagacatcgatctggggctggccggagaccaccagcaactaattttatacagactgggcaagacattctctataagacaccacctggcatcctttcagtggcatacgatctgcttgatatgggatggcgttaagggaaagttggaactcttcctaaataaggagagaatcctcgaggtgaccgaccagccacataatctgacaccccacggcaccctctttctcggacacttcctgaaaaatgagtcctctgaagtaaaaagcatgatgagaagctttccgggaagcctatactacttccagctctgggatcatattctcgagaacgaagagttcatgaagtgtctggacggcaatatagtgtcatgggaggaagacgtctggttggtgaataaaatcatacctactgtggacaggacactccggtgttttgttcccgagaatatgacaattcaggagaaaagcaccaccgtcagtcagcagatagacatgaccaccccgtcccagatcacaggagtgaagcctcagaatacagcgcacagttctacactcctctcccaaagtattccaatattcgccacagactacacaaccattagctatagcaatactacatcacctcccctggaaaccatgacggcccagaagatcctcaaaaccctggttgatgagactgctacctttgccgtcgacgtgttatccacttcctctgccatttccctgccaacacagagcattagtatcgataacactactaattctatgaaaaaaaccaagtccccttcctcggaaagtaccaagacaactaaaatggtcgaagcgatggctaccgaaatcttccagcccccaactccaagcaactttttgtcaacctccagatttacaaagaacagcgttgtctctacaacctcagcgattaagtcccaaagcgccgtgaccaagactactagccttttcagcacaattgaaagtacttccatgtcaactactccgtgcttgaaacagaaatccacgaacaccggcgcactccccatctcaaccgccggacaggaatttattgaaagtaccgccgctggtacagtcccttggtttactgtcgagaagacctcccccgcttctacacacgtgggaacagcctctagcttccctcctgagcccgtgctgattagcaccgcagctcctgtggattccgtttttccccgaaatcagaccgctttccctttggctacgacggacatgaaaatcgccttcaccgtccacagtctcaccttaccgaccaggctgatcgagaccactccagctccccgaacagccgaaactgaactcaccagcacgaattttcaggatgtaagcctgcccagggtggaggacgctatgtctaccagtatgtccaaggagacatcgtctaagaccttttctttcctgacctctttttcattcaccgggaccgaatcagtgcagaccgttatcgacgctgaggccacacggaccgctctaacccctgaaattaccttggcttccactgttgccgagacaatgttatcctcaactattacaggcagggtgtatactcagaatactcccaccgcagatggccacctgctgacccttatgagcacgcgaagcgcgagcacaagcaaagctccagagagtggcccaacaagcacaaccgatgaggctgcccacttgttctcgtcaaatgagactatatggaccagcaggccagatcaggcgctcctggccagcatgaataccaccaccatactaacgtttgtcccaaacgagaacttcacgtcagcctttcacgagaatacaacctataccgaatatctgagcgcaacgacgaatatcacccccctcaaagcgagtccagaaggaaagggcaccacagcaaacgacgcgactaccgcaaggtacactacagccgtgagcaaactcacatccccctggtttgcaaacttcagcatcgtatcggggaccacaagcatcactaacatgcctgagtttaaattgacgacactgttgctgaagactattcccatgtcaaccaagcctgccaacgagctgcccctcacaccacgcgagacagtcgtgccaagtgttgatatcattagtaccctggcatgtattcagcccaatttctcgaccgaggaatcagccagcgaaacaacacagacagaaattaatggtgcaattgttttcgggggtacgacgacacccgtcccaaagagtgccacaacgcagcgcctcaatgcgactgtcacacgcaaagaagcaacctcccactatctgatgaggaagtccactattgccgcagtcgcagaagtttcacccttctctaccatgctcgaagttactgacgagagcgcccagcgcgtcacagccagcgtgacagtttctagttttcccgatattgagaagttaagtacaccgttggacaataaaacagcaacaacggaggtgcgggaatcatggcttctcacaaagcttgtgaaaacaacaccgcgatcaagctacaacgaaatgaccgaaatgtttaacttcaaccatacatatgtcgctcactggacttctgaaacctcagagggcatctcagcaggtagtcctacaagtggatctacacatattttcggcgagccacttggggcatcgaccaccagaatctcagagacttccttttccaccactccaaccgacagaacagccacatcactgagcgatggcattcttccaccccagcccaccgcagcacattcttcagccacccctgtccctgtcacacacatgttctccctccctgtaaacggatcctccgtcgttgcagaggaaaccgaagtgaccatgagcgagccctccaccttggccagggctttcagcaccagcgtgttgtctgacgtgtcaaacctttcaagtaccaccatgacgaccgctctagtgccccctcttgatcagacagcttcaactaccatcgtcattgtgcctacccacggagacctgattcgcactacaagcgaggcaacagtgatttcagttcggaagacatccatggccgtgccaagcctgactgaaacaccctttcactccctgagactatcaacacccgtgacagcaaaggcggagacaacattgttcagtacaagcgtggacaccgttaccccatctacgcacaccctggtctgttctaagccacctccagataatatcccccctgcaagtagtacccacgtgatttccaccacgtctacaccagaggccacacagcctattagccaagttgaagaaacttccacctatgccctatctttcccctacacatttagcggaggaggcgtcgtcgcctcgctcgccaccggcactactgaaacgagtgtagtggatgagactacccctagtcatatctccgctaataaactgacaactagcgtgaattcccacatttcaagcagcgccacgtaccgcgtccacactccagtgagtatccagctcgtcacgagcacaagtgtactgagctctgacaaagaccagatgacaattagcctcggaaagacccccaggaccatggaagtgactgagatgagtccttccaaaaactcattcattagttattcgcgtggcaccccatccttagaaatgactgatactggattccccgaaaccaccaagatttcatcacaccagactcattccccctcagaaataccactgggcacgccaagcgacggcaacctcgccagtagccctacctccgggagtacccagatcacacccactctcacctctagcaatactgtcggagtgcacattccggagatgtctacctctctcggcaagacagctctgccaagtcaggcgcttaccatcacaacttttctttgtccagagaaagaaagcacttctgccctgcccgcttatacccccaggactgtggagatgattgtgaatagcacctatgttactcactcggtgagttacggacaggatacgtccttcgtggatacaacaacctcttcatcgaccagaatttccaaccccatggacataaataccaccttctcccatctacacagcctgaggactcagcccgaggtcacaagcgtggcctcttttatctcggagtccactcaaaccttccctgagagtctatctctgtccactgctggactatacaacgatggcttcacagtgctcagtgatcggattacaactgcttttagcgtgcccaatgtgcccacaatgctgccaagggaaagcagcatggcaacctccacgcccatctatcagatgtcatcactgccagttaacgtgactgctttcacctcaaagaaagtttcagatacccctcctatagtgatcacaaagagctctaagacaatgcacccgggatgtctcaagagtccctgcacagccacttcaggcccaatgagcgagatgtccagcattcccgtcaacaactctgccttcactcctgccactgtgtccagtgacacttccacgcgtgtaggactgttttccaccctgctctcatccgtgacacctaggacaacaatgaccatgcagactagcaccctggacgtaactcctgtcatctacgccggagcaacctcaaagaataaaatggtgtcctctgccttcaccacagaaatgatcgaggccccatcgaggatcacaccgactacatttctgagccccactgagccaacactaccattcgtgaaaacagtgcccaccaccataatggccggaatcgttactccgttcgtggggaccaccgccttctctcctctatctagcaagtccactggcgctatcagcagtatacccaagactaccttctccccatttctttccgcaactcaacagagtagccaggccgatgaagcgaccacgctgggtatactctccggcataacgaatcgttcactcagcactgtcaactccggcacaggcgtggccctgaccgatacatattccagaatcaccgtgcccgagaacatgttgtcacctacccacgctgatagcttgcatacctctttcaacattcaagtctctccctcacttaccagttttaagagcgcttcgggcccaaccaaaaatgtgaaaactactactaattgcttctctagcaacaccaggaagatgactagcctgttggagaagacatctctgaccaattatgctacttctctcaacacacccgtgtcctacccaccctggaccccgtcgtctgctactctgccctctctcactagctttgtatatagcccgcactcgaccgaggcggagatatcgacaccaaaaacatcacccccacctacgagccagatggtggagtttccagtcttgggtacccggatgaccagttcgaacacacaaccgctgctcatgacatcctggaatattcctaccgccgaaggctctcagttccctatctccaccacaattaatgtccctacctcaaacgagatggaaactgagactctccaccttgttcctggcccactgagcaccttcacggcttcccaaacaggactagtctccaaagatgttatggcaatgtcgtctatcccgatgtctggcatcttacccaatcacggtctgagtgagaatccatccctgtccacttccctgagagctatcacatctacccttgcggacgttaagcacacatttgaaaaaatgactacgtcagtcactccagggactaccttacccagcatactgtctggagctactagcgggtccgtcatttcaaaaagtccaatactgacatggctcctgagctcccttcctagtggctcaccgcctgccaccgtgagtaatgccccacacgtcatgacgtcgagcactgtggaagtctctaaatcaacgttcctgacttcggacatgatttctgcacacccatttaccaacctcaccacccttccatcagcgaccatgtcgactatacttacccgaaccattcccaccccaaccttgggcggaatcacaaccggctttccaacctctctgccaatgtcaataaacgtcaccgacgacatcgtatatatttctacgcaccctgaagcgtcttctcggactactattacagccaatccaagaaccgtctcacacccttcttccttctctagaaagaccatgtctccctccaccaccgatcatactctgtccgtgggtgccatgcccttgccctctagcaccattacaagttcctggaacaggatcccaaccgccagttcaccttctacactgatcatacctaaaccaactcttgactccctcttgaacatcatgaccaccacgtcaaccgtacccggtgcctctttcccactgatttcgactggggtgacctaccccttcacagcaaccgtgtccagccccatcagttcctttttcgaaacaacatggctagactctactcctagctttctctccaccgaggcaagcacctcacctactgcgactaagtcgacggtgtcattctataacgtggagatgtcttttagcgtgtttgtcgaggaaccacggatcccaattacgagcgtgatcaacgaatttactgaaaactccctcaattctatttttcaaaatagtgagttcagtctggccacactggagacgcagatcaagagccgggacattagtgaggaggagatggtcatggaccgtgctatcctggagcagcgagaaggtcaggaaatggcaaccatctcctatgttccttactcgtgtgtgtgccaggtgattatcaaggcctcctcgtcactggcatccagtgagctgatgaggaagatcaagtctaagattcacggtaatttcacccacgggaactttacacaagatcaactgactttgctagttaactgcgagcacgttgccgtcaaaaaactggagccaggtaattgtaaggcagacgaaactgcctctaagtataaggggacctataagtggctccttaccaatcccaccgaaaccgcacagactcgctgcatcaaaaacgaggacgggaatgccactcgattctgttctatttctatcaacacaggaaagagccaatgggaaaaaccaaagtttaaacagtgtaagctgcttcaggagctccccgataagatcgtcgaccttgctaacatcacaatttccgatgagaacgccgaagatgttgcggagcacatcctgaacctcattaacgaatcccccgcattggggaaggaggagactaagatcatagtaagcaagatttctgacattagccagtgtgacgaaatctctatgaatcttacacatgtcatgctccagataatcaatgtggtcctggaaaagcagaacaactctgcttccgacctccatgaaatctccaacgagatcctgcgcatcattgaacgcactgggcacaaaatggagttttcaggccagatagcaaacctcaccgtggccggactagcccttgcagtgctaaggggagatcacacttttgacgggatggctttcagcattcacagctacgaggaaggtactgatccggaaatttttctgggaaatgttcccgttgggggaattctcgcatcaatctacttacctaaaagtctgacagaacgaattcctttgagcaacctgcagaccattctgtttaatttcttcggccaaacctcacttttcaaaacaaaaaacgtgacaaaggccctcacgacatacgtggtatcagcatccatctccgatgacatgtttattcaaaaccttgcagaccccgtggtgatcacactccagcacatagggggtaaccagaattacggccaggtgcactgcgctttttgggactttgagaacaataacggcttaggcggatggaactctagcggatgtaaggtgaaggagacaaatgttaattatactatctgccagtgcgaccacctgacccacttcggcgtcctgatggacctgagtcgatccacggttgattctgtgaacgagcaaatccttgccctcatcacttataccgggtgtggcatcagttccatcttcctaggcgtggcagtcgtgacctacattgccttccataagttgcggaaagattatcccgcaaaaattcttatcaatctgtgcactgctttactcatgttaaatttggtctttttgataaactcctggctgtcatcatttcagaaagtgggcgtgtgtatcactgctgccgtagccctccactatttcctattggtctctttcacatggatgggcctggaggccgttcatatgtacctggccttagtgaaggtgttcaatatttatattccaaattacatcctgaagttttgcctcgtcgggtgggggattcccgcaattatggtcgccatcactgtcagtgttaagaaagatctctacgggaccctgtcaccgacaaccccattttgctggatcaaagatgactcaatattctatatcagcgtggttgcatatttctgcctgatttttctcatgaatttaagtatgttctgcacggtgcttgtgcagctgaactctgtgaagagccagatacagaaaacacgcaggaagatgatccttcatgacctcaagggaacaatgtccctaacttttttattaggtctcacttggggattcgcttttttcgcatggggtccgatgagaaacttcttcctgtatctgtttgccattttcaacacactgcaaggcttcttcatcttcgttttccactgcgttatgaaggaatctgtcagagagcaatggcagattcacctgtgttgtggctggcttaggctggataattccagtgacggctcatcccggtgccagatcaaagtcgggtacaaacaggaaggcctgaagaaaattttcgagcataagctgctgacaccatctctgaagtcaacagcaacatcttcgacctttaagtcgctgggatctgcacagggtacaccttcagagataagcttccccaatgatgattttgataaggacccgtactgcagcagtccata

SEQ ID NO: 50411 - DNA, 8627 bp, Artificial Sequence
  Description of Artificial Sequence: Synthetic coding sequence
atgaaggagcacatcatttaccagaaactgtacggactgatcctgatgtcttccttcatcttcctctccgtggtaccggagaatatgaccatacaggagaagtccactacagtgtcccagcagatcgacatgaccacgccctcccaaatcaccggcgtaaagccacaaaacacagctcattcatccacacttttgagccagtccattcctatttttgcaacagactatacgaccatttcatactcgaacacgacgagcccgcctcttgagactatgacagctcagaagattctgaagacactggtcgatgagacggcaacttttgccgtggatgttctgagcacctccagcgcaattagccttcccactcagagcatcagcattgataatactacgaactcgatgaaaaaaaccaagtccccctcttcagagtctacaaagactactaagatggtcgaggcgatggcgactgagatcttccagccgccaaccccttcaaattttctttcgacgtcacgtttcaccaaaaactctgtcgtgtccacaactagcgctatcaagagccagtccgcagtcacaaagaccacctcgctgtttagcactattgaaagtacatcgatgagcaccacaccatgtctcaaacagaagtccacaaacactggagcactgccaatctctacagccggacaggaattcattgagtccaccgcagccggaacagtcccgtggtttacagtggagaagacctcgccagcctctacgcacgtgggtaccgcctcatcttttcccccagaacccgtgctgatatcaacggcggctccggttgactcagtatttcctagaaatcagacagctttccccctagccactacagacatgaagattgcattcactgttcactctttaactttaccaacacggctcatcgagacaacccctgctcctcggacggccgagacagagctgacatcaacaaactttcaggatgtctcactacctcgcgtggaggacgccatgagtacctccatgagtaaagagactagttcaaagaccttttcctttcttacctccttttccttcacaggtaccgagtccgtgcaaactgttatagacgcagaagccactcggaccgccctgacccctgagatcaccctggctagcacggtggccgagactatgcttagtagtaccataacaggaagggtgtatactcagaatacacccaccgctgatggccatctgctgacactgatgagcaccaggagcgccagtactagcaaagctccagagtccggaccaacttctaccacagatgaggcagcccacctgttttcctctaatgagacaatttggacttcacggccagaccaagcattactggcctcaatgaatactaccacaattctgactttcgtcccaaacgaaaatttcacttccgctttccatgagaacactacctatactgagtaccttagtgctacaacaaacattacaccgctgaaggccagcccggaagggaaaggaacaaccgctaacgatgctactaccgccagatataccaccgccgtgtcaaagttgacctcaccttggtttgcgaactttagcatcgtttccggtacaaccagcattacgaacatgccggaattcaagctgactacactgcttctgaaaacaatcccaatgagcacgaaacctgcaaatgagctgccgctgacccccagggaaacagtagtcccctctgtggatatcatatctactctggcttgcattcagcccaacttctccactgaggagtctgcttctgaaaccacccagacagaaattaatggcgctattgtatttggagggaccacaacacccgtgcctaagagcgcgacaactcaacgattgaatgccacagtcacccgtaaggaggccacatctcattacctgatgagaaaaagcaccattgccgcagttgccgaggtgtcaccttttagcacaatgctagaagttactgacgagtccgctcagagggtgaccgcttctgtcaccgtgtcatcctttcctgatatagagaaactgagtacccctctggacaataagacagcaaccactgaagtgagggagagctggctattgaccaaattagtgaagactacacctcgctcttcctacaatgaaatgaccgaaatgtttaatttcaatcacacttacgtggcgcattggaccagcgagacctccgagggcatttcggcaggaagcccgacaagcggatcgacccacatctttggagaacccttgggggcttccacaacacgcatcagcgagaccagtttttctactaccccaacagaccgcaccgcaactagtttgtctgatggcatccttcctcctcaacctacagctgcccattcttccgcaactcccgtgccggtcacccatatgttttccctgcctgttaacggtagtagtgtcgtggccgaggagactgaggtcaccatgagtgagcctagtacacttgctagagcattttccacatcagtgctctcagatgtttctaatctgagttctactaccatgaccaccgccctagtgcctccactagatcagaccgcatctacaaccattgtcatcgtccctactcatggcgatctgatccgaacaactagtgaagccaccgttatctccgtaagaaagacgagcatggccgtccccagtctgacagagacacccttccatagccttagattgtccaccccagttacggccaaggcggagactaccctgttctccacttcagtagacacagttaccccaagtacacatacgctcgtgtgttctaagcctccccctgacaacatccctccagcctcctccactcacgtgatcagcaccacatctactcccgaggccacacaacccatttcccaggtcgaggagacatccacttatgccctctcctttccttatactttcagcggcggtggggttgttgcttcacttgccaccggtacaacggaaactagtgtcgtggatgaaactacaccgtcccatatttccgcaaacaagctcaccacgagcgtgaactcccacatcagctcctctgctacatatagggtgcatacccctgtgtccatccaactcgtaacatctactagtgtgctgagctcagacaaagaccaaatgacgatctctctgggcaagacgcctcgaactatggaagtgaccgaaatgtctccctcaaaaaactcttttataagctacagtagaggaaccccctcactggaaatgaccgacacaggtttcccagagacgactaaaatctcttcccaccagactcattcccccagcgaaattccacttgggactccaagtgacggcaatctggcttccagcccgactagcgggagtacacagataacgccaaccctgacaagttccaacacagttggagtgcacatcccggaaatgtcaacatccttgggcaaaacagccctaccgtctcaggccctcaccatcaccaccttcctgtgccccgagaaggagagtacttctgcactgcccgcatacaccccacgcaccgtggagatgatcgtaaattcaacatacgtgacacactccgtctcgtatggacaggacacatccttcgtggatacaaccactagttccagtactaggatttccaatcccatggacataaacaccaccttctcgcacctacactctctgcgtacacagcctgaggttaccagcgtcgcttcattcatttcagagagtacacagacgtttcccgagtccctctcactgtccacagcaggcctttataacgacggatttaccgtgttgtccgaccgcatcactacagcgttttccgttccgaacgtccccaccatgcttcctagagaatccagcatggctacttctaccccaatctaccagatgtcctcgctcccagtgaacgtaaccgcttttacgagcaaaaaggtctcagataccccgcctatcgtgattacgaaatcaagtaagaccatgcaccctggatgcctgaaaagcccatgcaccgcgacctctggcccaatgagtgagatgtctagcatccctgttaataattctgcctttaccccagcaaccgtgagctcagacacatctacgcgcgtgggtctgtttagcactctcctcagttcagtcacccctcgcaccacgatgactatgcagactagcaccctcgacgtgacaccagtgatttatgccggtgccacctcgaaaaataaaatggtgagcagcgctttcactacagagatgatcgaggcgcctagccgtatcacccccaccacgtttctgagccccaccgagcctacactgccctttgttaaaactgtccccacaaccattatggccggaattgtcacccccttcgtcggaacgaccgcttttagccccctgtcaagcaagtccaccggagctatatcaagcatccctaagactaccttttcccctttcttatctgctacacagcagagtagccaggcagacgaggccactaccctgggtatcctgtccgggatcaccaatcgttcactatctacggtcaactcaggaaccggggtagccttaaccgacacatattcacgcattaccgttcccgaaaatatgcttagccccacacacgccgactcactgcatacatccttcaacatccaggtgtccccctctttaacctcatttaagagtgcctccgggccaactaagaatgtgaagaccacgacaaactgctttagctcaaatacacggaaaatgacaagcttgctggagaagacatcgctcactaactacgctacatctttaaacactccggtcagctacccaccctggaccccttcctccgccacattacctagcctgaccagtttcgtatatagtccccattcaacagaagctgagattagcacacctaaaacctctcctcccccaactagccagatggtggaattccccgtcctgggtacaagaatgacaagtagcaatacacaaccattgctgatgacttcttggaatatccccacagcagaggggagtcagttccccatcagcacaacgatcaatgtgcctacttctaatgagatggagactgaaacactccacttagttcccggacccctttctacctttaccgcttcccaaactggccttgtatctaaagatgtaatggcgatgagcagcatccccatgtccggcatactcccaaatcacggcctgtccgaaaacccatcattgtctaccagcttgcgggcaatcacttctactttggccgacgtgaaacataccttcgagaagatgacaactagtgttacacccggtaccacattgcccagcatcctgagcggagccacaagtggcagtgttattagtaaatctccaattctgacttggctcctgtctagtctcccatccgggagtccacctgctactgtgagtaacgcacctcacgtcatgacctcttctaccgttgaggtgtccaagtctacttttctgactagtgacatgatctctgctcacccgtttaccaatcttaccaccctgccctccgccacaatgtccaccattctgacgagaaccatcccaacacccaccctgggaggtattacaactgggtttcctacgagtctgcctatgtccatcaatgttaccgacgatattgtatatatctccacgcaccccgaggcgtcctcccggactaccattacagcgaacccccgaacagtctctcacccttcctcattctccagaaagacaatgtccccttccaccactgatcataccctctctgtgggagcaatgccactcccatcatcgacaatcacaagttcttggaacagaatccccactgcgagctccccatctacgcttataatccctaagcccaccctggattccttgttgaatattatgacgaccacctcaactgtacccggagcatcattcccgttgatcagtacaggtgttacctacccctttacagcaactgtgtctagcccaattagcagctttttcgagacaacttggctggactccaccccctctttccttagtacggaggcctctactagcccgacagctacgaagagcaccgtgagtttctataatgtcgagatgtctttcagcgtgttcgtggaagagccaagaatccctatcacctctgtaataaacgaatttacagagaattccctgaatagtatattccagaatagtgagttctccttagctaccctggaaactcagatcaagtccagagacatcagcgaagaggagatggtgatggacagggccatccttgagcaacgagaagggcaggaaatggctactatttcctatgtcccttatagctgcgtttgtcaggtaattatcaaagccagttcttccctggcatcctctgaactcatgcgcaagattaagtccaagattcacggcaatttcactcatggcaacttcacacaggatcagctgaccctcctggtgaattgcgaacatgtggcagtgaagaagctggaaccgggaaattgcaaagctgatgagacggcatctaaatataagggcacgtataagtggttattgacaaatcctaccgagaccgctcagacacgatgcattaagaatgaggatggaaacgctactaggttttgttcaatttccatcaatacgggcaagtctcagtgggagaagcccaaattcaaacagtgtaagctcttgcaggagctgccggataagattgtcgatctcgcgaacatcactatcagcgacgaaaatgctgaggacgtggcggagcacatccttaacttaattaacgaaagcccagccttaggcaaggaggaaaccaaaattattgtcagcaaaatttctgatattagccaatgtgacgagatctcaatgaatctaactcatgtgatgttacaaattatcaatgtggtgctagaaaagcagaataatagtgcaagcgatttgcacgagatctctaacgagattctcaggattatagaacgcaccggccataagatggagttttccgggcagatagccaacctcactgtcgccggacttgcactggctgtgctgcgtggcgatcataccttcgatggtatggccttttccatccatagctacgaggagggcaccgatcccgaaatatttctcgggaatgtcccggtgggagggatcctcgcaagcatttacttaccaaaatccctcaccgaaagaatccctctgagcaacttgcagactatactcttcaacttttttggacagacatccctctttaaaactaaaaacgtgactaaagcactcactacatacgtggtgtctgcttctatttctgacgatatgttcatacagaatctcgcagatcctgtcgtcataacactgcagcacattggtggaaaccaaaattacggccaagtacactgtgccttttgggacttcgagaataataatggcctaggaggatggaacagttcagggtgcaaggtgaaagagactaatgtgaattataccatctgtcagtgcgatcacttgacccattttggagtgcttatggatttgtctagaagcactgtagactccgtgaacgagcaaattctcgccctgatcacatataccggttgtggcataagttccatctttttgggcgtggccgtcgttacatatattgcattccacaaacttagaaaggattatcccgcaaagatccttatcaatttgtgcacagccctgttgatgctgaatctcgtgtttttaattaattcatggctaagctcgttccaaaaagtcggcgtgtgcatcacagctgccgtggccttgcattacttcctacttgtatcctttacatggatggggcttgaggcagtccatatgtaccttgccctcgtgaaagtgttcaatatatacatccctaactacatactgaagttttgcctggtgggatggggaatccccgcaatcatggttgcgatcaccgtctccgtgaaaaaggatctgtatggcaccctgtcacctacgacgcctttctgttggataaaggatgacagcattttttatatctctgtcgttgcctatttctgcctgatcttccttatgaacctgtcaatgttctgtacagtgctcgtgcagctgaattccgtaaaaagccagatccagaaaacaagaagaaagatgattctgcacgacttaaaagggaccatgtcactaacctttctccttggtttgacatgggggttcgccttctttgcctggggccctatgaggaatttctttctgtatctctttgccattttcaacacactgcaggggttctttatcttcgtcttccactgtgttatgaaggaatcggtcagggaacagtggcagattcatctatgttgcggctggttgcgattagacaacagctccgacggttcttcacgttgtcagatcaaagtgggctacaagcaagaggggcttaaaaagatattcgagcataagctgctaaccccatcactgaagtctactgcgacatccagcacattcaagtcacttggaagcgcacaggggaccccaagtgaaattagttttcccaacgacgatttcgataaggatccatactgctcgtcccctta

SEQ ID NO: 50412 - DNA, 3240 bp, Artificial Sequence
  Description of Artificial Sequence: Synthetic coding sequence
atggtgtgcagcgcagccccattattactcctggctactactctgccgcttttaggatcccctgtggctcaagccagccagcctgtgtccgagaccggagtccgccctagggaagggttacagcggaggcaatggggccctctaataggtcgggataaagcctggaacgagcgcatcgaccgccctttcccggcttgcccaattcctttgagttcgtcattcggtcgctggcctaagggccaaacaatgtgggcacagacgtccactcttacactgaccgaagaagagttaggtcagagtcaggcagggggagagagtgggagcggccagttgctggatcaggagaacggcgcaggagaatctgccctggtgagcgtctatgtgcacttagatttccccgataaaacctggccgcctgaactctccaggacactcacccttccagcagccagcgctagtagctcaccacgacctctactgaccgggctccgactcactactgagtgcaatgtgaaccacaaagggaacttttactgtgcctgtctgagcggttatcagtggaacaccagtatttgtttgcactaccccccatgtcagtcccttcataaccaccaaccctgcggatgtctggtgttttcccatcctgagccaggatattgccagcttttgccacctgggtcaccagtgacatgtctccccgcagttccaggtatccttaatctcaactctcagctgcagatgccaggggacaccctgagcctgacgttacacctgtctcaggaggctacaaatttatcatggttcctgcggcacccagggtcaccaagccccattctgctgcagccgggaacacaggtctcggtgacatcttcgcacggccaggcagcactcagcgtgtcaaacatgtcccaccattgggctggcgagtacatgtcgtgttttgaggcccagggctttaaatggaacctgtacgaggtggtgcgggtccctctgaaggcgacagacgtggcacgactcccctaccagctgagcatcagctgtgcaacatcacctggcttccagctcagctgttgcatcccgtccaccaatctggcctatacagctgcttggagccctggggagggcagcaaagctagttctttcaatgagtccggctcgcaatgctttgttctggccgtgcagcggtgcccaatggccgatactacctacgcttgtgacttgcagagcctgggcttggcccctttacgcgttccaatttcaataacgattattcaggatggtgacattacttgtcctgaggatgcgtctgtgttaacctggaacgtgaccaaagcgggtcatgttgcacaggccccatgccccgaatctaagagaggcatcgtgcgacgactgtgcggggcagatggcgtgtggggtcctgtgcacagctcctgcaccgacgctcggctgctggccctcttcactaggactaagttgctgcaggcgggacagggctcgcccgctgaagaggttccgcagatcctggctcagctaccaggccaggctgctgaagcctcgtctccaagcgaccttctgaccttgctgagcacgatgaagtacgtcgccaaagtcgttgccgaggcccgtatccaactggatagacgggcattgaaaaacctgctgattgccacggataaggtgcttgatatggatacaagaagcctgtggaccctcgcccaggcacggaaaccctgggccggatccacattgttactcgctgtggaaactctggcctgttccctctgccctcaagaccatccatttgcattttctctacctaatgtgctgctgcagtcccaactgtttgggcctacattccctgctgactattctatatcatttcctacacggccacccctgcaagcgcaaattccaaggcattcccttgccccattggtccggaatggtactgaaattagcattacatccctggtgctgaggaaactggatcatttactcccctccaactacggccagggcctcggggattccctctacgccacacccggtctagtccttgttattagcattatggctggggatcgggcttttagccagggcgaagtgattatggatttcggaaacaccgatgggagcccccattgcgtgttttgggatcatagcctgttccagggacgtgggggatggtcaaaggagggctgccaggcacaggtggcctcggctagtccaacggcacagtgcctgtgtcagcatctgacagcctttagcgttctgatgagcccccacaccgtaccagaggaacccgctttggccttgctcactcaggttggactgggcgcttcgattctggccctcctggtctgtctgggcgtgtattggctggtctggagggtcgtcgtaagaaataagattagctacttcagacacgccgctttgttgaacatggtcttttgtcttctcgccgcagacacatgcttcttgggtgccccattcctgtctccaggacccaggagcccactgtgcctggctgccgctttcttgtgtcattttctctacctggcaaccttcttctggatgctggcccaggctctcgttttggcccatcagctactgttcgtctttcatcaacttgccaaacatcgggtactcccattaatggtgctgctggggtacctctgtccactgggacttgccggagtgaccttggggctgtaccttcctcaaggccagtatctgagggagggtgagtgctggcttgatggcaagggaggtgccctgtacacttttgtcgggcctgttctggctatcattggagtgaatggcttggtactggccatggcaatgctgaagcttctacgcccttcactgagcgagggacccccagccgagaaacggcaggctttgcttggggtgatcaaagctctgctgatccttacacctatcttcggtctaacatggggcctcggtctcgccaccctgttagaagaggtctctaccgtaccacactatatttttactattctaaacaccctacaaggtgtgtttatactcctctttgggtgtcttatggataggaagattcaggaagctctgcgaaaaaggttttgtcgcgcacaggcccctagcagcactatctctctggtgagctgttgtttacaaatcctttcctgtgcttctaagtccatgagcgaggggatcccctggcccagcagtgaggatatgggcaccgccaggtcttag

SEQ ID NO: 50413 - DNA, 2622 bp, Artificial Sequence
  Description of Artificial Sequence: Synthetic coding sequence
atgacaaccagaaaactaagcgcccatagcgctgcaactcccggttacaaagccgtaacgcacaagcatcacactggctgggctcggatggccaaaactgggttacccgagaagggccaaagccaggccggtggtgaaagcggttccgggcagctgttagatcaagaaaacggcgctggggagtccgccctggtgagcgtgtacgtccacctcgatttccccgataagacctggcctcccgaactctcgagaacactgacacttcctgcagccagtgctagcagcagtccgaggccactcctcaccggtctgaggctgacaaccggcgagtatatgagctgtttcgaggcccaggggttcaaatggaatctgtacgaggttgtccgcgtgccactaaaggctactgatgtcgctaggctcccataccagttgtcaataagctgtgccacaagccctggctttcagttaagctgttgtatcccatccacaaacctggcgtacaccgcagcctggtctccgggtgagggttcaaaggccagctcatttaatgagtccggttcacagtgttttgttctcgccgtgcagcggtgtcccatggccgacacaacttatgcctgtgacctgcagagcctgggcttggctcccctgcgggtgccgatatctatcacgatcatccaagacggagatattacctgtcccgaggatgcaagtgttttaacctggaatgtcacaaaagccggtcacgtggctcaggctccatgccccgagtccaagcgtggcatcgtgcggagactgtgcggtgctgatggggtctgggggccagtgcattcaagttgtaccgatgcgcgtctgttggctctgtttacaagaaccaaactcttacaggccggacagggttctccagccgaagaggtgccccaaatattagcccagctgcccggacaggccgcagaagcctcatccccttcggacctgctgacactgttatccactatgaagtatgtggctaaggtggtcgccgaggcacgaattcagttggataggcgagctctgaaaaatctcctcatagccacggacaaggtgctagacatggatacaagaagcctttggacgcttgcgcaggcccgaaaaccctgggccggatctacgctcctgctggctgtggagactctggcctgttccctgtgtccacaggatcaccctttcgctttctccctgcctaacgtgctgttgcaaagccagctctttggccctacctttccagcagattatagtattagcttcccaaccagaccacctttgcaggctcaaatcccaaggcactcactcgcgccactggtgcggaatggcaccgagatcagtatcactagtctggtgctgcgaaagctagatcacctgttgcccagtaactacggacaaggactgggggacagcctgtacgctacccctggacttgtgctggttataagcattatggcgggtgatagggccttctctcagggagaggtgattatggactttgggaatactgatggtagtcctcattgtgtcttttgggaccacagccttttccaagggagaggtgggtggagcaaagagggttgtcaggctcaggtggcgagtgcttcaccaaccgcccagtgcctctgccagcacctgacggcattttcagtgctgatgagcccccatacggtccccgaggagcctgctcttgctctgcttacgcaggttggtctcggtgccagcatcctcgccctgctggtgtgcctcggcgtgtattggcttgtctggcgagtggtcgtgcgtaataagatttcatactttcgccacgcggcactgctaaatatggtcttctgtctcctggcggctgacacatgttttctcggcgcaccctttctgtcacccggtcctcgctctcccctatgcctggccgcagcattcctctgtcatttcctgtacctcgcgactttcttttggatgttggcccaagcgttggttttagctcatcagctgctgttcgtgtttcatcagcttgcaaagcacagggtcctgccactgatggtgttgcttggctatctgtgcccactcgggctggcaggcgtgactcttggactgtacctaccccagggtcaatatctccgagagggggaatgttggctcgatgggaagggaggcgctctgtacacattcgtcggccctgtgttagcaattattggagttaacggactggtgcttgccatggctatgctgaagctcttgcgaccctcactatccgaaggtcctcctgccgagaaacgacaggctttgctgggagtgattaaggctctcctgattctcactcccatcttcgggctgacctgggggctcggacttgctaccttgctcgaggaggtgagtaccgtaccacattatatttttactattttaaatacacttcagggcgtgtttatcctgctcttcggttgtctgatggataggaagatccaggaggcattgcgaaagcgattttgtagggcccaggcaccctcttccactatatccctcgcaactaacgagggatgcatcctggagcacagcaagggagggagtgatacagctaggaagaccgacgctagcgaatag

SEQ ID NO: 50414 - DNA, 2028 bp, Artificial Sequence
  Description of Artificial Sequence: Synthetic coding sequence
atggcagataccacctacgcatgtgatcttcagagcttaggattagccccactgcgggttcctatcagcatcaccattatccaagatggtgatataacatgtcctgaggacgcttccgtgctgacctggaatgtgaccaaggccggtcatgtagcccaggctccctgcccggaatctaagaggggtatcgttcggaggctgtgcggagctgacggagtgtggggcccagttcatagcagctgcactgatgccaggttattggctcttttcacaagaaccaaactgcttcaggctggtcagggcagccctgctgaggaggtcccccagatcttggcccagctgccaggccaggccgctgaagcttcctcacccagtgatctgctaacgctcttgagcacaatgaaatacgtggcaaaagtggttgccgaagcccgtatccagctcgaccggagagccttgaaaaacctgttgattgcgaccgataaggtcttggacatggataccagatctctctggacacttgcccaggctagaaaaccctgggcgggttccacattgctattggccgtggagaccctcgcctgtagcctctgtccccaggatcacccatttgcattcagtctacccaacgtgttgttacagagtcagctctttggcccaacattcccggcagactatagtatttcctttccaaccagacctcctctccaggcacagatccccagacacagtctggcccctctggtgcgcaatggtaccgagatctccattacttctctcgtgctccgaaagctcgaccatctattgccttctaactacggacagggtcttggagacagtctgtatgctacccccggactggtcctggtcatcagcatcatggcaggtgatagggccttttcacagggcgaggtaatcatggactttggtaataccgatggaagcccacactgtgtgttctgggaccacagcctcttccagggcaggggtggatggtccaaggagggatgccaggctcaggtggcgtccgcaagtcccacagctcagtgcctgtgccagcacctcactgcgttctcagtcctaatgtcaccacacaccgtccccgaagagcctgccttagcgctgctgactcaagtagggctgggagcctcaatcctggctcttctcgtctgtttgggtgtgtattggttggtgtggcgggtcgtggtcagaaacaagatcagttactttcgccatgcggctttacttaatatggtgttctgtttactagccgctgatacctgctttttgggtgccccatttctgagtcctggacctcggagccccctgtgtctcgccgctgcattcttgtgtcacttcctatacctggccaccttcttctggatgcttgctcaagctttggtcctggctcatcagttgctgttcgtgttccatcagcttgcaaaacaccgagtgcttcctctcatggtcctgttagggtatctctgccctctgggcctcgcgggtgtaaccctggggctgtatttaccacaaggacagtacctgcgcgaaggtgagtgttggctcgacggcaaggggggagccttgtatacgttcgtaggccctgtcctagccattatcggagtgaacggcctggtgctcgctatggctatgctcaaattactaaggccttcgctgagcgaaggcccaccagcggagaagaggcaggccctgctcggcgtgatcaaagctctcctcatccttacacctatttttggcctcacttggggtttaggtctggccacacttctggaggaagtgtccaccgtcccccactatatattcactattctgaacaccctccagggcgtcttcatcctcttgttcggatgcttgatggaccgcaaaatccaggaagccttgcggaagaggttttgtagggcccaagcgcctagttctactatctcactggcgacaaatgagggctgtatcttggaacactcgaaaggaggcagcgacacagcaagaaaaactgatgccagcgagtag

SEQ ID NO: 50415 - DNA, 2994 bp, Artificial Sequence
  Description of Artificial Sequence: Synthetic coding sequence
atggtgtgctctgctgctcctcttctccttctcgctaccacccttccattgctcggttcaccggttgcccaagcgtctcagccgggtcagtctcaggcaggcggtgaaagcggtagtggacagctgctggaccaggagaacggagcaggcgagtcggcccttgtgtccgtctatgtccatctggatttccctgacaagacttggcccccagaattgtctcgtactcttacgctgccagccgcttcggcctcaagcagccccaggcctctgctcaccggtctgcgtctgactaccgagtgcaatgtgaatcacaagggcaacttctactgtgcgtgcttgtctggataccagtggaacactagcatttgcttacattaccctccttgtcagtctctgcataatcatcaaccctgcggttgccttgtgtttagtcaccccgagcccggttattgtcaactgctgccacctgggtctcctgtgacgtgtctccccgctgtacccggaattttgaatctgaactcccagctgcaaatgcctggggacacactgtctttaactctccacctgtcccaagaggcaactaacctgtcctggtttctacggcatccaggatccccgagccccatccttctccagcccggaacgcaggtaagcgttacgagcagtcacggccaggccgcactgagcgtttctaacatgtcccatcactgggctggtgagtatatgtcctgttttgaggcccaaggctttaaatggaatctgtacgaggttgtccgcgtgccactgaaggccacagacgtcgcccgacttccttaccagctgagtatcagctgcgccacttctcccggatttcagctgtcctgttgtatcccgagcaccaatctcgcttacacagcagcatggtcgccgggtgagggcagtaaggctagttctttcaacgaatctgggtctcagtgttttgtgctggccgtacaacggtgcccaatggccgataccacctatgcctgtgacctccagagccttggtctcgcgccacttcgagttcccatttcaattactattatccaagacggcgatattacttgcccagaggacgcaagtgttctaacttggaacgttactaaagctgggcacgtcgcacaggcgccttgtcccgaatcaaaaaggggaattgtgaggagactgtgcggcgcagatggcgtgtggggacctgtgcattcatcctgtaccgatgcccgtctgctggccctgtttacgcgtactaagctcctccaagctggacaagggtccccagccgaagaagtcccccaaatcttagctcagttgcccggtcaggccgctgaggcctcctctccatccgatctattgaccctccttagcacaatgaagtacgtggctaaagtggtggcagaagcacgaatccagcttgatcggagagcactcaaaaatctcttgattgccacagataaagtgctcgacatggatacaaggtcactgtggaccctagcccaggctcgcaaaccatgggccggatctaccctgttgttagccgtcgaaacactggcctgcagcctgtgtccgcaggaccacccattcgcattttccttacctaacgtgttactccagtctcaactctttggaccgacatttcccgcagactatagtattagcttccctactaggccaccgctgcaggctcagatcccacgccactctcttgcgccattggtgcgcaacggcactgagatttccattacctctcttgttctaagaaaactggaccatttgctaccgtcaaattatgggcaaggccttggagacagtctatacgctacacccggtctggtcctggttattagcatcatggcaggcgaccgagcgttttcccagggagaagtgattatggattttggcaatacagatgggtctccgcattgcgttttttgggaccatagcctgtttcaaggcaggggcggttggtcaaaggagggatgccaggcacaagtggcgtccgccagcccaactgcccagtgcctctgtcagcatctaaccgccttttccgtattaatgagtccacacactgtgccagaagagcccgcacttgcgctgctgactcaggtaggactcggggcttccatcctcgctctcttggtttgtcttggggtgtactggctggtctggcgggtagtcgttcgcaacaagattagctactttcgccatgccgctttgctgaatatggtgttttgtctcctagcggctgacacctgcttcctgggagcaccgttcctatcgcccggaccacggtctcccctctgtctggccgcagcttttttatgccactttctgtatcttgccaccttcttctggatgctggcacaggccctggtgctcgcgcaccaactgctcttcgtcttccaccagctggctaagcatagagtgttgcctctcatggtgctgttgggctacttatgccccttaggcctagccggagttactctgggcctgtatctgcctcagggccagtatttgcgggagggtgaatgttggttagatgggaaaggtggagcactctacacttttgtggggccagtgctggccatcattggggtcaatggcttagttctggccatggccatgctgaagcttctgcggccttctctatctgagggcccaccggctgaaaaaagacaggccctgctgggggtgataaaagcactcctgatcctcacccctatctttgggttgacctggggtctcgggctagctacgctccttgaggaggtttctaccgtcccgcactacatcttcactattcttaacactctgcagggagtcttcattctgttatttggctgtctgatggaccggaagatacaagaggccctgaggaagcgtttctgccgagcacaggcgccaagcagtactatcagcttggccactaatgaagggtgcatactcgaacatagcaaggggggatctgataccgcaagatag

SEQ ID NO: 50416 - DNA, 1587 bp, Artificial Sequence
  Description of Artificial Sequence: Synthetic coding sequence
atggaccactgcggtgcattgttcctctgtctgtgcctgcttaccctgcagaatgccacaacagagacttgggaagaactactgagctacatggagaatatgcaagtgtcgcggggaagatctagcgttttctccagcaggcaattgcaccagctggagcagatgctcctgaataccagttttccgggttacaacctgaccctccagacgcccactatccaatccctggcttttaaactgagttgtgacttctctggcctgagcctgaccagcgcaacattgaaaagggttcctcaagcaggtggtcagcatgcccgtgggcaacacgctatgcaatttccagcggagcttactcgcgatgcgtgcaaaacccgccctcgcgagctcaggctcatctgcatatacttttccaatacgcatttcttcaaagacgagaataattcctccctgctaaacaactacgtgttgggggcacagctttcacatggtcatgtcaacaacctaagggacccagtgaatatctccttctggcacaaccagtccctggaggggtacacactgacttgcgtcttctggaaggaaggagcaagaaagcaaccttggggaggatggagccctgagggctgccgcactgagcaaccaagccacagccaagtgctgtgcagatgtaatcacctaacatatttcgcagtacttatgcagcttagcccggctcttgtgccagctgagctcttggctccgctgacttacatctctcttgttggatgttctatttcaatcgtggcatctttgattacagttctgctccatttccacttccgcaagcagtctgacagcctgaccaggatccatatgaatcttcacgccagcgtcttgctgctgaacatcgctttccttctgagtccagccttcgccatgtcaccagtgcctggctccgcttgcaccgccctggcagccgctctccattacgctctgctgtcctgtctgacctggatggctatcgagggattcaacctgtacttactgcttggacgagtctataacatctacatccgcaggtatgttttcaagctgggcgttctagggtggggggcaccagctcttttggtcctcttgagcctgagcgtgaaaagttccgtgtacggaccatgcacaattcctgtctttgatagctgggagaatgggaccgggtttcagaacatgagcatctgttgggttcgttctccagtggttcactcagtactggttatgggctatgggggtttgacttctctgttcaacctcgtggtccttgcctgggcattatggacgctgcgaagactccgcgagcgggctgatgctccctctgtccgggcatgccatgatactgtgaccgtgctcggattgacggtgctgttaggcacaacgtgggccctggctttctttagttttggcgtcttcttgctgccccagctattcctctttaccattctgaattccttgtacggctttttcctcttcctgtggttctgctctcagagatgcaggtctgaagccgaagctaaagcacagattgaggcattctcctctagccagactacccagtag

SEQ ID NO: 50417 - DNA, 1713 bp, Artificial Sequence
  Description of Artificial Sequence: Synthetic coding sequence
atggatcactgcggggcattgttcctgtgcctctgtctgttgactctccagaatgctacaactgagacatgggaagaactcctgtcttacatggaaaacatgcaagtaagtcggggaagatccagcgtcttttcgtctaggcagctgcaccagttggaacagatgctgctgaacacctcattccctggttacaatctgaccttgcagacacccactatccagagcctggcctttaaactctcctgcgatttctcagggctgagtctgactagcgccacgctcaaacgcgtaccgcaggctggtggacagcacgctcgtgggcagcacgccatgcagttccccgctgagctgactcgggatgcttgcaaaactaggccgcgtgagctgcgactaatttgtatttatttctctaatacccactttttcaaagacgagaacaactcaagcctgctcaataattatgtcctaggggctcaactatcacatgggcacgttaacaatctgagggaccccgtcaatatttccttctggcacaatcagtcgctggagggctacaccctgacatgcgtgttttggaaggaaggggcacgaaaacagccctggggtgggtggtcaccagagggctgcaggactgaacagcctagtcacagccaggttctatgtcgctgtaatcacctgacttattttgctgtacttatgcagttgtcgcctgctctcgtacccgcagagctactggccccactgacctatatttcacttgtgggatgcagcatttctatagtggcaagccttatcacagtgcttctgcacttccactttaggaagcagtccgactcacttacgaggattcacatgaatcttcacgctagcgtcttactcctaaatatcgccttcctgctcagccccgcttttgcgatgtctcccgtgccgggatctgcttgcacagcgctggcagctgctctccactatgcactcctgagctgcctgacttggatggctattgagggattcaacttgtatttgctgctgggtcgcgtctacaatatttacatccgccgatatgtttttaaacttggagtgcttgggtggggcgctcctgctctgctcgtactacttagcctgtccgtcaagtcttccgtgtatggtccttgtaccattccagtgtttgattcttgggagaacggcaccggcttccagaatatgagtatttgttgggttcggtctcctgtggtacactccgtgctggtgatgggctacgggggactcaccagccttttcaacctagtcgtgctggcctgggccttgtggacactccggcgtctacgcgagagagctgacgcccctagcgtgcgagcttgtcacgacacagtcaccgtgctgggcctcacagtgctacttgggaccacgtgggctttggcattcttttctttcggagttttcttactacctcagctcttcctttttaccattctgaacagtctgtacggcaagggtggcggtactgtgtccaagaagagcgacgacacaaccgtcttcttgaagaacgatgagactgcttggggcaaactcctgtgcttgccatatagtggcttcttcttttccaagccaatcagcagcctggccatgatcaggggtaatacgcctgcaccagtagggggagacgacatccccgcaatatatgaagtggagcacttccagcaggagcaagtctag

SEQ ID NO: 50418 - DNA, 1356 bp, Artificial Sequence
  Description of Artificial Sequence: Synthetic coding sequence
atggaccactgtggtgcactctttttgtgcctgtgcctgttgacactgcagaatgccaccacagagacatgggaggagctgttgagttacatggagaatatgcaagtgagtcggggtcgatcgtctgtgttttcatcccggcaactgcaccagttggaacaaatgctcctcaatacttcattccccggatataacctcacactccagacccccactattcagtccctggcgttcaagctcagctgtgatttctccggcttgtctctcacctcggcaacccttaagcgagtgccccaggccggtgggcagcatgcaagaggccagcacgctatgcagttccccgctgagctcacacgtgatgcctgtaaaacccgaccgcgtgaattgaggctcatctgcatttacttctctaacacacattttttcaaggacgagaataactcgtctctgctgaataattacgtgctcggcgctcagctgtcccacggacacgttaacaatcttagggacccagtgaatatttctttttggcacaatcaatcactggaagggtatacacttacatgtgtcttttggaaggagggggcaagaaaacaaccatgggggggttggtccccagaaggctgccggactgaacagccctctcatagtcaggtactatgccgctgcaatcatctgacatattttgctgtgctgatgcagctatcccctgcactggtaccagccgagcttcttgcccctcttacctacatctcactggtcggatgcagtatttccatagtagcatcactcattacagtgctactgcatttccattttagaaaacagtccgatagcctcacacgcatccacatgaatttacacgcctcggttttgcttttgaacatcgcttttctgctcagccctgcctttgccatgtcacccgtgcctggttccgcttgtaccgctctggcggctgcgctgcactatgcgctcctgtcatgccttacctggatggcgatcgagggcttcaatttgtacctactgctaggcagggtgtacaacatctacatccgcaggtacgtcttcaagctgggagttctgggatgggacgccggttgcggtgccccatggtgtaccgtcagctggtcttgggcaaccgccgctagccgccctagcagcacttggtggtgctggcccggtaggtgcggcccatgcgccggttgcgggtcaggtcggatgcatcaggtgtctggccctgcaatgaccttatccctctgttgggcaagcccatgttgctgggagcctccaggtccctggccgtcctttctccttgcttcatcgtgttgcccaagttgtagctctagcccatcatag

SEQ ID NO: 50419 - DNA, 4041 bp, Artificial Sequence
  Description of Artificial Sequence: Synthetic coding sequence
atgaagagtccaagaagaaccaccctctgtctaatgtttatagtaatttactcttctaaagcagcattaaattggaattatgagtctaccattcaccctctgtcactccacgaacatgagcctgctggcgaggaggcactgaggcagaaaagagccgtggccacaaaatcccccactgctgaggagtacacagtgaacatcgagatatcgttcgaaaacgctagcttcctggacccaatcaaggcctacctcaactctctctcttttccaatccatggcaacaacacagaccagattaccgatatcttaagcatcaacgtgaccactgtgtgccgtccagcagggaatgaaatctggtgttcatgcgagacaggttatgggtggccaagagagaggtgtctgcacaacttaatctgtcaggagagggacgtgtttctgcccggacaccattgcagttgtttgaaagagctgccccctaatggacctttctgcctcctgcaagaggacgtgactttaaacatgcgggtcagactgaatgtggggttccaggaggatcttatgaatacatcttccgcactataccgcagctacaagactgatcttgaaactgcattcaggaagggctatgggattctcccgggtttcaaaggcgtcactgtgactggattcaaatccggcagcgtcgtggtgacttacgaggtgaaaactaccccaccctcgctggagctcattcataaagcaaacgaacaggtcgtgcagagcctgaaccagacatacaagatggattataactcttttcaagcggtgacgattaacgagtccaatttctttgtcactcccgagattatcttcgagggcgacacagtgagcctggtgtgtgagaaagaagtattgtctagtaatgtatcttggcgatacgaggaacaacagctcgaaatccaaaattctagtcgcttctcaatttacaccgccttatttaacaacatgacctcagtgtccaagcttactatacataatattacacccggagatgccggtgagtacgtgtgcaagctgattctagatatcttcgaatacgaatgtaaaaaaaagatcgatgttatgccgatacagatcttagcaaacgaagaaatgaaagtgatgtgcgataacaaccccgtcagcttaaactgttgctctcagggcaatgttaattggagcaaggtggagtggaagcaagagggaaaaattaacattccaggcacccccgagaccgatatagattcgagctgctcacgctacacacttaaagccgatggcacacagtgcccatcaggatcatcaggcaccactgtgatttacacatgcgagttcatctctgcctatggcgctcgcggttctgccaatataaaggtgacatttatctcagtcgccaatctcactatcaccccagatccgatcagcgtcagcgaaggtcagaatttctctatcaagtgtatttcagacgtttctaactacgatgaggtgtattggaataccagcgctggaatcaaaatatatcagaggttttacacgaccagaaggtacctagatggcgcagagagcgtccttaccgtgaagacatctacgcgcgaatggaatggcacctatcattgcatctttcgttacaagaacagctactccatagcgaccaaagacgtcattgtccatccactccctctcaagttgaacattatggtcgatcccctggaggccacagtgagctgtagcggctcacatcacattaaatgctgcattgaggaagacggagattataaggtcacattccacactggtagctcgagtcttccggcagcgaaagaggtaaataaaaaacaagtgtgctacaagcataacttcaacgcatcatctgtgtcttggtgttccaaaacagtggacgtctgctgtcatttcacaaatgcagccaataacagcgtatggtcaccttccatgaaactgaacctggtgccaggcgagaatatcacttgtcaagacccagtgatcggcgtgggagagccaggaaaagtgatccagaagttgtgcaggttttcaaatgtccctagttctcctgaatccccaattgggggtacaatcacctacaagtgcgttggctctcaatgggaggagaagcggaacgactgcatctccgcgcctatcaactctttgcttcagatggctaaggcgctaattaagtccccctcacaagacgagatgttacctacttatctgaaagatctgtccattagcatcgacaaagcagagcacgagataagctcgtctccaggctcactaggtgctatcatcaacatcctggatctgctgagtactgtgccaacccaggtgaactctgaaatgatgacccacgtcctgtcaactgtcaatgttatcctgggcaaacctgtcctcaacacttggaaggtcctccagcagcaatggacaaaccaaagctctcagttgttacactccgtggaacggtttagccaggctctgcagtccggtgactctccccctctctcttttagtcaaaccaatgtccagatgagcagcatggttatcaaaagtagccaccctgagacttatcagcagcgatttgtcttcccctacttcgacttatggggtaatgtcgtgattgataagtcatacctcgaaaacctgcaatctgattcatcgatagtgactatggcatttcctaccctgcaggccatcttggcccaggatatccaggaaaataacttcgccgagtccctggtgatgacgactaccgtctcacacaacacgaccatgccgtttcgcatttccatgacttttaagaataactccccctcaggcggtgagacgaaatgcgtgttttggaatttccgactcgctaacaacacaggcggttgggactcgagcggctgttacgtagaggagggtgacggcgacaacgtgacttgcatctgtgatcaccttaccagctttagcatcctgatgtctccggacagtcctgacccgagcagcctcttgggaatcctgctggatatcataagttacgtgggcgtcggattcagcatcctgtctctggccgcttgcctggtggtggaagctgtagtttggaagtccgtgaccaagaaccgaaccagctacatgaggcacacttgcatcgtcaatattgccgcaagcctcctggtggccaacacttggttcatcgtcgtcgccgcaattcaggacaacagatacattctatgcaagactgcttgtgtagcagcaaccttctttatccatttcttttatctgtctgtgttcttttggatgctgacccttggactgatgctgttttatagactagtgttcattcttcatgagacctcgaggagtacacagaaagccattgcattctgcctcggctatggttgccctctggctatttccgtgataacactaggcgctactcaaccacgagaggtgtacactagaaaaaatgtttgttggttaaattgggaggatactaaggcattgctggccttcgctataccagcactgatcatagtcgtggtgaacatcactattacgatcgttgtcatcacaaagatcctgagaccttctatcggagataaaccctgcaaacaggagaagagtagcctgtttcagatttctaagtctattggggtgcttacgcctctcctcggccttacatggggatttgggctcaccactgtgtttccaggcactaatctggtattccatatcatcttcgctattctgaatgtattccagggacttttcatattgctattcggctgtttgtgggatctcaaggtgcaggaagctttgcttaataagttttcgctgtcgcgctggtcatctcagcattccaagagtaccagcttgggtagtagcacacccgtgtttagtatgagtagtcccatcagtagacgctttaacaacctcttcgggaaaaccggaacatataacgtcagcacccctgaagccactagctcatcgctagagaattcatccagcgcaagtagtctgctcaattag

SEQ ID NO: 50420 - DNA, 4041 bp, Artificial Sequence
  Description of Artificial Sequence: Synthetic coding sequence
atgaagtcacccaggcgcactactttatgtctgatgttcatcgttatctactcgtccaaagctgctctaaattggaattacgagtcgaccatccatcctttgtcgttgcacgaacacgaacccgctggggaggaggcactccggcagaaaagagccgtagcaactaagtcccctaccgcagaagagtacactgtgaacatcgagatatcattcgaaaacgcatcctttctcgaccctatcaaggcctacttgaattccctctccttcccaattcacggaaataacaccgaccaaattaccgatatcctgtcaatcaatgtgacaacagtgtgccgaccagcaggcaatgaaatctggtgtagttgtgaaaccgggtacggctggcccagagagcggtgtttgcataacctgatttgtcaggagcgcgacgtgttcctgcctggccaccactgtagctgtctgaaggagctgccgccaaacgggcctttctgcctattgcaggaagacgttacactcaacatgagggtgcgccttaatgtggggtttcaagaggatttaatgaacaccagctctgccctgtatcggagttataagactgatctcgagacagctttccggaaaggttacggaattttgccaggttttaagggagtgactgttaccggttttaaaagtggctctgtcgtcgtgacctacgaggtgaaaaccacacctccttccctggagctaatccataaagctaacgaacaggtggtgcagagcttgaatcagacttacaagatggattataatagttttcaagcagttactattaacgagtctaattttttcgtgacccctgagataatttttgagggcgataccgtgagcctcgtgtgcgagaaggaagtcctctcatctaatgtgagctggagatacgaagagcagcaattggaaatccagaacagcagccggttttcgatatacaccgctttgttcaataatatgacaagcgtaagtaaacttactattcacaacataactccgggagatgctggggagtacgtttgtaagctgatcctggacatctttgaatatgagtgcaagaaaaagatagatgtgatgccaattcagatcctggctaatgaagaaatgaaagtcatgtgtgacaacaatccagtctctctgaactgttgcagccaagggaatgtcaattggtcgaaagtggagtggaagcaggaggggaagattaacatcccagggacgcccgaaaccgatatcgattcttcctgctcccgatatacacttaaggctgatggcacacagtgcccctcaggatctagcgggactacggttatctatacatgtgaatttatctccgcatatggcgctaggggctccgcaaacatcaaagtgacgttcatatccgtcgcaaacctgacaatcacccccgacccaataagtgtgtctgagggccagaatttcagtatcaaatgcattagtgacgtgtctaattatgacgaggtgtactggaatacatctgctggcataaagatctaccagagattttataccacccggcgatatctagacggcgcagaatctgtcttaacggtgaaaacctccactcgcgagtggaatggcacataccactgtatctttaggtacaaaaactcctactctatcgccacaaaggatgtgattgtacacccgctgcctttgaagctgaacataatggtggacccgctggaggcaaccgtatcttgctcaggatcacatcatattaaatgctgtatcgaggaggacggcgactataaagtaacatttcacacagggtcaagctccctgcctgcggctaaagaagtcaacaagaagcaggtatgttacaagcacaatttcaatgcaagctccgtgagctggtgttcaaagactgtggatgtttgctgccactttacgaacgctgccaacaattcagtgtggtcacctagcatgaaactgaacctggtacctggcgagaacattacctgccaagatcccgtgataggtgtcggcgagcctggcaaggtgatccagaaactttgtcggttctctaacgtaccatcgagcccagaaagccccattgggggtaccattacttataagtgcgtggggtcacagtgggaagagaaacgtaacgactgtataagtgcgcctataaattctttactccagatggctaaagctctcatcaaaagccccagccaggacgagatgttaccgacttacttgaaagatttgtccatttcgatagataaggctgaacatgaaattagctcttcacccggatctttgggcgcaatcatcaacattttggacctgttgtccacagtacctacccaggtgaacagtgaaatgatgacccatgtcctttcgaccgtgaatgtgattctcggtaaacccgtactgaatacctggaaggtcctacagcagcagtggacaaaccaatcttcccagttactccacagtgtcgaacggttctctcaggcgctccagtccggcgactcgccgccattatccttcagccagaccaatgttcagatgtcatcgatggttatcaaatcgtcacaccccgaaacataccaacagcgatttgtttttccctattttgatctttggggaaatgtcgtgatcgacaaaagttacctggagaatctgcagtcggatagctctatagtgaccatggccttccccaccctgcaggctatcttggcacaggacattcaggaaaataactttgccgaaagcttggtcatgacaactaccgtgtcccacaatactacaatgcccttccgtatttctatgactttcaagaacaacagtccttcaggcggagagactaagtgtgtattttggaacttcaggttagcgaacaacactgggggttgggactcctcagggtgttatgtcgaggaaggggacggcgacaacgttacctgtatttgcgatcacctgacttcattctccatcttgatgagtcccgatagccccgacccctccagtctccttggaatcctgctggatataatcagctacgtgggagtgggtttctctatcctttctttggctgcatgccttgtcgtcgaggctgtggtctggaagtccgtcacaaagaacagaactagttacatgaggcacacctgcatcgtgaacatcgccgcttctcttctggtagcaaatacctggtttattgtggtggctgcaattcaggataatcggtacattctgtgtaaaacagcttgtgttgccgcaaccttttttatacactttttttacctttctgtgtttttttggatgctgaccctaggtctcatgctgttttatcggcttgtcttcattttacacgagacctccaggagcactcagaaagcgatcgccttctgcttgggctatggctgccccctggcaatttcagtaatcacactcggtgctactcagcccagagaggtatatacacggaaaaatgtttgctggctgaactgggaagatactaaagccctccttgcctttgcaattcctgcgttaattatcgtcgtcgtaaacatcaccataactatagtcgtcatcacaaagatcttacgtccctcaattggagacaagccatgcaaacaggaaaaatcgtcacttttccagattagcaagagtattggagtgcttacccccctgctgggccttacctggggattcggcctcacaacggtctttcccggaaccaatctcgtcttccacatcatatttgccatcttgaacgtgttccagggcctgtttattttgctcttcgggtgcctgtgggatctcaaggtacaagaagcattgctgaacaaattctccctctctcgctggagctctcagcactccaaatccacgtccctgggctccagcaccccagtgttttccatgtcatcccctattagccgcagatttaataatctctttggaaaaactggcacttacaacgtttctacaccagaagccactagctcaagcctagagaattcttctagcgcttccagcttgctgaactag

SEQ ID NO: 50421 - DNA, 3981 bp, Artificial Sequence
  Description of Artificial Sequence: Synthetic coding sequence
atgaagagccctcgcaggactactctgtgccttatgttcattgtgatctacagcagcaaggcggcactcaattggaattatgagagcacaatacatcccctgtccttacacgagcacgagcccgcaggagaggaggccctgcgccagaaaagagctgttgctacaaagtcaccaacagcagaggagtacaccgtcaacatcgagataagctttgaaaatgcatccttcctcgatccaatcaaagcctatttaaactcactgtccttcccaatccacggaaataatactgatcaaatcacagacatattgtccatcaatgtcaccacggtgtgtaggcctgccggaaacgagatttggtgtagctgcgagaccggatacgggtggcctcgagagcgatgcctacacaacttaatttgccaggagagagacgtcttcttgcctggacaccactgcagttgcctcaaggagctgcccccaaatggaccattttgtctcctccaggaggatgtcaccctgaacatgcgcgtgcgtttaaatgtcgggtttcaggaggatctgatgaatacatcctccgcactttacagatcttataagaccgacttagaaaccgccttcaggaaggggtatggaatcttacccggattcaagggagttactgtgacaggattcaaaagtggtagtgtggtggtgacctacgaggttaagacaactccgcctagccttgaattgatccacaaggctaacgagcaagtggtgcagagtctgaatcagacttataaaatggactataattcgttccaggccgtaaccatcaatgaaagcaatttcttcgttacccccgagattatttttgagggcgatactgtgtcgctggtatgcgagaaggaggttctcagctcaaatgtcagctggcgctatgaggagcagcagctagaaatccagaatagctcgcggtttagtatttatactgctttattcaacaacatgacctctgtatccaaactcacaattcacaacattacccctggagacgccggtgaatatgtgtgcaaacttatcttggacatctttgagtacgagtgcaagaagaagatagatgttatgccgatacagatcttagccaacgaggagatgaaggttatgtgcgataacaacccagtgtccctcaattgttgttctcagggcaatgttaattggtccaaagtggagtggaaacaggaagggaagattaatatccctggaacacccgagacggatattgactccagttgctctagatacaccctgaaagccgacggaacccagtgtcccagcgggagctcaggtacaactgtgatctacacatgtgagttcatctcagcctacggtgctagagggtctgcgaacattaaagtaacgtttatctccgtcgccaatctgacaattacccctgatcctatttctgtgagcgagggccagaacttttcgatcaaatgtatctctgatgtgtcaaattacgacgaggtgtactggaacacaagtgctggaattaagatctatcagcggttctatactacccggcgttacctcgacggcgctgaatcggtgctcacagtgaaaacatccacaagagagtggaacggtacttaccattgtatcttccgatacaagaatagctactccatcgcaaccaaggatgtcatcgtgcatcccctgccgctcaaattaaatattatggtggaccctctggaagccacagtctcgtgctccggatctcatcacatcaagtgctgcatcgaagaagacggtgattataaggttacgtttcatacaggctcaagttcactgcccgctgcaaaggaagtaaataagaagcaagtctgctataagcataactttaacgcctcatctgttagctggtgcagcaagaccgtcgacgtttgctgccatttcacaaatgccgcaaacaacagcgtatggtcacctagcatgaagttgaatctggtgccaggagaaaacataacatgccaagatccggtcattggcgtgggggagccgggtaaggtcattcagaaactctgcagattcagtaacgtgccatcctcccctgagtcccccataggcggaactatcacttacaagtgcgttggtagtcagtgggaagaaaagcggaacgattgcatatcggcccctattaattcactcctccagatggcaaaggctctgataaagtctccttctcaggacgagatgctccccacttacctgaaggatttgtccatttccatcgacaaagccgaacatgagattagctcatcccccggtagcttaggtgctatcattaacattttagaccttctttcaactgtgccaacccaagtgaactccgaaatgatgacacacgtacttagcacagtcaatgtgattttaggaaaacccgttctgaatacctggaaagtccttcagcaacagtggactaaccagtcgtctcaactgctccactcagtcgagcggttctctcaggcactgcagagtggcgactccccccctttatcttttagtcaaacaaacgtccaaatgagctcaatggtgatcaaatcttctcaccctgagacctatcagcaaagatttgtgtttccttactttgacctctgggggaatgtggtgattgataaatcttatttggaaaatttgcagtccgattcgagtattgtaaccatggcattcccaactctccaggccatcctggctcaggatatccaggagaataattttgccgagagcctggtgatgaccactaccgtctcacataacacaactatgccattcagaatatctatgacgttcaagaacaactctccaagcggcggagaaactaaatgtgtgttttggaactttcggctcgccaataacactggcggatgggactcttcagggtgctatgtggaggaaggggacggggacaacgtaacctgtatctgcgatcatctcacttcattttcaattctgatgtctccagactcacccgaccccagttctctgctgggcatcttgctagacattattagttacgtgggcgtgggattttccatcttaagcctggctgcttgcctggttgtggaggccgtggtgtggaagtccgtaaccaagaatcggacgtcctatatgcgacacacctgcatcgtcaacatcgctgcttctctcctggtggccaatacatggttcattgtggtcgccgctatccaagacaatcggtacatcctttgcaaaaccgcctgtgtcgcagcaacattctttatccactttttctacctgtcagtcttcttctggatgctcacactcgggctgatgttattttatcggctggtcttcattctgcatgagacatcacggtcaactcaaaaggcaatcgccttttgtctgggctacggatgtcctttagcaataagtgtcatcacactaggcgcaacccagcctcgagaggtctacactagaaaaaacgtgtgttggctgaactgggaggacacaaaagctctgctcgcattcgccatccctgccttgatcatcgtggtggtcaatatcaccatcacaatcgtcgtgatcaccaagattttgagacccagcatcggcgataaaccttgtaaacaggaaaaatcgagtctgttccagatctcgaaatcaattggagttcttaccccactacttggactgacctggggatttgggcttaccactgtgtttccagggaccaacttggtctttcatattatcttcgccattctgaatgtgttccagggcttgtttatcttgttattcggttgcctctgggacctaaagtccacttctcttggcagctcaactcccgttttcagtatgagttccccaattagtagacgtttcaacaacctgttcggcaagactggcacttacaatgtttcaactcctgaagccacttcttcatctttggagaactcgagcagcgcctcctcgcttctgaactag

SEQ ID NO: 50422 - DNA, 4041 bp, Artificial Sequence
  Description of Artificial Sequence: Synthetic coding sequence
atgaaatccccccgacgaaccaccctttgtctgatgtttatcgtcatttacagttcgaaagcagcgctcaactggaactatgagtctacaattcaccctctctctttgcacgagcatgagccagcgggagaggaggccctcaggcagaagcgagccgtggcgaccaagtcgccaactgcggaggaatacactgtgaacatcgagatctctttcgagaatgcgtcttttctggatccaataaaggcttacttgaacagcttgagttttccaattcacgggaataataccgaccaaatcacagatatcctgagcatcaacgttaccaccgtctgtagaccagcagggaatgagatctggtgctcatgcgagaccggctacggatggccgagagagaggtgtttacacaacctgatctgtcaagagcgagatgtctttctcccagggcaccattgtagttgcctgaaagagctgcctcccaacggtccattctgtctcctccaggaagatgtgacgctcaatatgagggtcaggctgaacgtgggtttccaggaggaccttatgaacaccagttctgctctctaccgctcatacaagacagatttggaaactgcatttaggaaaggctatgggatcctgccaggctttaagggtgtgactgtgaccggatttaaatctggcagcgtggtggtgacatacgaagtcaaaaccactcctcctagtctggagttgatccataaagccaatgagcaagtagtgcagagtctgaatcagacctataagatggattataattccttccaggccgtgacgattaatgaatctaatttctttgtgacacccgaaatcatttttgagggcgacaccgtaagccttgtgtgtgagaaagaggtactgagctccaacgtgtcatggcggtatgaggagcagcaattagaaattcagaacagttccaggtttagcatttacaccgcgctcttcaacaatatgacatcagtgtccaagctgacaattcacaatatcacaccgggagatgctggggagtacgtgtgcaaactgatcctcgacatatttgagtacgaatgcaaaaagaagatcgacgtaatgcccatacagatactggcgaatgaggagatgaaggtgatgtgcgacaataaccctgtgagccttaattgttgttctcagggaaatgtcaactggtccaaagtggaatggaaacaggagggaaagattaacattcccggaactcctgagaccgacattgacagcagctgctctcgatacactctcaaggcagacgggacccagtgtccgagcggcagttcgggaacaaccgtcatttatacctgcgaatttatctctgcttacggggcacgcggttccgccaacattaaggtaacattcatctctgttgctaatttaaccattaccccagaccccatctcagtgtctgaaggacagaacttctcaatcaaatgtatttctgatgtcagcaactatgatgaagtgtattggaatacctcagctggaataaagatttatcagcggttctatacaacacgcagatatctggatggagccgagagcgtgctgaccgtgaagacctctacccgcgagtggaatggcacataccactgtatttttagatataagaatagttatagcatcgctaccaaagacgtgatcgtccaccctcttccactgaagctcaatattatggtggaccctcttgaggccaccgtgagctgcagtgggagccaccacatcaaatgttgcatcgaggaagacggtgactataaagtaacatttcacacggggtcgtccagcctcccagccgctaaggaggtcaataaaaagcaggtctgctacaagcataactttaatgcgtccagtgtgtcctggtgctccaaaactgtggacgtgtgttgccacttcacaaacgcagctaacaactccgtgtggtctccatccatgaaactgaatttagtcccgggtgagaacatcacctgtcaggatcctgtgatcggagtcggagaacctggaaaggtcattcaaaaactctgtcggtttagcaacgtgccaagttctcctgagagtccaattggaggaactattacctataaatgcgtcggctcacagtgggaagagaagaggaatgactgcatatcggcacccattaatagcttgttgcagatggcaaaggcacttatcaaatctccttcccaggatgagatgctaccgacttacttgaaagacctgtctatctccattgacaaggcagagcatgaaatctcaagctctcctggatccctgggggctattatcaacattctggatctcctttctacagtgcctacccaagtaaactctgagatgatgactcacgtcctgtcgactgttaatgttatcctgggaaagcctgtgcttaacacttggaaggtgcttcagcagcaatggaccaatcagtcctctcagctccttcactccgtggagcgcttctcgcaggccctccagtccggagactccccaccactctcattttctcagacaaatgtgcaaatgagcagtatggtcattaagtccagccatccagagacttatcaacagcgctttgtttttccctattttgacctgtggggcaacgtggtcatcgacaagtcctatctagaaaacctgcagagcgattctagtatcgtgactatggcctttccaacgctgcaagcgatcttagcgcaggacatccaggagaataattttgcagagagcctggtcatgactacaacggtcagccacaatacgactatgcccttccggatctctatgacattcaaaaacaacagcccgtcgggtggtgaaacaaaatgcgtcttttggaacttccgactcgccaacaataccggcggatgggactcgtccggctgttatgtggaggagggcgatggagataatgttacttgtatctgtgaccacctcactagcttcagcatacttatgagtccagacagtcccgacccttcatccctcctgggcattctactggacatcatctcctatgttggagtcgggttttccattctttccctggcagcctgtctcgtggtggaggccgtagtctggaagtcggtgacaaaaaataggacgagttacatgcggcacacatgcatcgtgaatattgcagcctctctcttggtagcaaatacttggttcattgtcgtagccgctattcaggataacagatacattctctgcaaaacagcatgcgtggcggcaacattctttattcatttcttctacctgagtgtgttcttttggatgcttaccctgggcctaatgctcttttatcgactggtctttatcctccacgagacatcccggagcactcagaaagctatagctttttgcctgggatatggatgccctctcgcaatttctgtgattacactaggcgctacccagccacgggaagtgtacacgcgaaagaacgtatgctggctgaattgggaagacactaaggctctgctggccttcgcgatacctgcactcatcatagtcgtggtgaacatcacaatcaccattgtggtgatcacaaaaatcttgaggccaagcataggagataaaccttgtaagcaggagaagtcctcactgttccaaatatcaaagtctataggagttttaactccgctgctgggactgacctggggattcgggctgaccactgtatttccaggaactaacctcgtttttcatatcattttcgccatcctcaacgtgtttcaggggctgttcatcttgctattcggctgcctttgggatctaaaggtgcaggaagctctgctaaacaagttttccttgtctcgatggagctcacagcattcgaaatcgacgagtctgggatcttctacaccagtgttctcaatgtcttcccccatctcccggagattcaataatctgttcgggaagaccgggacatacaacgtatccactccagaagccacatcctcatctctggaaaacagctcatcggctagctcactgctgaactag

SEQ ID NO: 50423 - DNA, 3615 bp, Artificial Sequence
  Description of Artificial Sequence: Synthetic coding sequence
atgaaatcaccacggcgtactactctctgtttaatgttcattgttatctatagcagtaaagcagccctgaactggaactatgagtcaactattcacccactaagcctgcacgaacatgagcctgccggagaggaagccctaaggcagaaacgggcagtggccacaaaaagccccactgccgaagagtacaccgttaacattgaaatcagctttgagaacgcatctttcttggacccaatcaaagcttacctcaattctctgagcttcccaattcacgggaacaacaccgatcagatcaccgacattctgtctatcaatgtaacaaccgtctgccggcctgccggtaatgaaatctggtgcagctgtgaaaccggctacggctggcccagggagcgatgcctgcataacctgatttgtcaagagcgtgatgtattcctacccggtcatcactgttcctgcctgaaggaactgcccccaaatggccctttctgtctgctccaggaagacgtcaccctgaatatgcgggtcagactcaatgttggctttcaagaagacctgatgaacacaagttcagccctctatcgcagctataagacggacctggagacggcctttaggaagggatacggtatcctgccgggtttcaaaggggttacggtcactggatttaaaagcggctctgttgtggtgacctacgaagtaaagaccacaccaccctcactggaactgatacacaaggctaacgagcaggtggtccagtcactgaaccaaacctacaagatggactacaactcgtttcaagccgtcacaatccggaccccagaaactgacatcgactcctcctgcagtcgctataccctgaaggcggacgggacgcagtgtccaagcggatctagcgggaccacagtcatttacacgtgtgagtttatcagtgcctacggtgctcgcggatccgccaacattaaagtgacatttattagtgttgccaatctaacaatcacgccagaccctatatctgtcagcgaagggcaaaacttttcaatcaagtgcataagcgatgtgagcaactatgacgaggtatactggaacacatccgccggaatcaaaatttaccagaggttttataccacaaggaggtacctggacggggctgagtccgttctcactgtgaagacctcaaccagggagtggaacgggacctaccattgtatcttccgttataaaaactcttatagcatcgcaaccaaggatgtcatcgtccaccctctgcccttgaaacttaatatcatggtcgatcctttagaagctactgtaagttgctcaggatcccaccatataaaatgttgtatcgaggaagatggcgactacaaggttacctttcacacagggagctccagcttacctgctgccaaagaggtgaataagaagcaggtctgctacaagcacaatttcaacgcatcaagcgtgtcctggtgttcaaagactgtggatgtatgttgccactttaccaacgccgctaataattcagtgtggagcccgtccatgaaactgaatctggtcccaggggagaacataacttgccaggaccccgtgatcggagtaggggagccgggtaaagtcatccagaagctatgtcggttctctaacgttccttcgtcccccgaatctcctataggcggtactattacttataagtgtgtggggagtcaatgggaggaaaaacgcaatgactgcatctcagcccctattaactctttgttacagatggcgaaagcactgattaaatcgccttcgcaggacgagatgctgcccacctatctgaaagacctatctatttctattgataaagccgaacatgaaatttctagcagtccaggatcactaggcgctatcattaatatactcgatctgttgtcaaccgtccctacccaggttaatagcgaaatgatgacacacgtgcttagcacagtgaacgtcattcttggtaagccagtgctgaacacctggaaggtgctacagcagcagtggactaatcaaagctcgcagctgctccactccgttgaacggttctcacaggccttgcagtcaggggatagcccgcctctgagcttctcacagaccaatgtacagatgagtagcatggtcattaagagttcacacccagagacctatcagcaacgattcgtgttcccctatttcgatttgtggggcaacgtggtgatcgacaaaagctacctggaaaatttgcagagtgattccagtattgtcacaatggcattcccaacactgcaggccatactggcacaggatattcaagagaacaactttgcagaatccctggtgatgacaacaacagtgagccacaataccacgatgcctttcaggatttccatgacctttaagaataacagcccatcagggggagagacgaagtgtgtgttctggaacttccgcttggcaaataatactggcggatgggactctagcggctgctatgtggaagaaggcgacggagacaatgttacatgtatctgcgatcaccttacctcattctccatcctcatgtcgcctgatagtccagatccaagtagtcttctggggatccttttagatattatttcgtacgttggcgtcggctttagcatattgagcttagctgcctgcttggtggtagaggccgttgtctggaagtctgtgacaaagaaccgaactagctatatgaggcacacatgtattgttaacatagccgcatcattgctggtagcaaacacatggtttatcgtagtggctgctatacaggacaatcggtacatcctgtgcaaaacagcctgcgtggccgcaacctttttcatacacttcttctatctgagtgtcttcttctggatgcttacattgggcctcatgttattttaccgcctggttttcatcctgcacgagactagcagaagtacccagaaagccattgccttctgcctcgggtacgggtgtcctttggctatttccgtgattaccctcggggcaacgcagcctcgtgaggtctatacgcggaagaatgtttgttggctcaactgggaagataccaaggccctcctcgcctttgctatcccagctctgattattgtagtcgttaatattaccattaccattgtggtaatcacaaaaatcctcagaccctcaattggtgataaaccatgtaagcaggaaaagtcatcactctttcagatttctaaatctatcggcgtcctcaccccactgctaggcctcacgtggggtttcggcctgactacagtgttccctggaactaatcttgttttccacatcatcttcgccattttgaacgtgtttcagggcttattcattcttttatttgggtgcctgtgggacttgaaagttcaggaagctctcctgaataagttctctctgagtcgctggagctcacagcactctaagtctacgtccctggggagctccacacctgtattcagcatgtcaagtcccatctccagaaggtttaataatctgttcggaaaaaccggtacatataacgtttctaccccggaggcaacatcgtcttccctggagaattcctcaagcgcctcgagcctgttaaactag

SEQ ID NO: 50424 - DNA, 2154 bp, Artificial Sequence
  Description of Artificial Sequence: Synthetic coding sequence
gattaccgttcacaggtgcatgtggagagtcgggagggcctgtggaaaatcaaaggcaagataaagaaactcgggtcaagtgagaaggtaacagagtctaagggcgaaaacattacttgccaggatcccgttattggtgtgggcgagcctgggaaagtgatccagaaattgtgccggttttctaatgttccttcttctccggagtctcccatcggaggcacgatcacatataaatgtgttggctcccagtgggaagagaagcgtaacgactgcatatctgcacccattaatagcctgctccagatggctaaggccctgattaagtccccgtctcaggacgagatgcttcctacatacctgaaggacctatcgattagcatcgacaaggccgaacacgagatctctagcagccccggatccctgggcgctattataaatatccttgacttactcagtactgtgcctactcaggtgaactctgagatgatgacccacgtgctgtcaactgtgaatgtcattctcggcaaacctgtcctcaatacatggaaggttctgcaacagcaatggaccaaccagagttcccagctgctgcactcggtggaaaggttcagccaggctcttcagagcggtgattctcctcctctgagtttctcacaaaccaacgtacagatgagcagtatggtgattaagagtagtcatcctgagacctatcagcagcgctttgtcttcccctattttgatctgtgggggaatgtggtcatagacaagtcctacctggagaacctgcagagcgactcaagcatcgtaacaatggcattccctaccttgcaggcaatcctagcccaagatattcaggaaaataacttcgcagagtccctggttatgacaacaacggttagccacaacaccacaatgccatttcgaatttctatgacgttcaagaataactcaccatcggggggagaaaccaaatgtgtgttttggaactttaggttagctaacaatacagggggatgggacagctcagggtgctacgtggaggagggggatggggacaacgtcacatgcatctgtgaccatctgaccagcttttccatcctcatgagtccagattctcccgacccctcgagcctcctggggatcctattggatatcatctcatatgtcggtgtgggcttctcaattctgtctctggcagcctgtctagtagtggaggctgttgtctggaaatcggtcacaaaaaatcgaacgagttacatgcgacacacgtgcattgtgaatatcgccgcatcactactcgtcgcgaacacctggttcattgtcgtggctgccattcaggacaatcgatatatactttgtaaaacagcgtgcgtcgccgcaacgtttttcatacacttcttttatttaagtgtgttcttctggatgctgactctcggactgatgcttttttacagactggtattcatcctgcatgaaacaagtcggtccacacagaaggccatcgcattttgcctgggctatggttgccccttggctatctctgtgatcacgctcggcgcaacccagcctcgcgaggtgtatacaagaaaaaatgtgtgttggctgaactgggaagataccaaagctctgctcgcatttgcaatacccgcattgataatcgtagttgtgaacatcacaatcacgatcgttgttattacaaagattttacgaccctctataggggataagccctgcaaacaggagaagtcatcactgtttcagatctctaagtcaataggcgtcctgacaccgcttctgggcctgacttggggattcggtcttaccaccgttttcccaggcaccaacctggtgtttcacataattttcgccatccttaacgttttccaggggctgttcattctgctctttgggtgcctgtgggatctgaaggtgcaagaggctctcctgaacaaattctccttatcacgttggtcgagtcagcactctaagtcaacaagcttagggtccagtacccctgtcttctcaatgagtagccctattagccggagattcaataatctgtttggaaagaccggcacctataacgtgtccacgcccgaagctacctcatccagcctcgaaaatagcagcagcgcgtcttctctgctgaactag

SEQ ID NO: 50425 - DNA, 2313 bp, Artificial Sequence
  Description of Artificial Sequence: Synthetic coding sequence
atggtggatcctctggaagccacagtgtcttgttctggttcacatcacattaaatgttgcatcgaggaagatggcgactacaaggtgaccttccatacgggtagttcaagccttcctgctgcaaaggaagtgaataaaaagcaggtttgctataagcacaactttaatgcttcttcagtgtcatggtgttccaagaccgtcgacgtttgctgccatttcacaaacgccgctaacaacagcgtatggagccctagtatgaagctgaacctggttccaggagaaaacatcacctgccaggatccagtaattggagtcggcgagccaggtaaagtcatccaaaaactctgtaggttctccaacgtcccctcttctccggagagccccattggcggaaccattacttacaagtgtgtggggtcccagtgggaagaaaaaaggaacgactgcatatctgctcccatcaatagccttctccagatggccaaggccctgatcaagtctccatcccaggatgagatgctgccaacatatctcaaggatctgagtattagtattgacaaagcagaacacgaaattagtagcagccccggtagcctaggcgctataatcaacatcctggacctgctatctacggtccccacacaggtcaattcggagatgatgacgcatgttctttctaccgttaatgtaatcctcggaaaacccgttcttaatacctggaaggtcttgcaacagcagtggaccaatcagtcgagccagttactccactccgtcgaaagattcagtcaggctcttcagtctggcgattctccccctctgtccttcagtcagacgaatgtgcagatgtctagcatggtaatcaagtcctctcatcccgagacctaccagcagagatttgtgtttccgtatttcgatctgtggggaaacgtggtcatagataagagttatctggagaaccttcagagcgattcaagcatcgtgacgatggccttccccacgcttcaggcaatcctggcccaggacattcaggagaataattttgcggagagcttggtgatgaccacgactgttagtcacaacacaactatgccattcagaatatctatgaccttcaaaaacaacagtcccagtggcggtgaaaccaagtgcgtgttctggaattttagactcgcaaataataccggagggtgggattccagcggatgttatgtggaagaaggggatggagataatgtgacatgcatttgcgaccaccttacaagtttcagcatcctgatgagtcccgattccccagatccatctagcctgctcggaatcctgctcgatataatcagctatgtaggcgttggtttcagtatcctctccctggcagcgtgcctagttgtcgaagcagtggtgtggaaatcggttactaagaacaggacgagctatatgagacatacgtgtattgtgaacattgccgctagcttactcgtcgctaatacgtggttcatcgtggttgcagctatccaggacaaccgctacatactgtgcaaaaccgcgtgcgtcgccgctacgtttttcattcatttcttttatctcagcgtgttcttttggatgctcactctgggtctgatgctgttttaccggctggtgttcattcttcacgaaacttcccgatctacccaaaaagcaatcgcattctgcctgggttacgggtgccctttggcaatctccgtgattaccctaggtgccacgcagcccagggaggtctatacacgtaagaacgtctgctggttaaattgggaggacactaaggccctgctggcgtttgcaattccagctctgatcatcgttgtagtaaacatcaccatcaccatcgtggtgatcaccaaaatcctgcggcctagtatcggggacaagccttgcaagcaggaaaaatccagcctctttcagatcagtaaatccataggggtgctcactcctctgcttgggctgacatggggcttcggacttacaacggtgtttcccggaactaacttggtattccacattatctttgccatcctgaacgtattccaggggctattcatactgctgttcgggtgcttgtgggacctgaaggtccaagaagccctgcttaataagttttctctttctcggtggtcctcacagcatagcaaatccaccagtttagggtcatccacacctgtgttctcaatgagctcacctataagccggagattcaacaatctgtttgggaagacggccgctcctaagatccctcccggtcacgatggtaatctggttagtggtgggtcgtcagccatttag

SEQ ID NO: 50426 - DNA, 1008 bp, Artificial Sequence
  Description of Artificial Sequence: Synthetic coding sequence
atggagtcctcgttttcattcggcgttattctcgcagtattggcttctcttattattgctactaacactttggtcgccgtagctgtcctcctgctcatacacaagaacgacggtgtttccctctgctttaccctaaaccttgcggtcgccgatacactcattggtgtggccataagtggtctgcttactgatcagttgtcatccccttcgcgtcccacacagaaaactctctgcagcctgaggatggctttcgtgacgtcgtccgcggctgcctcagtgctgacagtgatgcttatcactttcgacagatacctggccatcaaacaacccttccgctatctcaaaatcatgtccggattcgttgccggtgcctgtattgctgggctgtggcttgtctcttacctcattggatttttgcccctcggcatacccatgttccagcagactgcatacaagggccagtgctccttcttcgctgtgtttcatcctcattttgtgctgactctgtcttgcgttgggtttttccccgcaatgctcctctttgtgtttttctattgtgacatgctgaaaatcgcctcaatgcatagccagcagatcaggaagatggaacatgcaggggctatggccggagggtaccgctctccccgaacacccagcgattttaaagccctgagaacagtgtccgtactgattggatcctttgccttgtcatggactccattcctcatcactggcattgtacaagttgcatgccaggaatgtcatctgtatctcgtcctcgaacgctatctctggttactgggcgtgggcaattctcttcttaatccccttatctacgcatattggcagaaagaggtgcgtttgcagctgtaccacatggctttgggtgtaaagaaagtcctcactagcttcctgttgtttcttagcgcacgaaattgtggtcctgaacgcccacgggagagtagttgtcacatcgtgactatctcttcatctgaattcgacggctag

SEQ ID NO: 50427 - DNA, 1485 bp, Artificial Sequence
  Description of Artificial Sequence: Synthetic coding sequence
atggaggagccccagcctcctcgcccacctgcatcaatggcactgttagggagccagcacagcggagccccaagcgctgcaggtcctccaggaggtactagttctgccgctactgccgctgttctgtccttttctacagttgccaccgcagcactaggaaatttaagtgacgcctcaggtggaggaaccgcagccgcacccggtggagggggattgggcggaagtggtgccgcaagggaggcgggagcagccgtacggcgtcccctgggccctgaggctgcacctcttctgtcccacggcgcagccgttgccgcacaggccctggtgctgctcctaattttcttattatcctctctgggtaactgtgcggtgatgggagtcattgttaagcatcggcagttgcgtacagttaccaatgctttcattctttccctgagcctgagcgatctgctcacagctctcctctgcctccccgctgcctttcttgacctctttacccccccaggcggttcagcccctgccgcagcagctggcccatggagagggttctgtgcagccagcagattttttagttcttgctttggcatcgtgagcactctgagcgtggccctgatttcacttgaccggtactgcgccatcgtccgtcccccaagggagaagatcgggcgacgtagagcactgcagcttctggctggtgcatggctgaccgcactgggcttcagtttaccctgggagctgctgggagctccgcgtgagttagccgctgcccagagcttccacggttgcttataccggacctctcctgaccccgctcaacttggtgccgcattcagtgtggggcttgtcgtggcctgctatctattgccgttccttctgatgtgcttttgccactatcacatctgtaaaacggtgcgtctcagcgatgtccgcgtacgaccagtgaatacctacgctagagtccttaggttcttcagcgaggttcggacagcaactaccgtgctgataatgatagtgtttgtaatatgttgctggggcccttactgctttttagtcttattagccgctgctcgtcaggcccagactatgcaggcaccatctctgctgagtgtggtcgccgtttggttgacttgggctaacggagctatcaatcctgtgatttatgctattcggaatcctaacatctctatgctgctggggagaaaccgcgaggaaggatacagaacacggaacgtggacgcctttctgcccagtcaagggccagggctgcaggccagaagcagatcacggctgcgaaaccgatacgcaaacagactcggcgcttgtaatcgcatgagttcctctaacccagccagcggggtggctggcgacgtggccatgtgggccaggaagaatcctgtcgtcttgttttgcagagagggaccccctgaacctgtgacggcagtcaccaaacagccaaaaagtgaggccggagataccagtctctag

SEQ ID NO: 50428 - DNA, 1485 bp, Artificial Sequence
  Description of Artificial Sequence: Synthetic coding sequence
atggaagaacctcagccgccaagaccccctgcgtcaatggctctcctgggctctcagcattccggtgccccttccgccgcagggccacctggcggtacgagctctgccgcaacagccgctgttctgtcattctcaaccgttgcaacggccgcactgggcaatctgagcgatgctagcgggggaggaactgctgccgctcccggtggtggcggactgggtgggagcggagccgcaagggaagccggtgcggcagtgaggcggcctttggggccagaggcagcacccctgttgtcgcacggggctgccgtcgctgcccaagcgctggtactcctgcttatattcctgctttccagtctgggtaattgtgctgtcatgggtgtgattgtgaaacataggcagctgagaaccgtgaccaatgcctttatactgtcactgagtctttccgatctgctgactgccttactgtgcctgccggcagccttcctagacctgttcacgcctcccggaggcagtgccccagctgccgctgccggtccatggcgtggattttgtgcagccagtaggtttttctcctcctgttttgggatcgtgtctaccctgtcagtcgccctgattagtctggataggtattgtgctattgtgcggcctccacgcgaaaaaatcggcagacgtcgagcactccagctcttggctggcgcttggctgaccgctctgggattcagcctcccatgggagcttctcggtgccccacgagaacttgcagcagctcagagctttcacggatgtctgtacagaacatcccccgaccctgcccagctgggagctgcattttctgtgggactggtggtggcttgttacctgctcccgttcctcttgatgtgcttctgccattaccacatttgcaaaacagttcgcctttccgatgttagagtacggcctgttaatacatacgcaagagtgttgcgttttttcagtgaggtgaggacagccactacggtactgattatgatcgtgtttgtgatctgttgctgggggccatactgtttcctggtcctgctggcagctgcgagacaggcacagactatgcaagctcccagccttctgtctgtggtggcagtctggttgacgtgggcaaatggcgctatcaatcccgtgatctatgccatccggaacccaaacatttccatgctgcttggcagaaaccgtgaagaaggttaccgcacaagaaatgttgacgcgtttctcccttcacagggtcctgggttgcaagccaggtcaaggtccaggctcagaaatcgctatgctaaccggctgggggcatgtaacaggatgtccagtagcaacccagcctccggtgtcgcgggagatgtggccatgtgggcaagaaaaaaccctgtggtactgttttgccgtgaaggaccgccagagcccgtgaccgccgttaccaagcagccaaagtctgaagcaggagatacctcactgtag

SEQ ID NO: 50429 - DNA, 969 bp, Artificial Sequence
  Description of Artificial Sequence: Synthetic coding sequence
atggcactcctgggttcccaacacagcggcgctcctagtgctgccggacctcctgggggaacatcatccgccgctaccgcagctgtccttagcttctccacagtcgctaccgccgctctgggtaacctgagcgatgcaagcgggggtggcaccgctgccgctcccggaggcggagggttgggagggagtggcgcagctcgagaagcaggggctgccgtgcgacggcctctgggaccggaggccgctccactcctgtctcatggtgcagcagttgcagcccaggcactggtgctcctgctaatatttctgttgtcctctctgggaaactgcgccgtgatgggggtgatcgtgaaacatcgccagctccgcacagttacaaacgcctttatcttaagcctatctctcagcgacttgctgaccgccttactgtgtctgcccgctgcctttcttgatctgttcacgcctcccggaggcagtgcaccagcagcggctgctggaccctggagaggattttgcgcagcatccagattttttagctcctgctttgggatcgtgcatgcccagcgtggagcccacctcgtgggtcctctcctgcggtatcgaagacctcccagggaaaaaatagggcgtcggagagcactccagcttcttgccggagcatggctgaccgcactgggtttttctttgccttgggaactgctgggcgcacccagagagctggccgcagcccagtcttttcatggctgcctctaccgcacatcacccgaccccgcacagctgggagccgctttctctgtgggcttggtggtggcttgttacctgctgccatttctcttaatgtgtttttgtcattatcacatctgtaaaactgtgcgtctcagcgacgtgcgagtcagacctgttaatacatacgccagggtactccgcagctccgcaagatgcgcgagacccccaccgagttcctcatag

SEQ ID NO: 50430 - DNA, 1254 bp, Artificial Sequence
  Description of Artificial Sequence: Synthetic coding sequence
atggagtcaaacctctctggcctggtgccagccgctggacttgtgccagcactcccaccagccgtcactctcggtctgactgcagcctacacaacactttacgcactgctgtttttttctgtttatgcccagttatggctggtgctgctgtatggccataagcggctgagctatcagaccgtgttcctcgctttgtgcctactgtgggcagcactcagaacaacattgttctctttttactttcgcgatactccccgagccaatagactgggccctttgccattttggctactctattgctgcccagtgtgcctccagttcttcactttaactctcatgaacctgtatttcgcccaagtagtgttcaaggccaaagtgaaacggaggcccgaaatgagcaggggattattggccgtgaggggtgccttcgtaggcgcatccctgctgtttctgctggtcaacgtgttgtgtgcggtgttaagccatcgtcggcgagctcagccctgggccctgctattggtccgagtcctggtgagcgattccctgttcgtgatttgcgctctgtccctggcagcatgtttatgtttggtcgcacggcgtgctccctctacatccatctacctcgaggccaagggcacctctgtgtgtcaggctgccgctatgggtggggctatggtacttctctacgccagcagagcttgttataacctgaccgccctggccttggctccccagtcaagactggacaccttcgattatgactggtacaacgtaagcgatcaagctgatctggtcaatgacctcgggaacaaaggctaccttgtgttcggtctcatcctgttcgtgtgggagctgctgcctactactctgttagttggtttcttcagggtgcaccgccctccgcaggatctatccacatcccacattttgaatggccaggtgttcgccagtcgttcttacttcttcgatcgggcagggcattgcgaggatgaagggtgctcctgggaacattctcgaggagaatccaccaggtgccaggaccaagccgcaaccaccactgtctcaaccccaccacatcgacgcgatcctccaccgtctcccacagagtacccagggccaagtccccctcatccaagacctttgtgccaagtgtgcttgcccctactagcccaggaccccggtggacggggatatccactcttatggccagcaccctgctgttcctgccatagcgagctggtgccctcaccatag

SEQ ID NO: 50431 - DNA, 1041 bp, Artificial Sequence
  Description of Artificial Sequence: Synthetic coding sequence
atggaatcaaatctgagcggactcgtgcctgcagcaggactggtgcccgctctgccaccggctgttacactgggcctcactgcagcttacactactctgtatgcgttactcttcttcagtgtgtatgcacagttgtggcttgtactgctttacgggcacaagagattgtcctaccagaccgtgttcctggctctgtgtctgctgtgggccgcactccgcaccactctcttttcattctactttagagatacaccacgcgcaaaccgcctgggacccctgcccttctggctgctgtattgctgccccgtatgcctccagttctttaccctcaccctcatgaatctctattttgcccaggtggtgttcaaggcaaaggtgaaacgccgtccagagatgtcacggggacttttagccgttcggggagctttcgtcggggcatctctcctctttctgctggtcaatgtactgtgcgccgtgttaagccatagaaggagagcacaaccttgggcccttctcctggttcgcgttttggtgtccgacagcctgttcgttatttgtgccttgtcactagctgcttgtctctgcttagtggccagacgggctccgtctacaagtatatacctggaagccaaggctgacctcgtaaatgatctgggtaacaaggggtatctggtgttcgggttgatcctgttcgtctgggagctgctgccaaccacattgctggtcggcttcttccgcgtccaccgacctccgcaagatctgtccaccagccatatcctgaatggccaagttttcgcctccaggtcatatttcttcgacagagctggccactgtgaggacgaagggtgtagctgggagcactcacggggagagtccacctctatgtccgggagtctcggtagtggcagctggtacggcgctattggcagagagcccggatggtacgggggatcacaaaccaagaccacccctctgctgttttctcaagtgcctggtcctggcggtcaccaccactctctgtatagcactccccagacatag

SEQ ID NO: 50432 - DNA, 1428 bp, Artificial Sequence
  Description of Artificial Sequence: Synthetic coding sequence
atgctctgggcggttcgcactagatgctatgttgtgaaagcacagttaggccctacagtggccctcgagggacgcgcacctcgggctcctggtccctcttgcctcggtaatgggaactgccagagacctggacccatcaccagtcgcaacgttacccgggctagcctgcctgacatggagtcgaacctctccggcctggttcccgctgctggcctggtacccgcactgcctccagccgtgacactcggactcactgccgcatatactaccctgtacgccctgttgttctttagcgtatacgcacagctgtggctggtcttattgtatgggcacaagagactgagctatcaaaccgtcttccttgcactttgcctgctgtgggcagctttaaggacaaccttgttctccttctacttccgggacacacctagagcgaatagactagggcctttacccttctggttgctgtattgttgtcccgtatgtctgcaatttttcacacttacgctgatgaatctctactttgcccaggtagtcttcaaggccaaggtgaaaaggagacccgagatgagtcgtggtcttctggctgtcagaggcgcttttgtaggggcatctcttctgtttcttctcgtcaacgtgttatgtgctgttctgagccaccgtcggagagcacaaccttgggctctgctgcttgtgcgtgtgctggtgtccgacagcttgtttgttatatgcgcactgtcactggccgcttgtctctgcctcgtggccaggagagcccctagtacctcaatctacctggaagcgaaaggtaccagcgtctgtcaggccgcagccatgggcggtgccatggtgctgctgtatgcaagtcgtgcttgctacaacctgactgcactggccctggcccctcagtcccggctggacacatttgactacgactggtataacgtcagcgatcaggctgatctggtaaacgacctgggaaacaaaggataccttgtattcggcctgatcctcttcgtctgggagctcctgcctactactctcctggtagggttcttcagggtacacaggcccccacaggacttatccacaagtcatatcctgaatgggcaagttttcgcgagccgctcttactttttcgatcgcgcagggcattgtgaggacgaaggctgttcctgggaacacagtcgaggcgagagtacaaggtgtcaggaccaagcggcaacaactacagtaagtacaccgcctcataggcgcgaccccccaccaagtcctaccgaatatccaggtccaagccccccacaccctagacctctgtgccaagtctgtctccccctgctcgcccaggatccaggcggacgaggctatcccctgctgtggccagcaccctgctgctcatgccattcggagcttgtgccatccccttag

SEQ ID NO: 50433 - DNA, 1191 bp, Artificial Sequence
  Description of Artificial Sequence: Synthetic coding sequence
atggagagcaacctttcgggacttgtgccggctgccggtctcgtgcctgctctgcctccagcggtgaccttaggccttaccgcagcttataccaccctgtacgcactgcttttttttagtgtctacgctcagttgtggctggtgcttctgtatgggcataaacggctgagctatcagacagtgttcctggccctgtgtctcctgtgggccgctctgcggactacactgttctctttttattttagagacacacctcgcgctaatcggctgggtcctctgccattctggctgctctactgttgccctgtctgcctccagtttttcacactcacattaatgaatctgtactttgcccaggtagtgtttaaagccaaggtgaaacgtaggcctgaaatgagtcggggtttgctcgcagtgcgaggagcattcgttggggcatccctgctgttcttattggtgaatgtgctgtgcgcggttctgtctcatcgacgtcgagctcagccctgggcactgctgcttgtgagagttttggttagtgattctttgttcgtaatctgtgccttgtctttagcggcttgcttatgtctggtggctcggcgagcgccttcaacaagtatctacctggaggcaaagggaaccagcgtttgtcaggccgctgcgatgggaggcgcaatggtgttgctgtacgcttcccgtgcctgttacaatctcacggctctggctctggcccctcagtctcggttagacacattcgactacgactggtacaatgtgtcggatcaggctgatctagtgaacgacctggggaacaagggatacctggtgttcgggctgattctcttcgtttgggagctgctcccaaccaccctgctcgtgggtttcttccgcgtgcacagaccaccacaagacctgtcaacttcgcacatactgaacggccaggtgtttgcctcaagaagttacttttttgatagagcaggacattgcgaggacgagggctgctcttgggagcactcacgcggagaatccacctctatgtccggctccttgggatccgggtcctggtatggagcgatcggacgggagccaggttggtatgggggatctcagaccaaaacaacccccctgttgttttcccaggtgcccggtcccggtggccaccaccatagcttatatagcaccccgcagacttag

SEQ ID NO: 50434 - DNA, 399 bp, Artificial Sequence
  Description of Artificial Sequence: Synthetic coding sequence
atggagtcgaatttatctgggttggtccccgctgccggattagtccctgctctacctccggctgtgactttgggcctgaccgccgcttacacaactctctatgcattactctttttcagtgtttatgcccagttgtggttggtgttgttatacggacacaaaaggctatcttaccagaccgttttcctcgcattgtgtctgctgtgggcggctttgcgcacaacccttttcagtttttattttagggacacgcccagagctaaccgtctaggtccacttcccttctggctgctgtactgttgccccgtgtgtttacaatttttcactttgactcttatgaacttatactttgcccaggtggtttttaaggccaaagtaaagaggcgtccagaaatgtag

SEQ ID NO: 50435 - DNA, 504 bp, Artificial Sequence
  Description of Artificial Sequence: Synthetic coding sequence
atggaatctaacctgagcggtctggttcccgctgcgggactggttcccgcattgccacccgcagtgacactcggccttacagccgcatacaccacactgtatgcactccttttcttttccgtgtatgcacagctctggttagttctgttatacggtcataagaggctatcttatcagaccgtgttcttggctctgtgtctgctttgggctgctttacggaccacattgtttagtttctattttcgcgatacaccgagggcaaacaggttaggtccattgccgttctggctgctttactgttgtccagtttgtcttcagttcttcactctaaccctgatgaatctgtatttcgcccaagtggtgttcaaggccaaggtgaaacgcagacccgagatgagccgcggactgcttgccgtgcgcggagcattcgtcggtgcttctctgctgttcctgctggtaaatgtactgtgcgcagtcttatctcaccggcgacgtgcacaatag

SEQ ID NO: 50436 - DNA, 192 bp, Artificial Sequence
  Description of Artificial Sequence: Synthetic coding sequence
atggagtctaacctttccggactagtccccgctgcgggactggtgccggctctgccacctgccgtaacactgggcctcactgccgcatacaccaccctgtacgcattgctgtttttctcggtgtatgctcagctttggcttgtgctcctttatggccataagcgcctgtcttaccagacagtgtttctgtag

SEQ ID NO: 50437 - DNA, 663 bp, Artificial Sequence
  Description of Artificial Sequence: Synthetic coding sequence
atggaatcgaatctatcaggacttgtacccgcagctgggctagtgcccgctctgccgccagccgtgacactgggcctcaccgcagcgtacactaccctgtacgccctgcttttcttcagtgtgtatgcccagctgtggctggttctgctgtacggtcataaacgcttgagttaccagacagtatttctggctttgtgtttactttgggcagctctgcgcactacgttgtttagcttttatttccgcgacacccctcgggctaaccggctcgggcctctaccattctggttgctgtattgttgtcccgtttgtttacagttcttcacactgacactgatgaacctgtatttcgcccaggtagtcttcaaagctaaggtgaagcgtagacctgagatgagtcgcggtcttctcgctgtccgcggagcctttgtgggagcatcccttctttttttgttggtcaatgtcctctgtgccgtcctgtctcatcgtagacgcgctcaaccttgggcactgctcctcgtgagagtgctggtctccgactccctctttgtgatctgcgcactttccctggctgcgtgcctgtgtttggtcgccaggagggccccaagcacatcaatctatttggaggcaaagggaactagcgtgtgccaggccgctgcgtag

SEQ ID NO: 50438 - DNA, 963 bp, Artificial Sequence
  Description of Artificial Sequence: Synthetic coding sequence
atggaatctaacctgtcaggtctggtgcccgctgcaggcctcgtgcccgcattacctccagcggtaacattaggactgactgctgcatataccacactgtacgctctcttgttcttcagtgtgtatgcccagctctggttagtgctgttgtatggccataagagactgagctaccaaacagtattcctggcactgtgccttctgtgggcggctcttcgcaccaccttgttctctttctattttcgagacacaccaagggctaacaggctgggcccactgcccttctggctgctgtattgttgcccggtgtgcctccagttttttactttgacccttatgaatttgtattttgcccaggttgtgttcaaagcaaaagtaaagcggaggccagagatgtcacgagggcttttggcagtacgcggtgcattcgtaggggcttctctgctgtttttactggttaacgtgctctgcgccgtactgtctcacaggcgccgtgcccagccgtgggctctcttactggtacgagtactggtttcagactctctcttcgtcatttgtgccctctctctagccgcttgtctgtgcctggtggccagacgggcaccatccacgtcgatttacttggaggcaaagggcacctccgtgtgtcaggctgccgcaatgggaggcgctatggttctcctttatgcaagtcgtgcatgttataatctgaccgcgttggccttagcacctcagtctagactggacacgttcgattacgactggtataacgtgtccgaccaggccgatctggtcaacgatctgggaaacaagggatacttggtctttggactcattctcttcgtttgggaacttcttcctactacccttctagtaggattttttcgggtgcacagacctccccaggatctgtacgtgggccagtcgaggctgtgggagctcgtctggtgccaccgggcttag

SEQ ID NO: 50439 - DNA, 237 bp, Artificial Sequence
  Description of Artificial Sequence: Synthetic coding sequence
atggaatccaacctctccggcctggtgcccgctgcaggactagttcctgctctaccgcctgccgtgacacttggattaacggctgcttatactacattgtacgctctcctttttttctcagtctatgcccagctctggctcgtcctgctatatgggcacaaaagactctcttaccaaacagtgtttctggcactgtgcttgttgtgggccgctttaagaaccacccttttctcttag

SEQ ID NO: 50440 - DNA, 636 bp, Artificial Sequence
  Description of Artificial Sequence: Synthetic coding sequence
atggagtctaacctcagcggacttgttcctgccgctgggctagtccccgcattacctccagctgtcacacttggcctgacggcagcgtacaccacactctatgccttgctttttttttccgtgtacgctcagctgtggctggtactcttatatggccacaaacggctgtcgtaccagaccgtgttcctcgcactgtgcttactctgggccgctcttaggactacgctattttcattctatttccgagatactcccagggctaacaggttggggcctctgccattttggctgttgtattgttgtcccgtctgcctgcaattctttaccctcaccctgatgaatctgtacttcgcccaggtcgtgttcaaggcgaaggtgaagcgtcgccctgagatgtcccgcggactacttgctgtgagaggtgcttttgtcggggcttctctgctgtttctcttagtcaacgtcttatgcgccgtcctgagtcatagaagacgagcccagccatgggccttactgctcgttcgcgttctcgtttcagactccctgttcgtgatctgtgccctgtccctcgcggcatgcttatgtctcgtcgccggtgggaggcctccactagcctctacctggaggcctcgatag

SEQ ID NO: 50441 - DNA, 723 bp, Artificial Sequence
  Description of Artificial Sequence: Synthetic coding sequence
atggagagcaacttgagcggcttggtccctgcagccggattggttcctgccttgcctccagccgtcactctcggcctaactgcagcctacaccacattgtatgccctactgtttttcagtgtctacgcccaactctggctggttctgttatacggccacaagcgactcagttatcagaccgtttttttggccctctgccttctgtgggccgctttgaggacaacattgttttctttttacttcagagacacaccccgtgccaatcgccttggccctctcccattctggctattgtactgttgccctgtgtgcctgcagttcttcacactgacgttgatgaatttgtacttcgcgcaggtcgtgttcaaggcaaaggtgaaacgaagacccgagatgtctcgaggcctgctggccgtgcggggtgctttcgtgggagcttccctgttatttctgctggttaatgtactctgtgcagtgttgagtcatcgcaggcgggcacaaccttgggctttactgctggtcagggtcctggtgagcgactccctgttcgtaatatgcgccttatcgctggcagcttgtctgtgtttggtggcgagaagagcgccatccaccagcatctatctcgaggcaaaaggtacctctgtttgtcaggcggctgccatggggggtgctatggtcctcctatatgcctctagagcctgctataaccttaccgctctgtag

SEQ ID NO: 50442 - DNA, 702 bp, Artificial Sequence
  Description of Artificial Sequence: Synthetic coding sequence
atgagacccgagcgccctagaccacgcggatccgcgcctggtcccatggaaacacctccttgggatccagctcgaaatgattccttgcctccaacactgacgccagccgtcccaccatatgtgaagctcggtctaactgtcgtgtacacagtcttttacgccctcctgttcgtgtttatctacgttcaactctggctcgtgctccggtacagacataagcgcctgtcctaccagtctgtgttcttgttcctttgcctgttttgggcctccctaaggaccgttctgttcagtttctacttcaaagattttgtggccgctaactctctttcaccttttgtgttctggctcctttactgttttcccgtgtgtctccaattttttacacttaccctcatgaacctgtacttcacccagggatcgtcagtatgccaagttaccgccattggggtgacagtgattctgctttacaccagccgcgcttgttacaacctcttcatcctcagtttcagccagaacaaatcagtgcactcattcgactatgattggtacaatgtctccgatcaggtgtccggaggggctgaggaggtcagcccagaccagggcttgctcgtgagcagcaggcattggtttcaagaccccaggaaataccaaaatttggatgcgcaagtgccggatatcaaatggtgcagtatctgtatctag

SEQ ID NO: 50443 - DNA, 1200 bp, Artificial Sequence
  Description of Artificial Sequence: Synthetic coding sequence
atgcggccagagcgcccaagaccaaggggatcagccccaggacccatggaaaccccgccatgggacccggctaggaatgattcactgccaccaacccttactccggctgtgccaccttacgtgaagttaggactcacagtggtttacactgtgttttacgcgttgctgttcgtgttcatctacgtgcaactctggttggtcctgaggtatcgccacaagcgcctgtcataccagagcgtcttcttgtttctgtgcctcttctgggcctcattaagaactgtgctcttcagcttctattttaaagatttcgtcgctgcaaactccctgagccctttcgtgttttggctgctctattgctttcccgtatgcttacagttcttcactctgactctcatgaatctgtactttacacaagtgatctttaaggccaagtcaaagtattcccccgagctgctgaaataccgcctccccctgtatctcgcatcactgtttataagcctggttttcctgctggtaaatcttacctgtgccgtgctagtgaagaccggcaactgggagcggaaagttattgtgtcagtgcgcgtcgccattaacgatactttatttgtgttgtgtgccgttagtctttcaatatgcctctataagatcagtaagatgagcctcgcaaacatttatttggagagtaaaggaagtagtgtgtgccaagtcacagccattggagtgacggtgatcttgctgtacacatctcgggcatgctataatctgtttattctctccttttcacagaataaatcagtgcactcattcgattacgactggtataatgtgagtgaccaagctgaccttaagaatcaactgggcgatgcaggctacgttctgttcggagtggtcctctttgtctgggaacttttacccaccaccctggtagtctactttttccgagttaggaatccaaccaaggacctgacaaatccaggaatggtcccttctcacggattttccccacgttcatacttctttgacaacccacggcgatacgactctgatgatgacctcgcatggaatattgcccctcaggggctacaagggggatttgcccctgactattacgattggggccagcagactaactcgttcttagcccaggccggaactcttcaggactcaacgcttgacccagataaaccaagtctgggctag

SEQ ID NO: 50444 - DNA, 1197 bp, Artificial Sequence
  Description of Artificial Sequence: Synthetic coding sequence
atgagaggcgacccacgtccaagaggctccgccccaggacccatggaaacccccccttgggaccccgctaggaatgactcactgccaccgacactgacacccgctgtgccaccatacgtcaagctaggcctcactgtggtgtacacagttttttacgccctcctattcgtgtttatttatgtgcaattgtggttggttctgcgataccggcacaagagactctcatatcaatccgtttttctattcctctgtttattctgggcgtccctcaggactgtgctgttctctttctactttaaggacttcgtggcagcaaattccctgtctccttttgttttctggcttttgtattgcttccccgtgtgcctgcaattcttcaccctgaccctcatgaacctgtacttcactcaggtgatcttcaaagccaagtctaaatactctcccgagctgttgaaataccgactgcctctttatctggcatcactctttatatctttggtgtttctcttagtgaacttaacttgcgccgttctggtcaaaacggggaactgggagcgaaaggtgattgtgagcgtgagagttgcaatcaatgacacacttttcgtgctctgtgcagtcagcctgagcatttgcctgtacaagatttcgaagatgtccctcgccaacatctatctcgagtccaaaggtagctccgtttgtcaggtgaccgccatcggcgttacggtgatcctgctatacacttctagagcatgctataatctttttatcctttccttctctcagaataagtctgtgcatagtttcgattatgactggtacaatgtcagtgatcaggccgatctgaagaaccagttgggagatgccggatacgtactgttcggcgtggtgttgtttgtgtgggagctgttacccacaaccttggtcgtgtacttctttagagttcgcaatcccacaaaagatcttacaaatccgggaatggtccctagccacgggttcagtcccagatcatatttttttgacaaccccagaaggtacgattccgatgacgatctcgcttggaacattgccccacaggggttacagggcggatttgcgcctgactactacgattggggacaacagacaaacagttttctcgcacaggctggtactttgcaggatagcacactcgatcccgacaaaccatcactgggatag

SEQ ID NO: 50445 - DNA, 387 bp, Artificial Sequence
  Description of Artificial Sequence: Synthetic coding sequence
atgagcctggcgaacatttacctggagtccaaaggctcctcagtctgccaggtgaccgccattggtgttaccgtgatactgttatatacctcccgcgcatgctacaatctctttattctgtcttttagccagaacaagagcgtccattctttcgactatgactggtacaacgtttcggaccaagccgacctgaagaaccagctgggcgatgctgggtacgtgctgtttggggtggtgctgtttgtctgggagttactgcccacgacactggtggtctacttcttccgggtgcggaacccaacaaaagatttaaccaaccccggtatggttccgagccatggctttagccccaggtcatatttctttgataaccctcgtaggtactag

SEQ ID NO: 50446 - DNA, 693 bp, Artificial Sequence
  Description of Artificial Sequence: Synthetic coding sequence
tagcaggtgatctttaaggcaaagagcaagtatagtcccgaactgcttaagtataggctgccactctacctggccagcctctttatatccctggtgttcttgcttgtcaacctgacctgcgccgtgctcgtaaagacaggtaactgggaaagaaaggtcattgtcagcgtgcgcgtcgccataaacgacaccctgtttgtactctgcgccgtgtccctgagtatctgcctgtacaaaatctctaagatgtccctggctaatatttatctagagtccaaaggttcctctgtttgccaggtaacagcgataggcgtgaccgttatcctgctgtatacttcaagggcatgctataatctgtttatcctgtcattcagccagaacaagtccgtccactccttcgattatgattggtataatgtgagcgatcaggcagatctgaaaaatcagctgggagacgcaggatatgtgctcttcggcgtggtacttttcgtgtgggagctgctgcccacaactctggtagtgtatttcttccgagttcgtaaccctaccaaggatctcacgaaccccggtatggttccaagccatgggttcagtccccgaagctacttttttgacaacccacgtcgatacgacagcgacgacgaccttgcgtggaacattgctccacaggggcttcagggcggactgctgtag

SEQ ID NO: 50447 - DNA, 1290 bp, Artificial Sequence
  Description of Artificial Sequence: Synthetic coding sequence
atgagggtttccgtgcccggtccggcagccgcagctgcacctgcggctggtcgcgagcccagtacaccaggtggcggttcagggggtggcggagcagttgcagcggctagcggagccgctgtacccggttcagtccagctggccttatctgttttacacgcacttctgtatgcagctctattcgccttcgcttatttgcagctttggagactgctgctgtacagagagcgccgactgtcctaccagtctctgtgtctttttctctgcttgctgtgggccgctctgcgaacaaccttgttcagtgccgctttctctcttagtggtagcctgcccctgttgcgcccacccgctcacctgcatttctttccacactggcttctctattgctttccctcttgcctccaattctccacgttgtgcttactaaacctctacttggctgaggtgatctgcaaggttcggtgtgctacagaactggatcggcacaagattcttttgcaccttggcttcatcatggcatccctactttttttggtcgtgaacctgacctgcgccatgctagtgcatggtgacgtaccggagaaccagcttaagtggaccgtctttgttagagctctcatcaatgactcattatttatcttgtgcgccattagtctggtatgctacatctgtaagatcactaagatgtcaagtgcaaacgtgtatttagagtctaaaggaatgtcactgtgtcagactgtggtggtgggcagtgtggtaatcttattatacagcagtagggcctgttataatcttgtggttgtgaccatctctcaagacacgttggagagtccctttaattacggatgggataacctatccgacaaagcccatgttgaagatatatccggagaagaatatatcgtgttcggcatggtcctgtttctttgggagcacgtacccgcatggtcggttgtcctgttcttcagggcccaacggttgaaccagaacctagccccagccggaatgatcaattctcattcttattcatctcgcgcatattttttcgataacccaagacggtacgactctgacgatgacctcccacgcctcggcagttcccgagagggatctctccccaactcgcagtctctgggctggtacggaaccatgacaggctgtgggagctctagctacacagtcacaccccacctgaacggcccaatgactgataccgcaccgcttctgttcacctgctccaatcttgatcttaacaatcatcacagtctgtacgtcactccacagaactag

SEQ ID NO: 50448 - DNA, 1062 bp, Artificial Sequence
  Description of Artificial Sequence: Synthetic coding sequence
atggaacatacacatgcccatctggcagctaacagttcgctgtcctggtggtcaccgggaagtgcctgcggactcgggttcgtgcccgtggtgtactattctctccttttgtgcttaggcttgcccgctaatattctgaccgtcatcatactctcccagctagtcgcacgcaggcagaagtctagctataattacctgcttgcccttgccgctgctgacatcctggttctcttcttcatcgtcttcgtggattttctcctggaggacttcatcttgaacatgcaaatgccacaggtgccagataagatcattgaggtgttagaattcagttccatccatacttccatctggataaccgtgcctctcaccattgatcgctatattgccgtgtgccaccctctgaagtatcacactgtctcctaccctgcacgaacgaggaaggtcattgtctccgtttatatcacctgtttcctgacttctatcccatactattggtggcccaatatctggaccgaagactacataagcacaagcgttcatcatgtacttatatggattcactgctttactgtgtacctggtgccatgttcaatcttttttattctgaacagcatcatcgtgtataaactgagacgtaaaagtaacttcagactgcggggatattcaacaggcaaaactacagccatcttgttcacaattacttccattttcgccaccctgtgggcccctagaattattatgatcctgtatcatttgtatggggcaccaattcagaatcgctggttagtgcatataatgagcgacatcgccaatatgctggccctgctcaatactgctatcaatttttttctctactgtttcatttcaaagcggtttcgaactatggctgccgctacattaaaggcgtttttcaaatgccagaaacagcccgtccaattttacaccaaccataatttttcgataacttcctctccgtggatctcaccagcaaatagccattgtattaagatgcttgtgtaccaatatgacaagaacggaaagcctattaaggtatcgccttag

SEQ ID NO: 50449 - DNA, 1062 bp, Artificial Sequence
  Description of Artificial Sequence: Synthetic coding sequence
atggagcacacccatgcacacttggcagcaaatagttcgctgagctggtggagccccggttccgcttgtggactggggttcgtacccgtggtgtattattcgctgctgttgtgtctggggttgcccgctaacatcctaactgtgattatcttgtctcagctggtggcccgacggcaaaaatcctcatacaattacttactagcactcgccgctgccgacatcctggtgctgttcttcattgtcttcgtggatttcttactggaggactttattctgaacatgcagatgccccaggtgcctgataagatcatagaggtactggagttctcttctatccatacttccatatggataactgtgcccctcaccatagaccggtatattgcagtgtgtcatcctcttaaataccatacagtttcctacccggctcgtacacggaaggtgattgtgtccgtgtacataacatgctttctcactagtatcccgtactactggtggcccaatatctggacggaggattacatttctacatcagtccaccacgtgctgatctggattcattgttttaccgtgtatttagtgccttgttcaattttttttatcctgaactctatcattgtatacaagctcagacggaaaagtaatttcagactgcgcggatactcaacagggaagacaacggccattctattcactattacatctattttcgcaacactatgggcacccagaatcatcatgattctatatcacctatatggggcacccatacagaatcggtggctggttcatattatgagcgatatcgctaatatgctcgcattgctgaacaccgccattaatttttttctttattgttttatctccaagcgctttcggacaatggccgcagcaacactgaaagcattcttcaaatgtcagaagcaacccgtgcagttctacaccaaccacaattttagcatcacctcatccccctggatttccccggcaaactctcattgcatcaagatgctagtctatcagtacgacaaaaatggcaaacccattaaggtaagtccatag

SEQ ID NO: 50450 - DNA, 918 bp, Artificial Sequence
  Description of Artificial Sequence: Synthetic coding sequence
atgcctggccacaacacctctaggaactcttcatgtgaccccatagtcaccccccacctgatctctttgtactttatcgtcttaataggcggtctcgttggagtgatcagcatcctctttctcttggtcaagatgaatactcgttccgttacaaccatggctgttatcaatctcgtcgtcgtgcattctgtatttctcctcactgtgccatttcgtctcacttacctcatcaagaaaacctggatgtttggcttgccattctgtaaattcgtgagcgctatgttgcacatccacatgtatctgactttcctgttttatgtcgtgatcctggtcacccggtatcttatcttttttaagtgtaaagacaaggtggagttttataggaagctgcacgccgtagcagctagcgccggtatgtggacattggtaatagttatcgtggtccccttggttgtatccagatacgggattcatgaggaatataatgaggaacattgcttcaagttccacaaggagctcgcttatacctacgtcaaaattataaactacatgatagtgatctttgtaatcgccgttgcagtgattttattggtgtttcaagtgtttatcatcatgctgatggtacagaaactgaggcattcactgctgagccaccaggaattttgggctcagctgaaaaacttattctttattggggtgattctcgtctgttttcttccttaccagttttttcgtatctactatctgaacgtggttactcatagcaatgcctgcaacagcaaggtggccttttacaatgagatattcttgtctgtgactgctatcagttgctacgacctcctcctattcgtgtttgggggatcacattggtttaagcagaagattatagggttatggaattgcgtgctgtgccgctag

SEQ ID NO: 50451 - DNA, 918 bp, Artificial Sequence
  Description of Artificial Sequence: Synthetic coding sequence
atgcctggccataacacgagcagaaattcgagttgcgatcccattgtcactcctcatctgatctctttgtatttcattgtacttatcggcggactcgttggcgtaatcagcatcttgtttttgctcgtgaagatgaataccagatcggtgacaacaatggctgtgatcaatttggtggtggtgcactccgtatttctgctgaccgtaccattccggctgacttatctcatcaaaaaaacatggatgttcgggctacccttctgcaagttcgtttctgccatgttgcacattcacatgtatttgacattcctgttctacgtcgtgattctcgtcactcgctacctgatctttttcaagtgcaaggataaggtagaattctacaggaaacttcacgctgtggccgcatccgccggaatgtggaccttagtaatagtgatcgtcgttcccctggtcgtttcaagatatggcattcacgaggaatataacgaagagcactgcttcaaattccacaaggaactggcatacacttacgtgaagattatcaactacatgatagtgatctttgtcatcgctgtggccgttattttgctggtgtttcaagtgttcataatcatgctcatggttcaaaagctgagacacagtctgctttcacaccaggaattttgggctcaactgaaaaatctgttcttcatcggggttatcctggtttgtttcttgccgtaccagttcttccggatctactatctgaacgtggtcactcacagtaatgcttgcaacagcaaggtcgcattctataatgaaatatttctgtcagttaccgccataagctgttatgacctactgctcttcgtctttgggggtagtcactggttcaagcaaaaaattattggcctttggaattgcgtactctgtcgctag

SEQ ID NO: 50452 - DNA, 315 bp, Artificial Sequence
  Description of Artificial Sequence: Synthetic coding sequence
atgccaggacataatacttcccgcaattcttcttgtgatcccatcgtgactcctcacctgatcagcctgtacttcatcgtgctcattggaggactggtgggcgtaatttccatcctgttccttctcgtgaagatgaacacacgcagcgtgacgaccatggcagtgatcaatctcgtggtcgtccatagtgtgttcctactgacggtccccttccgtctgacctacctgatcaaaaaaacttggatgttcgggctaccattctgcaaattcgtgtccgcaatgctccatatccatatgtatcttacatttctctag

SEQ ID NO: 50453 - DNA, 1389 bp, Artificial Sequence
  Description of Artificial Sequence: Synthetic coding sequence
atgtccattatgatgctgccaatggagcagaaaatccagtgggtaccaacctcccttcaggatatcacagccgtgttggggactgaagcctatactgaagaagacaaatccatggttagccacgcccaaaaatcccagcactcttgcttgtcacatagtcggtggctgcggtcgccccaggtaaccggagggagttgggatctgagaattcgcccatccaaggattcgagtagcttcaggcaggcgcaatgcctccggaaagaccctggcgcaaacaatcacctggaaagccaaggcgtgcggggaaccgcaggcgacgcagatagagaactgaggggaccctccgagaaggccaccgctggccagcctcgagtgaccctgttaccaactccacatgtcagcggactgtcacaggagttcgaatcacactggcctgagatcgcagagcgatccccttgcgtggcaggcgtaattccagttatctattattccgtcctgctgggtctgggcctgcctgtgtctctcttaacagccgtggcattagccaggttggctaccaggacacgccgaccctcatattactatcttctcgcattgacagcctcagacatcattattcaggtcgtaatagtgttcgcagggttcctgctgcagggcgctgtcctggcaagacaagtgcctcaagctgtggtccgcacagcaaacatcctggagtttgccgcaaatcacgcatctgtgtggatcgccattctcctaaccgtcgacaggtatacggccctttgccaccccttgcaccaccgggcagctagctcccccggacgcactcggagggctattgctgctgtgctttctgctgccttgttaacagggataccgttttactggtggcttgatatgtggcgggataccgacagtcccaggactctggacgaggttttgaagtgggcccactgcttgaccgtgtacttcatcccatgcggagtcttcctggtgaccaactctgccatcatccaccgtctgcgacgtagagggcgaagcggtttacagccacgcgtcggaaagtcaaccgcgatactcttggggataacgaccctctttacactgctttgggctcctcgagttttcgtaatgctgtaccacatgtatgtggcccctgtgcaccgggactggcgagttcatcttgccctagacgtcgctaatatggtcgcaatgctccatacagctgcaaactttggcctctactgtttcgtttccaagactttccgcgctaccgtccgtcaagttattcatgacgcatatcttccctgcaccctcgccagccagccagaaggtatggcggcaaaacctgtgatggagcccccaggactgcccaccggagcagaagtctag

SEQ ID NO: 50454 - DNA, 2892 bp, Artificial Sequence
  Description of Artificial Sequence: Synthetic coding sequence
atggatgctccttggggggcaggggagcggtggttacacggtgctgccgttgatcgatccggcgtgtctctcggaccaccaccaacgccccaagtaaaccaaggcactttaggtccccaggtagcccctgtcgcagccggtgaggtggtcaaaaccgcagggggtgtctgtaagttctccggccagcgactttcgtggtggcaggcccaggaatcttgcgaacagcaattcggacacctagccctgcaacctccagatggcgtactcgccagccgcctgagagatccagtgtgggttgggcagagggaggcacccctgaggaggccaccccagagaagggcaaggaccaccgctgtgctggtgttcgacgaacggactgccgaccgggcagccaggttgcgaagccccctccccgaactcgcagctttgaccgcgtgtacacatgttcaatgggattgtgcaagtcctgaccccgctgctctgttcagtgtggccgctcctgcgttgccgaatgctttacagttgagggcgtttgcggagcctgggggagtcgtgcgggctgctcttgttgtgcgaggtcaacatgccccatttttagctgcctttagagccgacggccgatggcatcacgtctgcgctacatgggagcaaagggggggtagatgggctcttttcagcgacggcaggcggagagctggtgcaaggggccttggtgccggacaccccgtgccaagcgggggtatccttgtgctgggccaggaccaggactccctgggaggcggattctctgtccgacatgcactcagtgggaatctcactgacttccacctgtgggcacgggctctcagcccagctcagttgcacagagctagagcttgtgcacctccaagcgaggggctcctgttcagatgggaccccggtgctctggacgtgacccctagcctcctgccgactgtttgggtgagactcctctgtcccgtccccagtgaggagtgccccacctggaaccccggacctagatcagaaggttccgagttgtgtctcgagccgcaaccttttctctgctgttaccgcactgaaccatatcggcgtctgcaggatgcccaatcttggcctgggcaggatgtgatctccagagtgaacgcactggcaaacgatattgtcctcctgccagaccccctgagcgaggtccatggagccctcagccctgctgaggcaagtagcttcctggggttgcttgagcacgtccttgcaatggagatggctccactggggcctgctgccctgctggccgtcgtgcggtttctgaaaagagtggtggccttaggtgccggagatcccgagctattgctgaccggaccctgggaacagctgtctcaaggggtggtatcggtcgcttccctggtgttggaggagcaggtggccgatacgtggctctctctgcgggaggttattgggggacctatggcccttgttgcctctgttcagcgcctggcacctctgctgagcaccagcatgacaagcgagcgacccaggatgcgcatccaacacaggcacgccggattaagtggcgtcaccgtcattcacagctggtttacttccagagtgttccagcacactctggagggaccagatcttgaaccccaagcaccagcctcatccgaggaggctaaccgcgtgcaacgctttctctccactcaggtggggagcgctatcatttcaagcgaggtgtgggacgtgaccggcgaagttaacgtagccatgacgtttcacctgcagcatagggcacagtcacccctgttcccacctcaccccccttcaccctatactggcggagcctgggcgacaaccggatgctcggtggctgctctgtacctcgacagcaccgcttgtttctgcaaccattcaacgtcctttgcgattctactgcaaatctacgaggttcagagaggcccagaagaagaatccctactaaggactttgagctttgtcggatgcggcgtcagtttctgcgcccttactaccactttcctgttgttcctcgtcgccggagttccaaagagcgaaagaaccacggtgcataagaatcttacattctctctggcatcagccgaaggctttctgatgacatctgaatgggctaaggccaacgaagtcgcatgcgtagccgtgacagtggcgatgcattttttgttcctcgttgcgttctcatggatgttggtcgagggactgctgctgtggaggaaggtggtggctgtaagcatgcaccccggaccaggcatgaggctgtaccacgctaccgggtggggagttccagtgggcatcgttgctgtcacactggcgatgctgccgcatgactatgttgctcccggtcactgttggcttaatgtgcacaccaatgctatttgggcgtttgtcggacccgtgctgtttgttcttaccgccaacacctgtatcctggcacgggtggttatgattacagtcagtagcgcgaggagacgtgcaagaatgctgtcaccacaaccttgccttcagcagcaaatctggacccagatttgggctactgtcaagccagtgctcgtgttgctgcccgtccttggactgacttggcttgctggtattctggtgcaccttagtcccgcatgggcctatgcagctgttggtcttaatagcatccaaggactatacatttttctcgtttacgcagcgtgcaacgaagaagtgaggagcgccctgcagagaatggctgaaaaaaaagtggcggaagtcctgagagccctgggcgtctgggggggtgctgctaaggagcattccttgcccttcagtgtgctgcccctttttctccctcctaaaccatccactccgcgacaccctttgaaggcccctgcatag

SEQ ID NO: 50455 - DNA, 1104 bp, Artificial Sequence
  Description of Artificial Sequence: Synthetic coding sequence
ctgactgatttccatctttgggctagggcgctgagcccggctcagttgcacagggccagagcttgcgcaccccctagtgaaggacttctgtttaggtgggaccctggtgccttggatgtgacacccagtcttttgcctactgtctgggtcaggctgttgtgtccagaaccttataggcgcctgcaagacgcccagtcttggccgggacaagacgtgatctcccgagtgaacgccctcgctaatgatatcgtccttcttcccgacccgctttccgaagttcatggcgcacttagccccgcagaggcgtcttcttttctgggcctcctagaacacgttttagccatggaaatggcaccacttggacctgccgcactactggcagtggttaggtttctaaaacgagtggtcgctctcggtgctggtgaccccgagctgttactaactggcccttgggaacaattgagccagggcgtcgtctcagttgccagccttgtgttggaagagcaggtgattggagggccaatggccctcgtggcctcagtgcaaaggctcgccccactgcttagcaccagcatgacgtctgagcgacccagaatgaggattcagcaccgccatgcaggcttagaagtgaggagcctgcggctccgcgaagcctcaactcggggatgtctttttacaatgccaggcggaaggccagaaggccctggtcacattcatattcccgcaagcgaagtacgtagattactccgcaagggcctaagcggtgtgaccgtgatacactcttggttcacgagtcgagtgtttcagcacactctcgagggacccgacttagaaccacaggccccagcctcgtctgaggaagcaaacagagtgcagaggtttctttcaacacaggtagggagcgccatcatctcatcagaagtgtgggatgtcactggtgaagttaacgtagcaatgacatttcatttgcagcaccgcgcacagccaatttacagaggctgcctaggacatcaccgcctcctgcgcggatgccccgtgccgggactacacagactgttactgcagcctcaacaccaactatgtcatccggcagcaaacttatag

SEQ ID NO: 50456 - DNA, 393 bp, Artificial Sequence
  Description of Artificial Sequence: Synthetic coding sequence
tctggcggtatcttactggacgctggcggaggggcagctgccgtagaagaggggggatcttgtgagcacgcacctggcccacggcacgccgctctgccaagacacagactgggtgcgaccgtgaaacccgttttggtgctcctgccggtgctcgggctcacctggctggccggtatactggttcacctgtcccccgcatgggcgtacgctgccgtcgggctaaactctatccagggcctttacatctttctggtgtatgccgcttgtaacgaggaagtccgctcagctctgcaaaggatggcagaaaaaaaggtggcagaggggcctatggcgctagaactgccgcagcattctcccccattacagaccagacgcgaccgtttgtggaactag

SEQ ID NO: 50457 - DNA, 105 bp, Artificial Sequence
  Description of Artificial Sequence: Synthetic coding sequence
atgcacccccctccatcattgctgagttttttggcccctgttgcagccggagaggtcgttaagaccgcagggggagtgtgtaagttctcggggcagagactctag

SEQ ID NO: 50458 - DNA, 1002 bp, Artificial Sequence
  Description of Artificial Sequence: Synthetic coding sequence
atgtggagttgcagttggtttaacggaaccggcctggtcgaggagttgccagcatgccaagacttacaactaggcttatccttgctatcccttctgggcctggtcgtgggggtgcccgttggcctgtgttataacgcccttctagtcctggccaacctgcactctaaggcatcaatgactatgcccgacgtgtatttcgtgaacatggctgtggcagggttagttctgtcagcgctggcccctgtacacttactgggtcctcccagcagtaggtgggctctgtggagtgtggggggtgaggtccatgtcgctctgcagatccccttcaacgtatcctcactggttgccatgtatagcacagcactgctctctctggatcattacattgagcgtgcattgccgcgtacttatatggctagcgtttacaatacccgacacgtctgcggctttgtctgggggggtgctctcttgacatccttctccagcctccttttctatatctgtagccatgtttcaacccgcgctcttgagtgcgccaagatgcagaacgcagaggcagcagacgcaaccctggtgttcatcgggtatgtcgtgccagccctggccactttgtacgccctggtgttgctgtcccgagttcggcgagaggacacacctctggacagggataccgggcgtctggaacctagcgcccatcgcttactcgtggccaccgtgtgtacccagtttggcttgtggactccgcattaccttatcctcctggggcacaccgtcataataagtcgcggtaaaccagtcgatgctcattacctgggtctgctccattttgtaaaggactttagcaagctgctggcgttttcctcttccttcgtgaccccactcctgtatcgctatatgaaccaaagttttccgtcaaagttacagcgtctgatgaagaagctgccttgcggagaccgccactgttctccggatcacatgggagtccagcaagtcctggcgtag

SEQ ID NO: 50459 - DNA, 1002 bp, Artificial Sequence
  Description of Artificial Sequence: Synthetic coding sequence
atgtggtcatgcagctggtttaatggcactggtctcgtggaggagcttccagcctgccaagatctgcagctcggactgagcctactatctctccttggactggtggtgggggtcccagtcgggttgtgttacaacgctttactcgtactagccaatctgcattcaaaagcatctatgactatgcctgatgtgtacttcgtcaacatggctgtagccggattagtcctaagtgcacttgctccagtgcacctgctggggccaccatcgagccgctgggccctatggtcggtgggaggggaggttcacgtcgccctacaaatacccttcaatgtgtcctccttggttgccatgtattcgacagccctgttatctctagaccactacatcgaaagagccctgccacgtacttatatggccagcgtgtacaatacaagacatgtatgcggatttgtgtgggggggagccctgttgacaagcttttcgtctctgttgttttatatttgttcacacgttagcacgagggcactcgagtgcgctaagatgcagaatgccgaggccgctgacgcgaccttggtcttcatcggatacgttgtgcccgctctggcaaccttgtacgcgctcgtgctactgagccgcgtccgacgcgaggataccccattagaccgagataccggtaggctggagccctcggcacacagactgttggtggctacagtgtgtacgcagttcggtctgtggactccccactatctgatcctcctgggtcacacagtgattatttcaaggggcaagccagtggacgcgcactacctcgggctcctgcacttcgtaaaagattttagcaaactactggccttctcatcatcatttgttacacctcttttgtatcggtatatgaaccaatcattcccgtctaagttacagcggttaatgaaaaagcttccctgtggcgatcggcattgcagtccggaccatatgggggttcagcaggtacttgcatag

SEQ ID NO: 50460 - DNA, 948 bp, Artificial Sequence
  Description of Artificial Sequence: Synthetic coding sequence
atgtggtcctgttcctggtttaacgggaccggcttagtcgaggagttacctgcatgccaagatcttcagctcggcctgtccctcctgtctctgctaggcctcgtcgtgggggtgcccgtgggcttatgttataatgcgctgctcgttttggccaatcttcatagtaaagccagtatgactatgccagacgtctacttcgttaacatggcggttgccggactggtgcttagtgcactggccccagtgcatctgctggggccaccttcttctaggtgggccctgtggtccgtgggaggagaagtgcacgttgccctgcaaatcccttttaatgtttccagtttggtggcaatgtattctactgcactgctgtcccttgatcattatatagaacgcgcactgccacgcacatacatggcctccgtgtataatacaagacacgtgtgtggatttgtgtggggtggcgcactgctgacctctttcagctcactgctattctacatttgttcccatgtgagcacgagagcgctggagtgcgccaagatgcagaacgccgaagcggctgacgcgacactggtttttattggatacgtagtcccagctctagctactctctacgcacttgtgttgctgagcagggtgagaagggaggacacgcctctggacagggacacaggaaggctagagccgtcggcccacagactcttggtagcaaccgtttgcactcagtttggcctgtggactccacactatctgattttgctgggacacacggttatcattagtcgcggaaagcctgtggacgctcactacctaggtctgctccatttcgtcaaagatttctcgaagctgttggctttctcttcaagtttcgttactcccttgctataccgctatatgaaccagtccttccctagtaagctgcaaaggctcatgaaaaagctaccctag

SEQ ID NO: 50461 - DNA, 756 bp, Artificial Sequence
  Description of Artificial Sequence: Synthetic coding sequence
atgctcctcggaccaccatccagtaggtgggccctgtggtccgtcggaggcgaggtacacgttgcactgcagatacccttcaatgtgtcctcccttgtagccatgtacagcaccgcgctgttgagcctcgaccactatattgagcgggctctgcccagaacctacatggcaagtgtgtacaatactaggcatgtatgtggttttgtttggggcggtgctcttcttactagcttctctagtttactgttttatatctgcagccacgtctcaacacgggctctggagtgtgccaagatgcaaaatgctgaagcagctgacgccacccttgttttcattggttacgtggttcccgcacttgctacgctttacgccctcgtcctgctgtcaagggttcgaagagaagatactccgcttgaccgcgatactggaaggctggaaccaagtgcgcacaggctgctggtagcgactgtctgcacacagtttggcctctggaccccccattatctcatactgctgggacacaccgttattattagtcggggaaagccagttgacgcccattacctgggactcctgcacttcgtaaaggacttctcaaagctactcgcattttcgagtagtttcgttactcctttactgtacagatacatgaaccagtcctttcctagcaagctccagagactgatgaaaaagctgccctgcggcgaccggcactgttccccagatcatatgggtgtgcagcaggtgctcgcatag

SEQ ID NO: 50462 - DNA, 1044 bp, Artificial Sequence
  Description of Artificial Sequence: Synthetic coding sequence
atgggagacgaacttgcaccctgcccggtgggcactactgcatggcccgctctgattcagctcatcagcaaaacgccttgtatgccccaggctgctagcaatacatccttaggacttggcgacctgagggtaccaagttcaatgctgtattggctttttctgcctagctcactgcttgccgcagcaactctggctgtgtctccacttcttttagtgacaatcctacggaatcagcgactgcgccaggaaccccactacctgctccctgccaatatcctgctgtcggatctggcctatatcctgctgcacatgctcatcagctcgagctccctgggaggatgggaactcgggaggatggcctgcgggatcctaacagacgccgtattcgctgcatgcacctccacgatcctttcattcactgccatagtgctccacacctacctcgccgtcatccaccctctgagatatctctcctttatgagtcacggcgctgcatggaaggccgtggcgttgatctggttagtggcatgctgtttccccacttttttgatttggctgtctaaatggcaagatgcccaactggaggagcagggcgcatcctacattttgccgccaagcatgggtacccaacccggatgtggtctgttagtgatcgtcacctatacatcaatcctgtgcgtgcttttcctgtgtacagcactcatcgcgaactgtttttggaggatctacgccgaagccaaaacctctggaatttggggccaaggctattccagggccagaggaaccctgttgattcattccgtcctgattactctttatgtgtctacgggtgtggtttttagcctggatatggttctgacaaggtatcaccatattgattcaggcacacacacttggctcctggctgcaaattcagaggttctaatgatgttacccagggcgatgctcacgtatttatacctcttgcgctatcgccaattgctcggaatggtacgcggtcatctgccgagtcgtcgccaccaagccattttcactatcagttag

SEQ ID NO: 50463 - DNA, 2196 bp, Artificial Sequence
  Description of Artificial Sequence: Synthetic coding sequence
atgtccctcttcttgtctaatctgtcgacaaacgactcctctctttggaaggagaatcacaattccaccgacctattgaatccccctggcactctgaatatctacctcttctgccttacatgcctcatgacgtttgcggcattggtcggaagcatttatagtctgatatcgttactgaaaatgcagaatcgcactgtcgttagtatgctggtggccagttggtcagtcgacgacctgatgagtgtcctcagtgtgactatcttcatgttcctgcaatggcccaatgaagtaccaggctattttcagttcctctgtacaacgtccgccctgatgtacttgtgtcagggactgagttctaatctcaaagcaacactgcttgtttcctacaacttttacacgatgcaccgcggtgtcggatcacagaccgcatccagaaggtccggccaagtgctgggagtagtacttaccgtctgggctgccagcctgctactgtcagcgctccccctgtgtggttggggtgcattcgtgagaacaccgtgggggtgccttgtagattgttcatcctcttatgtgttatttctgtccatcgtctacgcactggcattcgggctccttgttggtttatccgtgcccctgacccatcgattactgtgctccgaggaaccccctaggctccattccaactaccaggaaatcagccgcggagcctcgattccgggtacaccaccgacagcagggagggtcgtctcactctcccctgaagatgctcctggacctagcctccggcgtagcggagggtgcagccctagcagcgacactgtcttcggtccaggggctccggcagcggcaggcgctgaagcctgtcggagagagaaccgtggaacgttatatggtaccaggagcttcactgtgtcggtggctcagaaacgctttgcacttattctcgccctgactaaggtggtcttgtggctgccgatgatgatgcacatggtggtacagaacgtcgtggggttccagtctctccctctggagacgttcagctttctgctgacactgctggctactaccgtcacccctgtgtttgtcctatcaaaaaggtggacccatttaccctgcggctgcataattaactgcaggcagaatgcttacgcagttgcctccgacggtaagaaaatcaaacgcaaaggcttcgagttcaacttgagctttcagaagagctacggcatctacaagatcgcacacgaggactattacgatgacgatgaaaacagtatattttaccacaatctgatgaatagtgaatgtgagactaccaaggacccacaacgtgataatcgcaacattttcaacgcaattaaagttgaaattagcacaacaccctcattggattcctcaacacagaggggcataaacaagtgcacaaacactgacatcacagaggctaagcaagactccaacaataagaaagacgccttctcagacaaaaccgggggagacatcaactacgaagaaactactttctcagaggggccagaaaggcgattgagccatgaggagtcccagaaaccggacctgagcgattgggagtggtgccgcagcaagtcggaacgcactcccagacaaagaagtggatatgccctcgcgattcctttatgcgccttccagggaaccgttagcctccatgccccaacagggaaaactctcagtctatcgacatacgaggtatccgctgaagggcagaagattactcctgcctccaaaaagatcgaagtctacaggagcaagagtgttgggcatgagccgaactcagaagatagtagcagtacattcgtggatacatcagtgaagattcacctggaggtgctggaaatctgtgacaatgaagaagcgctcgacactgtgtctattatcagcaatattagtcaaagctcaactcaagttagatccccatccctccggtacagtaggaaagagaaccggttcgtgtcctgtgatctgggagagaccgccagctattccctgttcttgcctacgtccaacccagacggtgacattaacatttctatccctgataccgtcgaagcccaccggcagaactcaaagagacagcaccaggaacgcgatggatatcaggaagaaattcagcttcttaacaaagcatatcgtaaacgtgaagaagagtctaagggaagctag

SEQ ID NO: 50464 - DNA, 1305 bp, Artificial Sequence
  Description of Artificial Sequence: Synthetic coding sequence
atggaggatctgttctcaccgtcaatcctccccccagcgcctaacatctccgtgccaattttgctcggctggggcctaaacctgacacttggtcagggcgcacctgcctccggtcctcctagcaggcgcgtgagactggtattccttggcgttatcctcgtagttgctgttgctggtaacaccaccgttctttgccggttgtgtggaggcggaggtccctgggcgggaccgaagaggcgaaaaatggacttccttttagttcagttggcgttggccgatctgtatgcatgtggagggaccgccttgagccagttagcttgggaacttctgggagaacccagggccgcaaccggcgatctcgcctgcaggtttctgcaattgttgcaagcctcggggaggggtgctagcgctcacctcgtggtgctgatcgctctggaacggagaagagccgtcaggctcccacacggccgtcctttgcctgcacgggctctggcagctctcgggtggctgcttgccttactgttggccctccccccagcttttgtggtaaggggcgattcacctagcccactgcctcccccaccccctccgactagtctgcagccaggggctcctccagctgctagggcatggcccggagagaggcggtgccatggcatattcgcgcctcttcccagatggcatctccaggtgtacgccttctacgaggcggtcgccggtttcgttgcacctgtcactgtgctgggtgtggcctgtgggcacctgctaagcgtttggtggcggcacaggcctcaggcgcctgccgcagcagcaccatggagtgcttctccaggacgggctccagccccatcggctttaccgagagcgaaggttcaatccctgaagatgagcctactgctggcccttctctttgtcggatgcgagctgccttacttcgccgcacggttagcggcagcttggagctctggcccagccggagactgggagggcgaaggcttatccgctgcactgagggtggtcgccatggccaatagcgcactgaatccttttgtttaccttttttttcaggctggggattgccggctccgacggcaactccgtaagaggttgggttcactgtgttgcgctccacagggaggggcagaagacgaggaggggcctcgcggacatcaggccctctacaggcaaagatggcctcacccccactaccatcatgccaggagagaacccctcgatgaagggggtcttaggcccccaccccctagacctagacccctgccatgttcctgcgaatccgccttttag

SEQ ID NO: 50465 - DNA, 1260 bp, Artificial Sequence
  Description of Artificial Sequence: Synthetic coding sequence
atgctggcagctgcattcgctgatagtaattcttcttcgatgaatgtgagtttcgctcatctccactttgcgggtggttatctgccttctgattcccaggattggcggaccattatccctgcactgctggtcgcagtatgcctggtcggatttgtcgggaacctgtgcgtgataggaatcctgttgcacaacgcgtggaagggtaaaccttctatgatccactctcttatccttaacctaagtctggcagacctgagcctgctcctgtttagcgcgcctatcagggcaaccgcctactcaaaaagtgtgtgggacctcgggtggttcgtttgcaagtcctctgattggtttatccatacgtgtatggccgcaaagagtctgacaatcgtggtggtggctaaggtgtgtttcatgtacgctagtgatccagcgaagcaggtgtctattcacaactacacgatttggtctgtgttggtagccatttggacagttgccagcctgctgcccctgcccgagtggttcttctctacgattcgacaccacgagggcgtggagatgtgtctggtggacgttcccgctgtggctgaggagtttatgagtatgttcgggaaactttatcctctgctggcgttcgggctgcctctgttcttcgccagcttctatttctggcgtgcatacgatcagtgcaagaagcgcggaactaagacgcaaaatctgagaaaccaaattcggtcgaaacaggtcacggtaatgctcctcagcattgccatcatctccgcactcctgtggttgccagagtgggttgcctggctgtgggtgtggcatttgaaagccgctggccctgccccaccccagggatttatcgccctgagccaggttctgatgttctctatcagctcagccaacccactgatctttctggtgatgagtgaagagttccgcgaaggattaaaaggggtttggaagtggatgattaccaaaaaacctcctaccgtgagtgagtcccaggagacaccggcaggaaattccgagggtctgccagacaaagtccccagtcccgagtcaccagcttcaatcccggaaaaagaaaaaccatcctcgccaagctctggcaaaggaaaaacagaaaaggctgaaatccccatcctgcccgatgtggaacagttctggcacgagcgggacacagtgcccagcgttcaagataacgatcctatcccgtgggagcacgaagatcaggaaactggggagggagttaagtag

SEQ ID NO: 50466 - DNA, 1413 bp, Artificial Sequence
  Description of Artificial Sequence: Synthetic coding sequence
atggacaccacaatggaggcagatctaggagctaccggacaccgtccccgaacggagctggatgatgaagacagctacccgcaggggggttgggatactgtctttctggtggctctcctgctgctgggtctcccggctaacggcctgatggcctggctggcaggttctcaggctcgccatggtgcaggcacaagactggcgctacttctcctgagcctggccctgtctgactttctgttcctggcagctgcggctttccaaatcctcgagatccgccatgggggacactggcccctaggtaccgcagcttgccgcttttactatttcctatggggagtgagttattcctcaggcctatttttattagcagccctctctctggatagatgtctgctggctctgtgcccccactggtaccctggccatcggccagtgagactgccgctgtgggtctgtgccggagtttgggtgctggcaacactattcagcgtgccttggcttgtgttcccagaagctgcggtgtggtggtacgacttggtcatatgtttggacttttgggacagtgaggagctgtccttgaggatgctggaggttctgggtggattcctccccttcctgctgttacttgtatgccatgttctgacccaagccaccgcctgccggacatgccatagacaacagcagcctgcggcttgtagggggttcgccagggtagcccgaactatcttgagtgcttacgtcgtgctgaggctcccctaccagctcgcccagttactgtatctggcattcctatgggacgtatactcagggtacttactgtgggaggccctcgtctattctgattatctgatcctgttgaattcatgcttatcccctttcctgtgcttaatggcatcggccgacctgcgcacgcttttgaggagtgtcttgtccagctttgctgcagcactgtgtgaggagcgcccagggtcatttactccgacagaacctcagacccagttggattcggagggaccaacactgccagaaccgatggccgaagcgcagtcccaaatggatcccgtcgcccagcctcaagtcaaccctacacttcagccacggtcagatccaacggcacagccccagctgaatccgaccgcccagccccagtccgacccgaccgcccagccgcagttgaatctaatggcacagccccagtcagacagcgtcgctcagcctcaggcagacactaacgtccagactcccgctccagctgcttcctcagttccctccccatgcgatgaggctagtcccactccctccagccaccctacacccggtgctctggaagatcctgctacaccacccgctagcgagggagagagtccaagcagcactcctcccgaggcagcaccaggtgccggaccaacatag

SEQ ID NO: 50467 - DNA, 2613 bp, Artificial Sequence
  Description of Artificial Sequence: Synthetic coding sequence
atgaactccaacctgcccgctgagaaccttactatcgcagtgaacatgaccaaaactctgcctaccgctgtgacccacggctttaattccaccaacgatcctccttcgatgtccattacacggctgttccctgccctgctggaatgtttcggaatcgtcctctgtggttacatcgctggacgggctaacgtgataacatctacgcaggcaaagggccttggcaattttgtttcacgtttcgccctgccggctctcctctttaagaacatggtagtcctcaacttctctaatgttgattggtccttcctgtattccatactcatagctaaggccagcgtgtttttcatcgtgtgcgtgctgacactattagtggcgagtcccgattccaggttttccaaggctggattatttccaatctttgctacccaaagcaatgactttgcactcggttatcccattgtggaggctttgtatcagactacatatccagaatatttgcagtacatatacctcgtcgcaccgatcagtcttatgatgctcaaccccattggcttcatcttctgtgaaatccagaagtggaaagatacccagaacgcctcccaaaataagatcaaaatagtggggttggggctattacgagttttgcaaaacccgatagtcttcatggtattcatagggattgctttcaacttcattctggatcggaaggtgcctgtctacgtagaaaacttcctggacggcctgggtaacagttttagcggatcggcgctgttttacctaggcttaacgatggtcgggaagatcaaaagattaaaaaagtccgccttcgtcgttcttattctgctgatcaccgcaaaactgctcgtgcttcccctgctgtgccgcgaaatggtggaattgcttgacaagggcgattcagttgtgaatcacacatctctgagcaactatgcttttctgtacggtgtatttcccgtggcgcctggggtggccatctttgccacccagtttaatatggaagtagagataattaccagcggcatggtgataagcaccttcgtaagcgcacccatcatgtacgtcagcgcgtggctactgacgtttcccacgatggaccccaaacccctggcctacgcaattcagaatgtcagctttgacatatcaatcgtgagcttgattagcctcatatggtccttagcgatactcctgctgagtaagaagtataagcagttgccgcacatgctcaccacaaacctgttgatagctcagagtatcgtgtgtgcaggcatgatgatatggaatttcgttaaggaaaagaatttcgttggacagattctcgtttttgtcctcctatactccagcctatatagtacttacttatggactgggctcttagctatctctttgtttttactaaaaaaacgcgaacgggtccagatcccagttgggatcatcatcatttcaggatggggaatccctgcactgcttgtgggggtattgttgatcacagggaagcataacggtgacagtatagattctgccttcttctacggaaaggaacagatgatcactaccgctgtgacactcttctgctccatcctaatcgcaggaatcagcctgatgtgcatgaaccaaacggctcaggccggatcttatgagggcttcgaccagtcacagagtcacaaagtggtagaacctggcaataccgcttttgaggaaagtccagctccagtaaacgaacctgagctcttcacgtcctcaattcccgagacctcatgttgcagctgcagtatgggtaacggcgaactgcactgcccctctatcgagcctattgctaataccagcaccagtgagcctgtgatcccttccttcgagaaaaataaccattgcgtgagcagatgtaactcacagagctgtatcttggcacaggaggaagaacaatatttgcagtctggggatcagcagttaaccagacacgttctcttatgtctgctcctcatcataggattatttgctaatctctcttcctgtttgtggtggctgtttaatcaggaacctggccgactatatgtggagctgcagtttttttgcgctgtgttcaattttggccaggggtttatcagctttggcattttcggattggacaaacacctcatcattcttccatttaaacgaagactagaatttctgtggaataataaggacactgccgaaaatagggattctcctgtgagtgaggaaatcaaaatgacatgccagcagtttattcattatcaccgtgatttatgcattagaaacatcgtgaaagagcggagatgcggagctaagaccagcgcaggaactttttgcggatgtgacctggtctcgtggctgatagaggtgggactcgcctcagacaggggcgaagcggtgatttacggcgataggctggtgcagggaggcgtgatacagcatattaccaatgagtatgagttccgggacgaatacctgttttatcggttcctgcaaaagtccccagagcaaagtccaccggcaatcaatgccaacacactccagcaggaaaggtataaggagatagaacactccagcccaccgagtcattcccccaaaacttag

SEQ ID NO: 50468 - DNA, 2613 bp, Artificial Sequence
  Description of Artificial Sequence: Synthetic coding sequence
atgaactcaaacctgcccgctgagaacctgacaattgcagtcaatatgacaaagacgctccctacggccgtgacgcatggctttaacagtacaaacgaccccccttcgatgagtattacccggttgttccccgctcttctcgaatgctttgggattgtgctatgtggctatatcgcgggtcgggctaatgtcatcacatcaacacaggctaaaggcctcggaaattttgtttcgcgcttcgccctgcccgcactactcttcaagaatatggtggtgcttaacttttctaacgtcgactggagcttcctctactcaatcctgatagccaaggcttctgttttcttcattgtctgcgtgctcaccctgctggttgcttcccctgattcacggttcagcaaggctggcctgttccctatctttgccacccagtctaacgatttcgctttgggctatccgatcgttgaagcattatatcaaacaacttatccggagtatctgcagtatatttatttagtcgcgccaatcagcctgatgatgctgaaccctatcggtttcattttctgcgaaattcagaaatggaaggatacgcagaatgccagtcaaaacaaaatcaagatagtgggtctgggtctgctcagagtgctccagaaccccattgttttcatggtattcataggcatcgccttcaacttcatcttggaccggaaggtgcccgtctatgtggagaacttcctcgacggcctgggcaattcattttcaggttcagctctgttctatctgggtttgacaatggtcggtaaaatcaaacgcctcaagaagtcggcgttcgttgtgttgattctcctgatcaccgcgaagctgctcgttttaccactcctctgtagagagatggttgagttgctagataagggagattccgtggttaatcacacctctttgtccaactatgcctttctgtatggagtctttcccgttgcacccggagtcgccatttttgccacccagttcaacatggaggtcgagatcattaccagcggaatggtcatctcaacctttgtgtcagcgccaataatgtatgtgtccgcctggctgcttaccttcccgacgatggaccccaagcccctggcctacgctattcaaaacgtgtcatttgatatctctattgtcagcctgatctcactcatttggagcctggctattttgttgctgtccaaaaaatacaagcaactgccgcacatgctgacaaccaacctgttaattgctcagtcgattgtctgtgcaggtatgatgatttggaactttgtgaaggagaaaaactttgtcggtcagattctggtgtttgttctcctgtatagtagcctgtactctacctacctgtggactggtctgcttgctataagcctatttctgttgaagaagagggagcgggtgcagattccagttggcataatcattatctcagggtggggtatccctgccctcctcgtgggcgtcttgctgattaccggaaagcataatggtgattctatcgattccgcattcttttacggaaaagagcagatgatcaccacagcagtcacgctgttttgcagcatactgattgcagggatttcactaatgtgtatgaatcagacagcacaagctggaagctatgagggcttcgatcaatctcagtcacacaaggtggtcgagccaggaaataccgccttcgaagagtcgccagccccagtgaacgagcccgaactcttcactagcagcattcccgagacgtcatgttgttcctgttccatgggcaacggagaattgcattgcccttcaatcgaacccatcgcgaatacctcgacttccgagcctgtcattccatctttcgaaaaaaataaccactgcgtgtctcgatgtaattcccaatcatgtatcctcgcccaggaggaggagcagtatctccagagcggggaccagcagctaactaggcacgtcctgttatgtttactcttgatcatcgggttgttcgcgaacctgtccagctgcttatggtggctgtttaaccaggagcctggtaggctgtatgtggagcttcaattcttttgtgccgtgttcaactttggacagggctttattagcttcggtattttcggcctggataagcaccttatcatcctgcctttcaaacgcagactcgaattcctctggaacaacaaggacactgcggagaaccgggacagccccgtcagtgaagaaattaagatgacttgccagcaattcatccactaccaccgtgatctgtgcatccggaacatagtcaaggagaggagatgcggggctaaaacctctgccggtactttttgcggttgtgacctggtgagctggctgatcgaggtggggctggcgagcgatcgcggagaggccgtaatctatggcgatcgtctcgtacaaggcggagtcattcagcatataaccaatgagtatgaattcagagatgagtacctcttctaccgctttttgcagaagtcaccggagcaatctcctccagccataaatgcaaacaccctccagcaagaaagatataaagaaatcgagcactcaagccccccttcccatagccctaagacctag

SEQ ID NO: 50469 - DNA, 2613 bp, Artificial Sequence
  Description of Artificial Sequence: Synthetic coding sequence
atgaacagtaatcttccagccgaaaacctgaccattgccgtaaacatgactaaaactttgcccacagcagttactcatgggtttaatagtacgaacgaccccccaagcatgagtattacccgcctgttcccagctcttctggaatgtttcgggatagtcctgtgcggctatatcgctggtcgtgcaaacgtgatcacgtccactcaggccaaggggctcgggaactttgtgtctagatttgcgcttcccgctctgctcttcaaaaacatggtggtccttaatttctcaaatgtcgactggagttttttgtatagcattttaatcgctaaagcttctgtgttcttcatagtatgtgtgctcacattattagtggcttcacccgactctagattctccaaggctggtttattccccatcttcgccacccagtcgaacgatttcgccctggggtatcccattgtggaggctttatatcagaccacctaccctgaatacctccagtatatctatctggtggcacctataagcctcatgatgctgaaccctatcggattcatcttctgtgagatccagaaatggaaggatacccagaacgcttcacagaacaagattaagattgtaggcctaggactcctccgcgttctacagaaccctattgtgtttatggtgttcatcgggatagcattcaatttcatactcgatcggaaggttccagtttatgtggaaaacttcctggacggcctgggaaacagtttcagcggctctgccttgttctatctgggtttgaccatggtgggtaaaattaaaaggctgaagaagtctgcgtttgtggtcctgatccttctgatcacagcaaagctcctagtactacccctcctgtgccgagaaatggtggaactcctcgataagggcgactccgtcgtgaatcacactagcctgagtaattacgcttttctgtacggagtgttccccgttgccccaggggttgccattttcgctacccaatttaacatggaagttgaaatcatcacttccggaatggttatctccaccttcgtgtccgcccctatcatgtatgttagcgcgtggctcttgacttttccaaccatggaccctaaacctctcgcttatgccattcaaaatgtgagtttcgatattagcatcgtttcgctgatctccctgatctggtccctggcaattctcctccttagtaagaagtataaacagttgcctcatatgctaaccacaaacctgttgattgcgcagagtattgtgtgtgcgggaatgatgatatggaattttgtcaaagagaagaattttgtgggacaaatccttgtgtttgtcctcctgtactcctctctgtattcaacatatttgtggactggactcctggccatctcactttttctgctgaaaaaacgggaacgagtgcagatacctgtggggattatcatcataagcggatgggggattcctgctttactggtgggggtgttactgatcacgggcaaacacaacggagattcgatcgattctgcattcttctatggtaaggagcaaatgatcacaactgcagtgaccctcttctgctccatcttgattgccggaatctcactgatgtgcatgaaccagactgctcaagcaggtagttatgaaggcttcgaccagagccagtcgcacaaagtggtggagccaggaaatacagcctttgaggagtctcccgcaccagtaaacgagcccgagctgtttacctctagcataccagaaaccagctgttgcagttgctccatgggaaatggtgaactgcattgtccgtccatcgaacctattgctaatacttctacaagcgagcccgttatcccatcattcgaaaagaataaccactgtgttagccgctgcaactcccaatcttgtatcctggcccaggaggaggaacagtacctgcagtctggcgaccagcagctgacacgccacgtgcttctctgcctactgcttatcataggattattcgccaatttatcgtcctgcttatggtggctgtttaatcaggaaccgggaaggctgtatgtggaattgcagttcttctgtgccgtctttaacttcggacaggggttcatctctttcgggattttcggtctggataaacacttaatcattctgcccttcaagcgtcgtctggagttcctgtggaacaataaagacactgccgagaatcgcgactccccagtttccgaggagatcaagatgacctgccagcaattcattcactatcatcgggacctgtgtatccgcaatatcgtgaaagagcgcagatgcggggctaaaacgagcgcgggaactttttgtgggtgtgatcttgttagctggttgatcgaagtcggattggccagtgatagaggcgaagccgtgatatatggcgatcgactagtgcagggcggtgttatccagcatattacaaacgaatatgaattccgcgacgaatatctgttttatcggttcctacagaagagccccgaacagtcacctcctgccattaatgctaacaccctgcaacaggagcggtacaaagaaattgagcacagcagtcctcctagtcacagccctaagacctag

SEQ ID NO: 50470 - DNA, 795 bp, Artificial Sequence
  Description of Artificial Sequence: Synthetic coding sequence
atgataaccaccgcagtcacattgttttgctcaatccttatcgcgggaatttcattgatgtgtatgaaccaaactgcacaggccggttcctatgagggattcgatcagtcacagagccacaaggtagttgagcccggaaatacagcgtttgaggagagccccgctcctgtgaatgagcccgaactattcacttcaagtattccagagacttcatgctgtagttgcagcatgggcaatggggagctccactgcccctcaattgagcctattgcaaatacatccacctctgagcctgtcataccaagcttcgaaaaaaataaccactgcgtgtctaggtgcaactcccagagctgcatcctggcccaggaggaggagcagtatcttcagtcaggagaccaacagctgacacgccacgtattgttgtgccttctgcttattattggcctttttgctaatctcagttcgtgtctgtggtggttgttcaatcaggagccaggccgactgtacgtagagcttcaatttttctgcgcagtcttcaatttcggccagggatttatcagtttcggcatcttcggattggacaaacatctaatcatcctgccgttcaagaggcggctggaatttctgtggaataacaaagacacagccgaaaatcgggacagccctgtcagcgaagaaataaagatgacgtgccaacaattcatccattatcacagagacctgtgtataaggaacattgtgaaggagagacggtgcggcgcaaaaacatctgccggtactttctgtgggtgttag

SEQ ID NO: 50471 - DNA, 417 bp, Artificial Sequence
  Description of Artificial Sequence: Synthetic coding sequence
tttcgggcacggggacccgatgggagggggagcgggagaacccgcgctggaagggctcctggccgtgagccgagagcccctaggtgcccagatggagggggtgtggcagcccgtgctgccagacttctgtcatcacgaagatccggaagctggccacctacccacgcactgtggcccgacctgcgcagtcgcgctcgaaggcttctactcttcctttctctcgcagatctgctgtctgcacggtgccctcccagccctactcctgctccgagttctggaccctggcctctgagatccacatgcacctcagcttccagcgcacccagagctgggctagcccagatcgcatgtttcggtcccagcatgagttctgcagggggatccaggtggtcatccttgtggcagccttccccttag

SEQ ID NO: 50472 - DNA, 1008 bp, Artificial Sequence
  Description of Artificial Sequence: Synthetic coding sequence
atgcaaccgagccccccaccaacggaactggtgcctagcgaacgggcagttgtacttctttcttgtgccctcagcgcgttggggtccgggcttctcgtggctacccacgccttgtggcccgatcttagatcacgagccaggagattgctgctgtttctctcgctagcagacttgttgagtgccgcaagttatttttacggtgtgttacagaatttcgccggtccttcctgggactgtgttctccagggcgctctttctacattcgctaacacttcatcctttttttggactgttgcgattgctctgtatctgtatttgtcgatcgtgcgagcagctcgagggcctcggaccgatcgcctcctgtgggcatttcatgtcgtgagctggggcgtgcctctagtaataaccgtggcagccgtagctcttaaaaaaattggctacgacgcgtctgatgtatccgttgggtggtgttggatagacttggaggctaaggaccatgtgttgtggatgcttctgaccggaaaactgtgggaaatgctcgcctacgtgcttctacctttactttacttgctcgtgcggaagcatataaaccgggctcacaccgctcttagcgagtatcggcctattttgtcccaggagcaccgcctgctgagacattcctctatggctgacaagaaactggtgctgatacctctgatctttatcggccttcgtgtgtggtcaactgtgaggttcgtcttaacactgtgcgggagccccgctgtgcagactcccgtactcgtcgtcctgcacggcataggcaacacattccaggggggagctaactgtataatgttcgtgctctgtactcgagctgtcagaacccgactgttctccctgtgttgttgctgttgcagtagccaaccgccaacaaagtcaccagctggcacccctaaggcaccagctccctcaaaaccaggggaatcccaggagtctcagggcactccgggtgaactcccttccacatag

SEQ ID NO: 50473 - DNA, 813 bp, Artificial Sequence
  Description of Artificial Sequence: Synthetic coding sequence
atgcagccaagtcccccaccgacggaactcgtaccgagcgagcgggctgtagttctcttgagttgcgcactgtctgccctgggcagcggtcttcttgtcgccactcacgcactgtggccagaccttaggtccagagcacgacggctcctcttgttcttgtccttagctgacctgttgagtgcagccagttatttttacggagttctgcaaaacttcgctgggcctagttgggattgcgtcctccagggagctttgagtacctttgctaatacttcctccttcttttggactgtggcaatcgcgctgtacctgtacctaagcatcgtgcgcgctgcaaggggacccagaactgatagactcctgtgggccttccacgttgtgtcttggggagtccctttggtcatcaccgttgccgcagtggcattaaagaagataggctatgatgcctccgatgtgtccgtaggttggtgctggattgatttagaggccaaagaccacgtgctgtggatgctcctcaccggcaagctgtgggaaatgctggcatacgtactgctgcctctactttatttgctggtacgtaagcatattaacagggccggaatcggaaacacctttcagggaggcgcaaactgcattatgtttgtcctatgtacacgggctgttagaacccgccttttcagtctctgttgttgctgttgttctagccagccaccaaccaaaagtccagccggaacccccaaggcacccgcaccttcgaaaccaggcgagagccaggaatcccagggaacccccggagaactgccttccacatag

SEQ ID NO: 50474 - DNA, 3648 bp, Artificial Sequence
  Description of Artificial Sequence: Synthetic coding sequence
atgggggctatggcatatcctcttctcctctgtctccttctggcacagctgggactcggcgcagtgggggcttcccgggatccccaggggcgtccggactcccccagagaacggacacctaagggcaaaccccatgctcagcagcccggtcgcgctagtgcctccgatagctccgccccttggtcccgcagtacagacgggactattctcgcccagaagcttgccgaagaggtccccatggacgttgctagctacctctacaccggagacagtcaccaactcaaaagggccaactgttcaggccgatacgagctcgccggtctccctggcaaatggccagccttagcctccgcgcaccccagcctccaccgcgcactcgacaccctgactcacgcgactaattttctcaatgttatgctgcaaagcaacaagagtagagagcagaacctgcaggatgaccttgactggtaccaagccctcgtgtggagtctgctggagggagagcctagcatcagtagagcagccatcacattctccacggactcgctaagcgcaccagctcctcaggtgtttttacaagcaacacgggaggaatctcggatcctgcttcaggatttgagcagttccgcgccacatctggccaatgctacgttggaaaccgagtggtttcatgggcttaggcgcaaatggcgccctcatctccaccggagaggccctaatcagggcccaagaggtctgggacattcctggcgtcggaaggacggacttggcggagacaaaagccattttaaatggagccctccatatctggagtgtgaaaatggcagctacaagcctgggtggctggtgactttaagctccgctatttatggcttgcagcccaacctcgtgcccgaattcagaggtgtgatgaaggtggacataaatctccaaaaggttgatattgatcaatgttcctcagacggctggttttctggtactcataaatgtcacctcaacaattctgagtgtatgcccatcaaggggctggggtttgtgctgggcgcttatgagtgcatttgtaaggccggattttatcatccaggagtgcttccggtgaacaatttcagaagacgaggtcccgaccagcacatctcgggttcaacaaaggacgtctctgaagaggcctatgtgtgtctgccttgcagggaggggtgccccttctgtgctgatgattccccctgttttgtgcaagaggacaagtatctgagactcgcaataatttcatttcaggccctgtgcatgctcctagatttcgtgagcatgctcgtggtctatcactttcgaaaggctaagtcaattcgagcatctgggctaatcttgctggagacaatcctgtttggcagcctgttgctgtactttccggtggtgatactttactttgaaccctccactttccgctgtatcctgcttagatgggcgagactgcttggattcgcaactgtttacggaactgtaaccctaaaactccatcgggtcctcaaagtctttctgtcacggacagcacaacgaattccttacatgactgggggtcgggttatgcgaatgttggccgttatcctgttggtggtgttctggttccttatcgggtggacatctagcgtatgccagaacctcgagaagcagatttcgttaataggtcagggaaaaacctctgaccatctcatcttcaacatgtgcctcatcgaccggtgggactatatgaccgcggttgccgagtttctttttctgctgtggggagtgtatctgtgttacgcagtgcgaacagtaccgagcgcctttcacgagccgcgatacatggccgtggctgtccataacgaattaattattagcgccatcttccatacaattcgtttcgtgctggcctcaaggctccaatcagactggatgctcatgttatattttgctcatacacatctgaccgtgacggtgacaattggactgttactgattcccaagttcagccacagcagcaataatccacgggacgacattgcaacggaggcctacgaagacgagcttgacatgggtcgttcaggttcatatcttaacagctcaatcaactctgcatggtcggaacactccttagaccccgaggatatcagggacgaactgaaaaagctgtacgcccagctcgagatttataaacgaaagaagatgattactaacaaccctcatctgcagaagaaacgatgtagcaagaagggcctgggaagatcaataatgaggcggatcaccgagatcccagagacagtgtcacgtcaatgttctaaggaagacaaggagggagctgaccatgggaccgctaagggaacggcgctgataaggaagaatcctccagagagcagcggaaacaccggaaagtccaaagaggagacacttaagaatcgggtgttcagtctgaaaaagtcccactcaacgtatgatcacgtgcgggatcagaccgaagaatcaagctccctccctaccgagagccaagaggaggaaacaacagaaaattccactctcgaatcattaagcgggaaaaaactgactcagaagctgaaagaagactctgaggccgagtcaacggagtccgtcccactcgtgtgtaaaagcgccagcgcacataacctctcctctgagaagaaaactggccacccacggacgtcaatgctacaaaagagtttgtctgttatcgcatctgctaaagagaaaacacttggactggccggaaagactcagaccgccggagtggaggaacggactaaatcccagaagccattaccaaaggataaggagactaatagaaaccattcaaactccgataacactgagaccaaggaccctgcccctcaaaattccaatcctgctgaagagcccaggaagccccagaagagcggaatcatgaagcagcagagggtcaaccctactaccgccaatagcgatttgaatccgggtaccacacagatgaaagacaacttcgacatcggcgaggtgtgcccttgggaagtctacgatctgacgccgggaccggtgcctagtgagagcaaggtgcagaaacacgtgagcatcgtggcctctgagatggagaaaaatcctaccttcagtttgaaagaaaagtctcaccacaaaccaaaggctgcagaggtgtgccagcagagcaaccagaagcggatcgacaaggctgaggtgtgtttatgggaatcccagggccaatccatcttggaagatgaaaaactgctcatctccaagacacccgttctgcctgagcgcgcaaaagaggaaaatggcggacagcccagggctgctaacgtgtgcgctggacagtctgaggagctacctcccaaagccgtcgcaagcaagacagaaaatgagaatctgaaccagatcggtcatcaggagaagaaaacaagttcttccgaggagaacgtgcggggatcatacaactcctcaaataactttcagcagccgctgaccagtcgcgcagaagtatgcccttgggagttcgaaacacctgctcagcccaacgccggtcgttccgtggcattacccgcttcctccgcgctgtccgccaacaagatagctggtccacgcaaagaggagatttgggactcttttaaggtgtag

SEQ ID NO: 50475 - DNA, 1017 bp, Artificial Sequence
  Description of Artificial Sequence: Synthetic coding sequence
atgacagctttatctagcgagaactgctcctttcagtatcagctcagacaaacaaaccaacctctcgacgtgaattacctcttatttcttatcatactggggaagattctgctgaacatactgacattgggcatgcgcagaaagaacacctgtcagaatttcatggagtacttctgtatcagtctggcgtttgtggatttactgctgttagtgaacatttctattatcttatacttcagggactttgtgctgctcagcataagatttactaaatatcatatttgcttgtttacacagattatcagttttacctatggttttcttcactatccagtcttcctgactgcctgtatagactactgcctcaatttcagcaagacaaccaagctgagcttcaaatgtcagaagctattctatttcttcacggtcatccttatttggatttccgtgctagcatatgtactcggggaccctgccatttatcaaagtctgaaagcgcagaacgcatacagcaggcactgccccttttatgtttctattcagagctactggctgtcctttttcatggtaatgatcctgttcgttgccttcattacatgttgggaagaggtgacaactcttgtgcaagcaatccgcatcaccagttacatgaacgaaaccatcctctactttccattcagtagccactctagttatacggtgcggtccaagaagatcttcttaagcaagttaatagtttgctttctgagtacttggcttccctttgtgttgctgcaggtgataattgtcctactcaaagttcaaattccggcttacatcgagatgaatataccttggctgtattttgtgaattctttcctcattgcaacagtttattggttcaactgccataagctgaacttaaaagacatcggactgcccctggatccctttgtgaattggaagtgctgcttcataccacttaccattcccaatttagaacagattgagaaacctatctccatcatgatctgctag

SEQ ID NO: 50476 - DNA, 432 bp, Artificial Sequence
  Description of Artificial Sequence: Synthetic coding sequence
atgacagcactttcttccgagaattgctcttttcagtaccagctacgtcaaaccaatcagccgcttgacgttaactatctgctgtttctcattattcttggcaagatcctgctaaacatattaaccctcggcatgagacggaagaacacgtgtcaaaacttcatggaatatttttgcatcagcctggcgttcgtggatttactcctgttggttaacatatctattatcttgtattttagggattttgtgctgttgagtatccggtttaccaagtaccacatttgtctgttcacacagattattagcttcacatacggtttcctgcactaccctgtcttcctaacagcctgcattgattactgccttaacttctccaagactactaagctgtctttcaaatgtcaaaaactgttctacttcttcaccgtgtag

SEQ ID NO: 50477 - DNA, 267 bp, Artificial Sequence
  Description of Artificial Sequence: Synthetic coding sequence
atgacagccctaagtagtgaaaactgctcctttcagtaccagctgcgtcaaactaaccagcccctcgatgttaactacctcctgttcctcatcatcttgggcaagattctgctcaatattctgacactggggatgaggagaaaaaatacctgtcagaactttatggagtatttctgcatatccttagctttcgtggacctattgctgctggtgaatatatccataatcctttacttccgggatttcgtgttactgagtatacggtag

SEQ ID NO: 50478 - DNA, 102 bp, Artificial Sequence
  Description of Artificial Sequence: Synthetic coding sequence
atgacggctctgtcaagtgaaaattgcagctttcagtatcagctgcgtcagaccaatcaaccactcgacgtaaactacctgctcttccttattatcctgtag

SEQ ID NO: 50479 - DNA, 1767 bp, Artificial Sequence
  Description of Artificial Sequence: Synthetic coding sequence
atggcgaggggaggtgctggggcagaagaagcctccttgcgcagcaacgcgttgagctggctggcatgtggccttctcgctctgttggccaacgcctggattattctaagcatttcagctaaacagcagaaacacaagccacttgagttgctcctctgcttcctggcaggtacgcacatcctgatggcagccgtcccactgactaccttcgccgttgtgcagttacgaaggcaagcctcaagcgactatgattggaatgaatccatctgcaaagtgttcgtatcaacctactacacgctagccttagccacctgcttcacagtggcttctctaagctatcatagaatgtggatggtcagatggcccgtaaattacaggctcagtaatgctaaaaaacaggccctgcacgctgtgatgggtatttggatggtgtcttttatacttagcacactgccctccatcggttggcataacaatggggagcggtactacgctagaggatgtcagtttattgtctcaaagattggtctcggctttggcgtgtgtttttcactgcttctgctgggcggtatcgttatgggtctggtctgtgtggccattaccttctaccagaccctctgggctcgcccaagaagggccagacaggcacgcagagttggtggagggggaggaacaaaggccggaggcccaggagcactggggacaagaccagccttcgaggtgcctgcaattgtcgtcgaggatgcaaggggcaagcgccgttcgtctttggatggcagcgagagcgcgaaaacttcgctgcaggtgacaaacctagtaagtgccatcgtgttcctatatgatagcttaaccggtgtgcccatcctcgtggtgtcattctttagtctcaagtctgactctgcccctccctggatggttttggccgtgttgtggtgctcaatggcccagactctgctgttgcccagttttatttggagctgcgagcgatatagagcagacgttcgtacagtgtgggagcaatgtgtcgcaattatgagcgaggaagatggcgatgacgatggtggctgtgatgattacgcagagggcagggtatgcaaagtgcgcttcgacgctaatggcgcaactggccctggtagccgggacccagctcaggtgaagctgcttccaggcaggcacatgctcttccccccattggaacgcgtgcactatctccaagtccccctctccagaaggttgagtcacgacgaaactaacattttctcaactccacgggagcccggttcgttcttacacaaatggagcagctcagatgatatcagagtactcccagcacagagcagagctttgggaggcccacctgaataccttggtcagcgccacagactagaagacgaagaggatgaggaggaggctgaaggcggtggcttggctagccttcgacaattcctggagtctggtgttctcggctcaggtggaggcccacctcgtgggcctgggttcttcagggaagagattaccacttttatcgacgagacaccactgccttctcctacagctagtcctggccacagccccaggaggccacgtccactgggtctctcccctcgcaggctcagtctcggctcacccgagagtcgcgctgtgggactgcctctgggcctcagcgctggccgacgttgtagcctgactggcggagaggagagcgcacgagcctgggggggatcttggggccctgggaatcccatatttccccagctgactttatag

SEQ ID NO: 50480 - DNA, 915 bp, Artificial Sequence
  Description of Artificial Sequence: Synthetic coding sequence
atgctgagtaccggtgtggttagcttctttagccttaaatcagacagcgctcccccatggatggtcctggctgtcttgtggtgttctatggcccagaccctgctgctcccatcattcatctggtcatgcgaaaggtacagagccgacgttcgcaccgtttgggagcagtgtgtggcgattatgtccgaggaggatggggatgacgatggcggatgtgacgactatgccgagggccgtgtttgcaaggtgcgcttcgacgcaaacggggctacagggccaggttccagagaccccgcacaggtcaagctgctccccggtcgacatatgctgtttcctccattagaaagggtccactatctgcaggtgccactatctaggcggctctctcatgatgaaaccaacatattcagcacccccagagagccaggctcttttctgcacaaatggtcttctagtgatgatatacgggttcttccagcccagtctagggcgcttgggggacctcccgaatacctcggacagcgtcaccgcctcgaagatgaggaagacgaggaggaagccgagggagggggactggcaagcctgcggcagttcctcgaatccggcgtcctagggagcgggggaggaccccctcgagggccaggttttttcagggaggaaattacaacctttatcgacgagacaccgctccccagtcccactgcctctcccggacattctccccgtcggcctagaccgctgggactgtccccaagacgactctccctcgggagtcctgaatcccgagcggtcggccttccactgggtctgtccgccggtcggcgatgtagcctgaccgggggtgaagaatccgctcgcgcttggggcggaagttgggggcctgggaatccaatttttccacagctgacactttag

SEQ ID NO: 50481 - DNA, 960 bp, Artificial Sequence
  Description of Artificial Sequence: Synthetic coding sequence
atgacgaactcctcttttttttgtcctgtgtataaggatctagaaccttttacatattttttctatttggtctttctggtgggaatcatagggtcttgcttcgctacctgggccttcattcagaagaatactaaccatcgctgtgtgtctatctacctcattaaccttcttacagccgactttctgttgacattggcgctgccggttaagattgtcgtggatcttggcgtggcaccatggaaactgaaaatctttcattgccaggtaacagcatgtctcatatatattaatatgtaccttagtataatttttctcgctttcgtgtctattgatcgatgcctgcaattgacccactcgtgtaagatctaccggattcaggaaccaggcttcgccaaaatgatcagtaccgtggtctggctgatggttctccttattatggtgccaaacatgatgatccccatcaaggacattaaagagaaatcaaatgtcgggtgcatggagtttaaaaaagagtttgggaggaattggcacctattgactaatttcatctgcgtggccatctttctcaatttctccgctatcatcctcatttccaattgtctggtgatcaggcagctgtaccgaaataaagataacgaaaactacccgaatgtgaagaaagcccttattaacatacttctggttaccacgggatatatcatttgctttgtgccctaccatatcgtgcggatcccatatactttgtcccagacagaagtaatcactgactgctcaacaagaatcagccttttcaaggcaaaggaagcaaccctcctgctggctgtttcaaatttatgtttcgatccgattctgtactaccacctcagtaaagccttcagaagcaaagttactgagacatttgctagtcctaaggagactaaagcacagaaggagaagcttcgctgcgaaaacaatgcttag

SEQ ID NO: 50482 - DNA, 57 bp, Artificial Sequence
  Description of Artificial Sequence: Synthetic coding sequence
atgactaatagctctttcttttgccctgtgtacaaggacttggaacccttcacttag

SEQ ID NO: 50483 - DNA, 1122 bp, Artificial Sequence
  Description of Artificial Sequence: Synthetic coding sequence
atggcaaatacaacaggcgaaccagaagaagtttccggagcactgagccccccatccgcatcagcgtacgtgaagctggttctgctaggcctcatcatgtgcgtgagtttagccggaaacgcgattctctccctgctggtgttgaaagaacgagctctccacaaggctccatattactttctgctagacctctgtctggccgatggcatacgatctgccgtatgtttccccttcgtcctggcctcggtgaggcatggcagctcttggacattctctgccctttcttgtaaaatcgttgcgtttatggcagtcctcttctgctttcatgccgcattcatgctgttctgcatctccgtcactaggtacatggctattgctcatcaccgcttttacgccaagagaatgacgctttggacctgtgctgcagttatctgcatggcttggacgctgtccgtggctatggccttccctcccgtcttcgatgtcgggacctacaaattcatccgcgaggaagatcaatgtatcttcgagcatcggtactttaaggccaatgacacactgggtttcatgctgatgctggccgtgttgatggccgctacacacgctgtgtatggaaaactgttgctgtttgagtaccggcatcggaagatgaagccagtgcagatggtgccagccatcagtcagaactggacattccacggcccaggcgctacagggcaagctgcagctaattggattgctggctttgggagagggccaatgcccccaactctactgggcataaggcagaacggacacgctgcgtctcggagattgctcgggatggatgaggtgaagggtgaaaaacaactgggcagaatgttctacgctatcacattactgtttttactcctgtggtctccgtacattgtggcttgttattggagggtcttcgttaaggcatgtgctgtgccacaccgctatcttgccactgcggtgtggatgtcatttgcccaggctgccgtcaatcctatcgtgtgttttctcctcaataaggacctgaagaagtgcctgagaactcacgcaccttgctgggggactggaggcgcacccgctccacgggaaccctactgcgtcatgtag

SEQ ID NO: 50484 - DNA, 159 bp, Artificial Sequence
  Description of Artificial Sequence: Synthetic coding sequence
atggctaatactacaggggagcctgaagaggtcagcggagcgctgtccccaccatccgcctccgcctacgtcaagctggtgctcctggggcttatcatgtgcgtgtcattagccggaaatgccattctgagtttgctggtgctgaaagaacgggcatag

SEQ ID NO: 50485 - DNA, 1002 bp, Artificial Sequence
  Description of Artificial Sequence: Synthetic coding sequence
atgcctgctaactatacttgtactcgacctgatggcgacaacaccgattttagatactttatatacgctgtcacatataccgtgattcttgttccgggactgattggtaatattcttgcattgtgggtgttttatgggtatatgaaggaaaccaaaagggcagtgatcttcatgataaatctcgccatcgccgacttactccaggtgttaagtcttcccctgagaatcttctactacctgaatcatgactggccttttggacctgggttgtgcatgttttgtttttaccttaagtatgttaacatgtatgccagtatctattttctggtgtgcatcagcgttagaaggttctggtttttgatgtatccttttcgctttcacgattgcaagcagaagtatgacttgtatatatctattgccggatggcttattatctgtctagcctgcgtcctattcccgcttctgcgtacctccgacgacacatccggaaataggaccaaatgctttgttgacctccccacgaggaatgtcaacctggctcagtcagtcgtgatgatgacaataggcgagctgatcggcttcgttacacccctacttatcgtcctatactgcacatggaaaaccgtattgagcttgcaagataagtatccaatggcacaagacctgggagagaaacagaaagctctgaagatgattctgacatgcgctggagttttcttgatctgcttcgccccataccatttctcttttccgctggacttcctggtaaagtccaatgagataaagagttgcctggccagacgggtgatcctgatcttccacagcgtggctctatgtcttgcaagcctcaactcctgcctagatccagtcatttactactttagcacgaacgaatttcgcagacgcctcagcaggcaggacctccatgattcaattcagttacacgccaagagttttgttagcaatcacaccgcttcgactatgacacccgagctctgttag

SEQ ID NO: 50486 - DNA, 7103 bp, Artificial Sequence
  Description of Artificial Sequence: Synthetic coding sequence
atgggcaccaggggggctgtaatgcccccacctatgtggggcctgctcggctgctgcttcgtctgcgcgtgggctctgggaggcccacgccctatccgttcactaccaccactcagttcccaagtcaaacccggatccgtgcctatgcaggtgccccttgagggggcagaggcagcattagcgtacctgtatagcggcgacgcacagcagcttagtcaggtaaattgttccgaacgttatgaggccaggggtgccggtgcaatgccgggactccctccgtctctccagggggctgcagggactttagcccaggcggctaattttctgaacatgctgcttcaggcaaatgacattagagaatcctcagtggaggaggatgtagagtggtatcaggcgcttgtgcgtagcgtagctgagggcgatccccgtgtgtatcgggcactgctaacctttaacccaccaccaggggctagccacctccaactggcattgcaggccactcgcacaggagaggaaaccattctccaggacttaagcggcaattgggtacaggaggagaacccacctggggacctcgatactcctgcactgaaaaagagagttctcactaacgatctggggtctcttggctctccaaaatggccccaggctgatggctatgtaggcgacacccagcaggtgcggctctctccgccatttctcgagtgccaggagggacgattaagacctggctggttaataaccctgtccgccacattttacgggcttaaacctgacctatcccctgaggtgagaggacaggtgcagatggacgtggacctccagtcggttgacataaaccaatgtgcctcaggaccaggctggtattctaatactcacttatgcgacctcaactctacacagtgcgtgcctttggagtctcagggttttgtgcttggaaggtatctttgccgctgtcgaccgggattctatggcgcatctccctccggcggactggaagagtcagactttcagactacagggcagtttgggtttcccgagggacgttcgggaagactgcttcagtgtctaccttgccccgagggctgcacgtcatgtatggatgctactccatgtcttgtggaagaggcagcagtccttcgggcagccgtgttagcctgccaagcttgttgcatgctggcaatctttctgagcatgctggtctcctatagatgtcgtcgcaataagcggatctgggcaagtggagtggttcttcttgaaacagttctcttcgggtttctgcttctgtactttcctgtgttcattctttatttcaagccaagcgtatttcggtgtatcgcccttcgctgggtgcgtctgttaggctttgctattgtatatggtaccataatccttaaactatacagggtcctgcagctcttcctgagtaggacggcacaacgttccgccttgctctcatccggcagactcctgagaagactcggactgctcctattaccagtactggggttcctggcagtgtggaccgttggggctttggaacggggtatccaacacgcgcctctggtcatccggggacataccccttctggccgtcatttttacctgtgccatcacgatcgatgggattacatcatggtggtcgctgagctactgctcctgtgttggggatctttcttatgctacgccacaagagccgtgctctctgcctttcatgagccccgatatatgggaattgcactgcacaacgaactccttctcagcgcagcctttcacactgcacgcttcgtgctggtgccgtcacttcacccggactggaccctgctgcttttcttttttcatacccactccactgttactaccactctcgctctgatctttatccctaagttttggaagctgggagcccctccaagggaggaaatggtggacgaagtgtgcgaggacgagcttgacctgcagcatagtgggagctacctgggctcctcaatcgctagcgcttggtccgagcacagcttagatcctggcgatattcgcgatgaacttaaaaaattgtatgcgcagctggaagtgcataagaccaaagagatggcagctaataatccacatctgcccaaaaaacgcggttccagctgtcaagggctgggcaggagtttcatgcgatacctggcagaattccccgaggcattagctcggcagcactctcgggacagcgggagcccgggacacggcagtcttcccggtagtagcaggaggaggctcctgtcttcctctctgcaggaacctgagggcactcctgcacttcacaaatctcgctcgacctatgaccagcggagggaacaggacccaccactcctcgacagtctcctgagaagaaagctggctaaaaaagcctccagaacggaatccagagagagtgtcgagggaccaccagctctgggattccggtccgctagtgctcataacctgaccgtaggtgagcgcctccccagggcaaggcccgctagtctgcagaagtcgttgagtgtcgcctcgagtagggagaaagctcttttgatggcctcgcaggcctacttggaagagacataccgccaggctaaagagcgtgaggagaggaaaaaggcaaaggccgcaatggcctccctggtgaggcggccttcagctaggcggctcgagagacccaggggcgctccactgagcgcccctccctccccagccaaatctagctctgtggactcctcgcatactagcgggcgtctccatgaggaggctcgaagaagactcccacatcctccaatcagacaccaggtcagcacaccgatactggccctctccggaggacttggagagcccaggatgctatcacccacctctaccttggcacctgcactccttccagccctcgccccaacaccagcacctgccctcgccccagttccagtgagtccccagtctccaaacttgctcacgtatatctgtccatgggaaaacgccgagctgccagcgaagcaggagaatgttccacaagaggggccaagcggcccagaacggggtcaccattctccggctccagctcgtgcccgactatggcgcgcactgagcgtggccgttgagaaatcccgcgctggtgagaatgagatggatgccgaagatgcacaccaccagcgggaggctaatgacgtggatgaggacaggccgaagatatttcctaagtcccattccctcaaggcaccagtgcaacagggctctatgagaagcctaggcctggctatcaaggctttgacaaggagcaggtcgacatatcgagaaaaagagtccgtcgaggagtcccccgagggtcaaaactccggtaccgcaggtgaatctatgggagctcccagccgttctcctaggctaggacgcccaaaagcagttagcaagcaggcagccctgattccctcagacgacaaggagtcccttcaaaatcaacagaacgcccatacatcccgaatgttgcaggtttgccagagggagggttctagggagcaggaggatagaggcagacgtatgacacaggggctcggggagagaaaggcagagcgagccggtaagaccggcctggccatgttgcgccaggtgtccagggataagaatatcaaacagtcaaaagaaactcctgttggctggcaggagctgcccaaggccggtttgcagtctttgggctcagcagaccaccgggtggctgaggtatgcccctgggaagttacagagtcagaaactcgccagcctgactcagggaataaggccgagatttgtccttgggagacaagcgagggggcaccagagtcaagggcgttacggcaggatcctggagacagccagaagaagagaggagaggccagaggcaagtccgagccaatagatgtggtgcccatgatgcggaaaaagcctgaaagattggtgcgcgaacaggaggcagtatgcccctgggagagcgctgatagaggcggtctgagcccgggatccgctccccaagacccaggcagaatccgggataagtccgaagccggagattccgtggaagctcgaaaggtagaaaaaccaggatgggaggccgcagggccagaggctcatacccccgacataaccaaggctgagccatgcccctgggaagcgagcgagggcggtgaagatggtaaacctgcacaagaggcagtcaaagacttacctcaggaaaaacaaaagaccagaaaagcaaccttttggaaggagcagaaacccggtggggatctggagtctctgtgcccctgggagtctactgactttcggggtccctcagctgtgagtatacaggcgcctggctcttcggagtgtagtggaagcttggggtctggaattgccgaggtatgcttgtgggaggccggtgacgcgccagcaattcagaaagcagaaatttgcccctgggaacttgacgataacgttatgggtcaggagatgctgtcgctcggtaccggacgagagtcgctccaagaaaaggaaaaagcctcacggaaggggagctttggggaaatgggtgagcagactgtgaaagccgtgcagaaactaagtcaacagcaggaatccgtctgcccacgagagagcaccgtccccggacactctagtccctgtttagacaacagtagctctaaggccggaagccagtttctatgtaacggcggatcgcgggctacccaggtctgtccacaggaagaccttaggccagaggcccaagaggctacgcctgctaaaacagagatttgtccctgggaagtgaacgagcgaacacgggaggagtggaccagcgcacaagtccctcgaggcggagagtcgcagaaggacaaagaaaaaatgcccggtaagtccgaaatagaagacgtcaccgcatgggaaaagcctgaaggacagatccagaaacaggaagccgttgggccttgggagagtgtcgatcctggcagctttagtcctcagcctagaccccaggatactgaaagacctcagaccctgttacagatgagcggctccgtcgggtccaaagcagccgacatttgtccattagatgtggaagagaacctgacagccggaaaggccgaaatttgtccatgggaagtgggggcaggggctggggaggaacgcgctttgggcgctgaagctatccgcaaatcaccaaatgatacaggcaaggttagtgccgatcttggaccaagggagcgtgctgtgaccgctcctgagaaacctcaaaagcctacgccagagtgggaagtggcatgcccctggggatctgtgggacctggggcatgcagtcaacaccctggcaccctggacgcggatggccctaaagccggttttcaagaactggaccacatggggtgtcggccaggagaagtttgcccatgggaggcacaggaggctgcaacttctgaaaaggctaagatttgtccctgggaagtaagcgaaggaacgaccggcaaggggttggatcagaaagctgggtcggaatctgcggagcagagggagaaggccctcgagaaaggccgtctaacttctttaggggaagatgtgagcaagggcatggctaagttgtgccagcagcaagagacaatctgcatttgggaaaataaagatttaagggagtcccccgcacaagcccctaagatcagtgatttgccaagttcaatgagtagcgaggtggctgaagggcacagcttggaggccacagaaaagggcgacctcaggcaggaccctaagaccgggagttttccagaacacattacacaggagaaggccccagcagctgacacagaagaattcacaactgaggatggagaaaagacatcgcatgagttgcagtcagtgtgcccatgggagacaaccgcaccggcagactctgtctcgcaccttgataggcaacgccctgatcagccgaaggcttcctcccagaggttagtttcaaccggagggagggcagctgacgtgtgtccttgggacgtgcctgatgctggcgtgtataagtccgacagctctgctaaggccgagacatgcccatgggaggttactgagcgcatccctgtcaaaggagtgtcccggcaggacgggaagggcgactcgcaggaggagaaaggccgagcccctgaaaaaagcgagccaaaaggagtgcctgtgcagaagaaaccggaaatggcagacttcagacagcaggaggctgtatgcccctgggaatcacaagatggtaagggactgagtccccagcccgcacccgatgcttcggacagaagtaggggatccagcgaagcagccggttcagtggaaactcgtgtggcggaggtgtgtttgtgggaggtggtggaagcacctagcgctaagaaggccgagatctgcccgtgggaggccggagggggtgccgcagaggagggtgaacaggaaagagaaagccagggacaaggcgaaatgttcctccagaaggccggtcccggaggaaccgaggagcacttcagcaaggcagcagccaagccaagggagcaggaggctgtctgtccaggagaagggactgggagtgggggtctgctgccccaatctggagctctcgacccagagcttaaagtgtcacccaaagaagccggaagcatgggcagccgtatggccgagctgtgccagtgggaaattactgaccccgagggcaataaaatcaaaggcactatggccgatatctgccccggtgaagaaacgggagtgcccagcgaggagtcagggctcttggctttgactgcgactcggagagagtttttccccactgctcctgagaaaccactctgtttgctggtgcatggcccactggatcatttcttccccgaatctaaaatcccttgtcccaaggtcagcagacccgcaagcacttttaccctggaaggcgtgcgagaactccagggcccttcaggtctcgagccgaggacaagcctggctccggagccttctctgcaggaggcggagtcacagtcaagttctttaactgaggatagtggtcaggtggcatttgaggcgcagtatgaggagttcactccaccaaccgtgtatccgtgggactgggaata

SEQ ID NO: 50487 - DNA, 1323 bp, Artificial Sequence
  Description of Artificial Sequence: Synthetic coding sequence
atgggcggactcaggttactggctgtggctctgacctgttgctggtggcctcagggctcccagggtaaaaccttgaggggctcttttagtagtaccgctgcccaggatgcccaggggcagagaattggacacttcgaatttcacggagaccacgccctcctctgcgtaagaatcaacaatatagccgttgcagtcggtaaggaggctaagctgtacctgttccaggctcaggaatggctgaagctccaacagagctcccacggatattcttgtagcgagaagttgtccaaagcacagcttaccatgaccatgaaccagacagaacataatttaaccgtctctcagataccctcaccacaaacgtggcacgttttttacgctgataaatacacctgccaggacgacaaagaaaactctcaagtagaggatatcccctttgaaatggttctgcttaatccggatgccgagggaaatcccttcgaccacttctccgcaggcgaaagtggcttacacgaattcttcttcctgctggtccttgtatacttcgtaatcgcctgtatctatgcccagtccctgtggcaggccatcaagaagggcggacccatgcacatgatactgaaagtgctcaccaccgcactgctgctgcaggccggaagtgctcttgctaactacattcactttagcagttattcaaaggatggcatcggagtgccgtttatggggtccttggccgagttctttgacatcgcgagtcagatccagatgctttacctcttgctctccctgtgcatgggctggacaatcgtgcgaatgaagaagagccagagtagaccactgcagtgggacagcaccccggcatcaaccggaatagccgtttttatcgttatgacacagtctgtactgctcctgtgggagcagttcgaggacatctctcatcattcataccacagccaccacaatctggccggtatactgttgattgtgctgagaatctgcctggcactcagtttgggatgcggcctttaccaaataattacggtcgagaggtctacacttaaacgcgagttttatatcacctttgctaaggggtgcatcttgtggtttctctgccatccggtgcttgcttgtatatctgttatcttttccgattaccaaagagacaaggtgattaccattggtgttatattgtgccaatccgtttctatggtaatcctctatagactcttcctgagccacagcctctactgggaggtctctagcctctcttctgttactctgccactgacaattagtagcggacataaatcaaggccccacttttag

SEQ ID NO: 50488 - DNA, 1215 bp, Artificial Sequence
  Description of Artificial Sequence: Synthetic coding sequence
atgagcgtgaagccgagttgggggccaggacctagtgaaggggtgacagctgtgcccaccagtgatttaggggagattcacaattggacagaattgttagatttattcaatcatacactgtccgaatgtcacgtcgagctgtctcagtcaaccaagcgagtagtgctgtttgccctgtacctggcaatgttcgtggtggggttagtcgaaaacctgctggtgatttgcgtcaactggagaggaagcggacgggcaggcctgatgaatctgtacattctgaatatggccatagctgatctcgggatcgtgctctctctcccagtctggatgctggaggttacgttggactatacatggctgtggggaagctttagctgtcggtttacacactatttttatttcgtgaacatgtacagttcgattttctttttagtttgtctgagcgtggataggtacgtcaccctcacgtccgcaagcccaagttggcagagataccagcacagggtgcgtcgggctatgtgtgccggaatatgggtactgtctgccatcattcccctccctgaagtcgtgcacatccagcttgtagagggaccagagcccatgtgtcttttcatggctcctttcgagacatactctacgtgggccctcgctgttgccctgtcgaccaccattctgggcttcttgttgccatttccacttatcaccgtctttaatgtcctgacagcgtgccggctgcgccagcccggtcagcctaagagccggagacattgtctcctgctgtgtgcttacgtcgccgtcttcgtaatgtgctggctcccctaccatgttacactgctgttacttaccttgcatggcacacatatttccctccattgtcacctggtgcacctgctatattttttttacgacgtcatcgattgcttcagtatgttgcattgcgtcataaatcctatcctatataactttctgtccccacactttcggggacgcctgctgaatgctgtggtacactacctacccaaggatcagaccaaggcaggtacctgtgcctcatcaagcagctgttccacgcagcatagcataatcattaccaagggggattcccagcctgcggctgctgctccccatcccgagccttccctgagctttcaagcccaccatctgctccctaacacatccccaatatctccaactcagcctttgaccccaagctag

SEQ ID NO: 50489 - DNA, 1446 bp, Artificial Sequence
  Description of Artificial Sequence: Synthetic coding sequence
atgaggtggctgtggcccctcgccgtgtccctggcagtgattcttgccgtgggactaagcagggtcagcgggggtgcaccactccacctcgggcgacacagggccgagactcaggaacagcagagtcggtctaaacggggaacggaggatgaagaggccaaaggcgtgcagcaatatgtgccggaagaatgggccgagtacccaaggcctatccacccagccggtctgcagcctacaaaacccctagtggcaacctccccgaatccaggcaaagacggtggcacacccgattctggccaggagttaagaggtaatctgacaggggctcccggacagcggctgcaaatccagaacccgctataccctgtaaccgaatcgtcttactcagcatatgcaatcatgctgctggccctcgtagtttttgctgtggggatcgtgggcaacctgagcgtaatgtgcattgtctggcatagctattacctgaagtccgcctggaattctattctggctagcctcgccctgtgggatttcctcgtgctgtttttctgcttgccgatagtgatttttaacgagataactaaacaacgcctgctgggagacgtcagttgcagggcagttccgtttatggaggtgtcaagccttggggtaactacctttagcctatgcgccttaggcatcgatcgttttcacgtggccacgtctacactgccgaaagtaagaccgatcgagagatgccaaagcattcttgcaaagctggcagtaatttgggtcggctctatgaccctggccgttcctgaactgttgctctggcagttagcccaggaacccgctcccaccatgggaactttggacagttgcatcatgaagccctcagcctccctcccagaatctctctactcactggtcatgacataccagaatgcaaggatgtggtggtatttcggctgctatttctgtctccctatcttgtttacggtgacttgccagcttgtcacgtggcgggtcagaggacctcctgggcgtaagtccgaatgccgggctagtaaacacgagcagtgcgaaagtcagctaaattcgaccgtcgttggcctcaccgtggtatacgccttctgtacccttcctgagaacgtgtgcaacatcgtggtcgcttacctttccactgaacttactagacaaacccttgaccttctcggccttattaaccagttttctaccttcttcaagggagccatcacccccgttctgttgctctgtatatgtagaccactgggccaggcctttcttgactgttgctgctgttgctgctgtgaggagtgcggcggagccagcgaggcctcagcagcgaatggatcagacaacaagttgaagaccgaggtgagtagctcaatctacttccacaagccccgtgaatcgccccctctgctacccctcggaactccatgttag

SEQ ID NO: 50490 - DNA, 1047 bp, Artificial Sequence
  Description of Artificial Sequence: Synthetic coding sequence
atgctgctggctctggtcgtctttgcagtgggcatcgtggggaacttaagcgtaatgtgcattgtgtggcacagctactacctcaagtctgcttggaacagcattcttgcctccttagcattgtgggacttcctcgtgctgtttttctgcctcccgatcgtgatcttcaacgagatcacaaagcagcggctcttgggcgatgtttcttgcagggcggttcccttcatggaggtctcgagcctgggcgtgaccacattcagcctgtgtgcacttggaatagatcgtttccatgtggccacatcaaccttacctaaagtccgccctattgagaggtgtcagagtatcctggccaaactagctgtgatttgggtgggctccatgacactggccgtgcccgagctgttattgtggcagttggcccaagaacccgcaccaacgatgggcacactcgatagctgcatcatgaaaccctctgcctccctgccggaaagcctttactcactggtgatgacgtatcaaaatgcacgcatgtggtggtactttggatgttacttttgcctaccgatcctctttactgtgacatgtcaactggtgacatggcgtgttcgaggtcccccaggaagaaagagcgagtgccgcgcaagtaagcatgaacagtgcgagagtcagctgaacagcacggtcgtgggcctcaccgttgtgtatgccttttgcacactgccagaaaatgtgtgcaatatagtagtggcatacctgtcaaccgagttgacccggcaaacattggatcttctcggactgattaatcagttttctacattctttaagggagcaattacccctgtgctgttactctgtatttgtagacctctgggccaagcttttctcgactgttgttgttgctgctgctgcgaggagtgcggaggcgcttctgaagccagcgccgctaacgggtcggataacaaactcaaaactgaagtgtccagttctatttatttccacaaacccagagaatcacctcctctgctaccactcggcaccccctgctag

SEQ ID NO: 50491 - DNA, 1014 bp, Artificial Sequence
  Description of Artificial Sequence: Synthetic coding sequence
atggggaatgactcagtcagttacgagtacggggactatagcgacttgtctgatcgccctgtcgattgtcttgacggggcttgtttggctatcgatccattgcgtgttgcacctcttccactctatgcagccatctttcttgttggggtgcccggtaacgcaatggtggcttgggtcgccggaaaagtggcccgaaggagggttggcgctacctggcttctgcacttggctgtggccgatctgctgtgctgcctgtctctgcctatcttagcggtgcccatcgcaagaggcggacattggccttatggtgccgtgggatgtagagctctgcccagcatcatcctgcttactatgtatgcttctgtgctcctgttggccgctctcagtgcagacctgtgtttcctcgctttgggacccgcttggtggtctacagtccaacgcgcatgcggcgtgcaagtagcctgcggagcagcatggactttggcactgctgttaactgtccctagtgcgatatatagacgcctgcaccaggaacattttcctgcccgactccagtgtgtcgttgactacggaggctcttccagtacggaaaacgccgttaccgccatccgctttttgtttgggttccttggcccattagtcgcggtggccagttgtcactccgcactgctgtgctgggccgctagacgatgtaggcctctcggaacagccatcgtggttgggttcttcgtttgctgggccccttaccatctgctcggccttgtgctgaccgtggccgctccgaatagtgccttgctagccagggccctgcgcgctgagcctctgattgtgggcctggctctggcacattcctgcctgaatcctatgctgttcctctatttcggaagggcccagctgagacgctccctgcccgcagcgtgccattgggccctccgagagtcccaaggccaggatgaatcagtcgattcgaagaaatctacatctcacgatctggtgtccgaaatggaagtttag

SEQ ID NO: 50492 - DNA, 1014 bp, Artificial Sequence
  Description of Artificial Sequence: Synthetic coding sequence
atgggaaatgacagtgtcagttacgagtacggcgattattctgacctgagcgaccggcctgtggattgtttggatggagcctgtttggccattgacccgcttagggtcgcaccattgccactttatgctgctattttcttagtgggagtgcctggcaacgcaatggtggcctgggtggcagggaaagttgccaggaggcgggtcggagcaacgtggcttctccacctggctgtggccgacctgctgtgttgcctgtctttgcccatcctggctgtgccgatcgcccgtggagggcactggccatacggagctgtgggttgtcgcgcacttccttctattattctgctgaccatgtatgcgagcgtcctccttttagcagctctatcagccgacttgtgctttctggcactcggcccagcgtggtggtcaactgtgcagcgtgcctgtggcgttcaggttgcttgcggcgctgcctggactctggcgctcctgctgacagtgccttcagcgatctataggcgcttgcaccaggaacattttccagcgagactccagtgcgttgtggactacggtggatcatcctctacagagaacgccgtcaccgccatcagattcctgttcggattcttgggtcccctggtagctgttgctagctgccattccgctcttttgtgttgggctgcccgtagatgtcgccctcttgggacagccattgtggttggcttttttgtatgctgggcaccgtatcatcttctgggactcgtcctcactgtcgcggctccgaactcagcgttgctggccagggctctacgagccgagcctctgatagtaggcctcgcactcgctcactcttgcctgaatcctatgctttttctgtatttcggcagggcacagctgagacggagccttccagccgcatgccactgggccttgagagaaagccaaggacaggacgaaagcgtcgattcaaagaagtcaacaagccacgacctcgtctcagaaatggaagtttag

SEQ ID NO: 50493 - DNA, 1155 bp, Artificial Sequence
  Description of Artificial Sequence: Synthetic coding sequence
atgaccaacagtagttcaaccagcacctcttcaactaccggtgggtcactgttgctgttgtgtgaggaggaggagtcctgggccggacggcgtattcctgttagcctgttatacagtggcttagcaattggaggaacactggctaatggtatggtgatttacctggtgtcttcattccgaaagctgcagaccacatcaaatgccttcatcgtcaacggatgcgccgcagacctctcggtctgtgcgctgtggatgccacaggaggctgtattgggactgctccctacaggttccgctgaacctccagccgattgggatggcgctggcggaagctaccggttgctgcgcggagggctcttggggctgggtctaaccgtgtctctccttagccactgtttggttgcgttgaaccggtaccttttaatcaccagagctcccgctacatatcaggctttgtaccaaagacggcacacggccggaatgctggctctgtcctgggcactggcactgggtctggtgttgctcctcccaccctgggcaccgaggccaggcgcagctccgccacgcgtccattaccccgctctgctggccgcagctgccctgcttgcgcaaacggcgctgttattacactgctacctcgggattgtgcgcagagtgagggtgtctgtcaaacgcgtctcagttctgaatttccatctgctgcaccaattgcccggttgcgcagcagccgcagcagctttcccgggagcgcagcacgcccctgggcctggcggagctgcacatcccgctcaggcgcagcccctgccgccagccctgcaccctcggagggctcaacgtaggctgagtgggttgtctgtgttgttactgtgctgcgtgttcctgctggccacacaacccctggtctgggttagcctggcgagcggcttttccctgcccgttccttggggagtgcaggcagctagttggttgctgtgctgtgccctttctgccctcaatcctctgctgtatacttggcgcaacgaggaattccgaagaagcgtacgctccgtcctgcccggtgtgggcgacgcagccgctgcggctgtcgctgcgacggcagtgcccgcagtaagtcaggcccagttggggacgagagcagccggacaacactggtag

SEQ ID NO: 50494 - DNA, 963 bp, Artificial Sequence
  Description of Artificial Sequence: Synthetic coding sequence
atgttcttaggcattctctctatcgaacaactcattagccgagtgggggttatcggagttactcttatggcattgctgtctggttttggcgctgtaaactgtccttacacctacatgtcatatttcctgcgcaacgtaacagacaccgacattttggccctcgagagacgtttgctgcagaccatggatatgatcattagtaaaaaaaaacggatggcaatggcccgacggacaatgtttcagaaaggcgaggtgcacaacaagccgagcggattctggggaatgattaaaagcgttacgacatccgctagcgggtccgagaatttgacacttatacagcaggaggttgacgccctcgaagaactcagtcgccaactgtttctcgagacggcggatctctacgctacaaaggagcgaatcgagtactctaagactttcaaagggaagtactttaactttcttggatacttcttttccatctactgcgtttggaaaattttcatggccacaattaatatagtcttcgaccgcgtgggtaaaaccgaccctgtgacacgcggaatagagatcacagttaactaccttgggatacagtttgatgtaaaattttggagccaacacattagcttcattcttgttggcataattatcgtgacatccattagagggctcctcattactcttaccaagttcttttacgctatcagctcctcgaaatcctctaacgtgatcgtgttgcttcttgcacagatcatgggcatgtacttcgtgtcatctgtcttactaattcgaatgtccatgccactagagtatcgaacgattattacagaggtgttgggcgagttacagttcaacttttatcaccgttggtttgatgtgatcttcttggtctccgccctatctagtatcctttttttgtacttggcgcacaagcaggcccctgaaaagcagatggctccctag

SEQ ID NO: 50495 - DNA, 1173 bp, Artificial Sequence
  Description of Artificial Sequence: Synthetic coding sequence
atgacactcacttgtgtgttctgggatgtcacgaaaggcacaaccggagactggtcctctgaggggtgttctaccgaagttaggccagagggcacggtgtgctgctgcgaccatctgacattttttgccttgctattgcggcctacattagatcagagcaccgtacacatcctgacacgtatctcacaagccggatgtggcgtctctatgatcttcctggcgttcaccattatcctttacgcctttctgcggctgtctagagaaagattcaaatcagaggatgcacccaagattcacgtggcactggggggttccctcttcttgttgaacctagctttccttgtcaacgtgggcagtggcagtaagggcagtgacgctgcctgttgggcgagaggcgcagttttccactatttcttactctgcgcgtttacatggatgggtttagaggctttccacctttatttgttggctgtgcgggttttcaatacatacttcggacactacttcttaaagctcagcctggttggctggggcctgccagcattaatggtcatcgggacaggcagtgccaattcatacgggctttacacaataagggatcgggagaaccggacttcactggaactgtgctggttcagggagggtacaaccatgtatgctctgtacattacagtgcacggttatttcttgattacttttttattcggtatggtcgttcttgccttagttgtctggaagatatttaccctctctagagctactgccgtcaaagaaaggggaaaaaatcggaagaaagttttaacactgcttgggttatcgtcattggtcggagtgacttggggactggctatttttacgcctctgggcctatcaacagtctatatttttgcgctattcaacagtcttcaggggtcatcagtggactgtcaagcactgtctgcgggtgagaaactgctgtctctgttagggctcccacaacagccctggaagctccgagctgcagcccacctcccggttaggatgttgggtgccgacgtagactgcaaatggatgaggtttgcttcgcctccatcaccccaggcagtcgagaggcaagagggtgggcctagcctgtacgcaaggcggtgcgttcccggtcgcgagatcctaggcagagggcactgcatcatctag

SEQ ID NO: 50496 - DNA, 1650 bp, Artificial Sequence
  Description of Artificial Sequence: Synthetic coding sequence
atggccacacccaggggattaggggctctgcttttgctactgctgctaccgaccagcggccaggaaaaaccaacagagggtccacgcaacacttgcctgggatcaaacaatatgtacgacatattcaaccttaacgacaaagcactgtgctttaccaagtgtcgtcagtcgggctctgacagttgtaacgtggagaatttgcaacggtactggttgaactatgaggcacacctaatgaaggagggtttaacccagaaagttaataccccctttctcaaggccttggtgcaaaacctcagtacaaacacagcagaggacttctatttctccctcgaacctagccaagtgcccaggcaggttatgaaagacgaggacaaacctcccgacagagtacgcctgcctaaatccctcttccgcagcctgccagggaaccggagcgtggtgaggctggctgtgactatccttgacattggacccggaacactctttaaaggcccacggttggggctgggggacggctcgggcgtgctcaacaacaggctggtgggcctgagtgtgggccagatgcatgtgactaagctggcagaaccgctggagatcgtgttctcacatcagcgccctcccccaaatatgaccttaacctgcgtattctgggatgttaccaaagggaccacaggcgactggtcatcagaaggatgtagcacagaggtaaggcctgagggcaccgtgtgctgttgtgaccacttaacattctttgccttattgttgcgtcctacactggatcagagcacggtgcacatactgacccggattagtcaagcagggtgtggagtctctatgatatttctggcattcaccataatcctgtacgctttccttcgcctgtcccgtgagagatttaagagcgaggacgccccaaagattcacgtcgccttgggtggatcactgtttctgctgaatttggcctttttagtaaatgttggctccggcagtaagggcagcgacgcggcatgctgggctaggggcgctgttttccactattttctactctgtgcgtttacatggatgggcctcgaagcattccacttatacctgctcgccgtaagggtgtttaacacttactttgggcattacttcctcaaactgagtttggtggggtgggggctacccgctctcatggtcattggcactggcagtgcgaattcatacggcttatacaccatcagagacagggagaatcgcaccagtctggaactttgctggttcagggaaggcaccacaatgtacgccctgtacatcacggttcacgggtacttcctgatcactttcctatttggcatggtggtgctagcgttggtggtgtggaaaatttttacactcagccgcgcaactgctgtaaaggaaagaggtaagaatcgtaagaaagtattgactttgctcggcctgtctagtctggtcggcgtaacatggggcctggcaatctttacaccactgggcctttctaccgtgtatatatttgcactgttcaatagcctccagggtgtattcatctgctgttggttcaccattctctatctgccatctcaaagcactaccgtctcttcatccactgccagactcgaccaggcccactctgccagtcaggaatag

SEQ ID NO: 50497 - DNA, 1290 bp, Artificial Sequence
  Description of Artificial Sequence: Synthetic coding sequence
atgaaggacgaagacaagcctccagaccgcgttagacttcccaaatccctcttccgttccctccccggaaatcgctctgttgtgagactggctgtgactattctcgacattggcccaggaaccctcttcaagggaccacgtcttggactgggcgacggatccggggttctgaacaaccggcttgtgggcctgagtgtcggccagatgcatgtgacaaagctcgcagagccactggagatcgttttctctcatcaacggccacctcctaatatgaccctgacctgcgtgttttgggacgtgaccaaagggacaaccggcgactggagcagtgagggctgctcgaccgaggtgcggccagaggggacagtctgttgttgcgatcacctcacgttttttgctttactattaaggccaacgttggatcagagcacggttcatattctgaccagaatctcacaggcagggtgtggtgtgtctatgatctttttggcttttaccatcatcctttacgcgtttcttcgactgtctagagaaaggtttaaatcggaggatgcacccaagattcacgtggcactagggggatccttatttctcctcaatctagcattcctcgtgaacgttggcagcggaagtaaaggcagtgatgctgcctgttgggccaggggcgcagtgttccattacttcttactgtgtgcgttcacatggatgggactcgaagctttccacctgtatctgctggctgtacgggtcttcaacacctatttcggccattattttttaaagcttagcttagtgggttggggattaccagctcttatggtaataggaaccggatctgccaattcatacggcctgtatacgatcagagacagggagaaccgtacgtcactggaactctgttggttcagggaagggactacaatgtacgcactctacatcaccgtgcacgggtacttcctgataacgtttctgttcgggatggtagtgcttgccctcgtggtgtggaagatcttcaccctgtccagggccacggccgtgaaagagcgtggcaaaaaccgaaaaaaagtcctgacgttgctgggcctcagcagccttgtcggcgtgacgtggggcctcgccatattcacccctctgggactgtcgaccgtttatatctttgctctcttcaactcacttcagggtgtttttatttgttgttggtttactatcctgtacctgccgagtcagtctacaaccgtgagctcttccaccgcgagacttgaccaggcacacagtgccagccaggagtag

SEQ ID NO: 50498 - DNA, 1074 bp, Artificial Sequence
  Description of Artificial Sequence: Synthetic coding sequence
atggctactactgttccagacggctgccgaaacgggctgaagagcaagtactatcgtttatgcgataaggcggaggcatggggcatcgtgctggaaacggtggcaacagccggagtcgtcactagcgtcgcgtttatgctaaccctgcctatactggtgtgtaaggtgcaagacagcaaccgcagaaagatgctgccaacacagtttctgtttctcttgggcgtgttagggattttcggactaacattcgcttttatcatcggtctagatggatccacaggtccaacccgtttcttcctatttgggatattattcagcatttgcttctcctgtctattggcccacgctgtcagcctgacaaaactggttagggggaggaaacccctgagtttgctggtgatactgggcctggccgttggctttagtctggtgcaggacgtcatcgccatcgagtacattgtgctgacaatgaatcgcaccaatgtgaatgtgttctctgagttatctgcccctcgaagaaatgaggatttcgttcttctcctgacttacgttctgtttctgatggcgctcacattcctgatgtcctcgtttaccttttgtggcagcttcacaggatggaagagacacggcgcacacatctatctgaccatgctgctgtccatcgctatatgggtcgcttggatcactctgctgatgctgcccgatttcgatcggaggtgggacgacactattctttccagcgctttagcggctaacggctgggtattcctccttgcctacgtctcgcctgagttttggctgctcacaaaacagagaaatcctatggactatccagtcgaggatgccttctgcaagccgcagctggtgaagaaatcctacggcgtggaaaatagggcttattcccaagaggaaataacacaagggtttgaagaaactggcgacacactctacgccccttatagtacccacttccagctgcagaatcagcctcctcagaaagaattcagtattccaagggcccatgcgtggcccagtccatacaaagattatgaggtcaagaaagaggggagttag

SEQ ID NO: 50499 - DNA, 825 bp, Artificial Sequence
  Description of Artificial Sequence: Synthetic coding sequence
atggcgactaccgtcccagacggatgcaggaacggactgaaaagtaaatactatagactttgtgacaaggccgaggcctgggggattgtgctggagactgtggccactgccggagtcgtgacaagtgtggcctttatgctaacgctgccaattcttgtatgtaaggttcaggactcaaataggcggaaaatgcttcccactcagtttctcttcctgctcggcgtgctggggattttcggccttacatttgcatttatcatagggctggatggttctactggacccactcgcttttttctttttgggattttattcagcatatgctttagttgccttctggcccacgctgtttctttgactaagctggtcaggggcagaaagccactttccctcctcgtcatactgggcctggctgtcggctttagcctcgtacaagacgtgatcgcaatcgagtacatcgtgctgaccatgaaccgcactaacgtgaatgtctttagtgagttgagcgctcctaggcggaacgaggatttcgttctgttgcttacatacgtactgttccttatggccttgacttttctgatgagcagcttcacattctgtggaagcttcactgggtggaagagacacggggctcatatctacctgaccatgctcttgagtatcgcgatatgggtcgcatggattacattgctcatgctgccagacttcgatcggagatgggacgacacgattctctcttctgccctcgccgctaacggatgggtgtttctgctggcctatgtgtcccctgagttctggctcctcacaaagcagaggaatccctag

SEQ ID NO: 50500 - DNA, 2781 bp, Artificial Sequence
  Description of Artificial Sequence: Synthetic coding sequence
atggcatttctcattatcctcattacttgcttcgttattattctggcaaccagccaaccatgtcagaccccagacgatttcgtagcagccacatcccccggacacattatcatcggagggctgtttgccattcacgaaaagatgctgtctagtgaagactctccgaggcgacctcagattcaggaatgtgtgggcttcgaaattagtgtatttcttcagacattagcaatgatccattcaatagaaatgataaacaacagcacactactgccaggtgttaaactgggctacgagatttacgacacgtgcacagaggtgacagtcgctatggccgcaactctgcggttcctgtctaagtttaattgttctcgtgaaacggtggaattcaagtgtgactacagtagctatatgcctagggtgaaagcagtcatcgggagtggatacagcgaaatcacgatggccgtgtccagaatgttaaatttgcaattgatgcctcaagtcggctatgagtccaccgctgagatcttaagcgacaagattcggtttccttcttttcttcgtaccgtgcccagcgactttcaccagatcaaggctatggcccaccttattcagaaatccgggtggaattggatcggaatcatcacaaccgacgatgactacggtagactcgccttaaacacctttattatacaggctgaggcgaacaatgtctgtatcgctttcaaggaggtcttacccgcattcctctcagacaacacaatagaagtgaggatcaatagaacccttaagaagatcatcttagaggctcaggtgaacgtgattgtggtgtttctgagacagtttcatgtgtttgacctcttcaataaggcaattgagatgaacatcaataagatgtggatcgccagcgataactggagcactgccactaaaatcaccaccatcccgaacgtcaaaaaaatcggtaaagtcgtgggattcgcatttcggagggggaacatctctagtttccacagctttttacagaacttgcatctccttccgtctgactcccataagctcctacacgaatatgccatgcacctgagcgcctgcgcctatgttaaagacaccgatctgagccagtgtattttcaatcatagtcagaggactttggcatataaagccaataaggccatcgaaaggaacttcgtgatgaggaacgactttctgtgggattatgcagagcccggactaattcatagcatacaactggccgtttttgccctgggctatgctattagggatctgtgtcaggctcgggattgccagaatcctaatgcctttcaaccatgggaactgctgggagtgctgaaaaacgttacctttactgatgggtggaacagcttccactttgacgcccatggcgacttaaacacggggtacgacgttgtcctgtggaaagaaatcaatggccacatgacagttacaaagatggctgaatacgatctgcagaacgatgtctttattattcctgatcaagagacaaagaatgaatttaggaacctcaagcaaatacagtctaagtgttccaaagagtgcagccccggacagatgaagaagactacccgctcccagcatatttgctgttacgagtgccagaattgtcctgagaaccattacaccaatcagaccgacatgccccactgcttattgtgtaataataagacacactgggcccctgtaaggtcaaccatgtgctttgaaaaagaagtcgagtacttgaactggaacgactctctagccatcctacttcttattctctcactcctggggattatattcgttctcgttgtgggaattattttcacccggaacctgaacacgcctgttgtgaagagctctggcggactccgggtgtgttacgtcatcctgttgtgccactttcttaattttgccagtacatccttcttcatcggcgagccacaggattttacctgcaaaactcgccagactatgtttggggtatccttcacactgtgcatcagttgcattctgaccaaatctttaaaaatcttgttagcctttagcttcgatccaaaactccagaagttcttgaaatgcctgtatcggccaattttaattatatttacctgcaccggtatacaagtggtcatttgcaccttatggcttattttcgcagctccaaccgtggaggtaaacgtgagcttgccccgagttattatcttggagtgtgaggaagggagcattttggcatttgggacgatgcttggatacatcgccatcctagcctttatttgctttatcttcgcattcaagggcaaatacgaaaattacaatgaagccaagttcataacattcggtatgcttatttattttatcgcctggataacttttattcctatttacgcgaccacgtttggaaagtacgtccccgcagttgaaatcattgtgatactcatcagcaattacggcatcctgtactgtaccttcatcccaaagtgttatgtcattatttgcaagcaggagatcaacacaaagagcgcattcctgaaaatgatttactcatattcctcccacagcgtcagcagcatcgccctgtctccagcaagcctcgattcgatgtctggcaatgtcactatgaccaacccaagctccagcggtaaatcagcaacatggcagaaaagcaaggatcttcaggcacaagccttcgcacatatttgccgggagaacgcgacatcggtcagcaagactttgccacgcaagaggatgagcagcatctag

SEQ ID NO: 50501 - DNA, 2568 bp, Artificial Sequence
  Description of Artificial Sequence: Synthetic coding sequence
atggcttttttaatcattcttattacctgcttcgtcatcattctcgcgacatctcagccatgtcagactccagacgattttgtcgcagcgactagtcccggtcacataattatcggcggtctgtttgcaatccatgaaaagatgctgagtagcgaagattctcccagaaggccacaaattcaggagtgtgttggctttgagatctccgtgtttcttcagaccctcgcaatgatacattcgatagaaatgatcaacaattctaccctgttgcccggagtaaagctaggctacgaaatctacgacacttgtacggaagtgactgtggccatggccgcaacccttagatttttgagcaagtttaactgctcaagagagacagtcgagtttaagtgcgactactcttcttacatgccccgtgtaaaagccgttatcggcagtgggtatagcgaaatcacaatggccgtgtccagaatgttaaaccttcagctgatgccgcaagtgggatatgaaagcaccgccgaaattctgtcagacaagatcaggttcccaagcttcctccgtacagtcccttcagatttccatcagatcaaggcgatggctcacctcatacaaaaaagcggctggaactggatcggcatcatcaccacagacgacgattatggccgactggcgctgaacactttcataatccaggcagaggcaaataatgtgtgtatcgctttcaaggaagttctgccagcattcctttcagacaacacaatcgaagtgcggattaaccggaccctcaaaaaaatcattctcgaagctcaggtaaatgttatcgtggtctttctgaggcagtttcacgtgtttgatcttttcaataaagcaattgagatgaatataaataagatgtggattgcatctgataattggagcactgccaccaagattacaacaatcccgaatgtgaaaaagattggcaaagtggttggcttcgcatttagaagggggaacatctcaagctttcattccttccttcagaacctgcatttactgcctagcgatagccataagttactccacgaatacgcaatgcatctttctgcctgcgcctatgttaaagacaccgacctgtctcaatgtatcttcaatcattctcagagaactcttgcctataaggcaaacaaggctattgagaggaatttcgtcatgcgaaatgatttcctgtgggactacgccgagccaggactgatccacagtatccagctcgccgtttttgccctagggtatgccattagggatctttgccaggcgagggattgtcagaatccaaacgcattccagccttgggagcagattcaaagcaaatgtagtaaagagtgcagtccgggacagatgaaaaaaactacacgcagccagcacatctgttgctacgagtgtcagaactgccccgagaatcattacacgaatcagaccgatatgccacactgcctgttgtgcaacaacaaaactcattgggctccagtgagatcaacaatgtgctttgagaaagaggtggagtacttgaattggaatgattccctggcaatcctcctgttgatactatctctactgggcattattttcgtcctggtggtcggtataatctttactaggaacctcaacactccagtggtgaagtcaagcggtggtctgagggtatgctacgtgatcctactgtgtcacttcctgaacttcgccagcacatctttcttcataggggagccgcaggatttcacttgtaagactagacagacaatgttcggcgtgtcctttaccttgtgcatctcctgtattctcacaaagtccctgaagattctgttggctttttcattcgatccaaaactgcaaaagttcctcaagtgtctgtaccgcccaatactgatcatttttacctgtaccggaatccaggtggtgatatgtactctctggctcattttcgctgcacccactgtggaggtcaatgtctccctccccagggtgattattctggagtgcgaagagggtagtatcctggcctttggcactatgcttggatatatcgccattcttgccttcatttgttttatcttcgcattcaagggaaagtacgaaaactacaatgaagcgaagtttatcacttttggaatgctcatctacttcatcgcatggatcacattcataccaatctacgccacgacctttggcaaatatgtccctgctgttgagataatagttattctgatctctaattatgggattctgtattgcacgttcatccctaaatgttacgtcataatctgcaaacaagagatcaataccaagtccgcctttctgaagatgatttacagttactcaagtcattctgtatcatccattgctttgagccctgccagtttagatagcatgtctggaaacgtgactatgactaaccccagtagttcgggtaaatctgctacctggcagaaaagcaaagatctccaggctcaggcctttgcccacatctgccgagagaacgcaacttccgtgagtaaaaccctgcccaggaaacgcatgtcatccatctag

SEQ ID NO: 50502 - DNA, 2256 bp, Artificial Sequence
  Description of Artificial Sequence: Synthetic coding sequence
atggcattcctcatcatattgattacgtgctttgtgataattctggccacatcgcaaccctgccagacccccgacgactttgtggccgcaacctctcccggacatatcataatcgggggtctgtttgccatccatgagaaaatgctgagttcagaggactccccgcgaaggcctcagattcaggagtgtgttggctttgaaatatcagtgtttcttcagacattggctatgattcacagcatcgagatgatcaacaacagcaccttgctgcccggtgtcaagctcggctacgagatctatgatacttgtacggaggtcacagtcgcaatggcagccacactgcgctttctttcgaagtttaattgtagccgggagactgtggagtttaagtgtgactactcatcctatatgccgagagtgaaggccgtcatcgggagcggttatagcgaaattactatggcggtctccaggatgctgaatttgcagctgatgccccaggtgggatacgaatctacggccgagatactgagcgataaaataaggttcccatcattcctgagaacggtcccaagcgacttccatcagatcaaggcaatggcccacctcatacagaaatcaggatggaattggatcggcatcatcactactgacgacgactatggcaggctggccctgaacacattcatcatccaggctgaagccaataatgtgtgcatcgcttttaaggaggtcctgccagcttttctctccgacaacacaatcgaggtgcgtatcaatagaactctgaagaaaataatactggaagcccaactgctcggagttttgaagaatgtgaccttcactgatggatggaattccttccactttgacgcccatggtgatcttaacaccggatatgatgtggtgctgtggaaggagattaacgggcacatgaccgtcaccaaaatggctgagtacgacttacaaaatgatgttttcatcattcctgaccaagaaacaaagaacgagtttaggaatttaaagcagatccaatctaaatgttccaaggaatgcagccctggccaaatgaaaaaaactactaggagccagcacatttgttgctacgagtgtcagaattgtcccgaaaatcactacaccaaccaaaccgacatgcctcattgcctgttgtgtaataataaaacccactgggcgcctgtaaggtccactatgtgcttcgagaaggaagtagaatacctgaattggaatgatagtctagctatccttctgttaattctgtccttattaggcataatcttcgtgcttgtggttgggattatctttactcgcaacttaaatacacccgtggtaaagagcagtgggggtctcagagtatgctatgtgatccttctgtgtcacttcctgaactttgcctcaacttcattcttcatcggggagccccaggacttcacctgcaagacacgtcagactatgttcggagtcagttttaccctgtgcatctcatgcatcctgaccaaatccctcaagattctgctcgcattttcgtttgatccaaagctgcaaaagttcctaaagtgtctgtatcgcccaattctcatcatctttacatgcacggggatccaagtagttatttgcaccctctggctcatcttcgcggcaccaacagtggaggtgaatgtgagtcttcccagagtcatcatcttagaatgcgaggagggcagtatcctggcctttggcaccatgctcgggtacattgccatcttggcatttatttgttttatcttcgcattcaagggcaagtatgagaactataacgaagcaaagtttattacgttcggtatgttaatttactttatcgcttggatcacatttataccaatctatgcaactacttttggtaagtacgtcccggcagtcgaaatcatcgtcatcctcatctctaactacggcatactgtactgtacatttattccaaaatgttatgtgatcatctgtaagcaggagatcaatacaaagtccgcattcctcaagatgatttacagctacagctctcacagcgtgtctagtatcgcgctgagtccagccagcctggatagcatgtcaggcaatgtaactatgaccaatcctagttctagcggtaagagcgctacctggcagaaatccaaggacctgcaggcccaggccttcgcccatatctgcagagaaaacgccacctctgtatctaaaacactgcctaggaagaggatgagcagcatttag

SEQ ID NO: 50503 - DNA, 330 bp, Artificial Sequence
  Description of Artificial Sequence: Synthetic coding sequence
atgaaagaggaggattctagcttcaagctgtgtgttcccggaatcgtggccctgcaatcccctccaaacaaggcttttcggagtactgacactgtcggttttcttgaatctgagttaaagaagcttcttggcatgcagcaggagtctaggctctggaagctcggaagccaggaaggcagagaactgctgactagacccgagatcactgttgtcgagggagaaggctacgaggtgcagcgcagactccgccacctgccatcccccatctccgttgctcagtgcctcttgcttgaggagaagggcgagatgggcaactggccaccagagtag

SEQ ID NO: 50504 - DNA, 2886 bp, Artificial Sequence
  Description of Artificial Sequence: Synthetic coding sequence
atgctgctgctcctcctccttgcgccattgttccttaggcctccaggtgctggcggagtgcagacaccgaacgcaacaagcgaggggtgtcagattatccaccccccatgggagggcggtattcgatatcgcggacttacaagggatcaggtgaaggcaatcaactttctgcccgtggattatgaaatcgagtatgtgtgtaggggggaacgggaagtggtaggtcctaaagttaggaaatgtctggcaaatggaagctggacagacatggacacaccaagtcgctgcgtccgcatttgctccaagtcttacctcactttagagaatggtaaagtcttcctgacgggaggcgacttgcccgcactggacggagcccgagttgactttcgctgcgaccccgactttcacttagtgggctccagtcgcagcatctgttctcaagggcagtggtccacgcccaaacctcattgccaagtcaatcggacacctcactcagaaagacgcgctgtgtatattggcgctctgtttcctatgtctggcggttggccaggcggacaggcatgtcagccagccgtcgagatggccctggaggatgtcaacagcaggcgagatatactgccggattatgaactaaaactaatccatcatgatagtaagtgtgatcccggacaggccaccaaatatctgtatgaattgttatataatgaccccattaagattattctgatgccaggctgctcctctgtctctactcttgttgccgaggctgctaggatgtggaacctgattgtccttagctacggctctagtagtcctgcgctgtcaaatcgacagcggttcccaaccttttttcgaactcacccttcagccactctccacaatccgacccgagtgaaactctttgaaaagtggggctggaaaaaaattgctacaatccaacagacaacagaggtctttacctcaaccttggacgacttggaggagagggtcaaggaggcgggtattgagatcacatttcgccagtccttcttcagtgaccctgcggtccctgttaaaaacctgaagcgtcaagacgctagaattatcgtcggcttgttctacgagacagaggccagaaaggtgttttgtgaggtctacaaggagagactgtttgggaaaaaatacgtgtggttcctcataggctggtatgctgataactggttcaagatttacgacccaagcatcaattgtacggtagacgaaatgaccgaagccgtggaaggacatatcactactgagattgtgatgctgaaccccgcaaacacacgctcaatcagtaacatgacctcccaagagtttgtggaaaagctgacaaagcgcctaaaacgccaccctgaagagacagggggattccaagaggctcctcttgcctacgacgccatttgggctctcgctttagccctgaataaaacaagcggtggcggaggaaggtccggagtcagactggaggatttcaattataacaaccagactattaccgaccagatctatagagctatgaactcttccagtttcgagggggtgtccgggcatgtggtgttcgacgcctcgggctctcggatggcctggacattgatcgaacagctccaagggggttcttacaagaagatcggctattatgacagtacaaaggacgacctatcgtggtccaagacagacaaatggattggcggatctcctccagccgatcagacactagttattaaaacatttcgttttcttagccaaaagctgttcatatctgtgagcgtgctctcctccctgggcatcgtgcttgcggttgtttgcttgtctttcaacatttataacagccatgtaagatatattcagaactcccagcccaacctgaacaacttgaccgctgtggggtgttctctggccctggcggcagtattccctttggggctggacggatatcatatcggaagaaaccaatttccctttgtgtgtcaggcaagactgtggttgttagggctggggttcagcttaggctacggttcgatgttcacaaagatctggtgggtccataccgtgttcactaaaaaagaggagaaaaaggaatggcgaaaaacactcgagccctggaaactctacgctacggtgggccttctggtggggatggacgtgctcaccctcgccatttggcagatcgtcgatcccctgcaccggaccatagagacttttgccaaggaagagcctaaggaagatattgacgtctcaatcctcccccagctggaacactgctccagtagaaagatgaatacgtggctggggatcttttacgggtataaaggcctcctgttgctgctgggcatctttctcgcatacgagaccaagtctgtctctacagaaaaaatcaacgaccacagggccgtcggtatggccatctacaacgtggctgtgttgtgcctaatcacagctcctgtgaccatgattctgtcgtcgcagcaagacgcagcctttgcctttgccagtttagccatagtgttcagctcgtacattactctcgtggtgctgttcgtacctaaaatgcgacggctgatcacacgcggagagtggcaatcagaagcacaagacacgatgaagacaggcagctcaactaataacaatgaagaggagaagtcaaggttgctggagaaagaaaacagggagctggagaagataatcgcagagaaagaagagagagttagtgagctccggcatcagcttcagagccgccagcagttacggtctaggcggcatccgcctacacctccagagccctccggaggcctaccccgtggcccacctgagccaccagaccgcttatcttgtgatggctcccgagtgcacctgttatacaagtag

SEQ ID NO: 50505 - DNA, 2700 bp, Artificial Sequence
  Description of Artificial Sequence: Synthetic coding sequence
atgctgctcttgcttctgttagcacccctgtttctaagacctccaggcgctggtggggtccaaacaccaaatgctacaagcgaggggtgccaaatcattcatcccccatgggagggaggaatacgctatagaggcttgacaagagaccaggtgaaagccatcaacttcctcccagtggactatgagattgaatacgtgtgcaggggcgaaagagaggttgttgggcctaaagtccgaaaatgtctggccaatggatcttggacagatatggatacgccctcccgttgcgtgaatagaacccctcactcggaacgcagggctgtatatattggagctctgttcccgatgagcggcggttggcctggagggcaggcatgccagccagcagtcgagatggcactcgaggatgttaattccaggagggacatcttaccggactacgagctgaagcttattcaccacgactcaaaatgcgatcccggacaggctactaagtacctgtatgagctcctgtataacgaccctatcaaaattatcctgatgccgggttgtagctccgtgagtaccttggtggcggaggccgctcggatgtggaacctgatcgttctgtcttatgggagctcatcacctgctctttccaatagacagaggtttccgacattttttcgcactcatcccagcgctacactacacaatcctaccagagtgaaactatttgaaaagtgggggtggaagaagattgcaacaatccaacagaccactgaggtctttacgtcaacactcgatgacctggaagagcgggtgaaggaagctggaatcgaaataacatttcggcagtccttctttagtgatcccgcagtgcctgtcaagaatttaaagagacaggacgcaagaatcattgtgggcttgttctacgaaactgaggctagaaaagtcttctgtgaggtgtacaaagagaggctgtttgggaagaagtacgtctggtttttgatcggatggtatgccgacaattggttcaaaatatatgacccgtcaattaactgtacagttgatgaaatgactgaagctgtggaagggcacataactactgaaatcgtgatgttgaatcccgcaaatactagatcaatttctaatatgacatctcaggagtttgtggagaagctgaccaaacgcctgaagaggcacccagaagagacggggggattccaggaggctcctctcgcatacgatgcgatatgggcactcgctctggcgctgaataaaacttccggtggagggggtcgttccggggtacgacttgaggacttcaactataataaccagacgattaccgatcagatctaccgagccatgaactcaagctcttttgaaggtgtgagcgggcacgtggtgtttgacgcatccggctctaggatggcctggacactgatagaacagctacaagggggtagctataagaagattggctattatgactccacaaaagacgacctgtcatggagcaaaactgataagtggattggaggatctcctccagccgatcagacattagtcattaaaacctttagatttctttcccagaaactgtttatcagtgtgtctgttttgagttctttggggatagtgcttgctgtggtgtgcctcagtttcaacatatataattcacacgtacgatacatccagaacagccaacccaatctaaataatttaaccgcagtggggtgttcactggctctcgcagcggtgtttcccctaggcctggacggatatcacatcggcaggaatcagtttccctttgtatgtcaggcccgtctctggttactagggctcggattcagtctggggtatggcagcatgttcaccaaaatctggtgggtgcatacagtgttcacgaaaaaggaggaaaaaaaagaatggcgtaagacactggaaccttggaaactgtatgccacggtaggcctgctcgtggggatggacgtactgacactcgcaatctggcagatagtcgatccactacatcgtacaattgagacattcgccaaagaagagcccaaagaagatatagatgtctctattctgccacaacttgaacactgtagtagccgaaaaatgaacacgtggctcggcatcttctatggatacaagggtctactgctcctcctggggatcttcttggcctacgaaaccaaatccgttagcaccgaaaagatcaatgatcaccgggcagtcggtatggcaatatacaacgttgctgtgctttgcctgatcacagctcctgtgactatgatcctaagcagccagcaggacgcagccttcgccttcgcttctttggccatcgtgtttagttcttacattaccttggtcgtcctgtttgtgccaaaaatgagacgacttatcacacgaggcgaatggcagagtgaagcgcaggacacaatgaaaacaggctctagcacaaataataacgaggaagagaaaagtcgcctgctcgagaaagaaaatcgggagcttgaaaagataatcgctgagaaggaagagcgagttagcgagttaaggcaccagctccagtcgcgccagcagctgagatccagaaggcaccctcccactccccctgagccatccggcggactcccccgtggcccacccgagcctcctgataggctcagctgtgacggcagcagggtccacctgctctacaagtag

SEQ ID NO: 50506 - DNA, 2535 bp, Artificial Sequence
  Description of Artificial Sequence: Synthetic coding sequence
atgggccctggcgcaccattcgccagggtgggttggcccctcccattactggttgtgatggcagccggagtggcgccagtatgggctagtcattcacctcatttaccacgtccacatagtcgggtccccccacatccttccagtgagagaagggctgtctatattggggctctcttccccatgtccgggggatggcctggcggacaggcttgtcaaccggctgtggaaatggcactggaggatgtgaatagccgaagagacattctgcccgactatgaactcaagctgatccaccatgactccaaatgtgacccaggccaggctaccaagtacttgtacgagctgttgtataatgacccaatcaagatcattctcatgcccggttgctcatccgtgtccacgctggtggccgaggcagcgagaatgtggaatcttattgtccttagctacggcagtagttctccagctctgtccaataggcaaagatttcccaccttttttcgcactcatccaagcgctactctgcataatcccacacgcgtcaagcttttcgaaaagtggggctggaagaagattgccactatccagcagaccacagaggttttcacaagcacactggacgacctagaagagcgcgtgaaagaggccggaatagagattacctttagacagagttttttctctgacccagccgtcccggtgaaaaatttgaagcgacaggacgcacgtataatagttgggcttttttacgaaaccgaggcacgaaaagtcttctgtgaggtctacaaagagcggttgttcggaaaaaagtacgtctggtttctgatcgggtggtacgctgataattggtttaagatctacgatccatctatcaattgtacagtggacgagatgacagaggccgtggagggtcacattactaccgagattgtaatgcttaatcctgcgaatacccggagcatctccaacatgacatcccaggaatttgttgaaaagttgacaaaacggctcaagcggcaccctgaggagactgggggttttcaggaagcacctctggcatatgatgcaatctgggctctggcccttgccctcaataaaacttccgggggaggagggagaagtggagttcggctcgaggattttaattataacaatcagacaattaccgaccaaatttacagggctatgaatagctccagtttcgagggagtgagcgggcatgttgtcttcgatgcctctggcagccgcatggcctggaccctcattgagcagctgcaagggggtagctacaagaagatcggttactatgattcaaccaaagacgatcttagttggtccaagaccgacaagtggataggaggatccccccctgccgaccagaccttagtcattaaaacatttaggtttcttagtcagaagctctttatttctgtgtccgtgctgtcatccttaggcatagtgcttgccgtggtatgtctgagctttaacatctacaactcccacgtccggtacatccagaatagccagccaaacctgaataatctgaccgctgtgggatgtagtttggccctggctgcagtttttcccctcggtctcgacggctatcacattgggcgtaaccaattcccttttgtgtgccaggctagactgtggctgttggggctgggcttcagcttgggctacggaagcatgtttacaaaaatatggtgggtgcataccgttttcaccaagaaagaagagaagaaggagtggaggaagacactcgagccatggaagctttatgccaccgtcggactcctggtggggatggatgtgctcacactggctatttggcagatagtcgatcctctgcatcgtactattgagaccttcgcaaaagaggagcccaaggaggacatcgacgtgtccatattaccacaactggagcactgtagctccagaaaaatgaacacctggctcgggattttctacggatacaagggactcctgcttctacttggcatatttctcgcttacgagaccaagtctgtctcgacagagaaaattaatgaccatagggcagtgggcatggccatctacaacgtggccgtgctgtgtttgataactgcacctgtgactatgatcctgtcatcccagcaggatgcagccttcgcgtttgctagcctcgccatagtcttctccagctacattacactggtcgtgctctttgtaccgaaaatgcgtcgtctgattacacgaggggagtggcagagtgaagcccaagacacaatgaagacagggtcttcaaccaacaataatgaggaagaaaaatctagacttctcgagaaggagaatagggaactcgagaagattatagcggaaaaggaggaaagagtcagcgagctgaggcaccaactccagagtcgccaacagctccggtccaggcgacaccctcccacgcccccagagccgagtggtgggttgccccgaggacctcctgagcctcccgataggctgagttgcgatgggtccagggtgcatctgctgtataagtag

SEQ ID NO: 50507 - DNA, 2535 bp, Artificial Sequence
  Description of Artificial Sequence: Synthetic coding sequence
atgggcccaggtgctcccttcgcccgtgtcgggtggcctcttcctttactcgtggtcatggcagcaggggtcgctccagtttgggcgtcgcactcaccacaccttccacgtcctcactctagagtaccaccacacccatcgtcggaacgccgtgccgtgtacataggagcactgtttcctatgtcaggaggctggccagggggacaagcctgtcaaccagccgtggagatggccctcgaggatgtgaattcccgaagagatattctacccgactacgagctcaagttaattcatcatgatagtaagtgcgatccaggccaggccactaagtacttgtacgagctgctctacaatgaccccatcaagattatcctcatgcctggctgctctagcgtctctacactggtcgctgaggcagctcgaatgtggaatctgatcgtgctctcttacggctcctccagtccagctctgtcgaataggcaaagattccccaccttcttccgcactcatccaagtgctacgctacacaaccccacacgcgtcaagcttttcgaaaagtggggctggaaaaagattgccaccatacagcagacaacggaagtgtttacctcaaccctagatgatctcgaagaaagggtgaaggaagccggaattgagattacctttaggcagtcgtttttctcagatccggctgtacccgtgaagaacttaaagaggcaggatgctcgaattatcgtggggctcttttacgaaacagaagcgcgaaaggtattctgcgaggtatataaggagcggctcttcggcaaaaaatacgtctggttccttatcggttggtacgctgataactggttcaaaatttacgaccccagcataaactgtacagtggacgagatgacagaggcagtggaggggcacatcaccaccgagattgtcatgctgaatcccgctaacacgagaagtataagtaatatgacttctcaggaatttgtggaaaaactgacaaaacgcctgaagagacacccagaggagaccgggggttttcaggaggccccattggcctatgacgccatttgggcattagccttggctctcaataagacttccggtggaggcggacgtagtggagtgcgcttagaggacttcaactataacaatcagactattaccgaccagatttaccgcgctatgaattcaagttcctttgagggagtaagcggacacgtggtattcgacgcttctggatctcgaatggcgtggacattgatcgaacaactgcaggggggatcatataagaaaatagggtattatgatagtacgaaggatgacctctcttggagcaagacagataaatggattggaggtagcccacctgctgatcagactcttgtgattaagacttttagattcttgagccagaagctgtttatctccgtatctgtactgtcctctctgggtattgtgctggccgtggtctgcctctctttcaatatctataacagccacgtccggtatatccagaattcgcagccgaatctgaacaaccttaccgccgtcggctgcagcctggcactcgcggctgtgttcccgctgggattagatggctaccacatagggcgaaaccaattcccgtttgtgtgccaagccaggctctggttactgggcctcgggtttagcctgggctacgggagcatgttcaccaagatttggtgggtccatacagtatttaccaagaaggaggaaaagaaggagtggcggaagaccctcgagccttggaagctgtacgctactgtaggccttctggtgggaatggacgtgctcaccttggcgatatggcagatcgtagaccccttgcaccgcaccatcgagacctttgcaaaggaagagcctaaagaagacatagatgtgtctatcctcccccagctcgagcactgttcaagcagaaaaatgaacacttggctgggcatcttttatgggtacaaggggctcttactgctgctggggatcttcctcgcatacgagacgaagtccgtcagtacagagaagattaatgaccatcgggctgttggcatggccatctacaacgtggccgtgctgtgtttaatcacggcaccagttacaatgattcttagctcccagcaggatgccgcatttgctttcgcctccctggcaatcgtgtttagttcttacattacgcttgttgtgctgttcgtgccaaaaatgcggaggttgattacaaggggcgagtggcaatccgaggctcaggacacgatgaagacaggctcgtccaccaataataatgaggaggaaaaatcacgtcttctagaaaaggaaaacagagagttagaaaaaattatcgctgagaaagaggagagggtctccgagctccggcaccagcttcagagcaggcagcagctcagatcacgaaggcaccccccaacaccacccgagcccagtggagggctgcctagaggccctcctgaaccgccagaccggctgagttgcgatggcagtcgagtccacctgttgtacaagtag

SEQ ID NO: 50508 - DNA, 1737 bp, Artificial Sequence
  Description of Artificial Sequence: Synthetic coding sequence
atgctcctcctgttactgctggccccactgttcttacgccctccaggtgcgggtggtgtccaaacacctaatgccacctccgagggctgtcagatcattcatccaccttgggagggcggaatacgatacaggggccttacacgagaccaggtgaaggccatcaactttctgcccgtagactatgagattgaatatgtctgtagaggagagcgcgaggtggtgggtccaaaagtacgtaaatgtctcgcaaatggttcctggactgacatggacacccccagccggtgcgttcggatctgctccaagtcgtatttaaccttagaaaacggcaaggtatttctgactgggggagacctgcctgcactcgatggagccagagtggatttcagatgcgaccctgattttcatttggtggggtcttctagaagcatttgtagtcaaggtcagtggagcacaccgaagccccactgccaggtcaatagaaccccccatagtgagaggcgcgctgtgtacatcggagccctgttcccaatgagtggcggatggcctggtggtcaggcttgtcagcccgctgttgagatggctctggaagatgtgaattcccggcgagacatcctgcctgactacgagctgaagcttatacaccatgattccaagtgcgaccctggacaagccaccaaatatctgtacgaattactgtacaacgatccgatcaagatcatactgatgcctgggtgcagcagcgtaagtaccctggtagcagaggccgcaagaatgtggaatctgatcgtactttcctatggaagctcctcccccgctttgtccaatcggcagcgctttcccacgttttttcgcacccacccgtctgctaccctgcacaatccgacacgggtgaagctctttgagaagtgggggtggaaaaagatcgctactattcagcagaccacggaggttttcacctctacccttgacgatctcgaggaacgcgttaaagaggcgggtatcgagatcacctttcgccaatcttttttctcagaccctgccgtgcccgtgaagaacttaaagcggcaagatgccagaatcatcgtgggcctgttctatgaaaccgaggcaagaaaggtgttctgtgaggtctataaagagagacttttcgggaagaagtacgtatggttcctcatagggtggtatgccgacaattggttcaagatttatgatcccagtattaactgtacagtggatgagatgaccgaggctgtcgaaggacatatcacgacagagattgtgatgctgaacccagccaacaccagaagcattagcaatatgacttctcaggaattcgtggaaaaactcaccaagaggttaaaacggcatccagaagaaactggcggtttccaggaagcccctttagcctatgatgcaatttgggctcttgccctcgccctgaataagacaagcggtggaggtggacggtcaggggtgaggctggaggactttaactacaataaccagacaattacagaccagatatacagggccatgaacagctcctcattcgagggcgtttccggccatgttgtgttcgatgcatccggctcccggatggcctggaccctcattgagcaattgcagggtgggtcgtataagaagattggctattatgattcgaccaaagatgacctcagctggtctaaaaccgataaatggattgtgatcagtaggacccactcaccgacatag

SEQ ID NO: 50509 - DNA, 1989 bp, Artificial Sequence
  Description of Artificial Sequence: Synthetic coding sequence
atggccgcagaaaacgaagccagtcaagaaagcgctctgggtgcctacagtccagtggattacatgtctattacctcttttcctcgtctgccagaggacgaacccgctcctgccgcacctctgcggggacgcaaagacgaagacgccttcctcggagatcccgatactgacccagattccttcctgaagtccgccagactgcaaagactgccctcctcttcctcggagatggggtctcaagacggctctcctctgcgtgagacacgtaaggatccattctccgcagctgctgctgagtgcagctgcaggcaggatggcttgactgtgatcgtcaccgcgtgcctcacttttgctactggggttacagtggctctggtgatgcaaatctattttggggacccccagatcttccagcagggagccgtggtcactgatgctgcccgatgtacctccctaggcattgaagtcctgtccaagcaaggcagcagcgtggacgctgccgtggctgctgcattgtgtttaggaattgtggccccacattccagcgggctcggcggtgggggagtgatgctagttcacgacatccgcagaaatgagagtcatttgatcgactttcgtgagagcgcccctggggcactgcgcgaagaaacgctgcaacgctcttgggagacaaagcctgggcttctagtgggggtaccaggtatggtgaagggtctgcacgaagcgcaccagctctacggccgactgccctggtcacaggtactcgcgtttgcagcagctgtggcccaggatggcttcaatgtgacccatgacctggctcgggctctcgccgagcagctgccacctaatatgagcgagagattcagggagacatttttgccctctggccgacccccactcccgggatctctgctgcatagacctgaccttgctgaagtgctggatgtgttgggcacttcaggaccggcagcattttatgccggtggaaatttgacgctggagatggtcgccgaagcccagcatgcaggtggcgtgataacagaggaggacttttccaactacagcgcccttgtcgagaaacccgtctgcggggtctaccggggacacctggtgttgagtcccccaccgcctcacacggggcctgctctgattagtgctctgaatatactggaaggcttcaatctcacaagtcttgtttcgcgagaacaggctttacactgggtagcagaaacccttaagatcgctttggcgctagcttcgcggttaggagacccggtgtacgattccactattactgaatccatggatgatatgctgtccaaagtagaagcggcttacctcagaggacacattaacgactctcaggctgccccagctccacttctgccggtgtatgagctcgacggagcacccaccgctgcccaggtgctcatcatgggacccgacgatttcatcgtcgcaatggtctcatctctgaatcagcccttcggcagcggcctgattacccctagcggtatattgctcaactcccaaatgctggatttctcctggcctaacaggactgcgaaccattctgcaccttctctcgagaattccgtgcagccaggtaagcggccattgagcttcctcctgcccaccgtggtccgccctgcagaggggctgtgtggcacttacctggcgctgggggcaaacggagccgcaaggggcctgtcgggacttactcaggttctattaaatgtactgacgcttaaccgaaatcttagtgacagccttgcgagaggcagactccatccagatctgcagagcaatctgttgcaggtggatagcgaattcactgaagaggagattgagttcctcgaagctcgcggacaccacgtggagaaggtggacgtgcttagctgggtgcatggctctcgcagaaccaataactttatcatcgcagtgaaggacccacgaagtccggatgccgcaggagccacaattctttag

SEQ ID NO: 50510 - DNA, 1185 bp, Artificial Sequence
  Description of Artificial Sequence: Synthetic coding sequence
atgatagtgttcatcttcctggccatgggtctcagtctggagaatgagtatactagccagacgaataattgcacctacctgcgagagcagtgtttaagggacgccaatggatgcaaacacgcctggcgcgtcatggaggacgcctgtaacgactcggacccaggggacccatgtaaaatgagaaactcgagctactgcaatttaagcatccagtacctggtggaaagtaactttcagttcaaggagtgcctctgcacggatgacttctattgtaccgtgaataagctgctcggtaaaaaatgcataaacaagtcggataacgtcaaagaagataaatttaaatggaatctgaccacacgaagccatcacggcttcaagggcatgtggtcatgcttagaggttgcggaagcgtgtgtcggagacgtggtttgcaatgcccagctggcttcgtacctgaaggcctgcagcgcaaacggtaacccatgtgaccttaaacaatgccaggccgcaatccgcttcttttaccagaacattcctttcaatattgcacagatgctggccttctgcgattgtgcccagtccgacattccttgccagcaatcgaaggaggctctgcactccaagacctgtgccgtcaacatggtgcctccccctacttgcctcagtgtgatccgcagctgccagaatgatgaactgtgtcgtagacattaccgcacctttcagtccaaatgttggcagagggtaaccagaaagtgccatgaagacgagaattgtatctcaacattgtccaaacaggatcttacatgctcggggagcgatgattgcaaggcagcatacatcgacatccttggaacagttctgcaggtccaatgcacatgtcgaactattacccagagtgaagagtccctgtgcaaaatctttcaacacatgctacacaggaaatcatgctttaactaccctacactctcaaacgtcaagggaatggcgctgtacacaagaaaacacgctaacaagataaccttgacaggatttcacagccccttcaatggcgaggtgatttacgccgctatgtgtatgaccgtgacctgtggcattctcctcctggtgatggtcaaactgcgcacttctagaatttccagcaaggcaagagatccctccagtatccaaatccccggtgagctctag

SEQ ID NO: 50511 - DNA, 1593 bp, Artificial Sequence
  Description of Artificial Sequence: Synthetic coding sequence
atgctgctctggcccctactgctgctattactacttcttccaactcttgctttgctaagacagcaaagatctcaagatgcaaggctgagttggctggctggactgcagcatcgggtcgcatggggggcactggtgtgggctgcaacctggcagagacgacgccttgaacagtctactctgcatgtacaccaatcccagcagcaggcccttcggtggtgtctgcagggagcacagcgccctcattgctccttgaggaggtctaccgacatcagtacatttcgtaatcacctgcccttaactaaagctagccagactcagcaggaggactcaggagaacagcccctccccccaaccagtaaccaagacctgggcgaggcttccttgcaggccaccctgttaggactggccgcactgaacaaggcttaccctgaagtcctggctcagggaaggaccgctcgggtgaccctgacctccccttggcccagacccctgccatggcctggcaacaccttggggcaggtgggaactccgggaactaaggacccacgcgctctgctcttagacgccctcagaagcccaggcctcagagctctggaagccggtaccgcagttgagctgttagatgtcttcctgggccttgagacagatggagaggagctggctggcgctatcgccgcaggtaaccccggagccccacttagagaaagggctgctgaactccgggaggccctggagcagggcccacgaggcttggccttgagattatggcctaagctgcaagtagtagtgacactggatgctggaggacaagcagaggccgtcgccgctttgggcgctctttggtgtcagggcctggcctttttttccccagcctatgccgctagcggaggcgtgctgggtctgaatctgcaaccagaacagccacatggactctacctgctaccacccggagcaccttttattgaattactccctgttaaagagggaacacaagaggaagccgcatccactttgcttctagcggaggcccagcagggcaaggagtacgagttggtgcttactgaccgtgcctctctgactcgttgcagactaggcgatgttgtgcgcgtggttggtgcatacaaccagtgtccagtggtgcgctttatctgtcgcttggatcaaacactttctgtgagaggtgaagacattggggaagaccttttctccgaagccctaggtcgcgctgtgggacagtgggcaggcgctaagctgttggatcacggatgcgtcgagtcttcaatcttggactcttccgcaggatcggcccctcattatgaggtcttcgtggcccttcggggacttaggaacctctccgaggagaatagagacaaattggatcactgccttcaggaagcgagtccacgctacaaaagcctcagattttggggaagcgtcgggcctgccagggttcatctcgtcggtcaaggggctttccgggctcttagagcagcattggccgcatgtccttcttcaccattccctcccgcaatgcccagagttctgcgccacagacaccttgcccaatgcctccaagagagagttgtgagctag

SEQ ID NO: 50512 - DNA, 1425 bp, Artificial Sequence
  Description of Artificial Sequence: Synthetic coding sequence
atgctgttatggcccctattgttgctgctgctcctgctccctactctagccttgttaagacaacagcgaccccactgctctcttcgaagatctactgacataagtaccttcagaaatcatttgcccctgacaaaagcttctcagacgcaacaagaggactccggggaacagcccctgcccccaacctccaatcaggatctaggcgaagcaagcctccaggccactttgctcggtctcgctgccctgaacaaagcctacccagaagttctagcccagggaagaaccgcacgtgtgacacttacctcgccttggccgaggcctctcccctggcccggaaatacactcggccaggtgggtacccccggaaccaaggaccccagagccttgctccttgatgcactccgaagtccgggattgagggccctcgaagcagggacggctgttgagctccttgatgtgtttctggggctggaaaccgacggggaagaactagcaggagcgatcgctgcaggcaacccaggagcccctctgcgtgagcgggctgcggaactcagggaggccctggagcaaggaccacggggattagccttgcggctgtggccaaaactacaggtggttgttacattggatgccggaggacaagcagaagccgtcgcggctcttggagccctgtggtgccaaggcctggcatttttttccccagcttacgccgcatctggtggtgttctgggcctgaatctgcaaccggagcagccacacggattatacttactgccacccggagcaccatttatagagcttctcccggtcaaggagggaacacaggaggaggcagcttcaactctgctgcttgccgaagctcagcagggtaaggagtacgaactcgttctcacagatcgggctagtctgacccggtgcaggctcggagacgtagtgcgcgttgttggggcttacaatcaatgccctgttgttcggttcatttgtcgactggaccagacgctaagcgtgaggggagaggatattggagaggatctgttctcagaggccctgggccgagcagtcggccaatgggccggagccaagctgctggatcacggctgtgtggagtcgagtattttggattcaagtgctggaagcgctcctcactacgaggtgtttgtggctctgagagggctgagaaacctctcagaggaaaacagggacaagcttgaccattgcctgcaggaggcatcccccagatacaaaagcttgaggttctggggcagcgtgggcccagctcgcgtccacttagtgggtcagggtgccttcagggccctgcgcgcagccctcgcagcttgtccctcaagcccctttcccccagcaatgccaagggtactccggcaccgccacctggcccaatgcctgcaggaacgggttgtgtcctag

SEQ ID NO: 50513 - DNA, 1425 bp, Artificial Sequence
  Description of Artificial Sequence: Synthetic coding sequence
atgcttctgtggccactgctcctgctgttgctgctgctgcctacactcgcacttcttcggcagcagcggagtcaggatgcaagactgtcttggctggccggactgcagcatcgagtggcatggggagctcttgtgtgggccgctacctggcagaggcgtcgactggaacaaagtaccttgcacgttcaccagtcccaacaacaggccctccgatggtgcttgcagggcgctcagcgtccgcattgttccctccggcgatctaccgatatctctaccttccggaatcatttacctctgacgaaggcttctcaaactcagcaggaggattctggcgagcagcctctgccccctacatccaaccaggacttaggcgaagccagtctccaggcaacacttctcggtctggccgctttaaacaaggcatacccagaagtgcttgctcaggggagaaccgctcgggttaccctcactagcccatggcccaggcccctcccatggcctggcaacaccctaggccaggttggaacccccggaaccaaagatccgcgagcgctgcttctggacgccctgaggtctccaggcttgagggccctggaggcaggtacggccgtggaacttctagacgtgtttctcggcctggagacagatggagaggaactggcaggcgcaattgccgctggcaaccccggtgctcctctcagagagcgcgcagccgagctcagggaggccctagagcagggcccacgcggattagctctgagactgtggccaaaactgcaagtcgtggtcactctggatgcagggggtcaggccgaagcagtggccgcattgggggctctttggtgccagggcctcgccttcttcagtccagcttatgcggctagtggaggagtgctggggttgaacctccaacctgagcagcctcatggactgtatctgctgccacccggtgcacccttcattgaacttctgcccgtgaaagaggggacacaggaagaggcagcttccacccttttgttggcagaggcgcagcagggtaaggagtatgaacttgtgctgaccgaccgagcttcactgacacgttgcagactgggcgatgtggtgcgagtcgtcggtgcatacaaccaatgccctgtggttcgatttatctgtcgcctggatcagacactgtccgttaggggcgaagatattggcgaagacctgttcagtgaagccctgggacgggcagtgggtcagtgggcaggcgcaaaattactggaccacgggtgtgtggagtcttcaattctagagtggggccgtaccgacagagctgaggatactagactgggatcttgcccattcaccgggtccatgtgcgctcacggggtgtactctcaaatccctttgcgggctctgctgcctactaccagatgcctgtggcgttag

SEQ ID NO: 50514 - DNA, 1476 bp, Artificial Sequence
  Description of Artificial Sequence: Synthetic coding sequence
atgttgttatggccgctgcttttgttactgctgctgttaccgactcttgctctgctgagacagcagaggtcccaagatgctagactgtcctggctcgccggactacagcatcgtgtggcctggggcgcacttgtgtgggccgctacatggcagcggcgtcgcctggaacagtctacgttgcacgtgcatcagtctcagcagcaggccctgagatggtgtcttcagggcgctcaacgcccacattgcagtctccggagatccacggacatttccacatttcgaaaccatcttcctctgacgaaggcttatccagaggtattggctcagggaaggactgcacgagtaactcttacatcaccctggccgaggcccttaccctggcctggtaacaccctgggccaagtcgggacgcccggaactaaagatccccgagctctactgctggatgccctccggtcccctggactccgcgctctggaggcaggtacagctgtcgaactgttggacgtgttccttgggctcgagacagatggcgaggaattagcaggcgctatagcagccggaaatccgggtgcccctctcagggaacgagccgcagaactcagggaagccctggagcagggaccccgtggtcttgccctgaggctatggccaaagttgcaagtcgtggtaacactagacgctgggggacaagcagaggcagtggctgcccttggcgctctttggtgtcagggcctggcattctttagccccgcttatgctgcctctggcggagttctcggactgaacctgcagcctgagcagccgcatggtctctatctgctccctccaggtgcaccctttattgaactcctcccagtgaaggaggggacgcaagaggaagccgcttctactcttctgctggcggaagcccagcaggggaaggaatatgagctggtacttactgatcgtgctagtctgactcgttgcagactgggtgatgtagtgcgtgttgtcggggcttacaatcaatgtcccgtggtccgattcatttgcagactagatcagactctctcagtgaggggcgaagacattggtgaggacctcttttccgaagctctggggagggccgttggccaatgggccggagcaaagctgctggatcatggctgtgttgaatctagtatattggacagttctgccggatccgctccacactatgaggtctttgtcgccctgcgcggtttgcgcaatctgagcgaagaaaatagagacaaattggatcattgtctgcaggaagcgagtcctcgctacaaaagcctaaggttctggggaagcgtcggccctgccagggtgcacctggtgggccagggcgctttccgagctctgcgagcagccctggcggcttgcccctccagtcccttcccgcctgcgatgcccagggtgctgcgtcatagacacctcgcgcagtgtctccaagagcgcgtggtgtcatag

SEQ ID NO: 50515 - DNA, 1425 bp, Artificial Sequence
  Description of Artificial Sequence: Synthetic coding sequence
atgctcctatggccactgctgctgctgcttctgcttctgcccacacttgcccttttgaggcagcagagatctcaggacgctaggttatcatggcttgcgggactgcagcacagagttgcctggggggcactggtgtgggccgctacttggcagcggaggcggctggagcagagtacattgcatgttcaccagtcccagcaacaggcactgcgctggtgtctgcagggtgcgcagcgcccacattgcagcctccggcgatccacggatatcagtacgtttcgtaaccacctccccttgacaaaggctagccagacgcagcaggaagacagcggtgaacagccactcccaccaacctcaaaccaagacctcggagaggcctctttgcaagccactttactcggattggcagctcttaacaaggcttatccagaagttttggctcaagggcgtaccgccagggtcacactaacctctccatggcctagacctctgccctggccaggaaataccctgggccaagtgggaacgccagggacgaaagatcccagagctctgcttctagatgctctgcggtccccaggactgcgcgctctcgaggcaggaacagcagtggagctgctggatgtttttttaggcctcgagactgatggggaagagctggctggggctatcgcagccggaaaccccggagcgcctttgagagaacgagctgctgagctccgggaagcactagagcagggtccaagggggttggcactgcgtctctggcctaagctgcaagtggttgttaccctggacgctggcggacaagccgaagcagtggctgcattgggtgccttgtggtgtcaaggactggcattctttagccccgcttatgccgctagcggaggagtgctcggcctaaacctgcaacccgagcaaccacacggcctttacttactgcccccaggggctccattcattgaactgctccctgtgaaggagggcacccaggaagaagctgcttcaacattgctgctcgccgaggctcaacaggggaaggaatatgagcttgttctgaccgatcgagccagtctcaccagatgcagacttggcgacgtggtgcgtgtcgtgggcgcttacaatcaatgtccagtcgtgaggtttatttgtagactggaccagaccctgtcagtgagaggggaggacattggcgaagacttgttttcagaggcactggggagggcagtcggacagtgggccggagctaagctgctggatcatggctgcgtggaatcctcaatcctggaatgggggaggaccgaccgggcagaggacacacgactgggctcttgtccattcactgggtctatgtgcgcacacggtgtttacagccaaattccccttcgagcattgttacctacaaccaggtgtctctggaggtag

SEQ ID NO: 50516 - DNA, 1593 bp, Artificial Sequence
  Description of Artificial Sequence: Synthetic coding sequence
atgctactgtggccgctgctattgctgctgctcttgctcccaaccttggcgttgttgcggcagcagcgctctcaggatgctcgactctcgtggctggccggactgcagcaccgggtagcctggggagcacttgtttgggcagccacctggcagcgcaggcgattagagcaatctacccttcatgtgcatcagagtcagcagcaggcactgaggtggtgtctgcaaggggctcagcggccacactgcagtctcagacggtcgacagacatttcaaccttccgcaatcaccttcctttgactaaagctagccagacccagcaggaggattcgggtgagcagccactgcctccaacgtccaatcaagacttgggcgaggctagtctgcaggcgacgctgcttgggttagctgccctcaataaagcctatcctgaagttctggcccagggtcggaccgcgagggtaactctcaccagcccttggcctaggccattaccctggccagggaacaccctgggccaggtcggaacaccaggaactaaagacccccgtgctctgctgctggacgctcttcgcagtcccggattgagggccttggaggctggtactgcagtggaactgctggacgtttttttggggctggaaacagacggagaagagctagccggagctattgcggctgggaatccaggagcccctctgcgagagagagccgctgagctgcgggaggcgctggagcagggccctcggggactggcactgaggttgtggcctaagctccaggtggtggtgaccctcgacgctggaggtcaggccgaggctgtggcagcccttggggcactgtggtgccagggccttgcatttttctcaccggcatacgcggcatctggtggcgttctaggccttaacctccagccggaacagccgcacggcctctatctgctgccccctggcgctccattcattgagttgcttccggtcaaggagggaacacaggaggaggcagccagcacactgctgctcgctgaggcgcagcagggcaaggaatacgaactggtcctgacagatagggcttccttaacgaggtgtagactgggcgatgtagtgagggtggtcggcgcttacaatcagtgtcccgtggtgcgctttatttgtcggctcgatcagacattaagcgtgagaggggaagacattggggaagatctgttcagcgaagcgttgggacgcgctgtgggccaatgggcaggtgcaaaactgctggaccacggttgtgtggagagcagcatccttgacagcagtgcaggcagtgcaccccactacgaggtgtttgtggccctgaggggcctgagaaacctttccgaggagaatagagataagctggatcactgtcttcaggaggcatctccaagatacaaatctctgaggttttggggctctgtgggccctgccagggtgcacttagttgggcagggagcattccgagcactgcgggcagctttggcagcttgcccttcgtcgccattcccgccagccatgcccagagtcttgaggcaccgccacttggcgcagtgccttcaggagcgcgtagtcagctag

SEQ ID NO: 50517 - DNA, 1002 bp, Artificial Sequence
  Description of Artificial Sequence: Synthetic coding sequence
atgcccctgggcctaggcagacgaaaaaaagcccctcccctggtagaaaacgaggaggcagaaccgggtcgaggaggcctgggagttggggagccaggaccacttggcggaggagggagtggtggccctcagatgggacttcctcctccccctccagcgctgcggccacggctggtgttccacacacagcttgcccacgggtcacccaccggacgcatagagggattcactaacgttaaagagctgtacggcaaaattgccgaggcctttagacttccaacagcagaagtcatgttttgcaccctgaatacccataaggttgatatggataagctgttaggcggacaaatcgggcttgaagacttcatttttgcacatgtgaaaggtcagcgcaaggaagtggaggtttttaaatctgaggacgctcttgggctgaccataacggataatggagccggttatgcattcattaagaggattaaggaagggtccgttatagaccacatacacttgatatcagtgggagacatgatcgaggctatcaatgggcagagcctgttgggctgtcgccactacgaggtggctagactgctaaaggagctgcctcgcggtcggactttcacgttaaaacttaccgagccccgaaaagctttcgatatgatcagtcagcgcagtgccggtggccgacccggaagtggacctcagttgggaaccggacggggtactttgcgcctgcgcagtcgaggacctgcaaccgtcgaggatctgccatctgcctttgaggagaaggccatcgagaaggtcgacgatctcctggagagttacatgggcattagggatacagagctggccgcaacgatggtcgagctgggcaaggacaaacggaaccccgacgaattggctgaagctcttgatgagcgactcggagactttgctttccccgacgagtttgtttttgacgtctggggagccatcggggatgctaaggtgggcaggtattag

SEQ ID NO: 50518 - DNA, 1002 bp, Artificial Sequence
  Description of Artificial Sequence: Synthetic coding sequence
atgcctcttggactaggtagacgaaagaaggcgccacccctggttgagaacgaagaagcagagcccggtcgaggaggcttgggtgttggcgagcctggacccctcggaggaggaggttccggcggaccacagatgggtctcccacctccaccaccagcgctgaggcccagactcgtcttccacactcaactggcccatggaagtccgacaggaaggatagaagggttcaccaatgtcaaagagctgtatgggaaaattgccgaagcgttcaggctgcctaccgctgaggtgatgttttgtaccctcaacacacacaaagttgacatggataagctgttgggcggtcaaatcggcctcgaggacttcatttttgctcacgttaagggtcaacggaaggaggttgaggtattcaagagcgaggatgctctgggcttaacaataactgataacggagctggttatgcatttattaaacgaatcaaggagggttctgttatcgaccatatccatctcatcagcgtcggggatatgatagaggcgataaatgggcagagcctgcttggttgccggcactacgaggtggcccgtctcctgaaggagctgcccagaggaagaaccttcacactcaaacttacagagcctcgaaaagcctttgatatgattagccaacgcagtgccggaggcagaccagggagcgggccacagctgggaaccggccgaggcacattacgtctccgcagccggggtcccgctacggtggaggatcttccatccgcctttgaggaaaaggctattgagaaggttgacgatctattagaatcgtatatgggaatcagagacactgagttggcggctactatggtcgaactcgggaaggataagcgcaatccggacgaactcgccgaagcacttgacgagaggttaggtgatttcgcttttccggacgagtttgtttttgacgtgtggggtgcaatcggagatgccaaagtcggcaggtattag

SEQ ID NO: 50519 - DNA, 711 bp, Artificial Sequence
  Description of Artificial Sequence: Synthetic coding sequence
atgttctgtaccctcaatacgcacaaggtagatatggataaactgttgggcggacagatcggactcgaggacttcattttcgctcatgtgaagggtcagcggaaggaggtggaggtctttaaaagcgaggacgccctcggtttgacaattacagacaacggtgcaggctacgccttcattaagaggatcaaagaagggtcagtgatcgaccacattcacctcatatctgtgggagacatgattgaggcaattaatgggcagtctctccttggatgcagacactatgaggtcgcacgactcttgaaggagcttcccaggggcagaacgttcactctgaaacttacagaaccacgcaaagcctttgacatgatatcccagagatccgccggaggcagacccggttcaggccctcagctgggcaccggcagggggaccttgcgattgaggtcccgcggacccgctacagttgaggacttgccttcagccttcgaagaaaaggccattgagaaggtcgacgacttgctggaaagctacatgggaattagagatacagagcttgcagccacaatggtggaactcgggaaggacaagaggaaccctgatgaactggccgaggctctcgacgaaaggctcggggactttgcatttccagatgaatttgttttcgacgtgtggggcgctataggcgacgcgaaggtaggaaggtattag

SEQ ID NO: 50520 - DNA, 711 bp, Artificial Sequence
  Description of Artificial Sequence: Synthetic coding sequence
atgttttgtacactcaacactcacaaagtggacatggataagcttctcgggggtcagatcgggttggaggatttcatttttgcccatgtcaagggacagcggaaggaggtcgaggtgttcaagagcgaagacgctttaggacttaccatcactgacaacggggctggttacgctttcatcaagcggattaaggaaggaagcgtaatcgatcacatccatcttataagtgtgggagatatgatagaggccatcaatggccagagcctactgggatgcaggcattacgaggtcgctcgtctgcttaaagaacttccccgagggagaacctttacactgaagctgactgagccacgcaaggcctttgacatgatctcccagaggtcagctggtggcagacccggttccgggccacagctgggcaccggacgtggcaccttgaggcttcgttcccgtggcccagcaaccgtggaggacctcccaagcgcctttgaggaaaaggctattgaaaaagtggacgacctgctggagagttacatgggtatccgggatactgagttagccgctacaatggtggaattaggcaaggataagaggaatcctgatgaactggccgaagctctcgacgaacgtctgggggattttgcttttccggacgagtttgtgtttgacgtgtggggcgctattggcgacgctaaagtgggccgatactag

SEQ ID NO: 50521 - DNA, 1002 bp, Artificial Sequence
  Description of Artificial Sequence: Synthetic coding sequence
atgccactaggccttgggagacggaaaaaggccccacctctggttgagaatgaagaggccgagcccggacggggaggcctgggcgtcggcgaaccaggccctctgggaggtggaggctcaggaggaccccaaatggggctgccccctcctcccccagctttgaggccgagactggtattccacacccagcttgcccacggctctcctacgggacgcattgagggctttactaatgtaaaggaactctacgggaaaatcgcagaagcgtttaggctgcctactgctgaagtgatgttctgtacgttaaatacacataaggtagacatggacaagttactgggagggcaaatcggtctcgaggacttcatatttgcccatgttaaagggcagaggaaggaggtcgaagtcttcaaaagtgaggatgccctgggactgactatcaccgataacggggctggctatgcttttataaagagaatcaaggaggggtccgtaatcgatcacatccatttgatatctgtcggtgacatgatagaggccatcaacggccagtcccttcttggctgtcgtcattacgaagtcgcgaggctgctgaaggagcttcccaggggccgtacctttacccttaagttgacagaaccacggaaagcttttgatatgataagccaaaggagcgccggaggcaggcctggcagcgggcctcaacttgggaccggcaggggaaccctccgccttcgtagccgcggtccagccactgtggaggatctgccctccgcttttgaggaaaaggccatagaaaaggtggatgatctgctggaatcctatatggggatcagagacaccgagttagctgcgacaatggtcgagttaggtaaggataagcgcaatcccgatgagttagccgaggctttggacgagcggttgggcgattttgctttccccgatgaattcgtattcgacgtgtggggagcaatcggagacgccaaagttggtcggtattag

SEQ ID NO: 50522 - DNA, 762 bp, Artificial Sequence
  Description of Artificial Sequence: Synthetic coding sequence
atggaggcagcacggccatttgcgagggagtggcgggctcagtctctgcccctagcggttggcggagtgctgaagcttcgcctgtgcgaactgtggctcctgcttctgggaagttctttgaatgcaaggtttctccctgatgaggaggatgtcgactttatcaacgaatatgttaatcttcataacgagcttcgcggagatgtgatcccgaggggatccaacctgcgcttcatgacttgggatgtggcactatcccggacagctagagcttggggaaaaaagtgcctttttacgcacaatatttatctacaggacgtgcagatggtacatccgaaattttatggtattggagagaatatgtgggtcggccctgaaaacgaattcacagccagtatagctatccgtagctggcatgcggagaaaaaaatgtacaacttcgaaaatggtagttgttctggcgattgcagtaactacatccaattagtttgggaccacagctacaaggttggttgtgcagttacgccttgcagcaaaattggccacattatccacgcagccatcttcatttgtaattacgcccctggaggaaccctgacccggaggccatatgaacccggaattttttgtactaggtgcgggagacgggacaagtgcacggatttcctttgttccaagattaaaaagataaacatgaaaaaaatgcacaatgggctcgacaagaaaaataaacgccttaatactagctttctgtggagttgctag

SEQ ID NO: 50523 - DNA, 321 bp, Artificial Sequence
  Description of Artificial Sequence: Synthetic coding sequence
atggaggccgctaggccctttgctagagaatggcgcgctcagtcactgccactggctgtagggggagtgctgaagctaagattgtgcgaattgtggctgctgctgctggggagctcactcaacgccaggtttcttccagacgaagaagatgttgactttattaacgaatacgtcaacctccacaacgaacttcgcggagatgtaatacccagagggagcaacctgcgattcatgctgtggtactgctgcgatagcgatggatcccgcttcatcatcggatttcccaatctctccccccgtacgccctctgctccactttag

SEQ ID NO: 50524 - DNA, 714 bp, Artificial Sequence
  Description of Artificial Sequence: Synthetic coding sequence
atggtccatcccaagttttatggcattggcgagaatatgtgggtgggccctgagaatgagttcacggctagcattgccatacggtcctggcacgccgagaagaagatgtacaatttcgagaacggaagctgctctggcgactgttctaattacattcagctggtatgggatcatagctataaagttggatgtgctgtcactccctgctcaaagataggacatattattcatgctgctatcttcatctgtaattacgcccctggcggtacgctgacacgtcggccatacgagccaggcatcttctgtactaggtgcggtaggcgagacaaatgtacggacttcctttgttcaaacgctgacagggatcaggcgacatactacaggttctggtacccgaagtgggaaatgccgagaccagtggtgtgcgatcctctgtgcacattcattcttttgcttcgcatcctgtgtttcatcctgtgcgtgatcacggtgcttatcgtccagtcgcaattccccaacattttactcgagcagcagatgatctttactccagaggagtcagaggctgggaacgaggaggaggaaaaagaagaggagaagaaagagaaggaggaaatggaaatggagataatggaaatggaagaagaaaaagaggagagagaagaggaagaagaggaaacccagaaggaaaaaatggaagaagaggagaaatag

SEQ ID NO: 50525 - DNA, 507 bp, Artificial Sequence
  Description of Artificial Sequence: Synthetic coding sequence
atggaggctgccaggccattcgctcgggaatggcgggcacagtcattgcccctggctgtcggcggagtgctaaagctacgtctttgcgaactttggctcctcctgctaggttcctccttgaatgccagatttttgccagacgaggaagatgtcgatttcatcaacgaatatgtgaatctgcacaatgaacttagaggggatgtcataccaagggggagcaacctgaggttcatgacctgggacgtcgccctttctcgtaccgccagggcctggggaaaaaaatgcctgtttacccacaacatatacctgcaagacgtgcagatggtgcatcccaagttttatggcatcggcgagaatatgtgggtggggcctgagaatgaatttaccgcgagtattgctattaggtcatggcacgcagagaagaagatgtacaattttgagaacggcagctgcagtggtgattgctcgaattacattcaacgtaatactgacgaaaaaacactgtag

SEQ ID NO: 50526 - DNA, 840 bp, Artificial Sequence
  Description of Artificial Sequence: Synthetic coding sequence
atgttaatcaccatgatcctgcatagagcaaggacaaagacatgggacgtcgctctgagcaggactgcaagggcttgggggaagaagtgcttatttacccacaatatctacctccaggatgttcaaatggtgcaccccaaattctacggcattggtgaaaacatgtgggttggaccggagaacgagtttacggcttcaatcgccatccgctcgtggcacgccgaaaagaagatgtataattttgaaaacggttcttgttcaggagattgcagcaattatattcagcttgtctgggaccatagctataaggtcggctgcgccgtcaccccatgcagtaaaatcgggcatattatccacgccgctatatttatctgtaactacgcccctggaggtaccctcactagacgcccttatgaaccaggtatcttttgcacaagatgtgggagacgggacaaatgtaccgacttcctgtgcagcaatgcagaccgtgaccaggcgacttactatcgcttctggtacccaaaatgggagatgccaaggcccgttgtctgcgacccactctgcacattcatcctgctgctgagaatcctttgtttcatcctttgcgtgatcaccgttctcatcgtgcagagtcaattccctaatatcctgttggaacagcagatgatcttcacgccagaagagagcgaggcaggaaacgaagaggaggaaaaggaggaagaaaagaaggaaaaggaggaaatggaaatggagattatggaaatggaagaggagaaggaggagagagaggaagaagaggaagaaacacagaaggaaaaaatggaggaagaggaaaagtag

SEQ ID NO: 50527 - DNA, 1035 bp, Artificial Sequence
  Description of Artificial Sequence: Synthetic coding sequence
atggaggcagcaaggccattcgctagagaatggagagcccagtcacttcctctggcagtcgggggagttctgaaactcaggctgtgtgaactgtggttactgctactggggtcttctctgaacgccagatttctccccgatgaggaggatgtggactttataaacgagtatgttaacctgcacaacgaactcagaggggatgtgatacctagaggatccaacctgcgctttatgacatgggacgtcgctctgagccgaacggcccgagcctggggcaagaaatgcctgttcacccacaatatatatttacaagacgttcagatggtacacccgaaattttatggcataggggaaaacatgtgggtgggaccagagaatgagtttactgcctctatcgccataagaagctggcacgcggagaagaaaatgtataatttcgaaaatggaagttgctccggagactgtagcaattatattcagttagtttgggaccatagttacaaggtgggctgtgctgtgactccatgctcaaagatcggtcatattattcatgccgcaattttcatatgtaactacgctccaggcggtaccttgaccagacgcccttatgagcccggaattttctgtaccagatgtggtcgcagagataaatgcacagactttctgtgtagcaatgccgacagggaccaggccacttattaccgtttttggtaccccaagtgggagatgccacgtccagtggtgtgtgaccctttgtgcacttttatcctattgctgcggattctctgttttatactttgtgtgattaccgtgctgatcgtgcaatcccaatttcctaacatcctcctagaacagcagatgatttttactccagaagagtcagaagccggaaacgaagaagaggaaaaggaggaggagaaaaaggaaaaggaagagatggaaatggaaataatggagatggaagaagaaaaggaggagagggaagaggaagaggaagagacccagaaggagaaaatggaggaagaggaaaagtag

SEQ ID NO: 50528 - DNA, 2544 bp, Artificial Sequence
  Description of Artificial Sequence: Synthetic coding sequence
atggcaaagcctctgacagaccaggagaagcggaggcagatttctattcggggtatagtgggcgtggaaaacgttgctgagcttaagaagtcttttaatcgccatttgcactttacgctcgtgaaggaccgtaatgtcgccacaacacgcgactactactttgccctggctcataccgtgcgcgaccatctggtcggacggtggattcgaactcagcagcactattacgacaaatgtccaaaaagagtctactatctgtctcttgaattttacatgggcagaaccttgcagaacaccatgatcaacctgggcctgcagaatgcctgcgacgaagctatctaccaactggggctggatatagaagagctcgaagagatcgaggaggacgctggactgggtaatggtggactagggcgactggctgcctgcttcctcgattctatggctacactgggactcgcggcatatggctacgggatccggtacgaatatggaatctttaaccagaagattagggacgggtggcaagtcgaagaagctgacgactggctgaggtatggaaacccctgggagaagagtaggccggagtttatgcttccggttcatttttatggaaaagtcgaacatactaacactgggacaaaatggatcgatacacaggtggtactcgcactgccttacgatactccagtgcccggatatatgaataacacagtgaataccatgcgcctttggagcgctcgggcaccgaatgacttcaatctccgcgactttaatgtcggcgattatattcaggcagttctggacaggaatctcgcagaaaacatcagcagagtgctgtatcccaacgacaatttcttcgaggggaaggaactcagattgaagcaagagtacttcgtggtggccgctacgctgcaagatatcatccgaagattcaaagcctcaaaattcgggtcgacccgcggagctggcacagtctttgatgcctttcctgaccaggtggctattcagctcaatgacacgcaccccgcacttgccatcccagagcttatgcgtatttttgtcgacatcgagaaactgccatggagcaaagcctgggagttgacccaaaagacatttgcctatactaaccacacggtgctgcctgaagctctggagaggtggcccgtggatcttgttgaaaagctgctgcctcggcatctggaaatcatttacgagataaaccaaaagcacctggataggatagtcgctttgttcccaaaggacgtagataggctgagaaggatgtccctaatcgaagaggagggcagcaaacgtattaatatggcacacctgtgtatcgttggttctcacgctgtgaatggcgtagccaagattcactctgacattgtgaaaacaaaagtgttcaaggattttagtgagctcgaaccagacaaatttcaaaacaaaacaaatgggatcacaccgagacggtggctgcttctgtgtaacccgggtctggccgagctcatagcagagaaaatcggagaagactacgtcaaggatctgtctcagttgactaaactgcacagcttcctgggggatgacgtgttcctgagggagctggcaaaggtcaagcaggagaataaacttaagttttctcaatttctagagaccgagtataaagtgaaaatcaatccaagcagcatgttcgacgtacaggtgaaaagaatccacgagtacaaaagacagctgttgaattgccttcacgtcattactatgtacaaccggattaagaaggatcctaagaagctgtttgtgcctagaaccgtgattattggtggaaaagccgctcccggatatcatatggccaaaatgatcataaagctcattacctccgtggcggacgtggtgaacaacgatcccatggtagggtctaagttgaaagtaattttcctggagaactatcgcgtgagtcttgcagagaaggtgatacccgcaaccgacctgtccgaacagatctcgacagcaggcaccgaggccagtggcacaggcaacatgaagttcatgctcaacggtgcacttacgattggaacaatggatggcgctaacgtggagatggccgaggaggccggagaggaaaacctgttcatattcggcatgcgtatcgatgacgtcgctgccttagacaagaagggctatgaggcaaaagaatattatgaggccctgccagagctaaaactggtcattgaccagattgacaacggattttttagcccaaagcagcccgatctgttcaaagatatcatcaatatgctcttttatcacgatcggttcaaagtgttcgcagactacgaagcatacgtgaagtgccaagacaaagtctctcagctgtacatgaaccctaaggcgtggaatacaatggtgctgaagaacatcgctgcctccggcaagttctcaagcgaccgcaccattaaagagtacgcacagaatatttggaacgtggagccttccgatctcaaaatttctctttccaatgagtccaataaggtgaatgggaactag

SEQ ID NO: 50529 - DNA, 492 bp, Artificial Sequence
  Description of Artificial Sequence: Synthetic coding sequence
atgaaacctgatgaaacccccatgtttgaccctagcctgcttaaagaagtggattggtcacaaaacactgccacgtttagtccggctatcagccctacgcaccccggtgaggggctggtccttcggcctctgtgtaccgcagaccttaataggggattcttcaaggtgctaggccagctcactgaaaccggagtcgtgtcaccagagcagtttatgaagagcttcgagcacatgaagaaaagcggagactactacgtgaccgtcgtagaggatgtcacattaggccagatagtggcaaccgccactctcatcattgagcacaagttcatccactcctgcgcgaaaagagggagagttgaagacgtagtagttagcgatgagtgtaggggcaagcagcttggcaaactgctgctgagtacattgacattgctgtctaaaaagctgaactgttacaaaattacgctggagtgcttgccccagaatgttggatag

SEQ ID NO: 50530 - DNA, 1362 bp, Artificial Sequence
  Description of Artificial Sequence: Synthetic coding sequence
atgaaaatctttaaatgctatttcaaacatacactgcagcaaaaagtttttattctcttcttaaccctgtggctgttatccctcctgaaactcttgaatgtgagacggctctttccccagaaggatatttaccttgtcgagtattccctgtccacgtctccttttgtacggaacaggtatactcatgtcaaagacgaggttagatacgaggtgaattgctcaggcatttatgagcaggagccactcgaaattgggaaaagcctggaaatacgaaggcgggatattatagacttggaggacgacgacgtggtggctatgaccagtgactgcgacatataccaaaccctgcgcggatacgcccagaagcttgttagcaaggaggaaaaatccttcccgatagcctactcgctagttgtccacaaggatgcaatcatggtggagagattgattcacgccatctataatcaacataatatatactgcatccattatgaccgcaaggcgccagatacctttaaagtggctatgaataacctggccaagtgcttcagcaacatcttcatcgccagcaagctggaagcagtagaatacgcgcacatatcccgactgcaggccgacctgaactgccttagtgatttgttgaaatcttctatccagtggaagtacgtcattaacttgtgtggccaggatttccccctgaaatctaacttcgaactggtgagcgagctcaaaaaactgaatggggctaatatgctcgagacagtcaagccacccaactccaaactggagcggtttacttaccaccacgagctgagaagagttccctatgaatatgtcaaactacccatccggaccaacatctctaaagaggcccctcctcataacattcaaatctttgtgggttctgcctacttcgtgctgagtcaggcttttgtgaaatacatctttaataattccatcgtacaggacttctttgcatggtcaaaggacacctacagtcccgatgagcacttttgggctactctgattcgggtgcctggcatacccggagagatctccagaagtgcgcaggatgtctctgaccttcaaagcaaaacgcgactggtgaagtggaattattacgagggcttcttctatccgagctgcacaggtagccatcttcgttctgtgtgtatctatggcgctgcagagctacgctggctaattaaggatggacattggttcgctaacaaattcgacagcaaggtggatcctatcctaatcaaatgcctggccgagaaacttgaggaacagcaacgcgactggatcaccctaccctctgaaaaattgtttatggaccgaaacttgactacaacgtcttag

SEQ ID NO: 50531 - DNA, 927 bp, Artificial Sequence
  Description of Artificial Sequence: Synthetic coding sequence
atgttcgttcagcttctcagagccatctacgtccctcagaacgtctattgtattcacgtggacgagaaagcacctatgaagtataagacggcagttcaaacactcgtgaactgctttgagaatgtgttcatctccagtaagactgaaaaggtcgcctacgctgggtttacccgcctccaggctgacattaattgcatgaaagtgttagttcacagcaagtttcagtggaattatgtgatcaatctgtgtggacaggactttcctataaaaactaatagggagataatacactacattcggagtaagtggtctgacaaaaacatcacccccggagttatccagcctctgcatatcaagtcaaagacgtctcaaagccacttggaatttgtgcctaagggatccatctacgcccctccgaacaataggttcaaggataagcctcctcacaatcttacaatttacttcggctcagcatactatgtgcttacccggaagtttgtggagtttatacttactgacattcacgcaaaagacatgctgcaatggagcaaagacatacggtcccccgagcaacactattgggttaccctgaatagattgaaggatgcccctggggctaccccaaatgcaggatgggaaggaaatgtccgggcaatcaagcgtaagtcggaggaggggaacgtgcacgacggttgtaagggaagatacgtggaggatatatgcgtttacggacccggtgatctcccctggctgatccagagtccttccctcttcgccaataaatttgaaccatcaaccgatccacttgtggtgacctgcctcgaacggcgacacaggctgcaagtgctgaggcaggctgaggtacccattgaaccgcattggcatttccagcagcagagtcattttaatatgcgcctgaatagatag

SEQ ID NO: 50532 - DNA, 519 bp, Artificial Sequence
  Description of Artificial Sequence: Synthetic coding sequence
atgcgcgactgctgcggaatggtgtcctccggttctctttctagcttgaaggccgcagaacggaccccaggggcacttttcttttcaagctcgacacctggaagatattacaactacgattcttcatcgcgcccacaatcgcgctctgtcatgagcgatcagtgtgcaggtcagtggttcctgaaggcttgcgggttgggcgaaggcgacaccgaggtgttccccactcagcacgtcgtaagagctctgcagacaatctttgagttgaacgtgcaggcgtttgctgggggtgcaatgggagcggtgaatggcatgcagccacacggggttccagataagtcctctgttcagtcggacgaagtgtgggtgggcgtcgtgtatgggctggcggctactatgatccaggaagtgatgcatagttttagccacctgtcaacaatttgtatcctggcccagaagacatcaagtacgacaaaattcctccaaggaattacgcagtgccacctcgtaagactgtag

SEQ ID NO: 50533 - DNA, 2634 bp, Artificial Sequence
  Description of Artificial Sequence: Synthetic coding sequence
atgggcacacaggacccaggtaatatgggcactggagtgcctgcgtctgagcagatcagctgcgctaaggaggatccgcaggtttattgccctgaagaaactggcggaacaaaagatgttcaggtcactgattgcaaaagccctgaggatagccgtccgccaaaggagactgactgttgcaaccccgaagacagcggacagctaatggtaagttacgagggaaaagcaatgggttaccaagtgcccccattcggttggaggatctgtctggctcacgaatttactgagaagaggaagccattccaagccaacaacgtgtcactgtcaaacatgatcaaacatatcggcatgggcctccgatacctccagtggtggtaccgtaaaacacacgttgagaagaagactcctttcatagacatgatcaactctgttccacttcggcagatctacggatgtcccctaggcggaattggtgggggtactatcactcgaggatggcgcggacagttctgccggtggcagcttaatccgggtatgtaccagcacaggactgtcattgccgaccagtttaccgtctgtttgcggagagaggggcaaactgtctatcagcaggttcttagtctggagagaccatctgtgctgcgatcttggaattggggcctttgtggatattttgccttctaccacgcgctgtacccgcgtgcctggacagtgtaccagcttcctggccagaatgttaccttgacttgtcgccagatcaccccaatcttaccgcatgactaccaggattcgtccctcccggtgggggtgttcgtctgggatgtggaaaatgagggagatgaggccctcgacgtgtctatcatgttcagtatgagaaatggcctgggcggaggagatgacgcccctggagggttgtggaacgagccattttgccttgaaagatccggggaaaccgtgagaggtttgctcctgcaccatcctaccttgcctaacccgtacaccatggccgtggccgctcgggtgacagcagcaacaaccgtaacacacattactgccttcgacccagatagcaccggccagcaggtgtggcaggacctcctgcaggatgggcagctcgatagccccacagggcagagtaccccaacccagaagggcgtgggaattgctggcgcagtgtgtgtgagtagcaagttgcgccctcgtggtcagtgcaggctggaattttccctggcttgggacatgccacgcattatgtttggcgctaaaggccaggtgcactataggaggtacacaagattcttcgggcaggacggtgatgcggcacctgccctgagtcattacgcactgtgtaggtatgccgagtgggaggaacggatcagtgcatggcagtctccggtgctggacgaccggagtttgcccgcttggtataagagtgccctctttaatgagctctactttctggctgatgggggtacagtatggctggaggttctcgaggactcactcccagaagaattggggcgaaacatgtgccacctgcgccctactctgcgagactacggtcggtttggttacctagaaggtcaggagtatagaatgtacaacacttacgacgtgcacttttacgcgtccttcgctctgattatgctctggcctaagcttgagctgtctctgcagtacgatatggctttggcaaccctgcgggaggacctgacccggagacgatatctgatgtctggtgtgatggccccagtgaagcggaggaatgtgatcccccatgatattggggatcccgatgatgaaccctggttgcgtgttaacgcctatctgattcatgacactgccgattggaaagacttgaatctcaagttcgtgttgcaagtgtatcgagactattatctcacaggggatcagaatttcttaaaggacatgtggccggtatgtctggcagtgatggaaagtgaaatgaagttcgataaagatcacgatgggctgatagagaatggcggttacgccgaccagacctacgatgggtgggtgactacagggccaagtgcttattgcgggggactatggttggctgctgttgctgtgatggttcagatggcggctctatgtggcgctcaagatatccaggataaattctcatctatcctctcgagaggacaggaggcatacgagcgccttctctggaatggacggtactacaattatgactcctcgtccaggccacagagtcggtcagtcatgtctgaccagtgtgccggacagtggtttctgaaggcctgtgggttaggagagggagataccgaagtcttcccaacccagcacgtcgtccgagcactgcagactatctttgagctcaatgtgcaggctttcgcaggtggagcaatgggagccgtgaatggaatgcagccacatggggtcccagacaagagcagtgtacagagcgacgaagtatgggtgggcgtggtttacgggctggccgctactatgattcaggagttgctcccaagcgggttttgcctatgggtgatcgtgataagtagcacttgttgggaactattagaaggcaaagacagcactgcaagtatataccccgtggaggtcgcactgcagcgagtccccagttag

SEQ ID NO: 50534 - DNA, 2784 bp, Artificial Sequence
  Description of Artificial Sequence: Synthetic coding sequence
atggggactcaagacccgggaaatatgggcacaggcgttcccgcttcggaacaaatctcctgcgctaaagaggatccacaggtctactgtccagaggagactggtggcactaaggacgtgcaggtgaccgactgtaaaagccctgaggattctcgtcctccaaaagagacggattgctgcaaccctgaggactccggacagctgatggtcagctatgagggaaaagcaatgggctaccaggtgcctcccttcggctggcgtatttgcctggcgcatgaatttaccgagaagcgcaaaccattccaggcaaacaatgtaagtttaagcaacatgatcaaacatattgggatggggctgagatatctacaatggtggtaccgtaaaacgcatgtggaaaagaaaaccccttttatcgatatgatcaactccgtccctctacgacagatttatggctgcccactggggggaatcggcggagggacgatcaccagaggctggcggggacagttctgtagatggcaactcaatccaggaatgtaccaacacagaacagtgatcgctgatcaattcactgtgtgcctccgaagagagggtcagacggtgtaccaacaggtgctctcgctagagcgccctagtgtcctgcgcagctggaactggggactttgtggctatttcgctttctatcacgccctctatccgagggcgtggactgtatatcagctgcctgggcaaaacgtcactttaacttgcagacagattacaccgatcctcccgcatgactaccaggattcctccctgccggtgggggtttttgtgtgggatgtggagaacgagggggatgaggctctagacgtgtcgattatgttttctatgagaaacggactcggaggtggcgacgacgctcctggtggcctctggaacgagcccttttgcctagagcggagcggcgaaactgtgagaggcctactgttacaccaccctacacttccaaacccctatacgatggccgtcgcggcacgagtaacagcggcaactaccgttactcacataaccgcattcgaccctgactccaccgggcaacaagtttggcaggatttacttcaggacgggcagcttgatagtcctaccggccagagtactcctacacagaaaggagtagggatcgctggggcagtttgtgtgtcctccaagcttaggccaaggggccagtgtagactggaattttccctggcatgggatatgccgcgaatcatgttcggcgctaagggccaggttcattacaggcgatacacgcgcttcttcggacaagacggagatgctgcacctgcactcagccactatgctctgtgtcgttacgctgagtgggaagagcgcatctctgcatggcagagtcccgtacttgacgacagaagtctgccagcctggtacaagagcgctctcttcaacgagttgtatttcctggctgacggaggtacagtatggcttgaagtactcgaggatagcctgcccgaagagctggggaggaacatgtgccacctgcgcccaacactacgcgattacggaagattcggttatcttgaggggcaggaatacagaatgtacaacacttatgacgtccatttttacgcatcttttgcgctgatcatgctctggcccaagctagagctatccctgcagtatgacatggcacttgccacactgcgcgaggatttgactcggcgacggtatctgatgtccggcgtcatggctcccgttaagaggaggaacgtgatcccgcacgacatcggcgacccagatgacgaaccttggctgcgtgtaaacgcctatctcatccacgatactgctgactggaaagacttgaaccttaaatttgtactgcaggtgtatcgagactactatctcactggagatcagaactttctcaaagatatgtggccagtgtgtctggccgtgatggagagcgagatgaaattcgataaggatcacgatggtctgatcgagaatggaggctacgccgatcaaacttatgatgggtgggttactactggacccagcgcctattgtggaggcctatggcttgccgctgtggccgtcatggtccagatggccgcattatgtggcgcacaagatatccaggataaattctcctccatcctgagtcgaggtcaggaggcttatgaaaggctgttgtggaacggcaggtactataattatgacagtagttccaggccccagtccaggagcgtgatgagcgaccagtgtgctggtcaatggtttctaaaggcttgtggactgggagagggcgatactgaggtattcccgacccagcacgtggtgagggctctccagaccatctttgaactgaatgtgcaggccttcgccggtggtgccatgggcgctgtcaacggcatgcagcctcatggagtaccagacaaatcttccgtgcagtcggatgaagtgtgggttggggttgtttacgggcttgccgctaccatgatacaggaggggcttacatgggaaggcttccagacagcagagggctgttaccgaaccgtgtgggaacgactcggccttgcctttcagacccctgaggcatactgccaacagcgagtctttcgctctctggcctatatgcgacccctcagcatttgggcaatgcagctcgccttgcagcagcagcaacacaaaaaggcctcctggcccaaggttaagcagggcactggcctgagaacgggcccaatgtttggacccaaggaagctatggccaatctgtcacccgagtag

SEQ ID NO: 50535 - DNA, 2802 bp, Artificial Sequence
  Description of Artificial Sequence: Synthetic coding sequence
atgggaacgcaggatcctggaaatatgggtaccggtgtacctgcctcagaacagatctcctgtgcaaaggaggacccacaggtctactgtcctgaggagacgggcggtaccaaggatgtgcaagtgactgactgcaaatcacctgaggattcgaggcccccaaaggaaaccgattgttgcaatcctgaagattctggccagctcatggtgtcgtacgaaggtaaagcaatgggctaccaggttccccctttcggatggaggatatgcctggcccatgagtttaccgagaagcggaaaccattccaggccaacaacgttagtctgagcaatatgatcaaacacatcggtatggggctccggtacttgcagtggtggtaccgcaagacacacgtagagaaaaaaaccccattcatcgatatgataaactcagttccactgaggcaaatctacggatgcccactaggcggaattgggggaggtaccataacaaggggctggcgcggtcaattctgcagatggcagctgaaccccggaatgtatcagcatagaactgtgattgccgatcagccaatctgtcctctgaagttcaccgtgtgtttacgtcgcgagggccagactgtctaccagcaggtgctgtctcttgaacggccttccgttctccggagctggaactggggattatgtggctacttcgccttttaccatgcactatatcctcgggcttggaccgtttaccagctaccaggacagaacgtcaccctgacatgtagacagattaccccaatcttgccccacgattaccaggattcgtctctgccggttggcgtcttcgtttgggacgtggagaatgagggtgatgaagctctagacgtaagcattatgttttctatgcggaatggcttaggcggtggagatgatgctcctggcggactgtggaatgagccattctgcctcgaacgctctggcgagacggtgcgagggctgctgctgcaccatcccacccttccaaatccttacacgatggcagtcgctgctagggtgactgcggctaccactgtcacccacataacagctttcgatcccgactctaccggacagcaggtgtggcaggatctgctccaggacggccaattagacagccccacaggccagagcaccccaacacaaaagggggtcgggatagcaggcgcagtgtgtgttagtagcaaacttcgccctcgcggtcaatgtcgcctggagttttcccttgcctgggatatgcccagaataatgtttggtgccaaaggccaggtgcactataggcggtacacacgttttttcggccaagacggcgacgctgcaccggctctgagccattatgccctttgtagatacgctgagtgggaagagagaatttctgcatggcagagccctgttctcgatgatcggtcgctgcctgcctggtacaaatccgccctcttcaacgagctgtacttccttgccgacggaggcacagtatggctcgaagtgctcgaagacagtcttccagaagaacttggacgaaatatgtgccacttaagaccaaccctgcgagactatgggaggtttgggtatctggaggggcaggagtaccgaatgtataacacatatgatgtgcatttctatgcttccttcgcacttattatgctttggcctaagttggaactctccctgcagtacgatatggccttggccacgttgcgggaggacctgaccagacggagatacctgatgtccggcgtgatggctcctgttaagaggcgtaatgtgattcctcatgatattggagaccccgacgacgaaccttggctgcgcgtgaacgcttatctaatccatgatacagctgattggaaggacctgaacctcaaattcgtcctccaggtgtaccgagactactacctcaccggcgatcagaacttccttaaggatatgtggcctgtgtgcctggccgtaatggagtctgaaatgaaattcgataaagatcacgatggcctcattgagaacggaggctacgccgaccaaacctacgatggttgggtgaccactgggccttcagcttactgcggaggcctctggcttgccgcagtggccgtgatggtgcagatggcggcactttgtggggcacaagatattcaggacaagttctcgtctatactcagtcgaggccaggaggcttacgaacgcctgctgtggaatgggaggtattataattacgatagctcgtcaagaccgcagagtcgatctgtcatgagcgaccagtgtgccggacagtggttcttaaaggcatgcggcctgggagaaggtgacaccgaagttttccccacacagcatgtggtgcgcgctctgcagaccatctttgaattgaatgtgcaggcgttcgccggaggcgcaatgggggctgtgaatggcatgcagccgcacggggtccccgacaagagctcagtgcagtctgatgaggtctgggtgggggtcgtatacggactggctgcaaccatgatccaagagggtttgacgtgggagggctttcagactgctgagggctgttatcgaaccgtttgggagcgcctgggcctcgcctttcagacgccagaagcatactgccagcagcgagtcttccggtccttggcgtatatgaggcccctgtccatctgggccatgcagctggctctacaacaacagcagcacaagaaggcaagctggcccaaagttaaacagggaaccggactgcgcactgggcctatgtttggacccaaagaagcgatggccaatcttagtcctgagtag

SEQ ID NO: 50536 - DNA, 3636 bp, Artificial Sequence
  Description of Artificial Sequence: Synthetic coding sequence
atggcaactacagcaacacctgccacaaatcagggctggcctgaggatttcgggtttcgcctggggggaagcggcccatgcttcgtgttggaggtggccaaggggtccagcgcccatgcagggggtctgcggccaggggaccaaatcctcgaagtggagggcctcgccgtcggtggtctctcacgcgagagactagttcggctcgccaggaggtgcccacgggtgcctccctcattaggagtgctgccagcccctgatggaggacccggtcccggttcaggcccagccgctccaaccactgtgctgagagcgccaagatgtggcagaggccttgccctgggaagggagctgcttcgcctggctggtagaaagcgacctgatgccgtgcacagagaaagacggagaaaggcacaggaattctctaggaaagtggacgaaattctaggcgatcagcccacggccaaagaacaggtctttgcagcgctgaaacagtttgccgctgaacagagagtcgacgacctggtgtggacgctcaccctcgccctcccacgggaagcttgcgggccattgttggacaatttgaggatcttcatccccaagaagcatagagcgagatttgacgaggtcgtctcacaagggcttctgggaaaattgtgtagagccagacgtgcccagggcgcacagaggctgcgcaggtctcgctcggaggagcgtcccgaacgccttttggtgagtactagagcgtcagcacctcccaggcgccctgatgagcctcctcctcggagggccagtcttttggtgggtggactcgcaggcccaggaggagccagaagaaccgttcgtgtgtataagggcaataagtcttttgggttcaccctcagaggccatggtcctgtgtggatcgagagcgtgctacctggctctcccgcagacaacgcagccctgaaatccggagataggatcctgtttctgaacggcctcgacatgaggaattgctcacacgataaggtcgtgagcatgctccaaggttctggcgcaatgcctacgctggtagtcgaagagggcctggttccattcgcttccgattcagacagcctggactctcccaatccaagcagcgctctgaccagtctccagtgggtggcagaaattctgccctcgtctattcgcgtccaggggagaacatttagtcagcaactcgagcacctgctgacaccccctgagcgctacggcgtttgcagggcgctggaaagctttttccagcaccggaacattgatactctgatagtggatgtctatccagtactggacacacccgcaaagcaggtcttgtggcagttcatctatcagctgctgacatacgaagaacaggagctgtgccaggagaagattgcatgcttcctagggtacacggccatgactgctgagcccgagcccgagctcgacctggagtctgaacccacccctgaacctcaaccaagatcttctttaagggcatctagcatgtgtagaagaagccttcgcagtcagggattggaagccggattgagctgcgggccttcggaatgccccgagatgccactgccactgatacctggagagcgacaggccggagacggtacatctctgcccgagacacctaatcccaaaatgatgtccgcggtatatgcagaactcgagagccgactgaattcatcatttaaggggaaaatgggcaccgttagcaagtcaagagcctctcccccaggtccaagccctgccgtgacaaccgggccaaggacactttctggagtgtcatggccatccgagaggctcctgccctcaccttgttaccacccactttgcagtggtggcctggcctcccctagcagctccgagtcccacccgtatgcttccttagattcttctcgagccccatcgccgcagccaggccctgggccaatttgtcccgatagtcccccatcaccagatcctacaagaccgccaagccgacggaaattatttacctttagccacccagtcaggtcacgcgatactgacagattcctggacgtgctgagtgagcagctggggccacgtgtgactatagtagatgactttctgaccccagaaaatgactatgaggagatgtcctttcacgatgatcaagggtcatttgtcactaatgagcggagctccgccagcgattgcatttctagtagcgaggaggggtcttccctgacctacagcagtatcagcgaccacatcccccctccacctctgtcacctcctcctccccctcccttgcccttccacgatgctaaaccctcttcgcgcagcagtgacggatcacggggacccgctcaggcgcttgccaagcctctgactcagctgtctcacccagtgccacctcccccaccccctccattgcctcccccagtgccctgcgccccacccatgctgtcgaggggactgggacatagaagatcagagacttctcacatgagtgtgaagagactgcgttgggaacaggttgaaaatagcgaaggaaccatttggggccagctcggcgaagacagcgactacgacaagctgtccgatatggtgaagtacctcgacctcgagcttcactttggaacccagaagcctgccaagcccgttcccggaccagagccatttcgaaagaaggaggtggtggaaattctgtctcataagaaggcctacaatacaagcattctgctggcccatcttaagctgagccccgctgagctgaggcaggttctgatgtccatggaaccgagaagacttgaacccgctcatctggctcagctgctgctgtttgcccctgacgccgatgaagagcagcgctatcaggcattccgagaggcccctggtcgcttgagtgagccagatcagttcgtgctgcagatgctcagtgtcccggagtataagacacgtttgcggtccctccacttccaggcaaccttgcaggagaagacagaagaaatccgcggatcactagagtgcctgcgccaagcctctctcgagctgaaaaacagtcgcaaactggccaaaatattggaatttgtactagcgatgggaaattacctaaatgatggacagcctaaaacaaacaaaaccactggtttcaagattaacttcctgaccgagctcaacagcaccaagacggtggacggtaaatctacatttctgcacattctggctaagtctctatctcagcactttcccgagcttctcggttttgcgcaggatctccccacagtgcccctggccgcaaaggtcaatcagagggccttaacaagcgatctagctgatttgcacggtacaatttctgagattcaagatgcatgccaatccatctcaccttcttcagaggataaatttgcaatggtcatgtctagttttctggaaacggcacagcctgccctgcgagcccttgatggactccagcgcgaggctatggaagagctagggaaagcactggcattctttggagaggactccaaggccaccacgtcagaggccttttttggcatatttgctgaattcatgagtaagttcgaaagggccctctctgatcttcaggctggtgaggggctgcgatcctctggcatggtgtcccctctcgcatggtag

SEQ ID NO: 50537 - DNA, 1197 bp, Artificial Sequence
  Description of Artificial Sequence: Synthetic coding sequence
atgcacacggtcgctacttctgggcctaatgcttcttggggcgcacctgctaacgcaagcggctgtccaggctgcggggcaaatgcgtctgacgggcctgtgccatcacctagagcagttgacgcatggcttgtgccactcttctttgccgctttgatgttgctggggctcgtgggcaattccctcgtgatatacgtgatttgtcggcacaagcctatgcgcacagtgaccaatttctatatcgccaatcttgctgcgaccgatgtgacattcctgctgtgctgcgttccatttaccgctctcttatatccactgcccggttgggtgctgggcgacttcatgtgtaagtttgtgaattacattcagcaggtcagtgtgcaggcaacctgtgcaacccttaccgcgatgagcgttgacagatggtacgtcacagtgtttccactcagagctcttcacaggagaacccctcgtttggccctggccgtcagcttgtctatatgggtcggcagtgctgcggtgtctgctcctgtgcttgctttgcaccggctgtctcctggccctcgggcttattgttccgaagcatttccatcaagagctcttgaaagggcatttgcactgtacaacctgttggccctgtatctgttacctctgctggccacatgtgcctgctacgctgcaatgttacgccacttaggcagagtcgcagttcgccctgctccagctgacagcgcgctgcaaggccaggtgttagctgaacgcgctggagcagtgcgggcaaaggtcagtcggctcgtcgctgccgtggtgctgctttttgccgcttgttggggaccaatccagctgttcttggtgctccaagctcttggaccagcgggaagctggcatccacggtcttacgcagcctacgcgctgaaaacctgggcacactgcatgtcctatagtaactctgctctgaatcccctgctgtatgctttcttaggatcccatttcaggcaagctttcagacgcgtgtgcccttgcgctcccagacgcccacgcaggccacgacgaccgggaccttccgaccctgcagctccacacgctgaattgctgaggctcggtagtcatccagctccagccagagctcagaagccgggttcttcaggcttagcagctagagggctctgcgtactgggcgaagacaatgcccctctctag

SEQ ID NO: 50538 - DNA, 3543 bp, Artificial Sequence
  Description of Artificial Sequence: Synthetic coding sequence
atggtgctgttgctgatcctcagcgtcttacttttgaaagaggacgtaagagggagtgcccagtcatctgaaagacgtgttgtagcccacatgcccggagacataataatcggcgctctgttctcagtgcaccatcagccgactgtggacaaggtgcacgaacggaagtgtggcgcagtgcgcgagcagtacgggattcagcgggtggaggcaatgctgcatacccttgagaggattaatagtgaccctaccctgctcccaaatatcacactagggtgtgagattcgagattcatgttggcactcagccgttgccctcgaacaaagcattgaatttattcgagactctctgatcagctcggaggaggaggaaggtctggtccggtgtgtggacgggagctcatcctcctttcggtccaagaaacctatcgtgggggtgatcggacctggctcctcttccgtggccattcaggtccagaaccttctgcaactgttcaatattccgcaaatcgcctacagcgcaacctcgatggatctttccgataagaccctgttcaaatattttatgcgggtcgtcccatcagacgcccagcaggctagggccatggtggacatcgtgaagcgatataactggacatatgtgtccgcggtgcataccgagggcaactatggcgaatctggaatggaggctttcaaagatatgtccgctaaggaaggcatttgtattgctcactcatacaagatctattctaatgctggggaacaaagcttcgacaagctactgaagaagctgacatctcatctgccaaaggctcgagtagttgcttgtttctgcgagggtatgacagtgcggggtctgctcatggctatgcgaagactaggtctcgccggagagttcctgctgctgggctccgatgggtgggccgaccggtacgacgttacagatggttatcagagagaggcagtcggagggatcacaataaaattgcagtctccagacgtaaaatggtttgatgattattacttgaaactgcgacccgagaccaatcacagaaatccgtggtttcaggagttctggcagcatcgcttccaatgcaggttagagggcttccctcaggagaattcaaaatataacaagacttgtaactcctctctcaccctgaagacccatcacgttcaggatagtaagatgggtttcgttatcaacgctatatatagtatggcctacggtctgcataacatgcagatgagtctgtgtcccggttacgctggcctgtgcgacgctatgaagccaattgatggtcgcaagctgcttgagtctctgatgaagaccaacttcaccggcgtatccggagacactatcctattcgacgagaatggggactctcctggtaggtacgaaatcatgaatttcaaggaaatggggaaagactattttgactatattaacgtaggatcttgggataatggagagctgaagatggatgacgatgaggtgtggtccaaaaaatcgaacattatccgatcagtatgctcagagccttgcgagaagggccagattaaagtaatccgaaagggcgaggtctcctgttgctggacttgcacaccttgtaaagagaatgagtacgtctttgacgagtacacgtgcaaggcttgccagcttggttcctggccgacagacgacctgacaggctgtgacttaattcctgtgcagtatcttcggtggggtgaccccgagccaattgctgcggtggtgttcgcctgtctgggcctgttggccactttatttgtgactgtggtgtttattatatacagggacacccctgtggtgaaaagctcctccagagagctctgttacatcatactggctggcatctgtttgggctacctctgtacattttgcctgatcgcaaaaccaaaacagatatattgctacctacagcggattgggatagggctgtcacctgccatgagttactctgcacttgtgacaaagacaaaccgcatcgccagaatcctagctggctctaaaaagaagatctgcacaaagaagcccagattcatgtccgcgtgtgcccaactggtcatcgcctttatcctgatttgcatacagctagggattatcgtggccctgttcattatggagcctcccgacatcatgcacgactacccatccatccgggaggtgtacctgatttgcaacacgacaaaccttggcgtcgtcactccacttgggtacaacggactgctcattctgagctgcacgttctatgcctttaagacgcgtaatgtgcccgcaaatttcaatgaagcaaaatatatcgcatttaccatgtacactacatgtatcatctggcttgcttttgtgcccatttactttggatcaaactataaaattataaccatgtgcttctctgtgtctttgagcgcaactgtcgccctgggttgcatgttcgtgcctaaagtatatatcatactggccaagcctgaaagaaatgtgaggtccgcgtttaccacctcaactgtcgtgaggatgcacgttggagacggaaagagttcgtcagctgccagcagaagcagctccctggtcaacctctggaagcgcagaggaagctccggggagacactctcatcaaacggcaaaagtgtaacctgggcccagaatgaaaagtcttcgagagggcagcacctttggcaacgcctcagcatccacattaacaagaaggagaatcccaaccagactgccgtcattaaaccatttccaaagtccaccgaatctcgaggcctcggggcaggtgcgggagctggtggctcagccggtggtgtgggggcaactggcggagctggatgcgctggcgctggaccagggggacctgagtcacccgacgcgggacccaaggcactgtacgacgtggcggaggcagaggagcattttcccgcacccgcaagaccccgatcacctagccctattagcaccctgtcacaccgtgctggaagtgctagccgtaccgacgatgatgttccctcacttcactctgaacctgtggcaagatcgtcaagctctcaggggtcattgatggagcaaatctcatcagtcgtgacccgcttcacggctaacatctcagagctgaattcaatgatgctgtccactgctgccccatcccccggtgttggcgcaccactttgttctagttatcttatcccaaaggagattcagctaccaacaacaatgactacatttgccgaaattcaacccctgccagctatagaagtgacaggtggagcgcaaccagccgctggtgcacaggctgccggtgatgccgctcgggagtctccagcagctggaccagaagccgcagctgccaagcccgatctggaagaactggtagcgctgacccctccatcacctttcagagactctgtcgacagtggttctacaacccctaacagtcccgtttcagagtcggccctctgtatccctagctctccaaaatatgacacactgatcatacgtgattacacacagtcatcatcctctctgtag

SEQ ID NO: 50539 - DNA, 3639 bp, Artificial Sequence
  Description of Artificial Sequence: Synthetic coding sequence
atggtgctgctgttgattctgtcagtgcttcttcttaaggaggatgttcgcggatcagcacagtcttccgaaaggcgcgtggtggcgcacatgcctggggacattatcattggggcactcttcagtgtccatcatcagccgaccgtagacaaggtgcacgagcggaagtgcggcgctgtacgggaacagtatggcattcaacgggtggaggccatgcttcataccctcgaacggattaactccgacccaacactgctccctaatataactcttggctgcgagatcagagacagttgttggcacagcgctgttgccttggagcaatctattgagttcattcgggatagcctcattagcagcgaggaagaagagggcctggtgcgttgtgtggacgggagctcttcctccttcagaagcaagaaaccaattgtgggcgtgatcggtcccggttccagctcggttgcaatccaggtgcaaaatctgttgcagctgttcaacatccctcagatagcatattcggctacctcaatggatctgagtgataagactttgtttaaatacttcatgcgcgtggtgcccagtgacgctcagcaggcgagagctatggttgacattgtcaaaagatacaactggacatacgtaagtgcggtgcatactgagggaaactatggagagtctggcatggaagccttcaaggatatgtcagccaaggagggtatctgcattgctcacagctataagatttactctaatgctggcgaacagtcatttgataagctcctgaaaaaactaacgtctcatttgcctaaagctcgtgtagttgcttgcttctgcgagggaatgaccgtcaggggacttctgatggcaatgaggcgcctcggcctcgctggagagtttctgctcctggggagcgacggctgggcagacagatacgacgtgacagacggttaccagagggaagcagtcggcggaatcaccattaaactgcaatctccagacgttaaatggtttgacgactactatctcaaactccggccagaaactaaccaccgtaacccatggttccaggaattctggcagcatcggttccaatgcagacttgaaggttttcctcaagaaaattcaaagtacaataagacctgtaactccagcttgaccttgaaaacccaccacgtacaggactcaaagatgggcttcgtgatcaacgctatttactcaatggcttacgggctgcataacatgcagatgagcttgtgtccaggctatgccggattgtgcgacgccatgaaacccatcgatggccgaaagctgctggaatcattgatgaagacaaacttcaccggagtgagcggggataccatcctttttgatgaaaacggagattcgcctggccgatacgagatcatgaacttcaaggaaatggggaaagactacttcgattacatcaacgttggaagttgggacaacggggaactgaagatggacgatgatgaagtgtggtccaaaaaatctaatattatcagaagcgtctgcagtgaaccttgtgagaaagggcagatcaaggtgatccgaaaaggtgaagtctcttgctgctggacctgcaccccctgtaaggagaacgagtacgtgttcgacgagtacacctgtaaggcctgccagctggggtcctggccgacggatgacctcaccggatgtgacctcattcccgtccagtatcttcgctggggtgaccccgagcccatagcagccgtggtctttgcctgtcttggcctcctggctacactctttgtcaccgtcgtcttcatcatctatagagatactcctgttgtcaaaagttcctccagagagctctgctacattatcctcgcagggatctgcctgggctacctgtgtacgttctgtctgatcgccaagcccaagcagatctactgttatcttcaaagaatcggcatcggcctgagccctgccatgtcatatagcgccctcgtgaccaagaccaatcgtatcgcacgtattctcgccggtagcaaaaagaagatctgtactaagaagcctagatttatgtcggcgtgcgcccagcttgtaattgctttcatcctaatctgcattcagcttgggattatcgtcgctctcttcatcatggagcctccagacattatgcacgattacccttccatcagagaggtctacctgatttgcaatacgaccaacctgggtgttgttaccccactggggtacaatggactgcttattctgtcctgtacattctatgccttcaaaacccggaacgtgccagcaaactttaatgaagctaagtatatcgccttcacaatgtacacaacatgtattatatggctggccttcgttccgatctactttggatccaactacaagataatcaccatgtgtttttcagtgagcctgtctgctacagttgccctgggatgtatgtttgtccccaaagtttacatcatcctcgccaagccagagcgcaacgtgaggagcgcttttacaacatctaccgtggtcaggatgcatgttggtgatggaaaatcatctagtgcggctagccggtcaagtagcctggtcaatctgtggaaacgcagggggtcctccggtgagacactgaggtacaaggaccgaaggctggctcagcataaatcagagattgaatgcttcacccccaaggggagtatgggcaacggtgggagggctacaatgagttcatccaatggaaagtcagtaacgtgggctcagaacgagaaatcctccagggggcagcacctctggcagcggctgtcgatacacattaacaagaaagagaatcctaatcagaccgcagtgattaagccctttccaaaatccacagaatccagaggcctcggagccggtgctggggcaggcggatcagctggtggggtcggagctacaggaggggctgggtgtgccggtgcaggtccagggggaccggagtcacctgatgccggacccaaggcattgtacgatgtggcagaagccgaggaacacttcccagctcctgcgagacccagatctccctctcctatatcaaccctgtctcacagggccggttcagcttctagaactgacgatgatgtgccgtccttgcatagtgaacccgtagccagatctagctctagccagggttcactaatggagcaaatcagctcagtcgtgacaaggttcacagcaaacatatcagaactcaactcaatgatgctctccacggccgcaccatctcctggggtgggggctccattatgctcctcctatctgattcctaaggaaatacagctgcctacgacgatgaccaccttcgccgaaattcagcccttacccgcaattgaagtaacgggcggtgcccagcccgcagccggagcacaggcagctggtgacgcagctcgggagtctcctgctgcagggccagaagctgctgcggcaaagccagacctggaggaattggtggcgctgactcctccatctccttttagagactcagttgacagcgggtccactacacccaatagtcccgtctctgagagcgcgttatgcattccatcctcaccaaagtatgacactctcatcatcagggactacacccagagtagcagctccctatag

SEQ ID NO: 50540 - DNA, 2829 bp, Artificial Sequence
  Description of Artificial Sequence: Synthetic coding sequence
atggttttgctgttgatcctgagcgttcttctgctgaaagaagatgtgcggggaagtgcccagagctctgaaaggagagttgttgcacacatgcccggtgacattataataggggctctcttctcagtgcatcaccaacctaccgtggacaaggttcatgagcggaagtgcggagccgtgcgggaacagtacggcatacagcgcgtcgaagccatgctgcacaccttagagaggatcaactctgatccgacattgctccctaacattacccttggttgcgagatcagagattcttgctggcattccgctgtagcacttgagcagagtatagagtttatccgcgacagtttgatctcctctgaagaggaagagggtctggtaaggtgtgtggacggaagttcaagctccttccgaagtaagaaacctattgtcggagtcataggacccggaagttcctcagtggcgatccaggtgcagaacctgcttcaactcttcaatatcccacagatagcatattcagcaacttctatggacctcagtgataagacacttttcaaatacttcatgcgtgtggttcctagcgatgcacagcaggctcgtgccatggtggacatagtgaagcgatataactggacctatgtgagtgccgttcacactgaagggaattatggggagtcaggtatggaggcattcaaggacatgagcgctaaggaaggaatctgtatagcccacagctacaagatctattctaacgccggagaacagtctttcgataaactactgaaaaagctcacttcacacctacccaaggccagggttgtggcttgcttctgtgagggcatgaccgtgagaggactattaatggccatgcgccgtcttggcctggctggcgagttcctcctcctgggatcggatggctgggcagatcggtacgatgtgaccgacggttaccagagagaagccgtaggcggaatcaccatcaaacttcagtcccccgacgtgaaatggtttgatgattactacctcaagttgaggccggaaacaaatcataggaacccatggtttcaagaattttggcaacaccggtttcaatgccgactcgaaggattcccccaggagaattccaagtataacaagacttgcaacagcagcctgacattgaaaactcatcatgtgcaggatagcaaaatgggattcgttatcaatgctatctatagcatggcttacgggctgcacaacatgcagatgtctctgtgccccggttatgcaggcttgtgcgacgccatgaaaccgatcgacggaaggaaactgctggagtcgctgatgaagaccaactttaccggggtgagcggagacactattctgttcgacgagaacggtgatagccccggtagatacgaaattatgaattttaaggaaatgggaaaggactattttgactatattaacgtcggctcttgggacaatggtgaacttaagatggacgatgatgaagtttggtctaagaagagtaatatcattagatccgtgtgctctgaaccgtgtgagaagggacagatcaaagtgatccgcaagggagaagtgagttgttgttggacttgcacaccttgtaaagagaatgagtatgttttcgacgagtacacttgtaaggcatgtcagctggggagctggccaaccgacgacttgaccgggtgcgatctcatcccagttcagtatctgagatggggagaccccgagcctatagccgctgtggtcttcgcgtgtctagggttactagctacccttttcgttaccgttgtgttcataatctaccgtgatactccagtagtgaaaagttctagtcgagagctttgttacattatcctcgctggaatctgtctcggctacctgtgcacattttgcctcatagccaagcctaaacaaatttactgctatttacagcggattggcattggcttgtcgccggctatgtcttactccgccctagtcaccaagactaatagaatcgctaggatcttggccggatctaaaaagaagatatgcacaaaaaagccacgttttatgtccgcgtgcgcccagctggttatagctttcattctgatctgcattcagctcggaatcattgtcgctctctttatcatggaaccgccagatataatgcatgattacccaagcattagagaggtctacctaatatgtaatacaaccaatctgggtgtcgtgacccccctgggttacaacgggttgcttattctgtcctgtactttctatgctttcaagactcgcaacgtgcctgccaactttaacgaagccaagtacattgccttcactatgtatacaacttgcatcatctggttggcttttgttccaatttactttgggagtaactataagataatcactatgtgcttttcagtgtctctgagtgctactgtggctcttggatgcatgttcgtccccaaagtttatatcattctggcgaaacctgaaaggaatgtcagatccgcttttacaaccagtacagtcgtgcgcatgcacgtgggggacggaaagagcagctcggctgccagccgcagctcttctctggtgaacctatggaaacggaggggaagtagtggcgagaccctgcgttacaaggaccggcgtctggcccagcacaaatctgaaatagagtgctttacccctccatctcccttcagggatagcgtggatagcgggtctactaccccaaattcacccgtcagcgaaagcgcgctgtgtatccccagcagccccaagtacgacaccctgattatcagagactatacacagagtagttccagcctgtag

SEQ ID NO: 50541 - DNA, 3639 bp, Artificial Sequence
  Description of Artificial Sequence: Synthetic coding sequence
atggtgctgttactcatcctttcagtgctccttttaaaggaagatgtcagagggtccgcacagtcatctgaaaggcgagtcgtcgcgcacatgccaggcgacattattattggagccctctttagcgtacatcatcaacctacagttgacaaggtgcacgaaaggaagtgcggcgcagtgagagaacaatacgggatacaacgtgtggaggccatgcttcataccctggagaggattaattccgaccctacacttctacccaatatcacactgggttgcgagatccgggacagctgttggcacagcgcggttgctctggaacagagtattgaattcatccgcgactccctcatctcctccgaagaagaggaaggtctcgtgcggtgcgttgacggcagttcatcatcctttagatcaaaaaagcctatcgttggagtaattggccctggtagtagcagtgtggctattcaggtccaaaatctgctgcagctatttaatattccccagatagcttactctgcaactagtatggacctctccgacaagaccctgttcaagtacttcatgcgcgtggttccttcagatgctcagcaggcacgggcaatggtggacattgttaagagatacaattggacttatgtgagtgccgttcatacggaaggaaactacggcgaaagcgggatggaggctttcaaggacatgagcgcaaaagagggaatctgcatcgcccactcctacaagatttactccaacgcaggtgaacagtcttttgacaagctgctgaagaaactaacctctcatttgcctaaggcacgcgtggtggcctgcttctgtgaaggaatgacagttcgcggtctgttgatggccatgaggcggctcgggttagctggtgagtttcttcttctgggcagtgacggttgggctgacagatacgacgtgacagacggctatcaaagagaggccgtcggtgggatcacaatcaagctgcagagtccagatgtcaaatggtttgacgactattacttgaagctgcgcccagagacaaatcacagaaacccttggtttcaagagttctggcagcaccggtttcagtgccgcttggaaggcttcccccaggaaaactccaaatacaacaagacatgtaactcctcccttacactgaaaactcaccacgttcaggatagcaaaatggggttcgtcataaacgctatatatagcatggcctacggactacataacatgcagatgagtttgtgccctggctatgccggtctatgtgacgctatgaagccgattgacggcagaaagctgttggagagcctgatgaagaccaactttactggagtctcaggcgacaccatcctgtttgatgagaatggcgactcacccggtcggtacgagattatgaactttaaagagatggggaaggattacttcgattatatcaacgtggggagctgggataacggggaactgaaaatggatgatgacgaagtatggtcgaagaagtctaacattatccggagcgtttgcagtgaaccctgcgaaaagggacaaattaaagtcatacgaaaaggcgaggtctcctgttgctggacctgtaccccatgcaaggaaaatgaatacgttttcgacgaatacacatgcaaagcctgtcagcttggctcatggccaacagacgatctcacaggttgtgatctcattccggtccaatatctgcgttggggcgacccagagcccatcgccgctgtcgtgttcgcttgcttaggcctcctggctacgctgttcgtgacggtcgtgtttattatctatcgggatacgccagtcgtaaaatcgtcttcacgtgagctctgttacatcatactcgccggtatatgcctgggctatctgtgtactttttgcctcatcgccaagcctaagcagatttactgctatctccagagaattggaattggcctatctccagccatgagttacagcgcattagtgaccaaaacaaaccgcattgcaaggattctggcagggtctaaaaagaaaatttgcactaaaaaacctagatttatgtccgcctgcgcgcaactggtgatcgcttttatcctcatctgcatccagttgggcataattgtggccctgttcataatggagcctcccgacattatgcatgactatcctagcataagagaggtctacctcatttgcaacactacaaacctgggcgtcgttaccccactgggctacaacggcctgctgattctatcttgtacattctatgcctttaagacacggaatgttccggctaacttcaacgaagctaaatatatcgctttcactatgtataccacgtgtatcatttggttggcttttgttcccatctatttcggttctaactacaagatcatcactatgtgcttcagtgtgagcttaagcgctaccgtggccctgggttgcatgtttgtgcccaaagtgtatattatactggctaaacccgagaggaacgtgcgcagcgccttcacaacatctacagttgtgcggatgcacgttggggacgggaagtcttcgtccgcagcttctcggtcctcctcactggtgaatctgtggaagagacggggatcatcgggtgagactcttagatacaaagatagaagactagcccagcataaaagcgaaatcgagtgcttcacacccaaagggagtatgggcaatggaggcagagcaacaatgtccagtagcaacggcaaatctgttacctgggctcagaatgaaaagtcctccaggggccagcacttatggcagcgcctgagcatccacataaacaaaaaagagaaccccaaccagactgcggtcataaaaccctttccgaaatccaccgagtcccgcggtctcggggctggggctggtgctggcggatcggccggaggtgtaggggctacaggaggagccggatgcgcgggagccggacctggagggccagaaagtcccgacgcgggacctaaggcactgtatgacgttgctgaagccgaggaacattttccggctcccgctaggccacgctctcccagtcctatctccactttaagtcaccgagccggttctgcatccagaaccgacgacgatgtgccctcccttcatagcgaacctgtggcgaggtctagttcttctcaggggtccctaatggaacaaatctcaagcgtggttacacgattcaccgccaatatctcagagttaaacagcatgatgctatctacggcagccccttctccaggcgtgggggcacctctatgctcaagttatctgatccctaaggaaattcagctgcccacaaccatgacaacgttcgcggaaatccagccattgcccgcaatcgaggtcactggcggagcccagcctgccgctggggctcaggccgctggagatgccgctagagagtcccccgctgcgggaccagaagccgctgctgccaagcccgacctggaggagttagtggctcttaccccaccctctccatttagagattcagtggatagcggcagcacgacccccaactctccagtatccgagtccgcactgtgtattccatctagccccaagtacgacacactgataatccgagactacactcagtcatcatctagcctgtag

SEQ ID NO: 50542 - DNA, 3543 bp, Artificial Sequence
  Description of Artificial Sequence: Synthetic coding sequence
atggtcctgttgctgattctttctgtcctactgctaaaggaagatgtgagagggtccgctcagtcgtctgagcgcagagtagtggcccacatgcctggcgacatcattataggcgctcttttctctgttcaccaccaaccaactgtcgataaggtgcatgagcgcaagtgcggtgccgtgagagagcagtacggaatccagagggtggaagccatgcttcatactctcgaaagaatcaacagtgatcccacgctcttgccaaacataacattgggatgtgagatcagggacagttgctggcattcagcagtggctcttgagcagagcatcgagttcattagagacagcctaatctcaagtgaagaagaggagggactagtgcgatgcgtggatggaagcagctcctcgttccgatccaagaagcccatcgtcggcgtgatcggacccggatcatcttcggtggctatccaggtgcagaacctcctgcaacttttcaatattccacagatcgcatatagcgccacctctatggacttgagtgacaagacactgtttaaatatttcatgagggtagttcccagcgacgctcagcaggcgagagcaatggtagacattgtgaaacgatataattggacatatgtgtcagcggtgcacactgaaggcaattacggtgaatcaggcatggaggcctttaaagacatgtcagccaaggagggcatctgcatagcacattcctacaaaatttattccaacgccggagagcagtctttcgacaagcttttgaaaaaattgacgtcccaccttcccaaagcccgagtcgtcgcctgcttctgtgaaggcatgacagtacgcggtttactgatggcgatgcggcgattggggctggcgggagagtttttactgctcgggagcgatggctgggcggacagatacgacgttacagatggttatcagagggaggctgtcggaggcattacgatcaaactgcagtcacccgatgtaaagtggttcgacgactattatctgaagctgcgacccgagactaatcacagaaacccgtggtttcaagagttctggcagcatagatttcaatgtaggctggagggcttcccgcaggaaaactctaaatacaacaagacatgtaattctagtctcacactgaagacccatcacgttcaggacagcaaaatgggatttgtaattaacgccatttattccatggcctacggccttcataacatgcagatgagtctctgccctgggtatgcgggtttgtgtgatgccatgaaacctattgacggcaggaagctgcttgaaagcctgatgaaaacgaatttcaccggggtatccggcgataccatactgttcgacgagaacggagacagtccgggtcgttacgagattatgaatttcaaagaaatggggaaggattactttgattacattaacgtaggaagctgggacaatggcgagttgaagatggacgacgatgaggtgtggtccaaaaaatccaatatcatcaggtctgtgtgttctgaaccatgtgagaaaggtcagattaaagtgattaggaaaggcgaagtcagctgttgctggacctgtaccccgtgcaaggagaatgaatacgtgttcgatgagtacacatgtaaagcatgtcagctcggaagttggccaaccgatgacctgaccggctgtgatctgatccctgtccagtaccttcggtggggcgatcccgagccaatcgccgcagtggtatttgcctgccttggactgctggccactctctttgtgactgtcgtgttcatcatctaccgcgacactccagtcgtgaagtctagcagccgggagttgtgttacattattttagcaggcatctgtctcggctacctgtgtacattttgtctgattgctaagccaaaacagatctattgctacctccagcgaatcgggattggattgtctccagcaatgtcctactctgcgctggtgactaagaccaatagaattgcgagaattcttgccggttcaaagaagaaaatctgtactaagaagcccaggttcatgagcgcgtgtgcccaactcgtgatcgcattcatcctaatatgtattcagctgggcatcatagttgcattgtttatcatggaaccacctgatatcatgcacgactacccgtccatccgggaggtctacttaatctgcaatacgacaaacctgggagttgtaactcctcttgggtacaacggactccttatactgtcatgtacgttttatgccttcaaaactcgtaacgttcctgctaactttaatgaggctaaatatatcgcgtttaccatgtatacaacatgcattatctggctggcgttcgtgccaatctattttggcagcaactacaaaattatcaccatgtgctttagtgtgtccctttctgccaccgtggctcttgggtgtatgttcgttcccaaagtctacatcatcctcgccaagccagaaagaaacgtgagatcagccttcaccactagcaccgtggtgcgtatgcacgtgggtgatggaaaatccagctcagcggcatcaaggagttcaagcctcgtgaacctctggaagcgcagaggtagttccggggaaactctgagtagcaatggtaagtccgttacctgggctcagaatgaaaaaagttctcgaggccaacatctctggcagaggctctcaattcatatcaataaaaaagagaatccaaaccagactgctgtaattaagccgttccctaaaagcaccgagagtcgtggactgggcgcaggcgcaggggcaggtggctccgccggtggggttggcgctactgggggagccggatgcgctggcgctgggccagggggtccggaaagcccagatgcagggcctaaggccctctacgatgtagccgaggccgaagaacactttcctgcaccagctcggcctcggagccccagtcccatcagcacattgagccatagagcagggagcgcttcccgtactgatgacgacgtgccgtccttgcattcagagcctgtggccagatcttccagctcacaggggtccctgatggaacagatcagctccgttgtaactcggtttaccgccaatatctccgagcttaactccatgatgctcagcaccgccgcaccttcgcctggcgtgggcgctccgctctgcagcagctatttgattccgaaggaaattcagctgcctaccaccatgacgactttcgccgagatccagcctcttcccgcaatagaagttactggaggtgcacagccggcagcgggtgcccaggccgctggcgacgctgctcgggaatctcctgccgcaggaccagaagccgcagcagcgaaaccagatctcgaggagttagtggccttgacccccccaagccccttccgggattctgttgactccggatctaccacacctaattctccagtttctgagagcgcgctatgcatcccaagttccccaaagtacgatacactgataattagagattatacccaaagcagttcgtctctttag

SEQ ID NO: 50543 - DNA, 1149 bp, Artificial Sequence
  Description of Artificial Sequence: Synthetic coding sequence
atgagatctgggggtagagggaggccgcgtttgagattgggggagagggggctgatggaaccattgctgccccctaagagaaggctgctaccccgtgttcggttgctacctctgctgctggccctggccgtgggatcagcattttacactatctggagtgggtggcatcggagaacagaggaactgcccctgggtcgagagttgagagtgccactaatcggaagcctaccggaagctagattaagacgtgtggtaggacaactcgacccccagcggctctggagtacttacctgcggccattgctggtggtgcgaacaccgggttctcctggaaatctgcaggttcgtaagttcctggaggcaaccctgagaagtcttaccgctggatggcacgtggaactggatccatttaccgcaagcaccccattgggaccagtggatttcggcaacgtcgtggctaccttggatcctcgcgctgctcgtcacctgactcttgcatgccactacgatagtaaactattcccaccaggctcaaccccttttgtgggtgctactgattctgcggtgccatgtgccctactgcttgagttagctcaagcgctggacctggagctttcgagagccaagaagcaagctgcgcctgtgaccttgcagttactcttcttggacggcgaagaggcactgaaggaatggggcccaaaagactctctctatggcagtcgccatcttgcccagctcatggagagcatacctcattcaccagggccaacccggattcaggccatcgagttatttatgcttcttgatctgcttggcgcacccaaccctactttttacagccacttcccgcgtaccgtcaggtggtttcatagactcagaagcattgaaaagcggctgcatagattgaacctcctccagtcacaccctcaagaagttatgtattttcagccgggagagccgttcggcagcgttgaggatgatcatatccctttcctgaggaggggggtaccagtgttacacctgatctccacaccttttccagctgtgtggcacacgcccgcagatacggaggtcaaccttcatccacctacagtccataacctctgtagaattttggccgtcttccttgcggaatatctgggcctgtag

SEQ ID NO: 50544 - DNA, 867 bp, Artificial Sequence
  Description of Artificial Sequence: Synthetic coding sequence
atgcgcagtggcggtcgcggtcgaccaaggctgcgtctgggagaacgcggattgatggagccactgctgcccccaaaaaggcggcttcttccgagggttcggttactgcctctgctgctggccctggccgtcggtagcgctttctatacaatctggtcagggtggcaccgacgcacggaggagctccctctcggtcgtgaactccgtgtgccactgatcggctcactgccagaagctcgtttgcgcagggtggtgggacaactcgatccccaaagactgtggtcaacttatctaaggccacttctggtggtgaggacacctggcagtcccggtaacctgcaggtacggaaggcggctcctgtaaccctccagcttctgtttcttgatggcgaagaagcacttaaggagtgggggccaaaggatagtctgtacggcagccgccatttagcacaactcatggaatctataccccatagtcccggtcctacccgcattcaggctattgaactgttcatgctgttagatttgctcggagccccaaatcccaccttttacagccacttcccgcgaaccgtgagatggttccatcgcttgcggagtatcgagaagcggttacatcggctgaacctcctgcagtctcaccctcaagaagtgatgtactttcagcccggagaaccgtttggctcagtggaggacgaccacataccatttctcagacgaggggtgcctgtgttgcacctcatcagtacgccctttcccgcagtgtggcacactccagctgacactgaagtgaacctgcaccccccaactgtgcacaatctgtgccgtatattggcagtgtttttggctgaatacttggggctttag

SEQ ID NO: 50545 - DNA, 960 bp, Artificial Sequence
  Description of Artificial Sequence: Synthetic coding sequence
atgcttggacgctctctacgggaggtgagcgcagctctgaagcagggtcagattaccccgactgaactgtgccaaaagtgtctttctctgatcaagaaaaccaagttcctcaacgcctacattaccgtcagtgaagaggtggctctaaagcaagccgaagaaagtgagaaacgctacaaaaacggtcagtctctgggtgacttagacggcatcccaatagccgtgaaagataacttcagcaccagtggcatcgaaaccacgtgcgcctcaaacatgctcaagggttacattccaccctataatgctacagttgttcaaaagctgctggaccagggtgcgttgctgatggggaagacaaatctggacgaattcgcaatgggctccggctccaccgatggcgtctttgggcctgttaaaaacccttggtcctatagtaagcagtatagagaaaagcggaaacagaaccctcacagcgagaatgaagatagcgattggttaattaccggaggaagttccggtggatcagccgcagccgtgtccgcttttacctgctacgctgcattgggcagcgatacaggcggtagcacccgcaaccccgcagcgcactgtggactggtaggttttaaacccagctacggactcgtgagcagacacggcctgatccccctggtcaacagtatggatgtaccgggtattcttactagatgcgtggatgacgcagccattgtgctgggcgcactggcgggacctgatcctcgcgactcaaccacagtgcatgagccaataaataagccattcatgcttcctagtctggccgatgtgagtaaactgtgcatcggaataccaaaagtgacattttcattccattattttactgagattctgtctagccctatcgaaagcacagatctcgggggagggctggggggttttgagagcctgctgtgccacttttactag

SEQ ID NO: 50546 - DNA, 1587 bp, Artificial Sequence
  Description of Artificial Sequence: Synthetic coding sequence
atgctcggcaggtctctacgagaggtttccgcagcccttaagcagggccaaattacacctaccgagctttgccagaaatgtttgtccttgattaagaaaaccaagtttctgaatgcctatattaccgtgagcgaagaagtggcactgaagcaagcagaagagtccgaaaaacggtataaaaatggccaatctctgggggacctggatgggatacccattgccgtgaaagacaatttttccacaagcgggatcgagacgacatgcgccagcaacatgctcaagggctatattccaccttacaacgccaccgtagtccaaaagctactggatcaaggcgctcttctcatgggtaagacaaatttggacgagttcgccatgggcagcgggagcactgacggtgtctttggcccagtgaaaaacccatggtcctacagcaagcagtatcgcgagaaaaggaagcaaaacccccattccgagaacgaggatagtgactggctgatcaccgggggttcttccggagggagcgccgctgctgtgtcagccttcacctgttacgcggcactgggctcagatacgggcggatcgacaaggaacccagccgcacattgcggcttggtcggttttaagccatcctatgggctcgtctcacgtcatggcttgatacctcttgtgaacagcatggatgttcctggcatcttaacgagatgtgtggacgacgctgcgattgtcctcggcgcattggccggtccggacccgagggattctacaaccgtccacgagcctataaataaacccttcatgctgcctagtttagccgatgtctccaaactgtgtataggaattccaaaagaatatctggtgcccgagctgtctagtgaggtgcagtcactatggtcgaaggccgctgatttgtttgaaagtgagggagccaaggtgatcgaagtgtccctgccacatacgtcatattccattgtctgctatcatgtgctttgcaccagcgaggttgccagcaacatggcccgtttcgacgggctgcagtacggccacaggtgtgatattgacgtatctactgaggccatgtatgccgctacaaggagagaaggctttaatgatgtggtgcgcggaaggattctctctgggaatttttttctgttaaaggagaattatgagaattattttgtaaaggctcaaaaggtgcggagactgatcgccaacgatttcgtgaatgcttttaatagcggagtggacgtgttgcttacccccacaacattgagtgaggctgtgccttacctcgaattcatcaaagaggataataggacaaggagtgcccaggatgacattttcacccaggccgtgaatatggctggcttacctgccgtgtcgattcccgtggctctcagcaatcaggggctcccgattggactgcagtttatcggacgcgctttctgtgaccagcagctgctgacggttgccaagtggtttgaaaaacaggttcagttcccggtgattcaactgcaagaattgatggacgactgctccgctgtattggagaacgagaagttagcatccgtgtctctgaagcagtag

SEQ ID NO: 50547 - DNA, 411 bp, Artificial Sequence
  Description of Artificial Sequence: Synthetic coding sequence
atgtggagccggctggtgtggcttgggctgcgagcgcctttaggcggtaggcaaggttttaccagcaaggccgatcctcaggggtctgggaggattaccgcagccgtcatcgaacacctagaacgcctcgccttggttgactttgggtccagggaggcagttgcacgattagagaaggcgatcgcattcgccgatagactacgggcagttgataccgacggcgtagagcctatggagtcagttctcgaagataggtgtctctacctacggagtgataatgtcgttgaaggtaactgtgccgacgagctgttacagaattcacaccgtgttgtggaagaatatttcgtggccccacccggtaacatctccttgccaaagctcgatgagcaggaacctttcccgcacagttag

SEQ ID NO: 50548 - DNA, 630 bp, Artificial Sequence
  Description of Artificial Sequence: Synthetic coding sequence
atggagcccctggctgcttatccactgaagtgcagtggaccccgagccaaggtcttcgcagttctcctctctatcgtgctctgtaccgtaactctattcctgctacagctgaaattccttaaaccaaagatcaattccttctatgcctttgaggtgaaggacgccaaggggaggaccgtgtcactggaaaaatacaaaggcaaggtttcactggtggtgaatgttgcgagcgactgccagctgacagaccgcaattatttgggtctgaaagaattacataaagagttcggccctagccatttttctgtcctagccttcccttgtaatcagtttggcgagagcgagccccgtcccagcaaagaagtggaaagcttcgctaggaagaactatggggtgacctttcctattttccataagatcaagatcttggggtcggaaggtgaacccgcattccggttcctcgtcgactcttcgaaaaaagaacctcggtggaacttctggaagtaccttgtgaacccagaaggccaagtcgtgaagttctggaagcccgaggagccgattgaagtgattcggccagacatcgctgccttggtgcgtcaggttattataaaaaaaaaggaagacctctag

SEQ ID NO: 50549 - DNA, 2388 bp, Artificial Sequence
  Description of Artificial Sequence: Synthetic coding sequence
atggccaccatgttagagggacgctgtcaaacgcaaccacgaagctcaccgagtggcagagaagcttccctttggtctagcggtttcggaatgaagttggaagccgtgacgccctttctggggaaataccggccatttgtcggaagatgttgccagacatgcacaccaaagtcctgggagagtctcttccaccgatctatcaccgatctgggtttttgcaacgtgattcttgtgaaggaggagaatacccgcttccggggttggctggtacggagactgtgttatttcctatggagcctggaacagcacatccccccatgccaggacgtccctcagaagatcatggagtccacgggtgtgcagaacctgttatctggacgggtaccagggggtacgggtgaagggcaagttccagacctcgtcaagaaggaggtgcagagaattctgggacatatccaagccccacccaggcccttcctcgtgcgactgttcagctgggccctcctgagattcctcaattgcctatttttgaatgttcagctccacaaagggcaaatgaaaatggtgcagaaagcagctcaagccggactgcctttggttctcctgtcaactcataagactctgctggacggtattctgttgccatttatgctgctgtcccagggcctgggtgttttgagggtcgcatgggactccagagcatgctcccctgcccttagagcactcctccggaagcttggaggactcttccttccccctgaagcgtcattgtccttggactcttcagagggactccttgccagagcagtcgtgcaagctgttatcgagcagttgctagtctctggccaacccctgttgatttttctggaggaaccccctggtgccttgggcccaagactgtctgcactgggccaggcatgggtggggtttgtcgtgcaggcagttcaggtcggaatcgtaccggatgcactgctagtaccagtggcagtgacatacgacctggtcccggatgctccctgtgacatagaccatgctagcgctcctctaggactctggacaggcgctctggcagtgctgcgctccctatggtctaggtgggggtgttcacacagaatctgttcaagagtccacctagctcaacctttctcacttcaggaatacatcgtctctgccagatcctgttggggcggacggcagacactggagcaattattgcaacccatcgttctgggtcaatgcaccgccgtacccgacaccgaaaaagaacaagaatggactccaatcacgggcccactcttggcactgaaagaggaggaccaactgctggtgcggcgactttcctgtcatgttctaagcgcatctgtggggtccagcgctgtaatgtcaacagcaatcatggctacactactgcttttcaagcaccagaagctgctcggggaattttcatggctcactgaagagattctgttgaggggcttcgacgtggggttcagcggtcagttacgcagccttcttcagcacagcttgtctctgttgcgggcacacgtggccctgcttagaataaggcagggagacctactcgtggtcccgcagcctggaccgggtctgactcatttggcacagttgtctgccgagctgctccctgtgttcctttctgaagctgtgggcgcatgtgccgtgagaggcctactcgccggaagagtcccgcctcaaggaccttgggaactgcaggggattctcttgttgagtcaaaatgagctgtatagacagattctgttactgatgcacctcctgccccaggaccttctcctgcttaagccctgccagtcgagttattgttactgccaggaagtcctggataggcttatccagtgcggactcctggtagcagaagaaacacccggtagcaggcccgcttgtgacacagggaggcagaggttatcacggaaattgctctggaaacccagcggtgacttcaccgactctgacagcgacgacttcggagaggccgatggaagatacttcaggctctctcagcagtcccattgcccagacttttttctgtttctgtgtcgccttctttcccccctcctcaaagcattcgcacaggccgctgcatttttgcgtcaagggcaactgcctgacacagagctgggctataccgagcagctcttccagttcctgcaggctactgcacaggaggaagggattttcgagtgtgcggacccgaagctggccatctctgccgtctggacgtttagagatttaggcgttctgcaacagaccccttccccggctggacctagactccatctttcgccgacctttgcgagcctagacaatcaggaaaaactcgagcagttcattaggcaattcatatgttcttag

SEQ ID NO: 50550 - DNA, 2016 bp, Artificial Sequence
  Description of Artificial Sequence: Synthetic coding sequence
atggccactatgcttgaggggaggtgccaaacacaacctagaagctcacccagcggcagggaggcctccctgtggagcagcgggtttggtatgaagctggaagccgtaacaccatttctcggcaagtacaggccttttgtgggccgttgttgccagacttgtacacctaagtcctgggaatctcttttccaccggtctattacggacctaggattctgcaatgtaatcctggtcaaggaggaaaacacacgattccgcggttggttagtgagaagattgtgttacttcctatggtccctcgaacagcacatacccccttgtcaggatgttccacagaaaattatggaatccaccggtgttcaaaatctgctttccggaagggtaccaggtggaacaggagagggtcaggttcctgatctagtgaaaaaagaggtacaacgaatcctggggcacatccaagccccaccacgcccattccttgtccggttgttttcttgggcactgcttcggtttctgaattgcctgttcctgaacgtgcagctgcacaaggggcaaatgaagatggtccagaaagcagcccaggccggtctgccactggtcttgctgtcaactcacaagacactgctagatgggatccttctgcccttcatgctcctgagccaagggttgggtgtgcttagagtggcttgggactctcgagcttgttcaccggctctcagagcgttgctgcgcaagctcggcggtctgttcctgcctccggaagcaagtctcagtcttgatagctcggagggattgctcgcaagagctgtcgtgcaagcagttattgagcagctcctcgtgtccggacagcctcttcttattttcctggaggagccgccaggggcacttgggcctcggctgtccgcactggggcaggcctgggtggggttcgtggtgcaagccgttcaggtcgggatcgtacctgatgcattgctggttcccgtggctgtcacttatgatctggtcccggatgccccttgcgatatcgatcacgcttccgctcctctcggtttatggacgggcgcacttgcagtgctaaggtcgctgtggtcacgctggggttgtagtcaccgtatctgctccagggtgcatctagctcagccattttcgctacaagaatatatcgtgtctgctcgaagctgctgggggggtaggcaaaccctggaacaactccttcaacctatcgtgttaggtcagtgtactgctgtgcctgacaccgagaaggagcaagagtggactcccatcacgggtcctctcttagccctgaaggaagaggaccagctgctggtcagacggctgagttgccatgttctgtcggcgtccgtcggaagcagcgccgtgatgagcacagctattatggccacgctcttactgtttaagcaccagaagctcctcggagagttttcttggctgaccgaggagatattactccggggattcgatgtgggcttctccggtcagctacgatccctcttgcagcattctctgtcccttctgcgggcacatgttgctctgttacgtataaggcagggagatctgctggtcgtgccgcagcctggacccggtttaacccacctcgcccagctgtctgcggagctgctgcctgtgtttctatccgaagccgtcggggcatgcgctgtgagggggctccttgctgggagggtgcctcctcaaggtccttgggagttgcagggtatactgctactttctcagaatgaactgtatcgccagatccttctcttgatgcatctgctgccacaagacctgctgctgctgaagccctgccagtctagctattgctactgtcaggaggttctggacagattgattcaatgcggcctcctcgtggctgaagaatcttgggccacacagagttcttgctcaagctcgtgtcggccaccgcctcgtaagaaaggatcgagctcggtgaggacccagtctagtccctctgtcctgagcggccctagcgagacctag

SEQ ID NO: 50551 - DNA, 2388 bp, Artificial Sequence
  Description of Artificial Sequence: Synthetic coding sequence
atggccaccatgctcgagggacgatgccagactcaaccacggtcttcccctagcggccgagaggccagtctctggagctctggctttggcatgaagttagaggcggtgaccccattcttgggcaaatataggccgttcgttggacgctgttgtcagacgtgtacccccaagagctgggaatcgctgtttcatcggtccataaccgatttgggcttttgcaatgttatcctggtgaaagaggaaaacactaggttcaggggatggcttgtgcggcgtctctgttacttcttgtggtcattagagcaacatatccccccatgtcaagacgtgccccagaaaattatggagagtaccggagtacagaaccttctgagtggcagagtaccgggagggacaggagaagggcaggtgcccgacctagtaaaaaaagaagtgcaacgcatcttagggcacattcaggcacccccacgccctttcctggtaaggctattcagttgggcgctgctgcgattccttaattgcctgttcctgaacgtgcagctccacaaagggcaaatgaagatggtacagaaagccgctcaagcaggacttccactcgtactgctatctacacacaagacactcctggatgggatcctcctgccatttatgctcctgtcacagggcctgggtgtgctgagggtggcatgggatagtcgtgcatgttctcctgcgctccgagccctgctgagaaaattggggggattgttcttacccccagaggcctcgctgagcctcgactcatcggaggggttgctggcaagggccgtcgtgcaagctgtgattgagcagttgctggtgtctggtcagcctctgctgatttttcttgaagagcctcccggtgctctgggaccacggctgtcagcactgggccaagcatgggtaggctttgtcgtacaggcagtgcaggtagggatagtgccagacgccctgctggtgcctgttgccgtgacatatgatctcgtacccgacgctccatgcgacatcgatcatgcctccgctccactcgggctgtggacaggcgctctggccgtactgcgctccctttggagccgatgggggtgcagtcatagaatttgcagtagagtgcatctggctcagccctttagtctgcaggaatacatcgtgtctgcccgttcatgctggggcggaagacagactctggagcagcttttacagccaattgtgctaggccagtgcacagctgtgcctgacaccgagaaggagcaagaatggacgcctatcacgggacccttactggctctcaaagaggaagaccagctgctcgtgaggcggctgtcgtgccacgtgctatccgccagcgtcggctcctcagctgtgatgtctacagcgatcatggcaacactgcttctattcaagcaccaaaagttgctcggggaatttagctggctgaccgaggagattctactgaggggcttcgatgttggcttcagcgggcagctgcggagcctcctgcagcattctctgagcttgctgagggcgcacgtggctctgctcagaatacgccagggggatctcctggtcgtgccgcagccgggacctggtctaactcatttggcacagctttccgctgagctcctacctgtcttccttagcgaagctgtgggagcttgcgccgtccgagggctgcttgctggcagggtacctcctcagggcccttgggagcttcaaggcatcttgctcctatcgcagaatgagctgtatagacagattctacttttaatgcatctcctcccccaggacctgctgctcttaaagccatgtcaatctagttactgctattgtcaggaagttttagatcgactgattcaatgtggtctgctcgtagcggaagagacccctggcagtcgtcctgcatgtgacactggcaggcagcgtttaagtagaaaactgctgtggaaaccctctggggatttcacagacagcgattctgatgattttggcgaggctgatggtcgctactttagactgagccagcagagccactgcccggactttttcttattcctctgtaggctcctgagccctttgcttaaagcttttgcccaggctgctgctttcctgcgccagggtcaacttcccgataccgagcttgggtatactgagcagcttttccaatttcttcaggccacggcgcaggaggagggtatctttgagtgcgcggatcctaagcttgcaatcagcgcggtttggacttttcgagacctcggcgttttgcagcagacaccgtcccccgctgggccacgactccatcttagtccgaccttcgcttccctcgataaccaggagaagctagagcagttcattcggcagtttatttgctcctag

SEQ ID NO: 50552 - DNA, 483 bp, Artificial Sequence
  Description of Artificial Sequence: Synthetic coding sequence
atggcaaccatgttggagggcagatgccagacgcagccaaggagtagtcccagtgggcgtgaagcctcgctctggtcctccggatttggaatgaagctcgaagcagtgaccccgtttctgggcaagtatcggccatttgttggcagatgctgtcagacctgtactcctaaatcatgggagtccttgtttcatcggagcattacagacctaggcttttgcaatgtcatactagtcaaggaggagaacactcggttcaggggctggctggtgcgacggctctgctactttctctggtccctggagcaacacatacccccttgccaagacgtcccccagaagatcatggaaagtaccggggtccagaatttactctccggacgggtgccaggcggaacgggagagggtcaagtcccggatctcgtcaaaaaggaagtgcagcggatacttggacatatacaggccccacctcgccctttcttgtag

SEQ ID NO: 50553 - DNA, 2487 bp, Artificial Sequence
  Description of Artificial Sequence: Synthetic coding sequence
atggacgagtctgcccttactctagggacaatcgacgtgtcttacctgccacattccagcgaatacagtgtggggcgatgtaaacatacttctgaggagtggggagagtgtggcttcagaccgacaatttttaggagtgcaactctcaagtggaaagagagtcttatgtccagaaaacgacctttcgttggaaggtgttgctacagctgtacccctcagtcatgggacaaattttttaatccgagcattccatccttaggtctgcgcaacgtgatctatattaatgagacgcacactcgccacagaggatggctggctagaagactttcgtacgtgctcttcattcaggagcgtgacgtgcacaaaggcatgttcgcaactaacgtcactgagaacgtgctgaactcgtcccgcgttcaagaggctatcgctgaggttgcagcagaactcaacccagacggctccgctcaacagcagtccaaagccgtgaataaggtcaagaagaaagctaagaggattttacaggaaatggtagcaaccgtaagccctgccatgatacggttgacaggatgggtgctcctgaaactgttcaattccttcttctggaacatccagatccacaagggccagctggagatggttaaagctgccactgagactaatctgcccctgctgtttctgcctgtccacagatcacacatagactatcttctgcttaccttcattctgttttgccacaacattaaagcaccttacatagccagcgggaacaatctcaatatccctatcttttctaccctgatccacaaactcgggggattcttcatacggcgaaggttggatgaaactccggacggaagaaaagatgtactgtaccgcgcacttctgcatggccacatcgttgaactgctccggcagcagcagttcctggagatctttctcgagggcactagaagtcgctccgggaagaccagttgtgctagggcaggactgctgtccgtggtcgtagacacacttagcaccaacgtcatacccgatatacttattatccctgtgggcatctcatatgaccgcatcatagagggacactacaacggagaacagctggggaaacccaagaaaaacgaaagcctgtggtctgtggccaggggggtgatacgcatgctgcggaagaactatggatgtgtgagggttgacttcgcccagccatttagcctgaaagagtacttagagtcccagtctcagaaaccagtgtcagcactcttatcgttggagcaggcactgctcccagctatcctcccctcgagaccgagtgacgctgctgacgagggcagggatacaagtattaatgaatccaggaacgcaacagatgaaagcctccggagaagactcatcgcaaacctggccgagcatattttgttcaccgcatccaaaagctgcgctatcatgtccactcacattgttgcctgtcttttactgtaccggcatcggcagggaatagacctatcgacactggtggaagactttttcgtgatgaaggaggaagtgctggccagagatttcgacctgggcttcagcggtaatagtgaagatgttgttatgcacgctattcagttattaggcaactgtgttacaattacacacacctcacgcaacgacgagttcttcataacaccatctacaacagtgccctctgtgttcgaactaaacttctactccaatggcgtactgcacgtctttattatggaggccattatagcctgctcactttatgctgtgctcaacaagaggggtctgggagggcctacgtcaacacccccaaacctaatttcccaagaacagctggtgcgaaaggctgcatccctttgttatttactctcgaatgaaggaacaattagtttaccatgccaaacattctatcaggtgtgccatgagacagttgggaaatttatccaatatgggattcttactgtggccgagcacgacgatcaggaagatatctcaccatcccttgccgaacaacaatgggacaagaagctccctgaacccctctcctggagatccgacgaggaggacgaagactccgattttggcgaggagcaacgggattgctacctgaaagtgtcacagagcaaagagcatcagcagttcatcacgttcctacagagactcctgggcccattgctcgaagcttacagtagtgctgccatcttcgtacacaatttctcagggccagtgccggagccggaatatctgcagaaactgcacaagtaccttattacccgtactgagaggaacgtagctgtgtacgccgagtctgcgacctactgtctggtgaagaatgccgtgaagatgtttaaggacataggtgttttcaaggagaccaaacagaagcgcgtgagtgtccttgagcttagttcaactttcctcccccagtgtaaccgccagaagctgcttgaatacatcctgagcttcgtggttctctag

SEQ ID NO: 50554 - DNA, 2133 bp, Artificial Sequence
  Description of Artificial Sequence: Synthetic coding sequence
atggatgaaagtgcccttacactgggcaccatcgatgtaagctacctgccacactcttcagaatactctgtggggcgatgtaaacatacaagcgaggaatggggagagtgcgggtttaggcctacgattttcagatcagccacgctcaagtggaaagagtctctcatgtctcgcaagcggccattcgttggccgatgttgctacagctgcacgccccagagttgggataagtttttcaatcccagtatcccatccttggggctcagaaatgttatctatattaacgaaactcacacaaggcacaggggttggctggcaagaaggctctcctatgtcctctttatccaggaacgggacgtgcataaggggatgttcgctacgaacgtgacggagaacgtgctgaatagttcgcgtgtacaggaggctatcgccgaagtggcggcagagctgaatcccgatggctcagctcagcagcaatccaaggccgttaacaaagtgaaaaagaaggccaaacgcattcttcaagaaatggtcgctaccgtgtcccctgcaatgatccgactgaccggatgggtcctgcttaagctcttcaacagttttttctggaacattcaaatccataaagggcagcttgagatggttaaggccgcaaccgagacgaacctgcccctgctttttctcccagttcaccgatcacatatcgattatctgttactgacctttatactgttttgccataacatcaaggctccctacattgcctccggcaacaatcttaatatacccattttttccaccttgattcataagcttggaggcttcttcatcaggagaaggctggacgagaccccagatggccgaaaagatgtgctatatcgtgcgttattgcacggacatatcgtcgaattactgaggcagcagcaatttcttgaaatatttttagagggtacgagaagcaggtccggcaagacttcatgcgccagggccggtcttctatctgtggtggtggatactctgagcaccaacgtaatacccgacatactcatcatccccgtcgggataagttacgaccgcattattgaggggcattacaatggcgaacagctcggaaagccaaagaagaatgaatccttatggtcagtggctaggggcgtgatcagaatgctgcgaaagaactacggatgtgtgcgtgtggatttcgctcagcctttctcattgaaggaatatctagagagccaatcccagaagcctgtatctgccctgctttcccttgagcaggctttactgcctgcaattcttccttcacggccaagtgatgccgctgatgaaggacgggatactagcataaacgagtcgcggaatgctaccgatgagtcactgcggcgacggttaatcgcaaatctcgcagagcacattctattcaccgcctcaaagtcatgcgcaataatgtctacacacatcgtagcttgcctcctcctctacagacataggcagggcatagacctctccacactggtggaggactttttcgtgatgaaggaggaggtcctggccagggattttgacttgggtttttccgggaactctgaggatgtggtaatgcatgccatccagttgctcggcaactgcgtaaccattacacatacaagccggaacgacgaattcttcatcacaccttcaactacggtgcctagcgtgtttgaattaaacttctattctaatggcgtgctgcatgtttttattatggaagccattattgcgtgcagtctttacgctgtgctgaataaaagaggcctcggaggacccacctcgactcccccaaacctaatcagccaggaacagctggttagaaaggcagcttcgctgtgctacctgctgtccaatgaaggaactatcagtctgccttgtcagaccttttatcaggtttgccacgagactgttggaaaattcatccagtacggaatcctgacagtcgccgagcacgatgaccaggaagatatttctccctccctagcagagcagcagtgggataaaaagctacctgagccattgagctggcgctcggatgaggaggatgaagacagtgactttggggaggaacaacgcgactgctacctcaaggtgctcggctag

SEQ ID NO: 50555 - DNA, 2487 bp, Artificial Sequence
  Description of Artificial Sequence: Synthetic coding sequence
atggacgagtccgcactgactctgggcacaatcgacgtctcttatctacctcactcctctgaatacagtgtcggcagatgcaaacatacttccgaggaatggggggagtgtggatttagacctactattttcagatcagccaccctgaagtggaaagagtcacttatgagccggaaacgcccattcgtcgggcgttgctgctattcctgcaccccccaatcctgggataagttttttaatccttcaatcccctccctgggattacggaacgtgatatacattaatgagacccatacaagacatcggggttggctggctcgcaggctgtcatacgtcctgtttatccaggaacgtgatgtgcacaaaggaatgtttgctactaacgtgaccgagaacgtgcttaatagctcccgcgtccaagaggccattgcagaggtcgctgcagagctgaacccagacggaagtgcccagcagcaatccaaggcagtgaataaggtaaagaaaaaggccaaaaggatactgcaggagatggtcgcaaccgtgagtccagccatgataagattgactgggtgggtgttactgaagttatttaactccttcttctggaatattcaaattcacaagggacagttggaaatggtgaaggcagccaccgagacaaatctgcctttactctttctccctgtgcataggagccatatcgactacctccttcttaccttcattcttttttgccacaatatcaaggcgccatatatcgcttctggcaataacctgaatatccccatcttcagcacgctgatccacaaattaggcggtttctttatccgaaggaggctggatgagactcccgatgggaggaaggatgtgttgtacagagcacttctgcacggtcacattgtggagcttctgagacagcagcagttcttggaaatttttctggagggcaccaggtcacggtccggcaagaccagctgtgcacgtgctggattactgtcagtggttgttgacacattgtctacaaacgtgatcccggacattctaattattcccgtgggtataagctacgatcgtatcatcgaagggcattacaacggagaacagcttggcaaaccaaagaagaacgagagcctctggtctgtcgctcggggagtaattagaatgctaaggaagaattacggctgtgtcagagttgactttgctcagccgttcagtctgaaagaatatctggagtcgcaaagccaaaagcccgtttccgcgctcctgtccctggagcaggcactgctcccagctattctgccatcccgtccctcagatgcagccgacgagggcagagacacatcaattaacgagtcacggaatgctacggatgaaagtctgagacgccgtctcatcgcgaaccttgctgaacatattctcttcaccgcgagcaaaagctgtgccataatgtctacccacatcgtggcatgtctcctcctctataggcacaggcaagggatagacctgtctacgctggtggaggatttctttgtaatgaaagaggaggtgcttgctcgtgattttgacctgggcttctcaggcaactctgaggatgtggttatgcacgccatccaactgcttggaaattgcgtgaccattactcacacctcaaggaacgacgagtttttcattaccccgtccactacagtaccctctgtgttcgagctgaatttttactctaacggagtgctacatgtctttattatggaagccatcatagcgtgttcactttatgcggttttaaataagaggggattgggaggtcctaccagtacgccacccaatctgattagtcaggaacagctcgtcaggaaggctgcttccctttgctacttactgtctaatgagggcactatttcactgccctgccagacattttatcaggtgtgtcacgagactgtgggtaaattcattcagtacggtatcctcactgttgctgaacacgatgatcaggaagatattagcccaagcctggcggagcagcaatgggacaagaaattgcccgagcctctctcctggcggagcgacgaggaagatgaggacagtgatttcggcgaagaacagcgcgattgctacttaaaagtctctcagagtaaggaacaccagcagtttattacgttcttgcagcgtctgctagggcctcttcttgaggcctatagcagtgcagccattttcgtacataactttagtggccctgtcccagaacccgagtacctgcagaaactgcacaagtacctcataactagaaccgagcgcaacgtcgcggtgtacgccgaatctgccacatactgtcttgtgaaaaatgccgtgaagatgttcaaagacatcggagtgttcaaggagaccaaacagaaacgcgtgtctgtcctcgaactgtcatctaccttcctaccccagtgtaataggcagaaacttctcgaatatatcctcagctttgttgtcctgtag

SEQ ID NO: 50556 - DNA, 945 bp, Artificial Sequence
  Description of Artificial Sequence: Synthetic coding sequence
atgagcagtaccgctgccttctacctgttgtccaccttaggagggtacttagtcacaagttttctgctgctcaaatacccaaccctcctccaccagaggaaaaaacaaaggttcctgtctaagcacatcagccacagagggggagcaggtgaaaacctggaaaacacaatggctgctttccaacatgccgttaagataggcacagatatgctcgaactggattgccatattaccaaggacgagcaagtcgtggttagccatgatgaaaacttaaaacgagctacgggggttaatgttaatatttctgacctgaagtactgcgaactacctccatatctgggtaagttagacgtcagttttcagcgggcttgtcagtgtgaaggcaaagacaatcgcatcccactgctgaaagaagtcttcgaagccttccccaatacacctatcaatatcgacataaaggtgaataataacgtgttaatcaaaaaggtctccgagctggtgaagcgctacaatcgggagcacctgacggtgtggggcaacgcaaactacgaaatcgtagagaaatgctataaggaaaattctgatatccctattctattcagcctccaaagggtgcttctgattctcggattgtttttcaccggcctcctgccattcgtacccattcgcgagcagttcttcgagatcccaatgccaagtattatactgaagctgaaggaaccccataccatgtccagatcccagaagttcctgatttggttgtccgatctgttgctgatgcgaaaggccctcttcgaccatctgacagccagagggattcaggtttatatttgggttctgaatgaggagcaggaatacaaaagggcttttgatctgggagctaccggtgtgatgaccgactatcctactaagctccgtgatttcctgcacaattttagtgcgtag

SEQ ID NO: 50557 - DNA, 870 bp, Artificial Sequence
  Description of Artificial Sequence: Synthetic coding sequence
atgagctctaccgcggcattttatctcctgtctacactcggcggttacctcgtgacaagcttcctgctcttgaagtatccaacactgttgcaccagaggaaaaaacagagatttctgagtaaacacatcagccaccggggaggtgctggagagaatctggaaaataccatggctgcgttccaacatgccgtcaagataggaactgatatgttagaactcgactgccacatcacgaaggacgagcaagtagtggtttcccacgacgaaaacctgaagcgcgctaccggggtaaatgtgaatatcagtgatctgaagtattgcgagctgcccccatatttgggcaaactagatgtcagcttccagagagcctgccaatgtgaaggcaaagataacaggatccccctactcaaggaggtcttcgaggcattcccaaatactcccatcaatatagacataaaggtcaacaataatgtgctcatcaaaaaagtgtctgaactagtgaagcgctacaaccgggagcaccttactgtttggggcaatgctaactatgagatcgtggagaagtgttacaaagagaactctgacatccctattttgttcagcctgcagcgcgtgttgctcattctagggcttttctttaccggtttgctgcccttcgtgccaataagggagcagttctttgagatccctatgccctcaataatcctcaagctaaaagagccgcacaccatgtcccgcagccagaagttcctgatatggctgtctgatttattgcttatgcggaaggcgttgttcgagcccctgcatcccgcatctaagcggaatttcgaggggcattgctcttatctcgtcgtgtcctgttacttctag

SEQ ID NO: 50558 - DNA, 873 bp, Artificial Sequence
  Description of Artificial Sequence: Synthetic coding sequence
atgtctagcacggcggcattttacctgctcagtactctgggtggatatctggtgacctctttcctgctgcttaagtatccaacactattacaccagcggaagaagcagagatttctctcaaaacatattagtcatcgtggaggtgccggtgagaatctggagaataccatggctgcatttcagcacgcggtgaaaattgggaccgacatgctcgagctggactgtcacatcacgaaggatgagcaggtggtggtaagtcatgacgaaaatctgaaaagagccaccggggtcaacgtaaatatctccgaccttaagtattgcgagttaccaccgtatctagggaagctggatgtctcattccaaagagcttgtcagtgtgaggggaaggacaatcgtatccctctgctgaaggaggtttttgaagcattccctaacacgccaattaatatcgacattaaagtgaacaataacgtgctaattaagaaggtctcagagctagtcaaacgatataacagagagcaccttaccgtgtgggggaacgcaaactatgagatcgtggagaagtgttacaaagaaaatagcgacatacccatcctcttttcactgcagagagtgcttctgatccttggattattttttactggcttactcccatttgtccctatcagggagcagttttttgaaatccctatgccatctataatcctgaagttaaaggagcctcacactatgtcccggtcacagaaattcctgatctggctgtccgacttacttctgatgagaaaggcgctcttcgaccatctgacggcacggggaattcaggtgtcgttttggaacgatgccttttggaagcagcactcatcgccagtgtag

SEQ ID NO: 50559 - DNA, 1620 bp, Artificial Sequence
  Description of Artificial Sequence: Synthetic coding sequence
atggctgagagccccggatgttgctctgtttgggccaggtgcttgcactgcttgtacagctgccactggcgaaaatgccccagagaacggatgcaaacttctaagtgtgattgcatctggtttggactgctttttttaacttttctactgagcctgagctggctgtatatcggattggtgctcttgaacgatctgcacaacttcaacgagttcctgtttcgtcggtggggccactggatggattggagtctagctttcctgctagtgatctctctacttgtaacatacgcatccctcctgctcgtactcgcattgctgctcaggctgtgccggcaaccactccacctgcactcattgcataaggtgctcttattactgatcatgctgctggttgcagccggactcgtcggactggatattcaatggcagcaggagtggcattctctccgggtatccctacaagctaccgccccatttttgcatatcggcgcagccgcaggcatcgctctgctggcctggcctgtggccgatactttctaccgcattcaccgaagaggtcctaagattctgctgctcctcctattttttggcgtcgtcctggtgatctatttggctccactttgtatctcatcgccatgtatcatggagcccagagatttgccccctaagcctggacttgttggacatcggggtgcaccaatgctggctcctgaaaatacgctgatgtcccttagaaagacggctgagtgtggggctaccgtgtttgaaacggacgtaatggtgtcatctgacggagtgccattcctcatgcacgacgaacatctctctagaaccactaatgtggcctcagtgttccccacacgtattaccgcacactcgagcgacttttcctggaccgagctgaaacggttaaatgccggttcctggttcctggagagaaggcccttctggggcgctaaaccattggctggacctgaccagaaagaagcagagtcccagacagtacccgcactcgaggagctcttggaggaagccgcagctctcaatctgagtataatgttcgatctcagaagacccccacaaaatcatacgtattacgatacatttgtcatccagaccctggagacggtgctaaacgctcgtgtgcctcaagctatggtcttctggctgccagacgaggaccgggctaacgtgcagagaagagcgcctggaatgaggcagatctatggcagacagggcggtaatcggaccgagagacctcaattcctgaatcttccctatcaagacttacccctgttggatattaaagccctgcacaaagacaacgtgagtgttaacctttttgtagtgaacaagccatggcttttttccctactgtggtgcgccggagtggacagcgtgaccacgaacgactgtcagctgttacagcaaatgagatatccaatttggctgataaccccccagacctatcttatcatatgggttatcacgaactgcgtgtctactatgctcctgctctggacgttcctcctgcagagacggtttgtgaaaaagaggggcaaaaccggcctggaaacggctgtgctactgacccgaattaacaatttcatgatggagtag

SEQ ID NO: 50560 - DNA, 1773 bp, Artificial Sequence
  Description of Artificial Sequence: Synthetic coding sequence
atggccgaatcccccggatgctgttcagtgtgggccaggtgtctgcactgcctctattcttgccactggcgcaagtgtccacgcgaaaggatgcagacaagtaaatgtgattgcatctggttcggattgctcttcctgacattcctgctgtcgctgtcttggctctacataggtctggtgctgttgaatgatctgcataacttcaacgagttcctcttcagacgctggggccattggatggactggtcactggcattcctcctcgtaatttcgctcctcgttacttatgcttccttgttgctggtcctcgccctcttactacgcctctgtcgtcagcctctgcatttgcattcacttcacaaagtgctgcttttgcttatcatgctgctggtggccgctggtctggtagggctggatattcagtggcagcaggagtggcacagcttacgggtctcgctgcaggctacagcgccttttctgcatattggagccgcagcgggaatcgcgctgttggcgtggcctgtcgctgacaccttttatcgcatccacagaagaggacccaaaattttgcttctgctgctgtttttcggcgtcgtgctcgtgatctatctcgctccgttgtgcatttcgagtccttgcatcatggaacccagggacctcccacccaagcctggactggtgggacataggggcgcacctatgttggcacccgagaacacacttatgtccctcaggaaaacggccgaatgcggtgccactgtgttcgagaccgacgttatggtgagctctgatggtgtgccattcctgatgcacgacgaacacctatcacggacaacgaatgtcgccagcgtattccccaccagaattaccgcgcattcttcggattttagttggaccgagctgaagagactgaacgccggtagttggttcctcgagaggcgccctttctggggagcaaagcctctcgcgggtccagaccaaaaagaggcagagtcacaaacagtacctgcattggaagagcttctggaggaagctgccgcactcaatctgagtatcatgtttgatctgagaagacctccgcagaatcatacatactacgatacgttcgtcatacagacactggagacggtgctgaacgccagagtgccacaggcgatggtgttttggctgccagacgaggaccgcgctaatgtccaacgccgagcaccagggatgaggcagatctatggcaggcaggggggaaatagaacggagcgaccacagttcctgaatctgccctatcaggatttgccactgctggatatcaaggaccggttcctccttcctgcgcaagccggactgaaactcctggcatcctcaaatctcccagcctcggcctctcagagtgccggaattacaggtctctcacattgtcctccacagccacccggttacaaacacgagctctctcacctcgcgatggccttacataaggacaatgtatcagtaaatttgttcgttgtaaataagccttggttattttctctattgtggtgcgcaggagtcgactctgtcactaccaatgactgccaacttctgcaacagatgcggtaccccatctggcttataacaccccaaacatacctgatcatttgggtgattacaaattgtgtaagtactatgctgctgctgtggacctttctcctgcagcggagattcgtgaaaaagcgcggaaaaactggactcgagacagctgtgttactgactcgcatcaacaacttcatgatggaatag

SEQ ID NO: 50561 - DNA, 1383 bp, Artificial Sequence
  Description of Artificial Sequence: Synthetic coding sequence
atggactggagcctggccttccttctggtcatatcccttctggtgacctacgcctctcttctcttggtcttagctctcctcctgcgattatgcaggcaacctcttcacttgcactccctccacaaggtgctactgctgcttatcatgctcctcgtggccgctgggctggtcggcctcgatatccaatggcaacaggagtggcattccctacgagtctctctgcaggcgacggccccatttctgcacattggcgcagccgctgggatcgctctcctggcctggcctgttgctgacacgttttaccgtatccacaggcgaggacccaagattctgttactattactcttttttggagtggtgttagtaatttatctggctccattgtgcatcagctccccctgcataatggagccacgggatctgcctcccaaaccgggactggtgggccaccgcggagcgcctatgttggcgcctgaaaacacactgatgtccttgcgaaaaaccgctgagtgcggcgcaaccgtgtttgagaccgacgtgatggtgtcaagtgatggtgtccctttcctcatgcacgatgaacacctgtcacggactaccaatgtggcatctgtctttccaactagaattactgcacattctagcgacttctcctggactgaactgaagcgtctgaatgccggaagctggttcctggagcgtaggccattttggggagccaagcccttggctggtccggatcagaaggaagctgagagccagaccgttccggctctggaggaactgcttgaggaggccgcagccctgaatctgtcgattatgttcgacttgcgtcgcccaccccagaatcacacctactacgataccttcgttattcagacattggagaccgtgctaaatgccagagtccctcaggctatggtgttctggctgcccgacgaagacagggccaatgttcaaagaagggctccagggatgcggcagatttacgggaggcagggtggcaaccggactgaaagaccgcagtttcttaacctgccgtaccaggacttgcccctgctggacatcaaggcccttcataaggataatgtgtcggtcaatctgttcgtcgtcaacaaaccatggcttttttcgcttctctggtgcgctggcgtggactccgttaccaccaatgattgtcagcttcttcagcagatgcgctacccgatatggctgatcacccctcagacatatcttattatttgggttatcaccaactgtgtgagcacaatgctcctgctgtggacttttttacttcaaagaaggttcgtaaaaaagcgcggaaaaaccgggctggagacggcagtgctactgacgcggattaacaatttcatgatggagtag

SEQ ID NO: 50562 - DNA, 1383 bp, Artificial Sequence
  Description of Artificial Sequence: Synthetic coding sequence
atggactggagtctcgccttcctgctcgtgatcagtctgctcgtcacttatgctagtctactcctggtactcgccctgctgttacggttgtgccggcagcctctgcatctccattcactgcacaaggtgctactgctgctcatcatgctgctggtggccgctggtctggtgggcctggacatccagtggcaacaggaatggcacagtcttagagtttcacttcaggctactgctccattcctgcatatcggagcagctgccggtatagctctcctggcatggcctgtggctgatactttttaccgcatacaccgaaggggcccaaaaatcctcttgctgttgctgtttttcggtgtggtgttagtgatctatttagcaccgttatgcatatcgtccccttgtatcatggaacccagagaccttcccccaaagccaggcctcgtcgggcaccgcggtgcgcctatgttggcgccagagaacacccttatgtctctgagaaaaacggctgagtgcggggcaacggtattcgagaccgatgtgatggtgtccagcgacggagtgcccttcctgatgcatgatgaacacttgagtaggaccaccaacgtggcttccgtgttccccacaaggataaccgcccacagctcagacttcagctggaccgagctcaagagactcaacgccggatcttggtttctcgagagaaggcccttttggggagctaaaccgctcgcagggccagatcagaaagaagccgaatcgcagactgtgcccgctctggaggagctcctggaggaagccgctgccttgaatctgtcgattatgttcgacctgcggagaccccctcaaaaccatacctactacgacaccttcgtaattcagaccttagagacagtcctaaacgcccgagtcccccaggcaatggtgttctggctgcccgatgaagatcgggcaaatgtgcagaggagggcgcctggaatgcgacaaatctatggcaggcagggcggaaaccgcaccgaaagaccacagtttctcaacctcccttatcaggacctccccttattagacatcaaggccctccacaaggacaacgtgagtgtcaatcttttcgttgttaataaaccatggctgttttctctcctgtggtgtgcaggtgtggactcagtaactaccaacgattgtcaattactacagcagatgaggtaccccatctggctgattactccacagacctacctgatcatctgggtaattacaaactgtgtttcaaccatgttacttctgtggacattcctccttcagaggaggtttgtgaagaaaagaggcaagaccggcctggagactgctgttctcctcacccggattaacaactttatgatggaatag

SEQ ID NO: 50563 - DNA, 771 bp, Artificial Sequence
  Description of Artificial Sequence: Synthetic coding sequence
atggcacagcggtccgatctcctcgaacttgattgtcaactgacccgggatcgggtggtggtcgtcagccatgatgaaaatttatgtcggcaaagcgggttgaatagggatgtcgggtcactggatttcgaggatctgccactgtataaagagaaactggaagtttacttctcacctggacacttcgcccacgggtcggatcgtagaatggttcgacttgaagatctatttcagaggttcccaaggacaccaatgagtgtggagatcaaaggcaagaatgaagagctcatccgagagattgctggcttagttaggcgctatgatcgaaatgagatcacaatctgggcctccgagaagagctcagtcatgaaaaaatgcaaagcggctaacccagaaatgcctctatcctttactatcagtcgtggcttttgggtccttttatcctattacctcggcctgctcccattcatcccaattccggagaaatttttcttttgtttccttccaaacatcataaacaggacctacttcccattctcctgtagctgtctgaatcaacttctggcagtggtttccaaatggctgataatgaggaagtccttaatccgtcatcttgaagagcgtggcgtgcaggtggtgttttggtgtctgaacgaagagtccgacttcgaggccgcattcagcgtaggtgctactggtgtcataactgattacccaaccgccctgcgacactaccttgataatcatggaccggctgcgagaacttcttag

SEQ ID NO: 50564 - DNA, 957 bp, Artificial Sequence
  Description of Artificial Sequence: Synthetic coding sequence
atgtccctcctgctgtattacgccctccccgctctcggctcttacgcaatgctttcaatctttttcctcaggaggccacacctgctgcatacgccgcgagcaccgacgttccgtattaggctgggagcgcacaggggtggtagtggcgaactgctagagaacactatggaggctatggagaatagtatggcgcagcggtctgacctcttagagctcgattgtcagctgacacgggaccgggtggtggtcgtctcgcacgacgagaacctgtgtagacaatccgggctaaaccgggatgttggctcgctggacttcgaggatctgccattatacaaggaaaagctggaagtgtacttctctcctgggcactttgcacacgggagtgatagacggatggtgcggctggaagatctctttcagagatttccacgcacgcctatgtcggtcgaaataaaaggtaagaatgaagagctcattcgggaaattgcagggctcgtccggagatacgaccgcaatgaaattacgatttgggcctccgaaaagtcgtcagtcatgaagaaatgtaaagctgccaaccccgagatgccactttctttcacgatttcccgaggattctgggtgctcttatcctactatctggggctcttgccgttcattcccatacccgaaaagttctttttttgcttcctgcctaatattattaataggacctatttccccttctcatgttcatgtcttaatcagctcttagcagtcgtctccaagtggcttattatgagaaagagccttataagacatctggaggagcgaggagtgcaggtggtgttttggtgtctcaacgaggaaagtgattttgaggccgcattctcagtgggtgccaccggcgtcatcacagattacccaactgcgctgcggcattatttagacaaccacggtcctgcggctcgtacatcctag

SEQ ID NO: 50565 - DNA, 1563 bp, Artificial Sequence
  Description of Artificial Sequence: Synthetic coding sequence
atgctcctatttttgtggatcgaaaccagtagcgaatactttaactttgattgggttacctttctggggacgggctactggtttttctggtctatctttattctgtctctagccagaattctaaccgcttactcctctcttcttctcctcctgggattcctcctcctgtgggagcgtatcgagctgtacctccacttgtgccataaaatcctgatactcctggtaatactgctttgcgtgattctcatgtttataatctgtaagttctggaaagagcgctggctggtggccggtctgtctatgcagatttttgcaccatacgttcatcttgtatcaattactgttatggtgattctcttctggccagtggcattttatgtggcctgtctggaaagggaagtgcgtatgcggagatatcgcatgacacacagcgagaaaaagagattaaaacagtgtaacgtgatcacacggcttcgcggtcttcaggtcccggtcggcctgccctttctgctgattctcttgggcctgtacctaatgcctttggggatatacagtccatgtatacaggagaaagagaaccttggccctaagcccaccatttttggacaccgtggtgccccaatgctaggcccagaaaacactatgatgagttttgagaaggcggtcgaacacggcgctcacggcctggaaactgatatacacctgtcatatgaccatgtaccattcttgatgcacgactttgatctaaaaagaacaaccaacatcggcgaagtacaaccagagtctgcctgcgagaaccctgcgttcttcaactgggactttctatcaactcttaatgcaggtaagtggttcgtgaagcctgagttacggcctttctacaatatgaagcctttatcagaggcagataaagagagggcacggaaccagtccatccccaccctggctgacctcctgacactcgctgaaaaggagaggaaattcgtcatttttgatctccaccgcccaccaccaaaacacccactgcgacacacatttgttaggcaagtggtttctgtgatcctggctagcaaaatagaacaacatctcatcttctggctacctgcgcatgacaggcagtacgtgcggtccgtggctcccggattccagcatgtgggaagactggttagtattgagaccctagccaagaacaatatctcaatcattaatgtcgattataagaagctgtttccgaacgggttgcgcgactataaggccgcaaacatccacatcaatgtctacacagtcaacgaaccctggctgttttctttggcttggtgcagtaggatcaactctgtgaccactgataatatcgggctgttatctcagctggaccacccgcattttttcatgaccccaaaattctacgttttcatgtggctcctggctgacattatctctgtgcttttcatcgtcgctatattttgcttccactggaggcgcgaaaccgaaaaggagaaactgtttgagacatctagcacgcgaaccgacactcagtccggctccaaaaacgaagaggacaggtag

SEQ ID NO: 50566 - DNA, 1872 bp, Artificial Sequence
  Description of Artificial Sequence: Synthetic coding sequence
atgttgctattcctctggatcgaaacttcttcagagtatttcaactttgattgggtcaccttcctggggacgggctattggtttttttggagcattttcattctgtctctcgctaggattctcaccgcctattcgagcctgttgttgcttctgggcttccttctgctgtgggagagaattgaactgtatctgcatctgtgccacaaaatactaatcctgctggtgattttactgtgtgtgatcctgatgtttataatttgcaagttctggaaagagcgctggctggtcgccggtctcagcatgcaaatattcgcgccttacgtgcaccttgtgagcatcaccgtgatggtgatactcttttggcctgtggcgttttacgttgcctgtttggaacgcgaggtgcgcatgaggcggtataggatgactcacagcgagaaaaagcgacttaaacagtgcaacgttatcacacgattgcggggtctgcaggtgcccgtgggcctaccatttctgctcatacttctgggcctgtacttgatgcctcttgggatttattcaccctgtattcaggaaaaggaaaacctgggcccaaaacctactattttcggacataggggcgcaccgatgctcggcccagagaacactatgatgagcttcgagaaagctgtggagcacggcgctcatggactggagactgacattcacctctcctatgatcatgtgccgtttctcatgcatgattttgacctgaaaagaacaacaaatatcggggaagtgcagcccgagtcggcctgtgagaacccggctttttttaactgggacttcctgagtactctgaacgccggtaaatggtttgtgaaacctgagttgaggcctttttataacatgaagcctttgtccgaagctgataaagaacgtgcgcgaaatcagtccatacccacgctggctgacctgctgaccttggcggaaaaggaaaggaagtttgtaatcttcgacctgcatcgcccacctccaaagcatcccctgagacacacgtttgtgcgccaggttgttagcgtgatccttgcctctaaaatagagcagcatttgatcttttggctgccagcacatgaccgacagtatgtacgttcggttgcaccaggcttccagcacgtgggacggctggttagcatcgaaaccctggctaaaaataacattagcataatcaacgttgattataagaagctgttcccaaacggactccgagactataaagcagcaaatatacacattaacgtgtatactgttaatgaaccatggctattctcactggcctggtgttcccggatcaacagcgtgaccactgacaacataggactcctgagccagctcgaccaccctcatttttttatgacccccaaattctacgtgttcatgtggctcctggcagacatcatatccgtcttgttcatcgttgccatattttgcttccactggaggagagagacggaaaaggagaagttatttgagacgagcagcactaggactgacacacagtccggaaatctgcacattgctatgaagccgcctgtgagagttgttgaaggtccatggaccctggccgcactctaccccgctctacctaaaagtgggaaggaacaccagggacacttcaactttgccgcacctagtaagaaacttctgcctatcaaaaatgccgtcacacccctgaagccaggtaaacatgaaattcaacctccaatgcccaccgtggtgttcgaattaactcaggcaccgacgagacaggccacaagcgaggcaacgtttcagaccactctgccaacgttgaaggtagataaaccaaccatgccttcaattgaagtgccctacccctag

SEQ ID NO: 50567 - DNA, 1254 bp, Artificial Sequence
  Description of Artificial Sequence: Synthetic coding sequence
atgacaactctggtccctgcaacactttccttcctcctgctctggactctgccaggccaagtgttgttgagggtggccctagcaaaggaggaagtgaagtctgggaccaaaggatcccaacccatgtcaccttccgattttttggacaagctaatgggtcgaacctctgggtacgacgctaggatccgaccaaacttcaagggacccccagtgaacgtgacctgcaatatttttattaactccttttcctccatcacaaagactacaatggattaccgcgtgaatgtgtttctccggcagcagtggaatgaccctaggctgagttatcgcgaataccctgacgattccctagaccttgatccgtccatgctagattcaatttggaaacccgatctattttttgctaacgaaaaaggcgcaaatttccatgaggtgaccaccgacaacaagctgctaaggatattcaagaacggaaatgtactgtacagcattcggctcaccctcatcctgagttgtcttatggacctgaagaactttcctatggacatccagacttgcacaatgcaactggaatctttcggatatacaatgaaggatctcgtcttcgaatggttagaggatgcccctgccgtgcaggtggccgaagggctgacactgcctcagtttattctgcgggacgagaaagacctggggtgctgtacaaaacactataacaccgggaagtttacgtgcatcgaggtaaagtttcacctggagcgccaaatgggatactatttaattcagatgtacatcccctctctcctgatcgtgatattgagctgggtaagtttctggattaatatggatgctgcccctgctagggtcgggctgggcattactaccgttctgactatgaccacccagtctagtgggtcccgggctagcctgccaaaagtctcttacgtgaaagcgattgatatctggatggcagtttgtctgttgttcgtgttcgctgccctgctagaatatgccgcaataaatttcgtgtccaggcagcataaggagtttatccgacttaggagacgccagcgtaggcaaagactggaggaggacattatacaggaatcgcgcttctacttcagagggtacggattaggacactgtctacaggccagagacgggggacctatggaaggaagcggcatttatagcccccaaccccctgcacctctgttgcgtgaaggcgagaccactagaaagttatatgtagattag

SEQ ID NO: 50568 - DNA, 1002 bp, Artificial Sequence
  Description of Artificial Sequence: Synthetic coding sequence
atgtttaaactatgctctaataagatggtttctcaagagggctcagaggtggagttattggtatccccaggtgcgaggagcgagcacggacgctacctgcaggatcccattgtctctattgacctaagtgagtggctcagaatcatcgaatttctgctgcaagggctcaaggtctacggatctgtgtaccacataaaccatggcaatcccttcaatatggaagtcctggtggacagctggccagaatatcagatggtcattatacgaccacagaagcaggaaatgacggatgacatggattcgtacacaaacgtgtaccgaatgtttagtaaagaaccacagaaatccgaggaggtactgaaaaattgcgagatagttaattggaagcagagactgcagattcagggtctgcaggagagcctgggtgaaggcattcgcgtcgcgaccttttccaagagcgtgaaggtggagcactcaagggccctgctactggtgactgaagatatcctgaagcttaatgccagctctaaatccaagctcggatcatgggctgagacaggtcatcccgacgatgagttcgaaagcgaaacaccaaacttcaaatatgcccagctcgatgtttcctattctggtctcgtcaatgacaactggaagcgagggaagaacgaacgttctctgcattatatcaagcgatgtattgaggatctgcctgcagcctgtatgttagggccagaaggtgttcctgtcagctgggttacaatggacccttcctgcgaggtgggcatggcatatagtatggagaaatatcgtcgcaccggcaacatggccagggtgatggtgcggtatatgaagtacctcaggcagaaaaacatacctttctacatctccgttttggaagagaatgaagatagcagaagattcgtggggcagtttgggttctttgaagcttcctgcgaatggcatcaatggacttgctacccacaaaacctcgtgcctttctag

SEQ ID NO: 50569 - DNA, 909 bp, Artificial Sequence
  Description of Artificial Sequence: Synthetic coding sequence
atgatattgctcaacaacagtcataagctgttagccctgtacaaaagcctggcaagatccatccccgagagcctgaaagtgtatgggtcggtctaccatatcaatcacggcaatccattcaatatggaggtactcgtagattcgtggcccgagtaccagatggttattatcagaccacagaaacaggagatgaccgacgatatggattcttacaccaacgtgtatagaatgttcagcaaagaaccgcagaaatccgaggaagtgttaaaaaattgcgagatcgttaactggaagcagaggttgcagatccagggccttcaggaatcactgggtgaggggatcagagtcgccacgttttccaaaagcgtcaaagtagaacatagccgtgccctgcttctcgttacagaagacattcttaagctaaacgccagcagcaaatcaaaactcggatcatgggcggaaacaggccatccagacgacgagtttgaatcagagactcccaatttcaagtatgctcagctggatgtgagctactcaggactggtcaacgataattggaagaggggaaagaacgagagaagcctccactacatcaagagatgtatcgaggacctacctgccgcttgcatgctgggtcctgaaggagttccagtcagctgggtgactatggacccgtcttgcgaggtgggaatggcctattctatggaaaagtaccggcgaaccgggaacatggccagggttatggtccggtacatgaaatacctgcggcaaaagaatattccattctacataagcgtcttggaggaaaacgaagacagcagacggtttgtgggacaatttgggttcttcgaggcttcatgtgaatggcatcaatggacctgttacccccagaatctggtaccgttttag

SEQ ID NO: 50570 - DNA, 840 bp, Artificial Sequence
  Description of Artificial Sequence: Synthetic coding sequence
atgatcttgctcaataattctcacaaattgctggctctgtataaatcattagcacgatccatccccgagtcactgaaggtgtacggcagtgtctaccacataaatcacggcaatcccttcaatatggaagtgctggtcgattcctggccggaatatcagatggtgatcatcagacctcagaaatcagaagaagtgctgaaaaattgcgagatcgtgaattggaaacagagacttcagattcaaggtctgcaggagagtttgggagaaggcatcagggtggcaactttttcgaagtccgtgaaggtggagcatagccgagctctgctgctggtcactgaggatattctgaagctcaacgcatcatctaaatccaagctggggtcttgggccgagactgggcacccagatgacgagtttgagagtgagaccccgaatttcaagtacgcccagcttgacgtttcctactcaggccttgttaatgataactggaaaaggggcaaaaatgaacgatcattacattatatcaagagatgtatcgaggacctccccgctgcttgcatgctcggcccagagggcgtgccagtcagttgggtgactatggacccttcgtgtgaggtgggtatggcctattctatggaaaaatatcgacggaccggaaacatggctagagttatggtgcgctacatgaaatacctaagacagaagaatattcctttttacatcagtgtattggaagaaaacgaggattctagacgattcgtgggacaatttggcttctttgaggcttcctgtgaatggcatcaatggacatgttacccccagaaccttgtgccattctag

SEQ ID NO: 50571 - DNA, 207 bp, Artificial Sequence
  Description of Artificial Sequence: Synthetic coding sequence
atgatcctgcttaataattctcacaagctcctagcactgtataaaagtctcgctcggtctatccctgagtccctgaaggtctacggctctgtgtatcatatcaatcacggaaacccttttaatatggaggtgctggtggactcatggccagagtaccagatggtgatcatacgcccacagaaacaagaaatgaccgatgacatgtag

SEQ ID NO: 50572 - DNA, 240 bp, Artificial Sequence
  Description of Artificial Sequence: Synthetic coding sequence
atgattcttttgaacaactcacacaaattgcttgccctgtacaagagcctcgcgagatctatccccgaaagccttaaggtgtatggctctgtgtaccatattaaccatgggaatccattcaacatggaagtgctggtcgactcctggccagagtatcaaatggtgattattcggcctcagaagcaggagatgactgacgacatggactcttatactaatgtgtatagaatgttctcttag

SEQ ID NO: 50573 - DNA, 885 bp, Artificial Sequence
  Description of Artificial Sequence: Synthetic coding sequence
atgctcgttctgcacaacagtcagaaacttcagatcctttacaagagtctggaaaagtccatccccgaatccatcaaagtttacggagccatttttaacatcaaagataaaaacccctttaacatggaggtactcgttgacgcatggcctgattatcagatcgtaattaccagacctcaaaaacaagaaatgaaagacgatcaggatcactatactaacacctaccatatcttcaccaaagcccctgacaagctcgaagaggtgcttagttatagcaatgttattagctgggagcagactctgcagatccaggggtgccaggaaggcctggacgaggccataaggaaagtggcaactagtaaaagcgtgcaggtggactatatgaagacaattctttttataccggagctccctaaaaaacacaagacttctagtaacgataaaatggagctctttgaggtggatgatgataataaagaaggtaacttttcaaatatgtttctggacgcatctcatgccggattagtgaacgaacattgggcctttgggaagaacgaacgctccctcaaatatattgaaagatgcctgcaggattttctcggatttggggtgttgggaccagaagggcaactagtgtcttggatcgtgatggaacagtcatgtgagctgcggatggggtacaccgtacccaaatatcggcaccaaggtaacatgctccagattggttaccacctcgaaaaatacctttcccagaaagagatcccattctacttccatgttgccgacaataacgagaagtctctgcaggctcttaataatctgggtttcaaaatatgtccctgtggatggcatcagtggaaatgcactcctaaaaagtattgttag

SEQ ID NO: 50574 - DNA, 885 bp, Artificial Sequence
  Description of Artificial Sequence: Synthetic coding sequence
atgttagtcctgcacaattctcaaaagctccagattctttacaaaagcctcgagaaaagcattccggaatccattaaagtgtacggggcaatatttaatattaaagataaaaatcctttcaatatggaagtcctggtcgacgcctggcctgattatcaaatcgttatcactagaccacaaaaacaggagatgaaggacgatcaggaccactacacaaatacttaccatatcttcaccaaggctcctgataagctcgaggaggttttaagctactcgaacgttattagctgggaacagacactgcaaatccaggggtgtcaagagggactggatgaggccatcaggaaggtggccacgtccaagagtgtgcaggtggattacatgaagaccatcctgttcatccccgaactccccaagaaacacaaaacctcgtccaacgataaaatggagttattcgaggtcgatgacgataacaaagagggaaatttctccaatatgttcctggacgcctctcacgccggactggtgaacgagcattgggccttcggaaaaaacgagcgtagccttaagtatatcgagaggtgtctacaggacttcctcggctttggtgtgctgggccctgaggggcagctggtgtcctggatcgtgatggagcagtcttgcgagctgcgcatgggatacactgtgcctaagtacaggcatcagggcaacatgctccagatcggatatcacctcgaaaagtatctgagccagaaggaaatccccttttactttcacgtggctgataacaatgagaagagcctccaggcgctgaataacctcggctttaagatatgtccgtgtggttggcatcagtggaaatgtacccccaaaaaatattgctag

SEQ ID NO: 50575 - DNA, 867 bp, Artificial Sequence
  Description of Artificial Sequence: Synthetic coding sequence
atgctcgtcctgaactgtagcaccaaactgcttattctggaaaagatgttaaaatcatgcttcccagagtccctcaaggtgtacggagctgttatgaatatcaaccggggtaatccttttcagaaggaagtggtgctggatagctggcccgattttaaggctgtcatcacacgcaggcaaagagaagctgaaacagataatctcgatcattacacgaacgcatatgctgttttttacaaggatgtcagggcctatcggcagcttcttgaggagtgcgatgtctttaattgggatcaggtgttccagatccagggactgcagtcggagctgtacgacgtgagcaaggctgttgccaatagtaagcagctcaacatcaagttaacatcttttaaggctgtccacttttcaccggtgtccagcttgccagacacatccttcctgaaagggccttctccgagattgacatatctgagtgtagccaacgcagatctgttaaatcgcacctggtcccgaggaggaaatgagcagtgtttaagatacatcgcaaaccttatcagctgttttccctcagtatgtgtgcgggacgagaaaggcaaccccgttagctggtcaatcactgatcagtttgccactatgtgccatggctacacgctacctgagcatcgccgtaaggggtactctcgattagttgcgctgaccttggcgagaaagctgcagtctcgcggatttccttcccagggcaatgtcctggatgataacaccgcaagtatctctctgttgaagagtctgcatgcagagtttctgccatgccgttttcaccgattgattctcacacctgctacgttttccgggcttcctcatttgtag

SEQ ID NO: 50576 - DNA, 471 bp, Artificial Sequence
  Description of Artificial Sequence: Synthetic coding sequence
atgcttgtgttgaattgctcaacaaagttactaatcctggagaagatgttgaaatcttgcttccctgagagcctgaaagtgtatggcgcagtgatgaacatcaacagggggaatccttttcagaaagaggttgtgttggactcctggcctgattttaaagcagtaatcactcgccgacagcgggaggccgagaccgataacctcgaccattacacaaacgcatatgccgttttttacaaggacgtccgtgcctatagacagctgcttgaagagtgcgacgtgtttaattgggatcaggtgttccagattcagggcctccagtccgagttatacgacgtttctaaagcggtagccaactccaagcagttgaacatcaagcttacttccttcaaagctgttcatttctcccctgtttcctccctcccggatacttccttcttgaagggaccatctcctcgccttacctactag

SEQ ID NO: 50577 - DNA, 1683 bp, Artificial Sequence
  Description of Artificial Sequence: Synthetic coding sequence
atggagtgtctttactactttttgggcttcctattactggcggcaaggttgcccctcgacgcagccaaacgctttcacgatgtgctcggcaatgaaaggccatccgcctatatgcgggaacataatcaattgaacggctggtcatcagatgagaacgattggaacgagaagctgtatcctgtatggaaacggggtgatatgcgctggaagaatagttggaagggcggaagggtgcaggcagtcctcacctcagacagcccagctctggttgggtcaaacattaccttcgccgtcaatctgatttttccaaggtgccagaaggaagatgctaatggtaacattgtctatgagaaaaactgccgcaatgaggccggtctttcagccgacccatacgtctataattggactgcgtggtccgaggactcagatggggagaatggtacgggccaatcccaccataacgttttccccgacgggaagccttttccccaccacccaggctggcgacgatggaatttcatctacgttttccatacgcttggccagtactttcaaaagcttgggagatgttccgttagagtaagcgtgaacacggcaaatgtcactcttggtccacagcttatggaggtcaccgtctatcgacgccacggtcgcgcatacgtccccatcgctcaggttaaggacgtttacgtagttactgaccagatcccggttttcgtgacgatgttccagaagaacgatcgaaatagcagcgatgagaccttcctgaaagatctgcctatcatgtttgacgtactgatacatgaccccagccactttctaaactattctacaataaattacaaatggtcattcggggataacactggcctcttcgtctctactaatcacactgtgaaccacacctacgtccttaacgggacattcagcctaaacctgaccgtcaaggccgctgctccagggccttgcccccctccacctccccctccccgtcccagcaagcccacaccgtcactcggtccagccggagataaccccctggaacttagtcgcattcctgacgagaactgccagattaataggtacggccatttccaagccactatcaccatagtggagggaatactggaagtgaacattatccagatgacagatgtcctgatgccagtaccgtggcccgaaagcagtctgattgatttcgttgtgacctgtcaaggctccattcccacggaggtgtgcacaattattagtgatcctacgtgcgaaattacccagaacacagtgtgctcccccgtggatgtggacgagatgtgtctcctgactgttcgcagaacattcaacggttccggaacatattgtgtaaatttgaccttgggtgatgataccagcctggccctcacttctaccctcatctccgttcccgatcgtgatcccgcttctcctctgcgtatggcaaacagcgccctgattagcgtgggctgtctcgcgatatttgttacggtgatatcactgctggtgtataaaaagcacaaggaatataatccgatagagaactctcctggcaatgtcgtgaggagcaaaggcctcagcgtgttcctcaaccgagccaaagctgtgtttttcccaggaaaccaagagaaggacccactactgaagaaccaggaatttaagggggtgagctag

SEQ ID NO: 50578 - DNA, 1719 bp, Artificial Sequence
  Description of Artificial Sequence: Synthetic coding sequence
atggaatgtctgtactatttcctcggattcctcttactagctgcgcgactgccattggacgctgccaaacgattccatgatgtgctcgggaacgagagaccttctgcttatatgagagagcacaatcagctgaacggatggagttcagacgagaacgattggaatgagaagctgtatcctgtgtggaaacgaggggatatgaggtggaaaaactcctggaagggagggagggtgcaggctgtcctgacctctgacagtccggcacttgtagggtccaacataacctttgccgttaacctgattttcccccgatgccaaaaggaggacgccaatggtaacattgtgtacgagaagaactgccgaaatgaggcagggctaagcgctgacccctacgtctataattggaccgcatggtctgaggactctgacggagaaaatggaactgggcagtcacaccataacgtcttccctgatggaaagcccttcccacaccacccaggctggcgacgatggaacttcatctacgtgttccataccctgggacagtattttcagaaactgggaagatgcagcgtgagggtgtcggtgaatacagcaaacgttactctcggtcctcagctaatggaagtgaccgtttatcggagacacggcagagcctacgtgcctatcgctcaagtgaaggacgtgtacgttgtcacagaccaaatcccagtattcgtgactatgtttcaaaaaaacgatcgtaacagcagtgatgaaacatttctgaaggacttacctattatgtttgacgtgcttattcacgacccatcccactttctcaattactctacaattaactacaaatggagcttcggtgataatacaggcctgttcgtaagcaccaaccacaccgtaaaccatacctatgttctgaatggcaccttctccctgaatctgaccgtcaaggcagctgctcccggtccttgtccgccacccccacctcccccaaggccctcaaagcccacaccctccctggctacaacgctgaaaagctacgactctaacacacctggacccgctggggacaatccgcttgagctgagtcggatcccggatgagaactgccagattaaccgctacgggcattttcaagcgactattaccatcgtggaaggcatcttagaggtgaatatcattcagatgacagacgtactgatgccagtgccctggcctgagtcttcccttatcgacttcgtggtaacgtgtcaggggagtatacccaccgaggtttgtaccatcatcagtgatccaacatgcgagattacacagaatacagtttgctcccccgttgatgtggacgagatgtgcttgctgactgttagacggacgttcaacggttccgggacttactgtgtaaacctgacgctgggtgacgatactagcttagcactgacaagcaccctgatctccgtacccgacagggacccggcaagtccccttcgtatggccaattcggcacttatcagcgttggatgtctagcgatattcgtcaccgtgatcagtcttctggtgtacaagaaacacaaggaatataaccctattgagaatagtcctggaaacgttgtgcggagcaagggattgtccgtatttctgaatagggcgaaggcagtcttcttcccgggaaaccaggagaaggaccccctgctgaaaaaccaggagtttaagggggtgagttag

SEQ ID NO: 50579 - DNA, 621 bp, Artificial Sequence
  Description of Artificial Sequence: Synthetic coding sequence
atggaatgcttatattactttttaggatttctcctcctggctgccaggctgccactcgatgctgccaaaagatttcacgatgtgttagggaacgagcgtccttccgcttatatgcgagaacataaccaacttaacggctggagctcagacgagaacgactggaatgagaaactttatcctgtatggaagagaggggatatgcggtggaaaaattcctggaagggaggcagagtgcaggctgttctgacctcagacagtccagctctagtggggagcaacatcacctttgccgtcaacctgatcttcccgaggtgccaaaaagaagatgccaatggcaatatcgtttacgagaaaaactgccggaacgaggccggtctgtcagccgacccatacgtctacaactggactgcgtggtctgaagattccgatggggagaatggcaccggacagtctcaccacaacgtcttccctgatgggaagccttttccccaccatcccggttggcggaggtggaacttcatttatgtatttcatacactgggctggttgctccagaccccaaagctcctgctttacctgtctttgaaatttcagccgtctcttttccttctgtataattag

SEQ ID NO: 50580 - DNA, 1368 bp, Artificial Sequence
  Description of Artificial Sequence: Synthetic coding sequence
atggaatgcctatactacttcctcggatttcttctcctagccgcaagactacccctggatgccgctaaacgtttccatgatgtactgggaaatgagcgcccatcagcctatatgcgagaacataatcaactgaatggttggtcctctgatgagaacgattggaatttcatttacgtctttcacacattgggacagtactttcagaagctcggcagatgtagtgtcagagtgagcgtgaatacagcgaatgttacactgggccctcagcttatggaagtcaccgtttacagacgacacggacgcgcttatgtgcccatcgcacaggttaaggatgtctacgtggttacagaccaaatccccgtttttgttaccatgtttcagaaaaatgacagaaactcatccgacgagacttttctgaaggatctaccaataatgtttgatgtcttgattcacgatccttctcactttttaaattactctacaatcaactataaatggtcttttggagacaacaccggactgttcgtatctactaaccatactgtgaaccatacctacgtgttaaacggaacctttagcttgaatcttaccgtcaaagccgctgcgccaggaccatgtccccctccgccaccccctcctcgaccgtccaaacccacacctagtttagccactactctcaagtcatacgactccaacacacccggaccagctggagataaccccctagagctgtcgcgcattcctgacgagaactgccagatcaataggtatgggcatttccaggccaccattacaattgtggagggaatcctggaggtgaatataatccagatgacagacgtgctgatgcctgtcccatggcccgagtcaagcctcattgattttgtcgtgacctgtcagggaagtattcccactgaagtgtgtacaattatctcagaccccacgtgtgaaattacgcaaaatacggtatgctctccggtggatgtggacgagatgtgcctcctaacagtccgcagaacttttaacggtagtggcacctactgcgttaatctgacgttgggagatgatacttccctcgccctgacaagtacgcttatttctgtccccgaccgggatccagcatcgccactgagaatggctaacagcgctctgatttccgtgggctgtctcgctatctttgttaccgtgatctcactgctggtgtacaaaaaacacaaggaatacaatccgattgagaactccccaggaaacgtcgtacggtccaaagggctgtccgtgttcctgaacagagccaaagccgtgttcttccctgggaaccaggaaaaggaccctctgcttaagaatcaagaattcaaaggagtttcttag

SEQ ID NO: 50581 - DNA, 1824 bp, Artificial Sequence
  Description of Artificial Sequence: Synthetic coding sequence
atgatactgccagaagccctctacttaatcaaaattgaacgcgaagcccctcagatgcctgaggaacattgttgttcttggtggacaggacccgaggagttctcaatggaatgcctatattacttcctaggcttcctgctgctcgcagcacgattgcctctcgatgccgcaaaacgctttcacgatgtgctgggaaatgaaagaccgtccgcctacatgcgcgaacacaatcagctgaatggctggtccagtgatgagaacgattggaatgagaagctataccctgtttggaagaggggcgatatgcggtggaagaattcttggaaggggggacgggtgcaggctgtgctcacgtcagatagtccagctttggttggctcaaacatcacattcgccgtcaatctcatattcccaaggtgtcaaaaggaagacgccaacggaaatatcgtctatgaaaaaaattgccggaacgaagctgggctgagtgctgacccatacgtatacaactggacagcctggtctgaagactctgatggagaaaatggaacaggacagagtcaccataatgtcttccctgatggcaaaccatttccccaccatcccggttggcggcgatggaatttcatctacgtgttccatacgctgggacagtattttcaaaagctcggccgttgctcggtgcgcgtcagcgttaacacggcgaacgtgacactgggaccacaactgatggaggttaccgtgtaccgcagacatgggcgagcttatgttcccatagcacaggtgaaagacgtctacgtagtgaccgaccagattccagtgtttgtcacaatgtttcagaagaatgatcgtaacagcagcgacgaaacttttctgaaagacttacccattatgttcgatgttttaattcatgatccaagccacttcctgaactattcaaccatcaattacaagtggagcttcggcgacaacactgggctctttgtgtctacaaaccacacagtgaaccacacatacgtgttgaacggcaccttcagcttgaatttgactgtcaaggctgccgcaccaggcccttgccccccacctccgcctcctccacgaccatcaaaacccacaccaagtttggcaactactctgaaatcttacgattctaacacccccggtccagccggagacaacccgctggaactgagtcgtatccccgatgagaactgtcagattaaccgctatggacatttccaagccacaattaccattgtcgagggaatactcgaggtaaacatcattcagatgactgatgtgttgatgcccgtgccatggcctgaatcctcactaattgatttcgtggtgacctgtcagggttctatacccactgaagtctgcacaataattagcgaccccacgtgtgagatcacacagaataccgtctgtagtccagtagacgtcgatgaaatgtgcctgctgaccgttagaaggaccttcaatgggtcaggaacatactgtgtaaatctgactctaggtgatgatacttctctggccttgacaagcactctgatctcagtccccgaccgagacccagcctctccattgcggatggctaactcagctctaatctctgtgggctgtctggcaattttcgtgaccgtcatctccctgctggtctataagaaacataaagaatataaccctattgaaaatagccccggaaatgttgtgagatctaagggactttcagtgtttttgaaccgcgcaaaagccgtcttctttccaggtaaccaagagaaagatccgctgttgaaaaatcaagagtttaagggcgtcagctag

SEQ ID NO: 50582 - DNA, 1545 bp, Artificial Sequence
  Description of Artificial Sequence: Synthetic coding sequence
atggaatgcctgtactacttcctcggctttcttctgctcgccgcaagattacccctggacgccgctaaaaggttccacgacgttctcggcaatgaacgcccttccgcttacatgcgcgaacacaatcaactgaacggctggtcctccgatgagaacgattggaatgagaagctgtatcccgtatggaaacggggtgacatgcggtggaaaaattcctggaagggtggacgcgtgcaagccgtgctgacatctgacagtcccgctttggtgggttctaatatcacttttgctgtgaatcttatcttcccccgatgccagaaggaagatgcgaacggaaatatcgtgtatgagaagaactgtcggaacggacagtactttcaaaaacttggtaggtgcagcgtccgggtgagcgttaacactgctaacgtgacccttggtccgcagctgatggaagtaaccgtctataggcggcacggcagggcctacgtgcccatcgctcaagttaaagatgtgtacgtggtgaccgatcagatcccggtgtttgtaactatgttccagaagaacgacaggaacagttcagacgagacttttctgaaagacttgcctatcatgttcgacgtactcattcatgatccctcgcacttcttgaattacagcacaataaattacaaatggtccttcggcgataatacaggcctctttgtgtctactaaccatacggtaaatcatacgtacgtgcttaatggcaccttctctctgaacctgacagtcaaggctgctgcacctggtccttgcccccctcctccacctccaccacgcccatcaaaacccaccccttctctggctaccactcttaaatcatacgattccaacacacctggacctgctggggacaacccgctggagttgagccgcattcctgacgaaaattgtcagattaataggtatggtcacttccaggccaccattaccatcgtagagggcatcttggaggtgaacatcatacagatgacagatgtgcttatgcccgtcccgtggccagagagctctcttattgacttcgtcgtcacatgtcaaggctccattcctacagaggtctgtaccattatctctgatcccacatgtgaaatcactcagaacacagtatgtagcccagtggacgtggatgagatgtgtctactaacggtgcgcagaacattcaatggctcaggcacctactgcgtcaaccttacgctcggcgacgacacatctttggctctgacgtcaacgttaattagcgtgccggaccgtgatccagcttccccactcaggatggctaattcagccttgatctccgtgggttgtctggcgattttcgtgaccgttatttcacttcttgtgtacaagaaacacaaagagtataacccaatcgaaaattcgccagggaacgtagtaaggtccaagggactaagcgttttccttaaccgggctaaggcggtattcttccctggaaaccaggaaaaagaccctctgctgaaaaaccaggagtttaagggtgttagttag

SEQ ID NO: 50583 - DNA, 1386 bp, Artificial Sequence
  Description of Artificial Sequence: Synthetic coding sequence
atggagtgcttgtactactttcttggcttcttgttgctggctgcaagactccctctggatgccgctaagcaggctggattgtcagcggatccgtacgtctacaactggaccgcttggtcggaagatagcgacggtgagaacggcactggccagtcccaccacaacgtatttccggatgggaagccattcccgcaccatcctggctggcgacgctggaactttatttatgtattccataccctcggccagtatttccaaaagcttggaaggtgttccgttagagtaagtgtgaataccgccaatgtgactcttgggcctcagcttatggaggtgactgtatatagaaggcatggacgagcatacgtcccaatagcccaggtgaaagacgtatatgtggtaactgatcaaataccagtatttgtgacgatgtttcaaaagaacgacagaaactcttccgacgaaacattcttaaaagacttgccgatcatgtttgatgtgctgatccacgacccttcgcattttcttaattattcaaccatcaattacaagtggtccttcggcgataatacagggctatttgtctctactaaccatacagtcaatcacacatacgtgctcaatggcaccttctccctgaaccttacggtgaaggccgcagcccctgggccttgccctccgccaccaccccctccacggccatctaaaccaacgcctagcttgggaccggcaggcgacaacccactggaattgtcaagaattcctgatgagaactgccagatcaatcgctatggacattttcaggctacaatcacaatcgtggaggggatactggaggtgaacattatccagatgactgatgtgctgatgcccgtgccctggcctgagtcatccttaattgactttgtcgtgacatgccagggctccatacctacagaggtctgcaccataatctcggacccgacatgcgagattacccagaatacagtgtgctccccggttgatgtcgacgagatgtgtttactgacagtacgcaggactttcaacgggtcgggtacgtattgtgtgaatctgacactcggagacgacacttctctcgccctcacctccacgcttatttccgttcctgaccgggacccagcgagtcctttgcgaatggccaactcggccttgatctcggtcggctgtttggccattttcgtgaccgtgataagtctactggtctataaaaaacacaaggagtacaatcctatcgaaaactctcctgggaatgtggtgaggtcaaaaggactgtctgtcttcttgaaccgcgcaaaagctgtgttcttccctggaaaccaagagaaggacccactactcaagaatcaggaatttaagggcgtgagctag

SEQ ID NO: 50584 - DNA, 960 bp, Artificial Sequence
  Description of Artificial Sequence: Synthetic coding sequence
atggttggcaagatgtggccggtgctgtggactctctgtgctgtgagggtgacagtggacgccatctcagtggaaaccccccaggatgtgctgcgagcgtcgcaagggaagagtgtgacccttccttgcacgtatcataccagcacttcgtctcgtgaggggcttattcagtgggacaagctactgctgactcataccgaacgcgtcgttatctggccattttccaataaaaattacatccacggcgaactgtacaaaaacagagtaagtattagtaataacgctgaacaatcagacgctagcatcacgatcgaccagctgacaatggcagataatgggacttatgaatgttcagtgagccttatgagcgaccttgaagggaatactaagagcagggtgagactattggtgcttgtcccaccatcaaaaccggagtgtggtattgagggcgagaccataatcggaaacaatatccaactcacatgccagagcaaggaagggtcccctacgccacagtattcctggaaacggtataacattctgaaccaggagcaacccctagcccagccagcctcaggacagccagttagcttgaaaaacatctccactgacacttcaggctactacatctgcaccagcagcaatgaggagggaacgcagttttgcaacattaccgtcgctgttaggagccctagcatgaatgtggctctgtatgtaggcattgcggtgggcgttgtggccgcactcattatcatcggaatcatcatatattgctgttgctgccggggtaaggacgacaacactgaggataaggaggatgcacgtcccaaccgagaggcctatgaggagcccccagagcagctcagggagcttagtcgcgagcgtgaagaggaggacgactacaggcaagaggaacagcgctccaccggaagagagtcccctgaccacctggaccagtag

SEQ ID NO: 50585 - DNA, 1683 bp, Artificial Sequence
  Description of Artificial Sequence: Synthetic coding sequence
atgcttaggggtacactcctttgcgcggtgctgggccttctccgcgctcagcctttcccatgcccgcctgcttgcaagtgcgtcttccgggatgccgcacagtgctccggaggcgacgtggccagaatcagcgctttgggactgcccactaacttgactcatatcttattgttcggaatgggaagaggcgtgttacagtctcagtctttttctggaatgactgtccttcagcggttgatgattagtgactcacatattagtgcagtcgctccaggcaccttcagtgatctcattaaactcaagacgctgagactctctaggaacaaaatcactcatttgccaggggcactgctggacaaaatggtgctgcttgagcagctatttctagatcacaacgctctccgaggtattgaccaaaacatgtttcagaaattagtcaacctgcaggagttggctctcaaccagaatcagttggacttcctgcccgctagtctcttcaccaatcttgaaaaccttaagttgctggacctgtctgggaataatttgactcatctccccaaaggtcttctgggtgcccaagcgaagctggagcggctgctgctgcattcaaatcgcctcgtctcccttgactcagggttgttaaacagcttgggagctctgaccgagctacagtttcataggaaccacatcaggtcaatcgctcccggtgcctttgatagattgcccaacctcagttctctgacactcagtagaaatcacttggcatttctcccttcagcgttgttcctccactcccacaatctcacactcctaacactgttcgagaatcccctcgctgagctccccggagttcttttcggagagatgggcggtctccaggagctgtggctgaatagaacccagctgaggacccttcccgcagccgcattcagaaacttgtcaagactcagatacctcggcgttaccctcagtcccaggttgagtgcgctcccccaaggcgcttttcaaggcctgggggagctgcaggtgctcgctcttcactcaaacggcctgaccgccctgcctgacggcttactgagaggactggggaagttgcgacaggtctctctgagacgaaataggctgagggccttacctagggcgctttttaggaatctctctagcctcgaatccgtccagttggatcataatcaactggaaacactcccgggagacgtgtttggagccctacctcgtcttacagaggtactgctgggccacaacagctggcgctgtgattgtggcctgggcccttttttggggtggctgcggcagcacctcggcctggtcggcggtgaagaaccgccacgttgtgcagggccaggtgctcatgctggtcttccactgtgggcattgccaggcggagatgccgagtgccccggtccccgaggaccccctcccagacctgctgcggatagttcctcagaagcccctgtccacccggctctggccccaaactcctccgagccatgggtgtgggcccagccggtgacaacggggaagggtcaggatcactcgcctttttggggcttttattttctcctcctggctgtacaggccatgattaccgtgatcatcgtgttcgcaatgatcaaaatcgggcagttattccggaagttgattcgggagcgagcattgggatag

SEQ ID NO: 50586 - DNA, 1683 bp, Artificial Sequence
  Description of Artificial Sequence: Synthetic coding sequence
atgttacggggtactttgctgtgcgcggttcttgggctgttgcgtgcccaacccttcccttgtcccccagcatgcaagtgtgtgtttagagacgcagctcagtgtagtggaggagacgtggcaagaataagtgctctagggctgcctactaatctgacccacatactgctgtttgggatgggcagaggcgttcttcagtctcagtccttctccggcatgacagtgctccaacggcttatgatctctgattcacacattagcgccgtggctcccggaacgttctcagatctgatcaagcttaagactctgcgcttgagcagaaacaagataactcacctgccaggggctctgttagacaagatggtgttactggaacagcttttcctagaccacaacgcattgaggggaatcgatcagaatatgttccagaaactggttaaccttcaggaactggccctgaaccagaatcaactagactttctaccggcaagcctcttcaccaatctagagaacctcaagctgctggatctatctgggaacaacctgacacacctgcctaaaggactgctgggcgctcaggccaaactcgagaggcttcttctccacagcaatcgccttgtctctcttgactccgggcttttaaacagtttgggagcactgaccgaactgcagtttcaccgcaaccacattcggagtatcgctcctggggctttcgatcgcctcccaaacctcagtagtttgaccctttctcggaaccaccttgcgttcttacctagcgccctcttcctgcattcccacaacttgaccctgctgacactgttcgaaaaccccctcgccgagctccccggagtgttatttggtgagatgggtggtttgcaagaattatggcttaatcggacacagctccggaccctccccgctgctgcgttccgaaatctcagccgtctgaggtatcttggagtgactctgagtccccgtctgtccgcccttccacagggggctttccagggcttaggtgaactgcaggtgcttgctttacattcaaacggcctgactgccctccccgacgggctgctacgaggcctggggaagttgcggcaggtctcgttgagacgcaacagattacgagcactgccacgggcactcttcaggaacctgtcatcccttgaatcagtccaactggaccacaatcaattggaaactctgccaggcgacgtattcggggctctgccccgtttaaccgaggttctgttgggtcataactcatggcggtgtgattgtggtttgggccctttcctgggatggcttagacagcatctgggcctggtgggcggtgaggaacccccaaggtgcgcaggtccgggagcccatgccggactgcctttgtgggccctcccaggaggggatgcggaatgtcccggacctcggggaccccctccacggccagctgcagactcttcatccgaagcgccagttcatcctgccctggctcccaacagttcagagccttgggtgtgggctcaacctgtcacaactgggaaagggcaggaccatagcccattctggggattctacttcttgctgctggccgtacaggccatgataacggttatcatcgttttcgcgatgatcaagatcggccagcttttccgtaaacttatacgagagcgagcactgggctag

SEQ ID NO: 50587 - DNA, 1869 bp, Artificial Sequence
  Description of Artificial Sequence: Synthetic coding sequence
atggcggctgctcccagagcagggcgaagaagggggcagcccctgttggcactgttgctgctactactggccccactgcccccaggagcaccacccggtgccgatgcttactttcccgaggagcggtggtcccccgagagtcctctccaggccccaagggtacttatcgcgctgctcgcaagaaacgcagcccacgccctgcccactactctgggcgctctcgaacggcttagacatcctagagagcgaacagctttatgggtcgccaccgatcacaatatggataacacctcgaccgtgctcagagagtggctcgtggccgttaaaagcctgtaccactctgttgaatggcgtcccgctgaggaaccacggtcttatcctgacgaggaaggaccaaaacactggtccgatagcagatacgagcatgtgatgaagctgcgacaagccgcacttaaatccgcacgggatatgtgggcagactacattctctttgtggatgccgacaatctcatcctgaacccagatactctgtcactgctgattgcggagaataaaactgtagtggctcccatgctcgactcccgagcagcctactcgaatttctggtgcgggatgacttcccagggatattataagcggactcccgcatatatacctatccggaaacgggatagacgtggatgtttcgctgtccccatggtgcacagtaccttccttattgacctgaggaaggccgcaagtcggaatctggctttctatccccctcatccggattacacctggtcctttgacgacataatcgtctttgccttctcctgcaaacaagcagaagtgcaaatgtacgtgtgcaacaaagaggagtacggcttcctgcctgtgccactaagggctcattctacactccaagatgaggctgagtcgtttatgcatgttcagcttgaggtgatggtaaagcacccgccagccgaacccagcaggttcatctcagcgccaaccaagacgccagataagatgggctttgacgaagtgttcatgatcaatcttagacgtagacaggatcggagggagcgcatgctgcgtgcactgcaggcccaggagatcgagtgtcggctggtagaggccgtggacggtaaggctatgaacacttcacaggtggaagcccttggaatccaaatgcttccaggttacagagatccataccacggcaggccactgacaaagggtgaactgggctgtttcttgtctcactataacatctggaaggaggtcgtggatcggggactgcagaagagccttgttttcgaagacgacctgcgcttcgaaatatttttcaagaggagactcatgaatctgatgcgagatgtcgagcgggaagggttggattgggatctcatctatgtgggcagaaaaaggatgcaggtggagcaccctgaaaaagccgttcctcgcgtccgcaacctggttgaggcagactactcatactggaccctggcctacgtgatctcactgcagggcgctcgcaagctcctagctgctgagcctctctccaagatgctacctgtagatgagttcctccccgttatgttcgacaagcacccagtttcggaatataaagcacatttttcgcttcgcaacctgcacgcattctcagtcgagccgctgctgatttaccctacgcattatacaggggatgacggatatgtgagcgacaccgagacctcagtggtttggaacaatgagcacgtcaaaactgactgggatcgtgctaagagtcaaaagatgcgagaacagcaggcattgagccgcgaggctaaaaactctgatgtgctgcaaagcccccttgacagtgctgctcgagacgaattgtag

SEQ ID NO: 50588 - DNA, 702 bp, Artificial Sequence
  Description of Artificial Sequence: Synthetic coding sequence
atggttcactcaaccttcctgatcgatctgaggaaagccgcttccaggaacctggccttttatcccccacatcccgattacacctggagctttgacgacatcatcgttttcgcattctcctgcaaacaggctgtgaagcatcctcctgccgagcccagtcgcttcatatcggccccaaccaaaaccccagataagatgggcttcgacgaggtattcatgatcaacctgcgcaggaggcaggatagacgtgagcgcatgctccgggcattacaagctcaggagatcgaatgtcgactggtagaagctgtggacggcaaggccatgaatacatctcaggtcgaggctctgggaatccagatgctgccgggataccgtgatccttaccacggtaggcctttgaccaagggtgagctcggttgttttttgtcccactataatatttggaaggaggtcgttgacagaggactgcagaagtctcttgtttttgaagacgatctgcgcttcgaaattttttttaagcgtcgactcatgaacttaatgcgagacgtggaacgcgagggactcgattgggacttgatttacgtcggaaggaaacgtatgcaagttgagcatcctgagaaagccgtacccagggtgcgcaacctggtcgaagctgattatagttattggacggtcctgcctgggatgaactctgaaggctag

SEQ ID NO: 50589 - DNA, 1881 bp, Artificial Sequence
  Description of Artificial Sequence: Synthetic coding sequence
atggccgctcgccctgcagcgactctggcttggtcattactgttgctgtctagcgccctgctgagggagggctgcagagctcgctttgtcgcggaaagggatagtgaggacgacggagaggaacccgtggtcttccccgagagccctctccaatctccaacagtgttagttgcagttctagcaagaaacgcggcacacacactgccacatttcctgggctgtctggaacgcctggactatcctaagtcaaggatggcaatctgggccgcaactgaccacaacgtcgataatacaactgagattttccgggagtggctcaagaatgtacaaaggttgtaccactacgtagagtggagacctatggacgaacctgaaagttaccctgacgagattgggcctaaacactggcctacatcacgtttcgcccatgtcatgaaactgaggcaggccgctctccggacggcccgagaaaaatggagcgactacatcctgtttatcgatgtggacaatttccttacgaatccgcagactttgaacctgctcatagccgaaaataaaacgatagttgccccaatgctggagtccagagggctatatagcaatttctggtgtggaatcacaccaaaaggcttttacaagcgcacacccgattatgtgcagattcgtgagtggaagcgtaccggttgctttccggtaccaatggtccacagcaccttccttatcgacctgagaaaggaggcctctgacaagctgaccttctatcctcctcatcaggactacacttggacctttgatgacattatcgtgtttgctttcagctcccggcaggcaggaatacagatgtatctttgtaatagggaacactacgggtatcttcctatcccgttgaaaccgcaccaaacactgcaagaggatatcgagaatctcatccatgtccagatcgaggctatgatcgatagacccccaatggaacccagtcaatacgtctccgtcgttccaaaatatcctgacaagatgggatttgatgagattttcatgattaatctaaaacgaaggaaagatagacgggaccggatgcttcgcacgttgtatgagcaggagatcgaagttaaaattgtggaggcagtggacggcaaagctctcaacacttcccagttgaaagccctgaacatcgagatgttacccggataccgcgacccttactcctctagacccctcactcgtggagagatcggatgttttctgagtcattactccgtgtggaaagaagtgatcgatcgcgaacttgagaagactcttgtgattgaagacgatgtgcgattcgaacaccaattcaagaagaagcttatgaagctgatggacaacatcgaccaggctcagctagactgggagctgatatatattggcaggaaaaggatgcaagtaaaagagccagaaaaagcggttcctaacgtagctaatctggtagaggccgactactcgtactggacccttggatatgtaatttcactagagggcgcacaaaagctggtaggcgcaaacccttttggaaaaatgctgcctgtggatgagttcctgcctgtcatgtacaataagcatccagtggcggagtataaagagtactacgagagtcgcgacctaaaagcctttagtgccgagcccttgctgatttatccgacgcattatacaggccagccgggatacctcagcgacaccgagacgagcaccatttgggataacgaaaccgtcgctacagactgggaccgcactcacgcctggaagagtcgtaaacagagtcgcatttattctaatgccaaaaacacagaagccttaccgccacctactagtcttgacaccgtcccttcaagggatgagctatag

SEQ ID NO: 50590 - DNA, 1092 bp, Artificial Sequence
  Description of Artificial Sequence: Synthetic coding sequence
atgttctctgattgctggttgtgcccgtctctcgggtcgtccggcatccagatgtacctgtgcaacagagaacactatggctatctgccaattcccctcaaaccccaccagaccctgcaggaagatattgaaaacctcattcacgtgcaaattgaggcaatgattgaccggccaccgatggaaccgtcacaatatgtgtcagtggtgccaaaatatccagataaaatgggctttgacgaaatattcatgatcaatctcaagaggagaaaagataggagggacaggatgctacgcacactctatgagcaggagattgaagtgaagatcgttgaagccgtggatgggaaagcactcaacactagccagctcaaggcccttaacatcgagatgctgcccggatacagggatccatactctagtaggccactgacacgcggagagattggctgcttcttaagtcactacagcgtctggaaagaggttatagatcgtgaattggagaaaaccctcgtgattgaagatgatgttagattcgaacaccagtttaagaagaaactcatgaagctgatggacaacattgaccaagcccaactggattgggaattaatatacattggtcgtaagcggatgcaggttaaagaaccggaaaaggccgtgcccaacgtcgcaaatctagtggaggccgactactcatactggactctgggttacgtgatctccttagagggagctcagaagctggtgggtgctaatccttttggcaagatgctgcctgtggatgaatttctgccagtgatgtacaataagcacccggtggcagagtataaggaatactacgaaagcagagatctaaaagcgttttcagcagaacctcttttgatttatccaacgcactacacaggtcagccaggctacctctctgatacagaaactagtaccatatgggataatgagaccgtggcaacagactgggatcggactcatgcctggaagtctcgcaaacaatcccggatatattcaaacgctaagaatactgaagccctcccacctccaacctcactggacacagttccgagcagggacgagttatag

SEQ ID NO: 50591 - DNA, 705 bp, Artificial Sequence
  Description of Artificial Sequence: Synthetic coding sequence
atgctgccagggtatagagacccctatagctcgcgccctctgacccggggtgaaattggatgtttcctctcccattactctgtgtggaaggaagtgatagaccgggaactggagaagacactggttattgaggacgatgttcggtttgagcaccaatttaagaaaaagctgatgaagctgatggacaacatcgatcaggctcagctggactgggaacttatctacattggtcgaaagagaatgcaagttaaagagcccgagaaggccgtgcctaatgtcgccaacttagtggaggctgattactcctactggacactcggctacgtgatatcccttgagggggcacagaagcttgtaggtgcaaaccccttcgggaaaatgctacccgtggacgagtttctgcccgtgatgtacaataaacatccagtcgctgaatacaaggaatattacgagagcagggacttgaaagctttttccgccgagccgttgcttatctaccccacccactacactggccaacccggatacctatcagatactgaaacgtccacaatttgggataacgaaacagtggccaccgattgggatcgcacccatgcctggaagagccgaaagcagagcaggatttatagtaatgccaagaatactgaggctcttcccccacctaccagtctcgacacagtccctagcagggacgagttgtag

SEQ ID NO: 50592 - DNA, 1665 bp, Artificial Sequence
  Description of Artificial Sequence: Synthetic coding sequence
atggcggcaaggccagcagcaaccctggcatggtccctcttgctgctttcttccgcacttttgcgagaaggatgtcgtgcccgatttgtcgctgagcgcgattctgaagacgatggcgaggaacccgtggtgttcccagagtcccctcttcagtcccccacagttctggttgccgtactcgctcgcaatgcagcccacactctgccacatttccttggctgtctggaaaggctggactacccaaaatcaaggatggctatttgggccgctacagaccacaacgtcgacaacaccaccgaaatttttcgcgagtggcttaaaaacgtgcagcggttgtatcactatgtcgaatggagaccaatggacgaaccagagagctaccccgacgaaattggtcccaaacactggcctacaagtcgattcgctcatgtgatgaaactgagacaggccgcactcaggaccgcacgggaaaagtggagcgactacatactatttatcgatgtggacaacttcttgacaaatccccagacgcttaaccttctgatagccgagaacaaaactatcgtagcgccaatgctggaatccagaggcctgtacagcaatttttggtgtggaatcacccctaaagggttctataagcggaccccagactacgttcaaatccgtgagtggaagaggaccgggtgctttccggtgcctatggtgcattctacattcctcatcgacttaagaaaagaggccagtgataagcttacattctatccacctcaccaggactatacctggacattcgatgacatcatagtgtttgctttctcatcaagacaggccggaatccaaatgtacctttgtaatcgcgagcattacggttacctccccattcccctgaagccacaccaaaccttgcaagaggacatcgaaaacctgatacatgtccagatcgaggctatgattgaccgcccacctatggagccatcccagtacgtgagcgtcgtccccaagtatcctgataagatggggttcgatgagatcttcatgatcaacctcaagcgcaggaaggataggcgggaccgcatgctgagaaccctgtacgaacaggagatcgaagttaaaattgtcgaggccgtcgatggcaaagctctgaatacaagtcagttaaaggccctgaacatcgaaatgctcccagggtatcgagatccctactcgtctcgtccgctcacacgcggagagatcgggtgcttcctgagccattatagtgtgtggaaagaagtaatagatagggagctggagaagacgctcgtgatcgaggatgatgttagatttgaacaccaattcaagaagaagctcatgaagctgatggacaacatcgaccaggcacagctggactgggaacttatatatattggcaggaagaggatgcaggtcaaagaacctgagaaggctgttccaaacgttgccaacctcgtggaggctgactacagctattggaccttgggctatgtgatctctctcgagggcgctcagaagctggtgggggctaatccgtttggtaagatgctacctgttgatgaatttctgccagtcatgtataataagcacccagttctgttgtccagtcctcactgtcacctgttccagacactgtctgatgattgccagaggtag

SEQ ID NO: 50593 - DNA, 1050 bp, Artificial Sequence
  Description of Artificial Sequence: Synthetic coding sequence
atggccctgttaagaaagatcaaccaagtgttgctgttcctgctgattgtgacactatgcgtgatcctatataaaaaagtccacaaagggacagtccctaagaatgatgccgacgacgaatcggaaacacctgaggaactcgaggaagagattcctgtggttatttgcgctgcagccggtcgaatgggcgcaacgatggctgctattaatagtatatacagtaatacagacgccaatattcttttttatgtcgtgggcctgaggaacacattgacgcggattcgtaagtggatcgaacactctaagctaagggagatcaactttaaaatcgtggaattcaaccccatggtgctgaagggcaagatccgacctgacagctccagacccgaattactccagcctctgaattttgtgcgcttttacctgcctttgctgattcaccaacacgagaaggtgatatatcttgatgacgacgtcatcgtccaaggcgatatccaggagctgtatgacacaaccctcgccctcggccacgctgccgcttttagtgacgattgtgatctcccctcagcccaggacattaacagactggtggggcttcagaacacctatatggggtatttggactaccgtaagaaagctattaaagatttagggatatccccatcaacctgttcctttaatcccggtgtcattgtggcaaatatgaccgaatggaagcaccaaaggatcaccaagcagttggagaagtggatgcaaaaaaacgtggaggagaacctgtatagctccagcctgggcggaggggtggccacatcccccatgcttattgttttccatggtaagtactcaacaatcaatccgctctggcatatcagacacctcgggtggaaccctgacgcaagatactcagaacacttcctgcaggaggccaagctgctgcactggaacgggcgacataagccatgggacttcccatccgtccataatgatctgtgggaatcttggtttgtgcctgatccagcgggtatcttcaagctgaatcatcattcctag

SEQ ID NO: 50594 - DNA, 1050 bp, Artificial Sequence
  Description of Artificial Sequence: Synthetic coding sequence
atggcccttcttagaaagattaatcaggttcttctgttcctgcttattgtaactttgtgcgtgatcttgtacaagaaagtgcataaaggtactgttccaaagaatgatgctgacgacgagagcgaaacgcccgaggagcttgaggaagagatcccggtggtgatttgtgcagctgccggtcgcatgggcgctacaatggcggctattaatagtatttattcgaataccgatgctaacattctattttacgtcgtgggcctgcggaacactctgaccagaattaggaagtggatcgaacattccaaactaagagagatcaatttcaaaatagtagagttcaatcctatggtattgaaaggaaaaatcagacctgatagctcccgccctgagcttctccagcccttgaacttcgtccgattttacttaccactgctgatccatcagcacgagaaagtgatatacctggatgatgatgtgatcgttcagggtgatattcaggagctttatgataccactctcgctctaggccacgccgctgcatttagcgatgactgtgacctgccaagtgcgcaggatatcaacaggttagtgggcctacagaatacatacatgggttaccttgactataggaagaaggccattaaggatttgggcatcagtccgagcacatgtagtttcaaccctggggtcatagtggccaatatgaccgaatggaagcatcagagaattactaaacagttggagaagtggatgcagaaaaatgtggaggaaaatctctattcgtcatccctaggagggggagtagcaacatcgcccatgctcattgtatttcatgggaagtattccactataaacccgctttggcatatacggcacctcggatggaacccagatgctaggtactccgagcatttcctgcaggaagcgaaactcctacattggaacggacggcacaagccgtgggacttcccttctgtgcacaacgatctctgggagtcatggtttgtgccagatcccgctggcatattcaaactgaaccatcacagctag

SEQ ID NO: 50595 - DNA, 1050 bp, Artificial Sequence
  Description of Artificial Sequence: Synthetic coding sequence
atggccctgctgcggaagattaaccaggtcctcttatttctgttaattgtgaccctgtgcgtgatactgtacaagaaagtccataagggaaccgtgccaaagaacgatgcagatgacgaatccgagacccccgaggagctagaagaggaaattccggtggtgatttgtgccgctgctggcagaatgggtgctacgatggccgctatcaattcaatttactccaacaccgatgcaaatatactgttttacgtggtcggtctgcgcaacaccttaacaagaatacggaagtggatcgagcactccaagctgcgggagataaactttaaaatcgtcgagtttaaccctatggtgctgaaaggcaagatacgaccagattctagccggcctgagctgctgcagccgctgaacttcgttagattttacctgccacttttaatccaccagcatgagaaagtgatttacttggatgatgatgtgatcgtacagggcgacattcaggagctgtatgatacgacgttagccctcggacacgccgcagcattctccgatgactgtgatctcccctccgctcaagatattaatcggctggtgggattgcagaatacttatatggggtacctcgattaccgaaagaaagctattaaggatttgggcatttcacctagtacctgttccttcaaccccggtgtcattgtggccaatatgactgagtggaagcaccagcggattaccaagcaactggagaagtggatgcaaaaaaacgtggaagagaatctgtatagtagctcgctcggtgggggtgtggctacatcacctatgctaatcgtgtttcatggtaagtacagcacaatcaatcctctatggcacataagacacctgggttggaacccggatgcaagatactcagaacactttctgcaggaggctaaactgttgcactggaacgggaggcataagccatgggattttcccagtgtacacaatgacctttgggagtcttggttcgttcctgacccagccggaattttcaaacttaaccaccacagttag

SEQ ID NO: 50596 - DNA, 942 bp, Artificial Sequence
  Description of Artificial Sequence: Synthetic coding sequence
atggcagcgaggagagccctgcattttgtgtttaaagtcggtaaccggttccagaccgccaggttttaccgcgacgttctcgggatgaaagttgagtcatgcagcgttgcccgtctcgaatgcagcggggctataagtgctcactgctccgattacacgcgcataacagaggattcctttagcaaaccatacgatggtaagtggagtaaaaccatggtaggcttcggacctgaggacgatcactttgtggccgagctgacgtataactatggagttggggattataaattgggaaatgactttatgggcattacactggcatctagccaggctgttagcaacgccagaaaactcgagtggcccctgacagaagtggccgaaggggtgttcgaaacggaggcaccaggcggatacaagttttatcttcaaaaccgtagcctgccacagagcgatcctgttctgaaggtgaccttggcggtatccgacttgcaaaaaagcctaaattattggtgcaacctcctcggtatgaaaatttatgaaaaagatgaagagaaacaacgcgcacttttaggctatgcggataatcaatgcaagcttgaactgcaaggagtaaaaggtggtgtggaccatgcggctgcttttgggagaatcgcattcagctgcccccaaaaggaactcccggacctagaggatttgatgaagcgggaaaaccagaaaattctgacccccttagtgagcctagacaccccgggaaaggcaactgtccaggtggtgatcctggccgaccctgacggccacgagatatgctttgtcggtgatgaagcatttcgcgagctgtctaaaatggaccccgagggctccaaactgctagacgatgccatggcagctgataaaagcgatgaatggtttgctaaacacaataagcctaaagcttcaggctag

SEQ ID NO: 50597 - DNA, 897 bp, Artificial Sequence
  Description of Artificial Sequence: Synthetic coding sequence
atggcagctaggcgagccctgcacttcgtttttaaagtgggcaaccgttttcaaactgccaggttttatcgcgacgtcttaggtatgaaggtgttgaggcacgaagagtttgaagagggatgtaaggccgcatgcaacggcccttatgacgggaagtggagcaaaactatggtcgggtttggccctgaggacgaccactttgtcgcggaacttacctacaactacggcgtcggggattataagctggggaacgattttatgggaattactctggcctcctctcaggctgtctcaaatgcacgcaagttagagtggcccctgaccgaggtagccgagggggtcttcgagaccgaggctcccggaggatacaaattctacctccaaaacaggagcttgccacagagcgatccggtactcaaagtaaccctcgctgtgtccgatctgcagaaaagtttgaactattggtgtaatctgttgggtatgaaaatctacgagaaagatgaggagaagcagcgtgcccttctggggtacgctgacaatcagtgtaagctggaactgcagggtgtgaagggcggagttgatcacgctgctgcttttgggcgaatagctttcagttgtccccagaaggagttaccggatctggaagatctgatgaagcgggaaaatcagaaaatcctcaccccactggtgtcccttgatactcctggcaaggcaactgtacaggtggtcatccttgctgatcctgacggacatgagatctgcttcgtcggcgatgaagcctttcgggagctgtctaaaatggatcctgaggggtccaaattgttggacgacgccatggctgctgataagagcgacgagtggtttgcaaaacacaataagcctaaggccagtggctag

SEQ ID NO: 50598 - DNA, 1506 bp, Artificial Sequence
  Description of Artificial Sequence: Synthetic coding sequence
atgcggttaactccattctctctctctaccggaaatagcttcaggtactctcgccgtctgaaaaaaaatatattcggtactgcccctgctctgcgcgcatcagaaatgtcactgcgtccctcttctagaattttcccttgcttttcccgcaatgggctggatttcaccattgtgatcaccttactgcagccaccggttcctgggatctccttcatcgtggctaagcccaggcttttcccaggagccggttctgccggttgtgggctgctggagcggctcttcttatccctcctcctaggaaccggcctgcggtggtgtagaggatgcttccccggagccagattctgctccactacatctccagaaggtaacactacctttacaggactaaggcggtcagcgcgaacccaaagacttcagggcccaaaaccaggaccacccgcagcaaccgtcgctcggcagacatcacgtgttagcccagcccctccttgctccttgagaccgggactgcgccatgaatcagcaccctcggccgctagcgatgtcaccgctaggggggctctccgcggtcttggctgcactgtaagagtcaccgccgcttgcgggggtaaccacgggtgttctcaacttcatttcgtctttaaagtgggtaaccggttccagacagccaggttttatagagatgttctcggcatgaaggttttacggcacgaagaatttgaggaaggatgtaaggctgcctgtaacggcccttacgacggaaaatggagcaaaacaatggtggggtttggcccagaagacgatcattttgtcgctgagcttacatataactacggtgttggtgattacaagctgggcaatgactttatgggcatcaccttagcttcatctcaggccgtcagcaacgcacgcaaactggagtggcctctgaccgaagtggcggagggagttttcgagaccgaagctccaggtggctataaattttacttgcaaaaccgaagcctcccacagagtgatccggtgctgaaagtgaccctcgctgtcagtgatttgcagaaaagcctgaactattggtgcaatcttttaggcatgaaaatctatgagaaggatgaagaaaagcaacgtgccctgctcggatatgccgataaccagtgtaagctggaactccagggcgtcaaaggaggggtcgaccatgcagccgcttttggtagaattgcattctcatgcccacaaaaagaactacctgatctcgaagaccttatgaagagagagaaccagaaaatcctgactccattggtaagtctcgacactcccggaaaggcaaccgtacaagtggttatcctggccgaccccgatggacatgagatttgttttgtcggcgatgaagcctttagagagttgagtaagatggatcccgagggctccaagctcctcgacgatgcaatggccgcagataagtccgatgagtggttcgccaaacacaataaacctaaagctagcggatag

SEQ ID NO: 50599 - DNA, 870 bp, Artificial Sequence
  Description of Artificial Sequence: Synthetic coding sequence
atgcgcaacctaaagaaagcagcgaagctgcccgtcatgggcatgataccctgctttctgaaatcccccctgggctcggactataccaggataacagaggatagcttttcaaaaccatatgacggaaagtggagtaaaacgatggtgggcttcggccctgaagatgaccactttgtggcagaactgacatacaactatggcgtcggcgactataaactgggcaacgatttcatgggcattaccttagcttcctcacaggccgtttccaatgctagaaaacttgagtggcccttgaccgaagtcgccgagggagtgtttgaaacggaggcccctgggggatacaagttctacctccagaatagaagcctgccccagagtgatccagttttaaaagtcacgttggcagtgtccgacctccagaagtctctcaattactggtgcaacttactcggtatgaaaatatatgagaaggatgaggaaaagcagcgggctctgttaggttatgcagacaaccaatgtaagttagaactgcagggcgtgaagggaggcgtggaccatgcagccgctttcggcaggatcgccttttcatgtccacagaaagagctgcctgacttggaggatctgatgaagagagagaatcagaaaatcctgaccccacttgtgagcttagacactcctggcaaggccactgttcaggtggtgattctggctgaccctgatggccacgaaatctgcttcgttggcgacgaagctttccgcgaactgagtaaaatggacccggaagggtcaaaactgcttgacgatgctatggccgcagacaagtctgatgaatggtttgccaagcataacaagcctaaggcttcaggatag

SEQ ID NO: 50600 - DNA, 5849 bp, Artificial Sequence
  Description of Artificial Sequence: Synthetic coding sequence
atgggcaattcctatgctgggcagctgaagacaaccagatttgaggaggttctccataactccattgaggcctcattgcggtcaaacaatctcgtgcctcgtccaatcttctcccagctgtaccttgaggccgaacagcaattggcagctctcgaggggggaagccgcgtcgacaatgaggaggaagaagaggaaggggagggtggactggagaccaacggtccgcctaatcccttccagcttcatcctcttccggaaggttgctgcacgacagacgggttctgtcaggctggaaaggatctgcgtctcgtgtctatttccaacgaacctatggacgtacccgcaggattcctgctggtcggagtgaagtccccgtcgctccccgatcacctgcttgtatgtgcagttgataagcggttcctgcccgatgacaatggacataatgctttgctgggtttctccggaaactgtgtggggtgcggtaagaagggattctgctacttcacggagttttccaaccacattaacctgaaacttactacacaaccaaaaaagcagaaacatctcaagtattatttagtgcggaatgcccagggcacattaacgaaaggtccattgatttgttggaaagggtccgagtttagatcaagacaaataccagctagcacgtgctcttcaagcctgttcccagctctagaaagtacagcagccttcccgtccgagcctgtgcccggaactaatccaagtattcttatgggagcacagcaggccggtcctgcctcggatcacccctcattaaatgcagccatgggccctgcagtgtttaacggaaaggactcaccaaaatgccaacagctggccaagaataacctgctagctctgcctcgccctagcgccctgggtatacttagcaatagtggaccaccaaagaagagacataaaggctggtcacccgagtcaccaagtgctcctgacggcggttgtccccagggcggtggaaatagggccaagtatgaatctgctggcatgagctgtgttccccaggttggactggtggggccagcatcggtgacatttcccgttgtcgcctccggcgagcccgttagtgtccccgacaatctgctgaagatatgcaaggctaaaccagtgatctttaagggccacggcaatttcccctacctgtgtggcaatctgaacgacgtagtcgtatctcctctactgtacacctgttaccaaaacagtcagagcgtgtcgagagcatacgagcagtacggtgcttctgcaatccagcctatttcagaagaaatgcaacttctcctaaccgtatattatcttgttcagctcgccgcagaccaagtgccactgatggaagacttggagcagattttccttcgatcctggcgggaatcacacctcactgaaatccggcaatatcaacaggcccctccccagcctttcccccctgctccatcagcggctgcccctgtcacaagcgcacagttgccctggttagcctccctggcagcttcaagctgcaatgactctgtccacgtgatagagtgtgcttacagtctcgcagagggcctgagcgaaatgtttagactactggtcgaagggaagctggcgaaaactaattacgttgtcattatctgtgcctgtcggagcgccgctatagacagctgcatcgcagtgactggaaagtaccaggcgcgaattctgagcgaaagcctcttgacgccggctgagtatcagaaggaggtcaactacgagctggtgaccggtaaggtcgactctcttggggcttttttcagcaccctgtgcccagaaggcgatatagacattctcctggacaagttccaccaggagaatcagggccacattagttccagcctggctgcctcctcggtcaccaaagccgcttccctggatgtgtcaggcaccccagtctgcacaagctataatctggaaccacactctatacgccctttccagctggcagtggctcagaagctactgtcacacgtgtgttctattgctgacagttctacccagaacttagatttagggtcgtttgagaaggtagatttcctgatctgtattccaccgagcgaggtaacctatcagcagactctgctacatgtgtggcatagcggtgtgctgctggagctgggccttaagaaggaacacatgacaaagcaaagggtggagcaatatgtgttaaagcttgataccgaggcccagacgaaatttaaggccttcctgcagaactcattccagaaccctcatactctgtttgtactcatccacgaccatgctcattgggacctggtgtcttctacggtacacaacctctatagccagtctgacccaagtgtaggcctcgtcgatcgtctcctgaactgccgcgaagtcaaagaggcgcctaatattgtaacactccacgtaacaagttttccttacgccttgcaaacccaacacaccctgattagcccatacaatgagattcactggccggcatcctgctccaacggagtagatctgtatcacgaaaacaaaaaatacttcggactctcagagtttattgaatcaacactgtccggccactcactaccactgctcagatacgacagctcttttgaagcgatggtgaccgccctggggaaacgatttcccaggttacactccgcagtaatacgcacgtttgtgctggtacagcattatgccgcagctcttatggccgtgagcggacttccacagatgaaaaactacacctctgtggaaacccttgagattacacagaaccttctgaacagccccaagcagtgcccctgcgggcacgggctgatggtgctcctgcgggtgccttgttcccctctcgcagtcgtggcctatgagcgattggcccatgtccgcgcacgactggctctggaggagcatttcgagataattctggggtcaccatcttccggtgtgaccgttgggaagcattttgttaagcaacttcggatgtggcaaaagattgaggacgttgagtggaggccccagacctacctagagctggaaggactgccgtgtatcctgatttttagcggcatggacccacatggggaatcactccctcgcagtctgcgatattgcgacctgaggcttattaattcttcttgcctcgtgaggacagccctcgagcaagagctgggactcgctgcctactttgtgtcaaatgaggtgcctctcgaaaaaggagcgaggaatgaagctctcgaatccgacgccgagaaactaagttccactgacaacgaggacgaagaactcggtactgaggggtccacatcagagaaaagatcgccgatgaagcgcgaacgctcccggtctcacgatagtgcgtcttcgagcctgtcctctaaggcttcgggaagcgctttagggggtgaatcctccgcacagccgacggctctgccccagggcgagcacgccagaagcccccagcccagaggacccgctgaagaggggagggcacctggcgaaaagcagcgccctcgagcttctcagggccctccgtccgctatctccaggcacagtccaggaccaacgccgcaacccgactgctccctgcgaaccggccagaggagtgtgcaggtgagcgttactagttcttgctctcaactgtcctccagcagtggctctagctcctcatctgtggcacccgctgccggtacctgggtgctccaggcttcacagtgttccttgaccaaggcctgtcgacagcctcccatcgtctttctgcccaaactggtctatgatatggtcgtgtctaccgatagctccggcctaccaaaagcggcatcattgctgccgagccctagtgttatgtgggcgtcctcctttcggcctctattgagtaaaactatgacttctacagaacagtctctgtactatagacagtggacagtcccacgcccatcccatatggactacggcaaccgcgctgagggcagggtcgacgggttccatcccaggcgtctcttgttgagcgggccaccacagattgggaaaacaggcgcttacttgcaattcctgagcgtgctgtcacggatgctcgttaggctgaccgaggttgacgtgtacgatgaagaggagattaatattaatctgagggaagaaagtgactggcactatctccagttgtcagacccttggccagacctggagctatttaaaaaacttccttttgattatattatacatgatccaaagtatgaagacgcctctctaatatgctctcactaccaaggaatcaagagcgaggacaggggcatgtctcgtaagccagaggatctttatgtgcgtaggcagacagccaggatgcggttgtctaagtacgccgcatacaatacataccatcactgtgaacagtgccatcaatacatgggtttccaccctcgataccaactgtatgaatctacactgcatgcctttgcgtttagctactctatgttgggtgaagaaatccaactgcactttatcatccctaaaagcaaggaacaccactttgtctttagccaaccaggcggtcagctggagtctatgagactacctctagttaccgacaaatcccatgaatatattaagagtcccactttcactcccaccactgggaggcacgagcatggacttttcaatctgtatcacgccatggacggagccagtcacctgcacgtactggtcgtgaaggaatatgagatggctatttacaagaagtactggcctaatcacattatgttggtcctgccatccatattcaattcagcaggtgttggcgcagctcactttctcataaaggaactgtcctatcacaatttagaactggaacggaatcggcaggaggaactcggaattaaaccccaagatatctggcccttcatcgtcataagtgacgacagctgtgttatgtggaatgtggtagacgtaaacagcgccggagagagatccagggaattttcctggtccgagcggaatgttagccttaaacacatcatgcaacacatcgaagcagcacccgatatcatgcattatgctttgctgggtctgcggaaatggtcatccaagacccgagcctccgaggtgcaggaacctttttcccggtgtcatgtccacaatttcattatcttgaacgtggacctcacacagaatgtgcagtacaaccagaatcggtttctatgcgacgatgtggatttcaaccttcgggtgcacagcgcaggtttgctactctgtcggttcaaccgatttagcgtgatgaagaagcaaattgtggtcggcggtcaccgatcattccacattacctcaaaagtctccgacaattccgcagccgttgtgcccgctcaatatatctgtgcaccagatagcaaacacacattcctggcagcaccagcccagcttttgctagagaagttcctgcagcaccattcacaccttttcttcccattatctttaaaaaaccatgatcatcccgtattgtctgtggattgttatctgaatcttggctctcagatctccgtgtgctacgtgagctcccgtccacactcactgaacatttcctgttctgacctgttgttctcaggactgctcctgtatctctgcgattctttcgtcggcgcaagtttcctgaaaaagttccatttcttgaaaggggcaaccttgtgtgttatttgccaggaccgctcttcattacgccagacagtagttaggcttgaacttgaagacgaatggcagttcaggcttcgggatgagttccaaaccgccaacgctagagaggataggcccctcttcttcctgacagggaggcacattta

SEQ ID NO: 50601 - DNA, 1395 bp, Artificial Sequence
  Description of Artificial Sequence: Synthetic coding sequence
atgcgtgagggaagtagcacgctgtcagagattaggaaactcaagcctggtatcatggtctgcacctgcaatccatcttattctaaccaagagactgaggttcaagaaaactcgcccggacatcgggcaggtctcgaacctttcttcgactttatcgtgagcataaatggttctcgactcaacaaagacaacgacacgctgaaggatctattaaaagcaaacgttgagaagccggtgaagatgttgatatatagcagtaaaaccctggagctcagagagacctcggtcacaccatccaacctatggggcggacaggggctccttggggtgtccattcgtttctgcagtttcgacggtgcaaacgaaaacgtgtggcatgtgctcgaagtcgaaagcaactctccagctgccctggcagggctgaggccgcacagcgactatataatcggagccgacaccgtgatgaacgagtccgaggacctgttttccctcatcgaaacccacgaggccaagccgttgaaactgtacgtgtacaatactgatacggataactgcagagaagtgataataacaccgaacagcgcgtggggcggagagggctcactgggctgcgggattggatacggatacttgcatcgcatccccaccagacccttcgaggaagggaagaagatttccttacccggacagatggctggaacccccattacacctctcaaagatggctttactgaagttcagttatcttccgtgaatccaccttccctgtctcccccaggtacaactggcatcgagcagtctctgacaggtctaagcatctcttctactcctcccgcagttagctccgtcctgtcaactggcgtacccacagtgccgctgctcccaccccaggtaaatcaatcccttacgagcgtgccgcctatgaatcctgccactaccctcccaggcctgatgcccctgccagccggattgcccaacctgcccaacctcaacttgaatctgccagcaccgcacattatgcccggtgtgggactccctgagcttgtgaaccccggactgccgcctttgccaagtatgcctccacggaacctgcccggaatagcacctttgccgttaccaagtgaattcctgccttcatttcctttggtgcctgaaagtagcagcgcagccagctcaggggagcttctaagttccctccccccaaccagcaatgctccgtcagaccccgcaacaacaactgcaaaggccgacgccgctagctcactgacggttgatgtgaccccccctacggccaaagctcctactacggtcgaagaccgggttggggactccaccccggttagtgaaaagcccgtgagtgctgccgtggacgccaacgcttctgagtcaccatag

SEQ ID NO: 50602 - DNA, 399 bp, Artificial Sequence
  Description of Artificial Sequence: Synthetic coding sequence
atgatttctattacggagtggcagaaaatcggcgtggggatcacgggttttgggatcttctttatcctgttcggtacactcctgtatttcgactcagtgctgttggcttttggtaacctgctgtttctgacaggtttatcattgatcatcggtcttagaaaaaccttttggtttttttttcagagacataaactgaagggcactagctttctgctgggcggagtggtgattgtcctgcttcgctggccactgctgggcatgttcttggagacctacggattttttagcctgtttaagggatttttccccgttgcattcggattcctcggcaacgtatgcaacattccttttctgggtgccctgttccgacggctccagggcacctcttccatggtgtag

SEQ ID NO: 50603 - DNA, 918 bp, Artificial Sequence
  Description of Artificial Sequence: Synthetic coding sequence
atgtcagtggatccagcatgtcctcagtccctcccatgcttcgaagccagcgactgtaaggagtctagtccaatgcccgtgatctgcggtccggaggaaaattatcctagcctgcaaatgagcagcgctgaaatgccccatactgagactgtcagtccacttccatcgagtatggacctgctcatccaagactctcctgatagctctacgtctccgaagggaaaacagcctacttcagccgagaagagcgtggccaaaaaggaggacaaggtgcccgttaagaagcagaaaacacgaaccgttttcagctccactcagttgtgtgtcctgaacgaccgctttcaacgacagaagtatctctcactccagcagatgcaggaactgagtaacatcctgaacctgtcatacaagcaggtgaaaacctggtttcagaatcagcggatgaagtccaagcgttggcagaagaacaactggcccaagaactctaacggtgtcactcagaaggcctccgctccaacgtatcccagtctctatagctcataccaccagggatgcctggtgaaccctaccgggaatctcccaatgtggagtaaccagacctggaacaactcgacttggagcaaccagacccagaacatacagtcatggtcgaatcacagctggaacacacaaacatggtgcacgcagtcttggaataaccaagcgtggaacagcccattctacaactgtggcgaagagtccctccagagctgtatgcagtttcagcctaatagcccggcttcggatcttgaggccgcactcgaggcggctggagaaggtcttaacgtgattcagcagacaacccggtacttcagcactccacaaactatggacctgttcctgaactactccatgaacatgcagcctgaagatgtatag

SEQ ID NO: 50604 - DNA, 1842 bp, Artificial Sequence
  Description of Artificial Sequence: Synthetic coding sequence
atggctgctacggccgttgcggctgcggtcgccggaaccgagagcgcccagggccctcctggcccagcagcatctctagaattgtggctcaacaaagccacagatccgtctatgtctgagcaggattggtcagctatccagaatttctgtgagcaggtgaatacggatccaaacgggcctacacatgctccttggctgctcgcccataagatccagtccccgcaggaaaaagaggccctgtatgccttaacagtgctggagatgtgtatgaatcattgcggagagaaattccacagcgaggtggccaagttcagattcctcaatgaattaatcaaagtcctatctcccaagtacctcggcagctgggccactggtaaagtgaaaggtagagtcatcgagatcttgtttagttggaccgtgtggttccccgaggacatcaaaatcagggacgcgtaccagatgctaaaaaaacaaggtattattaagcaggatcctaaactacccgttgacaagatcctgcctccccctagcccttggcctaagtccagcatctttgacgccgacgaagagaagagcaagctgctaactagattgttaaagtcaaaccacccagaggacctccaggccgcaaaccgtctcattaaaaacttagttaaggaagaacaggaaaagtccgagaaagtgagcaagcgtgtgtccgctgttgaggaagtgcggagtcacgtgaaagtcctgcaggaaatgctctcaatgtaccgtcgccctggtcaggctccacccgaccaggaggcactgcaggttgtctacgaacgatgcgagaagttaagaccaaccctgttccgcctggcatccgatacaacggacgacgacgatgctcttgccgagattctgcaggccaacgacttactgacacaaggcgtgctgctttataaacaagtgatggagggccgtgtgactttcgggaatagggtgacatcatccctgggcgatatccccgtgtcaagagtttttcagaatccagccggatgcatgaagacttgtccgttgattgatcttgaggtcgacaatggacctgcccaaatgggcacagttgtgccttcactgctgcatcaggatctggccgctctgggtatcagcgatgctcctgtgacagggatggtctccggccagaattgctgtgaagagaaaagaaatccttcaagcagcacccttcctggaggcggagtgcagaacccctctgctgacaggaatcttctggacttactatctgcgcagcctgccccttgtccccttaactacgtttcccaaaaatccgtgcccaaagaggtcccacccggtaccaaatctagccccggatggtcctgggaagcgggacccctcgcccctagccccagcagccagaatacacccctggcacaggtgtttgtgccactggaatcagttaaaccatctagtttacctcccctcattgtgtacgataggaacgggttccgaatcctacttcatttcagccagactggtgctcctggtcatccagaggtccaggtcctgctcctgactatgatgagcacagcgcctcagccagtctgggacatcatgtttcaggtcgccgtcccaaagtcaatgagggtcaagctgcagcccgcttcatccagtaaactgcccgctttctcaccactaatgccccctgcagtcatcagccaaatgctcttgttggacaatccccataaggagcccatcagactgcggtataagctcactttcaaccaaggtggccaaccgttctccgaggttggcgaggtgaaggactttccagacctggcagtcctaggcgcagcttag

SEQ ID NO: 50605 - DNA, 522 bp, Artificial Sequence
  Description of Artificial Sequence: Synthetic coding sequence
atgacattttccaaactcctaatttgtctcgacttcttggatgtgctcgagcggatgggcgtagctctattatttatttggaagcaggttgagctgctgcttggcataagcctctattcatttctgacgggtatcagtgacgcaccagtgacaggtatggtacgaatgccctttcccggtccaggagagcgaatgggaggaagtcaaacctgcccatgcgaggccgcacttcctggtgagcagcggggagcccctgccctctccagatgggaccatgggctggggggacccaaacccctgccacatccatattgcctggccgacacctggggtcgtcaggtcgccccaggtagttgcttccttgaagtatgtccaggtgccgcttgcgacttagctctctcctttccgtcgtgtcccaagcgttgccaccagagtggcccacagcagctgggctgggcccaggaatcttgtgctctggtgctgctttggcttatggttatccacacactggttctgttctag

SEQ ID NO: 50606 - DNA, 861 bp, Artificial Sequence
  Description of Artificial Sequence: Synthetic coding sequence
atggccgtgccgcaacctatgcctagcatcccggaggatctagagtcccgcgaggccatggtggcgttctttaatagcgcagtggcttccgctgaagaagaacaagcccgactgcgaggccagctgaaagaacagagagttcgttgtcggcgactcgcacatctgctagcaagcgcccaaaaggagcccgaggccgctgccccagcaccgggaaccggcggagattctgtctgcggagagacccaccgagcccttcaaggcgcaatggaaaagcttcagtcccggtttatggaactgatgcaggagaaagctgacctaaaggaaagagtagaggaactcgagcataggtgcatacagctgtccggcgagaccgataccatcggtgaatacattgcactttatcaatctcagcgggcagtgctgaaggagaggcaccgggagaaagaagagtatatatcccgactcgctcaggacaaagaagaaatgaaagtcaagctgctcgagcttcaggaactggtcctgcgattggtcggagatagaaatgagtggcacggacgctttctagcagcagcccagaatcctgcagatgagcccacttctggtgcccctgcccctcaagagctcggcgcagccaaccaacagggtgacttatgtgaggtgagcctcgccggttcagtcgaaccagcacagggcgaggctagggagggctcgcccagagataacccaactgcacagcagattatgcagctgctgcgcgagatgcagaatcccagggagagacccggtcttggatcaaacccctgtatcccctttttttacagagcagatgagaacgacgaagtcaagattactgttatctag

SEQ ID NO: 50607 - DNA, 3009 bp, Artificial Sequence
  Description of Artificial Sequence: Synthetic coding sequence
atgtggccacagccacggctgcctccacgtcccgcaatgtcagaagaaactcgccagagtaagctagctgctgctaagaagaagctcagagagtaccagcaaaggaacagcccaggcgtgcctacaggggcaaaaaagaaaaaaaagattaaaaatggatcaaatccggaaacgactacaagcggtggctgtcacagtcccgaagacaccccaaaggacaatgcagctaccctgcagccctcggacgatacagtgctgcctggtggtgtgccgagcccaggagcatcactaacatccatggccgcttcacagaaccacgacgcagacaacgttcctaatctgatggatgagacgaagaccttctctagtacagagagcttgcgccaactgtcccagcagctcaacgggctcgtctgcgaaagtgctacctgtgtgaatggagagggaccagcttcatccgctaacctgaaggatctggagtcaaggtaccaacagctggcggtggctctggactcctcgtacgtaacaaacaaacagttaaatatcacaatagagaagctgaagcaacaaaaccaggaaatcacggaccaactcgaagaggagaaaaaggaatgtcatcagaaacagggagctctgcgagagcaactgcaagtccatattcagacgattgggatcctggtgagcgagaaagccgagctccaaaccgcactcgctcatacacagcacgcagccaggcaaaaagagggagaaagcgaggacctggctagccggctgcagtattctcgtcgccgagtgggagagttagaacgggctctcagcgcggtgagcacccagcagaaaaaggctgataggtataacaaggaacttaccaaagaacgagacgccttgagattggaactgtacaagaatacgcaatcaaatgaggaccttaagcaagaaaaatctgagctggaagaaaaactacgcgtcttggtgacagagaaggcaggaatgcaactgaatcttgaagaactacaaaaaaagctggagatgacagagctccttttgcagcagttttctagcaggtgcgaagcacctgacgcgaaccagcagctccaacaggctatggaggagagagcccaactggaggcccacttgggccaggttatggaatccgtaaggcagctgcaaatggagcgtgacaagtacgctgaaaacctgaagggtgagtccgccatgtggagacagcgcatgcagcagatgtccgagcaggttcatacactccgggaggagaaggagtgctctatgagcagagtgcaggaacttgagacctctctggcagagctcagaaaccagatggctgaaccccctccaccggaacctcctgctggcccatcagaagtggagcagcagctgcaggccgaagctgaacacctgcggaaagagcttgagggacttgcagggcaactgcaggcacaggttcaggataacgaggggctgagtaggctcaaccgggagcaggaggagcggttgctcgagcttgagcgggctgcagaactctggggtgagcaggccgaggcccgacgccaaattcttgagaccatgcagaacgatagaacaactattagtcgggcactgtcacaaaaccgcgagttgaaggaacagttggccgaactccagagtggctttgtaaaactaactaatgagaatatggagatcacatccgccctgcagtccgaacagcatgtgaaacgtgagctcgggaagaagctgggggagctccaagaaaaattgtctgaactaaaagagaccgtagaactgaagagtcaagaagcccaatctctgcaacaacagagggaccagtatctgggccatcttcagcagtatgttgctgcatatcaacaattgacgtccgaaaaagaggtgctgcacaatcagctcttgttacaaacacagcttgtcgatcagctgcaacagcaagaagcccaaggaaaagccgtcgccgagatggctcgacaagagttgcaggaaacccaggaacggctcgaggctgccacacagcagaatcaacaattgcgcgctcaactctctctgatggcacatcctggcgaaggagacggactggatagagaggaggaggaagatgaagaggaggaagaggaggaggctgtggcagtgccccagcctatgccctctatcccagaagacctggagagccgcgaagctatggtcgcctttttcaattctgcagttgccagcgctgaggaagagcaggcgagactccgcggacagctaaaagagcagcgggtgcgctgccgcagactggctcacctgctggctagcgcccagaaggaacccgaggccgcagctccagcacctggaactggaggtgattccgtctgtggagagacacaccgggcactacaaggggctatggagaagttgcagagccggttcatggagctgatgcaggagaaagcggacctgaaggagagagtagaagaactggagcaccggtgtattcaactgagcggtgaaactgacacaattggagagtacattgcactctatcaaagccagcgagccgtgctgaaggagcgccacagggagaaagaggagtacatttcgcgactggcacaggataaagaggagatgaaagttaagctgctcgagcttcaagaactcgtgctgcgattggtgggagaccgcaacgagtggcacggacgttttctggcagccgctcaaaaccctgcagatgaacctacgagcggcgcaccggctccacaagagctcggcgctgccaatcagcagggggacttatgtgaagtgtcactggctggatcagtcgagccggctcaaggtgaagccagagagggctcacctcgggataatccaacggcccaacagattatgcagttgttacgagaaatgcagaacccacgggagcgtcccggtctcgggagcaatccatgcataccttttttctatcgagctgacgagaacgatgaagtgaagataaccgtcatatag

SEQ ID NO: 50608 - DNA, 1422 bp, Artificial Sequence
  Description of Artificial Sequence: Synthetic coding sequence
atgtggccacagccccgactacctcctcgaccggctatgtccgaagagaccagacagagcaagttggccgctgccaagaaaaaacttagagagtaccagcagagaaattctccaggggtgcccacaggcgctaagaagaagaagaaaatcaagaacggcagcaacccagaaacaaccacatctggcggttgtcatagtccagaagatattcaggatatccttaaggtcttggtatcagatctaaatcggagcaatggggtagcactcccccctctggataagtggaagacacccaaagataatgccgctacgctccagcctagcgatgacacagttttgcctggcggagtcccttctccgggagcttccctgacgagtatggccgcatctcagaaccacgacgcagataacgtgcctaacctcatggatgagacaaaaacattttcctccactgaatcattgaggcagctgagccagcagctgaacggcctcgtctgcgagtcagcgacttgtgtaaacggcgaagggccagctagcagcgccaacctcaaggatcttgagagccgataccagcagctcgcagtggctctggacagttcctacgtgacgaataaacagctaaatattaccatcgaaaagttgaagcagcagaatcaggaaattactgaccaactggaagaagaaaaaaaagagtgccaccagaaacaaggtgctctgcgcgaacagctgcaggtccatattcagacaattggaatcctggtctctgaaaaagccgaactgcagaccgctctggcccacactcagcatgccgcacggcagaaggaaggtgaatcagaggatttggcatccagactgcaatattcaaggagaagggtgggtgaactggaacgcgcattgtccgctgtatctacgcagcagaagaaggccgataggtataataaggaactgacaaaggagcgcgatgcactccggttggaactctacaaaaacactcagtcaaacgaggaccttaaacaggaaaagagcgagctggaagagaaattacgggtgctcgtaactgagaaagccggaatgcagctcaatcttgaggagctgcagaagaagttagagatgactgaactcctgctgcagcagttttcaagcaggtgcgaagcaccagatgccaatcaacagcttcaacaggctatggaagaacgggcacagctggaggcccacctgggccaggtaatggagtcagtgcggcaactgcaaatggagcgggataaatacgcagagaatttgaaaggcgagtctgccatgtggcgtcagagaatgcagcagatgagtgaacaggttcataccctgagagaggaaaaagaatgttcaatgagtcgtgtgcaggagctggagacctccttagccgagctgaggaatcagatgtag

SEQ ID NO: 50609 - DNA, 414 bp, Artificial Sequence
  Description of Artificial Sequence: Synthetic coding sequence
atgaggccccagcaagccccagtgagtggcaaagtgttcatacagagggactattcttcaggcacaagatgccagtttcagaccaagtttcctgctgaactggagaatcgcatcgataggcagcaattcgaagaaactgtccgaactctcaataatctctacgcagaggctgaaaaactgggtgggcagtcctacctggagggatgtcttgcgtgcctgaccgcttacactatcttcctctgtatggagacccattatgagaaagtgttaaagaaagtatctaagtatatccaagagcaaaacgaaaagatatatgctccacagggactgctgctcactgacccaatcgaaaggggcctcagggttatcgaaattacgatctatgaggatcgcggaatgagcagcgggaggtag

SEQ ID NO: 50610 - DNA, 405 bp, Artificial Sequence
  Description of Artificial Sequence: Synthetic coding sequence
atgcggccacaacaagcccctgtgagcgggaaggtgttcatccagcgagactattcttccggcactcgctgccagtttcaaactaaattcccagctgagctggagaacaggatcgaccgccagcagttcgaggagacggtgagaaccctgaacaacttatacgctgaagcagagaagctgggtgggcagagttaccttgaagggtgtctcgcctgcttgacagcgtacaccatttttttatgcatggagacccactatgagaaggtcctgaaaaaagtgagcaagtatattcaagagcagaatgaaaagatctatgcgccacagggacttttgctgacagacccaatcgagaggggcctgcgcgtgtttaggcttaagctcccattcatgaaaactgaggcctag

SEQ ID NO: 50611 - DNA, 414 bp, Artificial Sequence
  Description of Artificial Sequence: Synthetic coding sequence
atgaggccccagcaggcaccagtgtcaggcaaggtgtttattcagcgggactactccagcggaacccgttgccaatttcagactaagtttccagctgaactggagaaccgaatcgaccgccagcagtttgaggagaccgtgaggacactgaacaacctgtacgctgaagcagaaaaattgggaggtcagtcttaccttgaagggtgcctggcttgtctcaccgcctacacaatctttctatgcatggagactcattatgaaaaggtgcttaagaaagtgtctaagtatatacaggagcaaaacgaaaaaatatacgcaccacagggcctcctccttacagacccgatcgaacgtggactccgagtaatcgagatcaccatttacgaggaccgaggcatgagcagtggcagatag

SEQ ID NO: 50612 - DNA, 414 bp, Artificial Sequence
  Description of Artificial Sequence: Synthetic coding sequence
atgagaccacagcaggcgcctgtcagcggaaaagtcttcatccagcgggactacagctcgggcacacgctgccagtttcaaacaaaattccctgctgaattagaaaacagaattgaccgacagcagtttgaagaaacagttcggacgcttaataacttgtatgctgaggcggaaaagctagggggacagagctatctcgaaggttgcctggcctgtctcacagcatacaccatctttctatgcatggagacacactatgagaaagtcctcaaaaaagtttccaaatatattcaggagcagaatgagaaaatctatgctccccagggcctcctccttacagatcccattgaaaggggactcagggtcattgagatcaccatctatgaagataggggaatgagcagtggcagatag

SEQ ID NO: 50613 - DNA, 501 bp, Artificial Sequence
  Description of Artificial Sequence: Synthetic coding sequence
atggatgatcaacggtgtccactggatgatggtcaggccggtgccgcagaggccactgccgctccaaccctcgaagataggatcgcacagccatctatgaccgcctcgccccaaactgaggaattcttcgacctgatcgcatcatcccagtctaggagattggatgaccagcgcgctagcgtaggttccctgccgggtttgaggattacgcattccaacgcgggacatcttagaggacacggcgagccgcaggagccgggagatgactttttcaacatgctgatcaagtaccagtcgagccggatcgacgatcagcgttgtcctccccctgatgtcttgcctcggggtccaacgatgcctgacgaagacttctttagtctgattcaacgcgtacaggccaagcgcatggacgagcaaagggtagacttggctggtggaccagagcagggcgcaggaggccctcctgaacctcaacagcagtgccagccaggagccagctag

SEQ ID NO: 50614 - DNA, 1959 bp, Artificial Sequence
  Description of Artificial Sequence: Synthetic coding sequence
atggaggcctcctgcctcgagctggccctggaaggggaaaggctgtgtaaggcgggtgactttaagacaggggtggccttcttcgaggcagccgtgcaggtgggcacggaggaccttaaaaccttgtctgccatctattcacagctcggaaacgcgtatttttacttgaaggagcatggcagagccctcgagtaccacaagcacgacctcctcctcgcacgtacaatcggtgacaggatgggggaggcgaaggcgagcgggaacctcggaaacaccttgaaggttctgggcaggtttgatgaagcagctgtgtgctgccagaggcacctgtctatcgcccaggaacagggtgacaaggtgggcgaagccagagcactgtacaatataggtaacgtttatcacgcaaaagggaagcagctatcctggaacgccgcaaatgcgacccaggacccaggacacctacctcctgacgtgcgggaaacactgtgcaaagcttcagagttttatgaacgaaatctgtcgctagttaaggagctgggtgatcgggcagcccaggggcgagcctacgggaaccttgggaacacccactatctcctgggtaacttcactgaagccactaccttccacaaggaacgcctggctattgccaaggaatttggtgacaaggctgctgagcgcagagcctattccaatctggggaatgctcatgtgtttctcggacgattcgatgtcgctgctgaatactacaagaagactctgcagctctccaggcagttacgagatcaggccgtcgaagctcaggcttgctattcgctgggcaacacgtatactttgttgcaagactatgagcgcgctgccgaatatcaccttcggcacctgttaattgctcaggaacttgctgatcgcgtaggggagggacgggcatgctggtctcttggtaatgcatacgtgtcgatgggaagaccagcccaggccctgactttcgccaaaaaacacctgcagatatctcaagagataggcgatcgacatggagagctgaccgctcgcatgaacgtggcacagctgcagttggtgttgggcaggctgacgtctccggctgcttctgagaagcccgatctggctggctacgaggcccagggtgccagaccaaaacggacccaacggctgtccgccgagacttgggatctgctgcgccttcctctggaacgggaacaaaacggcgattcccatcattcaggcgactggcggggtccttctagggattcactgcctctgcccgttaggtccagaaagtatcaggaaggtcccgatgccgagagaaggccacgggaaggatcccactccccactcgattccgcggatgttcgcgtccatgtgcccagaacgagcattcctagggccccatccagcgacgaagagtgcttcttcgatctcctgactaaatttcagtcttccaggatggacgaccagaggtgtcccctggatgacggccaggctggcgcagccgaagctacagcagccccaacgctggaagacaggatagcccagcctagtatgaccgcatccccccaaactgaggagtttttcgaccttattgcgagcagtcagtcgagaagacttgatgatcagagagcgagtgtggggtcacttcctggccttcggattactcacagtaacgccggtcatctccgaggccacggggaacctcaagagccaggggatgatttctttaacatgctgataaagtaccagtcctccaggatcgatgatcagaggtgcccacccccagatgtgctcccaaggggtcctactatgccagacgaggacttttttagcctgattcagagggttcaggccaagaggatggatgaacagcgcgtcgacctggcagggggacctgagcaaggcgcaggcggaccccctgaaccacaacagcagtgtcagcctggcgcaagctag

SEQ ID NO: 50615 - DNA, 501 bp, Artificial Sequence
  Description of Artificial Sequence: Synthetic coding sequence
atggacgatcagaggtgcccgttggacgatgggcaggctggggctgcagaagccactgcagcgccaaccttagaggatcgcattgctcagcccagcatgactgcctcacctcagacagaagaatttttcgacctgatcgcaagctctcagtcgaggcggttggatgaccagcgtgccagcgtgggttccctgccaggtttgaggatcacacattcgaacgccggtcatcttcgaggacacggggaacctcaagaaccaggcgacgatttttttaatatgctgataaaataccaatcttctcggattgatgatcagcgttgtccgcctccggatgtgcttccaagaggcccaacaatgcccgacgaagattttttcagtctcatacagcgggtccaggccaaacggatggacgaacagagagtggatctcgccggagggccagaacagggtgccggtggccctcctgaaccccaacagcagtgtcaaccaggtgctagctag

SEQ ID NO: 50616 - DNA, 1374 bp, Artificial Sequence
  Description of Artificial Sequence: Synthetic coding sequence
atggctggtcccgctccacccgtggctgatgaactcccgggaccagctgcacggcgtctgtactcacgaatggaagcttcatgcctggaacttgctctagaaggcgaaagactatgtaaggcaggagatttcaagaccggggttgccttttttgaagccgctgtccaagtcggcactgaagatcttaagaccttaagcgctatatattcccagctcggaaatgcttacttttacctgaaggagcacggacgcgctttagaatatcacaagcatgaccttttgctcgctagaacaattggggatcgaatgggagaggcgaaagcctccgggaacctggggaacactctgaaagtcctcggtagattcgacgaggcggcagtgtgctgtcaacggcatctctcaatcgcacaggagcagggtgataaagtgggggaggcacgtgccctgtacaatatagggaacgtgtaccacgcaaagggaaaacagttgagctggaatgccgcaaatgccacacaggatcctggacaccttcctcccgacgtccgggagacgctctgcaaggcttcagagttctatgagcgcaatctgtcactggttaaggaactcggagacagagcagcacaaggcagggcgtacgggaatttgggaaacacacactatctgctaggtaactttacggaagccactacattccataaagaacgcctagccatcgctaaggagtttggagacaaggcggcagaacgcagagcctactccaacctgggcaacgcacacgtgtttctggggcgatttgatgtcgccgctgaatattacaagaagacactacagctctccagacagctgagagaccaggccgttgaagctcaggcttgttatagcctagggaatacttatacactcctccaagactacgaacgagcagctgagtatcacttgcggcacttattaattgctcaggaattagccgacagggtcggcgaggggcgagcatgctggtccctgggaaatgcgtacgtgtctatgggcaggcccgctcaagcgttaacattcgctaaaaagcatctccagatttctcaagaaattggggacaggcatggagaactaactgctcggatgaacgttgctcagctgcagctcgtgctgggtcgattgacaagtccagccgcttctgagaagccagacctggctggctacgaggcccagggggaattccagggctgcggaggcgtcctccttcctaccggcaccgacagaatccggtcgtgcgggggagtggggtccagacctggacagcacggtggtgggggaagcaggcagaagatggcccctacaagccagttcttcctggccagcgggaccgcacaggcctag

SEQ ID NO: 50617 - DNA, 501 bp, Artificial Sequence
  Description of Artificial Sequence: Synthetic coding sequence
atggacgaccagcggtgtcccttagacgatggccaagctggagcagctgaagcgacagccgcacctactctggaagaccgcattgcacagccgagtatgacagcctcgccacagactgaagaatttttcgacctgatcgcttcatcccagtctaggcgcctggacgatcagcgggcttccgtgggcagtctgccaggactcagaatcacccactcaaacgcgggacatttgcgcggacacggcgaaccccaggagccgggtgatgacttcttcaatatgctgataaagtaccaaagtagccgcatcgacgaccagaggtgcccacccccagacgtgctcccccgtggtccaaccatgcctgatgaggatttcttctcactgatccaaagggtgcaagccaagcgtatggatgaacagagggttgaccttgccggaggcccagaacagggagcaggaggcccacccgagccacaacagcaatgtcagcccggagctagctag

SEQ ID NO: 50618 - DNA, 2028 bp, Artificial Sequence
  Description of Artificial Sequence: Synthetic coding sequence
atggctggtcccgctccccctgtggccgacgagctgcccggacctgccgcacgcaggctatattcaaggatggaggcatcctgtctcgaactcgctctcgagggagaaagactttgtaaggcaggcgacttcaaaactggcgtggctttctttgaagctgctgttcaggtggggacagaggacctgaagacactttctgccatatattcccagttagggaacgcatacttttacctaaaagagcacggcagggctctcgaataccacaaacacgacttgttgttggccagaaccatcggtgaccgcatgggcgaggcaaaggccagcggaaatttgggcaatactttgaaagttctgggcagattcgatgaagccgctgtgtgctgtcagagacacctgagcattgctcaagagcagggagataaggtgggcgaagcacgcgctctgtataatattgggaacgtgtaccatgctaagggtaaacagctctcctggaacgctgcaaatgcaacgcaggatcccggacaccttccacccgacgtgcgggaaacattgtgcaaagcatctgagttttacgaaaggaatttgtccctagttaaggagcttggagatagagccgctcaggggagggcttatgggaacttggggaatacacattacctactgggcaattttaccgaggccaccacgtttcacaaagagcggctggcaattgccaaggaattcggggataaggccgcagagcgtagagcatactcaaacctgggaaacgcacacgtgttcctgggcaggttcgatgtggccgcagaatattacaagaaaaccttgcaattatccaggcagttgcgtgatcaagccgtggaagcgcaggcatgctactcactgggaaatacttatacgctacttcaggattatgaacgagcagctgagtaccacttgcggcaccttctcattgctcaggagcttgcagaccgtgtcggcgaaggccgagcatgctggtctctggggaacgcctatgttagtatggggcgtcccgctcaggccctgacatttgccaagaagcatctccagatctcgcaggagataggagacaggcatggggaactgacagccagaatgaacgtagcccagctgcagctggtcctcgggcgacttacaagtcccgcagcgtctgagaagccagatctcgcagggtacgaagcacaaggagctagacctaaaagaacccagaggctttcagcagaaacctgggatctgctgcgactgcctctggaacgcgagcaaaacggagacagccaccactctggcgattggcgaggaccaagccgagactccttgccactgccagtccggtcgcggaagtatcaagaggggcctgatgccgaacgaagacccagggaaggatcccattctccactggacagtgctgacgtgagagtccatgtccccaggacatcaattccgcgagcgccaagcagcgatgaagaatgctttttcgatttacttacaaaattccaatcctcacgtatggacgatcagagatgtccactggacgatggacaggccggagcagccgaggccactgcagcccctacactggaagaccggattgcccaaccaagcatgaccgcctctcctcaaacagaggagttcttcgatctcatcgcatctagccagagtcggagattggatgatcagagagcttcggtcgggtcgcttccaggcctgcggatcactcattctaacgcaggccacttacgtggccacggcgagccacaggaacccggagacgacttctttaacatgctgattaagtatcagagctctcgaattgacgatcaaaggtgtcccccacccgatgtcctgccaagaggtccaaccatgccggacgaggactttttctccctcatccagcgtgtgcaggccaaacgaatggacgagcaaagagttgaccttgccggaggcccagagcagggagcgggtggtccacccgaacctcagcaacagtgtcaacctggagctagctag

SEQ ID NO: 50619 - DNA, 2175 bp, Artificial Sequence
  Description of Artificial Sequence: Synthetic coding sequence
atgtttgacacaaccccccactccggccgttctaccccgagtagcagccctagcctcagaaagaggctgcagcttctccctccgtctcgaccgccaccagagccagagccaggaaccatggtcgaaaaaggttctgattcgagcagcgagaagggaggcgtgcccggaacgccctccacacagtccttgggctccagaaatttcatccggaactcgaagaaaatgcaaagctggtattcaatgctatcaccaacctacaagcaaaggaatgaggacttccggaaactcttctctaagctgccagaagccgagaggctcatcgtcgattatagctgtgccctccaaagggagatcctgcttcaggggcgactgtatcttagcgagaactggatttgcttctactccaatattttccgatgggagacaactatttccatccaactcaaggaagtcacctgtttaaagaaagagaagacagccaagcttatccctaacgctatccagatttgcaccgaatccgagaagcacttcttcactagttttggcgcacgcgataggtgctttctcctcatatttcgattatggcagaacgcactgctggaaaagaccctgtctccccgagagctgtggcatcttgtgcaccagtgttacggctccgaattgggcctcacaagtgaggatgaagactacgtttcaccgctgcagctgaacgggttagggactccaaaggaagtcggggatgtaatagctttgtcggacattacctctagtggagcagccgacagatctcaagagccttctcccgtcggctcgcgcagagggcatgttacaccaaacctgagcagagcatcctcggatgcggaccacggagcagaggaagataaggaggagcaggtcgattcccaacccgacgcatcaagctcccagaccgtcacacctgttgcggaacccccatctacggagcccacacagccagatgggccaaccacactaggacccttagatctgctgccttcagaagagctgttgaccgacacatcaaactcatcgtcaagcaccggggaagaggcggatcttgccgcacttctcccggacctgtccgggagactgctcatcaactcagtcttccacgtgggcgctgagaggttgcagcaaatgctttttagtgactctccattcctgcaggggtttctccaacagtgtaagttcaccgacgtgaccctgagtccctggtccggagatagtaaatgtcatcaacgtagggtgttaacctatacaatacctatatccaatccactggggcctaagtcggcaagtgttgttgagacgcagactctgttcaggcgcggtcctcaggccggaggatgtgtcgtggacagcgaagtgttgactcagggaatcccgtatcaagattacttctacacagcccacaggtactgcatcctcggcctagccagaaacaaagcacgcctccgggtttcgagcgaaatccgctatagaaagcagccctggtctcttgtgaagtcattgatcgaaaagaactcctggtctgggatcgaagactatttccaccatctggagcgagaactggcgaaggctgaaaagttgagtctagaagaaggaggaaaagatgccaggggcctgctgagcggcctgcgaaggcggaagcggccactttcatggcgggcacacggagatggcccacagcacccagaccccgacccctgtgcacgagcaggcattcatacatccggctctctgagctcacgctttagcgagcccagcgtcgaccagggtcccggagccggaatcccttcagccctggtgttgatttctatcgtgatctgtgtcagcctcatcatcttgatcgccctcaatgttttgctgttctacagactgtggtcactggagagaacagcccacactttcgaaagctggcattccctggccctcgccaagggcaagttccctcagaccgcaacagaatgggctgaaattctggcgctgcagaaacagttccattcggttgaggtacacaaatggaggcaaattctcagagccagcgtagaactgctggatgagatgaagttcagcctggaaaagttgcaccagggaataactgtcagtgatcccccatttgacacccaaccaaggccagacgactcttttagctag

SEQ ID NO: 50620 - DNA, 2142 bp, Artificial Sequence
  Description of Artificial Sequence: Synthetic coding sequence
atgttcgacaccaccccgcacagcggcagatctaccccctctagctcaccctccctgagaaagcgcctgcagctgttaccccctagtagacctccacccgaacctgaacccggaaccatggtggagaagggcagcgatagttcatcagagaaggggggtgttcctggaactccttcaacccaatcgttaggaagcaggaattttatcagaaactcaaagatgctcagtcccacgtacaaacagaggaacgaggactttcggaaactattctctaaactacctgaagccgagcggttgatcgtcgattattcctgtgccttgcagagagagatactcctgcaaggcaggctttacttgagcgagaactggatctgcttttatagtaacattttccggtgggagaccactatctccatacaattaaaggaagtgacatgtctgaaaaaggagaagacagccaaactcattcctaatgccatccagatctgtacagaatcggagaagcatttctttacttcattcggagcaagggatcggtgcttcctcctaatcttcagactgtggcagaatgcactactggagaaaaccttgtcccctcgcgagttgtggcatctcgtacatcagtgttacggaagcgagctgggactcactagcgaggacgaagattatgtgtcacctcttcagctgaacggactcggcacgccaaaggaggtgggagacgtgattgcactgtccgacattacatcatctggcgcagctgatcggagccaggaaccctccccggtagggtcacggcgaggccacgtgacgcctaacttatcccgcgcatcatccgatgcagatcacggagccgaggaagataaagaggaacaagttgactctcagcctgatgcttcgagctcacaaactgttacacccgttgcagagcctccatctacggagcctactcaaccggacggcccaaccaccctggggccactcgacctcctgccttctgaagagctgctcacggacactagcaactcttccagtagtaccggtgaggaagccgacctggctgctcttctgcccgatttgtccggcagattgttgattaattccgtgtttcatgtgggggctgagcggctgcagcagatgctcttctctgacagtcctttcctgcagggtttcctccaacagtgcaagtttacagatgtcaccctctcaccatggagcggagatagcaagtgccatcaaagacgggtactgacctacaccatcccgattagcaaccctctgggtccaaagagcgcgtctgtggtggaaactcagactctgtttcggagaggccctcaggctgggggttgtgtcgtagatagcgaagtcctgacccagggaatcccatatcaggattacttctataccgcacacaggtactgcatcttagggctggccagaaacaaggccaggctgcgcgtctcctccgagatacgctatcgaaaacagccttggagtctggtaaagagtttaattgagaagaactcatggagtggcatcgaagattatttccaccacttagagagggagttggcaaaagcagaaaagctgtccttagaggagggaggaaaggacgctcgcggattgctttccggcctgcggagaaggaaacgccctctatcatggcgcgcacacggagatggaccacaacacccagaccctgatccctgcgccagagccggtattcacacatctggctcgctctcgtcaaggttttctgagcccagtgtagatcagggccctggggcaggcattccttctgcgcttgtgttgatctcaattgtgctgattatactgatcgccttgaacgtactgctattctatcggttgtggtctctggagcggactgcccataccttcgaaagctggcatagtctggccctggctaaggggaagtttccgcagaccgcaacggagtgggcagagatcctggccctgcagaaacagtttcatagcgtggaagtgcacaagtggcgtcagatcctgagggcttccgtcgagttacttgacgaaatgaaattcagtttggagaagctccatcaggggatcaccgtatcagatccgccattcgacactcaacctcgacccgatgattccttctcctag

SEQ ID NO: 50621 - DNA, 2421 bp, Artificial Sequence
  Description of Artificial Sequence: Synthetic coding sequence
atggatgacgtcctgcccctgatgccgtgggagactttgctggctcaagggtctccacaagggagccctgacttgcctgccggacagagaaaacagcagccacagggagacagagcccaagggctggcctccgaatcctggaagctgctggaggtccctatcatacacataacacctagcagtgacggggagtccccggcttgtacgccaactccgagacgcagacagcaacaaagaatgccagatccacagagtttgtctcaggattcaactacgcctcattccggccgatcgacaccaagttcatccccctccctgagaaaaagactgcagctcctgccaccaagtagaccccctccagagccggagcctggaacaatggtggagaaggggtccgactccagctctgagaaaggtggtgtacccggtactcccagcacccagtcactgggttccaggaactttattaggaactcgaagaaaatgcaatcctggtatagtatgttgtcccccacttataaacaacgcaacgaagactttagaaaacttttcagtaagttacctgaagccgagcgtctgattgtggattactcctgcgccctccaacgggagattctccttcaaggcagattatatctgagcgagaattggatatgcttttactccaacattttccggtgggaaaccacgatttccattcagctaaaggaggtaacatgtcttaagaaggagaagacggccaaactcatcccaaacgctatccaaatctgtacagagtccgaaaagcacttttttacatctttcggtgcgagggacagatgcttcctcctgatattccgcctgtggcagaatgcccttcttgaaaaaactcttagccccagagaactctggcaccttgtgcatcagtgttatgggagcgaactgggtctgacaagcgaggacgaggattacgtgtctcctctgcagttgaacggcttaggaacaccaaaggaggtaggagacgtgatcgcactgtccgacatcacatcaagcggcgcagccgaccggagccaggagccctcacccgtcggctcgcggaggggacatgtgactcccaaccttagtcgagccagttccgatgcagatcatggtgctgaagaagataaagaagagcaggtcgatagccaaccagatgcgtcttcctcgcaaacagtgacacccgtcgccgagccaccctctacggaacccacccagcctgacggtcctactactttaggcccactcgacctgcttccatctgaggagttactgacggacaccagtaattcctccagcagcacaggagaggaagacctcgctgcactacttcccgacttgagcggccgattacttataaattctgtttttcacgtgggggcagaaagactgcagcagatgctcttctcagatagcccattccttcagggattcttgcagcagtgcaagttcactgatgtgacactgtcaccttggtctggtgacagcaagtgccatcagagaagagtgctgacatacactataccgatatctaaccccttggggccaaagagcgcctccgtagttgaaacacaaactctctttagacgcggtcctcaagccggagggtgcgttgtggacagtgaagtgcttactcaaggtattccctatcaggactatttttacactgctcaccgatattgcatattaggactcgcccgtaacaaggccaggctacgtgttagcagcgaaattcgctacaggaagcaaccatggtctctggtaaagagtttgatcgagaagaattcctggtctggcatcgaggattattttcaccacctggagcgcgagctcgctaaggctgaaaagctgtctctggaggagggcggaaaagatgcccgaggactcctctctggcttacgaagacgcaagcgaccgctgtcatggcgggcacatggggacggacctcagcatcctgatcccgatccgtgtgctcgcgcaggcattcacacctccggctccctgtctagccggttcagcgagccctctgtggaccaaggccctggagccggaatcccctccgccttggtgctcatcagtatcgtgcttataatccttatcgcactcaatgtgctgctgttttatcggctgtggagtctggagaggacagcgcatacttttgagagctggcatagccttgccctcgccaagggtaaattcccccagacagctaccgaatgggcggaaatcctcgcactgcagaaacaatttcactccgtcgaagtccacaagtggcgacaaatcctccgcgctagtgttgagctgctcgatgagatgaaattcagtctcgagaaactgcaccaggggattacggtgtctgaccccccattcgatacacagcccagaccagatgactccttttcctag

SEQ ID NO: 50622 - DNA, 1461 bp, Artificial Sequence
  Description of Artificial Sequence: Synthetic coding sequence
atgcactgtttgaagaggaccccaaaagaggttggggatgttatcgccttgtcagatattacgagctctggggctgcggacaggagtcaggaaccctcccccgtgggtagtaggaggggacatgtgactcctaatctttcaagggccagctctgatgcagaccacggcgctgaggaggataaagaggaacaggtggactctcagccagatgcttcgagctcacagaccgtcaccccagttgctgaacctccaagcacggaacccacccagccagacggcccaaccacattgggcccactggatctactcccctccgaggaacttctcacggacacatctaattcttccagcagcaccggcgaggaggccgatctggccgcactgttgcctgaccttagtggacgcctgctcatcaactctgtttttcacgtcggcgcagagagacttcagcagatgttgttcagcgacagtcccttcctgcagggatttttacagcagtgcaagttcactgacgtgaccctgagtccttggagtggcgatagcaaatgccaccagcgacgggtcctgacatatacgatcccaataagtaacccactggggccaaagtccgcaagtgtcgttgagacacaaacactcttcaggcggggtccccaggcaggcggatgtgtggtcgatagtgaggtgctgactcagggaatcccataccaggattacttctacacagctcaccggtattgcatattgggcctggcgaggaacaaggccagactccgcgtgagcagtgaaattcggtacagaaaacagccgtggagcctcgttaagtccctgatagagaagaactcctggtcaggcatcgaagactacttccaccatctggaaagggagctggcaaaagccgaaaaattatccctggaggaaggaggcaaagatgctcggggtttgctctcaggcctccgacgcagaaagcgccctctaagttggagagctcatggtgacggaccccagcaccctgatcccgacccctgcgccagggccggaattcatacctcaggaagcctcagttcaaggttctccgagccttctgtggatcaggggccaggggctggaattccaagtgcgctagtgctcatcagtattgtgctcatcattctcatcgccctcaatgtcttactcttctacagactgtggtccctggagcgcacagcccacacatttgaatcatggcattcactggccctggcaaagggaaagttcccacagacggccacagaatgggcagaaattttggccctgcagaagcagttccactctgtagaggtgcacaagtggaggcaaatcctcagggcgagtgtggaactccttgacgaaatgaaattttccttagaaaagctccaccagggcatcacagtatctgatcccccttttgacacccaacctcggccagatgatagcttttcgtag

SEQ ID NO: 50623 - DNA, 2217 bp, Artificial Sequence
  Description of Artificial Sequence: Synthetic coding sequence
atgaagggttttaagctaagctgcaccgcttctaatagtaaccgatccacgccggcttgcagtccgatcctcaggaagaggtccagatcccccacaccacagaaccaagatggagataccatggtcgagaaaggctcagaccattcgtctgacaagtctccaagcacccccgaacagggggttcagcgcagttgttccagccagagcgggcgatcaggcggtaagaacagcaaaaaatcccaatcctggtacaacgtgttaagtcctacatacaaacagcgcaacgaggatttccgtaaactatttaaacagctgcctgatacagaaaggctgattgttgactactcatgtgctctgcagagagatatacttctacagggcaggctgtatctctccgagaactggatctgcttttacagcaatatcttcaggtgggagacattattgacagttaggctcaaggatatttgcagcatgaccaaagagaagacagcaagattaattcctaacgctattcaggtgtgtacagactcagagaaacactttttcaccagcttcggtgcccgagacaggacatatatgatgatgtttcgtctgtggcaaaacgcactgctggagaaaccactttgccctaaggaactgtggcacttcgtccatcagtgctacggaaatgagttgggtttaacctccgacgacgaggattacgttccccctgatgacgatttcaacacgatgggctattgcgaggaaattcctgtggaggagaatgaggtgaatgattcctcctcaaagtcctctatagagacaaagcccgatgcatctcctcagcttccaaaaaagtcgatcacaaactccactctaacatcaactggcagcagtgaagctcccgttagcttcgacggtctgcctctcgaggaggaagctctggagggagacggctcactcgagaaagaactggcaatagataatattatgggcgagaagattgaaatgatcgcccctgttaactccccatctcttgacttcaacgacaacgaggatattccaaccgaactgtccgactcttctgacacacacgatgagggcgaagtgcaggccttttacgaagacctgagtggtcgtcagtacgttaacgaggtctttaacttcagcgttgataagttgtatgatcttttgttcacgaactctcccttccagcgagatttcatggaacaacgtcggttttcagacattattttccacccgtggaaaaaagaggaaaatgggaatcagagtcgagtaatcttgtacactatcaccctgacgaacccactcgcccctaaaaccgccacagtccgggaaacccagactatgtataaggcctctcaagaatccgagtgctatgtgatcgatgccgaagtactgacacatgacgtgccctatcacgattatttctataccattaatcgttacacactcacccgggttgctcgcaacaaatccagactgcgggtgagcaccgagctgcgttaccgtaagcagccatgggggctcgtgaaaacttttatcgagaagaacttttggagcggcttggaggattacttcagacatttggagtctgagcttgctaaaacggagagcacttatttggcagagatgcaccgtcagtcaccaaaggaaaaggcgagcaaaactacaaccgtgcgcaggagaaagagaccacacgctcacctccgggtcccacacctggaagaggtgatgagcccagttacaacacctacagacgaagatgtggggcatcgaattaagcatgtcgcgggatctacgcagacccgtcacattccagaggacacacctaatggttttcacctgcagagtgtttcgaaattactgcttgtcatcagctgcgtggtttccttcagtttagtcttactggtaatcctgaacatgatgttgttttacaaactttggatgctggagtatactacacagacccttacagcatggcaagggcttcgcctccaggaaaggctgccccaaagccagaccgagtgggcccagctgctcgaatctcagcaaaaataccacgatacggagttacagaagtggcgagagataattaaatcctccgtcatgctgttggatcagatgaaagattctctgattaatctacagaatgggatccgatcacgcgactatacttccgaatccgaagaaaagcgaaataggtaccactag

SEQ ID NO: 50624 - DNA, 2217 bp, Artificial Sequence
  Description of Artificial Sequence: Synthetic coding sequence
atgaaggggtttaagctgtcctgcacggcctcgaacagtaatcgttccacccctgcctgcagtcccattctgcggaaaaggtcccgttcacccaccccccagaaccaggatggagatacaatggttgagaaaggcagcgatcactcaagcgataagagcccgagcacccctgaacagggtgtccagcgatcctgctcgtcccagagcggtaggagcggtggtaagaactccaagaagtcccaatcatggtataatgtgttatccccgacgtacaagcagcgaaatgaggattttaggaagttgtttaaacagctgcctgacacagagcgcctcattgtcgactactcttgcgctttgcagcgtgatatcttgttgcaaggacgcctgtatctgtccgaaaattggatctgtttttactcgaacattttcagatgggagactctcctgaccgtgcgccttaaagacatttgtagtatgaccaaggagaaaacggccagacttatccccaatgccatccaagtctgcactgatagcgaaaagcacttctttacctcattcggtgccagagaccggacttacatgatgatgttcaggttatggcagaatgccttgcttgagaagccactgtgccccaaggagctgtggcactttgttcatcagtgttacggaaacgaactcgggctgacgtccgacgatgaggattatgtgccccctgacgacgacttcaacaccatggggtattgtgaagagatccccgttgaggagaatgaggtgaacgatagcagctctaagtcttccatcgaaacaaagccagatgccagcccccaactccccaaaaagtctatcaccaactcaaccctgacctcaacaggatcatccgaggctcctgtgtcttttgacggtctacctttggaggaagaagccctggagggagatggatcactggagaaagaactggctatcgacaacatcatgggcgagaaaatcgagatgatcgctccggtcaactccccatcactggatttcaacgataacgaggacattccaactgaactgtccgacagttccgatacccacgacgagggcgaggtccaagccttctacgaagacctgagcggcaggcagtacgtgaacgaagtgtttaacttttctgtcgacaagctctacgacttactcttcacaaatagcccctttcagcgcgattttatggaacagaggcggtttagcgacataatcttccatccttggaagaaggaggaaaacggaaaccagtctcgggtgattttgtatactatcacattgacaaatcccctagccccaaagaccgccactgtccgcgaaacgcaaaccatgtacaaggcttcccaggagtcagagtgttacgtgatcgacgcggaagtgctcactcacgacgtcccctaccatgactatttctacaccattaacagatataccctgacccgagtcgcgcgaaataaaagtaggctgagggtgtcgacagaactacgctatcgtaaacaaccgtggggactggtgaagacgtttatagagaagaacttctggagcggtttggaggactactttcgacatctagaaagcgaacttgccaagacagagagtacgtacttagccgaaatgcatcgtcagtcacctaaggagaaagctagtaagaccaccaccgtccggagaaggaaaagaccacacgcacacttacgtgtgccccacctggaggaggttatgagcccagttactactccgaccgacgaggacgtgggacatcgcattaagcacgtcgcaggctcaactcagactcggcacattccagaagacacacctaatggctttcatttacagtcggtcagtaagttgctgctagtgatttcctgcgtcatctgcttcagcttggtcttgcttgtgatccttaacatgatgctcttttacaagctgtggatgctggaatatactacccagaccctgactgcgtggcagggcttgagactccaggagcgccttccccaaagccagaccgaatgggcccaactattagaatcacagcaaaagtatcatgacactgagctgcagaagtggagggagattattaaatctagtgtgatgctgctcgaccagatgaaagatagcctgataaacctgcaaaatggtattcgcagtcgcgattacacctccgaaagcgaggaaaagcgaaaccgctaccattag

SEQ ID NO: 50625 - DNA, 2238 bp, Artificial Sequence
  Description of Artificial Sequence: Synthetic coding sequence
atgaaaggctttaaattgtcatgtacagcatcgaattcaaataggtcgactcccgcttgcagtcccattcttcgcaagaggtccagaagccccactcctcaaaatcaggatggggacaccatggtggaaaagggatccgatcactctagtgacaagagcccctcgacacccgaacaaggcgtacaaaggtcttgctccagtcaatctggaagatccggtgggaaaaattcaaagtcgcacaagaggttaagcaagaagtcccaatcctggtataacgttctgtccccgacatacaagcagcgcaacgaagatttccgcaaactgttcaagcaactgcctgataccgagaggttaatcgtcgactacagctgtgccctacagagggacatcctgttgcagggtaggctctacttaagcgagaattggatttgtttttactctaacatctttagatgggaaactctacttaccgttcggctcaaggacatctgttccatgaccaaagagaagacagcaagacttattccaaatgcaattcaagtgtgcacagacagcgaaaaacactttttcacttcctttggtgctcgtgataggacctacatgatgatgtttagactgtggcagaatgctctcctcgagaagccactctgtccaaaagaactgtggcatttcgttcatcagtgttacggcaacgaattgggcctaacctcagatgatgaagactacgtcccccctgacgatgacttcaacacaatgggctactgtgaggagataccagtcgaggaaaacgaagtgaatgatagcagcagtaagtcttccattgaaaccaagcctgacgcatcaccccaactaccaaaaaaatccataacaaactcaaccctcaccagcacgggttcatcagaggctcccgtgtcttttgatgggctacccttggaggaggaggccctagagggagatggaagcctggagaaggagttggccatagacaacattatgggcgaaaaaatcgagatgattgcccctgttaacagtccaagcttagatttcaacgataatgaggacattccaaccgaactgagcgactcctctgatacccacgacgaaggcgaggtgcaggctttctatgaagacttgtcggggcgtcagtacgtaaatgaagtcttcaatttctcagtggataaactctatgatctgctatttaccaattcgccttttcaacgcgactttatggaacaacggcgtttctccgacatcatatttcatccatggaagaaagaagagaacgggaaccagtccagggtgatcctgtacactataactctaaccaatcccttggctcccaagacagcaaccgtcagagaaacccaaacaatgtacaaggcaagccaggaatctgagtgctacgtgatcgacgccgaggtgctaactcacgatgtaccttatcatgactacttttacaccatcaatcgatatacgctcactagagtggccagaaacaagagtcggttgagagtctctactgagctccgatacagaaaacaaccttggggtctggtcaagaccttcatagagaagaatttctggtccggcctagaagattattttcggcacctggagtcagagcttgctaagacggagagcacgtatttagccgagatgcaccgacaatctccaaaggagaaagcatcaaaaacaaccacagtcaggagaaggaagagaccccacgcccatttgcgggtgccgcacctggaggaggtgatgtctcctgttacaacaccaaccgatgaggatgttggacaccgtatcaagcatgtcgccggatccacacagacgcgccacattcctgaggacacccccaacgggttccaccttcagagtgtcagcaagctgctgctggtaatttcttgcgtcgtgagcttttcattggtgctattggtgatactgaacatgatgctgttctacaagctttggatgctggagtacacaactcagacactgacagcgtggcagggactgagattacaggaaagactcccgcagtcacagacagagtgggcccaactactggagagccaacaaaaataccacgacaccgagctacagaagtggcgggagatcattaagtcgagtgttatgcttctcgatcaaatgaaggactccctgataaatttgcaaaacggaatccggtcgcgcgattatacatctgagtctgaggagaagagaaatcgctatcactag

SEQ ID NO: 50626 - DNA, 1989 bp, Artificial Sequence
  Description of Artificial Sequence: Synthetic coding sequence
atggaaggggcacctactgtcaggcaagtgatgaacgagggcgactcttccctggcaactgaccttcaggaggacgtcgaggagaacccctctcccactgtggaagagaacaacgtggtggtaaaaaaacagggacctaacctgcacaactggtccggcgactggtctttttggataagctcttctacctacaaagatcggaatgaagaatatcggagacagtttacccacctgcctgataccgagaggttaatcgccgattacgcttgtgccctgcagcgcgatatcctgctgcagggtcggctgtatctctctgagaactggctgtgcttctactcaaatatatttcggtgggaaacaacaattagcattgcactcaagaatattacattcatgacgaaagaaaagaccgccagactaatcccgaacgctatacaaatcgtgaccgaatccgagaaattctttttcactagcttcggcgcacgggacagatcctatcttagcatatttcgcctctggcagaatgtgctcctggataaaagcttgacacggcaggaattctggcagttactacaacagaactatggcacggaacttgggctcaatgcggaggaaatggagaatctgtcgctatccatagaggacgtgcaaccaaggagccccggacgctcaagtctggatgacagcggggagcgggacgaaaaactgagtaaaagcatcagttttaccagcgagtcaatttccagggtgtctgagactgaatcattcgatggtaatagtagcaaaggaggcttgggcaaagaggagagccagaacgagaagcaaacgaaaaagagcctcctgcccacgctggagaaaaaactgactagagtgccatctaaatcactggacctgaataaaaacgaatatctctcccttgataagtcctcaacaagcgactcagtggatgaagagaatgtgccagaaaaggaccttcatggcagattgttcattaaccgcatattccacatatctgccgaccggatgtttgaacttctgtttacaagtagccgctttatgcagaagtttgcctcctccagaaatattatcgatgtggtgtctaccccatggacagctgaactcggtggggaccagttgcgaactatgacttataccattgtgcttaacagtccacttacaggaaagtgtacagctgccactgagaagcagacattgtacaaagaaagcagggaggcgagattttacctggtcgacagcgaggtacttacccacgacgtaccgtaccacgattatttctacacagtcaatcggtattgtataattcgcagctccaagcagaagtgtcggctaagagtgagtaccgacctaaaatatcgaaagcagccatgggggttggtaaagtcgctgatcgagaaaaacagttggtcatcgctggaggattacttcaagcagttggagagcgacctcctcattgaagagagtgtcctcaaccaggcaattgaggatccgggtaaattgacaggactgagaaggcggagacgcacctttaataggactgccgaaacagtacctaaattatcaagccaacacagtagtggagacgttggcctgggagctaaaggggacataaccggtaaaaaaaaagaaatggagaactacaatgtaacattgattgtggtcatgtctatatttgtactgctcctggtgctattaaatgtaacgttattccttaaattaagcaaaatcgagcacgctgctcaatctttttatcggctgagactccaggaggaaaaatccctgaatctggcctcggatatggtgtcgcgagctgagacgattcagaaaaacaaggaccaggcccacagactcaaaggggtgctaagggactccatcgttatgttggagcagcttaagtcctctttgatcatgttgcagaagacttttgacctgctcaacaagaataaaaccgggatggctgtcgagagttag

SEQ ID NO: 50627 - DNA, 1374 bp, Artificial Sequence
  Description of Artificial Sequence: Synthetic coding sequence
atggagaacctgtcattgtccatcgaagatgtccaacccaggtccccagggcgaagcagtctggacgacagcggcgagcgggacgaaaagctcagtaagagtatttcattcacctctgagtccatctcccgggtaagcgagaccgaaagcttcgacggaaattcgagcaaaggagggctgggcaaggaagaaagtcaaaacgaaaagcagaccaaaaagtccctcttgccaacgctggagaaaaaactcacccgcgtgccttcgaagtcacttgatctgaataagaacgaatacctgtcgctggataaatcaagcacctccgattctgtagatgaggagaatgtgcctgagaaggatctccatggtcgactgtttatcaatcggatcttccacatctctgcagatcggatgttcgagttgctgtttacctcctcgaggttcatgcagaagttcgcttctagtaggaatattattgatgtggtttccacaccctggaccgccgagctggggggagatcagctcagaacaatgacctatacaattgtcctcaatagtcccctgacaggtaaatgcaccgctgctacagaaaagcaaaccctgtacaaagagagtcgtgaggccaggttctaccttgtcgactcagaggttctaacccatgacgtgccttaccacgattacttctacacggtgaatcggtattgcataattcgttcctctaaacagaagtgtaggcttcgcgtgtccaccgacctgaaatataggaagcagccatgggggctagtaaaaagcctaatagaaaagaactcttggtcttctctggaagattattttaagcaattagagtctgaccttttaattgaagagtccgtcctgaatcaggcaatcgaggacccaggaaaactgacagggctgcggaggagacgacggacgttcaatcgcacagccgaaacggtccccaaacttagctcccagcattcatctggggacgttggcctcggggctaagggtgacatcacaggcaaaaaaaaggagatggagaactataacgtgacgctgattgtggtcatgagcatcttcgtcctgctcctagtactgttaaacgtaacgttattcctgaaactgtctaagatcgaacatgcagcgcaaagtttttatcggctgaggctgcaggaagaaaaatctctaaacctcgcttcagatatggtctctagggccgagacaatccagaaaaacaaggatcaagcgcacagactcaagggagtattgcgcgatagtattgtgatgttagagcagcttaaaagttcgcttatcatgcttcaaaaaaccttcgatcttctaaacaagaacaaaaccggtatggcagtggagtcatag

SEQ ID NO: 50628 - DNA, 1176 bp, Artificial Sequence
  Description of Artificial Sequence: Synthetic coding sequence
atgaatatctttttgtggaccaaggccgctcttcagatcctgctaatgaagtacgcagccggacatgggttagtaatccggtgtctgcccgaattccgaaccctgggcagatccacacttgcgccaagtggacaaatcgaaaatgttcctgagaaagacttacacgggagactgtttattaatcgcatctttcacatctcagccgatcggatgtttgaactcctttttacctcttctcgattcatgcagaaattcgcctcctcacgcaatattatcgatgtggtatcaactccctggaccgccgagttgggcggtgaccagctccgtacgatgacgtacacaatcgtgcttaacagcccactcaccgggaagtgtacagctgcgaccgaaaaacagacactttataaagaaagcagggaggcaagattctacctcgtagattctgaagtgctaactcacgacgtgccctaccacgactacttttacacagtgaatagatactgcattatacgcagcagcaaacagaagtgcaggctgagggtgtccaccgacttgaagtatagaaagcaaccctggggcctcgtcaaatctctgatcgaaaagaactcctggagctcgctcgaagactattttaaacagctggaaagtgacctcttaattgaagagagcgttttaaatcaagccatagaagacccgggaaagctgactgggctgcgtcggcgaaggcgaacatttaacaggaccgccgagactgtccccaaactgtcctctcaacactccagcggtgatgtcggcctcggagctaaaggggatatcaccggcaagaaaaaagagatggaaaattacaacgtgaccctgatcgtagtaatgagcattttcgtgctactgctcgtcttacttaacgttacactctttctgaagctgtctaagattgaacacgcggctcaatccttctatcgcctgcgccttcaagaggaaaaaagcctcaatctcgcttcggacatggtcagccgcgcagaaactattcagaagaacaaagaccaggctcatcggttgaagggcgttctgcgcgatagcattgtgatgctagaacaattgaagagctcgctgatcatgctccagaaaacattcgatctgctcaacaagaataaaactggcatggctgttgagagttag

SEQ ID NO: 50629 - DNA, 1143 bp, Artificial Sequence
  Description of Artificial Sequence: Synthetic coding sequence
atggagaatctttctctttcaatcgaggacgttcaaccacgctcacctggaagaagcagccttgacgatagtggggaacgagatgaaaaactgagtaagtctatctcattcaccagcgagtccatctctcgcgtctcggagacggagtcattcgatggtaactcttctaagggaggcctcggaaaagaagagagccagaatgaaaaacagacaaaaaaatccctcctcccaaccctggaaaagaagttgacccgtgtgccatcgaagagcttggatctgaacaagaatgagtatctgtctctggataaatcctcaacatccgactccgttgacgaagagaacgttcccgagaaagatctgcacggtcggctgtttattaatcgtatcttccatatatccgcggatcgcatgtttgaactgttgttcacttccagtcggttcatgcagaaatttgccagtagccgcaacatcatcgacgtggtgtccaccccctggaccgctgagctcgggggtgatcagctacgaaccatgacttataccatcgtactgaattcgccactgacaggaaagtgtacagcagcaaccgaaaaacagaccctttataaggagtcccgcgaggcacgattctatttggtggactcggaagtgcttacacatgatgtgccctaccacgattatttctatactgtcaatcgatattgtattatccggtcttcaaaacagaaatgtcgactacgagtctcaactgatctgaaatacagaaaacaaccctgggggttggtgaagtcactaatagagaagaacagttggagcagcttggaggactactttaaacaacttgagagcgacctgcttattgaagaatctgtcctaaaccaggccatcgaagatccagggaagctcactgggctacgcagaaggcggcgaacctttaatcggacagcagagactgttcccaaattgtcatctcagcactcctcaggcgatgtcggcttaggtgccaaaggggacatcaccggcaagaagaaggaaatggaaaactacaatgttacactgattgttgtaatgtccatctttgtgctcctattagttctcctgaacgttaccctgtttctgaagctaagcaagatcgagcacgcttag

SEQ ID NO: 50630 - DNA, 1065 bp, Artificial Sequence
  Description of Artificial Sequence: Synthetic coding sequence
atgacagctctatctcgctccgaggcaactgaggaggggggaaatcaacaaatgcatagaaaaacagcctcactcaatagcccagtgagctgcaaagagaagccggatcgggtggaggagcctccagactattctctgcactggcctgagggtcttaagggcgaggagattaagaaatgtggcagggaaggtataactttgaacaaatacaaccaacagtatcacaagctgtttaaggatgtaccattggaggaagtggtgctcaaagtgtgttcttgtgccctccaacgagattttctcttgcaagggaggctgtacatatccccaaattggctttgttttcacgcgtcactgtttggcaaggatataaaggtggtgatccccgtggtgtccgtgcagatgataaaaaaacataagatggcgagactccttccaaatggactggctattaccaccaacacaagtcagaagtacatttttgtgtctctgctgtcacgggattctgtgtatgacctgctaaggcgagtttgtactcacttacagcctagctcgaaaaaatcactttcagttagggaattttctggagagccagaatctctggaggtgctgatacccgaaatgaagtggcgcaaggtgtgccctagttcccgctccctctccctccccgacaatataccctgcattccaccttcttccgtcgacagtacggatagcttttttccctctcgaaagcccccaatgtcagagaagtctagagctcaggtcgccagtgagaacggcggaaggtgggcctggccaatgcctgggtggggaccagcttgccccaagaaaatgcccaactgtagcccaacagcaaagaatgccgtctatgaggaggacgagttagaggaggagcccaggtccacgggcgagcttcgcctgtgggactacagactgctgaaagtgttcttcgtgctgatttgtttcctagtgatgagcagctcttacctggcctttcgcatcagcaggttagaacagcagctttgtagcctgtcttgggacgaccccgtcccaggtcaccgctag

SEQ ID NO: 50631 - DNA, 474 bp, Artificial Sequence
  Description of Artificial Sequence: Synthetic coding sequence
atgagcaaatcctgtggaaacaacctggccgcaatcagcgtcggcataagcctgttactgcttctcgtggtgtgtggtattggatgcgtttggcactggaagcatcgggtcgccaccaggtttaccttgccaaggttcctgcagaggcgtagtagtaggcggaaggtatgcacaaagacttttttgggacctcgaatcatcgggctgcggcatgagatatcagtagagacgcaagatcacaaaagcgctgtaagaggaaacaatacccatgacaactacgagaatgtggaagccggaccccctaaggcaaaaggaaaaacagacaaagagttgtacgagaatacaggacagagtaacttcgaagagcatatatatggtaatgagacttccagcgattactacaactttcagaagcctcgtccttccgaagttccccaggatgaagatatctatatccttcccgattcctattag

SEQ ID NO: 50632 - DNA, 474 bp, Artificial Sequence
  Description of Artificial Sequence: Synthetic coding sequence
atgtccaagagttgcggaaataatctggccgcaatttcagtgggcatctctctcctcttacttctcgtcgtgtgcggaatcggatgcgtgtggcactggaagcatcgggtagctacgcggtttacattgcctaggtttttacagcgtcgttctagcagacggaaagtgtgtacaaagacattcttaggcccaagaatcatcgggctccgccatgaaataagtgtggaaacccaggaccataagtccgcggttaggggaaacaacacacacgacaattatgaaaatgtcgaggccggaccacctaaagccaaggggaaaacggacaaagaactgtacgaaaacacggggcagtctaactttgaagagcacatttatggtaatgaaacctcctcagattattacaactttcaaaaaccacgaccttcagaggtgccccaggacgaagatatttatatactcccagatagctactag

SEQ ID NO: 50633 - DNA, 207 bp, Artificial Sequence
  Description of Artificial Sequence: Synthetic coding sequence
atgagcaagtcctgcggcaataacctcgccgcaatttccgtaggaatttctctgctgctgctgctggtggtctgtggcatcgggtgtgtgtggcactggaaacaccgcgtggctaccaggtttaccctccccagatttctccagcgccgatcatcaagacggaaggtgtgcacaaaaaccttcctcggcccacgcatcatcgggtag

SEQ ID NO: 50634 - DNA, 210 bp, Artificial Sequence
  Description of Artificial Sequence: Synthetic coding sequence
atgtcaaaatcatgcgggaataacctggctgctatcagcgttggcatctccctgctgctcctcctggtggtttgtggcataggctgtgtctggcattggaagcaccgggtggccacacgcttcacattgcccagattcctgcaaagacggtctagcaggagaaaagtttgcaccaagacttttctcgggccaagaattatcggcctgtag

SEQ ID NO: 50635 - DNA, 753 bp, Artificial Sequence
  Description of Artificial Sequence: Synthetic coding sequence
atgatccagtcctcccagcctatgtctctcaagctaacttgttcagctttccgattgcagagggcgctgagattcctcctcggacgcctgccttggcgggtcgcatccggagctaggaggtttaggcgctggctgaaccgctactcttacaccgtgttgagttcctggccagaaagggctctgatatcccttaagaataggagtagatttctggtccgtcccaacacacgcaatcgggcattttcatggacctgtagggctgcacgctcgaagcctcgccctcggcgtagcaccgcactgcctcgctcccaagccagttcgagtcgacactcttgggccgagttcctaaagttcagaaaatctttccaaatgtcaaatacgtcccaacctgacccaagcagacctgggacagaacgaacctcgagtaaggaggccggttgtcgtcctctcgggcaacttgacagtttttcatgggctgccaggccgcctcccggagccgctgggctcgctgtgagtgagggatttttcagaaaaattcgctcaagcgcgccttcgagcccaagcttcagccgggctctgatgagcaatacatacctgtgctttttaaccactggccctaggtcttctcgcgagaatacacagaagtcatttcccgcaacatctcctcgagaacccgtcaccagccggctccgtggtaaagctcctgctctgtctcccagtcgggagctgagcttcacctcagccccattttag

SEQ ID NO: 50636 - DNA, 978 bp, Artificial Sequence
  Description of Artificial Sequence: Synthetic coding sequence
atgcttgcagcccgtttagtatgcttaaggactctgccgtctcgggtttttcaccctgcttttacgaaggcctcaccagtggtcaaaaacagcatcactaaaaaccagtggcttctgactccctctagagagtacgcgacaaaaaccaggatcgggattcgcagaggtcggaccgggcaagaactgaaggaagcggctttggaaccaagcatggaaaagatcttcaaaatcgaccagatggggaggtggtttgtggcgggaggcgctatagaaaaggccgtcatctggccccaatatgtgaaagaccgaattcacagcacctatatgtacctggccggaagcattggacttaccgcccttagcgctatcgctatctctcgcaccccagtcctgatgaattttatgatgcggggatcctgggtcacgatcggcgtaacatttgccgcaatggtgggggcaggaatgctggtgaggtctatcccttatgatcagtccccaggtccgaaacatctagcatggctattacatagcggggtgatgggcgcagtggtggcaccactgacgatcctgggaggaccactgctcattcgtgcagcttggtacaccgctgggattgttggaggactgtctacagtggcaatgtgtgcacccagcgaaaagttcttaaatatgggggcaccactgggggtaggactgggactggtgtttgtgtcatccttgggatctatgttccttcctccaacaaccgttgccggagccaccttatatagcgtggccatgtacgggggactggtgcttttctccatgtttcttctgtatgatacccaaaaagtgattaagagagccgaggtgtccccaatgtacggtgtacagaaatacgacccaattaacagcatgctgtcaatttacatggacaccctcaatatatttatgagagtggctacgatgcttgcgaccgggggaaaccggaaaaagtag

SEQ ID NO: 50637 - DNA, 1038 bp, Artificial Sequence
  Description of Artificial Sequence: Synthetic coding sequence
atgctcgctgcccgtctagtgtgcctgaggacgttgcctagtcgggtgttccacccagcttttactaaagcctcacccgtcgtcaaaaactctatcacaaagaaccagtggcttctgacccctagccgggagtatgccaccaagaccagaattgggatccgccgaggcagaacagggcaagaattgaaagaagcagcactggaaccttccatggaaaagatcttcaagatcgatcagatggggaggtggtttgttgctggcggagccgcagtcgggctgggcgcactgtgctattatggtttggggctgtccaatgaaattggagctattgagaaggctgtcatatggccacaatacgtaaaggacaggattcactcgacatacatgtaccttgccggatctattgggctcaccgctctctcggccattgccattagcagaacacctgttctcatgaatttcatgatgcgcggatcttgggttaccattggagtgaccttcgctgctatggttggcgctggcatgctggtgcgatcaatcccctacgatcagtctcctggtcctaaacacttagcttggcttctgcactctggcgtcatgggggctgtggtcgccccactaactattctgggaggaccgctgctcattagagccgcatggtatacggcaggaatagtcgggggactgtctaccgtggctatgtgtgccccatccgagaaatttctgaatatgggagctccacttggcgtgggcctggggctggtttttgtgagcagcttggggagtatgtttcttccgccaacgaccgtggcaggggcaacactttactccgttgctatgtacggcggtttagtcctgttttctatgttcctcctctatgatactcaaaaagtgattaaacgtgccgaagtgagcccaatgtatggcgtgcaaaagtatgatcctatcaacagtatgctgtctatttacatggataccctaaatatctttatgagagtcgcgacaatgctagccaccgggggaaaccggaaaaaatag

SEQ ID NO: 50638 - DNA, 960 bp, Artificial Sequence
  Description of Artificial Sequence: Synthetic coding sequence
atgctagctgccaggttggtctgcctgagaaccttgccgtctcgcgtgttccacccggcttttactaaggcttcccccgttgtcaaaaattccattacaaagaatcagtggctcctaactccatctagagagtacgcaacaaagacgaggattggcatcaggcgcggacgaaccggacaggagctaaaggaagccgcactggaacccagtatggaaaagattttcaagattgaccagatgggaagatggttcgtggcagggggagccgctgtcggactaggagccctgtgttattacggtttagggcttagtaatgagattggagcaattgagaaagccgtcatatggccgcagtatgtgaaggacaggatccacagtacttatatgtatcttgccggtagcatcggtctgaccgccctatcggctatcgctatcagcagaacaccagttctgatgaattttatgatgagaggctcttgggtgaccataggagttacgttcgccgcaatggtgggggctggcatgttggttaggtccatcccctacgatcagagtccagggcctaagcatctcgcctggctgctgcactcgggcgttatgggggcagtggttgccccactcacaatactgggtggcccactgctcatacgggctgcatggtacacggctggcatcgtgggaggcctctccacagttgcaatgtgcgcccctagtgagaaatttttgaatatgggcgcaccgctgggcgtcgggctgggcctcgttttcgtgagctcgctcggcagtatgttcttgccccctacaacggtagcaggagccacactctattctgtggccatgtatgggggactggtacttttcagcatgttcctgctttatgatacccagaaagtgtcctctgtgcagaagtaccaccaatgtatggagttcaaaaatatgattccccttactcggtgttag

SEQ ID NO: 50639 - DNA, 999 bp, Artificial Sequence
  Description of Artificial Sequence: Synthetic coding sequence
atgcttgccgctcgacttgtgtgcctgaggacccttccattcgtaaaaaactcgataacaaagaaccagtggcttctaacaccatcaagggagtacgcgacgaaaaccaggataggcattagaaggggtcggaccgggcaggaactgaaagaggcagcactggaacctagcatggagaagatcttcaagattgatcagatgggaaggtggtttgtggccggaggcgctgcagtaggactgggggcactgtgctattacggccttggattgagcaatgaaattggggcaattgagaaagctgtgatttggccacagtacgtaaaggatcgtattcattctacatatatgtatttagcgggaagcattggcctcactgcactgtctgccatagcgataagcagaaccccagttctgatgaactttatgatgcgcggtagttgggtgacaattggggtgacctttgccgcaatggttggtgcaggaatgctcgtccggtctatcccttatgatcagagccccggtcccaagcatttggcgtggttgcttcattcgggagtgatgggagcagtggtcgccccactgacgatcctgggaggcccactgctgatcagagctgcctggtataccgcagggatcgtaggcggactgtccaccgtggctatgtgtgcgcctagcgaaaagtttctcaatatgggcgcacccctgggcgtcggcctgggcctggttttcgtctcctccctcgggagtatgtttctgccgcctactacagtggctggggctactctatacagcgtcgctatgtacggaggtctggtgttgttctctatgtttctcctttatgacacccaaaaggtaataaaacgggctgaagtctccccaatgtatggggtccagaaatatgatccaattaactcgatgctgagcatctatatggacacattaaacatctttatgagagtagccaccatgctggccacaggcggaaacaggaagaaatag

SEQ ID NO: 50640 - DNA, 5444 bp, Artificial Sequence
  Description of Artificial Sequence: Synthetic coding sequence
atgggcaatagctacgcaggccaattgaaatcggcccgatttgaagaagccctgcataacagtatagaggcttctctccggtgctcgtcagtcgtgcctaggccaatcttctcacagctgtatctggacccagaccagcacccattctcatcagcggacgtcaagcctaaggttgaagatttagacaaagacttggttaatcggtatacgcagaatggcagcctggacttcagcaacaatttgacagttaatgaaatggaggacgacgaggacgacgaagagatgtccgatagcaacagccctcctatcccctatagccagaaacctgccccagaggggagttgcaccaccgatggtttttgccaggccggtaaggacctgaggttggtgtctctttgcatggaacagattgacatccctgccggattcctgcttgtgggcgcaaagtcacctaatcttccggagcacatcctcgtttgcgccgtggacaagaggtttctccccgacgaccatggcaagaatgcgctcttggggttttcaggcaattgcattggctgcggcgagcggggtttccggtacttcacggaatttagcaatcatattaacttaaaactgaccacacaaccgaaaaaacagaagcatcttaagtattacctggtccgcagcagccaaggcgtgctgtccaagggccctctgatctgttggaaggagtgcaggtccaggcagagtagcgctagttgtcactctataaaacccagcagcagcgtcagtagcacagtgacccccgaaaacggcaccaccaacggctataagtctggattcacccagactgacgccgcaaatgggaacagctctcatggcggaaagggctcggccagcagttctaccccggctcacacgggaaactactcacttagcccaaggccctcctatgcgtctggagaccaagcgacgatgtttattagcggaccccctaaaaaaagacatcggggttggtatcctgggagtccactgccacaaccgggactcgtcgtgcctgtgccaaccgttagacctttatcaagaaccgagcccctgttgagtgccccagtccctcagacgcccctaacaggaattctacagccccgacctatccccgctggagaaaccgtgatcgtgccagagaaccttctctccaactccggtgtgcgcccagtaatcttaatcggatatggtaccctaccttacttctacggtaatgtgggcgacatcgtcgtgagtccattgctcgttaactgctacaagattcctcagctagaaaataaggacctcgaaaaactgggactcacgggatctcagttcctatctgttgagaatatgattctgcttacaattcaatacctggttcgtttgggccagcaccagagcagggcacttgctgagagcatgctgacgaccagcgagtttctcaaggagatcagttacgagctgatcacaggcaaggtaagtttcctggcctctcatttcaagacaacctcactcggagacgacttagataaactgctcgaaaaaatgcagcagagacggggagactccgtggtgacgcctttcgacggggacctgaatgaatgtgtcagcccacaggaagccgctgccatgatcccaactcagaacctggatctggacaatgagactttccacatataccagcctcagttgaccgtcgcccgaaagttgctttcacaggtgtgtgccatcgccgacagcggtagccagagcctggatctaggccacttcagtaaagtggactttataatcatagtacccaggtcggaggttctggtacagcaaacccttcagcggataagacagtcaggcgttttagtggatcttgggttggaggaaaatgggacggcccaccagagagcagagaagtacgtggtcagattagacaatgaaatccagactaagttcgaggtctttatgcgcagggtcaagcagaatccatacaccctttttgtccttgtgcacgataactctcatgtggagctgacatctgtaatctcgggaagcctaagccatagcgaaccaagtcatggattagccgaccgcgtcattaactgccgagaggtcctggaggctttcaatctcttagtcctacaggtatcttccttcccttacacactgcaaacacagcagtctaggatatcctcaagcaatgaggtgcactggattcagctggacactggcgaggatgtgggctgcgaggagaagctttacttcggtctttctgaatacagcaagagtctccagtggggtatcaccagtcccttgttaagatgtgatgaaacatttgaaaaaatggtgaatactctgctcgaacgataccctcgtctccacagtatggtggtccgttgttatttgctgatccagcagtatagcgaagcacttatggccctgacgacaatggcttctctgcgcgaccactccaccccagaaacactgtcgattatggatgatctaatctcgtcacccggtaagaacaagtctggcaggggacatatgctgatcatccgggttcctagcgtacagcttgcaatgctcgcgaaggaacgcttgcaagaggtgcgggataaattaggcctacagtaccgcttcgagataattctcggcaatcctgcaacagagctgagcgttgctacccacttcgtcgcaaggctcaaatcctggcgcggaaatgagcctgaagaatggattcctagaacctatcaggacctagacggtctcccttgcattgtcatcctgaccggtaaagaccctcttggagagacttttccacgctctctgaagtactgcgacttgcgcttgattgacagttcgtaccttacaagaactgctctggaacaagaggtcggtctagcgtgttgttacgtgagcaaagaagtaattcggggtccaacagtcgcattggacctctccgggaaggaacaagagcgcgctgctgtttcggagaacgactcagatgagcttctgattgatctggaacggccacagagcaattctagtgcagtgacaggaacctcaggcagcatcatggaaaatggggtgtccagctcttcaaccgccgataagtcccagaagcagtcactgaccccttcatttcaatctcctgcgacatctctcggtctggacgagggagtctcagcatcctcagccggagccggagccggagaaaccctcaagcaggagtgcgactctttgggcccacagatggcaagttccactacgtccaaaccgagctccagcagttccggccctaggacacttccgtggccaggacaacccatacggggttgtagaggacctcaagctgctctgccgccagtggtcatattgtctaaagctgcctatagcctgctggggtctcagaagtccggaaagctcccatcctccagttccttgttgccacatgccgatgtggcctgggtcagcagtctgcgccctcttctgaacaaggatatgtcctcagaagagcaatccttgtattaccgccaatggactctcgccagacagcaccacgccgattatagcaatcagctagaccccgcttctggaactcggaacttccatcctcgtcgactcctactgaccggccctcctcaggtgggcaaaaccggctcttacctccagttcctccggattttatttaggatgttaatccgactcttggaagtggacgtctacgacgaggaagagattaatacagaccacaacgaatccagtgaagtgtcccagagcgaaggggagccttggcccgatatcgaatccttcagcaagatgccttttgacgtctcagttcacgacccaaaatacagcctgatgtcactggtctatacagagaaattggccggagtgaagcaggaggtgataaaggaatcgaaggtggaggaaccacgtaaaagggaaaccgtgagtatcatgctcacaaaatatgccgcatataatacatttcatcattgtgagcaatgccgccagtacatggacttcacaagtgctagccagatgtccgactcaacgctgcatgcattcactttttcctcctccatgcttggagaggaagtacaactttactttattattccaaaatcaaaagagtcacacttcgtgttcagcaagcaggggaagcacctggagtctatgcgactgccactagtcagcgataagaatctcaatgctgttaaatcacctatcttcactccgtcctccggcagacacgagcatggactgcttaacctttttcacgctatggaggggatcagccatctccacctccttgtggtcaaggagtacgagatgccgttatataggaaatattggcccaaccacataatgctcgtgcttcccggaatgtttaataacgcaggcgtcggggctgccagatttttaattaaagagctgagctaccataaccttgagctggagcgaaaccgtctcgaggagcttgggattaaaaggcagtgtgtttggccatttattgtcatgatggatgactcttgcgtgctgtggaacatacattccgtacaggagccctcatcccaacctatggaggtgggagtgagctccaagaacgtgagtctgaagactgttctacagcacatagaggccaccccaaaaatcgtccattacgcgatcctgggcattcagaagtggagtagcaagctcacatctcagtctctcaaagcaccattctcacgatgccacgtacacgatttcattctactcaataccgacttaactcaaaatgtgcagtacgatttcaacaggtatttctgtgaggatgctgattttaatctccgcacaaattcatcaggactgcttatctgtaggtttaataacttttccctcatgaagaagcacgtgcaagtgggaggacagcgcgacttcataattaagccaaagatcatggtcagcgaaagccttgcccctatactcccccttcagtacatctgcgcccctgacagcgagcatacattgttggctgccccagcgcagttcttgttagagaagttcctccagcatgccagctataagttgttcccaaaagccattcataactttaggtctccagtcttagcgattgactgttatttgaatatcggaccggaagtggccatctgttatatcagcagccgaccgcactcatccaatgtgaactgcgagggagtgttcttctccggtcttctattgtatctgtgtgattcttttgtcggagctgatttgaagaagttcaaatttctgaagggcgcaactctctgtgtgatctgccaggatagaagtagcctcaggcagaccatagttagattggagcttgaagacgaatggcagtttcggctacgcgatgagttccagaccgcgaactcctctgatgacaaacctctctacttcctgaccggacggcacgtgta

SEQ ID NO: 50641 - DNA, 2229 bp, Artificial Sequence
  Description of Artificial Sequence: Synthetic coding sequence
atggggaactcctacgcaggtcagttgaagtccgccagattcgaggaagccctgcacaactctatagaggcgtcattgcggtgttccagcgtcgtaccacgccctattttcagccaactgtatttggaccccgatcagcacccttttagttcggcggacgtaaagccaaaagtcgaagacctggacaaggacctggttaaccgctacacgcagaacggctcgctggacttttcaaacaacctgaccgtcaatgagatggaagatgacgaggacgacgaggagatgagtgactcgaactccccacctattccttacagccaaaagcctgcgcctgagggcagctgtaccactgacgggttttgtcaagcagggaaagacctgcggctggtcagtttatgcatggagcaaattgatatccccgcaggtttcttgctggtgggtgctaaaagcccaaacctgcccgaacacattttggtttgcgccgtggataaacggttccttcccgatgatcatggaaagaatgcgttactcgggttctccggaaattgcatcggatgtggcgaacggggatttcgttactttacggaattctccaaccacatcaatttaaagctcacaacccagccgaaaaagcaaaagcacctgaagtactacctggtacgatcttcgcagggcgtgctgtctaagggcccactaatctgctggaaggagtgccggagccgacagtcctcagcaagttgccacagtattaaaccatcctcaagcgtttcctccaccgtgacgccagagaatggaaccactaacgggtataagtctggcttcacccaaacagacgctgcgaatggcaactcctcgcatggcggaaaagggagcgctagctcatctactccagcccacactggtaattattcgctcagtccaaggccaagttatgcatccggagatcaggccacaatgtttattagtgggccacctaaaaaacgccataggggctggtatcctggctcacctctacctcagccagggctggtggtgccagtcccaaccgtgaggcccctctcccggaccgagccgctcttatccgcgccagtgcctcagactcctctaaccggtattctacagcctaggcctatccctgccggagaaacagtaatcgtgcctgaaaatttgctaagcaactccggagtccggccagtgatcctaatcggctacgggacactgccctatttctacgggaacgtgggagatatagtcgttagcccactgctcgtaaactgttataaaattccccagttagagaacaaggacctggagaaactggggctgaccgggtcacagtttctgtccgtggagaatatgattcttctgactatccagtatttggtgcggctgggacctgatcaggtgcccttgagggaagagtttgagcagataatgcttaaggccatgcaggagtttactctgagggagagggcgttgcagatcggggcacagtgtgtgccggtttccccgggacagttgccatggctcgccaggctaatcgctagcgtgtcacaagacctggtgcacgtagtcgtcacacaaaatagcctcgcagagggtatatctgaaacactccgaacactgtccgagatgcggcattatcagaggcttcctgactacgtggtcgtcatttgtgcatccaaaataagaggaaatgagttttgtgttgtggttctcgggcagcaccagagccgggctctcgccgaaagcatgctaactaccagcgaatttctgaaggaaatcagctacgaactgattacggggaaggtcagcttcctggccagccattttaagaccacctcacttggtgacgatctggacaaactgctcgagaagatgcagcagagaaggggtgacagcgtggtgacccctttcgatggtgacctgaacgagtgcgttagccctcaagaagccgctgcaatgataccaacacaaaatttagatttagataatgaaacttttcacatttaccaaccccagctgacagttgctcgcaaacttctgtcacaggtatgtgcgattgcggactcaggttctcaaagcttggatcttggccacttctccaaagtggatttcatcatcattgtcccgaggagtgaggtgctggttcagcaaacattacaacggatcagacagagcgtgtctttccaggctttatgccacattgccaaccccgtcatgggatag

SEQ ID NO: 50642 - DNA, 5771 bp, Artificial Sequence
  Description of Artificial Sequence: Synthetic coding sequence
atgggtaatagctatgcaggacagctgaagagcgctagattcgaagaggcactccacaatagtatcgaggcatccctaaggtgttccagcgtggtccccagacctatctttagccaactgtatctggacccagatcagcacccgtttagtagcgccgatgtgaagcctaaggtggaggatctggacaaggatctggtgaatcgatatacacagaacgggtcattagacttcagcaacaacttgaccgtgaacgaaatggaggacgatgaggacgacgaagagatgtcagactctaactctccacctattccatattcccaaaagcctgccccagagggaagctgtaccactgacggtttctgccaggccggaaaggacttgcgcctggtgtcattatgcatggaacagatagatattccagccggtttccttcttgtcggcgcaaaatctcctaacctcccggagcatatcttggtatgtgcagtcgataagcggtttctgcccgatgatcacggaaagaacgcactattgggattctccgggaactgtatcggctgcggggagaggggtttccgatacttcacagaattcagcaatcacattaacctgaaactgactacccagccaaaaaagcagaagcacttgaagtattatctggtgcgttcaagtcaaggagttctgtcaaaaggaccactgatatgctggaaggagtgtcggagccggcagtctagtgccagttgccactctattaagcccagtagcagcgtcagtagtaccgtgacacctgagaacggcaccactaatgggtataagagtgggtttacgcaaacagacgctgcaaacggcaactcttcccacggaggcaagggatccgcttcttcatccacccctgctcacacaggcaattacagtctgtctccccgaccctcttacgcaagcggtgaccaggcaactatgtttatttcaggaccgcctaagaagagacaccgtgggtggtacccaggctccccattgccccagccagggctggtagtcccagtgccaaccgtgcggccattatcacggaccgaaccactgctgtctgcgcctgtgccccagacaccacttaccggcatcctccagccaagacccatcccggctggcgaaaccgtgatcgtgccggaaaacttgttgagcaactcgggggtccgcccagtgattttaatcgggtacgggacactgccctacttctacggcaatgtcggggatatcgtggtctccccactgctggttaactgttataagatcccgcaactagagaacaaagatctggaaaaactaggtctcactggctcccagttccttagcgtagaaaatatgatcctcttaaccatccaatatctggtgcgtctgggcccagaccaggtccctctgagggaagagttcgagcagatcatgctgaaggccatgcaggagtttacattgcgggagagagctctgcagattggcgcacaatgcgtgccagtgagtcccggacaactgccatggcttgctagattaattgcatcagtttctcaggatctggttcatgtggttgttacccaaaattccctggccgagggtatcagcgagaccctgcgtacattaagtgagatgcgacactaccagaggttgcccgactacgtggtggttatctgcgcatctaagattcggggtaatgagttctgtgtagtggtgcttgggcagcatcagagcagagccctagccgagtccatgctaaccacctcggaattcctcaaggaaattagctacgagctgattaccggtaaggtgagcttccttgcttctcatttcaaaacaacctccctgggcgacgacttagataagttactggaaaagatgcagcaaagaagaggagactccgttgtgacccctttcgacggggatcttaacgaatgcgtttcacctcaggaagccgcagccatgattcctacacaaaatcttgacctcgataacgagacttttcacatttatcaacctcagttaacggtggcaaggaagctcctgtctcaagtgtgtgcaatcgcagatagtggctcacagagcctggaccttggccacttcagtaaggtagactttataattattgtgccaagaagcgaggtcctggtacagcaaactctgcaacgtattagacagagtggggttctcgtagacctaggcctggaggaaaatgggaccgctcaccagagggcagagaagtacgtcgtgcggctggataatgaaattcagacgaagtttgaggtttttatgcggagggtgaagcaaaacccgtatactctgtttgtgcttgtccacgacaactcacatgttgaattgacgagcgtgatctcgggctcgctttctcatagtgaaccctcccatggtctggccgatcgtgtgatcaactgccgtgaggtgctcgaagcttttaatctcttagtgctgcaggtatcaagttttccttataccctgcagacgcagcaatcacgcatttcctcttccaacgaagtccactggatccaactagacaccggggaggatgtgggctgcgaagagaagctatacttcggcttgtctgagtactctaaaagcttacagtggggcattactagtccattgctcaggtgcgatgaaacgttcgagaagatggttaacacactccttgaaaggtaccccaggttacactctatggttgtgagatgctacctcctcattcagcaatacagtgaagccttgatggccctgacaacaatggcatcccttagggatcactcaaccccagagacactttcgatcatggatgacctgattagttctccaggtaaaaacaaaagcggcagagggcatatgttgatcattcgggttccctccgtacaactggctatgttggctaaagagaggctacaagaggtgcgcgacaagctgggactgcagtataggttcgaaatcatcctgggaaaccctgccactgaactgtctgtggctacacacttcgtcgcccgtctcaagagctggcggggtaacgagcctgaagaatggattccacgaacataccaggacctagacgggctgccctgtattgtgatcctgacgggcaaagaccctctcggagagacctttcccagatctcttaagtattgcgacctcaggctaatagactctagctatcttaccagaaccgcccttgaacaggaggttggcctggcctgctgttacgtgtctaaggaagtcatccggggtccgaccgtagctttagatctatcaggcaaggaacaggaacgggcagccgtaagtgagaatgatagcgacgaattgctgatcgacctcgaacgacctcagtcgaattcctctgctgtcactgggacaagtggtagcattatggagaacggcgtgtctagctcatcaaccgcagacaaatctcagaaacagagtctgacaccaagctttcagtcccctgccacctcacttggcctcgacgagggcgtatctgcctcctccgccggtgcaggtgccggagagaccctgaagcaggagtgcgattccctgggcccacaaatggcttccagtacaaccagcaagccgagtagctcttcatccgggccacgcaccctgccttggcccggacagcccatccgaggatgcaggggaccgcaagctgccctgcctcccgttgtaatactgtcaaaggccgcttatagtctgttggggagccaaaagagcggaaagctaccgtccagctcctccttgctcccacatgccgatgtggcatgggtctcttctctgcgtcctctcctcaataaagatatgagtagcgaggaacagagcttgtattatcggcagtggaccctcgctcggcagcaccacgcggattattctaaccagctggatcctgcctctggtacccgcaatttccaccccagacgactgctcttgacgggacctccccaagtaggtaaaactggatcctatttacagtttctgaggattctctttagaatgctcattagacttctggaagtcgacgtgtacgacgaggaagaaattaacactgatcacaacgagtctagcgaggtatcccagagtgaaggggaaccctggccggatattgaatcttttagcaaaatgcccttcgatgttagtgtccatgaccctaagtattccctaatgtccctagtctacactgaaaagctagctggtgtcaagcaggaggtaatcaaagaatccaaagtcgaggagccgagaaaacgcgagaccgtgtcgatcatgctgacaaagtacgcggcatataatacgtttcaccactgtgagcagtgcaggcagtacatggatttcaccagcgcaagccagatgtccgactccaccctacatgcctttacttttagctcaagtatgttgggtgaggaagtgcaactttattttattatccctaaaagcaaagaatctcactttgtattctctaaacagggcaaacacctggaaagcatgcgacttccccttgtcagcgacaagaatctcaacgccgtgaaatcccccatcttcacaccttcttctgggagacatgagcacgggctgttgaatctgttccacgcaatggaagggatctcccacctccacctgctggtcgtgaaagagtacgagatgcccctgtaccggaaatattggccaaaccacatcatgctggtgctgcctgggatgttcaataacgccggagttggggctgcgagattcttgattaaggagcttagttatcacaacctggaactcgaacgcaataggctggaggagctggggataaagcgccagtgcgtgtggcccttcatcgtgatgatggacgactcatgtgtgctctggaatattcactcagttcaggagccaagctcccagcccatggaggtgggcgtgtccagcaagaatgtgtccctgaagaccgtgttacagcatattgaagccacccccaagatcgtgcactacgccattctgggaatccagaagtggagctctaagcttacttctcagagcctcaaagcgcctttttctagatgccacgtgcacgatttcatcctattgaacacggatctgacccagaatgttcagtatgattttaacaggtatttttgtgaggacgcggacttcaatttgaggaccaacagtagtgggcttctgatctgtcgctttaacaatttttcactcatgaagaaacatgtgcaggtgggtgggcaaagagacttcataattaaaccgaagattatggtcagcgagtcgcttgccccaattctgcctttgcaatacatctgtgcgcctgacagtgagcacaccctgcttgcagctcctgcccagttcctattagagaagttccttcaacacgcgagttataaactgtttcctaaagcaatccacaactttcggagccctgtactcgccattgattgctatttgaacatcggccctgaagtggcgatctgttacatatcatcaaggccacacagcagcaatgttaattgcgagggtgtgttcttcagcggcctgttgctgtatctttgcgattcgtttgtaggggcagacctaaagaaattcaagtttctgaaaggcgcaaccttgtgcgtaatctgccaggacagaagcagcttgaggcaaaccattgtgaggctggaacttgaagatgagtggcagtttcggctgagggatgagttccagacagccaatagttccgatgacaagcccctctacttcctgacaggaagacacgtgta

SEQ ID NO: 50643 - DNA, 2244 bp, Artificial Sequence
  Description of Artificial Sequence: Synthetic coding sequence
atggggaactcttacgcaggccagctgaagtccgcacggtttgaggaggctttgcataatagcatcgaggctagcctgcgttgttcttccgttgttcctagacctatctttagtcagctatatctggacccagatcagcacccattttcaagtgccgatgtgaagccaaaagtcgaggacctcgacaaagatctggttaaccgatatacacaaaacgggagcttggatttttcaaacaatcttaccgttaacgaaatggaggatgatgaggacgatgaggagatgtcagattcgaattctccgccaatcccttattctcaaaagcccgctcccgagggctcttgtacaaccgatggcttctgtcaggcgggtaaggacctgcgactggtgagtttgtgcatggagcaaattgacatacctgccggttttttgcttgtaggtgccaaatccccaaatttaccagagcacattttggtctgtgccgttgataaacgattcctgccagatgaccatggcaagaacgctctacttggattcagcgggaattgcattggttgcggcgaaagaggatttagatactttactgaattttcaaatcacatcaacctcaagctcactacacaaccgaagaagcagaaacatttaaagtattatttggttcgttcttcgcagggagtgctgagtaagggacctctcatatgttggaaagagtgcaggagtcgacagagctccgcttcatgccattcaatcaaacctagcagctccgtctctagtaccgtcacaccagaaaacggcacaactaacggttataaaagcggcttcacacagaccgatgccgctaacgggaattcctcacatgggggtaaaggatctgctagtagcagcactcctgctcatactgggaattatagcctttcaccaagaccctcttatgcaagtggtgatcaggctactatgttcatctccggacctcccaaaaaaagacacaggggatggtaccctggtagtcctttgccacaacccggactggtagtgccagttccaactgtgagacctctgagtaggaccgagcctttgttgagtgcacccgtgccacaaacaccattaaccggcatattgcagcctaggcccattcccgcaggcgaaaccgtgatagtgcccgagaatctgctatcgaatagcggcgtacgccctgtgattttgattgggtacggaaccctgccatatttctatggcaacgttggggatatagtcgtgagccctctactcgtcaattgctacaaaataccacaactcgagaacaaggacctggagaagctgggtctgaccggcagccagttcctgtccgtggaaaacatgatcttgctcacgattcagtacttagtgaggctgggacctgaccaggtcccactccgcgaagaattcgagcagatcatgctgaaggccatgcaggaattcactctgagggaaagagccctgcaaataggagcccagtgcgtgccagtctccccaggtcaattgccctggctcgcacgtctcatcgcgtctgtctcgcaggatctggttcacgtggtggttactcagaattctttagccgaaggtatcagtgagacccttcgtaccctctccgaaatgcgtcactaccagcgcctgcccgattacgtcgttgtcatctgcgcaagcaagatccggggaaacgagttctgcgtcgtggtcctgggacagcatcaaagcagagcactcgctgagagcatgcttacaactagcgaattcttgaaggagatcagttacgaactcatcactggcaaagtttcgtttctcgcctcacactttaagaccacaagcctgggagacgatctcgataagcttctggaaaaaatgcaacagcggaggggggactccgtagtcactcccttcgatggagatctgaacgagtgcgtttctccccaagaagctgccgcaatgattccaacacaaaatctcgatctggataacgagaccttccacatatatcaaccccagctaactgtcgccagaaagctgcttagccaggtttgcgctatcgccgatagcggtagccagagtttggacctggggcacttcagcaaagtggacttcatcattatagtgccaaggtcagaggttctggttcagcagaccctccaaagaatacgacagagtgggtcctcacccggttcccacatcgcctttagctacgtgctcttcatctcatgcaacttgtag

SEQ ID NO: 50644 - DNA, 531 bp, Artificial Sequence
  Description of Artificial Sequence: Synthetic coding sequence
atgtgcctagagctgttccattcttccaacgtcatcgatggtctcaagctcaacgctttcgccgctgtgtttacagtgctctctggcttgctcggcatggtggcccacatgatgtacacacaggtttttcaagtaactgttagcctcggacccgaggattggaggcctcattcatgggattatgggtggagcttctgcctggcatggggaagctttacctgctgcatggcggcttcggtgaccacactgaattcctatactaaaactgtcattgagtttagacataagaggaaggtatttgagcagggctatcgggaagagccaactttcattgaccccgaggccataaaatattttagggagcggatggaaaagcgggatgggtccgaggaggattttcacctggactgtcgtcatgagaggtatcccgctcgacatcaaccccacatggccgacagttggcctcggagtagcgcacaggaggctcccgaattgaatcgccagtgctgggtcttaggccactgggtctag

SEQ ID NO: 50645 - DNA, 585 bp, Artificial Sequence
  Description of Artificial Sequence: Synthetic coding sequence
atgtgcttggaactatttcatagtagtaatgtgatcgatggactgaaactgaatgccttcgctgcggtgttcactgtgctgagcggtctgctgggaatggtcgcccacatgatgtatacgcaggtcttccaggtcacagtgtccctcggcccagaagattggagacctcactcatgggattatggatggagtttctgtctagcatggggctcttttacatgttgcatggccgcatcggttacaactctgaactcttacactaaaacagtaatcgagttccggcataagagaaaagtgtttgagcaaggctatagggaagaacccacttttattgaccctgaagccatcaaatatttccgcgaacgctggcaaatcgaagcgcagagggggagagctacttgccccaggtcccactcttggatggaaaagcgagacgggtccgaagaggacttccacctggactgccgccacgagagataccctgctcgccaccagccccacatggctgattcctggcctcgaagctccgctcaggaggccccagagctgaatagacaatgctgggtgctgggccattgggtgtag

SEQ ID NO: 50646 - DNA, 843 bp, Artificial Sequence
  Description of Artificial Sequence: Synthetic coding sequence
atgaaaaccagtaggaggggcagagcacttctggcagtggccctcaacctgctggccttattgtttgccaccaccgcttttctcacaacccactggtgccaggggacgcaaagggtgcccaaaccagggtgtgggcaaggaggaagggctaactgcccaaactccggggctaacgctaccgccaatggcacagcagcccctgcagcggcagccgctgcagctacagcttccgggaatgggccacctgggggtgcactgtatagctgggagacaggcgacgacaggttcttattcagaaactttcacacaggtatatggtactcctgcgaggaggagctgagtggccttggagaaaagtgtaggagctttatcgatcttgctccagcaagcgaaaaaggcctgctgggaatggtagcacatatgatgtacacacaggttttccaggtgaccgtcagtctaggtccagaggactggagacctcatagttgggactacgggtggagtttttgtctcgcctggggaagcttcacgtgctgcatggctgcgtcggtgaccactcttaactcctacactaagaccgttatagaattcaggcacaagagaaaagtttttgagcagggctacagggaggagccaaccttcatcgatcccgaggccatcaagtatttccgggagcgaatggaaaaaagagacggtagtgaggaggacttccatctggattgtcggcacgagcggtatcctgcccgtcaccagcctcatatggctgattcttggcccaggtcctccgcgcaagaggctcccgaactcaacagacaatgctgggtgctcggccactgggtgtag

SEQ ID NO: 50647 - DNA, 996 bp, Artificial Sequence
  Description of Artificial Sequence: Synthetic coding sequence
atgaagacaagtcgcaggggaagggcgttactggctgtggctctcaatctcctcgccctgctgtttgctaccaccgcatttctcacgacacattggtgccaggggacgcaaagggtgccaaagccgggatgcggtcaggggggtcgcgctaactgtcctaacagcggagctaatgccaccgcaaacggaactgccgctccagctgccgcagcagcagcagctactgcctccgggaatgggccaccaggcggtgccctgtatagttgggaaacaggcgacgaccggttcctctttaggaacttccatactgggatttggtattcatgtgaggaggagctgtcaggtctgggggaaaagtgcaggtccttcattgacctcgcccctgcctccgaaaagggtgtgctctggctctccgtggtgtccgaagttttatacattctgcttttagttgtcggcttcagccttatgtgtctggaactgttccacagctctaacgtaatcgatggcctaaagctgaatgcgttcgccgctgtgtttactgtgctgtcagggttgctgggaatggtagctcacatgatgtacacccaagtcttccaggttacagtttccctgggccctgaggattggcggccacactcatgggattatggctggagtttttgtctggcctggggttctttcacctgctgcatggccgcatctgtgacgactctgaacagctacaccaagaccgtgatcgagttccggcacaaacgtaaggtctttgagcaaggttacagagaagaacccaccttcatcgatccggaggctatcaaatatttcagagagcggatggaaaaaagggacggatctgaggaggattttcatctggattgtaggcatgagagatatccggcacgacatcagccacacatggctgactcgtggcctaggagcagtgcacaggaagctccagaactcaatcggcaatgctgggtcctcgggcattgggtgtag

SEQ ID NO: 50648 - DNA, 1479 bp, Artificial Sequence
  Description of Artificial Sequence: Synthetic coding sequence
atgtggcggggattatggactttggccgcacaagccgctcgcggtcccagacgactctgcaccagacgaagctccggcgctcctgcaccaggctcgggtgctactatatttgctctgtcttccggacagggtcgttgcgggatcgctgtgatccggacctccggacctgcaagcggacacgcgctgcggatcttgacagctccacgggacctgccactcgccaggcacgcctccctgcggctcctgagtgatcctaggtccggcgaacccctcgaccgcgcactggtactctggtttcccggaccccaatcgttcaccggggaggattgtgtcgagttccatgttcatgggggtccagccgtagtttcaggcgtgctgcaggctctggggtccgtaccaggcctccggcctgccgaggccggagaattcacccggagagccttcgccaatggcaaactcaacctgacagaagtggaaggcttggctgacttgatccacgcggagacggaggcccaacggaggcaggccctgcgccagttagatggtgagctgggccatctttgtagaggatgggctgaaacactgactaaggccctcgcccatgtggaggcttacattgattttggggaggatgacaatctggaagaaggggtactcgaacaggctgatatcgaagtcagggccctgcaggtggccctcggcgctcacctcagggacgctaggcggggtcaacggctgcgttctggggtccacgtcgtggtcacgggacctcccaatgctgggaaatcttcattagtcaaccttctgtcccgcaaacccgtaagcatcgtttcgccagaaccaggtacgacacgcgacgtactggagacccccgtggatttagccggattccctgtactcctgtccgataccgctggcctgcgggaaggggtcggccctgtagagcaagaaggcgtgcggagggcacgggagcggttagagcaggcggatctcatcctggctatgcttgatgcttcagacttggcctctccatctagctgtaatttccttgccaccgtagttgccagcgttggggcacaaagtccatctgattcctctcaacgcctgctcctggtccttaataagagcgatctactgtcccctgaaggcccaggcccaggccctgatttgcccccacacctgttgctatcttgcctgactggcgaaggattagacgggttgcttgaggcgctgaggaaggagctggccgctgtttgcggggacccctctaccgacccacccctgctaactcgggcacgacaccagcatcaccttcaaggttgtctggacgcgctgggacactacaagcagagcaaagatttagcactggccgcagaggcactgagggtggctagagggcaccttacacgtcttacaggcggtggcggaacagaagagattttagatatcatattccaggacttctgcgtcgggaaatag

SEQ ID NO: 50649 - DNA, 1575 bp, Artificial Sequence
  Description of Artificial Sequence: Synthetic coding sequence
atgtggaggggcctgtggacacttgcagcccaggctgcccgaggcccacggagattgtgtacccgcagatcctcaggggctccagccccaggctctggcgctactatattcgctctatcctcgggccaagggagatgcggcatcgccgtcattagaacatccggtccagcttccgggcatgctctgagaatacttacagctcccagggatctgcctctggcacggcatgcttccttgagactcctgtcagatccgcgatccggcgaacctttggatcgggcacttgttctctggttcccaggccctcagtcttttacgggagaggactgtgtggaatttcatgtccacgggggacccgctgtagtgagcggcgtcctgcaggcccttggttcagtgcccggtttgcggcctgcagaggccggagagttcacacgaagggccttcgccaatggaaagctgaacctcactgaagtggaggggctcgctgatttgatacatgccgaaacggaggctcagaggaggcaagctctccggcaattagatggggaacttggccacctgtgccgtgggtgggcagaaacattgacaaaggctttagctcacgtggaagcctatatcgactttggagaagacgacaacctggaggaaggggtgcttgagcaggggggatccacttggtggtgggggagaaaaacaccacacattagcccacaacggctgccgagtctgtctttgtccgcttgccttctctctcctacggctgatatcgaggtccgtgcattgcaagtggcactcggagctcatctccgcgatgcaagacggggtcaacgcttgaggtctggagtgcatgtagtcgtcaccggacccccaaacgcgggaaagtcctctctcgtgaacctgctgtctcgcaagcccgtcagtattgtgtcccctgaacccggtaccacacgcgatgtgttggaaacccctgtcgatctagctggattccccgtcctcctgtctgacaccgcgggtttgcgcgagggagtgggtccggtggagcaggagggcgtgcggcgagcccgagaacggctagagcaggctgacttgatactggccatgctggacgcatctgaccttgcgtctccaagttcctgcaacttcctggccaccgtcgtagcctcggtgggtgcacagagcccatcggactcctctcagcggctcctgctcgtgctgaataaaagcgatcttctgtctccggaggggccaggccctggaccagacctcccccctcatctgttacttagttgtcttaccggggagggactcgatggcctcctagaggctctcagaaaagagttagccgctgtctgtggcgatccgagcaccgacccgcctctcttaacaagggccagacatcaacatcacctccaggggtgcctggacgccctgggccactacaagcagtcaaaggacctggcgttggctgctgaagcactcagggtggcccgaggacacctcacacgattgaccggtgggggtggaaccgaggaaattttagatatcatcttccaggacttctgcgttggcaagtag

SEQ ID NO: 50650 - DNA, 1545 bp, Artificial Sequence
  Description of Artificial Sequence: Synthetic coding sequence
atggtacattctcccacatgtcctcatccgtgttttctgctggtgccagcgagcgagccacagtttcctcacctccaaacccccgacccaggagacgcagtttggaacgtgaggtgggccctgtgcacaaggagaagctccggtgctcccgcacccggaagcggagctactattttcgccctgagcagcggtcagggcagatgtgggatcgcagtcatcaggacatcagggccagcaagtggacatgccctacggatcctcaccgccccacgcgacctacccttagctcgccacgccagcttgcggctcctatctgacccgaggagcggggaacccttggaccgcgcactagtgctctggtttcccggacctcagtcttttaccggggaagattgtgtcgagttccacgtgcacggcggacctgccgtggtcagtggagtactgcaggcccttggctctgtacccggattaagacctgctgaagcgggtgagttcacgcggagagcctttgctaatggcaaactcaatttgaccgaggtggaggggctcgccgatctcatccatgctgaaactgaggcccaacgacgccaggcccttagacagctagatggggagcttggccacttgtgcaggggttgggcggaaaccctgacgaaggcccttgcacacgttgaagcctatatagattttggcgaagatgacaacctagaagagggtgtgctggaacaggctgacattgaggtacgcgctttgcaggttgctctgggtgcacacctgcgggacgcaagaagaggccagaggcttaggtcaggcgtgcacgttgttgtgacagggcctccaaacgccggtaaatcatccctggttaatctccttagccggaaacctgtgtctatcgtgagccctgaaccaggtactacaagagatgttcttgaaaccccagtggacctcgcagggtttcccgtcctcctgtcagataccgccggacttagggaaggggttgggcctgtggaacaggagggggtaaggagagcacgcgaacgtcttgagcaggctgacttgattctcgctatgcttgatgcctctgacctggcatctccttcttcctgtaattttctggctacagtggtcgctagtgtgggtgcccagtctccttcagatagtagtcagcggctgctgctcgtgctgaataagagcgacttgctgagtccggaaggtccagggccaggcccagaccttcctcctcatctgttgttgtcatgtctgactggggagggactagacggactgctggaggctctccgcaaggagctggccgctgtttgtggagatccttccaccgatcctcctcttcttactagagcaagacatcaacaccacctgcagggctgtctagacgccctaggacactacaagcagagtaaagatctcgccttggcagcggaagctctgcgagtagccagagggcacctgactaggctgactggcggtggtggcaccgaggagatcttagacatcatatttcaagatttctgtgtgggcaagtag

SEQ ID NO: 50651 - DNA, 456 bp, Artificial Sequence
  Description of Artificial Sequence: Synthetic coding sequence
atgtggcgtggactctggaccctggcggctcaggccgcacggggtccacgcaggctgtgcacccggaggtcctccggggctccagctcccggttctggtgctaccatattcgctctttcttcggggcagggtcggtgtgggatagccgtaataagaacctcaggtcccgcttccggccacgctctgcgtatcctgaccgcccctcgggaccttcccctcgcccgtcacgcctcacttagactcctgagtgatcctcgtagcggcgaaccactggatagagccctggtgctgtggtttccaggccctcaaagtttcacaggtgaggattgcgtggagtttcacgtacacgggggtcccgcagttgtgtcaggagtcctccaagctctgggttctgtgcccggattgcgtcccgcagagcctggagccggacgtgggtctgctcagggatgcacctag

SEQ ID NO: 50652 - DNA, 1416 bp, Artificial Sequence
  Description of Artificial Sequence: Synthetic coding sequence
atgtggaggggtctctggacccttgcagctcaggctgcgaggggaccccgtcgcctgtgcacccggcgaagttccggggctcccgcaccaggctctggcgctactattttcgcattgtcatctgggcaaggacgctgcgggatagccgtcattaggacatctggcccagcctccggccatgcccttcggattctaacagctcccagagatttgcctctagcccgacatgcaagcctgcgtctgctctcagatcctcggagcggcgagcctctggatcgcgcattggtgttgtggttcccaggtcctcagtccttcaccggcgaagactgcgtggagttccacgtgcatggagggcctgcggttgtgtctggcgtgctgcaggctctgggtagcgtcccaggcctgcgacctgccgaggccggtgaattcacgaggagggcatttgcaaatggaaagttaaatctaaccgaagtcgaagggctggccgacctgatccacgctgagaccgaggcacaacggaggcaagccctgaggcaactggacggtgagctggggcatttgtgccgaggctgggcggagaccctgactaaggccctcgcgcacgtggaagcctatatcgactttggggaagacgataacctggaggaaggtgtgctggagcaggcagatatcgaagtgagggctctgcaggtggccttgggcgcacatctcagagatgccagacgaggccagcgtctccgaagtggcgtccacgttgtggtgactggcccaccaaacgccggaaagagttctctcgttaatctacttagcaggaagccagtgagcatcgtttcccctgagccaggcactacccgcgacgtcctcgaaaccccagttgatctagctgggttcccggtccttctgtccgacacggccggtctccgggagggtgtaggtcccgtagagcaagagggagtgcgcagagctcgagaatcttgcaactttcttgcaaccgtggtcgcttcagtgggtgcccagagcccttctgatagctctcagagactgttgttggttcttaataagtcagatctgttgtcccccgagggtcccggtcccggaccagatctgcctccacacctgctccttagctgccttactggggaagggctggacgggctgctggaggcactacggaaagaattggcagcagtgtgcggcgacccaagcacggatcctcccctcctgacaagggccagacaccagcaccatctccaggggtgcctggacgcactgggacattacaaacagagcaaagatctggctttggctgcagaggcactgcgggtcgctaggggccatcttacgcgactgacaggaggcggagggactgaggagatcctcgacatcatattccaggacttttgcgtcggaaaatag

SEQ ID NO: 50653 - DNA, 423 bp, Artificial Sequence
  Description of Artificial Sequence: Synthetic coding sequence
atgaggaaggtcaagttcactcaacaaaactatcatgatcgtctatcccaaattctgacagactttcccaagctggatgacattcatcccttctatgctgacctcatgaatatcctctatgacaaggaccattataaacttgcactcggtcagatcaatattgctaagaacctggtggacaacgtggcaaaagactatgtacgactcatgaaatacggagactctctgtatcgatgtaagcagctcaagagagccgctctgggcaggatgtgcacagtgatcaaacgccagaagcagtcactggagtatttagagcaggtacgtcagcatctgagtaggctgccaacaattgacccaaacacacggacattgctgctttgcggatatccaaatgtgggaaagtcctcctttatcaacaagtag

SEQ ID NO: 50654 - DNA, 1905 bp, Artificial Sequence
  Description of Artificial Sequence: Synthetic coding sequence
atggctcactataatttcaaaaaaatcaccgtggtcccgtctgccaaggacttcatcgatttgaccctgagtaagacccaaagaaaaacccccacagtcatccataagcactatcagatccacagaatccgacatttttacatgaggaaagtgaagttcacacaacagaactaccacgacaggctctcacagatacttaccgattttcctaaattggatgacattcatcctttttacgcagacctgatgaatatcctctatgacaaggatcactacaagcttgccttaggtcaaattaacattgctaaaaatcttgtcgacaacgtagctaaggattacgtgagactgatgaagtacggagacagcctctatagatgcaagcagctcaagagagcagccctgggcagaatgtgcactgtgatcaaaaggcagaagcagagcttagagtatctggaacaggtgagacagcaccttagccggctgcccacaattgacccgaacaccagaaccctcctgctatgtggttaccccaatgtcgggaaatcttcctttattaacaaggtgacaagagctgacgttgacgtgcagccctacgcttttaccacgaaatccctgtttgtgggccacatggactacaagtatctgaggtggcaggtggtggatacaccgggtatcctggaccaccccctcgaagatcgaaatacaatagagatgcaagccataacggcattggcccacctgcgtgctgccgttctatatgtcatggatttgtctgaacagtgtgggcacggcctgcgtgagcagctcgagttgtttcagaatattcgcccattgttcattaacaagcctctgatagtggtagcaaacaagtgcgacgttaagcggatcgccgagttatccgaggacgaccagaaaatatttaccgatctccagtcagaagggttcccagttatcgaaacttcgaccctcacagaggagggcgtgattaaagtgaagaccgaagcctgcgaccggctcttggctcatagagtggagaccaaaatgaaagggaataaagtgaatgaggtcttaaatagactgcatttggccatcccgacacgcagggatgataaggaacgaccacccttcatacctgaaggggtggtggcacgtcggaaaagaatggagactgaggaaagtcggaagaaacgtgaacgtgacctggagcttgagatgggggatgattatatcttagatttgcagaagtactgggatctgatgaacctttccgaaaagcatgacaaaatccctgaaatctgggaggggcacaacattgccgactacatcgaccccgcaataatgaagaagctggaggaacttgaaaaagaggaggagctgaggaccgcagcaggtgagtacgactccgtatctgaaagtgaggacgaagaaatgttggagatcagacagctagccaaacagatccgggagaaaaagaagctgaagattcttgaatccaaggaaaagaacacccagggtccacgcatgccacgcacagcaaaaaaagtgcagcgtaccgtgctggaaaaagagatgcgaagtcttggcgtagacatggacgacaaggatgacgcccattacgctgttcaggccagaaggagcagatcaattacaagaaagagaaaacgagaggacagcgcaccaccatcatcggttgccagaagtgggagctgcagtcgtacccctagggacgtttcagggctgcgcgacgtgaagatggtgaagaaagctaagacaatgatgaagaatgcacagaaaaaaatgaacaggctggggaagaaaggcgaggccgatcggcacgtgtttgatatgaaacccaagcaccttctcagcggaaagcgcaaggccggaaaaaaggatcgacgctag

SEQ ID NO: 50655 - DNA, 1557 bp, Artificial Sequence
  Description of Artificial Sequence: Synthetic coding sequence
atgaagtatggagactccctgtatagatgtaagcagttaaagcgcgcagccctggggagaatgtgcacagtgattaagagacagaaacagagcctcgagtatctcgaacaggtgcgtcagcatctttccaggctaccaacaatcgatcctaacacccgaacactcctattatgcggatacccaaatgtaggcaagtcctcctttatcaacaaggtgacgcgagccgatgtggatgtgcagccgtatgccttcaccactaagagcctctttgtcggccacatggactacaagtacttacgctggcaggttgtggatacacctggaattctggaccatcccttagaagaccgcaacactatcgaaatgcaggcaatcactgcgctggcgcacctccgagcggctgttctgtacgtgatggatctttcggagcagtgtggccacggtctcagggagcagctcgaactgttccaaaatattcgaccactctttatcaataaacccctgatcgtggtggccaacaagtgcgatgttaaaaggatcgctgagctgagcgaggatgaccaaaaaatcttcactgatctccagtcagagggcttccctgtaattgaaacctccaccctgaccgaggaaggcgtgattaaagtgaagaccgaagcctgcgataggttgctcgctcaccgcgttgaaactaaaatgaaaggaaacaaggtcaatgaggtgctgaatagactccatctcgccattcctacccgacgagatgacaaggagaggcctcctttcatccccgagggcgtcgtggctcggagaaagcgcatggagaccgaggaaagccgaaaaaagcgtgagcgggatctggaactcgaaatgggcgatgattacattttggatctccagaagtactgggatcttatgaatctatctgagaagcatgataagattccggagatatgggaaggtcacaacattgcggattatatcgaccccgcaatcatgaagaaactggaggaacttgaaaaggaagaggaactaagaactgcagccggagaatatgatagcgtgagtgagtctgaggacgaggaaatgctcgagattcgccagctcgcgaagcaaataagagaaaaaaagaaactcaagatcctggaatccaaagagaagaatacccagggcccacgcatgcctcgcaccgcgaagaaggttcagaggaccgtgcttgagaaggaaatgcgttccctcggcgtggatatggatgataaggatgacgcgcactatgcagttcaggctcgcagatcccggagcatcacccgcaagcgaaagcgggaagattcagcaccgccttctagcgtggctcggagtggatcatgttcccgcactcccagggatgtctccgggctgcgggatgtgaaaatggtaaagaaggctaagactatgatgaaaaatgctcagaaaaagatgaaccgcctcggaaaaaagggcgaggccgacaggcatgtgtttgatatgaagcctaagcatctcctgagcgggaagagaaaagcaggtaaaaaagaccgaagatag

SEQ ID NO: 50656 - DNA, 1764 bp, Artificial Sequence
  Description of Artificial Sequence: Synthetic coding sequence
atgcggaaggttaagtttacgcagcagaactatcacgacaggctgtcccagattttaacagacttccccaagcttgacgatattcaccctttttatgcggaccttatgaacattctctacgataaggatcactacaagctagcactggggcagattaatattgcgaagaatttggtggataatgttgccaaggattatgtgcgccttatgaagtacggggactccttgtatcgttgcaaacagttaaaaagagctgctcttggaagaatgtgcaccgtaataaagagacagaaacagagcctggagtatctggaacaggtcagacaacatctttcccggctaccgacaatagatccgaatactaggacgctgttgctatgtggataccccaatgtcggaaagtcttctttcatcaacaaagtgacccgggctgatgtggacgtgcaaccatacgcttttaccactaagtctctgttcgtcggtcacatggactacaaatatctgcggtggcaagtggtggacacaccaggcattctggaccaccccctggaggaccgaaacacaattgagatgcaggcaattaccgctctcgcgcacctccgtgctgctgtactttatgtgatggaccttagcgagcagtgcgggcatggcctgagagagcaactggagcttttccaaaacattcggccattattcatcaataagcctctgatcgttgtcgcgaacaagtgcgatgtaaagcgaattgctgagctgagtgaagacgatcagaaaatctttaccgacctgcagagcgaaggctttcccgttatcgaaaccagtaccctcacagaggaaggcgtcatcaaggtcaaaacagaagcctgcgataggctcttggcccatcgtgtcgagaccaaaatgaagggaaataaggttaatgaggtcctgaataggttgcatctggcaatccccaccaggagagacgataaggaaaggccaccattcattcccgagggtgtggtggccagacgtaagaggatggaaaccgaagagtcccgaaagaagcgtgagcgagaccttgaactggagatgggcgatgattacatcctggacctgcagaagtattgggacctgatgaacctctccgagaaacacgataaaattcccgagatctgggaggggcataatatagcagattatatcgaccccgcaatcatgaagaaactggaagagctagagaaggaggaagaactgcgtaccgcagccggtgagtacgactcagtttctgaatctgaagatgaggaaatgcttgagattcgccagctcgctaagcagattagggaaaaaaaaaagcttaaaattctggaatcaaaggagaaaaatacccagggtccgagaatgccaagaaccgcgaagaaagtgcagaggaccgtgctggagaaggaaatgcgctcactcggcgtcgacatggatgataaggatgacgcgcactacgcagtgcaggctcgccgatctaggtctatcacaagaaagcgaaagagggaggatagcgccccaccctccagtgtcgccagaagtggatcttgtagcagaacccccagggatgtaagcggccttcgagacgttaagatggtgaagaaggccaaaacaatgatgaagaatgctcaaaagaagatgaacagactggggaaaaagggcgaagctgaccggcacgtgtttgacatgaaacctaagcatctattgtccggtaaaagaaaagcgggtaagaaggatcgcagatag

SEQ ID NO: 50657 - DNA, 1998 bp, Artificial Sequence
  Description of Artificial Sequence: Synthetic coding sequence
atgagtgaacagtcgtgccagatgagcgaactgcgtctcttactgctgggtaagtgtcggtctgggaagagcgctactggcaatgcaattctgggaaaacatgtgtttaagtccaagttctctgatcagacagtcatcaaaatgtgccagcgggaaagttgggtgctgcgcgagaggaaggtggtggtgattgatactccagacctcttctcaagcatcgcatgcgccgaagacaagcagcgtaacatccagcactgtctcgaattatctgcaccctcactacacgctttactcctcgtcatcgcaatcggccacttcacccgggaagacgaggaaacagccaagggcattcaacaggtatttggcgctgaggccagaagacatattataatcgtatttactcgtaaggatgatctaggggacgatcttttgcaggactttatcgagaagaacaaaccactaaaacagctggtccaggactacgaaggtcgttattgcatttttaataataagactaattcaaaagacgagcaaattacccaggtactcgagctccttcggaaggtagagtctttagttaacaccaacgggggtccgtatcacgttaatttcaaaacagaggggagccgatttcaggactgtgttaacgaggcagcttcacaggagggagataagcctcagggaccgcgagagcgccagctgcagtcaactggcccagaacaaaatccgggaacaagcgagctcactgtgttactagtgggcaagagaggggctggcaagtccgcggctggcaattccattttgggcaggcaggccttccagacagggtttagcgagcaatcagtgactcagagcttccttagtgagagccgctcttggaggaagaagaaggtgagcatcatcgacgcgccagatatcagctccttaaagaatattgactcggaggtgcgtaaacacatttgtaccgggcctcacgctttcctgttggtaacacccctagggttctatactaagaacgatgaagctgtgttatctacaatacagaataacttcggggaaaagtttttcgagtatatgatcatcttgctgactcgaaaagaagacctgggtgaccaggatctggatacatttctgagaaacagtaataaagctctgtatggcctgatccagaaatgtaagaaccgctactcagcttttaactaccgggcaacaggcgaggaggagcaaagacaggccgatgaactgctggaaaaaatcgagagcatggtgcaccagaacggcaataaacattgcgtctttcgggaaaaggagacactcaatattgtgctggtcggacggtctggaacagggaagtccgctaccggaaatagcatcctgggcagtttggtcttcacaagccggctgcgggctcaaccggtgactaagaccagccagtctggacgacggacgtgggacggccaagaagtggtggtggtggataccccgtccttcaatcagatgcttgatgtggagaaagacccaagtcggttggaggaagaagtgaaacgatgtctttcttgctgtgagaaaggtgacaccttcttcgttttggtcttccagttgggtcgttttacagaagaggataagaccgcagttgctaagctggaggctatttttggagctgactttacaaagtatgccattatgttattcacaaggaaggaggatctgggagcagggaatctcgaagactttatgaagaattccgataataaggctctgcgccgaatcttcaagaaatgcgggcgacgcgtgtgcgccttcaataacaaagagacagggcaggctcaagagacacaggtgaaagccctccttaccaaagtcaatgacctgaggaaggagtcgggttggagcggctatccacatacccaggagaatgtgtccaaacttataaagaatgtccaggagatgagccaggccgagaagttattaaaaaatcttattgggatattgcagtag

SEQ ID NO: 50658 - DNA, 924 bp, Artificial Sequence
  Description of Artificial Sequence: Synthetic coding sequence
atggccgcacctggtctacgcctgggcgcagggcgattgtttgaaatgccggcagtgttagaacggctttctagatacaatagcacttctcaggccttcgctgaagttttacggctcccaaagcagcagctccggaagttactctacccattacaggaggttgagcgcttcctggctccttatggacgccaggacctgcatctgaggatatttgacccctctccagaggacatcgccagggccgacaatatctttacagcaaccgagcgcaaccgcatcgattatgtgagctctgcagtccgcatcgaccatgcccctgatctaccacggcctgaggtcagaggagattctactgtccatctgcgcgcaggcgtcacagcactccctttgccgggaagacccgcacggggagtattttatcggcagagcaacgtaggaaaaagcagtctgattaagttatatttccactggccactgcggctgaagagcgaaagtccaaaaaaccaggacacacaagaaaatgagttcttcaaagtgggcaaacactttaccgttgtggacatgcctggctacggatttagggcccctgaggacttcgtggatatggtagagacatacctgaaggagcggagaaacttgaagcggactttcctgcttgttgattcagtcgtgggtatacaaaaaaccgacaacattgctatcgagatgtgtgaagagttcgcattgccgtatgtgatagtgctaaccaagatcgacaaatcctcgaagggccacctactcaagcaagtgttgcaaatccagaagtttgtgaatatgaagacccagggctgcttcccgcagttatttccagtgtctgcggtgactttttccgggatccacttgctaagatgttttattgcaagcgttaccgggagcctggactag

SEQ ID NO: 50659 - DNA, 756 bp, Artificial Sequence
  Description of Artificial Sequence: Synthetic coding sequence
atggccgctccagggttaagactaggcgctgggaggttgttcgagatgcctgccgtccttgaacggctttcccgctataattctacatcccaggcgtttgctgaagtactccgcttacccaagcagcaattgagaaagctactgtaccctctgcaggaggtggaaaggttcctggccccttacgggcgacaggacttgcatcttaggatttttgatccctctcctgaagatatcgcgagagctgataacatctttaccgcaacagaaagaaataggatcgattacgtgagcagcgccgtgagaatcgatcacgctcccgacttgccaaggccagaaggtcacacaaagaaaatgaatttctttaaggttggtaagcacttcacagtggtggatatgccaggctacggatttagagccccagaggactttgtggacatggtggagacatatctcaaagagagacgtaacctgaagcgcactttcctgctggtggatagcgtcgttggcatccagaagacagacaatatcgccattgagatgtgcgaggaattcgcgttgccctacgtcatcgtgcttacaaaaattgataagagctcaaagggccacctactgaagcaggtcctgcagatccagaaatttgtgaacatgaaaacccaaggatgcttccctcaactttttccagttagcgccgttacctttagtggtatccacctccttagatgcttcattgcttccgtgaccggaagcttggattag

SEQ ID NO: 50660 - DNA, 855 bp, Artificial Sequence
  Description of Artificial Sequence: Synthetic coding sequence
atggcggcaccaggtctacgcctgggagccggacggctgtttgagatgcctgctgtgctggaacgcctgtcaaggtacaactcaacttcacaggcctttgcggaggtcctccggctgcccaaacagcagctccgcaagttactttaccccctgcaggaggtggagcgtttcctggccccatatgggaggcaagacttgcatctgagaatctttgaccccagccccgaagatattgcgagggcagacaacatctttaccgccaccgaaaggaatcgaattgattacgtcagtagcgcagtgaggatcgatcatgctcccgacctgccgcgacccgaagtgtgttttatagggaggtcaaatgttggcaaatctagcctgatcaaggcacttttcagtctcgcccctgaagtggaggtccgtgtcagtaagaaaccaggtcacactaagaaaatgaatttttttaaagtggggaagcacttcaccgtggtagacatgcccggatacggattccgggctcctgaagacttcgttgacatggtggagacttatctaaaggaaagacgaaatctgaaaagaacattcctgctagtggactctgtggtcgggatccagaaaactgataatattgctatcgagatgtgtgaggaatttgctttgccttacgtcattgtgctgactaagatcgataagtcaagtaagggtcaccttctgaaacaggttctccagattcagaagttcgtgaatatgaaaacccaaggctgttttcctcagttgttccccgtgagcgcggtgaccttttccgggatacacctcctgaggtgcttcatcgcaagcgtgacaggctcattagattag

SEQ ID NO: 50661 - DNA, 522 bp, Artificial Sequence
  Description of Artificial Sequence: Synthetic coding sequence
atggtgtgttttattgggagatctaatgtcggcaagtcgtcactaattaaagccctcttctctttggctccagaagttgaagtgagggtctccaaaaagcctgggcacacaaagaaaatgaacttctttaaggtgggtaaacacttcaccgttgtcgacatgcctggttacggttttcgcgctccagaggacttcgtggatatggtggagacttacctgaaagagaggaggaaccttaagcgcaccttccttctggtggattctgtggtggggatccagaagaccgataatatcgctatcgaaatgtgcgaagagttcgccctgccctatgttattgttctcaccaagatcgacaagtcttccaaggggcatctgttaaaacaggtactacagatacagaagttcgttaacatgaaaactcaaggctgctttccccagctctttccagtcagtgccgtgaccttttccggaatccacctcttgagatgcttcattgccagcgtcacaggctcactagactag

SEQ ID NO: 50662 - DNA, 405 bp, Artificial Sequence
  Description of Artificial Sequence: Synthetic coding sequence
atgaatttctttaaggtcggcaagcatttcacggtagttgacatgccaggatacggttttagagcccctgaggatttcgtcgacatggtggagacgtacctcaaggagaggaggaacctaaagcggacctttttgctggtggattctgtggtgggcatccagaagacggacaatattgccatcgagatgtgcgaagagtttgctctgccatatgttatcgtcctcacaaaaattgacaaatcctcaaaggggcacctcctgaaacaggtcctgcaaatacaaaagttcgtcaatatgaaaacccagggttgttttccacagctctttccagtctctgcagtcactttttcagggatacaccttttgcggtgtttcatcgcctccgtcacaggcagtctagactag

SEQ ID NO: 50663 - DNA, 756 bp, Artificial Sequence
  Description of Artificial Sequence: Synthetic coding sequence
atggctgcacctggcttgagattaggtgccggacgcttgttcgagatgccagctgttctcgaacgtctttccagatacaacagcacatcacaggctttcgccgaggtgctgaggctgccaaaacaacagctgcgaaaactcctgtaccctctccaggaagtggagcgcttcctggctccatatgggcgtcaggacctccatctgcgcattttcgatcctagtccggaagacatagctagagctgacaatatctttactgccacagagcgcaaccgaatcgactacgtgtcatcagcggtacgcatcgatcatgcgcctgatctccctcggcctgaggggcacacaaaaaagatgaacttcttcaaagtggggaaacacttcactgtcgtggatatgcctgggtatggatttcgcgctcctgaagattttgtcgacatggtagagacatacctcaaggagcggcgaaacttgaagagaacatttctgcttgttgattccgtggtgggtatccagaaaaccgacaatatcgccattgagatgtgcgaggagtttgcattgccctatgtgatcgtcctgaccaaaattgataagagcagcaaaggccatctgttgaaacaggtgcttcagatccagaagttcgtaaacatgaaaactcagggctgcttcccgcagctgtttcccgtctccgctgtcaccttcagcggcattcacctcctgaggtgtttcatagcgtcagtgactggttctttggattag

SEQ ID NO: 50664 - DNA, 462 bp, Artificial Sequence
  Description of Artificial Sequence: Synthetic coding sequence
atgacggaacagatgaccttaagaggcacactgaaagggcataacggctgggttacccaaatagcaacaactcctcagttcccggatatgatcctttcagcctcgcgggacaagacgatcataatgtggaagctgacgagggacgaaaccaactatggcatcccacagagagcgctgcgtgggcatagtcacttcgtgtccgatgtggtcattagcagtgatggacagtttgccctgagtggatcatgggacgggaccctgagactttgggatcttactacgggcacgactaccaggaggttcgtcggacacaccaaagacgtgctgtcagtggctttcagttccgacaacagacagatagtctccggaagtcgcgacaagactatcaagctctggaatacattgggcgtgtgcaaatataccgtgcagtcccattcagtagcgcaagctggcgttcaatag

SEQ ID NO: 50665 - DNA, 954 bp, Artificial Sequence
  Description of Artificial Sequence: Synthetic coding sequence
atgaccgaacaaatgacacttaggggtaccctcaaaggccataatgggtgggtaacgcagatagccacgacgccgcaattccccgacatgatcctatccgcatcccgtgataaaactattatcatgtggaagctcacccgggacgaaacgaactacggcatcccacagagggcattaagggggcactcacattttgtatcagacgtggttatctcttctgacggtcagttcgccctctccggctcttgggatggaacactccggttgtgggacctgaccactggcacaactaccaggagatttgtaggccataccaaagacgtgctgtctgtcgccttctcatctgacaaccgacagatagtcagtgggagtagagacaagacaattaaactgtggaacacgcttggtgtgtgcaagtataccgttcaggacgaatcacactccgagtgggtgtcttgcgtaaggtttagtcccaattcctctaaccccattattgtctcttgtggatgggataagcttgtgaaggtttggaacttggccaactgcaagctgaaaacaaaccacatcgggcacaccggctacttgaatacagtcacggtgtccccagacggtagtctgtgtgcctcggggggtaaggatggccaagccatgctctgggatcttaacgagggtaagcatctgtatactctggacggtggagacatcattaatgctttgtgcttcagccccaataggtattggctttgtgctgcaacaggaccctccattaaaatatgggatctggagggcaagatcatcgtcgacgaattgaaacaagaggtgattagcacctcctccaaggccgaaccaccacagtgcacaagcctcgcctggtccgcagacggccagactttgttcgcaggctataccgacaatctagttcgggtgtggcaggttactatcgggacacggtag

SEQ ID NO: 50666 - DNA, 207 bp, Artificial Sequence
  Description of Artificial Sequence: Synthetic coding sequence
atgtctagtggagcctctgcgtcagcactgcagcgcctcgttgagcagctgaaactcgaagctggcgtggagaggatcaaggtgtcccaagcagccgcagagctgcagcagtactgcatgcagaacgcctgcaaggacgcgctgttggtgggggtgcctgcgggttcaaaccccttccgagagcctaggagctgtgccttgctttag

SEQ ID NO: 50667 - DNA, 219 bp, Artificial Sequence
  Description of Artificial Sequence: Synthetic coding sequence
atgtcctccaaaacagccagcaccaacaacatcgcgcaggccagaagaactgtccagcagctcagactagaagcttccatcgagagaattaaagtgtccaaagcctccgctgatctgatgagttattgtgaagaacatgctaggtccgacccattactaatcggaattcccacaagcgagaatccctttaaggacaaaaagacctgtattattctgtag

SEQ ID NO: 50668 - DNA, 228 bp, Artificial Sequence
  Description of Artificial Sequence: Synthetic coding sequence
atgaagggtgagactcccgtcaactccactatgagtatcggtcaggccaggaaaatggtcgagcaactgaaaatagaagcctccctctgtcggataaaagttagcaaggctgccgctgacttaatgacttattgcgacgctcacgcctgcgaagaccccctcattacccctgtccctacttcagagaacccttttcgggagaagaagttcttctgtgcactactgtag

SEQ ID NO: 50669 - DNA, 228 bp, Artificial Sequence
  Description of Artificial Sequence: Synthetic coding sequence
atgaaggaaggaatgtcaaacaacagtacaacgtctatcagccaggccaggaaagccgtagagcaactgaaaatggaagcttgcatggaccgggtaaaagtcagccaggccgctgccgatctccttgcttactgcgaggcccatgtcagagaagacccgttgattatccccgttcctgcttcagagaatccctttcgggaaaagaaatttttctgcaccattctctag

SEQ ID NO: 50670 - DNA, 228 bp, Artificial Sequence
  Description of Artificial Sequence: Synthetic coding sequence
atgaaggaggggatgtctaacaactccacaacttcaatcagtcaggccagaaaggccgtggagcagctgaagatggaagcttgcatggatagagtcaaggtaagtcaggcggcagctgacttactggcttattgtgaagcccatgtgcgggaggaccccctaattatacccgttcctgccagtgagaatccatttagagaaaaaaaatttttttgcaccattctgtag

SEQ ID NO: 50671 - DNA, 228 bp, Artificial Sequence
  Description of Artificial Sequence: Synthetic coding sequence
atgaaggagggcatgagcaacaattcgaccaccagtatcagccaggcaaggaaggccgtggaacagctgaagatggaagcctgcatggaccgggttaaagtgtctcaggcagcagccgaccttctggcatattgcgaggcccatgtccgggaagacccccttattatccccgttccagcatctgagaaccctttccgagagaagaagttcttttgcaccatcttgtag

SEQ ID NO: 50672 - DNA, 228 bp, Artificial Sequence
  Description of Artificial Sequence: Synthetic coding sequence
atgaaggaagggatgtcaaataatagcacaacttctatatcgcaagctcgcaaggcggtggaacagctcaagatggaggcatgcatggaccgagtcaaagtttcccaagcagccgctgacctgctggcctattgcgaagctcacgtgcgggaagaccctctcattatccccgtcccagcctccgagaatcccttccgggaaaagaaatttttctgtactatcttatag

SEQ ID NO: 50673 - DNA, 207 bp, Artificial Sequence
  Description of Artificial Sequence: Synthetic coding sequence
atgtctgccacgaacaatatcgcccaggcacgaaagttggtcgagcagctgcgaatcgaggccggaattgagcgcattaaggtctccaaggcggcttctgacctgatgagctactgtgaacagcacgcaaggaacgaccccctgttagtgggagttcccgcttcagaaaatccttttaaagataaaaagccatgcataatcctttag

SEQ ID NO: 50674 - DNA, 141 bp, Artificial Sequence
  Description of Artificial Sequence: Synthetic coding sequence
atgcctgtcatcaacattgaggatttgactgagaaggataaactgaagatggaggtggaccagctgaagaaggaagtgacactcgaaaggatgcttatacccgctcggcacttacagaatcagtccttgatggactactag

SEQ ID NO: 50675 - DNA, 141 bp, Artificial Sequence
  Description of Artificial Sequence: Synthetic coding sequence
atgccggttatcaacatcgaagacctgacggaaaaagataaactgaaaatggaggtggaccaattgaaaaaggaggtgaccttggaacgcatgcttattcctgcacggcatttgcagaatcagagcctgatggattattag

SEQ ID NO: 50676 - DNA, 141 bp, Artificial Sequence
  Description of Artificial Sequence: Synthetic coding sequence
atgcccgtcattaatatcgaggaccttactgaaaaggataagttaaaaatggaggtggaccagcttaagaaggaggtgacactagagcgcatgctgatacccgcacgccatcttcagaatcaaagccttatggactactag

SEQ ID NO: 50677 - DNA, 1065 bp, Artificial Sequence
  Description of Artificial Sequence: Synthetic coding sequence
atgggttcaggcatcagttcagagtccaaggaatctgccaagcggtctaaggagcttgaaaaaaagctgcaagaagacgccgaaagagatgcaagaactgtcaagctgttattgctcggcgctggtgagagcggcaaatccaccatcgtaaaacagatgaaaatcattcataaaaatggatactcagaacaggaatgtatggagtttaaggccgtgatctactcgaatactctacaatctattttggcaattgttaaagcgatgacaaccctgggaatcgattacgtaaacccaagaagcgctgaagatcagagacagctctacgcgatggccaacacccttgaggatggaggaatgacccctcagctagcagaggttatcaagagactgtggagggaccccggtatacaggcgtgcttcgaacgcgcttctgagtatcagctaaatgattccgcggcttattacctgaacgacttagataggatcaccgcgagtggctacgttcctaacgagcaggacgttctgcattctagagtgaaaacaactggaattatagagacgcagttcagcttcaaggatctgcactttcgaatgtttgacgtcggcggacagcgctcggaacggaagaaatggatccactgtttcgaaggagtgacttgtattatcttctgtgccgcactttcggcatacgatatggtcttggtggaggatgaggaggtgaatagaatgcatgagtccttgcatctctttaattcaatctgtaaccacaagtacttctctactacctccatagtcctgttcttaaataaaaaagacatctttcaagagaaagttacgaaagtgcatctgtccatatgtttccccgagtatactggcccaaacactttcgaggacgctggaaactatatcaaaaaccaatttctcgacttgaatctaaaaaaagaagacaaggagatttatagccatatgacttgtgccacagacacgcagaatgtgaaattcgttttcgacgctgtaaccgatattattatcaaagaaaatcttaaggactgcgggcttttttag

SEQ ID NO: 50678 - DNA, 1749 bp, Artificial Sequence
  Description of Artificial Sequence: Synthetic coding sequence
atgatgaagctgcgccacaaaaataagaaacctggcgagggctctaaaggacataaaaagattagctggccctacccacagcccgcaaaacagaatggcaagaaagccacttcaaaagtgccctctgccccacatttcgtccatcctaacgatcatgcaaaccgggaggcagaattaaaaaaaaaatgggtcgaggaaatgcgcgagaaacagcaggcagctcgtgagcaagagagacagaagcgaagaactatcgagagttactgtcaggatgttctcaggagacaggaggaatttgaacataaggaagaagttctacaagaactcaatatgttcccccagctcgacgatgaagccactaggaaagcctattataaggaattccgtaaggtcgtagagtactctgatgtaatcctcgaggtgttagatgctagagatcccctggggtgtcgctgctttcagatggaggaggccgtgctcagggcccagggaaataagaagctcgtgctggtgctaaacaagatcgacctggtccctaaagaagtcgtggaaaaatggctcgactacctgcggaatgaactcccaactgtggccttcaaggcgtctactcagcaccaggtgaaaaacctgaataggtgctctgtgcctgttgatcaggcaagcgagagcctcctcaagtctaaggcatgttttggcgcagaaaatctgatgagggtcctcggtaactactgcagactgggggaagttaggacccacattcgagtgggcgtggttgggctgcccaacgtagggaagagcagcttgatcaactcactgaagaggtcccgagcctgttccgtgggggctgtgcccggtatcactaagtttatgcaggaggtgtatctggataagtttatcaggctcctcgatgcccctggcatcgtgcctggtcctaattcagaggtgggtactattcttagaaactgtgttcatgtgcagaagctcgcagacccagttacccccgtggagactatcctgcagcgctgtaatctggaagagatctccaactattatggggtgagcgggtttcagacaacggagcactttttgacagccgtggcgcatcgactcggtaaaaaaaaaaagggtggactgtattcccaagagcaggccgcaaaggcggtgctcgctgactgggtgtccgggaagatctctttctatatccctccgccagctacacacaccttgcctacccacttgtccgctgaaattgttaaggagatgactgaggtctttgatatagaagatactgaacaggcaaacgaggacacaatggaatgcctggccactggcgaatctgatgagttactgggtgataccgatcctcttgaaatggaaatcaaacttctccactcaccaatgaccaagatagcggatgctatcgaaaacaaaactacagtctacaagatcggcgatttgaccggctattgtacaaacccaaatcgtcatcagatgggttgggcaaagcgtaatgttgatcacagaccaaaaagcaatagtatggtcgacgtgtgctccgtcgaccgacgcagcgtcctccagcgcatcatggagacagaccctttacagcagggacaggcactggcatctgcactgaaaaacaaaaagaaaatgcagaaacgggcagacaagatagcatctaaactatccgactcaatgatgtccgccttggacctgtcgggtaacgctgatgatggtgtcggcgattag

SEQ ID NO: 50679 - DNA, 1749 bp, Artificial Sequence
  Description of Artificial Sequence: Synthetic coding sequence
atgatgaagctgaggcacaaaaacaaaaagcccggagagggatccaaggggcacaagaagatttcctggccatatccccagccagccaagcagaatggtaagaaagccacaagtaaggtaccctccgcaccccattttgtgcacccgaatgaccatgccaacagggaggctgagcttaagaaaaagtgggttgaggagatgagagagaaacagcaggccgctagggagcaagagaggcaaaagagacgcaccatcgaatcctattgccaggatgttctgagacggcaggaagaatttgagcacaaggaagaagttcttcaggagctcaatatgtttccccagctagatgatgaggctacccgtaaggcatattacaaggagttccgcaaagtggtagagtatagtgacgtaatactcgaagtgctggatgcaagggacccactgggatgtaggtgcttccagatggaggaggcagtcctgagagcacaaggaaataagaagcttgtactggttctaaataagattgatctggtgcctaaggaggtggtggagaagtggctggattacctgcggaatgaattacctactgtggccttcaaggcttctacacagcatcaggtgaagaaccttaacaggtgcagcgttcctgtggatcaggcctcggaaagtctgctaaaaagcaaggcttgtttcggagctgaaaacttgatgcgtgtcttagggaactactgtcgtctaggagaggttcgcacccatattcgagtgggcgtcgtgggcctcccaaatgtgggcaagtcaagcctgatcaattccctgaagcgaagccgcgcatgcagtgtgggcgcagtacccggaatcaccaagttcatgcaagaggtttacttggacaaattcatccgacttttggacgcacctggaatcgtgcccggacccaattctgaggttggaaccattctgcgtaactgtgtgcacgtgcagaagcttgctgatccagtcactccggtcgaaactatcctgcagcgctgtaatttggaggagatttccaattattacggcgttagcggctttcagacgactgagcatttcctgaccgctgtggcccatcgattaggcaagaagaaaaagggtgggctgtattcccaggagcaggccgctaaggccgtgctggctgactgggtgtctgggaagatttccttttacatccctccacccgctacacacactctgcctacacatctgtcagcggagattgtcaaggaaatgacggaggtgtttgatatcgaagacaccgaacaggccaatgaagataccatggaatgcctggccactggagaaagcgacgagttgctaggcgatacagacccactcgagatggagattaagctccttcactctcctatgacaaagattgccgacgccatcgagaataagactaccgtgtataagatcggtgatttgacaggttattgcactaatccaaaccgtcaccagatggggtgggctaagcgtaacgtggatcaccggccaaagtccaactcaatggtcgatgtgtgttcagttgaccggaggtcagtgcttcagcggattatggagactgatccactgcaacaaggccaggcgctggccagcgcgctgaagaacaaaaaaaaaatgcagaagagggcagacaaaatcgcatccaaactgagcgacagtatgatgagtgcactggacctttccggcaatgctgacgacggggtgggcgattag

SEQ ID NO: 50680 - DNA, 2010 bp, Artificial Sequence
  Description of Artificial Sequence: Synthetic coding sequence
atgtggaccctggtgggacggggttgggggtgcgctcgggctctcgccccaagggctactggcgcagcactgttggtagctcctggacccagatccgcccctacgttaggggcagctcctgagtcctgggctactgacagactatactcctccgcagagtttaaggagaaacttgatatgagccggtttcctgtggagaacatcagaaacttctcgatagtggcccatgtggaccatgggaagtctacactggccgacagactgcttgagctgacaggcacgattgacaagactaagaataacaagcaggtcctagataagttacaagtcgagcgggaacgtgggatcacagtcaaggcccagacagcttctctgttctacaattgtgaggggaagcagtatttgcttaacctgatagatacgcccggtcacgttgatttcagttacgaagtgagtaggagcctgtcggcatgtcagggggtgcttctggttgtggatgcaaatgagggcattcaggcccagaccgtggccaatttctttctggcatttgaagcccaactctctgtaatcccagtgataaacaaaatagacctgaagaacgcagatccggaacgcgtggagaaccagattgaaaaagtatttgatatcccctccgatgagtgtattaaaatttctgccaagcttgggacaaacgtggaatccgtgttgcaggctatcatcgagcgcatccctccccctaaagtccaccgcaagaacccactgcgcgctctggtgtttgactccacctttgatcagtataggggggtgattgccaatgtagccctctttgacggagtagtgtccaagggcgacaagatcgtttctgcacacacacagaaaacttacgaagttaacgaagtgggggttctaaatcctaatgagcaacctacacacaagctttacgccggacaggtggggtacttaatcgccggtatgaaagatgtgaccgaagcccagattggagacaccttgtgtctacacaagcaacctgtggagcccctgcctgggttcaagtccgcaaagcccatggtgttcgccggaatgtacccccttgaccaatccgagtataacaatctgaagagcgcaatcgagaagcttactttgaatgactcttctgtcacagttcaccgcgactctagcctggcacttggggctggatggcggctggggttcttggggctcctgcatatggaggtcttcaatcagagacttgaacaagagtacaatgctagcgtcattctaacaactccaaccgtgccttacaaggccgtactttctagctcgaagctgataaaggaacaccgcgaaaaggaaatcacgatcattaatcccgctcaatttcccgataagtcaaaggtaacggagtacctcgaacccgttgtgcttggaaccattatcactcccgatgaatacacagggaagatcatgatgctttgcgaagcgagaagggcggtgcaaaagaatatgatatttatcgatcaaaacagagtgatgctaaaatacctgtttcctcttaacgagattgtcgtagacttctacgactccctcaagtcattatccagtggctacgcatctttcgactacgaggacgccggttaccagacagcagaactagtgaaaatggatatcctgcttaacgggaacaccgtagaggaactggtgactgttgtgcacaaggataaggcccattccatcggcaaggccatatgcgagcgcttgaaagacagcctccctagacagctgtttgagatcgccattcaggcagccatcggcagcaagatcatagcacgagaaacggtaaaagcttacaggaaaaatgtgttggccaagtgctacgggggagacataacgcggaaaatgaaattgctgaagcgacaggcagagggaaaaaaaaaactgcgaaaaattggcaatgtggaggttccaaaagacgcctttataaaggtcctgaaaacgcagtcttcaaaatag

SEQ ID NO: 50681 - DNA, 756 bp, Artificial Sequence
  Description of Artificial Sequence: Synthetic coding sequence
atggcacaccgcctgcagatcagactcctcacctgggatgtgaaggacacactgctgcgcttacgccatccgctgggcgaggcgtacgccaccaaggcacgagcccacgggctggaggtcgagccctctgcactcgagcagggcttccggcaggcctatagagcccagagccacagtttccctaactatggcctgagtcatgggttgacctcaaggcagtggtggttagatgtagtgctccagaccttccatctcgctggtgtccaggacgctcaggcagtggcgcctattgccgagcaattgtacaaagatttttcccatccttgcacatggcaggtcctcgacggcgcagaggacacccttcgcgagtgccgcaccagaggacttcgactcgcggtgatctcaaactttgatcggaggctggaaggtatcctcgggggactcggtctgcgcgagcactttgacttcgtgctaacgagcgaggcagcaggctggcccaaacctgaccccaggatcttccaggaggcgctgagattggcacacatggagccagtggttgcggctcatgtcggcgataattacctttgtgactaccaaggcccacgtgcagttgggatgcactcttttttagtggtcggtcctcaggctctcgatccagtcgtacgcgattcagttccgaaagagcatatactcccaagccttgcacacctgcttccggctctcgactgtctggagggctctaccccgggtctatag

SEQ ID NO: 50682 - DNA, 756 bp, Artificial Sequence
  Description of Artificial Sequence: Synthetic coding sequence
atggctcatcgcttgcagattcgacttctgacctgggatgtgaaggacacccttctgcgcctgcgacaccccttaggtgaggcgtacgcaactaaggcaagagcccacgggctagaggtcgagccaagtgctctggaacagggttttagacaggcctaccgcgcacaatctcactcattcccaaattacgggctgagccacggccttacatcaagacagtggtggctggatgtggtgttgcagacctttcatctggcaggggttcaagatgctcaggctgtagcaccgatcgcagagcagctgtacaaagacttctctcacccctgcacatggcaagtgctggatggtgcggaggacactctccgagagtgtcgcactcgtggcttacgtctggccgtgatctctaactttgaccgtaggctggaaggaattctgggtgggctgggcctgcgggagcactttgatttcgtgctgacaagcgaagctgccggatggccaaagccagacccccgaatcttccaggaagctctccggttagctcacatggagcccgtagtggcagctcatgtcggagacaactacctgtgtgattatcagggccctcgcgcagtgggaatgcacagctttcttgtcgttgggcctcaggccctcgaccccgtcgtgcgtgattccgtgccaaaagagcacatcctgccttcgctcgcccacctgttgccagcgctagactgtcttgaaggcagtacacccggactgtag

SEQ ID NO: 50683 - DNA, 867 bp, Artificial Sequence
  Description of Artificial Sequence: Synthetic coding sequence
atggatatcgggctctcgattgcaaattccagcggctttcagctgagcgaatttattctcattggattccctggcatccacgagtggcagcattggctgtccctgcccctcgcccttggagcgaacctgttgattattatcacaatccagcacgaaacaatgctgcatgagcccatgtatcacttgctgggaattctggcagtggtggatatcgggttggcaactacgattatgcccaaaatccttgccattttttggtttgacgcgaaggccatttcactccctgagtgcttcgcccagatatatgccatccactcattcatgtgcatggaaagtggtatcttcttgtgcatggccgttgacagatacatggccatatgttaccctctgcagtatacatcaattgtcaccgaagctttcgtcatcaaggctactctatctgtggttctccgaaacggattactaacaataccagttcccgtgttggcagcccaaagacattactgtagccgtaacgagatcgaccaatgcctatgttctaatctgggggtgacatctcttgcatgtgacgacacaactattaataggttctaccagctggcactggtttgggtagtcgtgggatctgatatgggccttgtgttcgcttcatactccctgatcatccacagtgtgctgaaattgaacagcgccaaagctacttcaaaagccttgaatacgtgttcaagccatttgatcttaatcctattcttctacacagcaattatcgtggttagcgtgacgacttggcaggaggaaggacttccggcatccctgttctcctccatgtgctgtattttgagttcaccccagcctcttaccccctag

SEQ ID NO: 50684 - DNA, 513 bp, Artificial Sequence
  Description of Artificial Sequence: Synthetic coding sequence
atggcctcagtgtccagcgcaacgtttagtggtcatggggctcgctcgctgcttcagtttctgaggctcgtcggacagctcaagcgagtccctaggacaggctgggtgtaccgaaatgtgcagcggccagagagcgtgtctgaccacatgtacagaatggctgtaatggcaatggtgatcaaggacgacagactgaataaggacagggaggcgatgaagcagattactcaacttctgcctgaggacctgcggaaagaactgtacgagctatgggaggagtatgaaacccagtcatctgccgaggccaaatttgttaaacagctggaccagtgcgagatgattcttcaggccagcgaatatgaggacttggaacataaaccagggaggcttcaggacttttatgactccacagccggaaaattcaaccatcctgaaatcgtgcaactggtctccgaactggaagcagaaagatctacaaatattgccgcagcggcatctgaaccacacagttag

SEQ ID NO: 50685 - DNA, 615 bp, Artificial Sequence
  Description of Artificial Sequence: Synthetic coding sequence
atggcctcagtaagttccgctaccttcagcgggcacggcgcaagaagtctcctccagttcctcagactggtggggcagttaaaaagggtcccaagaaccggttgggtgtacaggaatgttcagaggccagagtccgtgagtgatcacatgtaccggatggccgtgatggccatggtgatcaaagatgaccgtctgaataaggaccggtgcgtcagactcgcattagtgcacgatatggctgagtgtattgtgggcgatattgcacctgctgacaacattcccaaggaggagaaacataggcgtgaggaggaggcaatgaaacagatcacccaactcctgcctgaagacctccggaaagagctctacgagctgtgggaggaatacgaaacccagagcagtgccgaagctaagtttgttaaacaactggaccaatgcgagatgattctccaggcgtcagagtacgaggacctagaacataagcccggtagacttcaagacttctatgatagcaccgccggtaagtttaaccatccagagatagtgcagctggtgagcgaactcgaggcagagcggtcgaccaacattgccgctgcggcatccgaaccccatagctag

SEQ ID NO: 50686 - DNA, 3135 bp, Artificial Sequence
  Description of Artificial Sequence: Synthetic coding sequence
atggctctgtcaccaggcgcaaatctcgtcttccacgaagatccaaaaatgacaccttccccccctagctgtggcgctcccggactcggcagcggaacaatcccccagcctcatcctgacatggcgcaggtaccaatgctaaatttgttgccctcaccagggctcgccctggtccccgatctgaacgacagcttatctcccgtgtcaggtgaagcctccggactggtgagtgaaaacaccccacgtccagatgatagcagggccatcgccccagcgagcctgcaaatcacgtcgagctgttcaggagaggccttggatctagactcgaaagacgtctcacgaccggacagtcagggacgtctttgccctgccagtaatcccattctgtccccatcaagtacagaagccccaaggctgagctctgggaatcacccacagtccaatagcgaggacgcctttaagtgcctttccagcaagattttcaaactagggcaaagaaattctaacccttcacgccacgaactgaatccttttataagacatcattccagagaagggctagtgctgggacattgtataagtagaccttcctctaaggccttacttatccccaccagcaacagcagcctggaccttgatagcaaccctctccttaatatggggtcacgaaacaccagcaagctcaatctgaacgtggcccctgattcacacgggacactaattcccgacacgaatgagacaatcacgctggcaagccacaatatctcagagtcagtgtcaaaaggagcattttctactacgtggagcactagctcgaaggagacaatgaacgttgcttcaagcgggcactctcggtcagacctgtctgtcacaattacacaggcttcatatgtaacattgatccccggaagcagctacgggatctcactgcatagttcaacccacgagccaaactctacgatcagccctccttcatgtatgacgttgatactggggtcaaacgaaacgctgagccttgacagttctttgctcttttctgacacctcaacccttacactatctagccaacaggacgatgcaaaggacaactcaatacatacagtgcctttggaagagaatctcgagagttggtctgagatggccagcataaaggtcgggcagtttcctcttggatttcccatttccaatccggcagggaaggatgcagtgacgctgcaagggatcccagaaggcgcattcgatgaggtgacatcctgcctggtgaaggttcctgaaaagacggaaggagggaataacatggcactcgtggaaaacgtgacgactctgcaaaagagtcaggatttgttggaggccgaaggcgaaaagaaaaccatgatcaaaaagatcatgcgacagatccaggaagaacccctagattctctgagtagttccgtaaggaaacaggctatggagattctgacccagctgagccacacccagccaaccctaggtatgcgcgagcgaagcgaactggtgaacgtttgtgtacatagcgtctttagtttgcctagcgtccaggcaatgcaggaaaaggacgaggcaaaagctgaaacgatacaggccctgtaccaccagacactcgaggctctccaaacattgttaaaggcgctattcattgaagacccgactccagccggactcaagagtattctcgaggcgctgggtccgtggatgaattcaggtaaggcacatgaacgcgctagggcggtgaatacgaacgtgtccgtcttgaatcacatgctgctgacactgcctttttttatgccgctcggatttccagctctagggctgctgctcggacgactgatactccatataggcgatcccgacgaggaaatcggctgcgaagctctggacgggattattatcctgtataccatattggaactccagaaacgggctcgagataaagaggaaactaataagaaggaactatatgagagcaacaagcatttcctcgggccatataatcccgtgagtccatgtcaaaacatcctccgagttatcgaagagttcggggacttcctggggcctcagcagattaaggatcttctactcgctgcattagagggtctaaagggaagttccgaggctccgggaaaagacagtagagagatgatgcagctagcgtcagaggttatgttatctagtgtacttgagtggtacagacatcgagcgcttgaggtcattcctgagatcatgcagggcatctacatgcagctttcgcatatacaggaacccagggctagacaagtggccttactgcctgttagtctgcttgcatcaagctttatgacggaagtcgtggtagctctactgatgtgccctctaccgctgaatagtaacggggctgagatgtggcgacagttgattctctgcaaaccatcctgtgacgtccgagatctcctagacttactcctgggttctctgaaagagaaaccagtgacaaaggaaggcagagccagcatcgtgcccctagccgctgcgtctggcttgtgcgagctgctctccgtgaattcatgcatggggagagtgaggagaatatatccacaactgttgcttgctcttctgatccaggtccactaccatatcgggcttaatttgcctggctgcgtggcccctccgaaggatacaaagaaaggcgctcagcccagtcccttcgtgcctgtcaggtgggtggtgaaggtagttaagacattattgctgagaatgggatgtagctacgaaaccacttttctggaagatcaggggggatgggagctcatggaacaagtggaatcccatcacagaggcgtcgctcttctggctagggctatggtccagtactcctgtcaggagctgtgcaggatcctgtacctgctgatccccctgcttgaaagaggcgatgaaaaacacaggattacagccacagccttttttgtggagcagccttgtgaggaaggaatagttatcctgatgctgaggataagctgggagcgacagcagcaggccgttactggagccaggtcatggagggttacacacagcgccctgcctcacggtgctgatggtcatcaaaccgaaaccagttctaacctattggtgctgcaggtgtag

SEQ ID NO: 50687 - DNA, 1179 bp, Artificial Sequence
  Description of Artificial Sequence: Synthetic coding sequence
atggtgttgatggatattcgacgtcgcttgcccgctatctgctggttttgtaaatcagaggcccctggcagagcagagccaggaatccagtgcgccatcccagtacacggacgccctggcggatgtcccgctccgctttcactgggcagtaatgatcccctactcccccagttacttcaaatggagcaagtgagacgaatacctgaggaatacagtctcggaaggatggcagagggcctgtcccatcacgaccctattatgaaagttttgtcaatccgaggactcgtcatcctcgctcggaggtctgagaaaactgctaaggtgaaggccctcctgccatctatggtcaagggtctgaagaacatggacggcatgttggtggttgaagctgttcacaacctgaaagcagtattcaaaggtagagatcagaaactgatggattcggctgtctacgtggagatgctgcagatactgcttccgcattttagcgatgcaagagaggtagtgcgaagcagctgtattaatttgtacggcaaagttgttcagaagctgagagcccctagaacccaggctatggaggaacagctggtgtccaccctggttcctcttctactaactatgcaggaaggaaattctaaagtgtcccaaaaatgcgtaaagactctgctgagatgtagctatttcatggcatgggaactcccaaaacgagcttacagcagaaagccatgggataaccagcaacagacagtggcgaaaatctgcaagtgcctggttaacacacacagagactccgcctttattttcctatcacagtcgttagaatacgcgaaaaattctcgtgcaagcctccgaaaatgcagtgtgatgttcattggttcccttgtcccttgcatggagtcaattatgaccgaggaccgcctaaatgaggtgaaggccgctctggacaacctgcgacacgaccccgaggcctctgtctgcatctatgccgctcaagtccaggatcatattctagcaagttgctggcaaaacagttggttgcctcacgggaatagttgggtctgctattcagccaccacccatcgttggtcaccgagttgtgaaaatctgcccacaagccatcagcgaagaagttggatcatgcaggctctcggaagctggaagatgtcactgaagaagtag

SEQ ID NO: 50688 - DNA, 3093 bp, Artificial Sequence
  Description of Artificial Sequence: Synthetic coding sequence
atggcccttagtccaggggcaaacctggtcttccatgaggaccccaagatgacgcccagccccccatcatgcggagcccctggcttgggcagtggcaccatcccacagcctcacccggatatggctcaagtccccatgctcaatctactcccttcccccggactggcattggttccagatcttaatgacagcctgagcccggtgagcggtgaggccagcggtcttgtgtccgagaacacccccagacccgacgatagccgtgcgattgctcctgcctctctgcagatcactagctcctgcagcggggaggcccttgatctggactccaaggatgtttcccgccctgactcccaggggaggttgtgtcctgcttctaatcccattctctcaccaagctctactgaagcacccagactcagctccggcaaccacccccagagcaatagtgaggatgcgttcaagtgtctgtcaagcaaaatctttaaactggggcaaagaaactcaaatccgagtaggcatgagctgaatccctttattcgacaccactcaagggagggtctggtcttgggccactgcatcagtcgcccttcaagcaaggctcttctcatccccactagtaactcatctcttgaccttgactcaaatccgctgctgaacatgggctccaggaatacaagtaaactgaatctcaatgtagcgcctgactcgcacgggactctgatacccgataccaatgagaccatcaccttggctagccacaacatttctgaatcggtgagcaaaggagctttttcaactacctggagcacatctagcaaagagaccatgaatgtcgctagcagtgggcattctcgaagcgacctctcagtcactataacccaagccagttatgttaccctgattcctggatcaagttacggaatctctctccacagctctacacatgagccaaattctacgatttcaccaccctcctgcatgacactcattctaggctctaacgaaactctgtccctggattcctcactcttattctccgataccagcacattgactctttcttctcaacaggatgacgccaaagacaattctattcacaccgtgccactggaggaaaatctcgagtcttggagtgagatggcgagtattaaagtaggtcagttccccctggggtttcctatctccaatcccgctggcaaggacgccgtcactctgcaggggattccagaaggcgcatttgacgaagtcacctcctgcctagtgaaagtacctgaaaagacagaggggggtaataatatggctctggtggaaaatgtgaccaccttgcaaaagtcacaagatctcctggaagccgaaggagagaaaaaaactatgatcaagaaaatcatgaggcaaatccaggaagagcctctggattctctgagtagctccgtcagaaaacaggcaatggagattttaactcagctgagtcacacccagccaaccctgggaatgcgagagcgcagcgagcttgtgaatgtgtgcgttcatagcgttttcagcctgccctcagtgcaagcaatgcaggagaaagacgaggccaaggcggagaccattcaagccctataccatcaaaccttagaggcattacagacactgcttaaggcactgttcatagaagaccccacaccagcagggttgaagtctatcctggaagcactgggaccttggatgaactccggcaaagcccatgagcgcgcaagggctgttaacaccaatgtttcggtactcaaccacatgctgctgaccctgcctttctttatgcccctaggcttccccgcactagggctgcttctcggccgtctaatcctccatatcggcgatccagatgaagaaatcggatgtgaggcactcgatgggattatcatcttgtacacgatccttgagcttcagaaaagggcgagggacaaagaggagaccaataaaaaagagctgtacgagagtaataaacactttctaggtccctataaccccgtgtctccgtgccagaacattctgcgcgtgattgaggagttcggagatttccttggtcctcagcaaattaaagacctcctcctggcagcactcgaaggcctcaaggggagcagtgaggctcctggcaaagattctcgggaaatgatgcagcttgcttccgaggtaatgctctcctcagtcctggagtggtacaggcaccgggctctggaagtcattcctgaaattatgcagggtatctacatgcagctctcacacattcaggaacccagggccagacaggttgctctgctccccgtgtctctcctggctagttcctttatgaccgaagtggtcgtagccctacttatgtgtccgttgccattaaacagcaacggagccgaaatgtggcgccagctcattctgtgcaaaccctcttgcgatgtgcgggatctcctcgatctgctgctagggagcctgaaggagaaaccagtaaccaaggaagggcgagcttcaatagtgcctctggccgctgcaagcggtctctgtgaattattgagtgtcaacagttgcatggggagggtgagacgtatctacccacagcttctcttggctctgcttatacaggtgcactaccacatcggcctaaatctcccaggatgtgttgctcccccaaaagacactaagaagggtgcacagcctagtccatttgtccccgtcaggtgggtggtaaaggtcgttaagacactactcctgcgaatggggtgtagctatgagaccacatttctggaggatcaggggggatgggagttgatggagcaggtggaatcacatcaccggggagtggcccttctggctcgcgctatggtgcagtattcctgccaggagctatgcagaatcttgtatctgttgatccctcttctcgagaggggggacgagaaacaccgaattaccgcaactgcattcttcgtcgagcagccctgtgaggagggcattgtgattctcatgttgcggcctcaggacctaatggggaaggccacaacgtctagccaccggggttcagagctggaatccgacaccttgagttttgccacttggtgctag

SEQ ID NO: 50689 - DNA, 3870 bp, Artificial Sequence
  Description of Artificial Sequence: Synthetic coding sequence
atggccctgtcgcccggagccaacctcgtgtttcatgaggatcctaagatgaccccatcccccccttcttgtggcgctcctggcttgggatcgggcactatcccccaaccccaccccgacatggcccaggttcctatgctgaacctgctcccaagtccagggctggccctggtcccagatttaaacgactcactttccccagtgtctggtgaggccagcggtctggtgagcgaaaacacaccaagaccagacgattcgcgcgctattgctcccgcatccttacagattacgagctcctgttcaggtgaagcactcgatctggactctaaagacgtcagccggccagattctcaggggcgtttatgcccagcctccaatcccatactttctccgtcttcaacagaagcccctagactatccagcggaaaccacccgcagtcaaactcagaggatgcttttaaatgtctctcctctaaaatatttaaattgggacaacgaaactctaatccttctcgccacgaactcaacccctttattcggcaccactcgcgtgaggggcttgtacttggccattgtatctctcgccctagttccaaggctttgctcatacccacgtctaactcatctcttgacctggatagcaatccactgctgaatatggggtccagaaacacctcaaagctcaatctgaatgtggctcctgattcacatgggaccttgatcccagacacaaacgagactataaccctggccagtcacaacatttctgaatccgtgtcaaaaggcgcattttcaacaacatggtcgacttcttccaaagaaactatgaatgtagctagctctggccacagccgctccgatctgtctgtaacaattacacaggcaagttatgtgaccctaatcccgggatccagctatgggatctcactgcattccagcacccatgaaccaaacagtactatctcacctccaagctgcatgactctgatactgggaagcaatgagacgctgagcctggatagttcgctgctttttagcgatactagtacactgaccctgagtagccagcaagatgacgccaaggacaactctatccacacagtgcctcttgaagagaatctggagtcctggtccgagatggcaagcataaaagtgggacaattccccctgggatttcccatcagcaatcccgcaggtaaggacgcggtgactctccaggggatccccgaggatggagtctcactgctattgccacggttggaatgtaatggggctatatcagctcattgtaatctgtgtctgccaggcgcttttgacgaggtgacatcttgtcttgtgaaggtgccagaaaagacagagggcggaaataatatggcgctggtggagaatgtcacaacgctacagaaatcccaggacctcctagaggctgagggagagaagaaaaccatgataaagaagatcatgagacaaatccaggaagaacccctcgattccttgagctcatcggtcagaaagcaggctatggagattcttacacagctgagtcacactcagcctaccctaggcatgcgcgaacggagcgaactggttaacgtgtgtgttcatagcgtgttttcactgcctagcgtgcaggcgatgcaagagaaagatgaagcaaaggccgaaacgattcaggccctgtatcaccaaacactcgaagcactgcagacccttctcaaggctctgtttatcgaagaccccactccagctgggcttaagtccatccttgaagctctgggtccttggatgaacagtgggaaagcccacgagagagcccgtgccgtgaataccaacgtttccgtgctcaaccacatgctcttgaccctccctttcttcatcgcaatccagatgccactcggatttcccgcactaggactgctgttgggccgacttattttgcatattggggacccggatgaagagatcggttgtgaggctctagatggaattatcattttgtataccattctggagctccagaaacgtgcacgggacaaggaagagacaaataagaaagagctttatgagtccaataaacatttcctcggcccatataatccagtgtctccatgccaaaacatcctgagagtgatcgaagaatttggagactttcttggaccgcagcaaatcaaggacctgctgctagcagcgctcgagggcttaaaggggtcttccgaggcccctgggaaagactcaagggagatgatgcaattggcctcggaagtgatgctgtcgagcgtcctggaatggtatagacatcgggcattagaggtcatccctgagatcatgcaagggatctatatgcagctcagccatatccaggagccaagggctcggcaagtggcattgctacccgtcagcctgctggcctcttccttcatgacagaggtcgtggtcgccctgcttatgtgtccactgcctctgaactccaatggagcagaaatgtggcgacagctcattctgtgtaagccctcgtgtgacgtcagagacttgctggatctgttgctgggcagcttgaaggagaagcctgtcacaaaagaagggcgtgcaagcatagtgccactggccgctgcctccggtctgtgcgagcttctgagcgtgaactcatgcatgggcagggtgcgacggatctaccctcagctgctactggcactgcttattcaggtccattaccacatcggtctgaaccttccaggctgtgttgcacccccaaaggacaccaagaagggcgcacagccctcgcccttcgtccctgtgcgatgggtggtgaaggtggtgaaaaccctgctgttgaggatgggatgttcatacgaaacaacattccttgaagaccagggcggatgggaactgatggaacaggtggaatcccaccatcggggagtggccttattggccagggcgatggttcagtacagttgtcaggaactgtgccgaattttgtatttgctgataccccttctggagaggggcgatgagaagcacagaatcaccgccacggcctttttcgtggaattgcttcagatggagcaggtgagaagaatccccgaagaatactccctcggtcgaatggcagagggacttagccaccacgacccaattatgaaagttctcagcatccgaggactggtcatcttggctcgccgttctgaaaagacggccaaagtaaaggccttactgccatcaatggtgaagggactgaaaaacatggatgggatgcttgttgtcgaggccgtccataatctcaaggctgtttttaaagggagggaccaaaagctgatggattcagcagtgtatgtcgagatgctgcaaatcctgctaccccacttttctgacgccagagaggtagtgcggtccagttgcattaacctgtacggcaaagtggtgcagaaattgagagcacccagaacccaggccatggaggagcagctcgtttccactctggtacccctcctactaacgatgcaggaaggaaattccaaggtcagtcagaagtgcgtaaaaacccttcttcggtgctcctattttatggcatgggaacttcccaagagagcctattccagaaagccttgggacaatcaacagcagacagtggccaaaatctgtaaatgcctggtcaacacccatagagactcagcttttatttttctgtctcaatccctggagtacgcaaagaattctagggcctctctgcggaagtgctccgtgatgtttatcgcaacacctagagggcagcggtttcaccttctttgccctccgctttattctcagcccctggaacaggcaggaagtgcagagcgagcaaagaatctcaaacggtctccgtacctatag

SEQ ID NO: 50690 - DNA, 3972 bp, Artificial Sequence
  Description of Artificial Sequence: Synthetic coding sequence
atggccttgtccccaggcgcaaacttagtattccatgaggaccccaagatgaccccatctcccccatcctgcggcgctcccggtctcggtagcggaaccataccccagcctcacccggatatggcacaggtaccaatgctgaatctgttgccatcgcctggcctcgcattggtccctgatctcaatgattccctaagtcctgtgtctggcgaagcgtctggtctggtaagcgaaaatacacccaggcctgacgacagccgcgcaatcgcccctgcctcgctgcagattacgagtagctgttccggtgaagcactagacctggatagcaaggatgtgagcagacccgacagccagggccgactgtgtccagctagtaaccccatcctctctcccagcagcactgaagctccccgactcagctccggaaaccacccacaaagtaatagcgaagatgcttttaaatgcctctcaagtaagattttcaaactggggcagcgtaactccaacccatcccggcacgaactgaacccctttattcgccaccattctcgcgagggcctggtgcttgggcactgtatcagtcggccaagctccaaggcacttcttatccctacctccaactcttctcttgacctggactctaacccgctgcttaatatgggaagccggaacacctccaagttgaacttaaacgtcgctccagacagccatggtactctgattcccgatactaatgaaacgataactctggcaagccataatatttctgagtccgtgagcaaaggcgcattctctactacgtggagcacctctagtaaagagactatgaacgtagcatcatcagggcactctaggagtgatctgtccgtgactattacacaggccagttatgtcactcttatacctggttctagctatggaatctccctgcactcctctacacacgagccgaactccacaatcagccccccaagctgtatgactcttatcttgggctccaacgagaccctctcccttgattccagcttgcttttcagtgatacatctactctcactttgtccagtcagcaggatgatgccaaagataatagcatacacaccgtcccccttgaggagaatctagaatcctggtccgaaatggccagcatcaaggtgggacagttcccgcttggcttccccatttccaatcccgcaggcaaggatgcagtgactctgcaggggatccctgaaggtgccttcgatgaggtaacgtcgtgtctggtaaaagttcctgagaagaccgagggcggaaacaatatggccttggtggagaacgttactacactccagaaaagccaggacctgctggaagctgagggagagaaaaagactatgattaagaaaatcatgcggcagattcaggaggagcccttggacagcctgtccagtagcgtccggaagcaagcgatggagatccttacgcagttgagtcatacacagccaactctggggatgcgggagagatccgagctggtcaacgtgtgtgttcactccgtgttctcacttcccagtgtacaggcaatgcaggaaaaagacgaagccaaggccgagactattcaggccctgtaccatcaaacactcgaggcattgcagacattgctgaaggctctgttcatcgaggacccaaccccggctggactgaagtccatcttggaggcccttggcccttggatgaattctgggaaggctcatgagagagcccgagccgtcaacactaatgtgtcagttctaaatcacatgctgctcaccttgccgtttttcatgccactgggcttcccagcactgggcctcttgctgggcaggctgatcttacacatcggggacccagacgaggagattggttgtgaagctcttgatgggataattatcctttatactattctggagctgcaaaagagggcgcgtgataaggaggaaaccaacaagaaggagttatacgaatccaacaagcactttctggggccttataatcctgttagcccgtgccagaatattctgagggtgattgaggagttcggagattttttgggacctcagcagattaaggacctcctgctggcagccttggaggggctaaaaggctcttccgaagctcccggaaaggattctagggagatgatgcagctggcctccgaggtgatgctgtcctcagtcctcgagtggtatcgtcacagagctctcgaagtgatacctgaaatcatgcagggcatctacatgcagctgagccacatccaggaacccagagcaaggcaggtggctctgctccccgtctctctgttagcctcctccttcatgaccgaagtggtcgtcgcgctactcatgtgtccactgcccctgaattcaaacggagcggaaatgtggcggcaacttattttgtgtaaaccaagttgtgacgtgagggatctgcttgatttgctgctaggttctctgaaagagaagcccgtgaccaaggaaggtagggcctctattgtgccactcgctgctgcctctgggctgtgcgaattgttgtccgtgaactcgtgtatgggtcgagtgcggcgaatttacccacagctcctgttagcactccttatacaagtgcactaccacatagggctgaatctgcctggttgtgtagccccacccaaagatactaaaaagggtgcccagccaagcccttttgtccccgttcgctgggtagtgaaggtggtgaaaactttgctcctccgtatgggctgctcttacgaaactaccttcctggaagaccagggcggttgggagttaatggaacaagttgaaagccatcacagaggtgtggctcttctagctcgggcaatggtccagtattcctgtcaggagttgtgtcggatactgtacctgttgataccactcctcgagagaggagacgaaaagcataggattactgccaccgctttttttgtcgagctgctccagatggaacaggtccgacggatccctgaggaatactctcttggacggatggctgagggcttgtcgcatcacgaccctatcatgaaggttttgtccattcgcggtctcgtgatccttgccaggcgctctgagaagacagccaaggtgaaggctctgttgccttctatggtgaaggggctgaagaacatggatggaatgctggtggttgaggcagtgcacaatcttaaagccgtcttcaaggggcgtgaccagaagctgatggacagtgctgtctacgtggagatgctccagattctcctgcctcacttttcagacgccagggaggtggtgcgcagctcctgtattaacctatacggcaaagtggtgcagaaactaagggccccaaggacccaggccatggaggagcagctggtgtccactctagtccctctcctcttgaccatgcaggaggggaacagtaaggtttcccagaagtgcgtgaaaaccctcttgaggtgctcgtactttatggcatgggaactccctaagcgagcttactcccggaaaccctgggacaatcaacagcaaactgtcgcgaagatctgcaagtgtctcgtcaatacccatcgcgactcagcgttcatttttctcagccagtcgttggagtatgccaagaattcaagggccagcctgaggaagtgttctgtgatgttcattggctcactcgtgccctgcatggagtccattatgacggaggaccgcctgaacgaggtcaaggctgctctagataacctgagacacgaccctgaggcctcagtctgcatctatgcagcacaggtccaagaccatatactcgccagctgttggcagaactcatggttgccgcatggcaacagttgggtctgttattccgcaactacacaccgatggtcgccatcctgcgaaaacctgccaacctcccaccagagaagatcgtggattatgcaggccctcggctcttggaaaatgagtctaaaaaagtag

SEQ ID NO: 50691 - DNA, 2526 bp, Artificial Sequence
  Description of Artificial Sequence: Synthetic coding sequence
atggagatcctgacacagctctcccatacacaacctacactgggcatgcgcgaaagaagtgaactagtgaatgtttgtgtgcattctgtcttttcccttccttccgtccaggccatgcaggaaaaagacgaagccaaagccgagaccattcaggctctgtatcaccagactctggaagctctccagacattgttgaaggcgctcttcatagaagaccctacgcctgccggtctcaagtccattctggaggcactcgggccatggatgaatagcggtaaagcacacgaacgcgcacgagctgtcaacacgaacgtttccgtgctgaaccacatgctcctgacattacccttctttatgcctctgggttttcccgcattaggcctgctccttggccgtctcatcctccacataggcgatccagatgaggaaatcggctgcgaggccctggacggcatcattattctctataccattcttgagctgcagaagcgggcaagagataaggaggaaacaaacaagaaagagctgtatgagagcaacaaacatttcttagggccttacaacccagtgtccccttgtcagaacatcctgcgagttatcgaggaatttggggactttctgggaccccagcagatcaaagacctcctactcgccgcattagaaggactaaagggctcctcagaggccccaggaaaggatagccgtgaaatgatgcagctggctagcgaggtcatgctcagctctgtgttggagtggtatcgtcatagggcgctggaagtgatccccgaaataatgcaaggaatctacatgcagttgtctcatatccaggaaccccgtgcgagacaggtggctttattacctgtctcgctgctcgcctcaagctttatgactgaggtggtagtggcgttactaatgtgccctctgcctttgaacagtaacggcgcagagatgtggagacagttaattctttgcaagccgtcctgtgacgttcgagaccttcttgaccttttactgggctccctgaaggagaagcccgttacgaaagagggcagagcttccattgtgccactggcagcagcaagtggcctctgtgagctcttgtcggtgaacagctgcatggggcgagtcaggagaatttatccccagttattactggccttactcatccaggttcactaccacattggcttgaatctgccgggttgcgtcgcccctcctaaggatacaaagaaaggcgcacagcccagcccctttgtgcctgttaggtgggtcgtgaaagttgtgaagacacttctgctgcgcatgggatgctcctacgagaccactttcctggaggatcaggggggatgggaacttatggaacaggtcgagtcccatcaccggggtgttgcgcttctggctcgggctatggtccagtacagctgccaagaactgtgcaggatcttatacttgctgattcctctgcttgaacggggagatgagaagcacagaattaccgccactgccttttttgttgaattgctccaaatggagcaggttagacgcattccggaagaatattctctcgggagaatggctgaggggctatctcaccacgatccaattatgaaagtcctttcaattcgaggccttgtgattctagcccgaaggtctgaaaagacagctaaggtgaaggctcttctcccctccatggtgaagggtctgaagaatatggacggtatgttagttgtggaggccgtgcacaacctcaaggctgttttcaaaggtagggatcagaagctgatggattccgctgtttacgtcgagatgctgcagattcttctgcctcacttcagcgatgcccgtgaggtggtgcggagcagttgtatcaatctctacgggaaagttgtccagaagctgcgggctccaaggacgcaagccatggaggagcagctggttagcacactagttcctctgctgttgacaatgcaagagggcaactccaaggtgtctcagaaatgcgtcaagaccctcctgcggtgctcatattttatggcgtgggagctgccaaagcgagcctatagccggaagccctgggataatcagcagcaaactgtcgccaaaatatgtaagtgtctggtgaatactcatcgagacagcgcatttatctttctctcacagtccttagagtatgctaagaacagcagggcgagcctaaggaaatgttccgtcatgtttattgggtcccttgtgccctgcatggaaagcattatgacagaagacagattaaatgaggtcaaggctgcactcgataatctgcggcacgatcctgaggcctccgtatgcatttacgccgctcaggtgcaggaccatattctggcatcctgttggcagaactcctggttgcctcatgggaacagctgggtgtgttactctgccacgacgcacagatggtccccatcctgcgagaatttgccaacttctcaccagcgtaggtcctggatcatgcaggctcttgggtcctggaagatgtcactcaaaaagtag

SEQ ID NO: 50692 - DNA, 1623 bp, Artificial Sequence
  Description of Artificial Sequence: Synthetic coding sequence
atggcccttgtggagaacgttacaacgctgcaaaaatcacaggatttgctggaggccgaaggcgagaaaaaaactatgattaaaaagattatgaggcaaatccaggaggaacccctggattccttaagtagcagtgtgcgcaaacaggcaatggagattctgacccagctctcccacacccaacctaccttggggatgcgcgaaagaagcgagcttgtaaacgtttgcgttcattcggtattcagtctcccatccgttcaagctatgcaggagaaagatgaagccaaggccgagaccattcaggcgctctatcatcagactttagaggctctgcagaccctcctgaaggctctgttcattgaagacccgaccccagccggtctcaagagtattcttgaagcgttagggccttggatgaactcaggcaaggcacatgagcgagcgagagcagtaaatacgaatgtgagtgtgttaaaccatatgctgctgacactgcccttttttatgcctctggggtttcccgctctgggcttactgctgggccgactgatattacatattggggatccagacgaagagataggatgtgaggcactggacggaatcataattttgtatacaatcctcgaactccagaaaagagccagagataaggaggaaaccaataagaaggaactctacgagagcaacaagcatttcctcgggccttacaaccccgtgtctccctgccagaatattctgcgggtgatagaggaattcggtgacttcctggggccacagcagattaaagatcttcttctcgcggcactggagggcctgaagggctccagcgaggccccaggaaaagacagtcgtgagatgatgcagttggcttcagaggtgatgctctcatccgtccttgagtggtaccgccatcgggcactcgaagtgatcccagaaatcatgcagggtatatatatgcagctgtcccacatccaagagccacgcgcaaggcaggtggctcttctgcctgtgtcccttctagcttcatcttttatgaccgaagtggtcgtggccctgctgatgtgccctctcccattgaacagtaatggggctgagatgtggcggcagctgatcctgtgtaaacccagttgtgacgtgcgcgatcttctggatttacttctaggctctctgaaggaaaagcctgttacaaaggaaggacgtgccagtatcgtcccattagccgctgctagcggtctgtgtgagctgttgagtgtgaacagttgcatgggtagagtgcgacgtatctatccccagctccttctcgccctgttgattcaagttcactaccacatcgggctgaatctgcctggttgtgttgcaccccctaaagacaccaagaaaggggcacaacccagtccttttgtgccagtgagatgggtggtgaaagtagttaagacgctccttttgagaatggggtgcagttatgaaaccacttttctggaagaccagggcggttgggagcttatggaacaggtcgagagccaccaccgaggcgtggcccttttagcctcttcaagcaggtggtctagatgtgccggatcccctaggaacactctgtggggcggttggcagaaagcctag

SEQ ID NO: 50693 - DNA, 1416 bp, Artificial Sequence
  Description of Artificial Sequence: Synthetic coding sequence
atggccagagagatgacaatccttggtagtgccgtgctcaccctcctgctggccggataccttgcccagcagtacctacccctgcccaccccgaaggttatcgggatcgacctgggcaccacctactgctcagtgggtgtgtttttccctggcacggggaaagttaaagtgatccctgacgagaatggccacatttccattccttccatggtatcctttacggacaacgatgtctatgtaggttacgagagtgtggaactggcagactcgaacccacagaatactatttacgatgcaaagagatttataggaaaaattttcactgctgaggagctagaagctgagatcgggagataccccttcaaagtactaaataaaaacggcatggtcgagttctccgtcacgtctaacgagactataacggtcagcccggaatacgtgggatcccgcctcctgctgaaactgaaagaaatggccgaagcatacctcggcatgcctgtcgctaacgctgttatctccgtacccgcagagttcgacctcaagcagcggaactccacaatcgaggccgctaaccttgctggcttgaagatattacgggtgattaacgagcccactgccgcagccatggcgtacggtctccacaaagcggacgtgtttcatgtactggtaattgatttgggtggaggaaccttagatgttagtctgctgaacaaacagggcggtatgtttctcactagagcaatgtccggaaacaataaactcgggggacaggattttaaccaaaggctcctgcaatacctgtataaacagatataccagacatatggcttcgtaccctcgcggaaagaggaaatccaccggctgagacaagccgtggagatggtgaagctgaatctaaccctgcaccagtcagcccagctgagcgttctcttgacagtagaggaacaggatcgaaaggagccacatagttctgacacagagctgccaaaagataaattatcttctgcggacgatcaccgagttaatagcggattcggtagaggactgagcgacaaaaagagcggggaaagtcaggtgctgttcgagactgaaatctccaggaaactcttcgacaccctaaacgaagaccttttccagaagatcctagtgcctattcagcaggtgcttaaagagggacatctagagaagaccgagattgatgaggtcgtgctggtgggaggctcaacccggatccctagaattcgccaagtgatccaggaatttttcggtaaggatcctaataccagtgtggacccagatctggccgtcgtgacaggagtagctatccaagctggcatcgacggcggatcatggccactccaggttagcgccttggagattccaaacaagcaccttcagaagaccaactttaattag

SEQ ID NO: 50694 - DNA, 792 bp, Artificial Sequence
  Description of Artificial Sequence: Synthetic coding sequence
atggcatatgggttgcacaaagccgatgttttccatgtcctcgtgatcgaccttggaggcggaacactggatgtctctcttcttaacaaacagggagggatgttcttaacccgtgccatgtcgggaaataataagttgggtgggcaggactttaaccaacggctactgcagtacctgtataagcagatctatcagacctacgggtttgtgccaagtaggaaggaagagatccaccggctacgccaggccgtggagatggtgaagttgaatttaaccttgcaccagtcagctcaactgtcagtcctgctgaccgttgaggagcaggataggaaggagcctcattcatctgatacggagttacccaaagacaagttatcttcagcagacgatcatcgagtaaatagtggttttggacggggactgtccgacaagaagtccggggagtcgcaagtcttgttcgagacagaaatctccaggaagttgtttgacactctcaatgaagacctgttccaaaaaatactggtgccaatccagcaggtcctgaaggaggggcatctggaaaaaaccgaaattgacgaagtggtgttggtgggcggttcaacccgcataccccgaatccggcaagtgatccaggagtttttcggaaaagatcctaatacgtccgtagatccagatctagcagtggttacaggggtcgctatacaggccggaatcgacggcggtagttggccactgcaggtttctgcactggaaatcccaaacaaacacctgcaaaaaaccaacttcaactag

SEQ ID NO: 50695 - DNA, 1515 bp, Artificial Sequence
  Description of Artificial Sequence: Synthetic coding sequence
atgggaataaagacggccttacctgccgcagagctggggctttatagcctcgtgctgtctggcgcacttgcctacgcaggacgcggtctactagaggcttcccaggacggagcccacaggaaagcctttagagagagcgtgcgccctgggtgggagtacatagggaggaagatggacgtagcggattttgagtgggtgatgtggtttactagcttccgtaacgtgatcatttttgctcttagcgggcacgtgctgttcgccaaattgtgcactatggtggctcccaagctgaggtcctggatgtacgccgtatatggagccctggctgtcatgggtaccatgggcccatggtatctacttctgctgcttgggcattgcgtggggctgtacgtagccagcctgttaggacagccctggctttgtctgggcttgggcttggctagtctagcctcatttaagatggacccgttaatttcatggcagtccggatttgtcaccggcacctttgacctgcaggaagtgctctttcatgggggatcctcattcactgtgcttcgctgtacctcatttgctctggagagctgtgcgcaccctgaccgtcactattcacttgcagacctcctcaagtataacttttacctccctttttttttcttcggacccataatgaccttcgatcggttccacgcccaagtctcacaggtggagccagttaggcgggagggggagctctggcacatacgtgcccaggcgggacttagtgtagtggctattatggcagttgatatcttctttcactttttttacattcttaccatccctagcgacttgaagttcgctaaccgtctgcccgacagcgcgcttgccggtctggcctactctaacctcgtctacgattgggtgaaagctgccgtgcttttcggcgtggtaaacacagtcgcttgtctggatcacctcgatccccctcagccccctaaatgcatcactgccctgtacgtgtttgccgagacacatttcgacaggggaatcaatgactggctgtgcaaatatgtgtacaaccacattggaggcgagcatagcgctgtcatccccgaacttgctgccactgtggccacttttgccattacaacactctggctgggcccttgtgacattgtgtatttatggagctttctgaattgcttcgggctaaatttcgaattgtggatgcagaagctggccgagtggggcccactggccaggatcgaggccagcctgtcagtgcagatgtcccggagagttcgagccctctttggcgctatgaacttctgggctattataatgtacaatctggtgtcgctgaatagcctgaagttcaccgagctcgtggcccgacgcttgttgctgactggctttcctcagactacactgagtatcctattcgttacatactgcggggtgcaactcgtaaaagagcgggagcgcacgctggccctggaagaggagcaaaagcaggataaggagaagcctgaatag

SEQ ID NO: 50696 - DNA, 738 bp, Artificial Sequence
  Description of Artificial Sequence: Synthetic coding sequence
atggttgccccaaagctgagaagttggatgtacgccgtctatggggctctggctgtgatgggaactatgggaccctggtatctcttgctgctgctcggtcattgtgttggcctttatgtggccagccttctgggacagccctggctctgtctggggttaggattggccagcctcgcttcgtttaagatggatcctttgatctcatggcaatcggggttcgtgaccggcaccttcgatctgcaagaggtcctgtttcatgggggatcctcctttactgtgctgaggtgcaccagttttgcgcttgagtcttgcgcacatcctgatagacattattcactggcagatctgcttaaatacaatttctatctccctttcttcttctttgggcctatcatgaccttcgacagattccatgcccaggtgtcacaggtggaacccgtgaggcgggagggcgagctctggcatattcgtgcccaggccggtctgtcagtagtagccatcatggccgtagacatcttctttcactttttctatattttaagccccgcaacgtccagctctccaactgccagccagacagtaccgtccgccggacttgcttatagcaatctagtatacgactgggtaaaagggagaccattgtggtgctgccagcactggcatgcatccactacctggacgcacccccctcctaaatgtatcactgctctttacgtgtttgccgagacacatttctag

SEQ ID NO: 50697 - DNA, 696 bp, Artificial Sequence
  Description of Artificial Sequence: Synthetic coding sequence
atgggaatcaagactgctctgcccgctgcagaactaggattgtacagcctcgtgctcagcggcgcattagcatatgccggtagagggctgctggaggcgagccaggatggcgctcaccggaaagcgttccgggagagtgtacgcccagggtgggagtacattggcaggaagatggatgtggctgatttcgaatgggtcatgtggttcacatcgtttagaaatgttatcatctttgccctgtctgggcatgtcctgtttgcaaaactgtgcaccatggtagccccaaaactgcggtcatggatgtacgccgtctatggagcattagcagtcatggggacgatggggccttggtacttgctgcttctccttggacactgtgttggcttgtatgttgcttccctgttggggcagccctggctttgcctggggcttggattggcttctctggcaagctttaaaatggacccattaatcagctggcaaagcggattcgttaccggcactttcgatctacaggaagtcctgttccacgggggttcatctttcactgtgctaaggtgtacttcatttgctctcgaatcttgcgcacatcccgaccgtcactatagtctcgccgatttgctcaagtacaatttttacctgccattctttttcttcggtcctatcatgaccttcgataggtttcacgcacagtag

SEQ ID NO: 50698 - DNA, 1515 bp, Artificial Sequence
  Description of Artificial Sequence: Synthetic coding sequence
atgggcatcaagaccgctcttccagcagctgaactcggtctgtacagcttggtcctgtcaggcgcactcgcatacgctgggaggggcctactggaggcctcccaggatggcgcacaccggaaggccttccgggagtctgttcgcccaggttgggagtatattggcagaaagatggatgtcgctgattttgaatgggtgatgtggtttacaagcttccggaacgttatcatctttgctttgtctggccatgtgctgttcgccaaactctgtacaatggtggccccaaaactgcggtcctggatgtacgcagtctatggcgcactggccgtgatgggcaccatgggcccatggtacctgcttctgctgttaggacactgcgtggggctttatgtggccagtctcctgggccagccctggctatgtcttggcctcggcctcgcctccctggcatctttcaaaatggatccactgatctcgtggcagtctgggtttgtgaccggcacttttgacctacaggaagttctgttccatggaggttcctcctttacagtgctgagatgtacatctttcgccctggagtcatgtgcacatcctgatcgacactattcgcttgctgacctcctcaaatataatttttatctccctttcttcttcttcgggcctattatgacgtttgatcgatttcatgctcaggtctcccaggtggagcctgtcaggcgcgagggcgaactgtggcacatccgcgcacaggccggactcagtgtggttgcaatcatggccgtcgatattttctttcattttttttatatcctaacgatcccgtctgacttaaagtttgcaaacagactccccgacagtgctctggcaggtcttgcgtatagcaacctggtgtatgattgggtgaaagccgcagtgttattcggggtcgtgaacaccgttgcttgtcttgaccacttagaccccccacagccgccaaagtgtatcaccgcactgtacgtttttgcagagacacatttcgatcgaggcattaacgattggttgtgcaagtatgtctacaatcacatcggaggagagcactcagcagtgatcccagaactggctgccaccgttgccacatttgctataaccaccctctggctcggcccttgcgacattgtgtacctgtggagctttctcaactgttttggtctcaactttgagctttggatgcaaaagctcgcggagtgggggcctctcgccagaatcgaagcctctctctccgtccagatgagcagacgcgtgcgtgcactgttcggagccatgaatttctgggcaatcatcatgtacaacttggtgagccttaattcgctaaagttcaccgaactcgtagccagacgactcctactgacggggttcccacagacaacgttgtctattcttttcgtaacttattgtggggtgcagctggttaaggagagagagcgcacattggccctagaagaagagcagaagcaagataaggagaagcctgagtag

SEQ ID NO: 50699 - DNA, 282 bp, Artificial Sequence
  Description of Artificial Sequence: Synthetic coding sequence
atgatccacctgggccacatccttttcctccttctgctgcctgtcgccgctgcacagaccactcccggagaacgatcctctcttccagccttctaccccggaacaagcggctcctgttctggttgcgggagcctgtctttgccactgttggccggactggtggccgcagacgcagtggcgagccttctaattgtgggcgctgtgttcttatgtgcgagaccacgcaggtcgcctgcccaggaagatgggaaggtgtacattaatatgcccggacgcggttag

SEQ ID NO: 50700 - DNA, 279 bp, Artificial Sequence
  Description of Artificial Sequence: Synthetic coding sequence
atgattcaccttggacacatcctgtttttgcttctgctgcccgtggcagccgctcaaactacacctggtgagcggtcatctttgcctgccttctatcccggtacttccggttcctgcagcggatgcggttctctttcgctgccattgctggccggactcgtcgctgccgacgcagtcgcctctctcctgattgtgggcgctgtgttcctgtgcgctcgccctaggcgctcaccagcccaagatggtaaagtatacattaatatgcccggaagggggtag

SEQ ID NO: 50701 - DNA, 924 bp, Artificial Sequence
  Description of Artificial Sequence: Synthetic coding sequence
atggctgcactcctcctgggtgctgtgctgctggtggcacagccacagcttgtgcccagtcggccagccgaactcgggcaacaagagcttctcagaaaagcaggcacactacaggacgatgtgcgcgatggtgtggccccaaatgggtctgctcagcaattaccccagaccataattataggggttcgcaaaggagggactcgtgccctgctggaaatgttgtccctgcaccctgatgtcgctgctgcagagaacgaagtacacttcttcgactgggaggaacattactcacatgggctgggctggtatctgtcacagatgccgttcagctggccgcatcagttaactgttgagaaaacccctgcctacttcacctctcccaaagtgccagaaagagtttactccatgaatccgagcatcaggttgcttcttatcctgcgcgaccccagcgagcgggtgctatctgattacacccaggtgttctataatcacatgcagaaacacaagccctacccaagcattgaagagttcctggttcgcgacggtcgcttgaatgtggattataaggccctcaaccgctctctgtaccacgtgcacatgcaaaactggctaagattcttccctctcagacacatccacatcgtagatggtgaccggctgatccgggatccattccctgagattcagaaagttgagcgattcctcaaattatctccgcagatcaacgctagtaatttctatttcaacaagacgaaaggcttctattgcttgagagacagtgggagagatcgctgtttgcacgaatcaaaaggacgagcccatccacaggtggacccaaagctcctgaacaagcttcatgagtacttccacgagccaaacaaaaagtttttcgagttggtcggccgtacattcgattggcattag

SEQ ID NO: 50702 - DNA, 252 bp, Artificial Sequence
  Description of Artificial Sequence: Synthetic coding sequence
atggctgcactgctgctcggcgctgttctgctggtggcacaacctcagctagttccttcccgccctgcagagctcggccagcaggagttgctgcgcaaagcgggtacactgcaggacgatgtgcgcgacggcgtggcccctaatgggtcagcccagcagcttccccagactattattatcggcgtgaggaaaggcggtaccagggcactcctcgagatgctgtctctgcaccccgacgtcgctgccgcatag

SEQ ID NO: 50703 - DNA, 252 bp, Artificial Sequence
  Description of Artificial Sequence: Synthetic coding sequence
atggcggctctgttactaggggctgtcttgctagtcgctcagccgcagctggtccctagccggcctgctgaactcgggcaacaggaactattgcggaaagcgggtactctgcaagacgacgtaagagacggtgttgccccaaacggcagcgcccagcagctgccccagactattataataggcgtgcgtaagggtggcaccagagcgctgctcgagatgctgtcccttcatccggacgtggccgctgcgtag

SEQ ID NO: 50704 - DNA, 1029 bp, Artificial Sequence
  Description of Artificial Sequence: Synthetic coding sequence
atggctgggagcggtggtctgggaggcggagccggtggagggcagggtgcgggagctggacagggagccgcattgcgcgcttctagggcaccaatgttgctcgttgccctcgtactgggggcatactgtctatgcgccttgcccggtagatgccccccagcagcacgggctcctgccccagctccagcgccatctgaacctagttcttccgtgcataggcccggtgctcctggtctgcccctggcaagtgggcctggtcggagaaggtttccccaagccctcatcgtcggagtgaaaaaaggtggcactcgcgcacttctcgaatttttgcgcctgcatcccgacgtaagggctctaggtagtgagccacatttctttgaccgatgttacgagagagggctggcttggtatcgttctctcatgccccgaacgctcgacggccagattaccatggagaagaccccatcttactttgtcaccagggaagccccaaggcggattcacgccatgagccccgatacaaaacttattgtcgtggtgagaaacccggtgactcgcgcaatttccgattacgctcagaccctctcaaagactcccggtcttccatctttccgggctctcgcatttcgtcatgggctgggcccagtggataccgcttggagcgcagtaaggattgggctgtatgctcagcatttggatcactggttacgatactttccgctttcccactttctgttcgtgtccggagagagactggtgagcgatccagcgggagaagtgggccgagttcaagattttctgggcctgaagcgcgtcgtgaccgataaacacttctacttcaacgcgaccaaaggattcccctgcctgaagaaggcacagggaggctcgaggccacgctgcctcggaaaatcgaagggacgacctcacccacgtgtgcctcaagccctggtgcgtagactccaggaattctatcgaccgtttaatcgcaggttttatcagatgaccggtcaggacttcggatgggggtag

SEQ ID NO: 50705 - DNA, 936 bp, Artificial Sequence
  Description of Artificial Sequence: Synthetic coding sequence
atgctcctcgtggccctggtgctcggcgcatattgcctgtgcgcccttcccggacgatgcccccctgccgcaagggcaccagcacccgcaccagccccttctgagccctcatcttccgttcatcgccctggggcaccaggcctgcccctggcttccggtcccggaaggagacgatttcctcaggctcttatagtgggtgtcaagaagggcggtaccagagctctcctggagtttctgcgactccatcctgacgttcgtgccctagggtcggagccccactttttcgaccggtgttacgaaaggggcctcgcttggtatcgttctttgatgccccgaacactcgatggccagattaccatggagaagacaccatcgtactttgtgactcgcgaagccccacgtcgcatacacgccatgagccctgacacaaagctgatcgtggttgtgcgcaaccccgtgacaagagccatcagcgattatgcgcagaccctgtcaaagacaccgggtctgccctcttttcgggctctagctttcaggcatgggctgggaccagtggacacagcttggtccgcagttaggatcggcttgtacgcacagcacttggaccactggttgcgctacttccccctgagccatttcctgttcgtaagcggcgaacgtttggtgtccgatcctgccggagaggtcggtcgggtccaggatttcctcggtttaaagcgagtggtgacagacaagcacttctattttaatgcgaccaaggggttcccatgtctcaaaaaggcccagggaggaagccggcctagatgcctcggaaagtctaaaggcagaccgcatccacgggttccccaggccctagttcgaagactgcaggagttctatcgccctttcaacaggaggttttaccagatgaccggccaggatttcggttggggctag

SEQ ID NO: 50706 - DNA, 1146 bp, Artificial Sequence
  Description of Artificial Sequence: Synthetic coding sequence
gcagccggtccccctggcgcagaacacaagcctggtacccacggtctgtcgggtgcccgagccgaaatgagggctagactgctccctcccctccccggtttagagagacgagatccaatggctggtagtggcggactaggaggcggagctggtgggggtcaaggtgccggtgccggacaaggggctgccttaagagcttcccgagctccaatgctcctggtggccttggtgctgggcgcatactgtctctgtgcgttgcccggtagatgcccaccagccgctagggccccagccccagcccctgcgcctagcgaaccatcttctagtgtacatagaccaggggctcctggcctgccgctcgcctcaggtccgggaaggaggcgcttcccccaggctctaatcgtcggcgttaaaaaggggggtaccagagccctccttgagttcctgagattgcaccctgatgtacgcgctctgggcagcgaacctcacttcttcgacagatgttatgagcggggactggcctggtacaggtccctgatgccaagaacattagatggacagataactatggaaaagactccgagctacttcgtgacccgcgaggccccacgaagaattcatgcaatgtcgcccgacacaaagctgattgttgtagtccgaaacccagtgacccgtgccatttctgactatgctcagacgctatccaagacaccgggattgccatcattccgggctctggcatttaggcacggactgggcccagtagatacggcttggtctgccgtgcgcataggtctgtacgcccagcacctcgaccattggctcagatactttcctctgtcacattttttgttcgtgagcggagagcggctcgtcagcgaccccgctggcgaggtcggacgagtacaagactttctcggcctgaagagggttgtgacagataaacatttttatttcaatgcaaccaagggcttcccctgcctgaagaaagctcagggcggatctcggcctcgctgcctgggtaaaagtaaaggaaggcctcacccacgcgtccctcaggctttagtgagacgcctgcaggagttttacagaccctttaaccgaagattctatcaaatgaccggccaggactttggatggggatag

SEQ ID NO: 50707 - DNA, 906 bp, Artificial Sequence
  Description of Artificial Sequence: Synthetic coding sequence
atgttcagtcacctccctttcgactgcgtgctcctgctcttgctgcttctgctcacccgctcttctgaggtcgagtaccgcgctgaagtgggacagaatgcttatctgccctgcttctatacccctgccgcacctggtaatctggttcctgtgtgttggggaaaaggggcatgcccagttttcgagtgcggtaatgtcgtgcttcgcacggatgaacgggatgtaaattactggacgagcagatactggctgaatggggattttcggaaaggagacgtcagcctcacaattgagaatgtgacattggctgattctggcatatattgctgccggattcagatccctggaattatgaacgatgagaaattcaacctgaaattggtcatcaaaccagccaaggtgactcctgcacctacccggcagcgggacttcacggccgcattcccacgtatgctcaccactcgcggacacggtcccgcagagacccagaccttgggatccctgcccgatatcaacctgacccagatatctaccctcgctaacgagctgagagactcgcgtctggccaatgacctccgggattctggtgccactatcagaatcggcatttacataggcgctggcatttgcgccggattggccttggcactgatttttggggcactgatttttaagtggtactcacactccaaagaaaagatccagaatctgtctctgatctctttggctaaccttccacctagcgggctcgcaaacgcagtggcagaagggattcggagtgaggaaaatatctacaccatcgaagagaacgtctacgaagtggaggagcctaatgaatactattgctatgtgagctccaggcagcaaccgagccaacccctgggatgccgtttcgctatgccttag

SEQ ID NO: 50708 - DNA, 3480 bp, Artificial Sequence
  Description of Artificial Sequence: Synthetic coding sequence
atgccacggaagcagcctgctgggtgcatatttctgctgacattcctaggtctcagcgggcttgtgggaaccgtcacccgtacctattacatcggaatagtggaagaatattggaactacgtcccccagggcaagaatgtgatcaccggaaagagttttacagaggataaattggccacactgttcctcgagcggggtccaaatcggattgggtcaatttataagaaggccgtttatagacggttcactgatggcacctattccattgagatcccaaaaccaccttggttgggcttcctaggtcccatactgcgcgcagaagttggcgacgttatagtgatccatctcaaaaactttgctagtcgcccttatagcctgcatccccacggagtgttttacaacaaggatagtgagggcgcactgtatccggatggcacaagtggcagaaataagaatgacgacatggtcccccctggtaagaattatacctacgtgtggccagtgcgtgaagaatacgcgcctacgcctgcagatgccaactgcctgacgtgggtttatcatagccatatcgacgcccctaaggatatttgttctgggctgatcggccctctgctggtttgtaaagaaggaattctcaataggtacagcggaactcgcaacgacgttgaccgagaatttgttataatgttcacccttgttgatgagaatcagtcatggtacctgaacgaaaatattaagcatttctgcaccaatcccgactctgtggataagaaagatgcagtgtttcagcggtcaaacaaaatgcacgcccttaatggatatttattcggaaacttcccagagcctgacatgtgtgtgggcgagagtgttagctggcacctcttcggcatgggcaacgagatcgatattcactcaatctacttctacggcaacacatttattagccgcggacaccgcacggatgtcgttaacctctttcctgcgacattcttaacaaccgagatgattgctgaaaaccctggcaaatggatgatcacctgtcaggtatcagaccacctccaggctgggatgctcgggcagtataatgtcgacaactgcaaatccgacatattttatcccaagatgaagggtcagcagcgacggtacttcatcgcggcagagaaaattctgtgggactatgccccacaggggtataacaagtttagcggcctacccctaaacgcaagcggttcagactccgacctctacttcacacagggtgataaccgcatagggggtaagtactggaaggtgagatatacagagttcgtcgacgctacattcaccaagagaaagcgtctttcagccgaagaagctcatctggggatcttggggcctgttatcaaggccgaggtgggcgatacactactagtcacctttgccaacaaagccgataaagtttacagtatcctcccccatggtgttatctatgataaagcatccgacgctgcgcctaacctcgatggcttcgttaagccaggagcccacgtcaaacctggcgagaccttcacttataagtggacagtgccagagagtgtgtcaccaactgctggtgacccaccttgtttaacctacctttatttctccgctgtggatcccatcaaagacacgagtagtggccttgtggggcctctcttagtgtgtaaaaaaggagtgttaaatgctgatggtacgcaaaagggcattgacaaagagttctatctcctgttcacggtgttcgacgagaacctgtcacggtattttgacgaaaatatccagaaattcatttggcaccccttctctatagacaaggaagataaagagtttgtgaagagtaatagaatgcatgccgttaacgggtacatgtatggcaatcagcctgggctgaacatgtgcaaacgagatagagtcagctggcacctgatcggcttgggaacagacactgatatgcacgggattgtattccaagggaatacaatacatttgcggggtactcaccgcgacagcctggctcttttccctcatatggcaacgacggcctttatgcagccagaccacgcagggatttttcgagtattttgcgccaccatgccgcacttgtctcggggaatgggacagatatatgaagtttcctcctgcgacaacagggaccccagcgagcagaggtatgggatgattagaaccttttacatagcagctgaagaagtggaatgggattatgcccctaacaaaaattgggagttcgaaaaacagcacgtcgacgctagaggggaaagacatggggatatcttcatgaaccgaaccgaaaattggatcggttcgcagtacaaaaaagtggtgtatagagaatacacggacggcgagttcgtcgaaatcaaggcacgccctccacgcgaagagcacctggaactactgggccctatgattcatgcagaggtcgggaataccgtgcttatcatatttaagaataaggcatctcggccttactccattagtgcacagggggtggaagagatggatagcggaaagcagtttcaagtccccatgacaaaacctggggaggtgaagacttataggtggaatatccccaaacgctctggtccagggccttccgaccctaactgtatcccgtgggtttattattcgacagtgaatttcgtcaaggacacctactctggcctcatgggaccactcattacatgccggaaaggagtgctcaatgaaaagggcaggcggtcagacgtcgattacgagttcgcactgctatttctggtgttcaatgagaatgaaagctggtaccttgacgacaacatcaaaaagtatctcaataaggatcctagagacttcaagcgaaccgatgactttgaagagtccaacaggatgcatgcaattaatggaaaaattttcggcaacctgcatggccttattatgaatgaggacactatgaccaattggtaccttctaggcatcgggagtgaggtcgacattcatactatccattatcatgccgaatcgttcctgtttaagatcgacaagtcttacagagaggatgtgtacgacctcttcccagggacgttccagacgatagaactgttcgcggaccatcctgggacctggctgctgcactgtcacgtgagtgatcatatccatgctggaatggaaactacttacactgtgctgaggaacatcgacaataggattccatacagcacaacgtcaccaggggtcgccagccatcctgcgaccgttccatccaacgagaggccaggtaaagaacaactctattttttcggtaaaaatttggggccaactggtgctaaggcagccctagtgatcttatttatcattggcctgctgcttctcatcactaccgtcatcctgagcctgcggctgtgctcggctatgaagcagacagattatcagcaggtgcagtcatgcgctctgcccacagacgcactgtag

SEQ ID NO: 50709 - DNA, 1221 bp, Artificial Sequence
  Description of Artificial Sequence: Synthetic coding sequence
atggaccagtcaggcatggagatccctgtcacactaatcatcaaggcaccaaatcagaagtattcggatcagaccatctcgtgtttccttaattggacagtaggtaaattgaagacccatctgagcaacgtttacccctcgaagcccctgacgaaagatcagaggctggtttattccgggcgactgcttcctgatcacttgcagctgaaagacattcttcggaaacaagacgagtatcacatggtgcacttggtgtgcacttctagaacaccacctagctcacctaaaagcagcacaaaccgcgaaagccatgaggctttggcgtcatcatctaacagctccagcgaccattcaggcagtactaccccaagttccgggcaggagacgctcagtttagccgtgggatctagttcggagggactgcggcaacgcacccttccgcaggctcagaccgaccaagcacagagccaccagtttccttacgttatgcagggaaacgtcgataaccagtttccaggtcaggccgcaccccctggcttcccagtatatccggcattttctcccctccaaatgctatggtggcagcaaatgtatgcgcatcagtactacatgcagtaccaggccgctgttagcgcacaggcgaccagcaatgtcaatcctacccagcctaccacctcacagcctctcaatctggcacatgttcctggcgaggaaccaccaccggctcctaacctcgtcgcccaggagaatcggcctatgaacgaaaatgttcagatgaatgcacagggtgggccagtcttaaacgaagaagactttaaccgagattggctcgattggatgtatacctttagccgagctgcaattctactgtctattgtatacttctatagtagcttcagtagattcataatggttatgggagctatgcttttagtttacctgcatcaggcaggctggttcccgtttcgacaggaagggggacaccaacaggctccaaataacaatgccgaagtcaataatgatggccagaacgccaacaatctggagctggaagagatggagaggcttatggacgacggacttgaagatgaatcaggagaagacggcggagaggacgcatctgccatacagcgtccgggactgatggcgagcgcatggtcattcatcacgacattcttcacatccttgatccctgaagggcctccacaggtggccaattag

SEQ ID NO: 50710 - DNA, 1221 bp, Artificial Sequence
  Description of Artificial Sequence: Synthetic coding sequence
atggaccagagtggcatggaaatcccagtcacacttatcattaaagcacctaatcaaaagtactcggaccagaccatcagctgcttcctgaactggaccgtaggcaagctgaaaacccaccttagcaacgtttatcccagtaaacctcttaccaaagatcaacggctcgtgtattctgggagattactgcccgatcatctgcagttaaaggatatcctccggaaacaggacgagtaccacatggtccacctagtttgcaccagtcgcaccccaccgagcagtccgaaatcatcaacgaaccgggagagccacgaggctctggccagctcctcgaattcctccagcgaccatagcggttctactaccccgagcagcgggcaggaaacgctaagcctcgcagtcgggtctagcagtgaaggactgagacagagaaccctccctcaagcgcagaccgatcaggcacagagccatcagttcccttacgtgatgcaggggaacgttgataaccagttccctggacaggcagcacctcccggatttccagtatatccagcgttctcacctctacaaatgctctggtggcagcagatgtatgcacaccagtattacatgcagtaccaagctgccgtatctgctcaggctactagcaacgttaatcccacacagccaaccacctctcaacctctcaacttagcacacgtgccgggagaagaacctccccctgctccaaatctcgttgcccaggaaaaccgtccaatgaatgagaacgtccagatgaacgcgcagggagggcctgtcctgaacgaggaggacttcaatagagactggctcgattggatgtacaccttcagccgcgctgccattctgctatctatagtctacttctattcatctttctctagattcattatggtcatgggagccatgctgctggtgtacctgcaccaggccggatggtttccctttagacaggagggcggacaccagcaggcacccaacaacaacgcagaagtcaataatgatggacagaacgctaacaatctggaactggaagaaatggaacgactgatggacgatggcttggaggatgaatctggcgaagacgggggagaggatgcctcagccatccaaagacccggattgatggcatctgcatggtcatttatcaccaccttcttcacctcactgataccagagggccctccccaagtggccaactag

SEQ ID NO: 50711 - DNA, 1245 bp, Artificial Sequence
  Description of Artificial Sequence: Synthetic coding sequence
atgaaagctcagaccgcattaagttttttccttattctgatcaccagccttagcggctcccagggaatcttccctcttgctttcttcatctacgttccaatgaatgaacagatcgtaattgggaggctggatgaggacattatactcccatcctcctttgaacgcggaagcgaggtagtgatccactggaaataccaggactcctacaaggtccattcctattacaaaggtagcgaccaccttgagtcacaggaccccaggtatgccaaccgcaccagcctgttctacaacgaaatacagaatggtaacgccagtctgttctttaggcgggtctccctgctcgatgaaggaatatacacctgttacgttggcacagctatccaggttataacaaataaggtggtcttgaaagtcggagtgttcttgaccccggtaatgaagtatgaaaagcgcaatactaactctttcctcatatgttcagtgctctcagtataccctcgcccaatcatcacctggaagatggataacacccctatctccgagaataacatggaggaaacaggctccctggatagcttctccataaatagccctctgaacattactggctccaattcttcatacgagtgtacaattgagaactctttactgaagcagacatggacaggacggtggaccatgaaagacggtcttcacaagatgcaatccgagcacgtgtccttgtcttgccagccggtgaatgactacttttctcccaatcaggatttcaaggtgacctggtccaggatgaaaagcggcactttctcggtgctggcatattatctcagctccagccagaacacgattatcaatgagagccgatttagctggaataaggaacttattaatcagtccgattttagtatgaacctgatggacctcaatctgagcgactccggcgagtatctgtgcaacatttccagtgacgaatataccctgcttactatccataccgttcatgtggagccttctcaggagactgctagccataataaaggactctggattcttgttccgtctgccatactggccgctttcctcctgatctggtccgtgaagtgctgccgtgcacagttagaggcccgacgttcgcgccacccagccgacggcgctcaacaggagagatgttgcgtgcctccaggggagcgctgcccatcagccccagacaatggtgaggagaatgtccctctttcagggaaagtgtag

SEQ ID NO: 50712 - DNA, 294 bp, Artificial Sequence
  Description of Artificial Sequence: Synthetic coding sequence
atgaaggcccagaccgctctgtctttctttttgatcttaatcactagcctgtctggcagccagggtatctttccattggcctttttcatttatgtgcccatgaatgagcagattgtcattggcaggttagacgaagatatcattctaccttctagttttgaaagaggctcagaggtggtgatccattggaagtaccaagactcgtacaaagtccactcatactacaaaggatctgatcatcttgagtcacaggatcctaggtatgccaaccgcacttcacttttctacaactag

SEQ ID NO: 50713 - DNA, 438 bp, Artificial Sequence
  Description of Artificial Sequence: Synthetic coding sequence
atgaaggctcagaccgccttgtctttcttcctgatccttatcacgtcactcagcgggagtcagggcatttttcccctggcattcttcatttacgtaccaatgaatgaacagatagtgattggacgcctggacgaggacataatcctccccagttcctttgaacgcggtagcgaggtggtgatccattggaagtaccaggatagctacaaggtgcattcttactacaagggatctgaccaccttgaatctcaggacccccgttacgctaacagaaccagtttgttctacaatgagatccagaacggcaacgcgagtctcttcttcagaagagtgtctctcctcgacgagggcatctacacctgttacgttggcactgcaattcaggtcattactaacaaggttgttctcaaggttggggtctttttgaccccagtctag

SEQ ID NO: 50714 - DNA, 1245 bp, Artificial Sequence
  Description of Artificial Sequence: Synthetic coding sequence
atgaaagctcagacggcccttagcttcttccttattctgataaccagcctgtcaggatcacagggcatcttccccttggccttcttcatatacgtgcctatgaacgaacaaattgttatcggccgactggacgaggacatcatcctgccaagctcatttgaacgcggatctgaagtggtcatccattggaaatatcaagatagctataaggttcactcctattataagggctctgatcacctcgaaagtcaggacccacgctatgctaacaggaccagcctgttctacaatgagattcaaaatgggaacgcttccttgttttttcgaagagtgagcctgcttgacgagggaatctatacgtgttatgtggggacggctattcaggtgatcaccaataaagtggtcctgaaggtcggggtcttcctgactccagttatgaagtacgaaaaaagaaacaccaacagctttcttatttgcagtgtgctgagcgtgtaccctcggccaataatcacatggaagatggataacacccccatttcggaaaataacatggaagaaactggatcactggattcattttctatcaactcccctttgaatattaccggctcaaattctagttacgagtgcaccatagagaactctctcctgaagcagacttggactggccgttggacaatgaaggatggtctgcataaaatgcagtcggagcacgtgagcctctcctgccagccagtgaatgattacttcagtcccaatcaagatttcaaggtaacatggagtcgtatgaagtctggcacgttttcagtgctggcttattacctgagctcctcacagaatactatcataaacgagtcccggttcagctggaacaaagaacttattaatcagagcgatttctcaatgaacctcatggatcttaatttgtccgactccggggagtacctctgcaacatttccagtgatgagtacactctcctcaccatccatactgtacatgtggaaccgtcccaggaaacagccagccacaataaagggttgtggatactcgtgccctcagctattttggccgcttttttgctcatttggtctgtcaagtgctgcagggcccaattagaggctcgtagaagccgacatcctgcggatggggctcagcaggagaggtgttgtgttccacccggagaacggtgcccatctgcccctgacaacggagaggaaaatgtgccactctcaggtaaggtctag

SEQ ID NO: 50715 - DNA, 411 bp, Artificial Sequence
  Description of Artificial Sequence: Synthetic coding sequence
atgaaagctcaaaccgcgctgtctttcttcctcatcctgatcacctcattatcggggtcccaggggatctttcccctagcattctttatctacgtgcctatgaatgagcaaatcgtcatcggaagacttgacgaagacataattcttccaagttcatttgagcgaggtagcgaggttgtgattcactggaagtaccaggacagttataaggtgcactcctattataaaggaagcgatcacctggaaagccaggaccctcggtatgccaatcgcacctcgctgttctacaatgaaattcagaatggtaatgcatccctctttttcagaagggtgtcacttctggacgaggggatatacacctgctacgttggcactgcaatacaggtgatcacgaacaaagtggttctgtag

SEQ ID NO: 50716 - DNA, 1245 bp, Artificial Sequence
  Description of Artificial Sequence: Synthetic coding sequence
atgaaggcccagaccgcactctcgtttttcctaatcctcatcaccagtctgtctggctcacaggggatttttcctctggcgtttttcatttatgtccccatgaacgaacaaattgtgatcggcaggctggatgaggatatcatactccccagtagtttcgagcggggaagcgaggtagtcatacactggaaatatcaggattcttacaaagtgcactcttattataagggaagtgaccacctggaatctcaggaccccagatacgctaacagaacgtctcttttctacaacgaaatccagaatggcaacgctagccttttcttccgcagagtgagcctgctggacgaggggatctatacttgttatgtgggaaccgcgattcaggtgatcactaataaagttgtcctgaaggttggagtgtttctgacgcctgtgatgaagtacgagaagcgtaacaccaactcattcctgatctgctccgttctttccgtgtatcctagacccatcattacatggaaaatggataacactcccatctccgagaataacatggaggagactgggtccctggacagttttagtatcaacagcccccttaacattaccggatctaacagctcctacgagtgcacaattgaaaatagtctcctgaagcaaacctggaccggacggtggaccatgaaagacggactgcacaagatgcagagcgaacacgtgtccctgagctgtcagccagtgaatgactacttttctcctaaccaggactttaaggtgacttggagcaggatgaaatcagggactttttccgttttagcctattacttgtcatcttcccagaacaccatcattaacgaatctagatttagttggaacaaagagcttatcaaccagagtgatttctctatgaatctgatggatcttaacctctccgactccggagagtacctctgcaacatcagttcagacgaatataccctgctgacaattcacactgtccacgtcgaaccaagccaggagaccgcttctcataataaggggctctggattcttgttccttctgccatcctggcagcctttttgctcatctggagcgtaaagtgctgcagggcccagctcgaggcaagaaggagcaggcatcccgctgatggggctcagcaggaacggtgctgtgtgccgcctggagagcgctgtccttccgcccctgacaacggcgaggaaaatgttcccctgagcggcaaggtttag

SEQ ID NO: 50717 - DNA, 2193 bp, Artificial Sequence
  Description of Artificial Sequence: Synthetic coding sequence
atggctgcaggagtggaagcagcagcggaagtcgcagccacagaaattaaaatggaagaggagtctggcgctcccggtgtcccctccggcaatggcgctcctggaccaaaaggagaaggtgaaagaccggcacaaaatgaaaaaagaaaagagaaaaatatcaaaaggggaggtaaccggtttgaaccttatgccaatccaaccaagaggtaccgcgcatttataaccaacattccgtttgatgtgaagtggcaatcattgaaagacctcgtgaaggagaaggtaggcgaggtgacttacgttgaactgctgatggacgctgagggcaaatcgcgagggtgtgccgttgtcgagtttaaaatggaagagtccatgaaaaaagctgcagaggttttgaataaacactcgctatctggcaggccgctcaaggtgaaagaggatccagatggagaacacgccaggcgtgcgatgcagaaagtgatggccaccactgggggtatgggtatgggccctggcggacccggaatgatcactatccctccgagcatcctaaacaatccaaacatcccgaacgagatcatccacgccctgcaggctgggagactaggaagtaccgtatttgtggccaatcttgattacaaggttggatggaagaaactgaaagaggtttttagtatggcaggggtagtggtgagggccgatattctcgaagataaagacggcaagagccggggtatcggcacagtgaccttcgaacagagcatcgaggccgttcaagccatttctatgttcaacggacaactgttgtttgatcgtccaatgcacgtcaaaatggacgagagagcgctgccaaagggggatttttttccgccagagcgtcctcagcagctaccgcatggacttggagggattgggatgggcttgggccctggaggtcaacctatcgacgccaatcatttaaataaggggattgggatggggaatatcgggcctgctgggatggggatggaagggatcggctttggaattaataagatgggcggaatggagggacctttcggagggggaatggaaaatatgggcagattcggaagtgggatgaatatgggcagaatcaatgaaattctgagcaatgccctcaagaggggggagattattgcgaagcagggaggaggcggagggggtggcagcgtccctggcattgagagaatgggaccaggcattgatagactgggcggagctggtatggagaggatgggggctggattaggacacggtatggaccgcgtcggatcagaaatcgaaagaatgggactggtcatggacaggatgggaagtgtcgaaagaatgggcagtggtatcgagcgaatgggaccgctcggattagaccacatggcgagctccatcgagcgcatgggacaaaccatggagcggatcggtagtggtgtggaaaggatgggagcaggcatggggttcggattggaaagaatggcagcccctatcgaccgggttggtcagacaattgagagaatgggaagcggagtcgagaggatgggcccagccatcgaacgtatgggcctcagcatggaaagaatggtccccgcaggtatgggcgctggattggagaggatggggccagtcatggatcgcatggctaccggcttggaacgcatgggtgctaataacctggaaaggatgggcctggaacggatgggcgcaaactcgctcgaaagaatgggtctagaacgtatgggggctaatagcctggaacgaatggggcctgcaatgggtccagctttaggcgctggcatagagaggatggggctggctatgggtgggggtggcggagcctctttcgatagagccatcgagatggagcgaggcaacttcgggggaagtttcgcaggctccttcggcggtgccggagggcatgctcctggagtcgcacgtaaagcctgccagatattcgtgaggaatttgcccttcgactttacttggaagatgcttaaagataaatttaacgagtgtgggcacgtgctctatgcagatataaaaatggagaacgggaagagcaaaggctgtggtgttgtaaaattcgagagtcccgaggtggcggagcgcgcatgccgaatgatgaacggtatgaagctttctggaagagagattgacgtacggatagacaggaatgcatag

SEQ ID NO: 50718 - DNA, 2076 bp, Artificial Sequence
  Description of Artificial Sequence: Synthetic coding sequence
atggcagccggagtggaggccgcagctgaagtcgctgcaaccgaaataaaaatggaagaggagtcaggtgccccaggcgttcccagtggaaatggggcacccggtcccaagggcgagggggagcggccagcgcagaatgagaaacgtaaagagaaaaatattaaaagaggcggtaacaggttcgaaccctatgcgaaccctacaaaacgctaccgggcatttatcactaacattccctttgatgtaaagtggcagtcactgaaagaccttgtaaaggagaaggtcggtgaggtcacgtacgtggagctactcatggacgccgaaggaaagtctcggggttgcgcagtggtggaatttaaaatggaagaaagtatgaaaaaagccgcagaagtcctgaataagcatagtctgtctggacggccattgaaagtgaaagaggaccccgacggggaacacgccaggcgtgcgatgcagaaggcaggaaggctgggttcaacagttttcgttgccaacctcgactacaaggttggatggaagaagctgaaggaggttttctcaatggctggcgtggttgtgcgtgcggacattcttgaggacaaggatggcaaatcaagagggattggtactgtgaccttcgagcaatctatcgaagccgttcaggccatttccatgtttaacggacagttgctgttcgataggccgatgcacgtgaaaatggacgagcgggcactgccaaagggggatttttttccgccagaaaggccccaacagttaccccacggactgggtgggattggaatgggacttggtcccggaggccagcccatcgacgcaaaccacctgaacaaggggataggaatgggaaatatcggccctgcagggatggggatggagggaatcggcttcggcattaacaaaatgggcggtatggaggggcctttcggtgggggaatggagaatatgggtcgcttcggaagcgggatgaacatggggaggatcaacgagatactgtccaacgcactgaagagaggcgagattatcgcaaaacagggaggaggaggcggtggcggatcagtcccaggaatcgaacggatggggcctgggattgatcgactgggaggcgctggtatggagaggatgggagcagggttgggacacgggatggatcgcgttggctccgagatcgagaggatggggctcgtcatggacagaatgggcagcgtcgaaagaatgggtagcggcatcgaaagaatggggccactgggcttggaccacatggcatccagtatcgaacgcatggggcaaactatggagcgcattggcagtggcgtggaacgaatgggagccggaatgggattcggtctcgaaaggatggccgcacccatcgatagagtcggccaaaccattgaaaggatgggaagcggggtcgagaggatgggacccgctatcgaacgcatggggctaagcatggagcgaatggtgccggcaggtatgggtgccggtctggagcgtatgggacctgtgatggatcgcatggctacagggctcgagaggatgggagctaacaatctggagaggatggggctagagcggatgggtgctaatagcctcgagcgaatgggcttggagaggatgggggcaaactcactcgaaaggatggggcctgctatggggccagcacttggtgctggcatcgaacgaatgggtttagctatgggcggtggcggaggggctagctttgaccgcgctatcgagatggagcggggtaactttggcggatcatttgccggatcattcggcggagccggtggccatgctccgggagtggcacgcaaggcttgtcagatttttgtgcgaaacctgcccttcgacttcacatggaagatgctgaaagataaatttaatgagtgcggacatgtgctgtatgctgatatcaagatggagaatggaaaatccaagggatgcggggtggtgaagttcgagagcccagaggtggccgagagagcctgcaggatgatgaacggaatgaagctgagcggcagagaaatcgacgtgcgaattgatcgaaacgcatag

SEQ ID NO: 50719 - DNA, 864 bp, Artificial Sequence
  Description of Artificial Sequence: Synthetic coding sequence
atgggatctgtggagcgaatgggatccggtatagagagaatggggcctctcggtctagatcacatggcgtctagcatcgagagaatggggcagaccatggaaagaattggctcaggagtagagcgcatgggcgctgggatgggatttgggctggagaggatggccgcaccgatagacagagtgggacagaccattgagagaatggggtccggcgtggagcgcatgggacccgctatagaacgcatgggcctttcaatggaacgaatggtccctgcagggatgggtgcgggattagagagaatgggccctgtcatggaccggatggccactggactcgaacgaatgggtgctaacaatcttgagaggatgggcttggagcgcatgggagccaattcccttgaacggatggggctggagaggatgggcgcaaactccctggaacgaatggggcctgccatgggacctgccctgggcgcaggtatagaaagaatgggcctcgctatgggcggtggcggtggagcctcttttgacagagcgattgagatggaacgaggcaacttcgggggatcgtttgcaggcagcttcggaggggcaggcggtcatgcccctggtgtggcgaggaaggcatgccagatcttcgttagaaacctgcccttcgacttcacatggaaaatgctgaaggacaaatttaacgagtgcggacacgtcctgtacgcagatattaagatggaaaatgggaaatctaaaggctgcggcgtggtgaagttcgaaagccctgaagtggccgaaagagcatgcaggatgatgaacgggatgaaactctccggcagggagatagacgtgcgaatcgatcgcaacgcttag

SEQ ID NO: 50720 - DNA, 1848 bp, Artificial Sequence
  Description of Artificial Sequence: Synthetic coding sequence
aacggcagccacctcaagacttggctaaaaaaaaagggctgcgccgtcgtggaattcaagatggaagaaagcatgaagaaagctgccgaagttctgaataaacacagcctgagcggccgtccattaaaggttaaggaggatcccgatggagaacacgctcggagggcaatgcagaaggtgatggctaccactggcggtatgggaatgggccctggcggacctgggatgattacaatccctccttcaatcctcaacaacccaaatatacccaatgagattatccatgctctgcaggcgggacgtctggggtccacggtattcgtagctaacttggactacaaagtgggttggaagaagcttaaggaagtgttttccatggctggggtggtggttcgggcagacattctcgaggataaagacggtaaaagtcgtggcatcgggaccgttaccttcgaacagtctattgaagcagtccaagccatatcaatgttcaatggacagctgctgttcgaccgtcctatgcacgtgaagatggacgagcgggctctgcccaagggagattttttcccgcctgaacggcctcagcagttgccacacggattgggcggtataggcatgggacttggcccaggcggtcagcccatagatgccaatcatctgaacaaaggcattgggatgggcaacatagggcctgctgggatggagggcccattcgggggtgggatggagaatatggggcgtttcggatccggaatgaatatggggagaattaacgagatcctgagcaacgctctcaagcggggtgagatcatcgccaaacaggggggaggagggggaggtggttcagtgcccggtatagagcggatgggacctggaattgatagattaggcggtgccggaatggagaggatgggggctggcctgggtcatgggatggacagggtgggatctgaaatcgagcgcatggggctggtaatggaccgaatgggctccgttgaacgcatgggtagtggaatagagcgcatggggcctctcggcctggatcacatggcttccagcatagaaaggatgggacagaccatggaacgcattggctccggagtggagaggatgggcgcaggcatgggtttcgggcttgagcgcatggctgcacccattgaccgcgtgggccaaaccatcgagcgcatggggagcggagttgaaaggatgggacctgccatcgaaaggatgggactgagcatggagcgaatggtgccagctgggatgggagctggactggagcgtatgggcccagtaatggataggatggctactggactggaacggatgggcgctaataatctcgagaggatgggcctggagcgtatgggtgcaaatagcctggagaggatgggtcttgagagaatgggtgcgaacagcttagaacgaatgggccctgctatggggcctgcgctgggagccggaattgagaggatggggctcgctatgggcggtggcggaggggcatccttcgacagagccattgagatggaacgcggaaacttcggaggtagtttcgctggtagtttcggtggcgctgggggacacgctcctggcgtcgccaggaaggcgtgccagatcttcgtccgcaatctcccctttgactttacttggaagatgctcaaggacaagttcaatgagtgtggacacgttctgtatgcagatattaagatggaaaacggcaaatcaaaaggttgcggggttgtgaagtttgaaagcccagaagtagcagaacgagcctgcagaatgatgaatggaatgaaactcagcgggagagagatagacgtgagaatagacaggaacgcctag

SEQ ID NO: 50721 - DNA, 2754 bp, Artificial Sequence
  Description of Artificial Sequence: Synthetic coding sequence
atgtttgctgttcacttgatggcattttattttagcaagctcaaagaagaccagattaagaaggtggaccggttcctgtatcatatgcgcttgtctgatgacactctactcgacataatgcggagattcagagccgagatggaaaagggactggcaaaagatactaaccctactgccgctgtgaagatgttacccactttcgtgagagccattccggatgggtccgagaatggggagttcctgagtctcgaccttggcggatcgaagttccgcgtcctgaaagttcaggtggccgaagagggcaaacggcacgttcagatggagtctcagttctaccctacaccaaatgagatcattaggggcaatggaacggaattgtttgaatatgttgccgattgcctggccgattttatgaaaacaaaagatctaaaacataagaaattgcctctgggactgaccttctcattcccctgccgtcaaaccaagttggaggaaggggtcctcctgtcctggacaaaaaaattcaaggcccgtggcgtgcaggacactgacgtggtttcgcgcttgacaaaggcaatgcgcagacataaggacatggatgtcgatatattagccctggttaatgatactgtgggtacgatgatgacatgcgcctacgacgatccttattgcgaagttggagtcatcataggaaccggcaccaacgcttgctatatggaggatatgtccaatatcgacctagttgaaggagacgaggggagaatgtgtatcaataccgaatggggagcattcggcgacgacggggcactagaagatattaggactgaattcgaccgcgagctggatttgggatccttgaacccaggcaagcaactgtttgaaaagatgatttctggattatacctgggcgagctggtacggctcattctcttaaaaatggcaaaggcaggtctactgttcggcggagaaaagtctagcgctctccacacgaaaggtaagattgaaacgagacacgtagccgcaatggaaaagtacaaggaagggctagctaacaccagggagatcctggtcgatctgggactcgaaccatccgaggctgattgcatcgccgtgcagcacgtatgcacaattgtatccttcaggagtgctaacctctgcgcggctgccctagcagcaatcttaacaagactgcgggagaataaaaaggttgaacggctccgcactaccgtgggcatggatggtacactctacaagatccatcctcagtaccccaagcggctgcacaaggtcgtgcgcaaactggtgccttcatgcgatgttaggttcttactatcagagtcaggctcaacaaaaggagcagcaatggtgaccgccgtagcttcacgcgtgcaggctcaacgcaagcaaattgatcgggtgttagccctgttccaacttacacgggaacagctggtggatgtgcaggcaaagatgagggccgagctggaatatggactgaaaaagaaatcccacggactggccactgttcgcatgcttccaacctatgtatgtggattacccgacggcacagagaaagggaagttcttagctttggacctgggtgggaccaatttccgggtgctgctggtcaagatacgctccggtcggagaagcgtaaggatgtataataaaatctttgcaataccactcgagatcatgcagggaaccggcgaggagctgttcgatcacatcgtccaatgtattgcagacttcctggactatatggggctaaaaggcgcttccctgcccctgggattcacattctcattcccatgccgccagatgagtatcgacaagggcacattgataggatggacaaagggcttcaaagccactgattgcgagggagaggatgtggtggatatgctgagggaggctatcaagcgaaggaatgagttcgatctggatattgtggcagtggtgaacgatacagtgggaaccatgatgacctgcggctacgaggatcccaattgtgaaatcggactcatcgcaggtaccgggtctaacatgtgttacatggaagacatgcgaaatattgaaatggttgaaggaggagaggggaagatgtgcatcaacaccgagtgggggggatttggggacaacggctgtatagatgatatctggactcgatatgacaccgaggtggacgaaggaagtctgaatcctgggaagcagcgatatgaaaaaatgacttccgggatgtacctgggagaaatcgttcgacagattttgattgacctgaccaaacagggcctcctctttcggggtcagatatctgagcgattgcggaccagaggtatctttgagacgaaattcctctcgcagatcgagagcgatcgccttgctctgctgcaggtccgacggatccttcagcaactggggctcgactctacctgcgaggactcgatagtcgtgaaggaggtttgcggagcggtgtcccgaagagctgcccagctctgcggtgctggactcgcggcaatagtcgagaaacggcgagaagaccagggcctagaacaccttcgtattacagtcggggtggatgggaccctctataagctgcacccacactttagccgaattctccaagaaactgtgaaagagctcgcaccccgatgcgatgtgacttttatgctgagcgaggacggcagcggaaagggggctgccttgatcactgcggtggctaagcgattgcagcaagctcagaaggagaactag

SEQ ID NO: 50722 - DNA, 2421 bp, Artificial Sequence
  Description of Artificial Sequence: Synthetic coding sequence
atgttcgcagttcaccttatggctttttactttagtaaactgaaggaagaccaaatcaagaaggtggatcggttcctatatcacatgcgtttgagcgatgacacactactagatattatgagaagatttcgggcagagatggaaaaggggctggctaaagataccaaccctacagctgctgttaagatgctgccgaccttcgtacgggcaatacctgacggatccgagaatggcgaattcctgagtctagacctgggagggtctaagtttagggtgcttaaagtgcaggttgcagaagaaggcaagaggcatgtccagatggagtcacagttctaccccacaccaaacgagatcattcgcggtaatgggacagagctatttgaatacgtcgccgattgtctcgctgacttcatgaagactaaagatctgaagcacaaaaaactaccactcggtttaacgttcagtttcccctgtaggcagacgaagctggaagaaggagtgttgctgtcatggaccaaaaagtttaaagccaggggcgtacaagacacagatgtcgtcagccggttaactaaggcgatgcggagacataaagatatggacgtggacatcctcgcactcgtgaatgatacagtgggtacgatgatgacatgcgcctacgacgacccctattgtgaagtgggggtgattatcggaaccggcaccaatgcttgttatatggaagacatgtccaacattgacctggtggaaggcgatgagggacgtatgtgcatcaatacggagtggggtgctttcggcgacgatggagcgctcgaggatatccgcactgagtttgaccgcgaattggatcttgggtctctcaaccccggaaagcagcttttcgagaaaatgattagtggattatatctgggcgaactggtacggcttattctgttaaaaatggctaaagcagggctgctgttcggcggtgagaaaagcagcgccttgcacacaaaagggaagatagagaccaggcatgtagcagccatggagaaatataaagaggggttggccaacacccgggaaatactggtggatctgggcctggaacctagcgaggcagactgcatcgcagtccagcacgtttgtacaatcgtatctttccggagcgcaaatctttgcgctgccgctctggcagccatcctcacccgacttagagagaataagaaagtcgaaagacttcggaccacagtgggaatggacggcaccctttacaagattcatccacagtatcctaagaggcttcataaggtcgtgagaaaactggtgcctagctgtgacgtccgattcctcctctctgagtccgggagcactaagggagctgcaatggtcactgccgtggcatcccgagtgcaagcccagcgaaagcagatcgaccgagttctggcgctgtttcagctcacgcgggagcagctcgtggacgtccaggccaagatgagggccgaattagagtacggtttgaagaagaaaagtcatggcctcgctaccgtgaggatgctcccaacctatgtttgcgggctcccagacgggacggagaaggggaaattcctcgcgctggatttaggagggactaattttcgcgtgttattggttaagattcggtctggaaggcgctctgtgaggatgtataacaaaatattcgccatacccctagaaataatgcagggcaccggagaggagctcttcgatcacatcgtgcaatgtatagcagacttcctagactatatgggactcaagggagcatccctccctctgggattcaccttttcgtttccttgccgccaaatgagcatcgacaagggcacgctgatcgggtggaccaaggggttcaaagctacggactgtgagggggaggatgtggtggatatgcttcgtgaagcgatcaagcggagaaacgaatttgacctcgatattgtcgcagtagtcaacgacacagtgggaacaatgatgacgtgtggatacgaggatcctaactgcgaaattgggctcattgccggtaccggcagtaacatgtgttatatggaagacatgcggaacatcgaaatggtcgaagggggagaggggaagatgtgtatcaataccgagtggggtggcttcggtgacaacgggtgtattgacgacatttggaccagatatgatacggaagttgatgaaggaagcctgaatcccggtaagcagcggtatgagaagatgacgtctgggatgtatctgggagagattgtcagacaaattcttatcgatctgacgaaacagggtctgctgttccggggacagatttccgagcgcctgcggacacggggaatcttcgagaccaagtttctgtcgcagatagaacgcatgctttctgtcatcgacgcctactgtttggacttgctcttccactag

SEQ ID NO: 50723 - DNA, 2211 bp, Artificial Sequence
  Description of Artificial Sequence: Synthetic coding sequence
atgttcgccgtacatctgatggcattctacttctccaagctcaaggaagatcagattaagaaagttgatcgcttcctataccacatgcgcctctccgacgatacactgctcgacattatgaggaggttccgggctgagatggagaaaggcctcgctaaagacactaacccaacagccgctgtgaaaatgctcccaaccttcgtccgggctattcccgacggctccgaaaacggcgaattcctctcccttgacctcggtggttcaaagtttagggtcctcaaagttcaggtggcggaggaaggcaagcgtcatgtgcagatggagtcccagttctatcccacgcctaacgagatcattaggggtaatggcacagagcttttcgagtatgtcgccgactgcctggccgattttatgaaaactaaagaccttaaacataagaagctgccactcggacttacgttctcgtttccctgtcggcagacaaagcttgaagagggcgtgctgctttcttggaccaaaaaatttaaggcacggggagtccaagataccgacgtcgtgtccaggctcactaaggctatgcggaggcataaggacatggatgtggatatactggccctcgtcaacgacactgtgggaaccatgatgacctgtgcctatgacgacccctactgtgaggtgggggttataatcgggacaggcactaacgcttgctacatggaagacatgagtaacattgatctggtggagggggatgaaggcaggatgtgtattaacaccgagtggggagctttcggtgacgacggggcacttgaggacatcaggaccgagtttgatcgagaacttgacctgggatctctgaaccccggaaaacagctatttgagaagatgattagcggtctgtaccttggcgagctggtgaggctgatactgctgaaaatggctaaggccggtcttctcttcggtggcgagaagagttccgctctgcacacgaaaggcaagatcgagacccgtcacgtcgcagccatggaaaagtacaaggagggcctcgccaatacaagagagatactggttgacctaggactggaacccagtgaagctgattgcatcgcagtgcagcacgtgtgtacaatcgtcagttttcggtccgccaatctatgcgcagccgctctggcagcaattctcacacgccttcgggagaataagaaagttgagcgccttcgtacaacagtgggtatggatggtaccctctataagattcatccgcagtacccgaagcgcttgcacaaggtagtgcgcaagttagtgccttcatgcgacgttagattcctgcttagcgagagcggtagcactaaaggagccgctatggtgacagcagtcgcatctcgcgttcaggcccaaagaaagcagatcgatcgcgtcctggccttattccagctgacacgtgagcagctggtcgatgtgcaagctaagatgcgggctgaactggagtacggcttgaagaagaagagccacggactcgctaccgtccggatgctgcctacatatgtctgcggcctgccagacggaacagaaaaaggaaagtttctcgccctggacctcggtggcacaaacttccgcgtgcttttagttaagattcgcagcggcagacggagcgtgaggatgtacaacaagatcttcgcaattcctttagagattatgcagggtacaggagaggagctttttgatcacatcgtgcagtgcatcgcagacttcctggactacatgggtctcaaaggtgcctcacttccgctcggttttacattcagctttccgtgcaggcagatgtccatcgataaagggacgttaatagggtggacaaagggtttcaaagccaccgactgcgaaggtgaggatgtggtggacatgttgcgtgaggctattaagcgcaggaatgagttcgacctcgacatcgtggccgtggtgaacgacaccgtggggacaatgatgacatgcgggtacgaggaccccaattgtgagataggactgatagccggtacagggtctaacatgtgctatatggaggacatgcgaaatattgaaatggtggaaggcggagaaggaaagatgtgcatatgcttctcattttgcctgtggttcgtcttgcaggtcctgattgttgtgttacggatcgttaggtacagaaaaagtagtaagctcattaaaaagttttag

SEQ ID NO: 50724 - DNA, 282 bp, Artificial Sequence
  Description of Artificial Sequence: Synthetic coding sequence
atgtctactgacaccggtgtcagcctgccctcctacgaagaagatcagggctccaaacttatacgcaaagctaaggaggcaccatttgtgcccgttggcattgctggcttcgccgcaattgtcgcctatgggctgtataaactgaagagtagaggtaatactaaaatgagtatccacctgattcacatgcgagtggctgcccaaggattcgtcgtcggcgcaatgactgttgggatggggtacagcatgtacagggagttttgggcgaaacccaagccttag

SEQ ID NO: 50725 - DNA, 282 bp, Artificial Sequence
  Description of Artificial Sequence: Synthetic coding sequence
atgagtacagatacgggggtgagtctgccctcctatgaggaagaccagggatctaaactcatcagaaaggcaaaggaagccccattcgtgcccgttggcatagccggtttcgctgccattgtggcctacggactgtacaagctgaagtcacgtggaaatactaagatgtccattcacctcatacatatgcgggtggctgcacaggggttcgttgtcggggcaatgactgtgggcatgggctatagcatgtatcgggaattttgggcaaagcccaagccttag

SEQ ID NO: 50726 - DNA, 324 bp, Artificial Sequence
  Description of Artificial Sequence: Synthetic coding sequence
atggaacagaagctggtggaagaaattttacaggcgattacaatgtctaccgacaccggagtgagtctgccatcctacgaagaggatcaaggatctaaattgatcagaaaggcgaaggaagccccttttgtccccgtgggcatcgccggatttgctgccatcgttgcatatggtttatataagctcaaatctcggggaaacaccaagatgtccatacatcttattcacatgcgcgtcgctgcccagggattcgttgtcggggcaatgacagtaggcatggggtattctatgtaccgagaattttgggcgaagcccaaaccatag

SEQ ID NO: 50727 - DNA, 300 bp, Artificial Sequence
  Description of Artificial Sequence: Synthetic coding sequence
atgtccgccaaccgcagatggtgggtgcccccagatgatgaggactgcgtgtctgaaaaactcctgcgtaagactcgcgagtccccactggtgcccatagggctggggggatgcctcgtggtggctgcctatcggatatatcgcctccgttcccgcggaagcactaagatgagcatccaccttattcatacaagagtggctgcgcaggcatgcgccgtcggagccatcatgctcggggcagtctatacaatgtatagcgactatgttaaacgaatggcacaggacgctggtgagaaatag

SEQ ID NO: 50728 - DNA, 321 bp, Artificial Sequence
  Description of Artificial Sequence: Synthetic coding sequence
atggctactccaggccctgtgatccccgaggtaccatttgagccgagtaaaccgcctgtcattgaaggcctgtcacctaccgtttatcgcaatccagaatcttttaaagaaaaattcgtcagaaaaacgagggagaatcccgtcgtgcctatcggctgtttggccacagctgccgcactgacctacggactctacagcttccaccggggtaacagccagcgctctcagctaatgatgaggacacgaatcgctgcccaaggattcactgtggcggcaatcctgcttggacttgctgtgactgccatgaagagtcgcccttag

SEQ ID NO: 50729 - DNA, 321 bp, Artificial Sequence
  Description of Artificial Sequence: Synthetic coding sequence
atggctacgcttggctttgtgactccagaggccccattcgagtcctctaagccccctatttttgaaggtttatcccctacagtgtactcgaatccagaaggtttcaaggagaagtttctccggaaaacacgggagaatccagtggtcccaatagggttcctgtgtacagcagccgtgctaactaacggtttgtactgctttcaccagggaaactcgcagtgttcccggctcatgatgcacacccagatcgccgcacagggcttcacgatagcggcaatcctgttaggcctggccgcaaccgcaatgaagagcccaccctag

SEQ ID NO: 50730 - DNA, 1473 bp, Artificial Sequence
  Description of Artificial Sequence: Synthetic coding sequence
atgacacagggcaagaagaaaaaacgtgctgctaaccggagcatcatgctagccaagaaaataatcattaaggacggagggacaccacaggggattgggagtccatccgtttaccacgcagtgattgtcatcttccttgagttcttcgcttggggcctgctgaccgcccctacactagtggtgctgcatgaaacattccccaaacacaccttcttgatgaacgggcttatacagggcgtcaagggcttgctgtctttcctgagtgcacccctgattggcgctcttagtgacgtgtggggcaggaagtccttccttttgctcactgtattttttacttgtgcacctatccctctcatgaaaatctctccttggtggtactttgccgtgatttccgtctcgggcgtcttcgcggttaccttctcagtggtgtttgcatatgtggccgacatcacccaagaacacgagcgctcaatggcttatggcctagtgagcgctaccttcgcagcaagccttgttacctctcctgcaattggggcttatctcggccgtgtgtatggagactcacttgtcgtagtcttagcaacagccatagccctgctcgatatttgctttatcctcgtggctgtgccagaaagtctacccgagaagatgcgacctgcatcatggggggctcccatctcatgggagcaggccgatcctttcgcaagcctgaagaaagtaggccaggactccatcgttctgttgatttgtatcaccgtgttcttgagctatctgccagaggcaggccagtactcgagcttctttctgtacttgagacagatcatgaagttctccccagaatcagtggcagccttcatcgccgtcctcggtatattgagcattattgcccaaaccattgttcttagtctgctgatgagatcaatcggcaacaaaaacacgattcttctgggcctgggcttccagattcttcagctcgcctggtatgggtttggcagtgaaccgtggatgatgtgggctgccggagctgtggcagccatgtcctctattaccttccctgcagtgtctgcccttgttagtcggactgctgacgcagatcagcagggtgtggtgcagggaatgattacagggattaggggactgtgtaatggcctgggacctgcactgtatggattcatattttacatcttccatgtggagctgaaagagctgcctattacagggaccgatcttggcactaatactagtccacagcatcactttgagcagaattcaataatacccggaccaccttttttattcggggcttgctcggtcctgctcgcattactcgttgcactttttattccagaacataccaacctgtccctgagatccagcagctggcggaaacactgtggcagccactcacacccacacaacacacaggctcctggagaagcaaaggaaccactccttcaggatactaatgtctag

SEQ ID NO: 50731 - DNA, 363 bp, Artificial Sequence
  Description of Artificial Sequence: Synthetic coding sequence
taacacgaaacctttcccaaacacaccttcctgatgaatggtttaattcagggagtcaaagggcttctgagcttcctatccgcaccacttattggggcactttcggacgtctggggcagaaagagttttctgctgctgaccgttttttttacgtgtgcaccgattccattgatgaagattagtccgtggtggtatttcgcagttatcagtgtgtcaggcgtgtttgctgtgacgttcagcgtggtgttcgcttacgtggcagacataacccaggaacatgagcggtctatggcttacgggctcgtatgcatgttcatcctgtacttgctgtatttacttaggaacgccctgtttttacggtag

SEQ ID NO: 50732 - DNA, 462 bp, Artificial Sequence
  Description of Artificial Sequence: Synthetic coding sequence
atggtaggaatcctttcaatcgtggcacagacagcttttttatccatcctgatgaggagtctcgggaacaagaacacagtgcttctcggcttgggattccaaatgcttcagttagcctggtacggatttggatctcaagcatggatgatgtgggccgctgggacagttgctgccatgtcatcaatcacattcccggcaatttcagcgcttgtgtcccgcaacgcggagtctgatcaacagggggtggcccaggaccacaattggaacaagcgtactatgcaatggccaggggcattatacggcttcattttttacatgtttcatgtagagctcacagagctcggtcctaagctgaattctaataatgtccctctgcagggctcatgtcatccgcgacctgcagtcttcatctggggaatgtactcaccctacgttttctctggctgtcttatccactcgtag

SEQ ID NO: 50733 - DNA, 1521 bp, Artificial Sequence
  Description of Artificial Sequence: Synthetic coding sequence
atgtctgtggagccaccccctgagttggaggaaaaggccgcatctgaaccagaagccggagccatgcctgagaagcgtgccggagcccaagctgcgggaagtacctggctacaagggtttggcaggccaagcgtttaccatgctgccatcgttatcttcctggaattcttcgcctggggtctccttacaacaccaatgctgactgtgctgcatgagacattttctcaacacactttcctgatgaatggactgatccagggtgttaaggggttactcagttttttgtctgccccactgatcggtgccctgtccgatgtgtggggccgaaagcctttcctcctgggtactgtgtttttcacatgcttcccaattcctcttatgagaataagcccctggtggtactttgcgatgattagcgtaagcggagtgttttcagtgacttttagtgttatatttgcctatgtggccgatgtgactcaggagcacgagaggtctacagcctacgggtgggtatctgcaacgtttgcagcctccttagttagctcccccgctattggggcatatctgtcagcgtcgtatggggattctttggtggtcttagtggcgactgtcgtggctctgctggatatctgtttcatcctggttgctgtgcccgagtcgctccccgagaagatgcggcctgtaagttggggagcccagatttcttggaagcaggcggatccttttgcctccttgaaaaaggtcggtaaggacagtaccgtgctgctaatatgcatcactgtgttcctatcttacctgcccgaagcgggacaatacagttcttttttcctgtacctgcggcaagtgatcggcttcgggtctgtaaagatcgccgcatttattgcaatggtaggtatcctttcaatcgtggctcagaccgcgtttctttcaatcctcatgcggagcctgggcaataaaaatactgtgcttcttggccttggattccagatgcttcagctggcttggtatggcttcggaagccaagcctggatgatgtgggctgctggaactgtggcagccatgagttcaataacatttcctgctataagcgccttagtgagccggaatgccgagtctgatcagcaaggagtcgctcaggggatcatcaccggcatcagggggctctgtaacggactcggccctgcactctatggtttcattttctacatgtttcatgtggaactgacagaactgggccctaaacttaactccaacaacgtgcctctgcagggggctgtgatacctggacccccattcctgttcggcgcttgtattgtgcttatgagttttctcgtggccttgttcatcccagagtactcgaaggcttccggcgtgcagaagcactctaacagctccagcggttccttgacaaacactccggaacgcggatcggacgaggatattgaacctctcctgcaggatagctccatttgggagctctcaagcttcgaagagcctggcaatcagtgcacggagctttag

SEQ ID NO: 50734 - DNA, 936 bp, Artificial Sequence
  Description of Artificial Sequence: Synthetic coding sequence
atgttaacggttctgcacgagacttttagccaacacacattcctcatgaatggactcatacagggggtcaaggggcttttatccttcctgtctgcccctttgatcggcgcactcagcgatgtttggggcagaaaacctttcctgctggggacagtcttcttcacatgcttcccaatacctttaatgagaattagcccttggtggtactttgcaatgatcagtgtatccggagtattcagtgtgactttttccgtcattttcgcctatgtcgccgacgtgacgcaagaacacgaacggagtactgcttatgggtgggtttccgctactttcgcggcttctctggttagttctcccgctatcggagcttacttgtccgctagctatggagattctctggtggtgttggtcgcgaccgtggtcgccttgttggacatttgttttatccttgtggcagtgcctgaatctctgcctgaaaaaatgcggcctgtgagctggggcgcacagatctcttggaagcaggctgatccttttgcaagcctaaagaaggtggggaaagacagcaccgtgctactgatctgtatcaccgtctttttgtcttacctccctgaggccggacagtacagctccttcttcctgtacctccgtcaggtcatcggctttgggagcgttaaaattgctgccttcatcgctatggtcgggatcctctcaattgtggcgcaaacggctttcctttctatactgatgaggtcactgggcaacaagaacaccgtccttctaggactgggctttcagatgctacagctagcatggtatgggtttggtagccaggcctggagttgtcccggagatcacaactggaataaaagaacaatgcaatggcccggagcttctacagtatggctccatatactgcacgtgccctgcggaacagactag

SEQ ID NO: 50735 - DNA, 405 bp, Artificial Sequence
  Description of Artificial Sequence: Synthetic coding sequence
atgagcgtagaaccgccacctgaactagaggagaaggcagcgagcgagccggaggcgggtgcaatgcctgagaagcgcgctggcgcacaggctgcaggttcgacttggttgcaagggtttggccctcccagtgtttaccatgcggctattgtgatcttccttgaattttttgcgtggggtctactcacaactcctatgctgaccgtgttacacgaaactttctcccaacatacgtttctgatgaacggcctgatccagggggtgaaggggctgctctcttttctttcggccccactgatcggcgctctgtcagatgtgtggggaagaaagccttttttgcttgggactgtgtttttcacatgctttcctattccactcatgaggatcagcccatgccaggcctag

SEQ ID NO: 50736 - DNA, 348 bp, Artificial Sequence
  Description of Artificial Sequence: Synthetic coding sequence
atgctcggattgctgggttccactgcactggttgggtggattactggagcagctgtggccgtgctgctactccttttgctgcttgccacgtgtttgttccacggcagacaagactgcgacgtggagcggaatcggacagcagcgggtggaaatcgtgttcggagggctcagccctggccttttaggaggaggggacacctgggaattttccatcatcatcgccaccctggccatgtgtctcacgtgcctaatgtcggcttacaccaccaccaccacccgagacacacaccccatcacctccatcaccatcaccatccccatagacaccaccccagacatgccagatag

SEQ ID NO: 50737 - DNA, 1041 bp, Artificial Sequence
  Description of Artificial Sequence: Synthetic coding sequence
atgtacaatggaagttgctgccgcattgagggggacaccatcagccaggtgatgcccccactgctgattgtcgctttcgtgctcggggctttgggaaacggagtcgctctgtgtggattctgttttcacatgaaaacttggaagccgtcaaccgtatatttattcaatctagccgttgccgattttctcctcatgatatgcctgcctttccggaccgattattatctgcgcagaaggcattgggcctttggggatatcccatgccgcgtgggcctcttcacactcgccatgaatagagccggaagtatcgtattcctcactgttgtcgccgctgaccgttacttcaaggtggtacaccctcatcacgcagtgaacacgatcagcaccagagtcgccgctgggattgtttgtacgctgtgggcccttgtcattctggggaccgtgtacctgctgctggagaatcatttgtgtgtgcaggaaaccgccgtgagctgtgagagtttcataatggagtcagccaatgggtggcatgacattatgtttcagttagagttttttatgccgcttggtattattctgttttgttcttttaagatcgtctggagtctgcgacgaagacagcagcttgccaggcaggcccgaatgaaaaaggcaacacgttttatcatggtcgtggcaattgtctttataacgtgttacctcccatctgtaagtgctcgactatactttctctggacggtaccaagcagcgcctgtgatccttcagtacatggtgccttgcacatcaccctgagcttcacctatatgaactccatgctggaccccttagtctactattttagcagtcctagtttccccaaattctataacaagctcaaaatttgctctttgaagcctaagcagcccggacactcgaagactcaacgccctgaggaaatgcccattagcaacctaggtcgacgaagctgtatctccgtcgctaactctttccaaagccagtctgacggacagtgggatccgcatatcgttgaatggcattag

SEQ ID NO: 50738 - DNA, 1041 bp, Artificial Sequence
  Description of Artificial Sequence: Synthetic coding sequence
atgtacaacggaagctgctgccgaattgagggggatactatttctcaggtcatgcctccactactgatagtggcattcgtgctgggcgcactcggtaacggagtagcgctgtgtggtttctgtttccacatgaagacctggaaacctagcacagtgtatctgtttaacctggccgtagccgacttccttctgatgatctgtcttccgttccggactgattactacctgcgccgtagacattgggcctttggagatataccttgtcgggtcgggttattcaccctggcaatgaatcgcgcagggtcaattgtcttcttaacggttgtggcagcggaccgctactttaaggtggtacacccccatcacgctgttaatactatctcaaccagggttgcggctggaatcgtgtgtaccctctgggcgctggtgatcctaggcaccgtttacttactcctggagaaccacctgtgcgtgcaagaaacagccgtctcttgcgagtcatttattatggagtccgcaaatgggtggcatgacatcatgttccaattggaatttttcatgcctctgggcatcatcctcttctgtagctttaagatcgtgtggagcctgcgtcggaggcagcagctcgcacggcaggcacgcatgaagaaggccaccaggtttatcatggtagttgctattgtgtttattacctgctacctgccatccgtctctgccagattgtacttcctctggactgtgccttccagcgcttgtgatccgtctgttcatggggctctgcatatcaccttgagttttacatacatgaatagtatgctcgaccctctcgtgtactacttttccagccctagcttccccaagttctacaacaagcttaagatttgcagcctaaagcccaaacaaccaggccacagtaagacccaacgccctgaagagatgccaataagcaatctaggacggagaagctgcatatccgtggccaatagtttccaaagtcaaagtgatgggcaatgggatcctcatatcgtcgagtggcactag

SEQ ID NO: 50739 - DNA, 1041 bp, Artificial Sequence
  Description of Artificial Sequence: Synthetic coding sequence
atgtacaacggcagttgctgtagaatcgaaggtgatacgatttcccaggtgatgcccccattgctgatcgtggcctttgtgctcggcgcactcggtaacggggtggccttgtgtggtttctgctttcacatgaagacctggaagccttctacggtctacttgttcaatctggccgtggccgattttctgctgatgatctgccttccctttcgtactgactattacctgcgccgacgccactgggctttcggagatattccctgtagagttggcctttttacgttagcaatgaatcgtgcgggaagtatcgtgttcctgacagtagtggcagctgatcgatactttaaagtggtgcacccgcatcatgccgtgaacaccatctccacgcgggtcgctgccggtatagtctgcactctgtgggccctcgtaattctagggactgtctacctgttactggagaatcacctgtgtgtgcaggaaacagctgtatcctgtgaaagctttattatggagagtgcaaacggatggcacgatattatgttccaacttgaatttttcatgcccctggggatcattcttttctgcagctttaaaatagtgtggtccctgaggcgcaggcagcagcttgcgaggcaggctcggatgaagaaggcgaccagattcattatggtcgtcgccatcgtcttcatcacctgttacctacccagcgtttccgctcggctctacttcctgtggactgtaccttcttcggcatgtgacccaagtgtccacggtgccctgcacataactctcagcttcacttatatgaactccatgctggatcctctagtatactacttttcgtccccatcttttccaaaattctataataagctcaagatttgttcattgaagcctaagcagcccggacatagcaagactcagagacctgaagaaatgcccattagcaatctggggagacggtcctgtatttcagtggccaactccttccagtcccagtccgatggacagtgggacccccatatcgttgagtggcactag

SEQ ID NO: 50740 - DNA, 1092 bp, Artificial Sequence
  Description of Artificial Sequence: Synthetic coding sequence
atgaacagacaccacctgcaagaccactttctggagatcgataagaaaaattgctgtgtatttcgtgacgatttcatcgtcaaagtgctcccccctgttctcggactggaatttatttttggtctgcttgggaatggcctggccctctggattttctgctttcacttaaagagctggaaatcatctagaatatttttattcaaccttgcggtggcagactttttgcttatcatttgcctgcccttcctgatggacaactatgtgcgcaggtgggactggaaattcggcgacatcccctgcaggttaatgctttttatgttagctatgaacaggcagggaagcatcatttttttaacagtggttgcagtagacaggtactttagagtagtacacccccatcacgcattgaataagatctctaacagaacggccgctataatctcctgcctgctgtggggtataaccattggccttacagttcatcttcttaagaagaagatgccaattcagaacggtggtgcaaacctatgctccagcttttctatttgtcatacatttcagtggcatgaagcaatgtttctgcttgagtttttcctacccctggggataatattgttttgcagcgcccgtatcatttggtcattacgccagaggcagatggaccgccatgctaagatcaagagggcaattaccttcattatggtggtagctattgtgttcgtgatatgctttctgcctagcgtggtggtcaggatacggatattctggctgctccacacatccggaactcagaactgtgaggtctacaggtcagtagacctggctttcttcataactctatcctttacgtatatgaactcaatgctggaccccgtggtgtattacttctcttctccctcatttcctaacttttttagtaccctcatcaatcggtgtttacagcgcaagatgacaggtgaacctgacaacaatcgaagcacaagtgtcgaactgacgggagatccaaataaaacccgaggcgctccggaggccttgatggcaaacagtggcgagccatggtccccctcctacctaggccctacctccccgtag

SEQ ID NO: 50741 - DNA, 1164 bp, Artificial Sequence
  Description of Artificial Sequence: Synthetic coding sequence
atgaacaggcaccacttacaggaccacttcttggagatcgataagaaaaattgctgcgtgtttagggatgacttcattgtcaaggtgcttcccccagtactcggcctagagttcatcttcggtctgctagggaatggacttgcactgtggatcttctgttttcacctgaaatcatggaaaagttcacggatctttcttttcaatctggcggtggcagattttctgttgattatttgcctcccctttcttatggacaattacgtcagacggtgggactggaaatttggcgacatcccctgcagactaatgctgttcatgttggcaatgaataggcagggttctataattttcttaaccgtggtggccgtcgacaggtatttcagggtagtacaccctcaccacgctctgaacaagattagcaatagaaccgcagccatcataagttgcttgctgtggggcatcacgattggtttgacggtacatctactgaagaaaaaaatgcccattcagaacggcggtgcaaacctttgcagtagctttagcatctgccacacgttccagtggcacgaggcaatgtttctcctggaattttttttacccctcgggattattctgttctgttcggcacggatcatctggtcactccgccaacgccaaatggaccgacatgcaaagatcaaacgggcaatcaccttcattatggtagtagccatcgtcttcgtgatatgcttcttgcctagtgtagtggtgcgtatccggatcttctggctcttgcacacaagcgggactcagaactgtgaagtgtatcgctcagtggacctggccttcttcataacgctgtcctttacctacatgaactctatgctggaccctgtggtctactatttctcttctcctagcttccctaacttcttctctacccttattaacaggtgtctccagaggaagatgactggcgaacccgataataaccggtctacaagtgtggaactgaccggggaccctaacaagactaggggcgctcccgaggcactcatggccaattcaggcgagccttggagcccgtcttaccttggccctacctcaaataatcacgctaagaagggacattgccaccaggagcctgggtctcttgaaaaacagctgggctgttgcattgagtag

SEQ ID NO: 50742 - DNA, 954 bp, Artificial Sequence
  Description of Artificial Sequence: Synthetic coding sequence
atgtggctgtaccttgccgcttttgtgggactgtactacctcctccactggtaccgcgagcgccaggtggtgtctcatctgcaggataagtatgtctttatcactggttgtgacagcggattcggcaatctgttggctcggcagttagacgctaggggcctgagggttctggcagcttgcttaactgagaaaggagccgagcaactgcgcggacaaacctcagaccggctagaaaccgtgacactcgatgtgacgaagatggagtccatcgctgccgctacacaatgggtaaaagagcacgttggggaccggggtctttggggccttgttaacaacgctggaatactgactcccataacactgtgcgagtggctgaatactgaagactcaatgaacatgctcaaagtaaaccttattggtgtcatccaggtcaccttgtccatgctgcctctggtgcgcagagccagggggaggatcgttaatgttagctccattctggggagagtggccttctttgtcggtggctattgcgtaagtaagtatggggtggaggctttcagcgatatcctgcgtcgagaaattcagcactttggggttaagatttccatagttgagccaggatattttaggaccggcatgaccaatatgacacagtccttggagcgcatgaaacagtcgtggaaggaagcaccaaagcacatcaaagaaacatatggtcagcagtacttcgatgccttatacaatatcatgaaagagggcttgctcaattgtagcactaacctgaaccttgtcaccgattgcatggagcacgccctgacttctgttcatcctagaaccagatatagtgctggctgggatgcaaagtttttttttatcccactgtcctacctcccgacctcgctcgccgattatatactgactcgttcttggcctaaacccgcacaggccgtgtag

SEQ ID NO: 50743 - DNA, 954 bp, Artificial Sequence
  Description of Artificial Sequence: Synthetic coding sequence
atgtggctctatcttgctgctttcgtgggcttatactacttgctgcactggtatagagagcggcaagtggtcagccatttgcaagacaagtacgtgtttattactggctgtgattcaggtttcgggaatttactcgctaggcagctcgacgctaggggcctgcgcgtgctggcggcatgcctgacagagaagggggctgaacagctgcggggtcagacgtctgaccggctcgaaactgtcacactggacgtgactaagatggaaagcattgctgctgcaacacaatgggtcaaggagcacgtaggcgacaggggactgtggggtctcgtcaacaacgcaggcattctcacaccgataacactctgcgagtggctaaacactgaggatagcatgaacatgctcaaggtgaatctaatcggggtgatccaggtgaccttgagcatgctgcctctagtaaggcgcgctagagggagaatcgtcaacgtgagttccattcttggacgcgtagctttctttgtcggcggatattgtgtgtctaagtatggggtcgaggctttctccgacattcttcgaagagaaatccagcactttggcgtgaagatctcaatcgtcgaaccaggctactttaggaccggaatgacgaacatgacccagtcgctcgaacgcatgaagcagtcctggaaggaagctccaaaacacattaaggaaacctacgggcaacagtatttcgacgcactgtacaacataatgaaggagggactgcttaactgtagcactaatctcaatctcgtcaccgactgcatggagcatgcactgacgtccgtgcaccctcgcaccaggtactccgccggttgggatgcaaaattcttttttataccattgagctatctccccactagcttagctgactatatcttaacccggagctggccgaagccagcccaagctgtgtag

SEQ ID NO: 50744 - DNA, 267 bp, Artificial Sequence
  Description of Artificial Sequence: Synthetic coding sequence
atgtggctgtatctcgcggcattcgttggactgtattatctcctacactggtatagagagcgccaggtcgtgagtcatctacaggataagtatgtatttatcactggctgtgattccggcttcggaaatctgttggctaggcagctggacgctagaggccttcgcgtgttagcggcatgtttaacagaaaagggggctgagcagcttcggggtcagacgtcagaccgccttgagacggttacactggacgtcactaaaatggagtag

SEQ ID NO: 50745 - DNA, 954 bp, Artificial Sequence
  Description of Artificial Sequence: Synthetic coding sequence
atgtggctttatctggcagccttcgtgggcctctactatcttctccactggtaccgcgaacgccaggtcgttagccatctgcaggacaaatacgttttcataaccggatgtgattccggctttggcaatctgctggctagacagcttgatgccaggggcctccgggtgttggccgcatgtctcactgagaagggcgctgaacagctgcgtggacaaaccagcgaccggctggaaaccgtcaccctggatgtcacgaaaatggagtcaattgccgctgcaacccagtgggtaaaggaacacgtgggggaccggggactctggggactcgtgaacaatgcgggaatactgacccctatcacactatgcgagtggttaaacaccgaagacagtatgaacatgctcaaagttaatcttatcggcgtgatacaagtgacgcttagcatgctgcctctcgtgaggagggccagaggcaggatagtgaacgtgtcatctatccttggcagggtggcatttttcgtgggtggatactgcgtatcaaaatacggggtagaggcgttcagcgacatactgcgcagagagatccagcattttggcgtgaagataagcattgttgagcctgggtacttccgcaccggcatgacaaatatgacccagtctttagagcgaatgaaacagtcttggaaagaagccccaaagcatatcaaagaaacctacgggcaacagtattttgacgcattatacaacattatgaaggagggcctgctgaattgttccactaatctgaacttagtaaccgactgtatggagcatgcgttgacatccgtgcacccacgcacccgatacagtgccggttgggatgctaagtttttttttatacccctgtcatatctgcctacttctctggccgattacattcttacacgatcatggcccaagcccgcacaggctgtgtag

SEQ ID NO: 50746 - DNA, 954 bp, Artificial Sequence
  Description of Artificial Sequence: Synthetic coding sequence
atgtggctgtacttggcggcatttgttggcctctactacttacttcattggtacagggaacggcaggtggttagtcaccttcaggacaagtacgtgttcatcaccggctgcgactctggctttggaaatcttcttgcgcgacagctggatgccagaggactgagggtactggcagcatgccttacagaaaagggggctgaacaattgaggggtcagactagcgacagactggagaccgtgaccttggacgtaacaaagatggagtcaattgctgccgcaacgcagtgggttaaggaacacgtgggggaccgcggactgtggggcctggtaaacaatgcaggcatccttactccaatcacactttgtgaatggctaaacaccgaagactcaatgaacatgctgaaggtcaacctgattggcgttattcaagtcacactttccatgctgccattagtcagacgcgctcggggtaggattgtgaacgtgtcatccatacttggcagagttgccttcttcgttggagggtattgtgtgagcaaatacggggtggaggccttcagtgacatcctgcgcagagaaatacagcattttggtgtgaagatctccattgttgagccagggtacttccgtacaggcatgaccaacatgacccagagcctcgagcggatgaagcagagttggaaggaggcccctaaacacataaaggagacgtacggccagcaatatttcgacgcgctctacaatatcatgaaagagggcctgttgaattgttcaaccaatctgaacttagtcactgattgcatggagcacgccttgacaagcgtgcatcctcgtacacgctactccgctgggtgggacgccaaattcttcttcatacccctgtcctatctgcctactagccttgctgattacatcctcacacgatcatggccgaagcctgcacaggccgtgtag

SEQ ID NO: 50747 - DNA, 954 bp, Artificial Sequence
  Description of Artificial Sequence: Synthetic coding sequence
atgtggctgtacttagctgccttcgtcggactatattaccttctgcattggtatcgtgaacggcaagttgttagccacctgcaggacaaatacgtgttcatcaccggatgcgactctgggttcgggaatctcctggccagacagctggatgctagaggtctgcgggtgttggccgcatgtctgactgaaaaaggcgcagaacagctgcgcggacagacctctgaccggctcgagactgtgacacttgatgtcacaaagatggaaagcatcgctgcagcaacccagtgggtcaaagagcacgttggagaccggggactatgggggttggtgaataacgctggaattctgactcctattaccttatgtgagtggctcaacactgaagatagcatgaatatgcttaaagtgaacctgattggtgtgattcaagttactttgtcgatgctgcctctggtgaggcgggctcgcggaaggattgtgaatgttagctctatcctgggacgcgtagcattcttcgtgggaggatactgtgtgagcaaatacggcgtagaagcctttagcgacatcctccgtcgagaaatccagcacttcggagttaaaatctctatcgttgagccaggctatttcaggaccgggatgaccaatatgacccagtctctggaacgcatgaagcaatcttggaaggaggcgcctaagcacatcaaggagacatatggtcaacagtatttcgatgcactgtataacatcatgaaggaggggctgcttaactgttctaccaaccttaatctcgtgaccgactgcatggaacacgccctaacttctgtccaccccagaactaggtacagcgccggatgggatgccaaattttttttcatacctctaagctatctgcctacgtcacttgccgactacattcttaccaggtcctggcccaaacccgcacaagcagtgtag

SEQ ID NO: 50748 - DNA, 228 bp, Artificial Sequence
  Description of Artificial Sequence: Synthetic coding sequence
atgtggctttacctcgctgccttcgtgggactctattacctcctgcattggtaccgggaacgccaggtcgtttcccatctgcaagacaaatatgtttttattacgggatgcgactctggatttggtaacctgttggccagacagctggatgcaagaggcctccgagtacttgcagcatgcttgacagaaaagggcgctgagcagttgaggggacaaacatccgattag

SEQ ID NO: 50749 - DNA, 897 bp, Artificial Sequence
  Description of Artificial Sequence: Synthetic coding sequence
atggtgacaccggcactgcagatgaaaaaacctaaacagttttgtcggaggatggggcagaaaaaacagagacccgctcgggctgggcagcctcactccagctctgacgccgctcaggccccagccgaacaaccgcattcgtccagtgatgcggctcaggcgccttgccccagagaaagatgcctaggcccacctacaacccccggtccctatcgttcaatctacttcagttctccaaaaggtcatctgacccgactgggtctggagttttttgatcagcctgctgtgccgttggcaagggcatttctggggcaagtgctcgtgaggagactgcctaacggtaccgaacttcggggtaggattgtggagactgaggcatacctcggcccagaggatgaggccgcacatagcaggggagggaggcagactccaagaaatcggggaatgttcatgaaaccagggacactctatgtatatataatttatgggatgtacttctgtatgaatatctcatcacagggggatggggcatgtgtgctgctgcgagcactcgagcctctcgagggccttgaaaccatgcggcaactgaggagtaccctaaggaaggggaccgcctcgcgggtgttgaaggatcgagagctctgttctgggccatctaaactgtgccaggccctggccatcaataaatcctttgatcagagggatttagcccaggacgaggccgtatggttggaaaggggacctcttgaaccgagcgagcccgcagttgtggcggcagccagggtgggcgttggacacgcaggggagtgggccagaaaaccccttcgtttttacgtgcggggaagcccttgggtgagcgtcgtggaccgagtcgctgagcaggatacacaggcatag

SEQ ID NO: 50750 - DNA, 828 bp, Artificial Sequence
  Description of Artificial Sequence: Synthetic coding sequence
atggcagccgtggatagtttttatctgttatacagagagatcgctcgaagttgcaactgctatatggaagccttagctttggtcggagcctggtacactgcaagaaaatccatcaccgtcatatgcgacttttactccctgattcgactccactttattccacgcctgggcagccgagccgacctgataaaacagtacgggaggtgggccgtcgtgtcaggcgctacggacggcatcggaaaggcatacgctgaagaactagcaagtcgcggacttaatattattttgatctctaggaacgaagaaaagctccagtactttactcagctctcagaggataagttatgggacatcattaatgtgaatatagcggctgctagcttgatggtgcacgtggtactgccgggaatggtggaacggaagaagggtgctatagtcaccatctccagtggttcctgctgcaagcccaccccccaactggcagctttcagcgccagtaaggcttacttggatcatttctcccgggctctgcagtacgagtacgcctcgaagggcatcttcgtgcagtccctcatccctttctacgttgcgacctctatgaccgctccatcaaatttccttcatcggtgctcctggcttgtacccagcccgaaagtgtacgcacaccatgctgtgtccaccttgggcatctcaaagcggacaaccgggtactggtcgcacagcatccagtttctcttcgctcaatacatgcctgaatggctttgggtgtggggggctaatatccttaatcggagcctccgcaaggaggccctttcatgtacggcttag

SEQ ID NO: 50751 - DNA, 2673 bp, Artificial Sequence
  Description of Artificial Sequence: Synthetic coding sequence
atggaaggcggtggaaagcctaacagctcttcaaactctagggacgatggcaacagtgttttccctgccaaagcatcagcgacaggggcaggtccagcagcagctgagaagagactgggaaccccccctggcggagggggtgctggcgctaaggaacacgggaactctgtctgttttaaggtggatgggggtggtgggggtggtgggggaggcggtggaggcgaagaacccgcaggtggttttgaggatgccgagggtcccagaaggcagtacggttttatgcagcggcaattcacttctatgctacagccgggagtcaacaaattctccctccggatgttcggctcgcaaaaagccgttgagaaggaacaagagagagttaagactgcaggcttctggattatccatccttattcagacttcaggttttactgggacctaatcatgttaattatgatggtggggaacctggtgataattccggttggcatcacatttttcaccgagcagacaacaactccatggatcatatttaatgtcgcctcggatacagtgtttctgctggatctgatcatgaattttcgtacaggcaccgtaaatgaggacagctcagagattatcctcgacccaaaggtcatcaagatgaactatttaaagtcatggttcgtagttgatttcatcagcagtatcccagttgactacatcttcctgatagtagagaaggggatggattccgaggtgtacaagactgccagggctctccgtatcgttcgatttacaaagattctgtcacttctccggttgctcagactgtcccgtttaatccggtacattcatcagtgggaggagatctttcacatgacctacgacttagctagtgctgtggtacgaatcttcaacctgattggcatgatgttattgctgtgtcattgggacgggtgcctccagtttctggtgccattactgcaagattttcctcccgattgctgggtgtccttaaacgaaatggtcaatgactcatggggtaagcagtatagctacgcactattcaaggcaatgtctcatatgctctgtataggatatggcgctcaggcacctgtgtcaatgtctgacctctggatcaccatgctgtctatgatagtgggggctacctgctacgccatgtttgtggggcacgcaacagcgctgattcagtcactggattcatccaggaggcaatatcaggaaaaatataagcaggttgagcaatatatgagtttccataagctgcctgcagatatgcggcagaaaatccatgattactacgagcaccgctaccagggtaagatattcgatgaagagaacatcctgaatgaactcaatgaccctctccgggaggaaattgtcaactttaactgcaggaagcttgttgccactatgcctctgtttgctaatgctgatcctaactttgttacagccatgctgagtaaacttcgattcgaggtgtttcagccgggtgattacatcattcgggagggggcagtgggcaagaaaatgtactttattcagcacggcgtcgctggcgtcatcaccaagtccagcaaggagatgaagttgaccgacggctcatattttggagagatttgccttcttacaaaagggagaaggacagccagcgtgagggccgatacatattgtcggctctatagcctttctgtggataacttcaatgaggtcctggaagaatacccaatgatgagacgggcatttgaaacagtggctatcgacagattggacagaataggcaagaaaaacagcatcctactacagaagtttcagaaagaccttaataccggggttttcaacaatcaggagaacgagatacttaaacagattgtgaagcatgatcgagagatggtgcaggcaatcgcacccatcaattatccacaaatgactactcttaacagcaccagcagcaccactactcccacaagccggatgaggacccagtctccaccggtctacacagcaacttccctgagtcatagtaacttgcactccccttccccgtccactcagactcctcagcctagcgctatcttatctccttgctcctacaccaccgccgtgtgttctccaccagtgcaaagcccgctggccgcacgaacctttcactatgcatcacccactgcgagtcagttatcactgatgcagcaacagccgcaacagcaagtgcagcagagtcagccccctcagactcagcctcaacagcccagcccacagcctcaaactcctggcagttccactcctaaaaatgaagtgcacaagtcgactcaagccctccacaacaccaacctgactcgagaagtgcgtccactgagcgcatctcagccttccctccctcacgaggtgtcaacgctcatctctcgcccacacccaactgttggggagtctctcgccagcatccctcagccagttactgctgtccctgggaccgggctccaggctggagggaggagtacagtcccacaacgggtgactttgttccggcagatgtcatctggtgcaatcccccctaaccggggagtgcctcctgcccctcctcctcctgcggcagccctccctagggagagctcgagcgttctgaacacagaccccgacgccgagaaacccagattcgctagcaatctgtag

SEQ ID NO: 50752 - DNA, 1170 bp, Artificial Sequence
  Description of Artificial Sequence: Synthetic coding sequence
atggagccatcagccacccccggtgcacagatgggcgtccctccgggaagccgggagcccagcccagtacccccagactacgaggatgagtttctgcgctacttgtggcgcgactacctttacccaaaacagtatgagtgggttctgatagccgcttatgtggccgttttcgtcgttgctctggtgggcaacacccttgtctgtctggccgtgtggcgaaatcatcatatgcggaccgtgaccaattacttcattgtgaacctgtctctcgctgacgttctcgtgacagcgatctgcctcccggcaagtctcttagtcgacattaccgagtcttggctgtttggacacgccctgtgtaaggtgatcccgtaccttcaagccgtttccgtcagcgtcgcggtcctgacactgtctttcatagctctcgaccgctggtacgcaatttgccatcccctgctctttaaaagcacagccaggagagctcgcggatccattctgggcatttgggccgtgtctcttgccatcatggttcctcaagctgccgtaatggagtgttctagtgttctgcctgagctggccaaccgcacaaggctgttttccgtgtgtgacgagcgttgggccgatgacttgtatcccaaaatctatcacagctgtttcttcatcgtgacctacctcgcgcctcttggtctaatggctatggcttatttccagatattccgtaagctctgggggaggcagatccccggtaccacatcagccctagtacgcaactggaagcgtccatctgaccagctcggggacttagagcaaggcttgtccggggaacctcagcctagagcacgcgcattcctggctgaagtcaaacagatgcgcgctcggaggaagaccgccaagatgcttatggtggtgctcttagtgttcgcactgtgctatctcccaatctctgtgctgaatgtcctgaaacgggttttcggaatgttccgacaagcttccgatagggaagcagtgtatgcctgttttacgttcagccattggctggtctacgctaacagcgctgcaaatcccattatctataactttctttccggctgcaaagaaaaaagtctcgccctgagttgcccttcttgccccggacacgaccctcatctggccgctgccctgtgctcttag

SEQ ID NO: 50753 - DNA, 1278 bp, Artificial Sequence
  Description of Artificial Sequence: Synthetic coding sequence
atggaacccagcgcaacacccggagcccagatgggagtgccccctggcagcagggagccttcccctgtaccacctgactatgaagatgaatttctacggtatctttggagggattacctgtaccctaagcagtatgagtgggtgctgatcgctgcttacgtggcagtttttgtagtggccttggtgggcaataccctggtgtgtttggcagtttggaggaaccaccatatgcgtactgtaaccaattacttcatcgttaatctcagcttggccgatgtgttggtaactgccatatgtctgcctgcatcgttgctggtggatattactgagagctggctattcggccacgctctctgcaaggtcatcccctatctacaggccgtcagtgtatcagtggcagtgctgaccttatctttcatagcccttgatcgctggtacgctatttgtcatcccttgctgtttaaatcgacagctcgcagggcgagaggatccatccttggtatctgggcagtttctctggctattatggtgccccaggccgctgtgatggagtgttctagcgtcctgccagaactggcgaaccggacacgcctgttcagcgtgtgcgacgagagatgggcggatgatttatacccgaaaatttatcactcatgctttttcattgtgacgtatctggcccctctaggattgatggccatggcctacttccagatttttcggaagctctggggtcggcaaatcccaggtacgacgtccgcccttgtcagaaattggaaacgaccatcagaccaactaggtgatctggaacagggactttccggcgaaccacagcctagggcccgagcattcctggccgaggtgaagcagatgagggcccgacgtaagactgctaagatgctgatggtggtgctgctggtcttcgccctctgttatctccccatcagcgtgctgaacgtgttaaaacgcgtgttcggtatgtttcgccaagctagtgaccgggaggctgtctatgcctgctttactttttctcattggctcgtttacgcaaatagcgcggctaaccctatcatctataactttctgtcgggcaagtttagggagcagtttaaagccgcttttagctgctgtttgcctgggttaggaccttgtggaagcctaaaggccccaagcccacgctctagcgcatcccataaaagcctgtccctgcagtctagatgctctatcagcaaaatctccgagcatgtagttctgactagtgtgactaccgttctcccctag

SEQ ID NO: 50754 - DNA, 1278 bp, Artificial Sequence
  Description of Artificial Sequence: Synthetic coding sequence
atggaaccttccgccacgcccggagcacagatgggcgtgcccccaggcagccgcgagccatcccctgtacctccagactacgaagacgaattccttcgttatctgtggagagattacctgtaccccaagcagtatgaatgggtactgattgccgcttatgtagctgtgtttgtcgtcgccctggtgggcaacacactggtttgcctagcagtgtggcggaatcaccatatgagaaccgtgaccaactattttatagtcaacctgagcctcgctgacgtgctagttaccgccatttgcttaccagccagcctgctggtggatattactgaaagctggctgtttggccacgccttgtgtaaagtaatcccttacctccaggcagtttcagtgtccgtcgccgttcttacgctgtcctttatagcccttgaccgctggtacgcaatctgtcatccactccttttcaagtccaccgctcggagagcccgtggctctatactcggaatctgggccgtgagtctggctatcatggtgccacaggcagcagtcatggaatgcagcagtgtgctgccagagcttgccaatcgcacgaggctattctctgtctgtgatgaaagatgggccgatgatctgtacccaaagatctaccacagctgtttcttcatcgtgacctacctggccccactcggcttgatggccatggcctactttcagatctttcgtaagctgtggggtagacagattcctggaactacgagcgccctcgtacgtaattggaagagaccctccgatcagctgggcgacctggaacagggcctgagcggggagccccaaccacgggctagggcctttctggcagaggtgaagcagatgcgcgcaaggaggaaaacagctaagatgctaatggttgttctgctagtgttcgccctgtgttatctgccaatttcagttctcaacgtcttgaaacgagtttttggcatgttccgccaagcttcagacagggaagcagtctatgcatgcttcacattctcacactggctggtctacgctaactctgcagccaatcccattatttataattttctgtccgggaagttcagagagcagtttaaggccgcattttcatgctgtctgcctggactgggcccatgcgggagtctcaaagcccctagccccaggtcgtccgcgtcacacaagtctttgagcctgcagtccagatgttccatctctaaaatctccgagcatgtcgttctcaccagtgtgaccaccgttctgccctag

SEQ ID NO: 50755 - DNA, 1335 bp, Artificial Sequence
  Description of Artificial Sequence: Synthetic coding sequence
atgtcagggactaagctcgaggattcgcccccatgcagaaattggtctagcgccagcgaactaaacgagacacaggaaccattcctcaaccctactgattatgatgacgaagagtttctgcggtacctgtggcgcgagtaccttcatcccaaagaatatgagtgggttttaatcgcaggctacataatcgtgttcgtggtggctttgataggtaacgtgctggtgtgtgtggccgtgtggaagaaccatcacatgcgcactgttactaactattttatcgtaaacttgagtctggccgacgttttggttactatcacatgcctgcctgccactttagtggtcgacattacagaaacctggttttttgggcagtctctctgcaaggttataccctatctgcagacggtatctgttagtgtatcagttctaaccttgtcctgcatagccctcgataggtggtacgccatttgccaccccttgatgtttaagtcaactgccaagagagcccgtaacagcattgtgattatctggatcgtgtcttgtatcataatgattccccaggctatcgtcatggagtgtagtacagtattccccggattggcgaataaaacaaccctgtttacagtgtgcgatgaaaggtgggggggagagatttatccgaaaatgtaccatatttgttttttcctagtgacatacatggcacccctgtgtctgatggtgctggcatacctgcagattttcagaaagttgtggtgcaggcaaattcctggcacaagctccgtagtacagcgcaagtggaagcccctgcagcctgtctcacagcctcggggaccgggacagccgactaagtcccgaatgtccgctgtggccgctgagatcaagcagatcagggcgagaagaaagacggctcgtatgctgatgattgtgctgctggtctttgctatatgctatctgccaattagcatcttaaacgtgcttaaaagggttttcggtatgttcgcacacaccgaagaccgcgagactgtttacgcctggttcaccttttcccattggctcgtgtacgcaaatagcgccgcaaacccaattatttacaactttctgtccggcaagttccgtgaggaattcaaagcagccttttcctgttgctgcctgggagtgcatcacaggcaagaagacaggctcacccgtggacggactagtaccgaatccagaaagtccctgaccacgcagatcagtaacttcgacaatatatctaagctctccgagcaggtggtactaacgagcatctccactttaccagcggctaatggcgctgggccactccagaactggtag

SEQ ID NO: 50756 - DNA, 1134 bp, Artificial Sequence
  Description of Artificial Sequence: Synthetic coding sequence
atgtcagaggtcaagtcaaggaagaaatccggacccaaaggcgcacccgctgcagaaccaggtaagagatctgagggcggaaaaacgcctgtggctcgatcttctggcggtgggggttgggccgacccgagaacttgtctttctctgctctctctcggcacttgtttggggctcgcctggtttgtctttcagcaaagtgaaaagttcgctaaggtcgagaaccagtatcagcttctcaagttggagacaaatgagtttcaacagcttcagtcaaagatctctctcatcagtgagaaactggaatctactgagtctatcctgcaggaagccactagcagtatgtccctgatgacacagttcgaacaagaggtctctaatctgcaagacattatgcacgatatccagaacaatgaggaagtgctgacccagcgcatgcagagcctcaatgagaagtttcagaacatcactgatttttggaaacggtctcttgaagagatgaacatcaacaccgacatcttcaagtctgaagccaagcacatccactctcaggtgaccgttcagattaatagtgctgagcaggaaatcaagttgctcactgaaagactgaaagatttggaagactccaccctgcgcaatatacgaaccgtgaaacgtcaggaagaagaggatcttcttagagtggaggagcagctgggcagcgataccaaagccattgagaaacttgaggaggaacagcacgccctgttcgcccgagatgaggacctcacaaacaaactgtctgattatgaaccgaaagtggaagaatgcaagactcacctgccaaccattgaaagtgctatccattcggtgctcagagtttctcaggatcttatagagaccgaaaaaaagatggaagatctgacaatgcagatgtttaacatggaggacgacatgcttaaggccgtatccgagattatggagatgcagaagacgctggagggcattcaatatgacaactcgattttaaaaatgcagaatgagcttgacatcctcaaagaaaaagtccacgatttcattgcatactcgtcaaccggggagaaggggacactcaaggagtataatattgagaacaaggggatcgggggagatttttag

SEQ ID NO: 50757 - DNA, 1053 bp, Artificial Sequence
  Description of Artificial Sequence: Synthetic coding sequence
atgtcggaggtcaaatcacgaaaaaaatccggccctaagggcgcacccgcagcagagccaggcaaacgcagcgagggcggaaagactcctgtcgccaggtccagtggaggcggaggctgggcagaccccagaacatgcttgtccctgctgtctctcgggacatgcctgggcctggcttggttcgtctttcagcagtctgagaagtttgctaaagtggagaaccagtaccaactgctcaagctggagaccaacgagtttcagcagctgcagagtaagatttctctcatctcagaaaagtggcagaagtccgaggcaattatggaacaactgaagtcattccaaatcatcgcccacctgaaaagactgcaggaggagataaacgaggtgaaaacctggtctaacagaataaccgaaaaacaggacatcctgaataattcattgaccactttgtcccaagatatcactaaagtcgatcagtctaccacatctatggcaaaggatgtgggcttgaagatcacctctgtgaagacggatattcgtagaatttccggactcgtcaccgatgtaattagcctgacagattcagtccaagagttggagaataagatcgagaaggtcgagaaaaatacagtgaagaacataggggacttgctgtcttcgtctatcgatagaactgctaccctcaggaaaactgcctccgagaactcgcagcgtatcaactccgtgaagaagaccctaaccgaactaaaaagcgattttgacaaacatacggacaggttcttatctctcgaaggggatagggctaaagtcttaaagaccgttacattcgccaacgacctcaagcctaaagtctataatctaaaaaaggactttagcagactagagcctctggtgaatgacctgaccctccgaatcggccgacttgtaaccgacctgctacagcgcgagaaagaaatcgcattcctgtctgagaagattagcaacctgacaatcgtccaggctgagatcaaggatatcaaggatgagatcgcccacatcagcgatatgaactag

SEQ ID NO: 50758 - DNA, 213 bp, Artificial Sequence
  Description of Artificial Sequence: Synthetic coding sequence
atgagcgaagtgaagtccaggaaaaaaagcgggccaaaaggcgctcctgctgctgaaccagggaagaggtccgagggcggtaagacgcccgtcgcaagatcgagtggcggtggtggatgggccgatccgcgtacatgcctctcattactatcattgggcacctgcttggggttagcgtgtggccgaaacctgaaactgtcctggaacaattag

SEQ ID NO: 50759 - DNA, 735 bp, Artificial Sequence
  Description of Artificial Sequence: Synthetic coding sequence
atggagcagctcaaaagttttcagattattgctcacctgaaacgcctccaggaggaaataaatgaagtcaagacttggtccaaccggattaccgagaagcaggacattctcaacaattcactgaccacactctctcaagatatcactaaggtggatcagtccaccacctccatggccaaggatgttggcctcaagatcacttcggttaagactgatatacgaaggatctcaggcctggtgaccgacgtgatttccttaaccgattctgttcaggaactggaaaacaagattgaaaaagtcgaaaagaacacggtgaaaaatatcggagacctgctgagcagctcgatcgaccgcaccgcaacacttcggaagactgcctcggaaaatagtcagcgcattaattcggtcaagaaaacgctaactgagctaaaatctgactttgataagcacacagatcgatttctgtcattggagggtgatagggccaaagtgctaaaaactgttacattcgctaacgatttgaagccaaaagtctataaccttaaaaaggacttttctcggctagagccacttgtaaacgatttgacgctgaggattggaaggctggtaacagacttgttgcaaagggagaaggagatcgcctttctgagtgaaaagatctctaatcttaccatcgttcaggcggaaattaaggatatcaaggatgaaatcgcccacatttctgacatgaattag

SEQ ID NO: 50760 - DNA, 2445 bp, Artificial Sequence
  Description of Artificial Sequence: Synthetic coding sequence
atggctgtgcaacgcgcagccagtccaaggcgcccacctgcacccctgtggcctcgccttttgcttcccctgcttttactcctgttgccggctccttcagagggactggggcacagtgccgaacttgcttttgcagtggaacctagtgatgacgtggctgttccagggcaacctatagtcttagattgtagagtggaggggacacctcccgtaagaataacctggaggaagaacggagtggaactcccagagtcaacacattctaccctactggccaatggttcccttatgattagacatttcaggcttgagccaggtgggagcccctctgatgagggggattatgaatgcgtggctcagaacagattcggccttgttgtctcacgcaaagcgaggattcaggctgccacaatgagcgactttcacgtgcatccacaggctaccgttggcgaggaaggaggggtagctaggttccaatgccaaatacacggattgcctaaacccttgatcacctgggaaaaaaaccgcgtccctattgacactgataacgaaaggtatactctgttgcccaagggggtcctccaaataaccggtctccgagcggaggatggcggtattttccactgcgtcgcatcaaatattgccagtatcagaatctctcacggcgcacggctgacagtatcagggtccggcagcggcgcatataaagaacccgctatacttgttggcccagaaaatctcacactgaccgtccaccagactgcagtactggagtgtgtggccaccggaaatccccgacccatcgtaagctggtccaggctggacggacgccctattggagttgaagggattcaggtcttggggaccggcaatctgataattagcgacgtcacagtccaacactctggcgtgtatgtatgcgccgcaaatagacccggaaccagagtacggaggacagcacagggaaggcttgttgtccaggcccctgcagagttcgtccaacacccccagtcgatcagtcgccctgcagggaccacggcaatgtttacatgtcaggcccagggggagccccctccacatgtcacttggctgaaaaatggccaggttcttggtcccggtggccacgtcagacttaaaaacaataatagtacactgactatctccggcataggacccgaggacgaggctatctaccagtgcgttgccgagaacagcgctggtagctcccaggcctccgcacggctgaccgtgctctgggcagaggggctccctggtcctcccaggaatgttcgggcagtctctgtctcctcaactgaagtccgtgtgagttggtcagagccattggccaataccaaagaaatcatcggctatgtgctgcatattcgtaaagccgctgaccccccagaactcgagtaccaggaggccgtgtcaaaaagtacttttcagcatttagtgagcgacttggaaccctctactgcatattccttttacatcaaggcatatactccccgaggggctagctccgctagcgtccccactttagcctctaccctgggcgaagccccagcccctcctcccctctccgtacgcgtcctgggaagctccagtctgcagctactctgggaaccgtggcctcggctggcacagcacgagggtggttttaagttgttctatcgccctgcctctaaaacctcgttcacagggccaattctgctccctggaacagtaagttcgtacaaccttagccagttggaccctaccgccgtgtatgaagtgaaactgttggcatataaccaacacggcgatggcaatgcaactgtgaggtttgtctcactgaggggagcatctgaacgtaccgcactttcaccgccatgtgactgcaggaaagaagaggccgcaaaccagaccagcaccacaggaattgtgatcggcattcacattggcgtcacttgcattatcttctgtgtgctgttcctactattcgggcagcgcggaagggtgttgctgtgcaaagatgtcgaaaaccagctgtcccctccacagggccctaggtcgcagcgggatcccggaattctggcactaaatggcgcaaggaggggccagcgcggacagttagggagagatgagaagcgtgtcgacatgaaggaactcgagcagcttttcccgcctgccagcgctgctggccaacccgatccgaggcctacccaagatcccgcagccccagctccttgcgaggagactcagctgtctgtgttgcccctgcaagggtgcgggctgatggagggcaagactaccgaagccaaaacaactgaggcaacagccccttgtgctggcctagccgcagctccacctcccccagacgggggacctggcctactatcagaaggacaggcaagcagaccggcagccgctcgggtcacgcaacctgcacactcagagcaatag

SEQ ID NO: 50761 - DNA, 1914 bp, Artificial Sequence
  Description of Artificial Sequence: Synthetic coding sequence
atgtcagacttccacgtgcaccctcaggccaccgtgggggaagaagggggagtcgcccgatttcaatgccagattcatggtctgcccaagcctctaataacatgggaaaaaaacagggtcccaatagacacggataatgagcggtatactcttcttcccaagggcgtactgcagattaccgggttgcgagccgaagatggcggtatcttccattgcgttgccagcaatatcgcctcaatccgaatttctcacggcgctaggctgaccgtgagcggctcaggttccggtgcctacaaagagcctgcaatcctcgttgggccagagaacctgaccctgaccgtgcatcagaccgcggtgcttgagtgtgttgctaccggaaaccccagacccattgtcagctggtctcggctagacggacgacccatcggagtggaggggatccaagtgttgggcactggtaacctgatcataagcgatgtgacagttcagcattccggcgtctatgtatgtgctgctaacaggcctggtactcgggtccgtcgtactgcccagggtaggctggtggtccaagctcctgctgagtttgtccagcatccccagagtattagccgaccagccggaactactgctatgttcacttgccaagcacagggtgagcctccccctcatgttacctggctgaaaaacgggcaagtcctggggcctggagggcatgtgagactcaaaaacaacaattcaacactcacaatctcagggattgggcctgaagacgaggcgatctaccagtgcgtcgccgagaacagtgccggatcctctcaggctagtgcccgtctaacggtgctatgggccgaggggctcccaggaccccctcgcaacgtcagggccgtttctgtgagttccacagaagtgagggtctcctggtctgagcctctggccaacactaaggagatcatcggctacgttctgcatattagaaaggcagccgatccccctgagctcgaatatcaagaggcagtatccaaatccacttttcaacacctcgtgtcagaccttgaacctagcactgcttacagcttctacatcaaagcctacacacctcgaggtgccagtagcgccagcgtgcctaccctggcgagcacattaggagaagctccggctcctcccccattgagtgtgcgagttctggggtccagctctctccagctgctatgggagccttggcccaggctggctcaacacgaaggcggattcaaactgttctatcggccagctagcaagacctccttcacagggcctattctgctgccgggaacagtttcatcatataatctgtcccagttagaccctaccgccgtatatgaggtgaaactgttggcctacaatcaacacggcgacgggaacgcgacagtgcgcttcgtgtcactacggggagccagcgaacgtacggccctgagtcccccatgtgattgcagaaaagaggaagctgctaatcaaactagcactacagggatcgtaataggtatacacatcggagtgacctgcataattttctgcgttctgtttttactctttgggcagcgaggacgtgtccttctttgtaaggacgtcgatatgaaggaactcgagcagctgtttcccccagcctctgcagctggtcagcccgatcctaggcctacagaccctgccgctcccgctccctgcgaagaaacccagttgagtgtactgcctctgcaggggtgcgggctgatggaagggaaaactaccgaggcaaaaacgacggaggccacagcaccttgcgcgggtcttgcagccgctcccccacctcctgatggcggacctggccttctgtctgagggtcaggcctcccgtcccgctgccgcaagggtcactcagcccgcacattcggagcagtag

SEQ ID NO: 50762 - DNA, 3753 bp, Artificial Sequence
  Description of Artificial Sequence: Synthetic coding sequence
atggcccgaggcgacgcaggtagaggcagaggacttttagctcttaccttttgtctgctggcagctaggggagaactgttattgccgcaggaaactacagtggagttgtcttgcggagtcgggccactccaggtgattttgggtccagaacaggccgcagtgctgaactgctcgctgggagctgcagccgcaggccctcccaccagagtgacatggtctaaagacggtgatacactgttggaacatgatcatcttcatctgctccctaatggaagcctgtggttgagtcagccgctggccccaaacgggtctgatgagagcgtgcccgaggccgtcggtgtcattgaaggtaactactcttgtcttgcacacggacctctgggggtcctggcttcccagactgcagtggtgaagctggccaccctcgcagattttagccttcaccccgaatcccagaccgttgaggaaaacgggaccgccagatttgaatgccacatcgaaggtctcccagcccctattataacatgggagaaggaccaggtgaccttgcctgaggagcccagactgatagttctgccaaacggcgtgttgcagatcttagacgtgcaggagtctgacgccggaccatacaggtgcgtggcgacaaattccgcgcgacaacacttttctcaagaggccctgttgtctgtggcgcaccgtggaagcctggcctctacccggggtcaggatgtggttattgtcgcggctccagaaaatactacagtcgtgtccggacagtccgtggtgatggaatgcgtggcctcggcagaccccacgcccttcgtgtcttgggtgcgtcaggacggcaagccaatttccacagacgttattgtgctcggaagaaccaatttattaattgcaaatgctcagccctggcacagcggggtatatgtatgtagggccaacaaacctcgtacaagagacttcgccaccgccgctgcagagctccgggtcttagccgcacctgctatcactcaggcgcctgaggccctgtctaggacaagagcctcaaccgccagattcgtgtgtcgggcaagcggcgagccccgtcccgcattgcggtggctccataatggcgcacccctgaggcctaacggccgtgtcaaagtgcaggggggaggtgggtcactcgttatcacacagatcggcctacaagatgccggatactaccagtgcgttgcggaaaatagcgccggaatggcctgcgctgctgcgtccctggcagttgttgtgcgcgaaggtttgccctcagcccctactagagtgacggctacaccactgtcctcgtcggcggtgctggtcgcctgggagcggccagagatgcacagcgagcagattatcgggttttcgctgcattaccaaaaggcaaggggcatggacaacgttgagtatcagtttgctgttaacaatgacacgacagaacttcaggtgagggatctggagccaaatacagattacgaattctatgtggtggcatactcccagctcggcgctagcaggacatcaacgcccgcactggtgcacaccctggacgatgtgcctagcgcagcccctcagttgtccttgtcaagccctaaccctagtgacatccgggtggcatggctgccactgccccctagcctctcaaatggccaggtcgtgaagtataaaattgaatacgggttagggaaggaagaccaaattttcagcaccgaggttcgcggaaacgaaacgcagctaatgttgaacagcctgcagcccaacaaagtctacagggtaaggatttctgccggaaccgccgctggattcggagccccaagccaatggatgcaccaccggacaccaagcatgcataatcagtctcatgttccctttgccccagccgaactgaaggtgcaggccaagatggagtctctggtggtttcatggcagccccctccacacccaactcaaatctcaggatataaactttactggagagaggtcggtgccgaagaagaggccaacggagataggttgcccggagggaggggagaccaggcttgggatgtgggcccagtgcgccttaagaaaaaagtgaaacagtacgaattgacacagctggtgcccggtaggctctacgaggtcaaactagtggccttcaataagcacgaagacggctatgcggcagtctggaaggggaagaccgagaaggctcccgcaccagacatgcctatccagagaggaccacccctgccaccggcacatgtgcatgctgagtctaactcttctacatcaatctggcttagatggaaaaagccagactttacgacagtgaagatcgtaaattacaccgtgcgttttagcccgtgggggctgagaaatgcctccctcgtgacttactataccagctctggagaagacattctgattggcggattaaagccctttacaaaatacgagtttgctgtgcagtcacatggcgtcgatatggacgggccttttggcagtgttgtggagcgctctactcttccggaccgcccatctactccccctagtgacctgcgtctcagccccctgactcccagtacagtgagactgcattggtgcccccctaccgagcccaatggggagattgtggaatatctgattctgtattcgagcaaccacacccagcccgaacatcaatggactctgctgaccactcagggcaacattttttctgccgaagtacacggcttagaatccgatactcgttacttctttaaaatgggtgcccgaactgaggttggacctgggccttttagccggctgcaggatgtcattacgcttcaggagaaactcagcgacagtcttgacatgcattccgtgactggaattatcgttggcgtgtgtctggggctgctgtgtctgttggcctgcatgtgcgcaggccttcgaagaagtccacacagggagtctttgcctggcctgtcctccaccgctaccccaggaaaccctgccctttactcacgtgccaggttgggacctccttcacctccagcagctcatgagttagaaagcctggtgcaccctcatcctcaggactggtctccaccaccatctgatgttgaagacagggctgaagtgcatagcctgatgggcggaggtgtcagcgaagggcgttcccattccaaacggaaaattagctgggctcagcccagtggattatcttgggcagggtcatgggccggatgcgagctaccgcaggccggaccaaggcccgctttaacaagggcactgctgccacccgctggaacagggcagaccctactgctgcaggccctggtatacgacgctatcaaaggcaatggtaggaaaaaatctcctcccgcttgtcgaaaccaggtcgaggcagaagtgatcgtacactcagacttttcggcctccaacggaaaccccgacctgcacctgcaagatctcgaacctgaagaccctctgccgccagaggcacccgatctgatttcaggcgtgggggaccctgggcagggcgcagcctggctggaccgtgaactcggcggatgcgagctcgccgctcccggtccagatagactgacctgtctgcccgaggccgcttcagcctcatgctcctatccggatctgcagccgggagaggtgttagaggaaacacccggagattcctgccagctgaagtccccatgtcccctgggtgcttcaccaggcctacctcgctcccccgtgagcagctcggcctag

SEQ ID NO: 50763 - DNA, 2940 bp, Artificial Sequence
  Description of Artificial Sequence: Synthetic coding sequence
atgggtcggaggaaaggacgctctgcactgagccgtagctcattggaacgcgttaaccagggcgaggtgaaagtgatcggcagaggagccagagaaggaggaggcggtcaagcttggggcacaggaggcggtagggacttgagctgcgggattcccaggagtgctagcccattggcaccgctcgcagctcccgctattacacaggcacctgaggctctgtcacggacgcgggcatctacagcaaggttcgtttgcagggctagtggagagccacggcctgccctgcgctggctccacaatggtgccccactccggcctaatgggcgtgtcaaagtccaaggtggtggaggaagcctagtcatcacccagattggcctgcaggatgctgggtactatcagtgcgttgctgaaaattcagccggaatggcctgcgcagcggcttcactggccgtcgtggtgcgggagggcttacccagcgctccaactcgtgttactgcgacccccctgagcagctctgccgttctggtagcctgggagcgacctgagatgcacagtgagcaaatcatcggctttagccttcactaccaaaaagctcgtggcatggacaatgtggaatatcagttcgcggtgaacaacgatactacagaactgcaagtccgggatttagagcccaacaccgactacgagttctacgtggtggcttacagccaattgggcgcatcgagaacctctacccctgccctggtgcataccctcgatgatgtgccaagcgccgctccacagctgtccctctctagcccaaatcctagtgacatccgagtggcttggctgcctctgccaccctccttaagtaatggacaagtcgttaaatacaagattgaatacgggctcgggaaggaggaccaaattttttccaccgaggtgcgtggcaatgaaacccagcttatgctcaattctctccagccaaacaaagtgtatagagtgcggatcagcgctgggactgccgcaggatttggcgctccatcacagtggatgcatcacagaaccccatcgatgcacaatcaaagccatgtgccatttgcccctgctgagctgaaggtgcaggcaaagatggagtcactggtggtgtcatggcagccacctccccacccgacgcagatctccggttataagttgtactggagggaggtcggcgctgaggaagaggcaaacggagatcgactaccgggagggagaggggaccaagcctgggacgtgggacccgtcagacttaaaaagaaggttaagcagtatgaactgacccagctggtgcccggacggctgtatgaggtgaagctcgtggcattcaacaaacacgaggacgggtacgctgcagtgtggaaaggcaaaaccgagaaggccccagcacccgacatgcccatccagcgcggacctccactcccgccagcccacgtccacgcggagtcaaactcgtcaacctcaatctggctgagatggaagaaaccggattttacaaccgttaagatcgtaaattatacagtccgcttttctccatggggattgcgcaacgcgagccttgtcacttactacaccagttcaggcgaagacatcttgattggcggattgaaacctttcaccaagtatgaattcgccgtgcaaagccatggggtcgatatggatggtccatttgggtctgtggttgaaaggtccacactgcccgacagacctagtacacccccttccgacctgcggctgagccccctaactccgagcacagtgcggttgcattggtgccccccaacagagcctaatggagagattgttgaatacctgatactatattccagtaatcacactcagcctgaacaccagtggaccctcctgacgacacaaggaaatatattctctgctgaggttcatggcctcgagtctgatactaggtatttttttaaaatgggagcgaggactgaggtgggaccaggcccattttctcgtttgcaggacgtgataactctgcaggaaaaactttcggattcgttagacatgcattccgttacaggtattattgtcggcgtctgcttggggctcctgtgccttctcgcctgtatgtgcgccggtctgcgacgctccccccacagggaaagccttcctggtctaagtagtacagctactcccggtaaccctgcactgtattctcgagcacgtttagggccaccttcacccccagccgctcatgaacttgagtcactcgtgcatccccatcctcaggattggagcccaccgccatcagacgtcgaggaccgtgctgaagtgcactctctaatggggggaggcgtgtctgaaggtcgatcccacagtaagcggaaaattagctgggcccagccctctggtctctcctgggcaggatcctgggccggatgcgaactcccacaagccggtccccgtcccgcactcaccagagctctgctgcctcctgcaggcaccggtcagaccttactgcttcaggccctggtgtatgacgctatcaaagggaacggtaggaagaagtctccacctgcatgtcggaatcaggtcgaagccgaggtgatcgtgcatagtgacttttccgcctctaacggaaacccggatctgcacttgcaggacctggagccagaagatccccttcccccagaagccccagacctcatctctggagtcggtgatccaggtcaaggagccgcatggctggatcgcgagctcggtggatgcgaactagcagcacctggcccagacagactaacctgtttacctgaagccgcatcagcctcttgtagttaccccgacctgcagccaggagaagttctcgaggagactcctggcgattcttgccaactcaagagcccctgccctctcggcgcttctcccggattaccaaggagccccgtgtcttcaagcgcctag

SEQ ID NO: 50764 - DNA, 1293 bp, Artificial Sequence
  Description of Artificial Sequence: Synthetic coding sequence
atgagccttgtcgagctgctgctctggtggaattgcttctcccggacaggggtggctgcctcactagaggtatccgaaagccccggtagcatccaggtcgcaaggggccaacctgctgttctcccctgcaccttcacaacatctgcagccctgattaatctcaatgtgatttggatggtcactcctctgtctaatgctaatcaacctgaacaggttattctttaccaggggggacagatgttcgacggggctcctaggtttcacgggagggtcgggttcaccggaacaatgcctgctacaaacgtgtccattttcatcaataacactcagctgtccgacaccggaacttaccagtgcttagtcaataatctcccagatatcggagggagaaacatcggtgtcacaggtttaaccgttctggtgccgccttccgcaccacattgccagatccaggggtcccaggatatcgggtctgatgtcatcttgttatgttcatccgaggaaggcatacctcgtccaacttatttgtgggagaaactggacaacaccctgaagcttccacctacggccactcaggatcaggtgcagggtactgtgacgatccgcaatatatcagccctgtcttctgggctgtaccagtgcgtggcatcaaatgccatcggaacttcaacctgccttctggacctccaagtcattagtcctcaacccaggaatattgggctcatcgccggtgccataggaaccggcgctgttatcattattttttgcattgccctcatcctgggagcttttttttactggcgatccaaaaataaggaagaggaggaggaagaaatacctaacgagatcagggaggacgatttgcctccaaagtgcagttctgcgaaagcctttcacaccgagatcagtagttccgacaacaataccctgacaagcagcaatgcatacaactcacgatattggtcaaataaccccaaggtccatcggaacacagaaagcgtgagccacttctccgacctgggccagagcttttcattccattctggtaatgcaaacataccatcaatctatgccaacggaacgcacctagtgccaggtcagcataaaactctggtagttacagctaatagaggatcatccccccaggtcatgtcccgtagtaacgggtctgtttccaggaaaccacggccacctcatactcattcgtacacgatcagtcatgccaccctggagcgcataggcgcagtgcccgtaatggtccccgcacagtccagagctgggtctctggtgtag

SEQ ID NO: 50765 - DNA, 1296 bp, Artificial Sequence
  Description of Artificial Sequence: Synthetic coding sequence
atgacaagccagaggtcccctctagcaccactgctgctgctttctttgcatggggtagcggcttctctggaggtaagcgagagccctggctcaattcaggtggctagagggcagcccgctgttcttccttgtaccttcaccaccagcgcagcactgatcaacttgaacgtgatctggatggttactcccctgtctaatgcgaatcaaccggagcaagtgattctttaccaggggggtcagatgttcgacggcgctccacgctttcatggacgagtgggcttcaccggcaccatgccagccacaaatgtgtctatctttataaataacacccaactgagcgatacagggacctaccagtgtttggtgaataatctgcccgatattggtggacggaacatcggggtgactgggctgactgttctcgttcccccatccgccccacattgtcagatccagggttctcaagatattgggtctgacgtcatcttgctttgtagtagcgaggaaggcattcctcggccaacatatttatgggagaaactggacaacaccctcaaacttcccccaaccgccacccaggaccaggtccaagggaccgtgaccataaggaacatttccgccctgagtagcggtctgtaccagtgcgttgcctctaatgctatcggaacgtccacctgcctgctcgacttacaggttatatccccgcagccaaggaacataggtctcattgccggagcgattgggactggcgctgttattattatcttctgcatcgccctgattctgggtgcttttttctactggcgctcgaagaacaaagaagaagaagaagaagagattcctaatgagattcgcgaggatgatcttccccctaagtgctcctcagcgaaagcattccacactgagatcagtagcagcgataataacactctcacctccagtaatgcgtataatagcagatactggtcaaataatcccaaagtccatcggaataccgagagtgtgtcacacttttctgacctcggccagagctttagctttcattcagggaatgccaacatcccttctatttacgctaacgggacacatctggttcctggccaacacaagaccctagtggtcacggctaacagaggttcgtccccgcaggtcatgagccgcagtaacggttccgtctcgagaaagcccagaccaccgcatacccactcttacacaatttcacatgcaaccctggagagaatcggcgcagtcccagtgatggtcccagcccagagccgcgctggcagtttggtgtag

SEQ ID NO: 50766 - DNA, 1293 bp, Artificial Sequence
  Description of Artificial Sequence: Synthetic coding sequence
atgtcactggtagagcttctcttgtggtggaactgtttcagtcggaccggggtcgcggcttccctagaggtgtctgagtcccctggttcgatacaagtggccaggggccagccagcggttcttccttgtacatttactacaagcgctgcgctcattaatcttaatgtaatttggatggttactcccttatcaaacgcaaatcagcctgaacaagtgatcttgtatcaggggggacaaatgtttgacggagcaccccgattccacggaagggtgggcttcacaggtacaatgcctgctaccaacgtgtccatctttataaacaatacacagttgtccgacactggaacataccagtgcttggtgaacaatctgcctgacattggtggcaggaatatcggagtcaccggcttaaccgtcctggtgcccccatctgctccacattgccagattcagggcagccaggatattggttctgacgtcatcctcttatgctcctcagaggagggaattcctcgaccaacgtacctctgggagaagctggataacacgttgaaactccctccaacagcaacccaagaccaagttcaggggactgttactatcaggaacatctcagcattgagttctgggctttatcagtgcgtggccagcaacgcgatcggaacgagtacctgcctcctggacctgcaggtcatttccccacaacccaggaacatcggattaattgccggagccatcggaacaggtgccgttattatcattttttgcatcgcgctgattctaggcgcatttttctattggcgtagtaagaataaggaggaagaggaagaagaaataccaaatgaaattcgcgaggatgacctgccccctaagtgcagttctgcgaaagcctttcacacagaaatttctagctcagataataatacattaacctcatccaacgcttataattcaagatattggagtaataatcccaaagtgcaccgaaataccgaaagtgtcagccatttttctgacctgggtcagtccttttcctttcacagtggaaacgcaaacatacccagcatctacgcaaatggcacccacctagtgccaggacagcacaaaacactggtggtgaccgcaaatcgcggaagttcgcctcaggtcatgagcaggtcgaatggcagcgtatcccgcaagccgcgacctccccacactcattcctatactattagccacgcgactctcgaacggatcggagccgttcctgtgatggttcccgctcagtcacgagctgggtccctcgtatag

SEQ ID NO: 50767 - DNA, 579 bp, Artificial Sequence
  Description of Artificial Sequence: Synthetic coding sequence
atgcgggctaaaccacagtcgcctttgcctaggaaccctgttcctgcctggagtcccccaaccacaaccacagacccgatgctggaaaaagatgcggctggcggagatttccctgctaacctggtgcttcagctgatgcccctgaagacttttcccgctgcaattagaggcgtaatacaatctgagcttaattattcagttattctccaatgggtcgtcacgatggacccagaacctgttctgtcctggacgtttagcggcgttccgtgcggaatgggtgaaaaactgttcatccgacggttatcctgtgaacagctggggacctatatgtgcattgctactaatagcaagaagcagctggtatcggaacccgtcacgatcagcctgccaaagcccattatgcaaccgaccgaagctgagcctatggagccggatccaactctgagcctttctggtggtagcgccatcggcctcttggccgcaggcatactcggggctggagcactcatcgcgggaatgtgcttcattataattcaaagcttgcggacggaccgccagcgaatcgggatttgcagttag

SEQ ID NO: 50768 - DNA, 1224 bp, Artificial Sequence
  Description of Artificial Sequence: Synthetic coding sequence
atggggcagaaggagcgatccaccgccgacacgcttcctgatcttgaggagtggaaatcagccgcagggcttcgatggtggcaaacggccgtggttgatgggagcgggtccggcaacgaggtaatcgaaggtcctcagaatgcccgtgtcctgaagggaagtcaggctcgcttcaattgcactgtgtcccagggatggaagctgatcatgtgggccctctccgacatggtggtgctgagcgtgcgtcccatggaacccatcattacgaatgatagatttaccagtcagcgatacgatcaggggggaaattttacgtcggaaatgatcatccataatgtagagccgtcagattctggcaacatacggtgtagcctgcaaaactcaagacttcatggcagcgcgtacttgactgtccaggtgatgggcgaattgtttattccttcggtcaatctcgtggtcgcagagaatgagccctgcgaggtgacgtgtttaccttctcattggacgcgcttgcccgatattagctgggagttgggcctactcgtatctcactcatcctattatttcgttcccgagccctctgacttgcagtccgccgttagtatccttgcactgactcctcaatcaaacggcactctcacctgtgttgcgacctggaagagcctgaaggccagaaaaagcgcaactgttaacttgacggttatacgctgtccacaggacaccggaggcggaattaacatccctggcgtcctgtctagcctgcccagcctggggtttagcctgcctacttggggtaaggtcgggctgggcctcgcaggcaccatgctgctcaccccaacgtgtaccttgacaatcaggtgctgctgctgtcggaggcgctgttgcgggtgcaattgttgctgtcggtgctgtttttgttgtcgcaggaaaagaggcttccgcattcaatttcagaagaaatcggagaaagagaaaaccaacaaggagacagagacagagtctggtaacgaaaactctggctacaatagtgatgaacaaaagacaacagacaccgcatccctgccccctaagagctgcgagtcatcagatcctgaacagcgcaattcaagttgcggcccacctcaccaacgcgctgatcagaggcccccacgtcccgcttcccacccccaagcatcctttaacctagcttcccccgaaaaggtgagcaacacaactgtcgtctag

SEQ ID NO: 50769 - DNA, 1920 bp, Artificial Sequence
  Description of Artificial Sequence: Synthetic coding sequence
atggatcgggtcctactgcggtggatttctctcttttggctgaccgcaatggtggagggcctacaggtaacagtccctgataagaagaaggtcgccatgctgttccagccaaccgtgctacggtgccactttagtaccagctcacatcagcccgctgttgtgcagtggaaattcaagagctattgccaggatcgcatgggggagagcctaggaatgagctccacgcgtgcccagagcctatcaaagcgcaacttagaatgggatccgtacttagactgccttgatagccgacggactgttcgggtggtagcaagcaaacaggggtcaacagtcaccctgggcgatttctaccggggtcgggaaatcaccatcgtgcacgatgctgacctccagatcggtaaactaatgtggggggactcgggcttgtactattgtataataacgactccggacgacctggagggtaagaatgaggacagtgtagagttgcttgtactggggcgaaccggcctgctggccgacttattgcccagcttcgccgttgaaattatgcccgaatgggtattcgtgggacttgtccttctcggcgtctttctcttcttcgttctggtgggtatctgctggtgccagtgctgtccccacagttgctgttgttacgttcggtgtccctgctgtcctgactcatgctgttgtcctcaggctctgtatgaggctgggaaagccgctaaggccggttaccctcccagcgtgtctggggtaccaggaccttatagcattccatcagttcccttaggtggcgcaccctcatccgggatgttaatggacaaaccccaccctccaccattggccccttcggattcaacaggcggatcccacagcgtccggaaaggctacaggattcaggctgataaagagcgtgactccatgaaagtgctctattacgtagagaaggaattagctcagttcgaccccgctcgcagaatgcggggaagatataacaatacgataagtgagctaagctctttgcacgaggaagactcgaacttccgccagagtttccaccagatgcgaagcaaacagtttcctgtgagcggagatctggaatctaatcccgattattggtcaggcgtgatgggaggctcctcaggcgcaagccgagggccatcagccatggagtataataaggaggaccgggaatcgttcaggcactcccagcctagaagtaaatcagaaatgctgtccagaaaaaattttgccactggagtcccggctgtttcgatggatgagctggcggcattcgctgatagctatggtcagagaccaaggcgggcagatggaaactcccatgaagccaggggaggaagcaggtttgagcggtccgagagccgggcacattcaggattttatcaagatgactcactcgaggaatactatgggcagcggtccaggagccgagaacctttaaccgatgccgaccgcggttgggcttttagccctgcgagacgacggcctgcggaagatgcccacttaccacggctcgtatcacgcactcctggaactgccccaaagtatgatcactcatatctcggtagtgccagggaacgccaggccagacccgagggagcatccagagggggatcgctcgaaactcctagtaagaggtctgcacagctcgggccaaggtccgccagttattatgcatggagcccaccaggcacatacaaggcgggaagctcacaagacgaccaggaagatgcctccgatgacgcgctccccccatattccgaattggaactaacccggggaccgtcataccgaggtcgcgatctgccctaccatagcaattcagaaaagaagaggaagaaggaaccagcaaaaaaaaccaacgacttccccacgcgcatgtctctcgtggtgtag

SEQ ID NO: 50770 - DNA, 1644 bp, Artificial Sequence
  Description of Artificial Sequence: Synthetic coding sequence
atggccatgggcttgttcagagtgtgtttagtagtggtaacagctattattaaccatcctttgctgtttccaagggagaacgcaacagtgccagaaaatgaggaagaaatcattcggaagatgcaggctcatcaggagaagctgcagctcgagcagctacgtttggaggaggaggtggccaggttggctgcagagaaggaagctctggagcaggtagccgaggaaggcagacagcagaacgaaacacgggttgcttgggatctgtggtctactctctgcatgattctgtttctcatgatcgaagtttggcgacaggatcaccaagaagggccatcacccgagtgcctgggaggtgaggaagacgagctgccaggcttgggtggggctccccttcagggactaacactgccaaacaaagcgaccttggggcacttttacgagcggtgcattcgtggagccactgccgatgccgcacggacccgtgaattcctggagggattcgtcgatgacctcctcgaagcactccggtccctgtgtaatcgagatactgacatggaggtggaggatttcattggcgtggattctatgtatgagaattggcaggtggacaggcctctcttgtgtcatctgtttgtgccttttacaccaccagagccctatcgatttcaccccgagctgtggtgctccggccgatcagtcccccttgatcgccagggctacgggcagatcaaagtggtgcgcgctgacggagacaccttgtcttgtatttgtggcaagaccaaattgggtgaagatatgctgtgtctccttcatgggagaaactccatggctccaccatgcggagatatggaaaatctgctgtgcgcaacagacagcctgtacttggatactatgcaagtgatgaagtggttccagacagcattaacaagagcttggaagggtattgcgcataaatacgaatttgacctggcctttggacaattggattcgccaggttcgctgaagatcaagtttcggtccgggaaatttatgccctttaatctcatacctgttatccagtgtgatgactcagacctgtatttcgtctctcatctaccccgtgaaccctctgaaggcacccccgcaagttctacagattggctgctgtcatttgctgtttacgaacgccacttcctgcgaacaaccttaaaagctttaccggaaggtgcttgccatctttcatgtttgcagattgcctcatttctgctaagtaagcaaagccggctaacagggccttctggactttcgtcataccacctgaagacagcactgttgcatctccttctgctgcggcaggctgcggattggaaggctggacagctggacgctcgccttcacgagctcttatgctttctggagaagagtctgctccaaaagaaactgcaccacttctttattggcaaccgtaaagtccccgaggccatgggcctcccagaagctgtcctgagggccgagcccctgaacctgtttaggccttttgtcctgcagcgatctctctacagaaagaccctcgactccttctatgaaatgcttaagaatgcacctgcattgataagtgagtactccttgcacgtgccctctgatcagccaacccctaaatcgtag

SEQ ID NO: 50771 - DNA, 1644 bp, Artificial Sequence
  Description of Artificial Sequence: Synthetic coding sequence
atggctatgggccttttccgggtctgcctggtagtcgtgactgctatcataaaccatcccctgctctttccccgtgagaatgccacagtgcctgagaatgaggaggagatcatccgaaagatgcaggcccaccaggagaagctgcaactggaacagctcagactggaggaagaggtggccaggttggccgctgagaaggaagcgctggagcaagtggcggaggagggcaggcagcaaaacgagacccgcgtcgcctgggacctgtggagcacattgtgtatgatcctctttcttatgatcgaggtctggagacaggaccaccaagaggggccatcccccgaatgcctaggaggtgaggaggacgagttgcctggactcgggggagcgccacttcagggtctgacactgccaaacaaggccacgctggggcacttttatgagcggtgtattcgcggagcaaccgcagatgccgctcggactcgggagtttctggagggttttgtggacgatctgctcgaggccctcaggtccctgtgcaatagagataccgacatggaagtagaggactttataggggtggattcaatgtacgaaaactggcaagtggaccggcctctactctgtcacctcttcgttccctttaccccccctgaaccctaccgctttcaccccgagctctggtgcagtggcaggtctgtacctttggacaggcagggatacggtcagataaaagttgtgcgggcagatggcgatactctgagctgcatctgtggtaagaccaaactgggcgaagatatgctgtgcctgctgcatggcagaaattccatggcccctccatgtggagacatggagaacctattatgtgccacggattcattataccttgacaccatgcaagtaatgaagtggtttcagactgcgcttacaagggcctggaaggggatcgcccacaagtacgaatttgacctagctttcggacagctcgatagtccaggttcccttaaaatcaaattccggtcgggtaagttcatgccgttcaatttgatacctgtgatacagtgcgacgacagcgatctgtactttgtgtcccatctccccagggagcctagcgagggcactccagccagttctactgactggctcctgagcttcgcagtatacgaacggcactttttgcgaactacacttaaggcactgcctgaaggtgcctgtcacctgtcctgcctgcagatcgctagcttcctgttaagcaaacaatcccggttgactggaccatccggcctatccagttaccacctgaaaactgccctcctccacctgttgctgctaaggcaggccgctgactggaaagcagggcagctggatgccaggcttcacgagctgctgtgttttctggaaaaatccctgttgcagaagaagctccatcacttcttcataggtaaccgcaaagttccagaagccatgggcttgcccgaggctgtgctccgcgcagagccacttaaccttttccgccctttcgttctgcagagatcactgtatcggaagaccttagacagtttctacgaaatgctgaaaaacgctccagcacttattagtgagtactctctgcacgtgccttccgatcagcccactcctaagtcctag

SEQ ID NO: 50772 - DNA, 1644 bp, Artificial Sequence
  Description of Artificial Sequence: Synthetic coding sequence
atggctatggggctgttcagagtgtgtttggttgtggtgaccgctattattaatcaccctctgctgttccccagggagaacgcgactgtgcccgagaatgaggaagaaatcatcagaaaaatgcaggcacaccaggagaaactgcaactggaacagctgagacttgaggaggaagtggcacgactcgctgccgaaaaagaggctctcgagcaggttgccgaggaaggacgtcaacagaacgaaactcgcgtggcctgggatctgtggagcacgttgtgcatgattctgtttctgatgatcgaggtctggaggcaggaccatcaagaagggccttccccggagtgtctaggaggcgaggaggacgagttgcctgggctgggtggtgccccacttcaagggcttactctgcctaataaagcaaccctgggacacttctacgaacggtgtatacgcggagcgacagctgacgctgccagaacaagagagtttttggagggcttcgtggacgatctgctagaggccttgcgcagcctgtgcaacagggacaccgacatggaggtggaggacttcatcggcgttgactccatgtacgaaaattggcaggtcgaccggccactgctgtgccacttatttgttccatttaccccgcctgaaccatatcggtttcaccccgagttgtggtgctctggaagatctgttccacttgataggcagggatacggtcagatcaaggtcgttcgggctgatggtgataccctctcatgtatctgcggaaaaacaaaactgggtgaggatatgctatgcttattacatgggcgaaatagcatggcacctccttgtggggatatggagaatctgctgtgcgccaccgatagcctgtatctggatactatgcaagtaatgaagtggttccaaaccgctttaactcgggcttggaagggtattgcgcacaaatacgaatttgacctggccttcggccagctcgatagccccggaagtctcaaaatcaaattcagatctgggaaattcatgccctttaatctgattccggtcattcaatgcgatgactctgatttgtacttcgttagccacctcccccgtgagcctagtgaaggaacccccgcatcctcgacggactggcttctctcatttgccgtctacgaaagacatttcctgaggaccacactgaaggccttgccagaaggcgcttgccacctgtcttgcttgcagatagcctcttttctgctcagcaaacagtcaagactgaccggtccctcaggcctaagctcctaccatttgaaaaccgccctattgcacttgctgctacttcggcaagccgctgattggaaggctggacagctcgatgccaggctgcatgaactgctctgctttctcgaaaagtctcttctgcagaagaagctgcaccatttttttatcggaaacaggaaagtgccggaagccatggggctaccagaggccgttctaagggctgagcccctgaatctcttccgcccatttgtgctccagcggtccctgtacaggaagaccctggattcattctacgagatgctgaaaaatgcacccgctctgatcagtgaatattccctccacgttccctcagatcaacccacacctaaatcctag

SEQ ID NO: 50773 - DNA, 345 bp, Artificial Sequence
  Description of Artificial Sequence: Synthetic coding sequence
atggccatgggtttgttcagagtttgcttagtcgtggtaactgccattatcaaccatccactgctgttcccgagggaaaatgctactgtgcccgaaaatgaggaggaaataatccgcaaaatgcaggcccatcaggaaaaacttcaattagagcagctgcggctggaggaggaagtggccaggctagcagctgagaaggaagcactagagcaggttgcagaggaaggtcggcagcagaatgaaaccagagtagcttgggacctgtggtctaccctttgtatgatcctattcctcatgattgaagtgtggcgccaggatcaccaggaggggccaagccctgagtag

SEQ ID NO: 50774 - DNA, 1692 bp, Artificial Sequence
  Description of Artificial Sequence: Synthetic coding sequence
atgaccactgactcttacagtcctacttcacctgacgccgaagcctcaatggccgtgatctcgttactttttctggcagtgatgtatgtagtgcatcacccactgatggtatctgaccgtatggacctggacacactggccagaagccgccagttggagaagagaatgagcgaagagatgaggctattggaaatggagtttgaggagcgcaaaagggcggcagagcagcggcagaaggctgaaaatttttggactggtgatacctctagcgaccagctcgtgctgggcaaaaaggatatgggatggccattccaggctgatggccaagaggggcctctggggtggatgctggggaacttatggaatactggattgttctgcttattcctggtgttcgaactgttacggcagaacatgcagcacgagccagcttttgactcatcatcggaagaggaagaggaggaggtgagggtcgtgcctgtgacaagctacaactggcttacagatttcccatcccaagaggccctcgactctttctacaagcactatgtgcagaatgctatacgtgacctgccatgtacttgtgaattcgtggaatctttcgtagatgatctcatagaggcatgcagagtgctctcccggcaggaggcacatcctcagctcgaggactgcttgggtataggcgcagcattcgagaagtggggaaccctacatgagacccagaagttcgatattctagtgcctatcgtgcccccacagggaaccatgttcgtgctggaaatgagagatcccgcactcgggagaaggtgcgggtgtgtactcgtcgagagcgagtgtgtctgcaagcgtgagaaactgctcggcgacgtgctgtgcctggtgcaccaccaccgtgacccatccgccgtgctggggaagtgttcgagcagcatcaaagccgcattatgtactggtttccacctcgacgtgtgtaagaccgtgcagtggtttcggaatatgatgggaaacgcttgggctctcgtcgcccacaagtacgactttaagctgtccctgcctccaagcacaacctcatgtaagctccgcctggattaccgcagcggacggtttctgtcgatccacctggtactcggggttcaaagagaagataccctagtgtacctcgtgagccaggcccctgaccaggagcaactcacttctgtggactggccagaatcttttgtggcctgtgagcatctgtttctgaaacttgtgggaaggtttgcacccgagaacacatgccatcttaagtgtctgcagatcatcctgtcattgaggcagcaccagtcgctgccacatggagcctcaagacctatacttacgtcctatcatttcaagactgccttgatgcatctgttactacgactgccacttacagactgggctcacaacatgctttcccagagactgcaggatatactgtggttccttggaaggggcctgcagcagaggtcgctgcaccatttcctcatcggaaataattttctgcccctgactatccctattccgaagacattcaggaatgctgaaccagtgaatctgttccagcaccttgttcttaacccaaaggctcatagccaagctgtggaggagtttcagaatctgctgactcaagtgaagactctaccacacgccccattagcagctgccccttag

SEQ ID NO: 50775 - DNA, 1668 bp, Artificial Sequence
  Description of Artificial Sequence: Synthetic coding sequence
atgaacgtggatgctgaggcctcaatggcggtcatttcacttctttttcttgcagtcatgtatgttgtgcaccaccccttaatggtatcagaccgcatggacctcgataccttagcaaggtcacgacagctggaaaagcgcatgtccgaggaaatgcgcctactggagatggagttcgaggagcggaaacgcgcagctgagcagcggcagaaagctgagaatttctggacaggtgacacatcctcagatcagttggtcctggggaaaaaagatatgggatggcctttccaggcggacggccaggagggccctcttggctggatgctcgggaacctttggaacacgggcctcttctgtctgttcttggtgttcgaactgctgcggcaaaatatgcaacatgaacctgccttcgacagcagctctgaagaggaagaggaagaggtgcgcgtggtgcctgtgacatcatataactggcttaccgacttccccagtcaggaggcgctggactccttttataaacattacgttcagaatgccatccgggacctgccatgtacttgcgagttcgtggaatctttcgttgatgacctgattgaggcatgtcgcgtgctaagtaggcaggaggcccacccacaactggaggactgcttggggattggagctgcatttgagaagtggggcaccctccatgaaactcaaaaatttgatatactggtgcccatagtcccccctcaagggacaatgttcgttctcgaaatgagggatcccgctctgggtagaaggtgcggctgtgtgctcgtggagagtgagtgtgtctgtaaacgggaaaagctattaggagatgtgctgtgcctcgtgcaccatcatcgcgatccctccgcagtgctcggcaagtgttcctcttccatcaaagcagctctctgcacaggctttcatctggatgtctgcaagaccgtgcagtggttccggaacatgatgggtaatgcatgggctttggtggcacacaaatacgactttaaactctctctgccaccctcaactacatcctgtaagctgaggttggattatcggtcaggaaggttcctctcgatacatttagtgcttggggtgcagcgggaagatacccttgtgtatctggtgtcgcaggctcctgaccaggagcaattgacaagtgtagactggcctgagtcattcgtggcgtgtgagcacctttttctgaaattggtggggaggttcgcccctgagaacacatgtcacctgaaatgtctgcagattatcctgagtctgcggcagcatcaatctctcccccacggcgcttctcggcctattctgactagctatcatttcaaaactgccctgatgcacctactcctgagattgccgctgacagactgggcgcacaacatgttgtctcaacggttgcaagatattctgtggtttcttggccgaggactgcaacagcggagtctgcaccattttctaatagggaacaattttctcccccttacgattcctatcccgaagacctttcgcaacgcagaaccagtcaatttgtttcagcatctagttcttaatcctaaagctcatagtcaggccgttgaagaattccagaaccttctgactcaagtgaaaaccctcccacatgccccacttgccgcagcgccttag

SEQ ID NO: 50776 - DNA, 1644 bp, Artificial Sequence
  Description of Artificial Sequence: Synthetic coding sequence
atggcagtgatttctctcctgttccttgccgtcatgtacgtggtgcaccatccattgatggtgtcagacaggatggatctggacaccctggcaaggtctcggcagcttgagaaacggatgtccgaagagatgcgtctactggagatggaatttgaggagcgtaaacgcgctgcggagcaacgacagaaagccgagaacttttggacaggagatacatcttccgatcagctagtgctcggcaagaaagacatgggatggccttttcaggccgatggacaagaagggcctctggggtggatgcttggcaatctttggaacactggccttttctgtctttttctcgtctttgaactcttaaggcagaacatgcaacatgagcccgctttcgatagttcaagtgaggaagaggaagaagaagtccgggtcgtaccagtcacgagctataactggttaacagacttccccagccaggaggcattggattccttctacaagcactacgtgcagaatgcaatccgggacctcccttgcacttgtgagttcgttgaaagctttgtggacgatctaattgaggcctgcagggtcctgagtcggcaggaggctcacccacaactggaagattgcctgggaataggtgctgcatttgaaaaatggggcacacttcacgaaacccagaaatttgacattcttgtgcctattgttcctccccaaggcacaatgttcgtcctggagatgcgggatcccgctttaggcaggaggtgtgggtgcgttcttgtggagagcgagtgcgtctgcaagcgagaaaagctcctcggtgacgtgctctgtctggttcatcatcatagagatccatctgcagtgctcggcaagtgcagttccagtatcaaggccgctttatgcacaggctttcatcttgacgtttgcaaaaccgttcaatggtttcggaatatgatgggaaatgcgtgggcgcttgtggcccacaaatatgacttcaaattgtcactccccccaagcaccacctcttgtaagctccgcttagattatcggtctggacgcttcctgagcatccacttagtgttgggtgtacaaagggaggataccctcgtctacctcgtctcccaggctccagaccaagagcagttgacatctgtggactggccagaaagctttgttgcgtgtgaacacttgttcctcaaactggtgggtcggtttgcgcctgagaacacctgccacctgaaatgccttcagattattttgtccctgcgacagcatcagagcctgccccacggagcctccaggccaattctgacatcgtaccatttcaagactgcactcatgcatttgctgctccggctgccattgactgactgggcccacaacatgctctcccaacgtttgcaggatatactgtggttcctcggcaggggcctgcagcagcggtccctgcaccattttctaattggaaacaacttcctgccactgacgataccaatcccaaagacttttaggaatgctgaacccgtgaatctgtttcagcatttagttctaaaccccaaagctcatagccaggccgtggaggaattccagaatctcctgactcaggtcaagaccttgccacatgcccctttggccgcagccccatag

SEQ ID NO: 50777 - DNA, 1644 bp, Artificial Sequence
  Description of Artificial Sequence: Synthetic coding sequence
atggccgtgatttcactcctgttcctggcagtgatgtacgtggtccaccatccgctcatggttagcgaccgcatggacctggacacgttggctcggagtcgtcaactggagaaaagaatgtcagaagagatgagactcctagagatggagtttgaggaacgaaagcgcgctgcggaacaaaggcagaaggccgagaatttctggacaggagacacctcatctgatcaactagttctaggtaaaaaagacatgggttggccattccaggctgatggtcaggaaggtccattaggctggatgctggggaacctctggaacactggcctgttttgccttttcctggtgttcgagctcctgagacagaacatgcagcacgaacccgcatttgactccagctcagaggaagaagaagaagaagtccgggtggttccagtcacctcttacaactggcttaccgattttccgtctcaagaggccctagattcattttataaacactatgtgcagaacgccattagagacctgccctgcacttgcgaatttgtcgagagcttcgtggatgatctgatcgaggcgtgccgtgtcttgtctcgacaggaggcacacccacagcttgaggattgtttgggcataggtgccgcatttgagaaatgggggacactccacgagacacagaagtttgacattctcgttccaattgttccaccccagggaacaatgtttgtgctcgaaatgagagatccggcacttgggaggagatgtgggtgcgtattagtcgagtccgagtgcgtgtgcaagcgtgaaaaactgcttggtgatgtgctatgtttagttcatcatcaccgggatccaagcgccgtcttaggcaagtgctcctccagcattaaggctgcactgtgtaccgggttccatctggacgtctgtaagacagtgcaatggttccggaacatgatgggcaacgcctgggccctcgtagcccataagtatgattttaagctgagcttaccgccttcgaccacgtcatgcaagttgagactggactatcgcagcggtcgctttctcagcattcatctcgtgcttggtgtccagcgtgaggacactttggtttacctggtttcacaggccccagatcaggaacagctgacatctgtcgactggccagagagcttcgtggcctgcgaacacctttttctgaaacttgtcgggcgtttcgccccagaaaacacgtgtcatctaaagtgcctgcagatcattcttagcctgcggcagcatcagtctcttccacacggagcctcccggcctattttaacctcatatcactttaaaacggctctcatgcacctgctactgaggctgccgcttaccgattgggctcataatatgctatctcagcgactgcaggatatcctgtggttcctcggcagaggactccaacagcgatcactgcatcacttcctcataggcaacaattttctgcccttgacaattccaatacctaaaacctttagaaatgccgagccagtaaatctcttccaacatctggtgttgaaccctaaagcccacagccaggccgttgaggagttccagaatttgctcacccaagtgaaaacgcttccacatgcgcctcttgcggcagcgccatag

SEQ ID NO: 50778 - DNA, 1608 bp, Artificial Sequence
  Description of Artificial Sequence: Synthetic coding sequence
atgagcgtccactacacccttaatctgagagtgttctggcctctcgtgacgggcctatgcactgcgttagtttgcttgtaccacgtgcttcgagggtcagggggagcccgtgctgagcccgcagacggtgtggatggcggtttccccttgctgaaagttgcagtcctcctccttctcagctatgtactcctgcgttgtcggcatgctgtgaggcagaggtttttgcctggatctcctagactggaggggcacgcagcattctctagtcggcattttcgcgaacctgggctgtccatcctattggagagctactacgagcatgaagtccggcttagtccgcacgtgctgggacactctaaggctcatgtgtccagaatcgttggtgagctggtccgtgcgggtcgtgctcggggaagtcccggactgatcccagggggagccctggctctcgcatttagaggagattttattcaggtgggctcagcatatgagcagcacaaaatcagacgtcctgatagctttgatgtgcttgtcccccttcgcctgccccctctcgttgctctagagcctaggagcctgggggaagaacccgctctagccccagccttccggggatgtttcttgtgcgcgctcaaggcacctccatccccttctggtgcttctggtggtcactggctgagggattgcaagccgtttgcagacgcgttttgtgtcgatgttagagggagacggcacctcagcgctacgctggtgctgagatggttccagagccacttgcagaggtccctggctactgtgcgctactctctcgaagggcgatgtagggtgacactcactccagggggtctagaacaaccgcctacattacacattctcccctgtagaacagattatggatgttgcaggctcagtatggctgtgagactgattccggcagtacatctgggcgacggagtgtttcttgtcgctccgcctcctccacccctgccttctgcacccctgctggagcttcctgagggcctccgggcagaggccctgtggggagttaatactgcccgacaggaacagaagttactcagttggctgcaggagcgggcagcaccaggtgcctgctacttgaaatgcctgcagcttttgaaagcgctgagggatttaggcgctcgtgggctggactctgctgcggctacccagtggggaagaattctgtcttcctatgttctgaagactgtcctgcttgctgtactcctgcggaagggggctcccggacagggctgggacgaagaacacttgggcagatgcctagaggagctggtacagtttctacgtgattgtctcctgaggcgtcacacactgtttcactgtgttctgggacccggaggcgctgccgcagaagttggtcctctccctaaagctctgagagaagctgccccagtggatcttcttgctgctttcgacggtcacgctcgagaactggccgctgctagattactctccacttggcagcggctgccccagctgctgagggcctacggtggaccacgttatctggcgcgatgtccaccaccgagatcccagcgcacacaagggtttctggaaggggaaccctag

SEQ ID NO: 50779 - DNA, 3774 bp, Artificial Sequence
  Description of Artificial Sequence: Synthetic coding sequence
atggcatcttgctcctttacacgggaccaggccaccagaagactccggggagcagccgctgctgccgctgctgcacttgccgctgtggtgactaccccacttctctcgtctggtacacccacggctctgatcggcacaggctcttcctgcccaggggcaatgtggcttagtacagccacaggctcccgttccgacagcgaaagcgaagaagaagacctgcctgttggggaggaggtttgcaaaaggggctacttgcggaagcaaaaacacggccatagacggtacttcgtgctgaagttggagaccgctgacgcacctgctcgcctcgagtactacgaaaatgcacgaaaatttcggcactctgtgcgtgctgcggcagctgcagctgctgccgctgccagcggtgccgctatccctcccttgatccccccaagaagggtaattactctgtaccagtgcttcagcgtgtctcagagagcggacgccaggtatcggcacctgattgctttgtttactcaagacgaatactttgcaatggtggcggagaatgagtccgagcaggaaagctggtacttactgctctcccggcttatcctggaatccaagaggcgtagatgtggaacccttggtgcgcaaccggatggcgaaccagccgctctggcggctgccgcagctgccgaaccccctttttacaaggatgtgtggcaggtgatcgtcaaaccaagggggctgggacatcggaaggaattgtcaggcgtgtttcggctctgtctgacagatgaagaggtggtttttgtgcggttgaacacagaagtcgcctctgtggtggtccagcttctgtctatcagacgctgtggacactcagaacaatacttctttctcgaagttgggagatctaccgtgatcggtccgggagaactttggatgcaggtggacgattgtgtcgtcgcacagaatatgcacgagcttttcctcgaaaagatgagagcgctttgtgctgacgagtacagggccagatgcaggtcctattccatttccattggagcccacctgcttacactgctcagcgccagacgtcatctgggattggtcccgctagagccgggaggatggctacgcagatctaggttcgagcagttctgccacctacgtgctataggcgatggcgaagacgagatgctgtttacaaggaggttcgtgacaccctcagaacccgtggctcactcaaggcgtggtcggctgcacttgcctagagggaggcggtccagaagagcagttagcgtgcccgcatcctttttccgcagactggcgccaagccccgcacgccctaggcacccagccgaagcaccaaacaatggcgctagactttcttctgaggtgtcaggtagcggctcaggcaattttggcgaagagggtaatcctcagggcaaagaagatcaggaggggtcagggggtgactacatgccaatgaacaactggggcagcggaaacggacgtggttctggcggagggcagggcagcaacggccaggggagcagcagccacagctccggaggcaaccagtgcagcggggaaggacagggtagtcggggaggccaaggctctaacggccagggatccggtggtaatcaatgctctcgggacgggcagggcaccgccggtggccatggctccggtggaggccagagaccagggggtggccatggctcaggcggaggccaggggccaggggacggccatgggtcgggaggtgggaagaacagcggcggagggaaaggctcaggctcaggaaaggggagtgacggagacggtgagcgagggaaaagcctgaagaagcggtcctacttcggtaaactcacacagtctaaacagcagcagatgcccccaccacctccacccccaccaccaccgccacctgccggaggaaccgggggaaaaggtaaatcgggcggacgtttcaggctttacttctgtgtcgaccggggagccactaaagaatgcaaggaagccaaggaggtgaaggacgcagaaatcccagagggcgctgcaagaggaccacacagggcacgcgctttcgatgaggatgaagacgacccttacgtccccatgcgcccaggcgtggccacgcccctggtgagctctagtgattatatgccgatggccccacagaatgtttcagcctcaaaaaagcggcactctcgtagcccgtttgaggatagcaggggctacatgatgatgtttcctagggtgtcacccccacccgcaccaagccctccaaaagcacctgacacgaacaaggaggacgatagcaaagacaatgacagtgagtcagactatatgtttatggcccctggggctggcgctatccccaagaatccacgcaacccacagggcggaagttccagcaagagctggtcgtcctatttcagcctgccgaatccattcaggtcctccccactgggtcaaaatgacaattctgaatacgtgccaatgctgccaggcaagttccttggaaggggactggacaaagaagtgagttacaactgggaccccaaggacgctgctagcaagcctagtggcgaaggttcgttcagcaagcccggagacgggggaagcccctctaagccttcagaccatgagcctcctaaaaacaaagctaaaagacccaacaggctcagcttcatcactaaagggtacaaaatcaagccaaaaccccagaagcccactcacgaacagcgcgaggctgattcctctagtgactacgtgaacatggactttactaagcgggaatcaaacaccccagccccatctactcaggggctgccagacagttggggtatcatcgctgagcctaggcagtctgccttctccaactacgtgaacgttgagtttggcgtaccctttcctaatccagcaaacgatttgtctgatctgctgagagccatcccacgagcaaaccccctcagtctggattccgcacgctggccactgcctccactgcctctgtccgctaccgggtcaaatgctatcgaagaggagggcgattatattgaggtgatctttaactctgctatgacgcccgcaatggctctggcggatagcgcgattcgctatgacgcagaaacagggcgaatctacgttgtggaccccttctccgaatgctgcatggatatcagcctgagcccttcgcggtgtagcgaaccccctcccgtcgccaggctcttacaggaggaggagcaggaaaggcgcaggcctcaaagtagatcacagagcttcttcgcagcagcgcgagccgctgtttcggctttcccaaccgactccttggaacgcgatcttagtccctcctctgcaccagcagtggcaagcgctgccgagccaaccctcgccctgagccaggtggtggcagccgcatctgctttagctgccgctccagggataggggcagccgcagccgcagcaggattcgactctgccagcgctcgctggtttcagcccgtggcgaacgctgcagacgccgaagctgttaggggcgcacaggatgtcgcgggtgggtccaaccccggagcccacaatccgagcgcgaatcttgcccgaggagacaaccaagcaggaggtgctgcggctgctgctgccgctccggagcctcctccgaggtctaggagagtccctagacctcctgagagggaagactcggacaacgatgatgacacccacgtcaggatggattttgctcgtagggataatcagttcgatagccctaagcggggacgttag

SEQ ID NO: 50780 - DNA, 7184 bp, Artificial Sequence
  Description of Artificial Sequence: Synthetic coding sequence
atgtggctgtcgggaaagtcccaggtccaaaaaagaggagctgttcgatacttgcaagcaccaccggttaatggagaggctagtgcttgccccgcaccacccactcacttagacaggactacttgcgctaggcggaggcctgctcggctacctcctccttggggagcggctggcattcggccagcccctcgggcttcgcgagcttcattttgggctcggttcccccctcactgcttcccttcaggatgcagcgggtcccgcgtcctcgagggcggagagattggcttcagattccgaggaggcagagtcgcagccgcagccctgagaagcagatgggcgcgaggtgacgctgctgcagctggttcaagagaaggccgtggtcggatgaacagagcgaagccaaccacagtgcggcgaccttccgcggcagctaagcctagcggccatcctcctccaggtgattttatcgccctgggtagcaaggggcaagccaacgaatccaaaaccgcatctacattattaaaacccgcaccctcaggcctaccaagcgaaaggaaaagggacgcagccgctgccctgagcagcgctagcgcactgaccggtctcacgaagaggccgaagttgagctcaacccctccactctccgctctgggcagacttgccgaggcggctgtggctgagaaaagggcgatctctccttctatcaaggagccctctgtcgttccgatagaggtattgccaacagtgctgctagatgaaattgaggccgctgagctcgaaggaaacgacgaccggatcgagggagtgctgtgcggagccgtgaaacagctcaaggtaacacgagcaaagccagatagtactctctatctcagcctgatgtatctggccaaaattaaacccaacatatttgcaaccgaaggggtgatagaggccctgtgtagcttgctgcggagggacgcatctatcaatttcaaggcaaaaggtaactctctcgtgtctgtgttagcttgtaatctactcatggccgcatacgaagaggatgaaaattggcctgagatttttgtaaaggtgtacatcgaggatagtctgggagaacgtatttgggtggactcgcctcactgtaaaacatttgtcgacaatatccaaacagccttcaacacacgaatgccacccagatccgtgttgttacagggggaggcaggacgggtcgccggagatctgggagcaggctctagtccccatcccagccttaccgaggaagaggattcccagaccgagctcctcattgcagaagaaaagctaagcccagaacaggagggtcagctcatgcctaggtacgaggagctggccgaaagcgtagaagagtacgtgttggatatgctgcgtgatcagctaaaccgtagacagcctatcgacaacgtgtcaagaaacttgttgcgcctactgacaagcacatgtggatacaaagaggtacggctgctggccgtgcagaagcttgaaatgtggctgcagaatcctaagctgactaggcccgcacaagacttgcttatgagcgtgtgcatgaattgtaacacacacggatccgaggatatggatgtgattagccacctcattaagatcagactgaagccaaaggtgctcctcaatcactttatgctctgtattcgcgaactgctatccgcgcacaaagataacttagggaccacaattaaactggtgatatttaatgagctgagcagtgccaggaatccaaacaacatgcaggtcctgtacacagccctgcagcactcaagcgaactcgctcctaaattcctcgccatggtatttcaggacttgctcaccaataaggacgattacctgcgtgcttcccgtgccttgttgcgggagatcattaagcagaccaagcacgagatcaatttccaagccttttgtctgggcctcatgcaggaacggaaagaaccccagtacctggagatggaatttaaagaacgatttgtcgtgcacattacggacgtcttggcagtctccatgatgttggggataacagcacaggtcaaagaggctggaatcgcctgggataaaggagaaaaacgtaatttggaagtgttaagatctttccagaatcagatcgcagccatccagcgcgacgcggtgtggtggttgcacaccgtcgtgccaagcatcagtaaactcgctccaaaagattacgtacattgcctgcacaaggtgttgttcactgagcaaccagaaacttactataaatgggataattggccacctgaatctgatcgcaactttttcctacgcctgtgctccgaggtccctattctggaagatacacttatgcggattctcgtgattgggctgtccagggagttgcctctgggacccgcagatgccatggagctggcagaccatctcgtcaagagggccgcagccgtgcaggccgatgacgtagaagtccttaaggttgggaggactcagctgatcgatgccgtcctcaatctctgtacttaccatcacccggaaaacatacagctgcctccaggttaccagccacctaacctggctatatccactctgtattggaaggcatggcccctgttacttgtggtggcggctttcaaccctgagaacatcggcctggccgcatgggaggagtacccaacccttaaaatgctgatggaaatggtcatgacaaacaactactcttatcccccatgcacactgactgacgaggagaccaggacagaaatgcttaaccgggaactccagactgcacagagggaaaagcaggaaattttggcttttgaggggcacctggccgcagcaagtacgaaacaaaccatcacagaatcctccagcttactgttgtcccagctcaccagcctcgacccccaatatgcggcacacactgccccaccctgcgcttgtcgccgagatctcggacctccgagacggccaccaccgcatatactagaccaggttaagagtttgaaccaaagcctaaggttgggccacttgctgtgtaggtcccggaatccggactttctgcttcatatcattcagcgccaagcgtcgagccagtccatgccctggctggccgatctggtgcaatcctcggagggatccctggacgtcctgcctgtccagtgcctgtgtgagttcctcctacacgacgcagtagatgacgccgcaagtggggaggaagatgatgaaggtgaaagcaaggaacagaaggccaagaagaggcagcggcagcagaaacaacggcaactcctggggcgactgcaggacctgttgctcgggcctaaggccgatgaacagaccacttgtgaggtgctggactacttcctcaggcgacttggctcctctcaggtggcctcaagggtgttagctatgaagggcgaaaccttgcctgcgctcccaaaggctggccctgctcacgaatgcctgccccaggggctctccctcgtactgagcgaaggttctctgcgggatggcgaggagaaagaaccgccaatggaggaagatgttggcgataccgatgtattgcagggttatcagtggcttttgcgcgacttgcctcggctccccctattcgattcagtgcgctccaccactgccttggcactccagcaagctatccacatggagacggatccacaaacgatatctgcctatttgatttacctcagccagcacacacccgtggaagagcaggcacagcactccgacctggctctagacgtggcaagactcgtggtagagcgcagcacaatcatgagccatcttttttccaagttgtccccctcagctgctagtgatgcagtgctgagtgccctgctctccatcttctcccgctatgtacgacgaatgcgtcagtcaaaagagggagaggaagtttatagctggagcgaatcccaggaccaggtattcctgcgatggtcctctggcgagactgctacgatgcacattctggtggtgcacgcgatggttattctgttaacactgggccctccacgcgctgacgactctgaattccaagcccttctagacatatggtttcctgaggagaagcctctccctactgccttcctggtggacacaagcgaggaagctctgctgttgcccgactggctgaaattgcgaatgatcagatccgaggtgcttcgattggtggatgcagccctgcaagaccttgagcctcagcaactgctgctgtttgtgcaaagtttcggaattcccgtgtcttcaatgtctaagctgctgcagtttctggaccaagcagtggcgcacgacccccaaacacttgaacagaacattatggacaagtccaaaatgcctggaacatgcggcgtaggctcccacactctcacagaaccccaacctggtcaggcctttggagcttgggttcgcgctggagtcaccctcctgagattcgcggactatatggcccacttagtagaagttcagcatgagcgcggtgctagcgggggtcagaccttccatagcctgctaaccgctagtctgcctcccagaagggactcaactgaggctcccaagccaaagtcttcgccagagcaaccaatcggccagggtaggataagggtcggcactcagcttcgtgtactaggacctgaggatgatctggcgggaatgtttttacagatcttcccactttctccggatccgcgttggcagtcttccagcccgcgacctgtagcattggcgttgcaacaagccctgggacaggagttggcaagagtggtccaaggctcacccgaggtcccgggaattaccgtccgtgtcctccaggccttggctacccttttaagctcaccccacggcggagcactggttatgtctatgcaccgatcacacttcttggcttgtcctctgctgcgacagctctgtcagtaccagcgatgcgtcccacaagacacgggattctctagtctgtttctgaaggtgctcctgcagatgctgcaatggctggatagccctggagttgaaggcggtcctctgagggcacaacttcgcatgctggcctcacaggctagcgccggacgaaggttgtccgatgtgcggggaggactcttgcggctcgccgaggccctcgccttcagacaggacctcgaggtggtctcctccaccgtgagagcagtgattgcaacgctgcgtagcggagagcagtgctcagtggaacctgatctgatatccaaggttctgcaaggcctgatcgaagtaagaagtcctcatctggaggagctgttgacggcattctttagtgcaaccgcagacgccgctagccctttccctgcatgtaagcctgtggtggttgtcagctcactgctgctccaggaggaagagccactggcaggcggtaagcctggagccgatgggggttcactcgaagctgtgaggctgggcccttcatccggcttgttggtggactggctggaaatgctggacccggaggtggtgtctagctgccctgacctgcagttaagactgttattcagcagacgcaaggggaaaggtcaagcccaggtaccatcctttcgtccctacctgctcacattattcactcaccagagcagttggccaacactacatcagtgcatccgagttctcctgggcaaatcccgcgaacagcgtttcgaccctagcgcttcattggactttttgtgggcatgcatccacgtgccaagaatttggcagggtcgtgaccaacggaccccccaggccggattgggccgaaaacgaagagaggagctagtgttacgggttcaaggacccgagctcattagcctcgtcgagctgatactagccgaggcggaaacacgctcccaagacggagataccgcagcctgcagccttatccaggccagactgcccctccttctatcatgctgctgcggtgatgatgagagtgtgaggaaggtgaccgagcacctgtctgggtgcattcagcagtggggcgacagcgtgttgggcagaaggtgccgtgatctgctcctgcagctgtaccttcaaaggccagagctgagagtgccagtccccgaagtgctgcttcactccgaaggagccgcttcgtcatccgtctgcaagttggacgggttgattcataggttcattaccttgttggctgatacctccgacagccgagcactcgagaaccgcggagccgatgcttcaatggcctgcaggaaactggccgtggctcaccccttgctgcttctccgccatctgcccatgattgctgcattactgcatggacggacacatctgaatttccaagaattccgacagcaaaaccatttgagttgttttctccacgtgctggggcttttagaattgctgcagccccatgtcttccggagcgaacaccagggcgctctttgggactgtctactcagcttcatcagactactgcttaattatcgaaaatcgtcccgccatctcgccgcatttattaataagtttgtgcagttcatccacaagtatattacgtacaatgccccagctgcaatcagcttcctccaaaagcacgcggatcctctgcatgacctttccttcgataattcggatcttgtaatgctcaaatccctcctggcaggtctttccctgccaagtcgtgacgaccgtacggaccggggactcgacgaagaaggggaggaagagtcatctgccggatcgctgcctctagttagcgtcagcctgtttacaccacttactgcagcagaaatggccccttatatgaaaaggctgtcccgcggtcaaacagtggaggacctgctggaggtgctgtccgacattgacgaaatgtcccgccgaagacctgagatactatcctttttcagcaccaacctgcagaggcttatgtcttcagcggaggagtgttgccgcaacctagccttctccctcgcgctgcgaagcatgcagaattcaccatcgattgccgctgcctttctcccaacttttatgtactgtcttgggagccaggatttcgaggtcgtacagactgcgctccgtaatttgcctgagtatgcgttattatgtcaggaacacgccgctgtcttgctgcatagggcattcttggtgggcatgtacggacagatggacccaagcgcccaaatatccgaagcactcagaattctgcacatggaggctgtcatgta

SEQ ID NO: 50781 - DNA, 6572 bp, Artificial Sequence
  Description of Artificial Sequence: Synthetic coding sequence
atgaatagggccaagcctacaacagttagacgaccgtctgccgcagcgaaaccatctgggcacccaccccctggagacttcattgcactgggatcaaaaggacaggctaatgagtctaagacagcttccacactgttgaaaccagcgcctagcggccttccaagtgaacggaaaagagatgccgctgcagcactgagctcagcttcagccctgactgggttgactaagagacctaagctctcatcaaccccccctctgtccgctctagggaggctagccgaagctgctgtagccgaaaagcgcgcaatttccccgtctattaaggagcctagtgtcgtgccgatagaagtcctccctacagtgctgctggacgagattgaagctgcagagctggagggcaacgacgataggattgaaggggtcctgtgtggggcagtgaaacaacttaaggtgacccgagctaaaccagacagtactctgtaccttagtttgatgtatctggccaagatcaagcccaacatctttgctacagagggagtgattgaggccctgtgttctctcttgcgccgagacgcctcaatcaactttaaagcaaagggaaactcacttgttagtgtgctggcctgtaatctgctgatggccgcatatgaagaggatgagaactggccagagatattcgtcaaggtatacatcgaggactcactaggcgaacggatttgggtggattctccacactgcaagacctttgttgacaacatccagacggctttcaacacaagaatgccacctaggtcagtgctccttcagggggaagccggtagggtagctggggatctgggggcaggctcctccccacacccctcacttaccgaagaggaggattctcagactgaattattaatcgcagaggagaagctcagccctgagcaggagggccagttaatgcccaggtacgaagagctcgctgagtctgtcgaagaatatgttctggatatgctgcgggaccagttaaaccgcagacagccaattgacaacgtaagcagaaatctgttgcgtctgctcacctcgacttgcggctacaaagaggttagactcctggctgtccagaagctagaaatgtggctgcagaatcctaagctgacaagacccgctcaggatcttcttatgtccgtgtgtatgaattgcaacacgcatggctccgaagatatggacgtgatttcacacctaatcaagatcagactgaagcctaaggttctgctgaatcattttatgttgtgcattcgcgaattactgtccgcgcacaaagataatctgggcaccacaatcaaactcgttatctttaacgaactgagctctgcccgtaaccctaataacatgcaggtgctatacacggccctgcagcactcctcagagctcgccccaaagttcctagccatggtcttccaggatctccttactaataaggatgactaccttcgggcatccagagccttacttagagaaatcattaaacagactaagcacgagatcaatttccaggccttctgcctcgggctaatgcaggagcgtaaagagcctcagtatctggaaatggagttcaaagagcgcttcgtggtacatattactgacgtgcttgcggtgtctatgatgttgggcatcacggcccaggttaaggaagccggaatagcctgggacaagggagagaaaaggaaccttgaggtcctcagaagttttcaaaaccagatcgcggcaattcaacgggacgcagtgtggtggttacatacagtggtgccctcaattagcaagcttgccccaaaggactacgtccactgcctacataaggtgctgtttacggaacagccggagacatactataagtgggacaactggccccctgaatctgatagaaacttcttcctgcgcctgtgctctgaagtgcctattttggaggacacccttatgaggattcttgtgattggactgtctagagagctaccccttgggcctgcagatgccatggaattggcagatcacctggtcaaacgcgcagccgcagtgcaggcagatgacgtggaggtgctgaaagtgggtcggacacaacttatcgacgctgtcctcaatttgtgtacatatcatcaccccgagaacatccagctgcctcccggataccagcccccaaaccttgccattagcacattgtactggaaagcctggcctttattattggttgttgctgcattcaaccccgagaatatcggattagccgcatgggaggaataccccaccctgaaaatgctgatggagatggtgatgacaaataactattcatacccgccttgcacattgacagacgaggaaactcgtactgagatgttgaatagggaactccagactgctcagcgcgagaagcaggaaatcctggcctttgagggtcacctcgccgctgccagcacaaaacagaccatcacggagagcagctccctgttgctctctcaattgaccagcctggatcctcagggcccaccaagacgcccaccaccacatatcctggaccaggtgaagtcactcaatcagtcactgaggctgggtcatttgctttgcaggtctcggaatcccgatttcttgctccacatcatacagcgtcaggctagcagccaatcaatgccttggctggccgatttggtgcagtcctcagagggctcactagacgttctcccagtgcagtgcctgtgtgagtttctgttgcacgacgctgtcgatgacgccgcttccggggaggaggatgacgaaggagaatctaaggagcagaaggctaaaaagcgccagcggcaacagaagcaaaggcagctgttgggccgtctccaggacctgttgctcggcccaaaagccgatgagcagactacctgtgaagtgctcgattatttcttaagaaggctcgggagttcgcaggtagcgtctcgcgtgctagccatgaaggggctttcactagtcttaagcgaagggtcactgagggacggcgaggaaaaggagcctccgatggaggaggatgtaggggatactgacgttctacagggctaccagtggctgttgcgggatcttcctcgattacctctcttcgacagcgtacggagcacgacagcactcgcgttgcagcaggctatacacatggagaccgatcctcagacgatttcagcctacctgatttatttatcccagcacacaccagtggaggagcaggcgcagcactcagacctagcccttgatgttgctaggcttgtggtcgagaggtctaccattatgagtcacttgttcagcaagctctcccctagcgccgctagtgatgcggtgctgtctgcactgctcagcatttttagtaggtatgtccgcaggatgagacagtccaaggaaggagaagaggtgtattcatggagtgaatcccaagatcaggtttttctaagatggtctagcggtgaaacggcaacaatgcatattctcgtcgtccatgctatggtgattctcttgacgctggggccacctagagccgacgactcagagttccaagcactgctagacatctggtttccagaggaaaaacccctgcccaccgctttcctggtggatacaagcgaggaggcccttctgttacccgactggctaaaactgcgcatgattcgttctgaagtactgaggcttgtggatgctgccttgcaagacctcgagccccaacaactgcttttatttgttcagagttttggcatcccagttagtagcatgagcaaactgctccagttcctggatcaggccgttgcacacgaccctcagactctggagcagaacatcatggacaagaattacatggcccatctcgtggaagtccagcacgagcggggagctagtggaggccagactttccactccttattgacagcatccctgcccccaaggagggactcaactgaggccccaaaaccaaagtcaagtcccgagcagcccatcggacagggacggatccgcgtgggcacacagttgagggtgctcggacccgaggatgacttggctggtatgttccttcaaatttttcccttgagtcccgacccaaggtggcagtcaagtagccccagaccggttgctctcgccctgcaacaagctttaggccaggagctggcgagagtcgtacagggctctcctgaagtacccggaattaccgttcgggtgctgcaagcgctcgccacccttctttcaagcccacacggaggtgccttagtgatgtcaatgcaccggagccacttcctggcttgccccctcctgaggcagctatgccagtatcagaggtgtgttccacaggataccggcttcagctctctgttcctcaaagtgttgctgcagatgctgcagtggcttgacagcccgggagtggaaggagggcctcttcgtgcccagcttcgcatgctggcaagccaggcaagcgccggacgtaggcttagcgatgttagaggaggactgttgaggctagctgaggctctcgctttccgacaagacctggaagtggtttccagtaccgttcgagctgtgatagccacactcagaagtggagaacagtgcagcgtggagcctgatcttatatctaaggtgcttcagggtctgatcgaggttcgttcaccccatctggaggagctgctgaccgccttcttcagcgctactgcggacgctgcaagcccattccctgcctgcaagccagtagtggtggtcagttccctactcctccaggaagaggagcctctcgctggcggtaaacctggagctgatggcggatcactagaagccgtgagactgggaccctccagtggtctgctggtcgactggctggagatgctggaccctgaagtggtgtccagttgccccgatctgcagctgcgcctgctcttttcccgcagaaaggggaaggggcaagcccaggtcccaagctttcgtccgtacctgctgacattgtttacccaccagtctagctggccaactttgcaccagtgtatcagggtactgctcggcaagagccgtgagcaacggtttgacccatcagctagcctcgacttcctgtgggcctgcattcacgtgcctagaatctggcaggggagagaccagaggactcctcagaagcgtagggaagagctcgtcctgcgggtgcagggccctgaactgatcagtcttgtcgaactgattctggctgaagccgagacacgtagccaggacggtgatacagcagcgtgttcattaatacaagccagactgccgctgctcctctcatgctgctgcggggacgatgaaagcgtaagaaaagtgacagagcacctgtcaggatgtatccaacagtggggggattccgtcctgggacgacggtgcagggacttgctgctgcagctgtacctccagaggccagaactgcgggtccccgtcccagaagtgctcctgcattcggagggagcagccagcagtagtgtgtgcaaacttgatgggcttatacatcggtttattactctgttggccgacactagcgattccagggccctggagaatcggggtgccgatgcgtccatggcttgtaggaagctggccgttgctcatcccctcctgctgctgcgccaccttccgatgatagctgccctgctccacgggcgaacccatctgaatttccaggagttcagacagcaaaaccatctgtcttgctttctgcatgtactgggcctactggagctcctgcagccacacgtctttagatccgaacaccagggggcactgtgggactgcctgctcagcttcatccgtttattgttgaattaccggaagagttccagacatctggccgcttttatcaataaattcgtgcagtttatacacaagtatatcacctataacgcccctgccgctatttcctttctgcagaaacatgctgacccactgcatgacctgtcctttgataactctgatctagtgatgctcaagagcctgctcgcaggtctttcactgcccagccgagacgataggactgaccggggattggacgaagaaggggaggaggaatcgagtgccggatcactgcctctggtcagcgtaagcttatttacgcccctcaccgcggcagagatggctccttacatgaagagactgtcccgaggccaaactgtcgaggacttactcgaggtcctctcggatatagatgagatgtctagacgcagaccagaaatactctctttcttttctacgaacctgcagagactgatgtcgagtgccgaggaatgctgccgcaatttggccttctcactcgccctcagatccatgcagaattcaccctctatagctgctgcattccttccaacgttcatgtactgcctgggatctcaagattttgaagtcgtgcaaactgcactgcggaacctgcctgaatatgcgctgctgtgtcaggaacatgcggctgtgcttttgcaccgggcattcttggtcggaatgtacggccagatggaccccagcgcccagatatcggaggccttacgtatcttgcacatggaagctgtcatgta

SEQ ID NO: 50782 - DNA, 3612 bp, Artificial Sequence
  Description of Artificial Sequence: Synthetic coding sequence
aaagaccagcagacagtgataatgactgagtgtacctctctccagtttgtttctccatttgcgttcgaagcaatgcagaaagtggatgttgtgtgtttggcatcactgtcggatccagagttacggttactcctgccatgcctggtgcgcatggccctttgcgctcctgcggaccaatcacagtcctgggcccaagataagaagctgattctccgcctcctgtccggagttgaagcagttaacagcattgttgccctcctgtccgtcgacttccacgcccttgagcaagacgccagtaaggaacagcagctccgtcacaaattgggcggtgggtcgggagagagtattctggtgagtcagctgcagcatggactcaccctcgaatttgaacactccgatagtccccgaagattgagactggtccttagcgaactgctagcaatcatgaacaaagtgtccgagagtaatggggagttctttttcaagtcatctgagctgtttgagagtccagtgtacctggaggaagcagccgatgtgctgtgcatcctccaggctgaactgccgagtctgctgcctatcgtggatgtggcagaagcgctgctccatgtgagaaatggcgcatggtttctgtgcctgttggtggccaacgtccctgatagctttaacgaggtctgcagaggtctgattaagaatggggaacggcaggatgaagaaagcctggggggaagacggaggactgacgctctccgattcttgtgtaagatgaatccctctcaagccctcaaggtgagaggtatggtggtggaggaatgtcatttgcctgggctgggagtggctctgacccttgatcatactaagaatgaggcctgtgaggacggcgtaagcgatctggtttgcttcgtgagcggcttgctcctcggcaccaacgccaaggtgaggacctggtttggcacattcatccgaaatgggcagcagaggaaaagagaaacctctagcagtgttctttggcagatgagacgtcaactgctgctcgaactgatgggcattcttccaacagtcagatccacacggatcgtggaggaggccgacgtggatatggagcctaatgtgtccgtatactcaggcttgaaagaggagcacgtggttaaggcctctgcccttctgagactgtattgtgcgcttatgggcattgccggtctgaaacctacagaagaagaggccgaacagcttttgcaactgatgactagccgccctcccgcaacaccagccggtgtcaggttcgtcagtctttccttctgcatgctgctggccttctctaccctcgtctctacgcctgagcaggaacagctaatggtcgtgtggttgtcctggatgattaaagaggaggcctatttcgaatccaccagcggggtgtccgccagcttcggcgaaatgctgttgttggtggccatgtatttccactcgaaccaactctcggccatcatagatctggtctgtagtactctggggatgaagatcgtaataaaacctagcagcttgtctagaatgaagacaatctttacacaagagatctttacagagcaggtggtgactgctcacgctgtaagagtgccggtgacatccaacctatcggccaatatcacgggctttctgcctattcattgtatttatcagcttcttaggtcacgctccttcacgaagcataaggtttctatcaaggactggatctataggcagctgtgtgaaacttccaccccactacaccctcaactccttccactaattgatgtttatataaatagcatattgacaccagcttcaaagtcaaatcccgaagcgaccaaccagcctgtgactgagcaggaaatactcaatatcttccagggggtgatcggaggggataacattaggctcaaccaaaggttttctataaccgcccagctgctcgtgctgtactatatcctgagctacgaagaggccctcttggcaaatacaaagacccttgctgctatgcagcggaaaccaaaaagctacagcagctcccttatggaccagattccaatcaagttcctgatcaggcaggcacagggccttcagcaggagctcggtggcttgcattcagcattgctgaggctgctggccacaaattaccctcacctctgtattgttgacgattggatctgcgaggaagagattaccggtactgacgcactcctgcgcagaatgcttcttactaacaatgcaaaaaatcacagccctaaacagctccaggaggccttctcggctgtacccgtgaataatacgcaggttatgcagatcatcgagcatttgactctgctgagcgcctctgagcttattccttatgcggaagttctcactagtaatatgagtcagctccttaattccggggtgcccaggcgcattctccagaccgtcaacaaactctggatggtactgaacaccgttatgcccaggcggttatgggtcatgacagtgaatgcacttcagccgagcattaaatttgtgcgccagcagaagtatacccagaacgaccttatgatcgaccccctgattgtattgagatgcgatcagcgggttcacagatgtccgcctcttatggatattacattgcacatgctcaacggatacctgctggcctccaaagcatacctgagtgcccacctgaaagagacggagcaggatcgtccttcccagaacaataccattggcctggtgggtcagaccgacgcccctgaggtgaccagagaggagctgaaaaacgctttgctggctgcgcaggactcggccgcagttcagatactgctggagatctgtctgcctacagaagaggagaaggccaacggtgtcaacccagatagtctgctcaggaatgtacaatcggtaattactacttctgctccgaataaaggtatggaagaaggcgaagacaaccttttgtgcaatttgcgggaggtccagtgtctcatctgttgtctgctgcatcagatgtacatcgcagatcccaacattgccaagctcgttcactttcaggggtacccttgcgagttactacctctcaccgtcgccggaataccctccatgcacatctgccttgatttcatccctgaactgatcgctcaaccagaactggaaaagcaaattttcgctatccaattgctgtcacacctgtgcatccagtatgccctgcccaaatccctgagcgtggccaggctggcagttaacgtgatgggcaccctccttaccgttctgacacaggcgaagaggtatgcttttttcatgcccacactgccatccctcgtgagcttctgccgcgctttcccgcctctctatgaggacataatgtcactcctgatccaaatcgggcaggtatgtgcctcagacgtcgcaacgcaaacacgtgatattgacccgataattacgaggctgcaacagattaaagagaagccttccgggtggtctcagatttgtaaagacagttcttacaagaacggcagccgcgacaccgggtccatggacccagacgtgcagctttgccattgcatcgaaaggaccgtaattgagataatcaatatgtctgtatccggaatctag

SEQ ID NO: 50783 - DNA, 3615 bp, Artificial Sequence
  Description of Artificial Sequence: Synthetic coding sequence
atgaaggaccagcagacggtcatcatgactgaatgtacatcactccagtttgtgagcccctttgcattcgaagctatgcagaaggtggatgtcgtttgcctggcatctctttctgatccagagctgcggctcctgctgccctgtctggtgagaatggccttgtgcgccccagctgaccagtcccagtcatgggctcaggacaagaaactcatcctccggttgctgtccggcgtggaagcagtcaacagcattgttgcactactatccgtggattttcacgcattggagcaagacgcctcgaaggaacaacagctgcggcataaattaggaggcggaagcggggaatccatccttgtctcacagcttcaacacggcctcaccctggaattcgagcacagtgattcccctaggcgtctgcgcctagtcttgagtgaactgttggcaatcatgaacaaagtgtccgaatcgaatggggaatttttcttcaagtccagcgagctgtttgagtccccagtttatctggaggaggctgcagatgtcctctgtattctccaggccgagctgccaagcctattaccaattgtcgacgtggctgaagcacttctccacgtacgtaatggggcttggtttttgtgccttctggtggccaatgtgccggatagttttaatgaggtgtgcagaggcttgatcaaaaatggggagcgccaagacgaagagagtctgggcggtcgcagaaggaccgacgcgctcagattcttatgcaaaatgaatccaagtcaggctctcaaggtgagaggtatggtggtggaagagtgtcacctgccagggctgggggtggccctcaccctcgaccatactaagaacgaggcctgcgaggacggtgtgtctgaccttgtctgctttgttagcggcctcctgttggggacgaacgctaaagtccgcacatggttcggaacctttattagaaacggccaacaacgaaagagagagaccagctcatctgtgctttggcagatgaggaggcaattgctcctcgaactcatgggaatcctacccaccgtacggagcaccagaattgtggaggaagccgacgtggatatggaaccaaatgtgagcgtgtactcaggcttaaaggaggaacatgtggtgaaggcctcagccctgctgcgattgtattgcgccctgatgggtatcgccggactaaagccaactgaggaagaagcagagcagctccttcagctgatgacatctcgccctccggcaacgccagcgggagtgcgttttgtgtctttatctttttgcatgctcctggccttctctaccctggtatcaacacctgaacaagaacagctgatggtggtatggctgagctggatgatcaaggaagaggcctacttcgagagcacaagtggggtctccgcatcctttggcgagatgctgctgttagtcgcaatgtattttcatagtaaccagctgtccgccattatcgacctggtgtgctctaccctcggaatgaaaatagtaataaaaccctccagtctcagtaggatgaaaaccattttcacccaggagatttttaccgagcaggtggtaacagctcatgccgtgcgcgtgccggtaaccagcaacctgagtgcaaacattactggttttctcccaattcattgtatttaccagctgctgagaagccggtcattcaccaagcacaaagtgtccataaaggactggatctatagacagctgtgtgagacgtcaacccccctgcatccccagttgcttcccctgatcgatgtctacattaactccatactgactccggcatctaagtccaaccccgaagccacaaaccagccagtgaccgagcaagagattctcaatatctttcagggagtcatcgggggagacaatattagactaaaccaacgtttttctattaccgcccaactcctcgtcctgtattacatcctgtcttacgaagaggccttgttggccaacaccaagactctggccgctatgcaaaggaaaccaaaaagctactctagttcattgatggaccagatcccaataaagtttcttatcagacaggcacagggtctccaacaagagcttggcggactgcattctgcgttgttgaggttactggctacgaattatccacatttatgcattgttgatgactggatctgcgaagaggagatcactggaactgatgccctacttagacgtatgctgctgacgaataacgctaagaatcactcccccaaacagctgcaggaagccttctccgcagtgcctgtgaacaacacccaggtgatgcagataattgagcacctgactctcctcagtgcaagcgagctaatcccctatgccgaggttctcactagtaatatgagtcagctactgaattccggagtccctcgtaggattctgcagacagtgaacaagctgtggatggttctgaatacagtcatgccaagacggctgtgggtgatgaccgtcaacgcattacagcccagcatcaaattcgtgagacagcagaaatacactcaaaatgacctgatgatcgatcctctgattgtcttgagatgtgatcagcgtgtgcaccgttgtccaccattaatggacatcaccttgcatatgctgaacggctatctcctcgcttcaaaggcctacctttcagctcatctgaaggagaccgaacaggataggccaagccaaaataataccattggcctggtcggtcagacagacgccccagaggtcaccagagaggaactgaaaaatgcactgctggccgctcaagattctgccgcagtacagatcttgctggaaatatgtctgcccactgaggaagagaaggccaatggagtaaacccagattccttgctccggaacgtccagtctgtgattaccacgtctgctcccaacaaaggcatggaagagggggaagataatctcctatgtaacctcagggaagtccagtgtcttatttgctgcttgctccaccaaatgtatattgccgaccctaatatcgcaaagctggtccactttcaggggtacccctgcgagctcctaccactcactgtggccggtattccgtccatgcatatctgcctggactttatacccgagctgatcgctcagcctgagctagagaagcaaattttcgctatccagctgctgtctcatctatgtatccagtatgctctccccaagagtctctctgtggctcgactagctgtgaatgtaatgggtactctgctcactgtcctgactcaagccaagagatatgcattttttatgccaacactgccatctttggtgtccttttgtcgtgcctttcccccactgtatgaggatattatgtctcttctgattcagatcggacaggtgtgtgcctctgatgttgcaactcagacgagagacatcgatcccatcataacgcggttacagcaaataaaggagaagccctctgggtggagccaaatatgtaaggattccagttataaaaatggatcgcgcgatacaggtagcatggatccagatgtccagctgtgccattgtattgagcgaaccgtaatcgagattataaacatgagcgtaagcggcatctag

SEQ ID NO: 50784 - DNA, 3060 bp, Artificial Sequence
  Description of Artificial Sequence: Synthetic coding sequence
atgtccgcgctatgtgatcccccaggcgcaccgggaccccctggacccgcaccggctacccacgggcctgcgccactctctgctcaggaactgtcgcaagaaatcaaagcattcctgacaggggtggatcccatcctcgggcatcagctgagcgccagggagcacgcaaggtgcggtttactgctccttagatcgttgccgcctgctagggctgcagttcttgatcatctccgaggcgtgttcgatgagagtgtccgcgcacatcttgcagcactcgatgagacaccggttgcaggccctccccacctcagacccccaccgccttcccacgtcccggctggtggaccagggctggaggacgtggtgcaggaagtacaacaggtgctctccgagttcataagagcgaatccgaaggcttgggcccctgtgatatcagcgtggagcatcgatcttatggggcagctgtccagcacttactccggccagcaccagcgggtgccccacgccactggcgcacttaacgagctgctccagctgtggatggggtgtagagctactcgcaccctcatggacatctacgtgcagtgtctctcggcattgataggtagttgtccggacgcttgcgtcgacgccctgctggatacctcagtgcagcacagcccgcacttcgactgggtggtcgctcacattggatctagctttccgggtacaatcatttcaagagtattgagctgcggactcaaagacttttgtgtccatggcggtgccggaggtggggctggatctagcggcggaagtagcagccagactcctagcacagaccctttccccggaagccccgctatcccagctgaaaagagagtacctaaaatagctagcgtggtcgggatcctgggtcaccttgcgtccaggcacggcgacagcattagaagagagttactgagaatgttccacgatagcctcgcaggcggatccggcggacgctctggggacccctccctccaagccacagtgcccttcttactacagctcgcggtgatgtctccagcacttctgggcacagtgagtggggaacttgtggactgcctgaaaccgccagccgtgctgagccagctacaacaacatcttcagggtttccccagggaagagctggacaatatgcttaacctggctgtgcacctggtgtcccaggcatcaggcgcaggcgcatacaggttattgcaattcttggttgatacggcgatgccagcctctgtaatcacaacccagggccttgccgtccccgataccgttcgcgaagcctgtgaccggttaatccaactgttgctgctacacctgcaaaagctggtgcaccaccgcggtgggtctcctggtgaaggggtcctggggccaccgcctccaccgagactggtgccttttctagatgccttgaagaaccatgtgggggagctttgcggagagactctgcggttggagagaaaaaggttcctgtggcagcatcaattgctgggactgctttcagtttataccaggccgtcgtgcggtcctgaggccctcggccacctcttaagcagggcccgaagtcctgaagaactcagcctggccacacagctgtacgccggtctcgtggtgtcccttagtggattgctgccactggcatttcgctcgtgtctcgctcgggtgcacgcagggaccttgcagccacccttcactgcaagatttctgaggaatctggcgctgctggtgggctgggaacaacaggggggagagggccctgctgccctgggggctcattttggcgaatctgcaagtgctcacctgagtgatcttgctccactccttctgcatcctgaggaagaagtggccgaggccgctgcatccttgcttgccatttgcccttttccatcagaggcactgagcccctcgcagctgctgggattagtacgcgcaggtgtacacagattcttcgcctcgctgcgcctgcacgggcctcccggagtggccagcgcttgccagttgcttactagactgtcacaaacaagtcccgctggtttgaaagccgtcctgcagctgctggtggagggggctctgcacaggggtaacacggaactatttggcggtcaagtcgatggtgataacgaaactctgtctgtggtcagcgcctctctggcttctgcttctcttctggacaccaatcgacggcacaccgccgctgtaccgggtcccggagggatttggtccgtattccacgcaggagtgatagggaggggtctaaaacctccaaagttcgtgcagagcaggaatcagcaagaggtgatatataatacacagagtctcctgtcccttctagtccactgctgctcagctccaggagggactgagtgcggcgaatgttggggagctcccattctttccccagaggctgctaaagcagtagcagtgacactggtcgagagcgtttgccccgatgccgctggagctgagctggcatggccgccagaggagcatgctcgagcaactgttgaacgggatttgcgtatcgggaggcgcttcagagaacagccacttctcttcgagctactcaaacttgttgccgcagcgcctccggctctgtgctattgttcagtgctgctgcggggacttctcgcagcactgctgggccactgggaagcctctagacatccagatactacacattccccctggcatctggaagcctcatgtactctcgtggcggtgatggctgagggaagcctcttaccgccagcattaggtaatatgcacgaagtgttttcacagctcgcaccgtttgaggtgcgtctgctccttcttagtgtgtgggggtttctccgggagcacggacctctgccccagaaatttattttccagagcgaacggggtcggtttatccgcgatttctctcgagagggcggaggggagggaggcccacatcttgcagtgcttcactccgttttacatcgaaatatcgaccggcttggactgttttccgggcgtttccaggcacccagccctagtacacttctccgccagggcacttag

SEQ ID NO: 50785 - DNA, 1659 bp, Artificial Sequence
  Description of Artificial Sequence: Synthetic coding sequence
atgcttgaccataaggacctcgaagccgaaattcatcccctgaagaatgaagagcgcaaaagtcaggaaaacctcggaaacccatctaagaatgaggataacgttaagtccgctccgcctcagagccggctgtccaggtgcagagccgctgccttctttctgagcctgtttctgtgtctgtttgtggtgttcgtcgtgtcctttgttatcccctgccctgaccgccctgcgtctcaacggatgtggagaatcgattatagtgccgctgtgatatacgatttcttagctgtggacgatataaacggggacagaatccaggatgtgctcttcctctataaaaacaccaactcttctaataatttcagtcgaagttgcgtagatgaaggattcagtagtccatgtaccttcgccgctgccgtgagcggggcaaacgggtctactctgtgggagagaccggtggcgcaggacgtagctctcgtcgagtgcgccgtaccgcaaccaaggggatctgaagcgccatccgcgtgtatcctggtcggcaggccctcctctttcattgccgtgaatctcttcactggagagaccctgtggaatcattcctcttcgttcagcggtaacgcatcaatcctgagcccgcttttgcaagtgccagacgtggacggtgacggtgcccctgacctccttgtcctgacacaggagcgagaagaagtcagtgggcatctctactccggctctactgggcaccagatcggcctcaggggatccctgggtgtagatggggaatctggattcctgctgcacgtgacccggacaggcgctcattacattctgttcccatgtgctagctccctgtgtggttgcagcgtgaaaggcctgtacgagaaggtaacgggatcagggggtccctttaaatcagatccccattgggaaagcatgcttaacgccactactcgtcggatgctaagccacagtagcggcgctgtgcggtatctgatgcacgtaccaggtaacgccggagccgatgtgctgcttgtaggcagtgaggcatttgtcttgctggacggtcaggagctgacacctcgctggacccctaaggccgctcacgtccttagaaagcccatttttggcaggtacaagcctgataccctggccgtggccgttgaaaatggtacgggtacagaccgtcaaattctattcctggatctcggaacaggcgctgtgctctgctccctggccctccctagcctgcccggaggtccactgtcagctagtctccccaccgctgatcacagatccgcctttttcttttggggtctgcatgaactgggaagtacaagtgaaaccgaaactggcgaggcaagacacagcctgtatatgtttcatcctaccctacctcgcgttctgctagaattagcaaatgttagcacgcatattgtggcatttgatgcagtgctcttcgagccaagtcggcacgcagcctatattctgctcaccggcccagctgacagcgaagccccagggctagtgtctgtcatcaaacacaaggtgagagatctagtgccctcttcccgtgtggtgagattaggcgaaggcggacctgacagcgaccaagccataagggaccgtttttctcgcttacgataccaatccgaggcgtag

SEQ ID NO: 50786 - DNA, 1659 bp, Artificial Sequence
  Description of Artificial Sequence: Synthetic coding sequence
atgctagatcataaagacttagaagccgaaatccatcctcttaagaacgaagagagaaaatcccaagagaacctgggcaatccgtcaaaaaatgaggataatgtcaagtcagcgcctccacagtcccggctgtcccggtgccgagcggcagctttctttctgagtctcttcctgtgcctattcgtagtcttcgtcgtgtccttcgtgatcccttgtcccgataggcctgcttcacagagaatgtggcggattgattactccgcagcagtaatctacgacttcctcgccgtggacgatatcaacggcgatcggatacaagatgttctcttcctctataaaaataccaattcttctaataacttcagtcgctcatgcgttgatgagggattctcttccccatgtactttcgccgctgctgtgtctggcgcaaatggctccacattatgggaacggcctgtagcccaggatgttgcgctggttgaatgtgcagtgcctcaaccaagaggttcagaagccccatctgcatgtatcctggttggccgacccagctctttcatagcggttaacctgtttacaggggagactttgtggaaccatagtagctcgttctccgggaacgctagtattttatccccacttctacaggtgcccgacgttgacggagatggcgctccagacttacttgtgctgacccaagaaagagaggaggttagtggccacctgtactctgggagtacaggtcatcaaatcggcctgcgagggtcgttgggcgtggatggagagtccgggttcctactgcacgtgacgaggaccggcgcacattatatcctgtttccttgcgcctcaagtctctgcggttgcagcgtaaaaggcctatatgagaaggtgacaggctccggaggcccttttaagagcgacccccattgggaatccatgctgaacgctaccacacggcgaatgctgtcgcactcatccggagctgttcggtacctgatgcatgtcccgggtaatgccggagcagatgtgctgttagtgggatcagaggcctttgtcttgctggacggtcaggagctgacaccaagatggacaccgaaggctgcacacgtccttaggaaaccaatcttcggtcggtataagccagatacccttgctgtggccgtggagaatgggaccggtactgatagacagatccttttcctagatttgggcacgggcgctgtcctctgctcgctggctctaccttccctccctggtggaccactgtcagcatcccttcccaccgccgatcaccgatctgccttcttcttctgggggctgcacgaactgggctctaccagtgagaccgaaactggcgaagctcgacattcactgtatatgtttcacccaaccttacctcgagtgctgctggagcttgcaaatgtcagtacgcacattgtggcgttcgatgcagtcctgtttgagccatcaaggcacgcagcatatatcctcctgacaggccctgcggactcagaagcgccagggctggtgtccgtcatcaagcataaggtgcgggatctggtaccctctagtcgggttgtgagactgggggagggtgggccagacagcgaccaggccatcagagaccgatttagtcgactcagatatcagagcgaagcctag

SEQ ID NO: 50787 - DNA, 210 bp, Artificial Sequence
  Description of Artificial Sequence: Synthetic coding sequence
atgctggatcacaaagatctggaggctgaaatccacccactgaagaacgaagaacggaagagtcaggagaacttgggcaatcctagcaaaaatgaagataacgtcaagagcgctccccctcagtctcgtttatcccgatgtagggccgcagctttcttcctgtccttgtttttatgtctgtttgtggtgttcgtggtctccttcgtgtag

SEQ ID NO: 50788 - DNA, 309 bp, Artificial Sequence
  Description of Artificial Sequence: Synthetic coding sequence
atgttggaccacaaggacttggaggctgaaatccatccgttgaagaacgaagagcgcaaatcccaggagaatctggggaatccatctaagaacgaagataacgttaaatcagctcctcctcagtcaaggctcagtcgctgccgcgctgcggctttttttctttctttgtttctgtgcctgtttgtagtcttcgtggtgtccttcgtcattccctgccccgacaggcccgctagtcaacgtatgtggcgaatagactacagcgctgcggtgatctatgacttcttagctgtagacgacattaatggctag

SEQ ID NO: 50789 - DNA, 702 bp, Artificial Sequence
  Description of Artificial Sequence: Synthetic coding sequence
atgctggaccacaaggatctggaggccgaaatacaccccttgaaaaatgaagagcggaagtctcaggaaaatctcggcaaccccagcaaaaacgaggataatgtcaaaagcgctcctccacagtcccggctgtccagatgccgcgcagccgcattcttcctgtcgctttttctgtgtctcttcgttgtcttcgttgtttctttcgtgataccctgtcccgatcgcccagctagccaaagaatgtggaggatcgattactcagcggcagtgatttatgattttctggcggtggacgatatcaacggcgatagaatccaagatgtcctgtttctctacaagaacacaaatagcagcaacaacttctccaggtcctgcgtggacgagggtttttcatctccctgtacttttgcagccgctgtgtctggtgccaatggctccactctctgggagcggccagtggctcaggatgttgccctcgtcgagtgtgcagtacctcagccaaggggctctgaggcaccatctgcatgcattttggtcggaagaccttctagttttatcgctgtgaacctgtttactggtgagaccctttggaaccactcatccagcttttctgggaacgcgtccattttaagtcccctgttgcaggtcccagatgttgatggcgatggcgctcccgaccttctagtgctcacacaggagtag

SEQ ID NO: 50790 - DNA, 156 bp, Artificial Sequence
  Description of Artificial Sequence: Synthetic coding sequence
atgctcgatcataaagatctcgaggctgaaattcacccactgaaaaacgaagaaagaaagtcgcaggagaacctgggtaacccctctaagaacgaagataacgtgaagtccgcccctccccagagcaggctgtctcgatgtcgggcagctgcttag

SEQ ID NO: 50791 - DNA, 1596 bp, Artificial Sequence
  Description of Artificial Sequence: Synthetic coding sequence
atgttggaccataaagacctagaagctgagattcaccctcttaagaacgaggagaggaagtcccaggagaaccttggcaacccgtcaaagaatgaagacaacgtgaagagtgcccctccacagtctagactttcgcggtgtcgggctgctgccttcttcctgtcattgttcctgtgcctgtttgttgtctttgtagtctcctttgtaataccatgccccgatagaccggcttcccaaagaatgtggaggattgactattccgctgccgttatttacgactttttagcggtggacgatatcaatggggaccggatccaagacgttctgtttctgtacaaaaacacgaatagcagcaataacttcagtagaagttgtgttgacgaggggttctctagcccctgcacatttgccgcagccgtgtctggagcgaatggcagtacactctgggagaggcctgtggcccaggatgtcgccttggtggagtgtgccgtgccacagcctcgaggctccgaagctccctccgcttgcatccttgtcgggaggcctagttcattcattgccgtgaacctcttcacaggagaaacgctgtggaaccattccagttcctttagcggcaatgccagtatcctgagccccctgctgcaggttccagatgtggacggagatggagcgcctgacctcctggtattaacccaagaaagagaggaagtatctggacatctgtattccggtagtactgggcaccagatcggtctgagggggtctctgggtgtggatggtgaatctggcttcctgttgcatgtgacaagaacaggtgcacactatatcctctttccctgtgcctcatctttatgtggttgttcagttaaagggttgtatgagaaggtgaccggctctggtgggccattcaagagtgacccacactgggagtccatgctgaatgctaccactcgtcggatgctctcgcattcaagcggtgcggttcgatatttgatgcatgtccctggaaacgctggagcagatgtgctcctggtcgggagcgaagccttcgtgctactggatggacaagagctgacacccagatggactcctaaagctgctcatgtgcttcgaaagccaattttcggaaggtataagccagacactctggcggtagcggtggaaaacggcactgggactgaccgccagatacttttcctagatctcggaacaggtgcagtgctgtgctctcttgccctgccatcactccccggtggcccactcagcgcgagcctgcccacggctgaccataggagtgccttcttcttttggggcctccatgaactcggaagtacgtcagaaaccgaaaccggagaagcacgtcactccttatatatgttccatcccaccctgcctagggtgctgctggaactggcaaacgtgagcacccacattgtggccttcgatggctctcactgggctacggccgagcgtttgctggacggcgcagagttggcccctagaccggcttgtccacgcctcgtgactggtgtgtgggaggctgcccgtctgtgtatactgttgccaggcatcaggtggctcatttattggttctag

SEQ ID NO: 50792 - DNA, 264 bp, Artificial Sequence
  Description of Artificial Sequence: Synthetic coding sequence
atgctcgaccacaaggatctcgaggccgagatccatccgctgaagaacgaagaacgcaaaagccaagaaaacttgggcaatccatccaaaaatgaggacaatgtgaaaagtgcccctccccagagccggctcagtcgctgtcgcgcagccgcatttttcttgtccttgttcttatgcttgtttgtcgtatttgtggtgtcattcgtgattccttgtcccgaccggcctgcctctcaacggatgtggaggattgattatagctag

SEQ ID NO: 50793 - DNA, 1623 bp, Artificial Sequence
  Description of Artificial Sequence: Synthetic coding sequence
atgctggaccacaaagacctggaagccgaaattcatcctctgaaaaatgaggagcgtaaatctcaggagaacttgggaaacccaagtaagaatgaggacaacgttaagagcgcacccccacagtcaagattgtcaaggtgcagagcagctgcctttttcctgagtctcttcttatgcctctttgtggtgtttgtggtcagtttcgtgatcccatgtcctgaccgcccagctagccagagaatgtggaggattgattactcagcagctgtgatttacgacttcctggccgttgatgatattaatggagataggattcaggacgtgctttttttatacaagaacactaacagttccaacaatttctcacgctcttgtgtggacgagggcttctcttctccatgtacgtttgccgctgcagtgtcaggagctaatggtagcacactgtgggaacgcccagtcgcccaagacgttgccttggtggaatgcgcggtcccacagccccgtggaagcgaggccccaagtgcttgtatcctcgtcggacggccatctagctttatagccgtgaatttattcacaggagagaccctgtggaatcactcctcttctttcagtggcaatgcttccatactaagtcctctgctgcaagttccggacgtggacggtgacggcgcacccgatttgctggtgttgacccaggaacgggaagaggtgtcaggccacttgtactctggctccaccgggcaccagattggcctacggggaagcctgggtgtcgatggtgaaagcggatttctgcttcatgtcacccgaactggagcccactatatcctgttcccttgtgcatcctccctttgcggatgtagcgtgaagggtctgtatgagaaggtcacaggcagtgggggaccgttcaagtcggaccctcattgggaatccatgttgaatgcaaccaccaggcgaatgctgtctcacagctctggcgcagtcaggtatctgatgcacgtccccggtaatgccggagcagatgtgctgcttgtgggttcagaggctttcgtgttgcttgatggccaagaattgacaccaagatggactcctaaggcagcccacgtgctcagaaaaccgatttttggaagatacaagcctgatactctggccgtggcagtggaaaacgggaccggcactgatcgccagatactgttccttgacctcggcactggcgcagtcctatgttctctcgctctcccctccctgccaggtgggcctctgagcgcctctctcccaaccgccgatcaccgctcagcattcttcttctggggcctgcacgaactcggtagtacctctgaaacagagaccggagaagcaaggcacagtctctacatgtttcacccgactctgccaagagtgttactcgaattagctaacgtctccacgcacatagtggcctttgatgccgtcctcttcgagccatcacggcacgccgcatatattctccttaccggccctgcagattctgaagcgccagggctggtctccgtcattaagcacaaggcccataccggaagacagcgacgcggaagttggactgggcaatcctctcggagagacttgcacgtcagagttctttag

SEQ ID NO: 50794 - DNA, 711 bp, Artificial Sequence
  Description of Artificial Sequence: Synthetic coding sequence
atgctggatcataaggacctggaggcagaaatccacccacttaaaaacgaggaaagaaagtcacaggagaacctaggcaacccttccaaaaacgaggacaatgtaaagtctgccccaccccaatccagactgagccgttgccgggcagcggctttctttctctccctctttctatgccttttcgttgtgtttgttgtgtctttcgtgattccttgccccgacaggcccgctagccagcggatgtggaggattgattacagcgctgccgtcatctacgactttcttgctgtcgacgacatcaatggggataggattcaggacgtgttgtttctctacaaaaacaccaatagctcgaacaatttctcaaggagttgcgtggacgaaggtttttcatccccgtgcacttttgccgctgcagtgagcggcgctaatgggtccactctgtgggaaaggccagtcgcccaggatgtcgcccttgtcgagtgtgccgttccccagcctcggggaagcgaagctccttccgcctgcattcttgtaggccgaccatcctcgttcatcgccgtgaaccttttcacaggcgagacattatggaaccactcctctagcttttcaggcaacgcttcaattctaagcccactgttgcaggtgcctgatgtggatggcgatggtgcacctgacttactcgtgctaactcaggaaagggaggaatag

SEQ ID NO: 50795 - DNA, 3504 bp, Artificial Sequence
  Description of Artificial Sequence: Synthetic coding sequence
atggaacttccgttcgtgacgcatctctttctcccgctagtctttctgaccgggctctgttcccccttcaacctggacgagcaccaccccagactgtttcccggaccaccagaagccgagtttggttatagtgtactccagcatgttggcggtgggcagaggtggatgttggtgggggcaccctgggatgggccatctggggaccgccgtggtgacgtctataggtgtcccgtagggggtgcacacaacgcgccatgtgcaaaggggcatctgggcgattaccagctgggcaactcgtcacatccagccgtaaatatgcacctggggatgtcacttctagaaactgacggagatggaggcttcatggcatgtgcacctctctggagtagggcctgcggcagctcggtgttctccagcggcatctgcgccagagtggacgcatcttttcagccccagggctccctcgcgccaactgctcagcgttgccctacatacatggacgtcgtgatagttttggacggaagcaatagcatctacccctggagtgaagtacaaacatttctgaggcgcttggtgggaaagctgtttatcgaccctgagcaaatccaggtcggactggtgcagtacggtgaaagccctgtccacgagtggtcactcggagactttagaaccaaagaagaggtcgtcagagccgcaaaaaacctttcccgtcgagaggggagagagacaaagaccgcccaggcaatcatggtggcctgtacggaaggttttagtcagtcacacggcggaaggccagaggccgcaaggcttctggttgtcgttactgacggagaatcgcatgacggggaggaattgcccgcagcactgaaagcatgcgaagctggcagggtcacacggtatgggatcgcagtactgggccactacctgaggcgtcagcgggacccttcctccttccttcgggaaataagaacaatcgcctcagatcccgatgagcggttttttttcaatgtgactgatgaagccgctcttactgatatcgtggacgctctgggcgataggatctttggattggagggatcccacgccgagaatgaatcaagcttcggcctggagatgagccagataggattttccacgcaccggctgaaagatggtattctgttcgggatggtgggggcatatgattggggaggcagtgtgttgtggctggaaggcggacacagactattcccccctcggatggccttggaggatgaatttcctccagctctgcagaatcacgccgcatacttgggctactcggttagctctatgctgctgaggggcggacggcgactgtttctcagcggagcccctaggttccgacacaggggcaaggtcattgcattccaattaaagaaggacggagccgtgagagtcgcccagagccttcagggcgagcagattggtagttacttcggctccgagctttgtcctcttgacaccgaccgggacggaacaacagatgttttgctcgtggcagcacccatgttcctcggcccacagaacaaagaaaccggtcgggtgtatgtgtacctggtcggccaacagagtttgctgaccctgcagggtactctgcaaccggagccccctcaggacgcccgattcgggtttgccatgggagccctgccggaccttaatcaagatggcttcgccgatgtagcagtgggagctcccctggaagacggtcaccagggagccctctacttataccacgggacccaatcgggcgttcgcccacaccctgcgcagcggatcgccgctgcatccatgccgcatgcactctcatacttcggcagatccgttgacggaagactcgacctcgacggcgacgacctggtcgatgtggccgtcggtgcccagggggctgctattcttctgtccagcaggcccattgtgcacctcactccatccctagaagtgaccccccaggctattagcgtggtacagcgggattgtcgacggaggggacaagaggcagtgtgcttgaccgcggctctgtgttttcaagtgacgtctcgcaccccgggtcgctgggaccaccagttctatatgagattcaccgctagccttgacgaatggaccgcaggggcacgggcagctttcgatggttcgggtcagaggctgtctcccagacgcctacggctgagcgtgggcaatgtgacttgtgaacagctgcatttccacgtgcttgatactagcgactatctgcgccctgtggctctcaccgtcaccttcgccctcgataacacaaccaaacccggtccagtgcttaacgagggttctccaacctctatacagaaacttgtacctttctcgaaggactgcggccctgacaacgagtgcgtaacggatctggtcctgcaagtcaacatggatataaggggctccagaaaagctcccttcgtggtgaggggtgggaggcgaaaggtcctggtgtcaaccacgctagagaatcgcaaggagaacgcctataatacttcgttaagtctgattttttccagaaacctgcatcttgcttcactcacaccccagagagaatctcctatcaaagtggaatgtgcagccccatcagctcatgccaggctgtgctccgttggccatcccgtgttccaaaccggggctaaagtgacttttctgttagaattcgagtttagctgctcatctctactctcccaggtcttcgtgaagctgacagcctccagtgattccctggagcgaaacggaacattgcaggataacacggcccagacaagcgcgtatatccagtacgagccccacctgctgttctcatccgaaagcacactgcataggtacgaggtgcatccttatggtacgttaccagtcggaccagggcctgagttcaagactaccctcagggtccagaatctgggctgttatgtggtttcaggcttgattatcagcgctctgttgcccgcagtggcccatggagggaactactttctttccctcagtcaggtgataaccaataatgcctcatgtattgtacagaatttgacagaacctccagggcctccagtccaccctgaggaattacaacacacaaataggctgaacggcagtaatacccagtgccaggtagtccggtgtcacctggggcagttagcgaagggcactgaggtgtctgtgggactgctacgattggttcacaacgaattctttcgacgcgcaaagttcaaatccctgaccgtggtttccacgttcgaactaggcactgaagaggggagcgtactgcagctaactgaagcctctaggtggtcagaatccctcctggaggtggtacagacaagacccatcctgatcagcctatggattctaatcggcagtgtgctaggcggactgctgctccttgccctccttgtgttttgcctgtggaagctggggttttttgcacacaagaagataccggaagaggaaaaacgtgaagaaaagctggagcagtag

SEQ ID NO: 50796 - DNA, 3111 bp, Artificial Sequence
  Description of Artificial Sequence: Synthetic coding sequence
atgaatattacacatgcatacagtcagggacatcagaagctaaacctggacaccgtgtcatacaacatgctcggcgtagattcagatgggtgtccaacctacatggatgttgtcatcgtattggatggctccaacagcatctacccttggagcgaagtgcagacctttttaagaaggctcgtcggcaaactgtttatcgacccggagcagatccaggtgggattagtgcagtatggtgagtcgcccgtccatgagtggagccttggtgatttccgcacgaaagaggaggtggtgagggctgctaagaatctgagcaggcgggagggtcgggagacaaaaacagcgcaggctatcatggtcgcgtgtacggagggattctcacagtctcacggtggcagacccgaggcggcacggttgctcgtagtggtgaccgacggcgaaagccatgacggagaagaattgcccgctgccctgaaggcatgcgaggcaggacgcgtaaccagatacggcattgcagtacttggccactatctaaggagacagagagatccaagctcctttctgagagaaatacggaccatcgcatccgatccagatgagagattcttcttcaatgtcacagacgaagctgccttaactgacatcgtggacgctctgggagaccgaatattcggcctcgaggggagtcacgcagagaatgagtcatcatttggcctggagatgtcccagatcggattctccacacaccgcttaaaggatgggatactttttggtatggtcggcgcatacgactggggagggtctgtattgtggttggaaggtggacatagattgttccctccacgaatggctctggaggacgagtttcccccagctcttcaaaaccatgcagcttatctgggctattctgtgtcttccatgctgctgcgtggaggaagaagactgtttttgagcggcgcaccacgatttaggcaccgaggcaaggtcatcgcgtttcagctgaagaaggacggagcagtcagagttgctcaaagcctgcagggtgagcagattggctcctatttcggttccgaactctgccccttggatacagaccgcgatggcaccaccgacgtcctcttggtcgctgcccctatgtttctgggcccacagaataaggagacaggcagggtttacgtttatctcgtgggacaacagtccttgctgaccctgcaggggactctgcagcctgagccacctcaggacgccagatttggttttgctatgggagcactgcctgaccttaaccaggacggctttgccgatgtggccgtaggggctcccctcgaagacggccatcagggtgccctttacctgtaccatggtacccagtctggtgttaggccccatcccgctcagcggatagccgctgcctctatgccccatgctctgtcctactttggacggagcgtcgacgggagactcgatctcgacggagacgatctggttgatgtggccgtgggcgcacagggtgctgctattctgctgagcagtcgtccgatcgtacatctcacaccatctcttgaggtcacacctcaagctatctcggtggtccagcgggactgtagaagaagaggccaggaggccgtctgcctgacagcagccctgtgcttccaggtgacatcacggactcctgggcgatgggatcatcagttctatatgcggttcacagcttcgctggatgagtggactgcaggggcacgggctgcctttgatggctccggtcagaggctgtctccccgaaggctgcgcctgtccgtgggcaacgttacctgtgagcagctgcactttcatgtcctcgacacatccgactacctccgcccagtcgccctgactgtgacgttcgcactggacaataccactaaaccagggccagttctgaacgaaggttctcccaccagcatccagaagttggtgcctttctctaaagactgcgggccagacaacgaatgtgtgaccgatctggttctgcaggtgaacatggacatcagggggtcccgcaaggctcctttcgtggtaaggggcggtaggagaaaagtgctggtctctacaactcttgagaaccggaaggagaatgcgtacaatacaagcctgtctctcattttctccaggaatctgcaccttgccagtttgacaccgcaaagggagagccccattaaagtggagtgcgccgctcccagcgctcacgcgagactatgctcagtgggccacccagtgttccagactggggctaaagtgacatttctgctagaattcgagttcagctgctcaagcttattgagtcaagtttttgtcaagctgactgccagcagtgattccttggagagaaacgggactctgcaggataacacagcacagactagtgcctacatccagtatgaaccccacctcctgtttagctcagagtccactcttcataggtacgaagttcacccgtacggaaccttgccagtcggacccggacctgagtttaaaaccacactgcgggtgcagaacctcggttgttacgtggtctccggattgatcatctccgcgctgctgccagctgttgcccatggagggaattacttcctgtcgctaagccaggtaattacaaacaatgcttcatgcattgtgcagaacttgacggagcccccaggcccacctgtccatcccgaggaactccaacatacaaatagactgaacgggagcaatacccagtgtcaggtagtaagatgtcatctgggacagctggcaaagggcaccgaggtctctgttggacttctgcgactcgtgcataatgaattctttcgccgagctaagtttaaatccttgacggtggtaagtaccttcgagctcgggactgaggaagggtctgtgctccaactaaccgaagctagccgctggagcgagagccttctagaggtggtgcagacaaggcccatcctgatctccctgtggatcctcataggttctgttctgggcggattgcttctcctcgcgctgctagtgttctgtttatggaagctgggcttcttcgctcataagaaaattccggaggaagagaagcgcgaggaaaagctggaacagtag

SEQ ID NO: 50797 - DNA, 3075 bp, Artificial Sequence
  Description of Artificial Sequence: Synthetic coding sequence
atggagttgccttttgtcacacacctgttcctgccactcgtgttcctgacagggtgccctacttacatggacgtcgtaatagtgcttgatggatcaaatagtatctatccatggagcgaggtccaaaccttcttgcgccgactagtgggaaagctcttcatagatccggagcagatacaggtgggactagttcaatacggggagtcacctgtgcacgaatggtccctgggggactttcgaactaaggaagaagttgttcgagccgcaaagaacctgagcagaagggagggacgcgagactaaaacagcccaggccattatggtcgcatgtacggaggggttcagccagagccacggcggacggccagaggctgctcgtctgctcgtagtagtgaccgatggtgaatcccatgatggcgaggaattaccagcggcactgaaagcgtgcgaagcaggtcgggtcaccaggtatggaatcgcagtgttaggacactacctgcggagacagagagaccccagctcattcctccgggagattagaaccatagcctctgatcctgatgagcggttcttctttaatgttactgacgaggccgcactcactgatatcgtggacgccctgggggaccgcattttcggcctcgaaggcagccacgcagagaatgaaagcagctttgggctggaaatgagccagataggatttagtacacacagacttaaagatggcatcttgtttgggatggttggggcatacgattgggggggttccgtcttgtggctcgagggcggtcatagactgtttcctccaaggatggctttagaagacgagttcccgcctgccctgcagaatcacgcggcatacttaggctattcagtctcctccatgctgctgcgaggagggagaaggttgtttctctccggcgctcccaggtttcggcaccgtggaaaggtgattgcctttcagctaaagaaagatggcgctgtacgtgtcgcgcaatctctgcaaggagagcaaatcgggagctatttcgggtccgagttatgtcctctagacacagatcgcgacggcaccacggatgttctgctcgtggctgcccctatgttcctgggccctcagaacaaggagaccggcagagtgtacgtgtacttggtcggccagcagtcactgttgaccctccagggcaccctgcaaccggagccaccacaagatgccaggttcggcttcgccatgggggctctgccagacctgaaccaggacggattcgcagatgtagctgtgggcgcaccgttggaggatggccatcaaggcgctctgtatctgtaccatggcactcagtctggcgttcgtccccatcctgctcagcggatcgccgctgcttccatgccacatgcactcagctactttggccgatcggtggacggcaggttggatctggacggcgatgatttggtggatgtggccgtgggcgcacagggcgctgcaatactcctgagtagtcggcctattgtgcacctgacccctagcctggaagtcacaccacaagcaatctccgtagttcaacgagactgcaggagaaggggacaggaggctgtgtgtctgacagctgcactgtgttttcaagtaacgtctaggaccccaggacggtgggatcaccagttctatatgaggttcacagcctccctggatgagtggactgcaggcgcacgagcagcgtttgacggctccgggcagcggttaagccctaggcgcctgagactgtccgttggtaacgtgacttgtgaacagctgcatttccacgtgctggacacctccgactacctgcgccctgtggccctgaccgtgactttcgcacttgacaatactactaagcctggccctgtgttgaacgagggctccccaacctccatacagaagctggtgccattttcaaaagactgtgggccagataatgagtgcgtgacagacctcgtgctccaggtgaatatggatataagggggagccggaaagcgccatttgtagtccggggtgggagacgcaaagttctcgtctctacaactctcgaaaatcgtaaagagaacgcctacaacacaagcctttccctgatctttagccgaaatctccacctagcatcattgacgcctcagagagaatcaccgataaaggttgagtgtgcagctcccagtgcacatgccaggctatgcagcgtagggcaccccgtgttccagaccggggctaaggtgaccttcctgctcgaattcgagttcagttgttcctcccttctctctcaggtattcgtaaaactgacagcatcctcagactccctcgagcgcaatgggacattgcaggacaacacagcgcagacctcggcttacattcaatatgagcctcacctactttttagcagtgaatcaactctccataggtatgaagttcacccctacgggaccctccccgtgggccctggcccagagtttaagactaccctcagagtccagaacctgggctgttatgtggttagcggcctgatcatatctgccttgctccctgctgttgcgcatgggggtaattacttcttgtcactgtcacaagtgatcacgaataatgcctcatgcatagtgcagaatctgacagagcctcccggaccgccagtgcaccctgaagaactgcagcacacaaatagactcaacgggtcaaacacacaatgtcaagttgtaaggtgccatctggggcagctggccaagggtacagaagtaagcgttggcctcctgcgcctggtgcataacgaattttttagacgggcaaagttcaagagtctgaccgttgtgtccacctttgaactgggtacagaagaagggagcgtgctccagctaaccgaagcttctcgctggtctgagagcttattggaagtagttcagactcggccaatcttgatttccctgtggatcctcatcggttcagtcctcggtggtctcctgttgttagcgctacttgtgttttgcctgtggaaattaggtttttttgcacacaagaaaatccccgaggaagagaagcgggaagagaagctggaacagtag

SEQ ID NO: 50798 - DNA, 3288 bp, Artificial Sequence
  Description of Artificial Sequence: Synthetic coding sequence
atgaacatcacccacgcttattcccaggggcatcagaaactgaatctggacactgtcagttataacatgctaggtgtggacagcgacggctgttggtgggcgccacctgggatgggactacaggctacaggtggcggagcccacaatgctccatgtgctaagggacacctgggtgactatcagctggggaactcaagtcatcctgctgttaacatgcatttagggatgtctctcctggagaccgatggggatggaggcttcatggcatgtgcaccgctttggagcagggcctgcgggagcagcgtcttcagtagtggtatctgtgcacgggtggacgcatccttccaaccccaggggtccctggctcctactgcccagcggtgtcccacctacatggacgtggttattgttctcgatggatccaattctatatacccttggagtgaagtccagacattcctgcgcagactggttgggaagctcttcatcgaccctgagcaaattcaagtcggactggttcagtatggagaaagtcccgtgcatgagtggagcctgggagatttccgcacgaaggaggaggtggttagagccgcaaagaacttatccagaagggaggggcgtgagacgaagactgctcaggctatcatggtggcatgcacagaaggtttctcccagtcccatgggggacggccagaggctgctcggctcctcgtggtcgtaacagacggagagtcccatgacggcgaggagctgcccgctgccctcaaggcttgtgaggccggtagggttactcgctatggcatcgccgtgctggggcactatctacgccgtcagcgggatccatcctctttcttgagggagattcgcactattgcaagcgatccggatgaacgattcttcttcaacgtgacagacgaggcagccttgactgacattgtggatgcccttggggataggattttcggcctcgagggttcccacgctgagaatgagagtagtttcggcctagagatgtcacaaattggcttcagtacacatagactcaaggacggaatcctgtttgggatggtaggcgcatacgattggggcggatcagtgctctggctggaaggcggtcatcgattattccccccacgcatggctctcgaggacgagtttcccccagctctgcagaatcacgcggcatatctgggatacagcgtgtcaagtatgttgttaagggggggacgccgactttttctgagtggcgctcccagatttaggcaccgaggcaaggtgattgcgtttcagttaaagaaggacggggcagtgagggtggcacaaagcttgcagggcgagcaaatcggctcatatttcggaagcgagttgtgtcctctggacacagaccgggatggcactacagatgtgctgctggtagccgctccaatgtttctggggccacagaataaggaaactggacgtgtctatgtgtacctggtaggccagcaatcacttcttacactccagggtacgttacaacccgagccaccccaggacgcccgtttcggctttgccatgggcgcactacctgacctgaaccaagatggcttcgcggacgttgccgtgggcgctcctttggaggacggacaccagggcgcactttatctataccatggaacccagtctggcgtccgcccacacccagcccagcggattgcagcggcaagcatgccacatgccttgtcatatttcggtcgctctgtcgacgggagattggatctcgatggagacgacctcgtggatgttgccgttggtgctcagggcgctgctatcctgctgtcttctcggcctattgtgcatctcacaccatcgctcgaagtaacaccacaggcaatcagtgttgtgcaacgtgactgcagacgccgaggtcaggaggcggtgtgtctgacagcagcactgtgctttcaggtgacatcacggactcccggaagatgggaccaccagttttacatgcggttcacagccagccttgatgagtggacagccggagccagggccgcatttgacggttctggccagcggctctcgcctaggcggctgagactatccgttggcaatgtgacctgcgagcagctccatttccacgtgctcgacacatcggactaccttaggcccgttgcactgacagttacatttgctctcgacaacaccaccaaacccggaccagtcctgaacgagggctctcctacgtccattcagaaactggtaccattcagtaaggactgcgggccagataacgagtgcgtgacggacctcgttctgcaggtgaacatggacatccggggatctaggaaagcaccttttgtggtgcgcggtggaagacgcaaggtccttgttagcactaccctggagaacagaaaagagaatgcttataatacaagcctgagcctcatattttctaggaatttgcaccttgcttctctgacacctcagagagagtcacccataaaagtggaatgcgccgctcccagtgctcacgcccgtctttgtagcgttgggcacccagtgttccagacaggagccaaagtcacttttctactagagttcgaatttagctgttcgtccctgctgtctcaggtctttgttaaactgactgcatcttccgactccctggaaaggaacgggaccttgcaggataatacagcgcagacgagtgcctatatccagtatgaaccacatttactcttttcttcagaaagcacgctgcatagatacgaggtgcacccatacggcacccttccggtcggcccaggacctgagtttaaaaccactcttcgtgtgcagaacctggggtgctacgtcgtcagcggcctgatcatctctgcactgctgccagcagtggcgcatggcggtaactatttcctctcactctcccaggtgattactaacaatgccagctgcatagtccagaaccttacggaacctcctggaccgccagtgcaccccgaagaactgcagcacactaataggttagccaaattcaaatctctgacggtggtgtccacttttgaattggggacagaggagggaagtgtactgcagctgactgaagcatcgagatggtccgagagtctgcttgaggttgtccagacccgtcccatcctgatttctctttggatactcataggctccgtcctcggtggcctactattactggccctgctggtcttttgcttgtggaaattaggctttttcgcccacaagaaaatccctgaggaggagaagagggaagaaaaactagaacagtag

SEQ ID NO: 50799 - DNA, 3192 bp, Artificial Sequence
  Description of Artificial Sequence: Synthetic coding sequence
atgagtccaggcgcaagccgcggtcccagaggtagccaggctcccttgatagccccactctgttgtgccgctgccgctcttggcatgttgctctggtctccagcctgccaagcctttaacctagacgttgagaagctgaccgtttactcaggtcccaaaggcagctatttcggttacgctgtggatttccacatccctgatgcccgtaccgcctccgtgctcgtcggcgctcccaaggcgaacacaagtcagcccgatatcgtggaaggcggagcggtctattattgcccctggccggcagagggtagcgcccaatgtcgacagattcccttcgatacgactaataaccgtaagatccgcgtaaacggtacaaaggaacctattgaatttaaaagtaatcagtggttcggcgcaaccgtcaaggctcataagggcaaagtcgtcgcgtgtgcccctctctaccattggcgcacactcaagcccacccccgagaaagatcccgtagggacctgctacgtagcaatacagaattttagtgcctacgccgagttcagcccttgccgaaactccaacgccgatccagaaggtcaaggctactgccaagctgggttcagtctggacttctacaagaatggagatctgatcgttgggggaccaggcagtttctattggcagggccaggtaatcaccgcttctgttgccgatatcatcgcaaattacagcttcaaagatattctcaggaaactcgccggtgaaaaacagaccgaggttgccccagcatcctatgacgattcttacctcggctattccgtggccgcaggagaattcacaggcgatagccagcaggagctagtcgccggtatcccacggggagcacagaatttcgggtatgtaagtattatcaattcaaccgacatgacttttatccagaacttcacgggcgagcagatggctagctatttcggatacactgtagtggtaagcgacgtgaatagcgatgggctggatgacgtgctagtgggggctcctctcttcatggagcgtgaattcgaatctaaccccagagaggtggggcagatttatctctacctgcaggtgtcaagcctcctgtttcgagaccctcagatactgaccgggaccgaaactttcggccgattcggctccgccatggcgcatcttggtgacctgaatcaggacggctacaacgacatcgcgattggcgtgcccttcgcaggcaaagatcaacgtggaaaagtgttgatttataatggaaataaggacggactgaataccaagccgagtcaagtgctgcagggagtctgggcttcccatgcagtgcccagtggtttcggtttcacgcttcgtggagatagcgacatcgataaaaacgactaccctgacttgattgtgggagctttcgggaccggaaaagtcgcagtttatcgcgcaagacctgtggttacggtggacgcccagcttctgctacaccctatgatcatcaatctggaaaataagacttgccaagtgcctgactccatgacgtcagctgcatgcttttctctcagggtgtgtgcctctgtaacgggtcaaagtattgcaaatacaatagtccttatggctgaagtgcagttggattcgctgaagcagaaaggcgctataaaacgtacactgttcctcgataatcatcaggcacaccgagtattccccctggttattaagagacagaagtcacaccagtgccaggacttcattgtatatttgagggacgagactgagtttcgtgacaaactcagtcccatcaacatctcactgaactactcactggacgagtctacctttaaggaggggcttgaagtcaaacctatcctcaattactaccgggagaatatcgtgagcgagcaggctcacatcctcgtggactgtggcgaggataacctctgcgtcccagatcttaaactcagcgcccgacccgacaaacaccaagtaatcatcggcgacgaaaatcatttaatgttaattattaacgcaaggaacgagggagagggggcatacgaagccgagctgtttgtgatgatacccgaggaggcggactatgtgggtatcgaacgaaataacaaaggcttccggcctctgtcatgtgagtataagatggaaaatgttactagaatggtggtgtgcgaccttggaaatccaatggtaagtggtaccaattattcactgggcctgagatttgcagtacccagacttgagaaaacgaacatgtcaatcaactttgatctgcaaataaggtcgtccaacaaagacaaccctgacagtaacttcgttagcctccagatcaacatcacggccgtcgctcaggtagaaattcgaggagtgtcccacccaccccagattgtactacctattcacaactgggagccagaagaggaaccacacaaagaggaggaagttggaccactggtcgagcacatttacgagttacacaatatcggaccttctactatcagcgataccattctggaggttggctggccattctctgcccgtgacgagttcctgttgtatatcttccacatacagacactgggtcccctccagtgccagccgaatccaaacattaaccctcaggatatcaaacctgcagcctccccggaagatacccccgagctctccgcattcctgcgaaacagcacaatacctcatctcgttcggaagcgagatgtgcatgtcgtggagtttcaccggcagtccccagctaaaattctgaactgtactaatatcgaatgtttacagatcagctgcgcagtcggcagactggaggggggagaatcagctgtgctgaaggtccggagtaggctctgggcccacacgttccttcagcgaaagaacgacccttatgctctggcaagcctggtctcctttgaggttaagaagatgccttatacagatcaacccgcaaagctgcctgaaggtagcatcgtcattaagactagcgtaatttgggcaactcccaatgtcagcttctccatccccctgtgggtaatcatacttgccatactactgggcctgctggtgttagctatattgaccctggcgctctggaaatgcgggttctttgatcgcgctcgaccgccacaggaggacatgaccgatagagagcaactgacaaatgacaagactcctgaagcttag

SEQ ID NO: 50800 - DNA, 3147 bp, Artificial Sequence
  Description of Artificial Sequence: Synthetic coding sequence
atgtccccgggagcatctagggggccacggggatcccaggcaccactgatcgctccgttatgctgcgcagccgctgcgctaggcatgctgctgtggtcacccgcatgccaggcctttaacctcgacgtggaaaaactcacggtctattccggacctaaggggtcctacttcggatacgctgtggattttcatatccccgatgcccgtacagcgtctgtgctcgtaggagctccaaaagcgaatactagccagccagacattgttgaggggggtgccgtctactattgtccctggcccgcagaggggtctgctcagtgtaggcagatcccattcgatacaaccaataacagaaagattcgcgtcaacggaaccaaagaacccatcgaattcaagagcaatcagtggttcggcgctaccgtcaaagcccacaagggaaaagtcgttgcctgtgccccactctaccactggaggactctgaagcctacccccgagaaggaccctgtaggtacttgctacgtcgccattcaaaacttctctgcctacgcggagttctccccctgtagaaattctaacgcggatccggagggtcaggggtactgccaggcgggattctcactggacttctataaaaacggcgacctcatcgttggaggccctggctcgttctactggcaggggcaggtgattacagcaagtgtcgccgacatcattgccaattatagtttcaaggacatactgaggaaactggcgggtgaaaagcagactgaggtggctcccgcatcatacgatgacagctacctggaactggttgcagggattccccgaggagcccagaattttggatacgtgagtataattaattccacggacatgacctttatccaaaacttcacgggagagcagatggcatcttatttcggatacactgttgttgtaagcgacgtcaattccgacggcctggatgacgtgttggtgggcgcaccactcttcatggagagggaattcgagagtaaccctagagaggtgggccagatatacctgtatctacaggtatcgtcgctgctgtttcgcgatccccagatactcactggaaccgaaacattcggcagattcggctctgccatggctcacctgggcgatcttaaccaggacggttacaacgacattgccattggggtcccctttgccggaaaagaccagcggggaaaggttctcatctacaatgggaacaaggacggtttaaacaccaagccatcccaagtgctacagggagtatgggctagccacgctgttccaagcggcttcgggtttacgctgcggggagattccgacatagataaaaacgactacccggatctgattgtgggggcatttgggaccggtaaggtagccgtttaccgcgctaggccagtggtgacggtcgatgcccagctcctgcttcatcctatgataattaatctggaaaataaaacctgccaagtcccagacagtatgacgagcgccgcttgtttctctctgagagtctgtgcctctgtgactgggcaaagcatagccaacacaattgtcctcatggcggaagtacagctggactcactgaagcagaagggagccataaaaaggaccctgtttcttgataaccaccaggcccaccgggtatttccactcgtgatcaaacggcagaagagtcaccagtgccaggactttatcgtataccttcgggatgaaacagagttcagggacaaacttagtcctataaacattagtttaaactactccctcgacgagtctacttttaaggaaggcctggaggtcaaacctatcctgaattactatcgcgaaaacatcgttagcgaacaggcacatatcttggttgactgcggggaggataacctgtgtgtccccgatcttaaactgtctgctcgtcctgacaaacatcaggtgatcattggggatgaaaaccacctgatgcttataatcaacgcacggaatgaaggagaaggcgcatatgaggccgaactctttgtcatgatccctgaggaagccgattacgttgggatcgagcggaacaataagggattcagacctctcagctgcgagtataagatggagaacgtaacgcggatggttgtctgtgacctcgggaacccgatggtatccggtactaattatagcttagggcttagattcgcggtccctcggctcgagaaaaccaacatgtccatcaacttcgacttgcagattcggagctccaacaaagataacccagattctaactttgttagcctccagatcaacattacggcggtggcgcaggtggaaattcggggagtctcccacccaccacagatcgtcctgcccattcataactgggagcccgaagaggaaccacacaaggaggaggaggtggggccattagtggagcacatctatgaactgcacaacatcggaccaagcactataagtgacacgatcctagaggttggctggccgttttccgctagggatgagttcctgttgtacatcttccacatccaaaccctgggacccctgcagtgtcagcctaacccgaacatcaatcctcaagacattaagcccgcagcaagtcccgaggacactcccgagttatccgccttcctccgaaacagtactataccccaccttgtccgaaagcgcgacgtccacgtggtagagtttcacagacagagtccagctaaaatcttgaattgcaccaacattgaatgtctccaaatcagctgcgcggttggacgcttggagggtggcgagagcgccgtcctgaaagttcggagcagactgtgggcacacacctttctccaacggaaaaacgacccctatgccttagcatctctcgtgtcttttgaagtcaagaagatgccttacaccgatcagccagccaaactccccgaggggagcattgttattaagacctcagtcatttgggctactcccaatgtgagtttctcgattcccttgtgggttattatccttgctatccttctcggtctgctcgtactggccattctaacgctggccttatggaagtgcggcttttttgaccgggcaaggccaccacaagaggacatgacggatcgtgaacaactgaccaacgacaagaccccggaggcctag

SEQ ID NO: 50801 - DNA, 3540 bp, Artificial Sequence
  Description of Artificial Sequence: Synthetic coding sequence
atgtggctgtttcacacactgctgtgtatcgcatctctcgctcttttggccgcttttaacgtcgacgtggccaggccctggctcacacccaaaggaggagcaccattcgttctgagctccttgctacaccaggatcctagcactaatcagacatggctgttagtgacatctcctaggacaaagcggacccctggcccactacaccggtgcagtctggtccaggacgagatcctctgtcacccagtcgagcatgtgccgatcccaaagggtcgccaccgaggcgtcactgtcgtacgtagccatcacggtgtgctcatctgcattcaagtactggttaggcgcccacactccctgagctctgagctcactggaacctgcagcctgctggggcctgatctacggcctcaggcacaggctaacttctttgacctggaaaacctgctggaccctgatgctcgcgtcgacactggtgattgctacagcaataaagagggtgggggtgaggacgacgtgaatacagccagacaaaggcgggctctggaaaaggaagaagaagaagacaaagaggaagaagaggatgaggaggaagaggaggccggtacggagattgctattatcttagatggttccggctctattgatccacctgatttccagagagctaaagactttatcagcaatatgatgagaaatttctacgaaaagtgttttgaatgcaattttgcgttagtccagtatggtggtgtaattcagaccgagtttgatttaagggatagccaggacgtcatggctagccttgccagagtgcagaacattacccaggtcggtagtgttaccaagaccgcatctgccatgcaacacgtgctcgattccatcttcacaagttcccacgggtcccggagaaaagcatccaaagttatggtggtgctgactgatggagggatctttgaagaccctcttaatctgacaaccgtcattaactctccgaaaatgcaaggggtggaaaggtttgccatcggcgttggagaggaatttaaaagtgccagaacagcgagagaacttaacctgatagcttccgatcctgacgagactcatgcctttaaggttactaattatatggcgctcgatggccttttgtctaagctgcggtataacatcatttctatggagggaacagtcggcgatgcactccactaccagcttgcccaaattggtttcagcgcccagatcctggacgaacggcaagtacttctcggagccgtgggggcttttgactggtctggcggagctctgctctacgacaccagaagccgtagaggacgcttcttgaaccagacagcagccgctgccgctgatgccgaagccgctcaatattcctacttggggtatgccgtggctgtgctccacaagacctgctcactgtcttatattgccggagcacccagatacaagcaccatggagctgtctttgaattgcaaaaggaaggcagagaggcgagcttcctgcccgtgctggaaggagagcagatgggctcttattttggctcagagttatgcccggttgacatcgatatggatggctctacggactttctgctcgtggccgcacccttctaccatgtgcacggggaagagggcagggtgtacgtctaccggctgagtgagcaggatggtagcttctcgcttgcccgaatactcagcggtcaccctggcttcacgaacgcgagatttggattcgcaatggctgcaatgggagatttaagtcaggataagctcacagatgtagctattggtgcgccactggaaggattcggcgctgatgacggggcaagtttcggaagcgtttacatctataacggccactgggatgggctctccgccagtcccagccagcgtataagggcgtcaacggtcgctcccggattgcagtattttggcatgtctatggctggcggattcgacatttctggggacggactcgctgacattactgtggggacactgggacaagccgttgtttttcgctctcgaccagttgtcagactgaaagttagcatggctttcaccccttctgccttgcctattgggtttaacggcgtggttaatgtgcggctctgcttcgaaatatcaagcgtaactaccgcgagtgaaagcggcctgagagaagcattgctgaattttactctggatgtagacgtgggaaagcagcggcgtaggcttcagtgttccgatgtccgctcctgtctgggttgtctccgtgagtggtcctctgggagtcagttgtgcgaggatttgctgctaatgcctacagagggagagttgtgtgaagaggactgcttttccaacgcgtccgttaaggtgtcataccagctgcagacccccgaaggccagacggaccatcctcagcctatattagaccggtataccgagcccttcgcaatttttcagttgccctatgaaaaggcttgcaaaaataagctgttctgcgtcgctgagttacagttggccactactgtttcccagcaggagctggtggtgggtttgaccaaggaactgacgctgaacattaatctgacaaattccggggaagacagctatatgacgtcaatggcccttaactatcctaggaacctgcaactgaagaggatgcaaaagcctcctagtcccaacatccagtgtgatgatccacaacctgtggcatccgtgctcatcatgaactgtcgaattgggcacccagtactaaagcgctcctcagctcacgtgagcgtggtgtggcagctagaagaaaacgcgttccctaatcgtaccgctgatatcactgtgacggtgacaaacagcaacgagcgacggtcattggccaatgaaacccatacattacaatttagacatggttttgtcgctgtcctttcgaagccatcaataatgtacgtcaatacaggccaagggttgtcccatcacaaggaatttctgttccacgtacatggggaaaatctgtttggtgccgagtaccagctgcagatctgcgtgccaaccaaattacgcggattgcaagtcgtggcagtgaagaagctcacccggacgcaggcctccaccgtgtgtacgtggagccaagagagagcatgcgcatacagctcagtgcagcacgtggaggaatggcacagtgtctcttgtgtgatcgcttctgacaaggaaaatgtgactgtggcggctgaaatcagttgggaccattctgaggaactattgaaggatgtgaccgaactacagattttgggggaaatctctttcaacaagagtctgtacgaaggtctgaacgccgaaaatcaccgcacaaaaatcacagtggtatttctgaaagatgaaaagtatcatagccttcctatcatcattaaagggagtgtgggtggactgctcgtgttgatcgtgattcttgtgatcctgttcaaatgtgggttctttaaacggaaatatcagcagttgaacctggaaagtattcgcaaagcccagttgaaatccgagaatttgctagaggaagaaaattag

SEQ ID NO: 50802 - DNA, 2400 bp, Artificial Sequence
  Description of Artificial Sequence: Synthetic coding sequence
atgccgagagcgcctgctccactctacgcctgcttactcggactgtgtgcactgctgccgaggctggccggtctcaatatttgtaccagcggcagtgcgacctcatgcgaggagtgccttctgatacatccaaaatgtgcgtggtgtagtaaagaggacttcggctccccgcgatccattacgtctcgatgcgatctgcgcgctaacttggtgaagaacggatgtggcggagaaatcgagagtcccgcttcctcctttcatgttttgcggagccttcctcttagtagtaagggtagtggctcagcaggatgggatgtgattcaaatgacgccacaagagatcgctgtcaacctgagaccaggcgataaaacaaccttccagctgcaagttcgtcaggttgaagactatcccgttgatctgtattatctcatggatttgtccttatccatgaaagacgacttggataatatacgatccctggggaccaagttggctgaggaaatgcgcaaactcacttccaattttcgcctcggcttcggaagcttcgtagacaaggacattagtccgttctcatataccgcccctaggtatcaaacaaatccgtgtatcggttataaattatttccaaactgtgtcccgtcattcgggtttcgccatctgctgcctttgacagaccgggtggattccttcaacgaagaggttcggaagcagcgtgtgagtagaaatcgcgacgcgcctgagggcggatttgatgctgtgttacaagcagccgtctgcaaagagaagatcggttggaggaaggatgcgctgcacctcttggtgttcacaaccgatgatgtgcctcacattgccctcgacgggaagctaggaggcctggttcaaccccacgacggtcaatgccatctgaatgaggcaaacgagtacactgctagtaaccaaatggattatccttctctggctctactcggcgagaaactggctgaaaataatattaacctcatctttgccgtaacgaaaaaccactatatgctgtacaagaacttcacggctttgattccaggcaccacggtggaaatcctcgatggcgattccaagaacattatccagctgataatcaatgcttacaacagcattcgatccaaagtcgaactgagtgtttgggatcaacccgaagacctcaaccttttcttcaccgccacttgtcaagatggagtctcttatccagggcagcgcaagtgtgaaggtctgaagataggggacacggcatcttttgaagtgtccctggaagcccgttcatgcccttcgaggcataccgagcacgtgttcgcgctgaggcccgtcggtttccgtgacagccttgaagttggcgtgacttataactgcacgtgcgggtgtagcgtcggcctggagcccaattccgccaggtgtaatgggtcaggcacatatgtctgtgggctgtgcgagtgcagccccggatacctggggactcggtgtgagtgccaagatggggaaaaccaaagtgtgtatcagaacctttgtcgtgaggcggaaggaaaaccactgtgctccggcaggggggactgtagctgtaaccagtgttcttgcttcgaatccgaattcggaaagatctacgggcctttctgcgagtgtgacaacttttcttgcgcgaggaacaaaggggtcctgtgtagtggacatggcgagtgtcattgcggcgagtgcaagtgccacgccggttacattggcgacaactgcaattgctccactgacattagtacatgtagggggcgagacgggcaaatctgtagtgaacggggtcactgtctctgcggccagtgccagtgcaccgaaccaggagcgttcggtgaaatgtgcgaaaaatgcccaacctgcccagacgcctgtagcaccaagcgtgattgtgtagagtgcctcctgcttcattctggcaagcccgataaccagacctgtcatagcctgtgccgcgacgaggtgatcacatgggtggacacaattgttaaggacgatcaggaagccgttctgtgcttttacaagacagcaaaagactgtgtcatgatgtttacctatgttgagctcccatccggaaagagtaatctgaccgtactgagggagcctgagtgtgggaatacccctaatgcaatgacgattctattagctgttgtgggctcaattctgctggtaggacttgccttacttgcaatctggaaactgctggtcactatccatgaccgacgggagtttgccaaattccagagtgaacgttcccgggcacgttatgaaatggccagcaacccattgtaccgtaagccaatatccacccacaccgtggactttacgtttaacaaattcaacaagtcctataatggcacagtggattag

SEQ ID NO: 50803 - DNA, 1065 bp, Artificial Sequence
  Description of Artificial Sequence: Synthetic coding sequence
atggggcgactggtggctgtcggcttgctcggtatcgctctggccttgcttggggagcgccttttggccctcagaaacaggctgaaggcttccagggaggtggaaagtgtagacctgccacactgccatctgattaaggggatcgaagcaggaagcgaagatatagatattctgcctaatggactggcttttttctcggttggattgaagttccccggtctgcacagctttgcgccagacaagccaggtgggattttaatgatggacctcaaggaggaaaaacctcgtgctcgcgagctgcgcatatcgaggggctttgacttggcgtctttcaacccccatgggatttcaacattcattgacaatgatgatacagtgtatctgttcgttgtaaaccaccctgaattcaagaacactgttgagatcttcaagttcgaggaagctgagaattctctcctgcacctcaagacagttaaacacgaactgctgccgagtgtgaacgatattaccgccgtagggccagcacatttttacgcaaccaatgatcactacttctctgaccccttcttaaagtatctggagacctacctaaaccttcattgggctaacgtagtgtattactcacccaatgaggtcaaagtggtcgccgaaggattcgactccgccaacgggatcaatatctctcccgatgacaagtacatctacgtggcagacatcttagcacacgagatccacgtgctcgagaagcatactaatatgaatctgacccaactcaaggtgcttgagctggacaccttggtcgacaatctatcgattgaccccagttctggtgatatctgggtcggctgccaccccaatggccagaagctttttgtttacgaccctaataatccccctagctccgaggtgttacgaatccagaatatcctatccgaaaagccgactgtaaccactgtctacgcaaacaacgggagcgtgctgcaagggagcagcgtcgcatcggtatacgatggtaaactgttaatcggaaccctgtaccaccgagctctctattgcgagttatag

SEQ ID NO: 50804 - DNA, 1905 bp, Artificial Sequence
  Description of Artificial Sequence: Synthetic coding sequence
atgcttaaagtccatcccctaaaaaaataccccgtggacctgtattacctggtagatgtctccgcctcaatgcataataacatcgagaaactgaactccgtggggaacgatttgtctagaaaaatggctttcttcagcagggatttccgcctgggattcggatcctatgtggataagacagtgagcccctacatatccatacaccctgaacgtattcacaatcagtgcagcgattataatctggactgcatgcctccacacgggtacatccacgttctgagcctcacagaaaacataactgagttcgaaaaggctgtccatcggcagaagatctccgggaatatcgacacacccgaaggtgggttcgacgccatgcttcaagctgcagtgtgcgaaagtcacattgggtggcgaaaggaagcgaagaggctcctgttggtaatgaccgatcagacatctcacctcgctctggattctaaacttgccggaatagtggtgccaaacgatggaaattgccacctcaaaaataacgtttacgtgaagtccaccacaatggaacacccctcgctggggcagctgtccgagaagctgatcgataacaacatcaacgtaatatttgctgtccagggcaaacagtttcactggtataaggatttactgccacttttgcctgggactatcgctggggaaattgagtctaaagcagcaaatttgaataatttggtcgtagaagcctaccaaaaactgatctctgaagtgaaggtgcaggtcgagaaccaggtgcagggaatttatttcaacattaccgcaatttgcccggatggctccagaaagcccggtatggaaggctgccggaatgttaccagcaacgacgaggtgttgttcaatgtgacagtcaccatgaaaaaatgtgacgtaaccggtgggaaaaactatgcgatcatcaagccaatcggtttcaatgaaactgccaaaattcatatccaccgaaattgttcgtgtcaatgtgaagacaatcgtggacccaagggcaaatgcgtggacgaaacgttcctcgatagcaaatgtttccagtgcgacgagaacaagtgccatttcgatgaggaccagttctcatccgagagttgtaagagtcacaaagatcagccggtctgctccggcagaggcgtgtgcgtgtgcggaaaatgctcatgccataaaatcaaactggggaaggtctacggaaagtattgtgaaaaggacgacttctcctgtccataccaccatggtaatttatgtgcagggcatggggagtgcgaggccggtaggtgtcaatgcttcagcgggtgggagggagaccgctgtcagtgtcctagcgctgcggctcagcattgcgtcaactcaaagggacaagtctgtagcggtcggggaacctgtgtgtgcggaaggtgtgagtgtactgatcctcgtagcatcggacgtttctgcgaacattgtccaacctgctataccgcctgtaaggagaactggaactgtatgcagtgtttacaccctcataatctttcacaggctattctggaccaatgtaagacctcatgtgccctcatggaacagcagcattatgttgatcagactagcgagtgtttctctagtcctagctacttgaggatattcttcataatctttatagtgacatttctgataggtttactcaaagtgctcattattcgtcaggtaattctacaatggaactcaaataaaatcaagtcatcctcagactatagagttagcgcctctaaaaaagataaactaattcttcaaagcgtttgcacgcgagcagtcacatacaggagagaaaaaccggaagagattaaaatggatatcagcaagctcaatgcacatgaaactttcaggtgcaacttttag

SEQ ID NO: 50805 - DNA, 1314 bp, Artificial Sequence
  Description of Artificial Sequence: Synthetic coding sequence
atgactagctacatggctatcgatggttccgctctggtcccacttcgccagaagcctcggcgaaaaactcagggtttcttaaccatgagcagacggagaatatcctgcaaagatcttggacacgccgattgccaagggtggctgtataagaaaaaagagaagggctctttcctttctaacaaatggaaaaagttttgggtgatcctgaaaggcagctccctgtactggtatagcaaccagatggcagaaaaagcagacggctttgtcaacttgccagacttcactgttgagcgggcaagtgaatgtaagaagaaacacgcattcaaaattagtcacccgcagatcaagacattctactttgccgcagagaacgtgcaagagatgaatgtgtggctgaacaaattgggctccgctgtgatccaccaggaaagtacgacgaaggacgaggaatgctattccgaatctgagcaggaggatcctgaaatagccgcagaaaccccacccccaccccacgcatcgcagacccaaagcctcacagcccaacaggcctcctctagtagtccctcactttctgggacgtcctacagcttttcctcattggagaacacggtcaagaccccatcctcttttccctcctccctgtctaaagagcggcagagcctgcctgataccgtgaattctctgagtgctgcagaggatgaaggacagccaataacattcgcagtccaagtacacagccccgttccaagcgaggcgggtatccacaaagctctggagaatagctttgtaacatctgagagcggattcctcaactctttgtcaagcgatgacacaagctcgctgtcttctaaccacgatcacttgactgtgcccgacaagcctgctgggtcaaaaatcatggataaggaggaaacgaaggtttccgaggatgatgaaatggaaaagctgtataagtctctggaacaggctagtctgtcacccctcggcgaccggagaccttctaccaaaaaggagctccggaagtctttcgtgaaacgctgtaagaatcccagcatcaacgaaaagctccataaaataagaactcttaatagcaccttgaaatgcaaggagcacgacttagctatgatcaaccagctactggatgatccaaaactgaccgctcgtaagtatcgcgaatggaaagtgatgaacaccctgctcatccaggacatttatcagcagcaacgggcttctccagcccctgatgacacagatgacactccacaggagctaaaaaagagcccaagctctccgagcgttgaaaattcaatctag

SEQ ID NO: 50806 - DNA, 1317 bp, Artificial Sequence
  Description of Artificial Sequence: Synthetic coding sequence
atgacaagttacatggctatagacgggagcgccctgcaggtcccattaaggcagaagccaaggaggaagactcaaggattcttgacaatgtcccgcaggcgcattagctgcaaagaccttggtcacgccgactgccagggctggctttataagaagaaagaaaagggctccttcctttccaataaatggaaaaagttttgggttattttgaaggggagttcgctctactggtattctaatcagatggctgagaaggccgacgggtttgttaacctcccagatttcacagtcgaacgggcttcagaatgcaaaaaaaagcacgctttcaaaatcagccatccacaaatcaaaacattctactttgccgcagaaaacgtccaagagatgaatgtatggctcaacaagcttggctccgccgtcatacaccaggagagtaccaccaaagatgaagagtgttattccgagtccgagcaggaggaccccgaaatcgccgctgagacacccccacccccacatgcctcccagacacaatcactgacagctcagcaggcttcttccagctcccctagcttatctgggacctcttactcctttagcagcttagagaacacagtgaagactccctctagtttccccagtagcctgtccaaggagagacaatcacttccagatacagtcaacagtctgtctgccgctgaagacgaaggccagcccattacattcgcggtacaggtacattctccagtaccatccgaggctgggatccataaggccctcgagaacagcttcgtaacgtctgaatctggctttttaaacagcttgtcatctgatgacacatccagcctaagtagcaatcatgatcacttgacggtgcctgacaaaccagccggatctaaaatcatggacaaagaggagacaaaagtgtcagaggacgacgagatggaaaagttatataagtctcttgagcaggcgtccctcagccctctcggagatagacggcctagtaccaagaaggagctgagaaagagttttgtgaaaagatgtaaaaatccctcgattaacgaaaagctgcataagatccgaacgttgaattcgaccctaaaatgcaaagaacacgatctagctatgattaaccagctgctggatgaccctaagctgaccgctaggaaatatagggagtggaaggtcatgaacactctcttgattcaagatatctaccagcagcaacgtgcaagcccagcacccgacgacaccgacgacactccccaagaattgaaaaagtctcctagcagcccttcagtggaaaactccatttag

SEQ ID NO: 50807 - DNA, 1317 bp, Artificial Sequence
  Description of Artificial Sequence: Synthetic coding sequence
atgaccagttacatggcgatagatgggtcggccctgcaggtccccctcagacagaaacccaggcggaagacccaaggatttctgacgatgtccagaaggcgcattagctgcaaagacctggggcacgccgactgtcaaggctggttgtacaaaaaaaaagaaaaaggttccttcttgagtaacaaatggaaaaagttctgggttattctcaagggatctagcctttactggtattctaatcagatggctgaaaaagccgacgggtttgtcaatctccctgactttacggtcgaaagagcctctgaatgcaagaaaaaacatgcattcaagatctctcatcctcagattaagacattttatttcgcagctgaaaacgtgcaagagatgaacgtgtggctgaacaaactaggaagcgctgtgattcaccaggaaagcactacaaaggacgaagaatgttactcggaaagcgaacaagaagatcccgaaatcgccgctgaaacgccccctcctccccacgcttcacagacacagagcttgaccgcacagcaggcgtctagttcatctcccagcctgtccgggactagttactccttctctagcctcgagaatacagtaaaaaccccctccagctttccatccagtctttcgaaagagcggcagtcactccccgacaccgtcaactctttgtcagccgctgaggacgaaggacagccaatcaccttcgccgtacaggtccattcacctgttcctagcgaagccggtatccacaaagccctggagaattctttcgttacttccgaatccggcttccttaattcgctgtcttccgacgacacgagctctctgtcttctaaccacgatcacctaacagtacccgacaaaccagctggatctaaaatcatggacaaggaggaaacaaaagtttcagaagacgacgagatggagaaactgtataaatctctggagcaagcttcactgagcccgctaggcgatagacgcccatcgacaaaaaaagagctgcgcaagagcttcgtcaagcgttgtaagaaccctagcatcaatgaaaaactccataaaatccgcaccttaaatagcactctgaagtgcaaagagcacgacctagctatgattaatcagttgctggacgatcccaaattgacagccaggaagtacagggagtggaaggttatgaacacactgctgatccaggatatctaccagcagcagagagcgtcccccgcaccagacgacactgatgacactcctcaagaactgaaaaagtcacccagctcccccagtgttgagaatagcatctag

SEQ ID NO: 50808 - DNA, 237 bp, Artificial Sequence
  Description of Artificial Sequence: Synthetic coding sequence
atgactagctatatggccatcgacgggagcgctctcgtccctttacgtcagaagcccaggcgtaagacgcaggggtttttgaccatgtcccgccgacgcattagttgcaaagatttggggcatgcagactgccaaggttggctgtacaagaaaaaagaaaaaggttcatttctatccaacaagtggaaaaaattttgggtcatccttaaaggctcttctttgtactggtatagctag

SEQ ID NO: 50809 - DNA, 396 bp, Artificial Sequence
  Description of Artificial Sequence: Synthetic coding sequence
atgttctccgacaattcacattgcccagactgcggccagcaatggtttccctccttagagctgggtcactggctttaccaaacagaactggtggagaatgagtgctaccaggtctttcttgatagaatcaatagagcagactactgccctgagtgttacccagataaccctgccaatagatcactggtactgccatggagcttccctttggagtgggctccccaaaatcttacaaggtggacttttgagaaggcctgccacccctttctgctgggaccaccacttgttcgaaagaggattcatgactcacgtgtggcgggtttcaatcccgcattacaattaatcctgacccgcacagacaagaccctgaataagaaactgggtcagaataagtag

SEQ ID NO: 50810 - DNA, 687 bp, Artificial Sequence
  Description of Artificial Sequence: Synthetic coding sequence
atgagggagggtaagagaggtcccccttgcattctgtccttcaggggtactctggagcgcgttgaagcacagtgggaactggaagcacagggcccaggccaatgtccagcccctctcggcgatcccgcaagtacgacagatggggctcaggaagctcgggtgccgctcgatggcgctttctggattcctagaccccctgctggaagccccaaggggtgcttcgcatgtgtttccaagccccctgcgctgcaggctcctgccgcaccagcacccgaaccctcagcttctccgcctatggctccaaccctattcccaatggagtcaaagtccagtaagacagactccgtgcgagcagctggggctcctcccgcttgtaagcacttggccgagaagaaaacaatgacgaatcctaccacggtaatagaggtgtatccagacactactgaggttaacgactactacttgtggtccatatttaacttcgtctacctgaatttctgctgcctgggttttatcgccctcgcatacagccttaaagtcagagacaaaaaacttctaaacgacctgaacggggcagtagaagacgcaaaaacagcgcgtctcttcaacatcacatcaagtgcactggctgcttcctgtatcatcctcgtttttatctttctccggtatcctcttaccgactattag

SEQ ID NO: 50811 - DNA, 399 bp, Artificial Sequence
  Description of Artificial Sequence: Synthetic coding sequence
atggacaccgcctacccccgagaggacacaagagccccaaccccatcgaaggcaggagcccataccgcgctgacactgggagcgccacacccacccccaagggatcatctaatctggtcagtcttttctactctgtatttgaacctgtgttgcctggggttcctggctctggcctattctattaaagcaagagaccaaaaggtggtcggagacttagaggcagctaggaggtttggctccaaggctaaatgttataatatccttgccgctatgtggaccctggtccctcctctactgctgctgggtctagtggtcactggcgcactacatctggcccgactggcaaaggattccgccgctttttttagcacaaaatttgatgacgcagactatgattag

SEQ ID NO: 50812 - DNA, 1551 bp, Artificial Sequence
  Description of Artificial Sequence: Synthetic coding sequence
atgcccgtgccagagcggccagctgctggccctgattctccaagacctggaaccagaagggctgctcccagagttttgttcggagaatggttgctcggggagatctcttccggatgctacgaagggctgcagtggctagacgaggcgaggacctgcttcagggtcccgtggaagcatttcgccaggaaagatttgagtgaagccgacgccagaattttcaaggcttgggctgtagctaggggccgttggccaccaagttctaggggcggaggtccccctccagaggccgagaccgcggaaagagctggttggaaaaccaattttaggtgtgccctgcggagcacccggagatttgtaatgttacgcgacaactccggcgaccctgccgatcctcataaggtttacgccctctctcgtgaactgtgctggcgtgagggcccagggactgaccaaacggaggccgaagcgcctgctgcggttccccctccccagggaggcccaccaggcccatttttggcacacactcatgcaggcctccaggcccctggcccactgccagctccagctggtgataagggggatctcctattgcaggctgtgcagcagtcctgtctggccgatcatctgctcactgcgagctggggggctgacccggtcccaacaaaggctccaggggaggggcaggaaggcttgcctctgaccggtgcctgtgctggcggtcctgggctgccagctggggaactgtacgggtgggcggtggagacgactccttcgcccggaccccaaccagccgcactgacaacaggcgaggcggcagcacccgagtccccccatcaggccgaaccatacttatctcccagtccatccgcttgtacggctgtgcaggagccctcgcccggagccctcgatgtgaccattatgtacaaaggaaggaccgtccttcagaaggtggtcggtcatccatcctgcacctttttgtacggcccaccagacccagccgtgagggcaaccgacccacagcaggtggcctttcccagccctgccgaactccccgatcagaaacagcttaggtacacagaggagctcctccgtcacgttgcacctgggctccacctggagctgagaggaccccagctgtgggccaggaggatggggaaatgcaaggtttattgggaagttggaggcccaccgggaagcgctagcccatccacccctgcttgcctgctgccacgcaactgtgacaccccgatcttcgacttccgggtgttctttcaggagctggttgagtttagggcccgacagaggagagggtcaccccgatacacaatatacctggggttcggacaggacctaagcgcgggaaggcctaaggagaagtccttggtgctggtgaaacttgagccatggttgtgtagggtccatcttgaggggacccaacgcgagggggtcagctctctggattcatcttctctgagcttatgcctcagttcggccaatagcctatacgatgatatcgagtgttttcttatggagctggagcaacctgcttag

SEQ ID NO: 50813 - DNA, 1425 bp, Artificial Sequence
  Description of Artificial Sequence: Synthetic coding sequence
atggcattggcgcctgagagggccgctcctcgcgtcctcttcggagagtggttgctcggcgagatctcctccggatgctacgaagggcttcagtggctggacgaggcaaggacttgtttccgcgtaccttggaagcactttgcccgtaaagatctctccgaggcagacgctcggatatttaaggcctgggcagtggcgcgagggagatggcctccctcttcgcgcggtggcggaccccctcccgaagctgagaccgcagaacgcgcagggtggaagacaaattttcggtgtgcccttaggtctaccagacggtttgtaatgctccgtgataatagcggggacccggctgacccacataaggtctacgcattatcaagagaattgtgctggcgggagggcccaggaacagaccaaacagaagcggaggctcccgcagccgtaccgccacctcaggggggtcccccaggcccattcttagcacacacccacgcaggactgcaggcacctggcccactcccagccccagctggggacaaaggggacctgctgctccaggccgtacagcaaagctgcctggcagatcatctcttaacagcgagttggggggcagaccccgtccctacaaaggccccaggggaggggcaagaaggtctaccgctgacaggcgcttgcgctggcggtgaagccgctgcacctgagtcaccccaccaggctgagccttacctttcacccagccctagcgcctgtacagccgtgcaagagcccagccccggagcactcgacgtcacaatcatgtacaaggggagaacagtcctgcaaaaggttgttggccatccttcgtgcaccttcctctacggtccccctgatccagcagtgagggctaccgacccccagcaggtggctttcccgtccccagctgagttgcccgaccagaagcaactgcgatataccgaggagctcctccggcatgtggcccctgggctgcacctggaactgagaggccctcaactgtgggccagaaggatggggaagtgcaaagtatactgggaggtgggcggaccccctggctctgcatccccatcaacccccgcatgcctgctgcctaggaactgcgacacccccatatttgatttccgcgtgtttttccaggaactagtggaattcagggccagacagaggagggggtcaccaaggtacacaatctacctcggtttcggccaggatctgagcgccggaaggccaaaggaaaaatcccttgtgctggttaagctggaaccttggctgtgtagagtgcacctggagggcacacagagagagggggtgtcttctctggactccagctccctgagtttgtgtctcagcagtgcaaactccttgtacgacgacatagagtgcttcctgatggaattggaacagcccgcttag

SEQ ID NO: 50814 - DNA, 633 bp, Artificial Sequence
  Description of Artificial Sequence: Synthetic coding sequence
atgtataaggggaggaccgtattgcaaaaagtcgtgggccacccttcctgtactttcttgtacggcccaccagatcctgcagtacgagccactgatcctcaacaggtcgctttccctagtcccgcagaacttcctgaccagaagcagctgcgatatacggaagagcttctgaggcatgttgcccctggtttgcatttggaactacggggaccacaactctgggcaaggcgcatgggaaaatgcaaggtctactgggaggttggaggacctcccggttctgccagcccatcgacacccgcttgtttactgccgcgtaactgtgatacacctatattcgacttcagggtttttttccaggagttggtcgagtttagggctagacaaaggcgcggaagcccccgatataccatttacctaggcttcggacaagacctctcagcaggcaggccaaaagaaaaaagcctagtgctcgtcaagctggagccctggctgtgccgtgtgcacttggagggcacccagagggagggcgtgtccagtcttgactctagttcattaagcctctgcctgtcttcagcgaattcactttatgacgatatcgagtgtttcttaatggagctggagcagccggcttag

SEQ ID NO: 50815 - DNA, 1551 bp, Artificial Sequence
  Description of Artificial Sequence: Synthetic coding sequence
atgccagtgcctgagaggccagctgcagggcctgacagtccgaggcccggaacacggagagccgctcctagggtgttgtttggcgaatggctcctaggagagatctctagtggatgttatgaaggacttcagtggctggacgaggcgagaacctgtttcagggtgccatggaagcacttcgccagaaaagatctgagcgaggcggatgcgagaatatttaaagcgtgggccgtggctcggggaagatggccccctagttcacgaggtggaggacctccacccgaggcggaaaccgccgagcgagccggatggaagaccaactttagatgtgccctgaggtctacgcgaagattcgtgatgctcagggacaattctggagaccctgcagacccgcacaaggtgtatgctctatctcgggagctttgttggagggaggggcctggtactgaccagactgaggccgaagcgccagcggctgttcccccaccacagggaggaccacctgggccttttctggcccatacacacgctggactccaagctcctgggcctcttcccgcacccgcaggcgacaaaggggatctcctgctgcaggcagtccagcaaagctgcctagctgatcacctgctgaccgcatcttggggtgcggatcctgtcccaacaaaagcacccggtgagggccaggagggtctccctcttactggggcttgtgcagggggtccaggactgcctgccggagaattgtacggctgggccgtggagacaacaccatcaccgggtccccagcccgcagccctgacgacgggcgaagccgcagcacccgagtcccctcaccaggcagagccttatctgtctcctagtccgtcagcctgcaccgcggtccaggagccgtcccccggagccctggacgtgaccattatgtataagggtaggacggtgttgcaaaaagtggtggggcacccctcctgtacctttctgtacggccctccggaccccgcagtgagagccaccgacccccaacaagttgccttccctagccccgcagaactgcccgaccagaaacagctgcggtataccgaagagcttttgcggcacgtggcccctggactgcatctcgaactgcggggtccacagctgtgggcaagacgcatggggaagtgcaaggtctactgggaggttggtggaccgccaggatctgcgagcccaagtactcctgcttgcttactcccacgcaactgtgatactccaatatttgacttcagagtctttttccaggaattagtcgaatttcgggcaagacagcggaggggtagcccgagatatacaatttacctgggctttggccaggacctgagcgccggacggcctaaggagaagagcctcgtactcgtgaaactggagccctggctgtgtcgcgtccatctggaggggacccaaagggagggtgtgtccagtttggatagctcctctctctccttgtgcctgtcgagtgccaactcgctctatgacgatatcgaatgttttttgatggagcttgaacaaccagcctag

SEQ ID NO: 50816 - DNA, 1425 bp, Artificial Sequence
  Description of Artificial Sequence: Synthetic coding sequence
atggccctcgcccctgagcgggcagctcctcgagtcctgtttggggagtggttattgggagaaatcagcagtgggtgctacgagggactgcaatggctcgacgaggcccgaacctgctttcgggtgccctggaagcattttgctagaaaggatctcagcgaggcagacgccaggattttcaaagcatgggcggtagctcgagggagatggcctcccagctcacgcggaggtggtccacctcctgaagcggagacagcagagcgggctggttggaagacaaatttccgttgtgccctgcgctcgacacgacgatttgttatgctgagagataattcaggagacccagcagatcctcacaaggtttatgcgctttctcgtgagttgtgttggcgcgagggccctggaactgatcagacagaagctgaggcccctgccgcagttccgcctcctcagggaggccctcctggcccattcttggcgcatactcacgctggactacaagctccgggtccgctccccgcacctgccggagataagggagacttgttgttgcaggcggtgcagcaatcgtgtctggcggaccatctgctaaccgctagctggggtgcggatccagtgcctacaaaggcacccggtgagggccaggaaggacttccattgaccggagcatgcgctggcggagaggccgcagctcctgagtcacctcatcaggcggagccgtacttgagtcctagcccttctgcctgcacggccgtgcaggaacccagccctggagctcttgacgtgactattatgtacaaaggccgtactgttctgcagaaggtagttgggcatccgagctgcacatttctttatgggcctcctgatcctgccgtgcgagccaccgatccccagcaggttgcattcccctctccggcagagttgccagatcagaaacagctccggtatactgaggaactactccgacatgtggcccctggcctccacctagagctgagaggccctcagctatgggccagaagaatgggcaagtgtaaggtttattgggaggtcggcggacctccagggtcagccagcccttctactcccgcatgccttttaccacgcaattgcgacactccaatctttgactttcgggtgttctttcaggaactggttgagttcagagccaggcaacgccgaggatccccacgctacactatctacctcggatttggacaggatctgtccgccggtagacctaaagaaaagtccctggtgctggttaagctggaaccttggctgtgtagggtacatctagaagggacacagagagaaggcgtgtccagcttggactctagcagcctcagtctgtgcctgtctagtgctaattccttgtatgacgatatagagtgtttcctcatggaactggagcagcctgcctag

SEQ ID NO: 50817 - DNA, 1512 bp, Artificial Sequence
  Description of Artificial Sequence: Synthetic coding sequence
atggcccttgcccctgaaagagctgccccacgggtcttattcggagaatggctactgggagagatcagtagcggatgttacgagggcctgcagtggctcgacgaagcaaggacctgttttcgggtgccttggaagcactttgccagaaaggacctgtctgaagctgacgcaaggatatttaaagcatgggccgtagctcggggtcgatggcccccttctagtcgaggaggcggaccccctcctgaagctgagactgctgagagggctggctggaaaaccaatttccggtgtgctctacgcagtacccggcgattcgttatgttgagagataacagtggggaccctgctgaccctcacaaggtatacgcgcttagcagggaattgtgctggagagaaggacctggaacagaccagacggaagccgaggccccagctgccgtgcccccaccacaaggcggacctcccggtccattcctggcccacacgcatgctggcctccaggcccctgggccactccccgctcctgccggtgataagggcgacctcctgctgcaggctgtccaacagtcttgcctggccgatcatctcctgaccgcctcttggggcgctgatccagtcccgaccaaggctcctggcgagggccaggaggggctccccttaacgggagcctgtgcgggtgggccagggctgcctgccggtgagctttacggttgggcggtcgagactacgccgtctcctggtcctcagcctgcagccctcaccaccggagaagcggcagctcccgagtcgcctcatcaggccgagccttacttatcaccgagcccctcagcctgtactgcggtccaggagccatcccctggagccctagacgtgacaatcatgtataaaggcaggaccgtattgcagaaagtggtgggccatccctcttgcaccttcttgtacggccctccggaccccgctgtaagggcaactgacccccagcaagtggcttttccttcacccgctgagttgcccgatcagaaacagctgcgctacacagaagagctactccggcacgtcgctcctggcctccacctggaattaagaggacctcaactctgggccaggaggatgggaaagtgcaaggtctactgggaggtggggggtccgccaggctcggcgtctccctccacccccgcttgccttttgcctagaaattgcgatacccccatctttgactttcgcgtgttctttcaggaattggtggaattcagagcccgtcagcgccgtgggtccccacgctatactatttatctgggatttgggcaggacctgtctgccggaaggcctaaggagaaatccctagtcttggtcaaactggaaccgtggctgtgccgtgttcatttggaaggaacccagagagagggggtgtcctcgctggactctagttctctgtctctctgcctgtcaagtgcaaactcactgtacgacgatatcgaatgctttttaatggagctcgagcagcccgcatag

SEQ ID NO: 50818 - DNA, 315 bp, Artificial Sequence
  Description of Artificial Sequence: Synthetic coding sequence
atgggtaaggagagcggatgggactccggcagagccgctgttgcggctgtcgtcgggggagtggtggctgttggcaccgttctggtggctctcagcgcaatgggttttacatccgtggggattgccgcatcaagcatagccgcaaagatgatgagcaccgccgcaattgcaaatggaggcggagtagctgcgggatcccttgtggcaatactgcagtccgtaggcgctgcagggcttagcgtgacttctaaagtcattgggggtttcgccggaactgcccttggcgcttggttgggctcacccccatcttcctag

SEQ ID NO: 50819 - DNA, 315 bp, Artificial Sequence
  Description of Artificial Sequence: Synthetic coding sequence
atggggaaggagtcgggctgggattctggcagagcggcagttgccgctgtagtgggaggcgtagtcgcggtggggacggtcctggtagcactgagcgctatgggttttactagcgtcggaattgcggcttccagcatcgctgccaaaatgatgagcactgctgctattgcaaacgggggaggcgtagccgcaggctccctggtggccattctgcaatccgtaggcgcagccggtctctccgtgacctccaaggtaatcgggggattcgcgggaactgctctgggcgcatggctcgggtctccgccaagcagttag

SEQ ID NO: 50820 - DNA, 393 bp, Artificial Sequence
  Description of Artificial Sequence: Synthetic coding sequence
atgatgaagagggccgctgccgcagcagtaggaggcgcacttgcagtcggggcagtcccagtggtcctgtccgctatgggcttcaccggtgcgggaatagccgcaagcagcatcgcagccaagatgatgagtgctgccgctatcgcgaacggaggaggcgtgagtgccggtagccttgtagctactctgcagtcagtgggcgctgccggactgtcaaccagttctaacattctcctggcgagtgtgggatccgtgctgggcgcttgcctcgggaactctccctcctcaagccttcctgccgagccagaggctaaggaagacgaagctcgcgagaacgttccacaaggcgaacctccaaaaccacctctcaagagcgagaaacacgaggagtag

SEQ ID NO: 50821 - DNA, 417 bp, Artificial Sequence
  Description of Artificial Sequence: Synthetic coding sequence
atgagacagaaggctgttagtctctttctatgctacttacttttgttcacatgttcaggggtcgaggcaggggagaatgccggaaaggacgctggtaaaaagaaatgctccgagtcctccgattccggctccggtttctggaaggccctgaccttcatggcggttggcggtggtttggctgtcgccggtttaccagcattgggcttcactggagcaggtatcgccgctaactccgtggctgcgagtttaatgagttggtccgctattttgaacgggggaggcgtgcctgcaggcggattggtggccactctccagtccctgggagctggtggatcgtctgtggtgatcggcaacattggtgctctgatggggtacgctactcacaaatatctggatagtgaggaagacgaagagtag

SEQ ID NO: 50822 - DNA, 393 bp, Artificial Sequence
  Description of Artificial Sequence: Synthetic coding sequence
atgcgacagaaggcagtatccctgtttctatgttacctgttgctgttcacctgctccggagtagaggcaggaaaaaaaaagtgcagcgaatcgtcggatagtggctcgggtttttggaaagccttgaccttcatggccgtgggcggaggcctggctgtggcaggcctgcccgctctgggattcaccggtgcgggaattgctgctaactctgtcgcggcttctctgatgtcatggtcagctatactgaacgggggaggggttccagccggtggtctggtcgctacgctgcagtcactgggagccggaggctccagcgtggtgattggaaacatcggagctttaatgggatacgccacccacaagtatctggatagcgaagaggacgaagaatag

SEQ ID NO: 50823 - DNA, 405 bp, Artificial Sequence
  Description of Artificial Sequence: Synthetic coding sequence
atgcggcagaaagcggtctccttattcttgtgctatttattattgtttacatgtagtggcgttgaggctggagagaacgcgggaaaaaaaaagtgttccgaatccagtgattccggtagcgggttttggaaggccttgactttcatggctgtgggaggtggactcgcagttgccggactaccagctctgggattcaccggagcaggtattgcagccaattctgtggcagcgtcactcatgagctggtctgctatactcaatggagggggagtgcccgctggtggcttggtggctaccttacagagcctcggggctggtggctcaagcgttgtcatcggaaatatcggagctctgatgggttatgcaactcacaagtatctggactccgaagaggacgaagagtag

SEQ ID NO: 50824 - DNA, 978 bp, Artificial Sequence
  Description of Artificial Sequence: Synthetic coding sequence
atggcatggagtctcggcagctggttggggggttgtctcctggtgagtgccctcggcatggtgcctccccctgagaatgtacgcatgaactccgtgaatttcaaaaatatactgcagtgggagagccccgcttttgccaaaggcaacctaaccttcacggcccaatacctttcataccggatcttccaggataaatgtatgaataccaccctcactgagtgcgacttctcatccctaagcaagtacggggatcatactttacgggtgagagctgaatttgcggatgaacacagcgattgggtgaatatcactttttgtccagtcgacgacacaataattggcccacccggtatgcaggtggaggtgctcgctgactccctgcacatgagatttcttgctcccaagatcgaaaacgagtacgaaacatggaccatgaagaacgtttacaattcctggacctacaacgtccagtactggaagaacgggactgatgagaagttccagattactccccagtatgatttcgaagtgctccggaatctagaaccttggaccacttattgtgtacaagtaagggggttcctgccagaccggaataaagcaggggaatggagcgagccagtatgcgagcaaaccacccatgacgagactgttccttcctggatggtggctgtgatccttatggcctccgtgtttatggtttgtcttgcattactgggctgctttgcactgctatggtgtgtgtataagaaaacaaaatatgccttttctccaaggaactctctaccgcagcacctcaaagagttcctggggcatcctcaccataatactctccttttcttttccttcccattgagtgacgagaacgatgtcttcgataagctttctgttatcgcggaggattccgaatctggaaaacagaaccctggagatagttgtagccttgggacaccacccggtcagggtccacagagttag

SEQ ID NO: 50825 - DNA, 969 bp, Artificial Sequence
  Description of Artificial Sequence: Synthetic coding sequence
atggcctggtctttggggagctggctcggagggtgtttactcgtcagcgccctcggcatggtccctcccccagaaaacgtcaggatgaacagtgtgaattttaagaatatcctccagtgggagtctccagcgttcgctaagggaaacctcacatttaccgcccaatatttgtcctaccggattttccaggataaatgtatgaatactaccttgacagagtgcgatttctcatctcttagcaagtacggggaccacaccttaagggtccgggcagaattcgcagatgaacacagcgactgggtgaatattaccttttgtcccgtggacgacaccatcatcgggccacccggaatgcaggtcgaggttctggcggatagtctgcatatgcggttcctcgccccaaagattgagaacgaatatgagacatggacaatgaagaacgtgtacaactcttggacctacaacgtccagtactggaaaaacgggacagatgaaaaattccagattaccccacaatatgatttcgaggtgctgaggaacctggaaccttggacaacttactgtgtccaggtgcggggatttctccccgatcggaacaaggccggtgaatggagcgaaccagtttgtgaacaaaccactcatgacgaaacagtaccttcttggatggtggctgtgattctgatggcttccgtcttcatggtctgcctggccctattaggatgttttgctttgctgtggtgtgtctacaaaaagaccaaatacgccttttctcctagaaactcgctgccacagcacttgaaggaatttcttgggcacccgcaccacaacactttgctcttcttttccttcccactgtcggacgaaaacgacgtttttgacaagttatccgtcatagctgaggacagtgagtccggcaaacagaaccccggagatagtcccacctctcggacacccagaccatggacgtag

SEQ ID NO: 50826 - DNA, 444 bp, Artificial Sequence
  Description of Artificial Sequence: Synthetic coding sequence
atgaagcacctcttaatgtggagccctgttatcgccccaggggagaccgtctactactccgtagagtaccagggggaatatgagagtctgtacactagccacatttggattccttcaagttggtgtagcttgaccgaaggccctgaatgcgatgtgacagacgatatcactgccacggtgccctataacctgagagtgcgcgctacactgggtagccaaaccagtgcttggtctatcctgaaacacccttttaatcgcaattctacaattttgactaggcccggaatggaaatcaccaaggatggctttcacctagtaattgaactggaggacctcggccctcagtttgagtttctcgttgcgtattggcgccgtgagcccggtgcagaagaacggccttttccttggtactggccatgtctaccattgctggcctcatgttag

SEQ ID NO: 50827 - DNA, 936 bp, Artificial Sequence
  Description of Artificial Sequence: Synthetic coding sequence
atgcagacctttacaatggtgctggaagagatctggacatcactgttcatgtggtttttttatgccctgatcccttgcctgttaacagacgaagtggctatcttgcctgccccacagaaccttagtgtgctctccaccaatatgaaacaccttctgatgtggtcacccgttatcgcccctggagaaactgtatactactcagtggaataccagggcgagtatgaaagtctctacacatcacacatttggatccctagtagctggtgtagcctcacagagggaccagaatgcgatgtgacagatgatataaccgcaaccgtcccatacaatctgagggtgcgcgctaccctgggctcacaaacttctgcctggagcattctgaagcacccgtttaacagaaactctactatcctgaccagaccaggaatggagataacaaaggacggctttcacctggttatcgaactcgaggacctgggtccccaatttgaatttctcgtcgcatactggagacgggaacccggtgctgaggagcacgtcaaaatggttcgcagtgggggaatccccgtccacctggagacgatggaacctggcgcagcctattgcgtgaaagctcaaactttcgttaaggcaataggacggtattccgcattctcccagacagagtgcgtggaagtccagggtgaggccattcctctcgttctcgctttgttcgctttcgtgggatttatgctgatcctggtggttgttccgctttttgtgtggaaaatggggaggcttttacagtatagctgctgcccagtcgtcgtactgcctgacactcttaaaattacaaatagtccccagaagcttatcagttgtagacgagaagaagttgacgcatgtgcaaccgctgttatgtcccccgaagagctactgagggcttggatcagttag

SEQ ID NO: 50828 - DNA, 1725 bp, Artificial Sequence
  Description of Artificial Sequence: Synthetic coding sequence
atgcgcacgctgctgaccatccttactgtgggcagccttgctgcccacgcgccagaagatccgtccgacctgctgcaacacgttaagttccagtctagcaacttcgagaacattctgacctgggacagtgggccagaaggtactcctgataccgtatattcgattgagtataagacctacggcgaacgggattgggtcgccaagaaaggctgccagagaatcactcgaaagtcctgtaatcttaccgttgagacaggcaatctgactgagctttactacgctcgagttaccgccgtttccgctgggggaagatcagcgactaagatgaccgacaggttcagtagcctccagcatacaacattaaagccccctgatgtcacatgcatcagcaaagttagatcgattcagatgattgtgcacccaacccccaccccaattcgtgccggagatggccacaggttaacactggaggatattttccacgatctcttctatcacctggagctccaagtcaaccgaacataccagatgcatttgggcggaaaacagcgtgaatatgaatttttcggacttacccctgacaccgagttccttggaacgatcatgatctgtgtgcccacctgggcgaaagaatcggccccatacatgtgccgtgtgaagactctgccagaccggacatggacctattctttctctggcgcattcctgttctctatgggcttcttagtagccgtcctatgttacttgtcctaccgctatgtgacaaaaccccctgcccctcccaatagtctaaatgtgcagagggttctgacgttccagcctctgcgctttatacaagagcatgtccttatcccagtgttcgatctctctgggccatcatccctcgcacagcctgtccagtacagccagatccgtgtgtccggtccacgggagcctgccggagctccccaaaggcacagccttagcgaaatcacctatctcgggcaaccagacatctcgatcttgcagcccagcaacgttccaccgcctcaaatcttgtcccccctctcttatgccccaaacgcagctcctgaagtggggcctccaagctatgcccctcaggttacacccgaggcccaattcccgttctacgctccacaggctatctctaaggtccagcctagctcttacgcccctcaggcaacccccgattcttggccgccttcatacggcgtgtgtatggaggggagcgggaaagattcccccaccggcaccctgtcatcccctaaacatctacggccaaaggggcagctgcagaaagagcctcctgccggaagttgcatgctgggaggcttgtcacttcaagaggtcactagcctcgctatggaagagagtcaggaggctaagtctcttcatcagcccctggggatctgcaccgatcggaccagcgatcctaacgtccttcattctggcgaggaaggcaccccccagtacctgaagggacagctcccactgctatcatccgtccagatcgagggccaccctatgtctctgccgctacaacccccaagccggccttgcagcccatccgatcagggacccagcccctggggcttactcgagagcttggtttgcccaaaggatgaagctaagtcccccgctccggagacgtcagacttggagcagccgacagagcttgactcactcttccgagggcttgccctgacagttcagtgggagtcttag

SEQ ID NO: 50829 - DNA, 1911 bp, Artificial Sequence
  Description of Artificial Sequence: Synthetic coding sequence
atgcgaggcggacgaggggcacccttttggctgtggccactgccaaaactcgccctgttgcccctgttgtgggtactgtttcaacggacgcggccacaaggatcagccggacccctgcagtgttacggcgtgggacccctgggtgatctgaactgctcctgggagccactcggggatctgggggcaccatccgaactccacctgcagtctcagaagtacagaagtaacaagactcagactgtggcggtggccgctggccgtagctgggtggctatcccacgagagcagctgacaatgtccgataaactgctcgtctggggtacaaaggcgggacagccgctgtggccaccagtatttgtcaatcttgagacccagatgaaaccaaatgcgcctagactcggtcctgacgtggacttcagtgaagacgacccactggaagccacggtgcattgggcaccccctacctggccttcccataaggtgctgatctgccaatttcactacagacgatgccaagaagccgcttggaccttgttagagcccgagcttaaaaccatcccccttactccagtggagatccaggacctggagctggccaccggttacaaagtgtatgggcgatgtaggatggagaaggaagaagacctgtggggcgagtggagccccatcctatcttttcagaccccgccaagcgctcctaaagatgtgtgggtatctggtaatctctgtggaacccccggaggcgaagaacccctgctcctgtggaaagcgcctgggccatgcgtccaggtaagctataaggtgtggttttgggtgggcggacgggaactgtcacccgaaggcattacctgttgctgcagcctgattcctagcggtgctgagtgggccagggtgtccgcagtcaacgctacgagctgggaaccgctcacgaacttatcgctcgtgtgcttggattccgctagcgctccacggagtgtcgccgtgagtagcattgctggatccacagaactgctggtcacatggcaaccaggacctggtgaaccactggaacacgtggtcgactgggcgagggacggcgatcccctggaaaaactgaattgggtaagattaccaccaggcaacctgtccgcccttctgcccggaaattttacagtcggcgtcccctataggataaccgtgactgccgtctccgcctctggcctggcctcagcaagcagcgtgtggggttttagagaggagctggcccctctggtgggtccaaccctttggcggctgcaagacgccccaccagggacccccgctatagcctggggggaagtgccgagacaccaactgcgcggacacctcactcattacacattatgcgctcagtctggcacatcgccctctgtttgtatgaatgtctcggggaatactcagtctgtcacgctccccgatctcccctggggcccttgcgagctgtgggtgacagctagcaccatcgcgggtcaggggcctcccggacccatcctacggctgcacctgccagacaacactctcaggtggaaagtcctgcccggaatactgtttctgtggggcttgtttttactgggatgtggcctttctcttgcgacttcaggcagatgctaccacctacggcacaaagtgctgccacgctgggtatgggagaaagtgccagatcccgctaattcctcttctggtcagccgcatatggagcaggtgccagaggcacagcctcttggtgacctgccaatactcgaagtggaggagatggaacccccacctgtcatggagtcgagtcagcctgcgcaggccaccgcgcctttggatagtgggtatgaaaagcacttcctcccaactccggaggagctcgggctgttgggaccacccagaccgcaggtgctggcctag

SEQ ID NO: 50830 - DNA, 453 bp, Artificial Sequence
  Description of Artificial Sequence: Synthetic coding sequence
atgactatcctgggcactacatttggtatggtgttctctctcctccaagtcgtgtctggagaatctggctacgcacagaatggcgacctcgaagacgccgaattggatgattactctttttcttgttatagccagttagaagtgaacggctctcaacacagtctgacttgtgccttcgaagatccagacgtgaatattacaaacctggagttcgagatttgcggggctctggtcgaagtcaaatgtctgaattttcgcaagctccaggaaatttattttatcgagaccaagaagttccttttaataggaaaaagcaatatctgtgtgaaggtgggggagaaatccctcacatgcaaaaagatcgatctgactactattgggaagaagctatatatcaaggtttggctttccttacttggctatctgaaaacactgtgtctggatattctctag

SEQ ID NO: 50831 - DNA, 543 bp, Artificial Sequence
  Description of Artificial Sequence: Synthetic coding sequence
atgacaattctggggaccacctttgggatggtgttctctcttttacaggtggttagtggtgagagcggctacgctcaaaacggggatttggaggatgccgagctcgatgattatagcttttcttgttactcacaactggaagtaaatggctcccagcatagcctgacttgtgcattcgaagatccagacgtgaatattacgaacctagagtttgagatctgtggtgccctggtcgaggtgaagtgcctgaacttcagaaagcttcaggagatttatttcattgaaacaaaaaagtttctgctgattggcaagagcaatatctgcgtgaaggtgggagagaagtcattgacatgtaaaaagattgacctgacgactattgtgaaaccagaggcccctttcgatttgtctgtggtgtaccgcgaaggagccaacgatttcgtggtgacattcaacacctcacatttgcaaaagaaatatgtcaaggtactaatgcacgacgtggcctatagacaggagaaagatgagaacaagtggactgactag

SEQ ID NO: 50832 - DNA, 1893 bp, Artificial Sequence
  Description of Artificial Sequence: Synthetic coding sequence
atgcctttagggggaagagcgtctctcacgccgcagaagttatggcttgggacggccaagcccggaagcctcacgcaggctctcaactctccgttgacttgggagcacgcgtggacaggggttccagggggtaccccagattgcttgactgacacatttcgagtaaaaaggccacatctgagaaggtccgcatcaaatgggcacgtgcccggaactccagtctacagagagaaggaagatatgtacgatgagatcattgaattgaagaagtccctgcacgtgcagaagtccgacgtggacctgatgcgcactaagctcaggcgcctggaagaggagaactcccgaaaagaccggcagatcgagcagctgctggatccgtcaaggggcaccgactttgttcgcacacttgccgaaaaaaggcccgacgccagttgggtgattaatggactgaagcagcgtatcctaaaactcgaacagcagtgtaaggagaaagatgggacaattagtaagctgcagaccgatatgaagaccactaatcttgaggagatgagaattgccatggagacctactacgaggaagttcacaggctgcaaactctcctcgcatctagcgaaacgacgggcaagaaacctctaggagagaagaagaccggcgctaagcgccagaagaagatgggcagcgccctgttgtctctgagtcgatccgtccaggagctgaccgaagaaaatcagtccttgaaagaagatctggatagagtcctgagcacatccccaactataagcaaaacccaggggtacgtggagtggtctaaaccaaggctcctccggaggatcgtggaattggaaaagaaactctctgtgatggaaagcagcaaatcccacgcagcagaacccgttcgctcacatcctcctgcttgtttagcctcttcttcagccttacaccggcagcctcgcggagatcgcaacaaggaccacgagcgactccgaggcgcagtacgcgatctgaaggaagagcggacggcccttcaggaacagcttctacagagagatctggaggtgaaacagctcctgcaagcgaaggccgacctggaaaaggaactcgagtgtgcacgggaaggtgaggaggaacgccgtgagcgcgaagaggtcttgagagaggaaatacagactctgacttccaagctgcaggagttacaagagatgaaaaaggaggaaaaagaagactgtccagaagtacctcacaaggctcaggagctgccggctccaactccaagctcaagacattgtgaacaagactggcccccagactcatcagaagaagggctgccccgtccacggtcaccttgcagtgacggcaggagggacgcggcagcccgagtgctgcaagctcagtggaaggtgtacaagcataagaaaaaaaaagccgtgctggatgaggcagccgtcgtactgcaggcagcctttcgcggacacctgacccgaacaaagctcctggcatcaaaggcccacggctccgagccaccttctgtgcccggtttgccagaccaaagttccccggtgccacgcgttccaagcccaatcgcccaggccacaggaagcccagtgcaggaggaagcgatcgtcataatccagtctgctttgcgggctcatttggcacgcgcaagacatagcgccacaggcaagcgcacgactacagccgcatctacgagacgcaggagtgcctcagcgacgcacggggatgcgtcgtctccaccattccttgcagcactgcctgatccgtcacctagcgggcctcaagcgttggccccattgcccggtgacgacgtaaattccgacgatagtgacgacatcgtgatcgcacctagcctgcctacaaagaacttccctgtatag

SEQ ID NO: 50833 - DNA, 2088 bp, Artificial Sequence
  Description of Artificial Sequence: Synthetic coding sequence
atgtttctgggcaccggagaaccagcacttgataccggagacgactccctcagcgccgttacgtttgactcagatgtcgagacaaaggcaaaacgtaaagcattccataagccccctcccacgtctcctaagagcccttatctgagcaagccacggaaagttgcaagctggcggtctctgcgcactgccggttctatgcccttgggaggtcgggcttcattgacaccacagaaattgtggcttggcacagccaagcctggttccctgacccaggcgctgaatagtcccttgacctgggagcatgcatggactggggtgcccggaggaacaccagactgtctgactgatacgtttcgcgtaaaacgacctcacttgaggcgaagcgctagcaatggtcacgtgccaggtactccagtctacagggagaaggaggacatgtacgacgagatcattgagctgaagaaatctctgcacgtccagaagtccgacgttgatctaatgcgcaccaaactgcggcgactggaagaagagaatagcaggaaggacagacagattgagcagctactggatccctcacgcggaacggactttgtcagaaccctggccgagaaaagaccggatgccagctgggtcattaacggcctgaagcagagaatcttgaaactcgagcagcagtgtaaagaaaaagacggcaccatttctaaactgcagacggatatgaagacgaccaatctggaagagatgcggatcgcaatggaaacgtactacgaagaagtccacagactacagacactgttggcctcgtctgagacaacaggcaagaagccattgggcgagaagaaaactggagcaaaacgtcagaagaaaatgggctctgctctgctttccctgtccaggagtgttcaggagttgactgaggagaaccagtccttgaaagaagatctggacagagtcttgtccacaagtcccacaattagcaagactcagggctacgtggaatggtccaagcccagactcctgagacgtatcgtggagctggaaaaaaagctctcagtgatggagagcagtaaatctcatgccgctgaacctgtccggtcccacccccctgcgtgtctggcttcgagtagcgcgcttcacagacagccacgaggggatcgaaacaaagaccacgaacgactgcggggagctgtcagggacctcaaggaggagcgcactgctttgcaggaacagctgttgcagcgggatcttgaggtgaagcaactcctccaggccaaagccgatttagagaaggagttagagtgtgccagggagggggaggaagagagacgagagcgtgaggaggtgctgcgggaagaaattcagacactcaccagcaaactgcaagaattgcaggagatgaaaaaggaggaaaaagaggactgtcccgaggtgccccacaaggcacaggagttgccagccccaacgccaagcagtagacattgcgaacaagactggcctcctgacagctcagaagaagggctccctaggcccagatctccctgctccgacgggaggagagacgcagcagctcgcgtgttgcaggctcaatggaaggtctacaaacacaagaagaagaaggctgtcctggatgaggccgctgtagtactgcaggccgcattccgcggtcatctgacacgcaccaagctgctggcatctaaggctcatggctcagaacccccatcagttcctggcttaccagatcagtcaagtcccgttccacgggtgccaagcccgatcgctcaggcaacggggagtccagtccaggaggaggccattgtcattatccagtctgctttgcgtgcccacctggccagggcacgccactctgcgaccggcaagcggactacaaccgcggctagtaccaggagaagatccgccagcgcaacacacggcgacgccagtagcccaccgttcttagcggctttgcccgatcccagcccttccggcccacaggcacttgccccactgccgggagacgacgtgaactcagacgattccgatgatatcgttatcgcgccttccctgccaacaaaaaactttcccgtatag

SEQ ID NO: 50834 - DNA, 1935 bp, Artificial Sequence
  Description of Artificial Sequence: Synthetic coding sequence
atgttcctgggcaccggtgaacctgctctagacactagtcacctcattagcctcagtagggcttcactcacgcctcagaagctctggttgggcaccgccaagcccggaagcctaacacaggctctgaattctccattgacatgggagcacgcctggactggggtgccaggaggcacccccgattgcctcacagacacgttccgtgtgaagagacctcacctcagacgatctgctagcaatggacacgtgccaggaaccccagtgtatcgtgaaaaggaggatatgtatgacgaaatcatagaactcaaaaagagtcttcacgtgcaaaagtctgatgtcgatcttatgcgcactaagctgaggaggctggaggaggaaaacagcaggaaggatcggcagatcgaacagttgctcgaccccagccggggaactgattttgtacgtaccttggcagaaaagaggccagatgcttcgtgggtgattaacggcctgaaacaacgaatactgaaattagaacaacagtgcaaggagaaggatgggaccatctctaaactgcagacagatatgaaaacgaccaacctagaggaaatgcggatagccatggagacatactacgaagaagttcaccgtcttcagacgctcctggccagtagcgagactaccgggaaaaaaccccttggcgaaaagaagaccggtgctaaaagacagaagaagatgggaagtgccttactctccctgagccggtctgttcaggagctgaccgaagaaaatcagtctctgaaagaggacctggaccgggtcctctccacctctcccacaatatcaaagactcaaggatatgtcgagtggtcaaaacccagactgctgcgcagaatagtagagctggaaaaaaagctcagcgttatggagagttccaaatcacatgctgcagaaccagtcaggtcacaccctcctgcttgcctcgcgtcatccagcgctctgcatagacagccaaggggggaccggaacaaggaccacgaacgtcttagaggtgccgtgagagatctaaaggaagagcgtactgctcttcaggagcaactgctgcagcgcgatctggaggtcaaacaactgttgcaggccaaggctgacttggaaaaagaattagaatgcgcacgggaaggggaagaggagcggagagagagagaggaggtactccgcgaggaaattcaaaccttaaccagtaaactgcaggagctgcaggagatgaaaaaggaagagaaggaagactgcccggaggtcccacataaggcccaggagctgcctgcacccaccccaagctcccgccactgcgaacaggactggccacccgattccagcgaagaaggcttgcctagacccaggtccccatgtagtgacggcagacgcgacgccgcagccagagtactccaggcacaatggaaagtctacaaacataaaaagaaaaaggccgtgctggacgaggccgcagtagtacttcaggcagcttttcggggacacctgactcggacaaaacttctcgctagcaaagctcacggctctgagccgcctagcgtaccaggccttcctgaccaaagtagtcctgtcccccgagtgccttcacccatcgcccaggctactgggtcgccagtgcaagaagaggccatcgttattattcaatcagccctcagggcccacctggccagggcaagacatagcgcaactggtaagcgcacaacaactgcggcatccacacgaagaagatctgccagcgcaacccatggagacgctagctcacccccttttctggccgctctcccagacccctcacccagcggcccacaggccctggcacctctccctggcgatgacgtcaatagtgatgactctgacgatattgtgattgccccatcactcccgactaagaacttccccgtgtag

SEQ ID NO: 50835 - DNA, 387 bp, Artificial Sequence
  Description of Artificial Sequence: Synthetic coding sequence
atgccgttgggtgggagagcgagtctgactccacagaagctgtggttgggtaccgctaagccgggtagcttgactcaggcactgaatagtccactcacttgggagcacgcctggacaggtgtccccggtggtaccccagattgccttaccgatacttttagggtcaagcgccctcacctgagacggagcgctagcaacggacacgtgcctggaacccctgtatacagagagaaggaagatatgtacgacgaaattattgagttaaagaaatcactacacgtacaaaagtctgatgttgatcttatgcggaccaagctcagaagattagaagaagaaaattctagaaaagaccgccagatcgagcagttgctggaccccagtcgttag

SEQ ID NO: 50836 - DNA, 387 bp, Artificial Sequence
  Description of Artificial Sequence: Synthetic coding sequence
atgccattaggcggacgcgctagtctgactcctcaaaaattgtggctaggtactgccaaacccggatcattgactcaggcattgaactctcctttgacttgggagcacgcctggacaggagtgcctggaggaacacccgattgcttaacagacacgttccgagtcaagcggccacacttgcggagaagtgcatccaatggccacgttcctggaacacctgtgtatcgagagaaagaggatatgtatgacgaaatcattgagcttaagaaaagcctccatgtgcagaagagcgatgtcgatcttatgaggacaaagctccggcgtctggaagaagagaactctagaaaggataggcagatcgaacagctgcttgacccctctcgctag

SEQ ID NO: 50837 - DNA, 2040 bp, Artificial Sequence
  Description of Artificial Sequence: Synthetic coding sequence
atgttcctgggtaccggcgagcccgcattggatactaaggcaaagcggaaggcattccataaaccaccacccacttcaccgaaaagtccctacttaagcaaacccagaaaagtggcaagttggaggtcccttagaaccgccggttctatgcctttgggaggtcgcgcatccctcacccctcaaaagctgtggctaggcacagcaaagcccggtagcctgacgcaggcactcaatagccccctgacgtgggagcacgcatggactggcgttcccggtgggacaccggactgcctcaccgatacatttagagtgaaaagacctcacctgcgccgtagcgcatctaatgggcatgtgccagggacacccgtctaccgggaaaaggaagacatgtacgacgaaataatagagctgaagaaaagcctgcacgtgcagaaaagcgacgtcgacctgatgcgcaccaaattacggaggctggaggaggagaattcacggaaagatcgtcagatcgaacagctactggacccgtctcggggaaccgattttgtaagaacgctggctgagaagcgacccgacgcatcatgggttatcaacggcctgaagcaacggatccttaaactcgagcagcagtgtaaggagaaggacggcacaatttcgaagctgcagaccgacatgaagaccacaaacctggaggagatgcgcatagctatggaaacatattatgaggaagtccatcgcctacagaccctcctcgcttcttctgaaacaactggaaaaaaacctctcggggaaaagaaaacaggcgcaaagcggcagaaaaagatggggagtgcgttgctcagtctctcccggtccgtgcaagaactgaccgaagaaaaccagagcctcaaagaagacttggatcgcgtgctgagtaccagccccacaatcagcaagacccagggatatgtggagtggagcaaaccaaggctgctgcggagaattgtcgagctggagaaaaagctgagcgtgatggaatcatcaaaaagccacgccgctgagccagtccggagtcatccaccagcatgtttggcctcatcctctgcactgcacagacagccacgcggagatagaaataaggaccatgagagactcagaggggctgtccgcgatttgaaagaagaacgaacggctctgcaagagcagctcctgcaaagagacctcgaggtgaagcagctgctgcaagcaaaggcagatctagaaaaggaactcgagtgcgccagagaaggtgaagaagagcggcgagagagagaagaagtcttgcgcgaggagatccaaacgctgacttcaaagctgcaagagctgcaggaaatgaaaaaagaagagaaggaagattgtccagaagttccccataaagcccaggagctgccggctccaacgccctcttctaggcactgtgaacaggactggccgcctgattcaagtgaggagggcctgccacggccaaggtccccatgtagcgatggtagaagagatgccgcagctcgggttcttcaagcccagtggaaggtgtacaagcacaagaaaaagaaggctgtgctagatgaggccgcagtggtcctgcaagcagccttcaggggacaccttactcggaccaaattgcttgcatccaaggcccatggcagtgagcccccatcagtgccagggctgcctgaccagagcagtccagtgccaagagttccttctccgattgcccaggctaccgggtcccctgtgcaggaggaagccatcgtaattatccagagcgccttaagggcacaccttgcccgagcccgacattcggcaaccggaaagcgtaccactaccgccgctagcaccaggcgtcggagcgcttccgccactcatggcgacgcaagtagcccgccttttctggccgctctgcctgatcccagtccttctggtccgcaggccctggctccattgccaggagacgatgtgaactcagatgactccgacgacatcgtgatcgccccaagccttcccacaaagaatttccctgtgtag

SEQ ID NO: 50838 - DNA, 4896 bp, Artificial Sequence
  Description of Artificial Sequence: Synthetic coding sequence
atggagaggcgcgctgccggacccggatgggccgcttacgaaaggctgactgcagaggaaatggatgagcaaaggagacagaatgtggcatatcagtatttgtgtaggctagaggaggccaaaagatggatggaggcttgtctcaaggaagagcttccttccccagtagagttggaggagagcctgagaaacggggtgttactagccaaattggggcactgttttgctcctagtgtcgttcctcttaaaaagatctacgacgtggagcagctgagataccaggccaccggcctgcattttaggcatactgacaatataaacttttggttatcagcaatcgcacacatcggtctcccttctacattcttccccgagacaaccgatatctacgataagaagaatatgccccgagtcgtctattgcatccacgcgctgtcactcttcctattcaggttgggactcgccccacagattcacgacctgtacggcaaagtaaagttcactgccgaagagctgtcaaacatggccagtgagctcgccaaatatggtcttcagttaccagcatttagtaaaattgggggaatcctggcgaatgagctgtccgtagacgaagcggctgtgcatgccgctgtactagcaatcaatgaagccgtggaacgaggcgtcgttgaggatacactcgctgcactccagaatccttccgcattgctggaaaacttgagggagccacttgcagccgtgtatcaagagatgctggcccaagcaaaaatggaaaaggccgcaaatgcacggaaccacgacgaccgggagtcccaggacatctacgatcattacctgacgcaagcagagatccagggcaatattaatcacgtgaacgtgcacggtgcgctcgaggtggttgacgatgccctggaacgccaatcccccgaggcgctgctcaaagctctgcaggatcctgctcttgcactacgcggagtgaggagggactttgctgactggtatttagaacagcttaattccgacagggagcagaaagctcaggagcttggattggtggagctcttggagaaagaggaggtccaggcaggcgtcgccgctgccaacacaaaaggcgaccaagagcaggccatgcttcacgcagtgcaacggattaataaagcgatccgacgcagggtcgccgctgacacagtaaaagaactgatgtgccctgaggcacagctcccacctgtttacccagtggcctcctcaatgtatcagctcgagcttgccgtgctgcaacaacagcaaggggagctgggtcaagaggagctatttgtggcggtggagatgttgtcagcggtggtgctgattaaccgggctctcgaggctcgtgacgcctctggattttggtcctcccttgttaatcctgctaccggcctggccgaggtggaaggagagaacgcgcagagatactttgacgcattgctgaagctcagacaggaacgaggcatgggggaggacttccttagctggaacgacctccaggccacagtgtcccaggttaatgcccagacacaggaagagacagaccgagtgctggcagtgtccttaataaacgaggctcttgacaagggttcacccgagaagacattgtctgctttgctcctgcccgcagccggacttgacgacgtgtcgctgccagtggcaccgcgataccacctgctcctggtggctgcaaaacgacaaaaggcacaggtgactggtgatcctggagcagttctctggctggaagaaattaggcagggggtggtaagggccaatcaggacaccaacacggctcagcgcatggcacttggagttgcagccataaaccaggctatcaaggaaggaaaagccgctcagactgaaagggtgctgcgcaatcccgcagtggctctgcggggtgttgttcctgattgtgccaatggctatcagcgggctctggaatctgcgatggcgaaaaagcaacggccagccgataccgctttctgggtccagcacgatatgaaggatggtaccgcatattacttccatctccagactttccagggcatctgggaacagccacccggttgccccctgaacacaagtcatctcaccagggaggaaatacagtctgccgtgacaaaagtgaccgctgcatacgacaggcaacagctgtggaaggccaatgttggctttgtgatccagctgcaggctcggttgcgtgggtttttagtgcgacagaaattcgccgaacattctcactttctgaggacatggctgcccgctgtaattaagatacaggcacactggcgtggttataggcagagaaagatttacctagagtggctccagtattttaaggcgaacttagatgcgattattaagatccaggcatgggccagaatgtgggccgctcgcaggcagtatctgcggcgactgcactatttccaaaaaaatgtgaattctatagtcaagatccaagcttttttccgggctagaaaagcacaagatgattataggattctggtgcacgcaccccacccaccactttccgtggtcagaagatttgctcacctgcttaaccagtctcagcaggactttctggccgaagcagagctgcttaaactccaggaggaggttgttagaaagatacggagcaatcaacaattagagcaggatcttaacatcatggacattaagatcgggctgcttgttaaaaatcgcatcaccctccaggaagtagtgtcacattgcaaaaagctgaccaagcggaacaaagagcagttgtccgacatgatggtgttggataagcagaaggggctcaagagcttgagcaaggagaagagacagaagctggaagcttaccaacatcttttctacctccttcaaacacagcctatctatctggctaagctgatttttcagatgcctcagaataagaccactaaattcatggaggccgtgatcttttccttgtataattatgccagctctagacgagaagcgtacctgctcctccaactgtttaagacagccctgcaggaagagattaagtccaaagtcgaacagcctcaggatgtggtgactgggaatccgaccgtggttaggctggttgttcgcttttaccgcaacggcaggggtcagagcgcactgcaggagattctggggaaggttattcaggatgtactcgaggacaaggtgttatccgtgcatacagaccctgtgcatttgtataaaaattggatcaatcaaactgaggcccagaccgggcagaggtcccatcttccttacgacgttactcccgaacaggctttaagtcatccagaggttcagcgtagacttgacatagcactgcggaatctgctggccatgacagacaagtttctcctggccatcacatcaagcgtggaccagatcccttacggaatgagatatgtggccaaggtgttgaaggcaacgctggctgagaagtttcccgacgctactgactcggaggtttacaaggtagtgggcaatctgctgtattacagatttcttaatccagccgttgttgctcccgatgcgttcgatatagttgctatggcggctggtggtgccttagccgctcctcagcgacacgcccttggggctgtagcccagctgctgcagcatgccgcagccggaaaagcatttagtggccaaagtcagcatttgcgggtgctcaacgactatctcgaagagactcacctaaagttccggaagttcatacaccgcgcttgccaagttcctgagcctgaggaaagatttgctgtggatgaatattctgatatggtagccgttgctaagcctatggtgtacatcacggtgggagaactggtgaatactcaccgattattactggagcatcaggactgtatcgcaccagaccatcaagaccccctgcacgagctgctagaagacctaggggagctgccaacaatcccggacttgattggcgaaagtattgctgccgacggacatacagatttaagtaagttggaggtttcactgacgctgacaaataaattcgaggggctggaagcagatgcggatgatagtaacacaagatccctcctgctttcaaccaaacagctgctcgccgatattatccagttccaccccggagatactctcaaggaaattctgtctctctccgcttcccgcgagcaggaggcagcacataagcagctgatgtcaaggcgacaggcttgcaccgcccagacaccagaaccacttagacggcaccggagcctcacagctcattcactcctgcccctggccgaaaagcaacgcagggttcttcgtaatctaagaagactggaggctctgggactcgttagcgcacggaacggctatcaaggattggtggatgagctggctaaggatatcagaaaccagcaccgccacaggcaccgtcggaaggctgagctagtgaagctccaggctacactgcagggactgagcacaaaaaccaccttctatgaagaacagggggactactactctcagtatatccgggcatgcttggaccatctggcaccagactccaagagctcaggcaaaggcaaaaaacagccctccctgcattacaccgccgcacagctgctcgagaagggggtgcttgtggagattgaggacctgcccgcttctcacttcagaaacgtgatcttcgatataacccctggagacgaggcaggcaagtttgaggtgaatgccaagttcctgggcgtcgacatggagagatttcagctacactaccaggacttacttcagctacagtatgaaggcgttgcggtgatgaaactgtttaacaaggcgaaagtaaatgttaacctgctgatttttcttctgaataagaaatttctgcgcaagtag

SEQ ID NO: 50839 - DNA, 465 bp, Artificial Sequence
  Description of Artificial Sequence: Synthetic coding sequence
atggctgccgcttgggggagtagcttgactgccgctacgcagcgggcagtcaccccctggccccgaggaagactcttgaccgctagcttggggcctcaggccagaagagaagccagtagctctagcccagaagcgggagaggggcagattcgactgacggactcttgcgtccagcgactactggaaattacggaagggtccgagtttttgcgtcttcaggtcgagggcggtggttgttccggattccagtacaagttctctttggatactgtaataaaccccgatgatcgcgtctttgagcagggaggcgcacgtgtcgtagttgacagtgattccctcgcttttgttaaaggggcacaagttgatttctcacaagaactgattagatcttcctttcaggtacttaataacccacaagcccaacaaggctgttcctgcggtagctccttcagtataaaattgtag

SEQ ID NO: 50840 - DNA, 666 bp, Artificial Sequence
  Description of Artificial Sequence: Synthetic coding sequence
atgccattagccctgacgctgctactgttatctggactgggcgctccgggagggtggggttgtctacaatgtgaccccctggtgctggaagcacttggacatctgaggtctgcactcattccatcacgctttcaactggagcagctgcaagccagggccggagccgtgctgatgggcatggaaggccctttctttcgcgattacgccttgaacgtcttcgttgggaaggtcgagacgaatcagttggatctggttgcctcattcgtgaaaaatcagacgcagcacctcatggggaattcactcaaggacgagccgctgcttgaagagctggtgacgcttcgcgctaatgtgattaaggagtttaaaaaggtgcttatctcttacgaactcaaagcatgcaaccccaagctatgcaggctcctgaaggaggaagtcctagattgtctccattgccagcgcattaccccgaagtgtatccataaaaagtattgcttcgttgacaggcagcctcgggtggctcttcagtaccagatggacagtaagtatcctagaaatcaagctctgcttggtatcctgatttctgtgtccctagcggttttcgtctttgtggtgatcgttgtttccgcatgcacttatagacagaatcgcaaacttctgctgcaatag

SEQ ID NO: 50841 - DNA, 579 bp, Artificial Sequence
  Description of Artificial Sequence: Synthetic coding sequence
atgccgctcgccctgactctcctgctcctctccggcctcggcgcacccggtggttggggctgtctgcagtgcgaccctctcgtgctggaggcccttgggcaccttcggtccgctttgataccaagtaggtttcaattagaacagcttcaagccagagcaggtgctgttcttatgggaatggaaggaccctttttcagagattacgctctgaacgtcttcgttggtaaagtggaaaccaaccagctggacttggtcgcttcgtttgttaagaatcagacacagcacctgatgggcaacagtcttaaggacgagcctctacttgaagaactcgtcacgctgcgggctaacgtaatcaaggagtttaagaaagtgctaattagttatgaactgaaagcgggaaatcccgcttggccttgttcaacgcggtggaccgccaacacaagaggaacaagacgctgctgggcctccagttttctctgtctctggttgtcactgagctcgtggtctagttggagcagactagtccatacggacaaaaccgaaaatagctgttgcagcaggactgtagtctggggctag

SEQ ID NO: 50842 - DNA, 720 bp, Artificial Sequence
  Description of Artificial Sequence: Synthetic coding sequence
atgggcgatttgtggctcttcttactcttgcccctctcagcgtttcatggcgtgaaggggtgcctggaatgcgatccaaaatttatcgaggatgtcggatcactcctaggcaacttgataccatctgaggtgccaggacgtacacagcttttggaacgccagatcaaagaaatgatacacttgtcctttaaagtgagccatagtgataagcgcttacgggtgctagcagtgcaacaggtcgtgaaactgcgtacctggcttaagaacgaattctacaagcttggcaatgagacctggaagggggtgttcatctatcaggggaaactactggacgtgtgtcaaaatctcgagagcaaactcaaagaactgctgaagaatttttctgaaatagcatgctccgaggactgtatcgtggtggaaggtccgattctggattgttggacctgcctccggatgacaaaccgatgctttaaaggcgagtattgcggcgatgaagaccccagaaaagctgaaaaccgggaaatcgcgctctttctcatcctactcgcaacggccgtcatactgggctcagccgttctgctgttccacttttgtatcttccataggagaaaaatgaaggccattcgacgaagcctgaaagagtacgtagaaaaaaagttagaagagctaatggggaaaatagatgaaaaggaagagaaggacttcagacttcggaaatag

SEQ ID NO: 50843 - DNA, 1053 bp, Artificial Sequence
  Description of Artificial Sequence: Synthetic coding sequence
atgggccctcacttcacactgttatgcgctgcactggcagggtgtctccttccggcagaggggtgtgttatctgcgatccctccgtggtcctcgcccttaagtcattagagaaggattatctgcctggtcatttagatgctaagcatcataaggccatgatggagagagttgagaatgccgtcaaagactttcaagagctgtctcttaatgaagacgcgtacatgggggtggtcgatgaggcaactctccagaaaggctcctggtccctccttaaagacctgaagcgcatcacggattcagacgtgaaaggagacctgttcgtaaaggaacttttctggatgttacatttacagaaggaaacttttgcaacttatgtcgcaaggttccagaaagaggcctactgtccaaacaagtgcggcgtcatgctgcagacgctgatctggtgcaagaactgtaagaaagaggtgcatgcctgtcgcaagtcctatgactgcggggaacgaaacgtcgaagtgccccagatggaggatatgattttagattgtgaactgaactggcaccaggcatccgagggcttgactgactattcattctatcgcgtttggggaaacaatacggaaaccctggtaagcaagggcaaggaggcaaccctcacaaaacccatggtcggccctgaggatgcgggttcataccgttgcgagctgggttccgtaaattcaagcccggcaactatcatcaactttcacgtgacggtcttacctaaaatgatcaaagaagaaaagccctcacctaacatagtcaccccaggggaggcgaccacagagtcctccatcagtctgcagccgcttcagcccgaaaaaatgctcgcaagtcggctgctgggactgctaatttgcggaagtctggccctcatcaccggactcacgtttgccattttcaggaggcggaaagtaatagacttcattaaaagctccctgttcggcctcggatcaggggcagccgaacaaacccaggtcccaaaagagaaagcaactgattctcggcagcagtag

SEQ ID NO: 50844 - DNA, 552 bp, Artificial Sequence
  Description of Artificial Sequence: Synthetic coding sequence
atggccagtagggccggacccagggctgcgggtaccgacggcagcgatttccaacacagagagcgagtcgccatgcactaccagatgtccgtgacccttaagtacgaaatcaaaaagttgatatacgtgcacctggtgatctggctgctgctcgtcgctaaaatgtctgtcggacatctccgattgctaagtcatgatcaggtggcaatgccatatcagtgggagtacccttatcttctgagcatcctgccaagccttctgggcttgctgtcgtttcctagaaacaatatcagttacctggtgctgtccatgatcagcatgggcctcttcagcatagccccactgatttatgggtcaatggagatgtttccagccgcacagcagctctacagacatggcaaggcctacagattcttattcggatttagtgcagttagcattatgtacctggttcttgtgcttgccgtccaggtccacgcctggcaattgtactacagcaaaaaactgctggatagttggttcaccagcactcaggaaaagaaacacaaatag

SEQ ID NO: 50845 - DNA, 546 bp, Artificial Sequence
  Description of Artificial Sequence: Synthetic coding sequence
atggccagtcgagccggacccagagcggcaggtacggacggttcagactttcagcacagggagagagtcgcgatgcattatcaaatgagcgtcacactaaaatacgaaattaaaaagctcatttatgttcacttggtaatatggctgctgcttgtcgctaagatgagcgttggacaccttagactgttatcacacgaccaggtagcaatgccctatcagtgggaatacccttacttactgagtattctgccgtcactcctggggttactgtcctttcctcggaacaacatcagttatctggtgttgagcatgatttctatgggacttttccataggtctacgcacctgtggcaacacggtgacgtaccgtgctgtaccgctgccacagccatggccagacctaccgtctcgtctctggtgtttttgccgtttccaatgtatcttgtgctggtactggcagtccaggtgcacgcttggcaattgtactattcaaagaagctgctcgacagctggttcacgagcactcaggagaagaaacataaatag

SEQ ID NO: 50846 - DNA, 1881 bp, Artificial Sequence
  Description of Artificial Sequence: Synthetic coding sequence
atgtccaaaaagggacgcagcaaaggtgagaagccagaaatggagacagatgcagtacagatggcaaatgaggagctgcgcgctaagttgacatctatccagattgagttccagcaggaaaagtccaaagtcgggaagcttagggaacgcttacaggaagcaaagttagagagagagcaggagcagcgcaggcatacagcctatatttccgaactaaaagcaaaattacatgaggagaagactaaggagctgcaagcgctgagagagggacttatcaggcagcatgagcaggaagcagctcgcaccgcaaagatcaaagaaggagaattgcagagactccaggctactcttaacgtgctacgcgacggcgctgctgacaaagtcaagaccgctctgctcactgaggcaagagaggaggctcggagggcttttgatggggagcgcctcaggttacagcaagaaattctcgaactgaaagcggctagaaagcaggctgaggaggccctgtcaaattgcatgcaagccgacaagaccaaagctgcagatctacgagccgcttaccaagcccaccaggacgaagtgcaccggataaaacgagagtgcgagcgtgacatccggagactgatggacgagatcaaaggcaaagaccgagttatcttggcccttgaaaaggaactcggagttcaagccggacagactcagaaactgctcctccaaaaagaagcattggacgagcagctggtgcaggtgaaggaggctgaaaggcatcacagctctcctaagagggagcttccccctggaataggagatatggtggagctgatgggggtccaggaccagcacatggatgaaagggatgtccgtcgctttcagcttaagatagccgagctcaattctgtaattaggaaactggaagatagaaataccctgctggcagatgaacgaaacgagctcctcaagagatcacgagaaacagaggtccaattgaagccattggtggagaagaataaaaggatgaacaaaaagaatgaggatcttctgcaatcaatccagagaatggaggagaaaatcaagaatctgacccgggaaaacgtggaaatgaaggagaagcttagcgctcaggcctcactgaaaaggcacacgtctttgaacgatctgtcacttacacgggatgaacaggagatagaattcctgcgcttgcaagtacttgagcagcagcacgtcatcgatgatctgagcctggagcgggaaagattgttgcggtcgaagcgtcatagggggaaatcactgaagccgccaaagaagcatgtcgtggagaccttttttggcttcgacgaagagtcggtggattcagagactctgtccgagaccagttataatacagacaggacagacagaacacctgcgacacctgaagaggatctggacgacgcaacggccagggaggaggccgacctgcgtttctgtcagctcacaagggaataccaggcgctccagagggcctacgccctgctgcaggagcaggtaggcggaactttagacgctgaacgggaagcgagaaccagagaacagctgcaggctgatttactacgctgtcaggcaaaaatcgaggatctggagaaacttttggttgagaaagggcaggattccaaatgggttgaagagaaacagctgctcataaggacaaatcaggatttactcgagaagatctatcggctggagatggaagaaaaccagctgaagaacgagatgcaggatgccaaagatcagaacgagctgttggaattcagggtgctggaactagaagtacgagactccatctgctgcaaactgagcaatggggctgatattttgtttgagccaaagttaaaatttatgtag

SEQ ID NO: 50847 - DNA, 2496 bp, Artificial Sequence
  Description of Artificial Sequence: Synthetic coding sequence
atgtccaagaagggcaggtcaaagggcgaaaaacctgaaatggagactgacgccgtgcaaatggcaaatgaagagctgagggctaaactaacaagcattcagatcgagtttcagcaggaaaagagtaaggtgggcaagcttcgagaacggctccaggaggcaaagctggaacgagaacaggaacagcggagacatacagcctatatctccgaactaaaagctaaattacatgaggagaagaccaaagaactccaggccctccgggagggcttaattcgacaacacgagcaggaggctgccaggactgccaaaatcaaagaaggggaactccaaaggctgcaggccacattgaatgtcctccgggatggagcagccgataaagtgaaaaccgcactgctgaccgaggctagagaggaagctagacgggctttcgacggtgagaggctgagactgcagcaggaaattcttgagcttaaagctgcccgaaagcaggcagaggaggcactgagcaattgcatgcaagcggacaaaacaaaagctgctgacctgagagccgcttaccaagctcaccaggatgaagtgcatcggatcaaacgggagtgtgagcgcgacattcgtagattgatggatgagatcaaggggaaagatagagttatcttagccttagaaaaagagttaggtgttcaggcaggccagacacagaagctgctgctgcagaaagaggcgttggacgaacagttagtacaagtgaaggaagccgaaagacaccacagctctccgaagagagaacttccacccggtataggggatatggtagagctgatgggagtgcaagatcagcacatggacgaaagagatgtcaggagatttcagctgaaaatcgcagagttaaactccgtgatccggaaattggaagatcgcaacactcttctggctgatgaacgtaacgagctgctgaagaggtctcgcgaaactgaagttcagttaaagccactcgtggagaagaacaaaagaatgaacaagaagaatgaggacctgttacagtccattcagcggatggaggagaagatcaagaatctgacaagagagaacgtagaaatgaaagagaaactgtcagcccaggcttccctgaaacgtcatacttcactcaacgaccttagcctgacccgcgacgaacaggagatcgagttcctgcggttgcaggttctggagcaacagcacgtgatcgacgatctgagtctcgagcgagaaagactactgaggtccaagcgccacagagggaaatccctcaaaccacctaaaaaacacgtcgtggagacatttttcggatttgacgaagagtcggtcgattccgagactttaagtgagacatcttacaataccgatcggactgaccggacacccgcaacccctgaagaagacctagatgatgctaccgctcgtgaggaagctgacctgcgtttttgccagcttacaagagagtaccaggccttgcagcgggcttatgcactattgcaggagcaggtgggcggaactttggatgctgagcgtgaggcgaggaccagggaacagttacaggcagatctgctccgatgtcaggcgaaaattgaagatctggagaaacttctcgtggagaagggccaggactccaaatgggttgaggagaaacagctgctgattaggaccaaccaagatctgctagagaagatttatcggttggaaatggaggaaaaccaattgaagaatgagatgcaagacgccaaggatcagaacgagctcctcgagttcagagtgttggaattggaggagagagaacgcaggtctcccgcattcaatctgcagattaccacatttcccgagaaccatagttcagctttacagttgttttgccatcaagagggcgtaaaggatgtgaacgtaagtgaactgatgaagaaactggacattctcggcgacaatgggaatctccgcaatgaggagcaggtggcaataatacaggcgggtacggtgcttgcactttgcgagaaatggttaaaacagatcgaaggaacggaggccgcactgactcaaaaaatgctcgacctggaaaaggaaaaagacttgttcagtcggcagaagggctacttagaggaagagctggattatagaaagcaggccctggaccaggcatatctaaagatccaagatttggaagccactctctataccgcactacaacaggagcccggacggagggctggcgaagccttgtccgaaggccagcgggaggacctccaggctgcagttgaaaaagtgcgacgtcaaatcctccggcagagccgggagttcgatagccagatcctgcgggaacggatggaactgctgcaacaggcacagcagaggattagagaactcgaggacaagttggagttccagaaaagacaccttaaggagcttgaggaaaaatttctgttcctgtttctttttttcagcctggccttcatcctgtggccttag

SEQ ID NO: 50848 - DNA, 1941 bp, Artificial Sequence
  Description of Artificial Sequence: Synthetic coding sequence
atgtcaaaaaagggcaggtcaaagggggaaaagcccgaaatggaaacagatgctgtgcagatggccaacgaggaattgagggccaaactgacgtccattcagatcgagttccagcaggaaaaaagtaagatggatgagattaagggaaaagatagggtgatactcgcactcgagaaagaactgggggtgcaggccggacagacacagaaactattattgcagaaggaggcccttgatgagcagctagtgcaggtcaaagaagccgagcgacaccattcaagccccaagcgcgaacttccgccaggcattggggacatggtcgagttgatgggagtccaggatcagcatatggatgaaagagatgtccggcgattccaactcaaaatagcagagctgaactccgtcattaggaaactagaagacaggaataccctcctggcggacgagcgtaatgaactgctcaaacgtagcagagagaccgaggtacaattgaagcctctcgtagaaaaaaataagagaatgaacaagaaaaacgaggacctgctgcagagcattcagcggatggaggaaaaaattaagaatctgacccgcgagaatgttgagatgaaggagaagctttccgcacaagctagcctcaaaaggcacaccagtctgaacgacctctcccttaccagagacgagcaggaaattgagttcctgcgtttgcaggtcttagagcagcaacatgtgattgacgacctttcgctcaaacacgtggtcgagacctttttcggctttgacgaagagagtgtggatagcgagaccctgtctgaaactagttacaatacagatagaaccgatcgtacccccgctacccccgaggaagacctggatgacgccactgccagagaggaggctgatcttcgattttgccagcttaccagagaataccaggccctacagagagcctatgccctgctgcaggaacaagtaggcggtacattagatgctgaacgcgaggcccgaacaagggagcagctccaagctgacttattacggtgccaggccaagattgaagaccttgagaagctacttgtcgaaaagggccaggatagcaaatgggtggaagagaaacagctcctgatccgcactaaccaggatctcctcgaaaaaatttatcgcctggaaatggaggaaaaccaactcaaaaacgagatgcaggacgctaaggatcagaacgaactactggaatttagagtcctggaattagaggagcgagagaggcgctcacccgctttcaacctccaaataacaactttccccgaaaaccacagcagcgccctgcagcttttctgtcaccaggaaggagtgaaagatgtaaatgtctccgaactgatgaagaaactggatattctgggagataacgggaatctgcggaatgaggaacaggtagccattatacaggccggtaccgttctggccttgtgtgaaaagtggttgaagcagatagagggcactgaggctgcccttacccaaaagatgttggatctggaaaaggagaaggacctgttttctagacaaaaggggtacttggaggaagaactggactataggaagcaagcacttgaccaagcatatctgaagatccaggatcttgaagccaccttatatacagcattgcagcaggaaccaggacgacgagctggggaggctctctctgagggtcagagggaagatctccaggccgcagtggaaaaagtgcggagacagatcttacggcagagtcgggaattcgatagccaaatcctgcgcgaacgcatggagctcctgcagcaggcacaacagaggatccgggagcttgaagacaagttggagttccagaagcgccatcttaaggagttggaagagaagttcctgttcttatttctgtttttttctctggcttttatactttggccttag

SEQ ID NO: 50849 - DNA, 1881 bp, Artificial Sequence
  Description of Artificial Sequence: Synthetic coding sequence
atgagcaagaagggcagaagcaaaggggaaaagccagaaatggagactgatgccgtccagatggcaaatgaagaattgcgcgcaaagctaactagcatacagattgaattccagcaggagaaaagcaaggtgggaaaacttagggaaagactgcaggaggcaaagctagaacgcgagcaggaacagcggagacatacagcgtacatatccgaactcaaggcaaagctgcatgaggaaaagactaaggagctgcaggccttgcgcgaggggctgatccgtcaacacgagcaggaggccgctcgcacagctaaaattaaggaaggagagcttcaaagattgcaagctaccctaaacgtcctgcgcgatggcgctgcagacaaagtgaaaaccgcactgttgaccgaggcccgagaagaagcccgacgagccttcgatggcgaacgcttaaggcttcaacaggagattttagaattaaaagccgctagaaagcaggccgaggaagccctttctaactgcatgcaagccgataagaccaaggccgctgacctgagggcagcctaccaggcccaccaagacgaggtgcatagaataaaaagggaatgcgagagagacattagacggctaatggatgaaattaaagggaaggaccgggttatcttggccctcgaaaaggagctgggggtgcaagccggacagacgcaaaagctgctgctccagaaagaggccctggatgagcagttggtgcaagtaaaagaagcggagcggcaccatagttcccctaaaagggaactccccccagggattggggacatggttgaattgatgggggtgcaggatcagcacatggatgagcgtgatgtcaggcggttccagctgaagatcgctgagctgaattctgtgatccgaaagttggaggatagaaatactcttttggccgacgagagaaatgagctgttgaaaagaagccgggaaaccgaggtgcagttgaaacccttggttgagaaaaataagcggatgaataagaaaaatgaagaccttctccaatctatccagcgcatggaggagaagatcaagaatctaacccgcgaaaatgtagagatgaaggagaagctcagcgcccaagccagcctcaaaagacatacctctcttaatgatctgagccttacccgggacgagcaggaaatagaattcctgcggctgcaggttctcgaacagcagcatgtaatcgacgacctgagtcttgaacgcgagagactgctgcgctccaagcggcatagagggaagagcttgaaaccccctaagaaacacgttgtggagacatttttcgggtttgacgaggaatcggtggatagcgagaccctgtccgagacttcatacaatactgatagaacagacaggacacccgctacaccagaagaggatttggatgatgctacagcgagagaagaggcagaccttcggttctgccagttaacacgggagtatcaggcgctgcagcgggcttatgctctgctgcaagaacaggtcgggggtactctggacgcagagcgggaggcaaggaccagggaacaactccaggccgatcttctgaggtgccaagccaaaatcgaggatctggaaaagctgttagtggaaaaggggcaggacagcaagtgggtcgaggagaagcaactccttatcagaacaaatcaagatctcctggagaagatttacagattggagatggaggaaaatcaacttaaaaacgagatgcaagatgccaaagaccaaaacgagctgctcgagttcagggtcttggagctcgaggtaagagattcaatttgttgcaaactgtctaacggtgccgacattctcttcgaacctaagttgaaattcatgtag

SEQ ID NO: 50850 - DNA, 1296 bp, Artificial Sequence
  Description of Artificial Sequence: Synthetic coding sequence
atgagcaaaaagggccgttctaaaggagagaagccggagatggagacagatgctgtccaaatggccaacgaagaacttcgcgcaaagctgacatccatccagatcgaattccagcaggagaaaagcaaggtgggcaagctgagggaacgactccaagaagccaagctggagagagaacaggaacagaggcggcacacagcgtatatcagtgaacttaaagcgaagcttcacgaggagaagacgaaagagcttcaggctttgcgcgagggtctcatcaggcaacacgagcaagaagccgcaagaacagctaaaatcaaggaaggagagcttcagagactacaggctaccctgaatgttctgagagatggggctgcagacaaagtgaagacagcattgctgacagaggccagggaagaagcgcgtagggccttcgatggagagagactccgcctccagcaggagattcttgagttgaaagctgcacgaaagcaggctgaggaggccctgtcaaactgtatgcaagccgataagacaaaagctgccgatctccgcgcagcttaccaggctcaccaggatgaggtgcatcggattaagagggaatgtgaacgcgacatccggcgactcatggacgagatcaagggcaaagaccgagtcattctggctctggaaaaggagttgggggtccaagctggtcaaacccagaagctcctgctacaaaaagaagcactggatgaacaactagtacaggtgaaggaggccgagcgccatcattcatcccctaagcgcgagctccctccaggaatcggggacatggtggagctgatgggtgtgcaggatcaacatatggatgagagagacgtgcgccgttttcagctcaagatcgcggaattgaatagcgtgataaggaagctggaggacagaaacaccctcttggccgacgaacggaacgagttactgaagcggagccgtgaaaccgaagtacagctgaagccactcgttgaaaagaacaagaggatgaacaaaaagaacgaggatctgctccaatccattcagcgaatggaagaaaaaatcaaaaacctgaccagagaaaatgttgaaatgcctgacccagccggagcccatggagctgctgccgctggtccagctgaaaatccacggactggcggtcagaccggggtgtccgaggctgcgcctgagcggacaggtggaaaagtgtttgtccccttttttgtctttctgacatcaatccatagtgtggctctcatgacatccgtgagccaggagttaggactctag

SEQ ID NO: 50851 - DNA, 1710 bp, Artificial Sequence
  Description of Artificial Sequence: Synthetic coding sequence
atgagcaaaaagggccgaagtaaaggggaaaaacccgagatggagacagacgccgtgcaaatggccaacgaggagctgcgggctaagttgacaagcattcaaatcgagtttcagcaggaaaagagcaaagtagggaagctgcgtgaaaggctccaagaagcaaagctggaaagggagcaggagcagaggaggcataccgcgtacatttctgaactcaaggccaaactgcatgaggagaagactaaggagctgcaagccctgcgtgagggtttgattaggcagcacgaacaagaggccgctcgaacagctaaaatcaaagaaggagagctgcagagactgcaggctacactgaacgtgctcagggatggcgcagctgataaagttaagacagctctgctgaccgaagctagggaggaagcaagacgcgcatttgatggcgagaggttacgcttacagcaggagatactggaattgaaagcggctcgtaagcaagctgaagaagccctctccaactgcatgcaggcggacaagacaaaggcagcggatctacgagcggcataccaggcacatcaggatgaggtgcatcgcatcaagagggagtgcgagagagacatcagacggttgatggatgaaataaagggaaaagacagagttatcctggccctagaaaaggagctaggcgtccaggccggacaaacacagaagcttctcctgcagaaggaagccctggatgaacaattagtccaagtaaaagaagccgagcggcaccattcctcaccaaagcgcgaactgccacccggaattggcgatatggttgaacttatgggtgtgcaggaccagcacatggacgagagggacgtgaggcgttttcagttgaaaattgcggaactgaactccgtgattcgcaagctggaggatcgaaatacccttcttgctgatgagcggaatgagttgctgaaacggtctcgggaaaccgaagttcagctgaagccactagtggaaaaaaacaagagaatgaacaagaagaatgaggatttactccagagtatccagagaatggaagagaagatcaagaatctcactcgggagaacgtcgaaatgaaggagaagttgtccgcacaggctagtttgaagaggcacacctccctgaatgaccttagtctgactagggacgagcaggaaattgagtttctgcgtcttcaggtgctcgagcagcagcacgtgatcgacgacctgagcctggagcgtgagagactactccggtccaagagacaccgcggaaaatcactcaagccgccaaaaaagcacgtggtggaaaccttttttgggttcgatgaagagtccgtggactctgaaacgctgagcgagacatcatataacacggataggacagatcggactccggcaacgcccgaggaggacctggacgatgccacagccagggaagaagctgatctccggttttgccagctgactagggaagacctgcaggccgctgtcgagaaggtccggagacaaatcttgagacagtcaagggagttcgactctcagattcttcgcgagaggatggaactgctgcaacaagctcagcagagaatccgggagttagaggacaaattggaatttcaaaagaggcatttgaaagaactcgaggaaaagtttttattcctgtttctcttcttctctctcgcttttatcctctggccatag

SEQ ID NO: 50852 - DNA, 1557 bp, Artificial Sequence
  Description of Artificial Sequence: Synthetic coding sequence
atgagcaaaaaaggaaggtcaaagggtgaaaaacccgagatggaaacggatgctgtccaaatggccaatgaggcactgagagaggggttaatccgccagcacgaacaagaggcagccagaaccgctaagattaaagaaattctggaattaaaagcagctagaaaacaagctgaggaagctctatccaactgcatgcaagctgataaaaccaaagctgcagacctgagggccgcataccaggcccaccaagatgaagtgcatagaatcaaacgggaatgtgagcgggacatcagaaggttgatggatgagatcaaaggcaaagaccgagtcattcttgcattggagaaggaactgggggtacaggcgggacagactcaaaaactcttactccagaaggaggctctcgacgagcagctggtccaggtcaaagaggccgagcgccaccactcgtcaccaaaaagagaactacctcccggaatcggggatatggttgaactaatgggtgttcaggatcagcatatggatgagagagatgtgcggcgatttcagttgaaaattgccgaacttaacagtgtgatcagaaaacttgaggacagaaatactttgctagccgatgagagaaacgaactgctaaaacggagtagggagaccgaagttcagttaaagccactcgtagagaaaaacaagcggatgaacaagaagaacgaagatctgctgcagtccatacagaggatggaggagaagattaaaaacctcacgagggaaaatgttgagatgaaggagaagctctcagctcaggcctcactcaagcggcataccagcctgaacgatctgagtttgacaagagatgagcaggagatcgaattcttgagactgcaggtcctcgagcaacagcacgtgatcgatgacctgtccctcgaacgtgagaggctgctgaggtcaaagaggcacaggggcaagtcgcttaagccacctaaaaagcatgtggttgagactttcttcggattcgacgaggaatcagtggactccgaaaccctgtcagagacctcttataacaccgacagaaccgaccggacccctgcaacacctgaggaggacctggatgatgccactgccagagaagaggccgacctgcgattctgtcaactcactcgagagtaccaggccctccagagagcttacgcccttctacaggaacaggtcgggggtacgttggacgcagaacgagaagccaggacgcgagaacagctacaggcggaccttctccgatgtcaggctaagatcgaggatctcgaaaagctgctcgtcgagaagggccaggattctaagtgggtcgaagagaagcagctgttaatcaggacaaaccaggacctgcttgaaaaaatatatcgattagagatggaggaaaaccagttaaaaaacgaaatgcaggacgctaaagatcagaacgagcttttggagttcagagtgctggagctcgaagttcgtgatagcatttgttgcaagttgtccaatggtgccgacatcttgtttgaaccaaaactgaaatttatgtag

SEQ ID NO: 50853 - DNA, 2433 bp, Artificial Sequence
  Description of Artificial Sequence: Synthetic coding sequence
atgtctaagaaagggagaaacaagggcgagaagcctgaagcactgattgtggcactccaggccgctaacgaagatttgagaaccaaactcactgatatccagattgaactgcatcaagagaagtctaaggtgtcaaagctggagcgtgaaaagacacaggaggccaaaaggattagggaactggagcagcgcaagcacacagtactggttacagagctgaaggcaaagcttcatgaggagaagatgaaggaactgcaagcggtccgggaaaatctcattaagcagcacgagcaggagatgtcccgaaccgtgaaagttagggacggcgagatccagaggctgaaatctgctctttgtgccctgcgggatggcagctccgataaagtcaggacagctctcacaatcgaggctagggaggaggctaggaaactgttcgatacagaacggttgaaactcctgcaggaaatagctgacctcaagactgcaaaaaaacaggtggatgaagccctgagtaatatgatccaggctgataaaatcaaagcaggggatctccgcagtgagcaccagagccatcaggaggccatctcaaagattaagtgggaaagcgaacgtgatataagaaggctcatggatgagatcaaagctaaggacagaattatcttcagtctggagaaagagctggaaactcagaccggctacgtccaaaagcttcagctgcagaaggaggcccttgacgagcaattgttccttgtaaaggaggcagagtgtaatatgagtagcccaaagagagagatccctgggagagctggagacggctctgaacattgttcgtctcccgatctgcgtagaaaccagaagcgtatcgcagagctgaatgcgaccattcgtaaactggaagatcgcaacaccctgctgggcgatgaaaggaatgaattgctgaaacgtgtcagggaaaccgaaaagcagtgcaaacctctgctggagaggaataaatgtctcgccaagcgcaacgatgagctcatggtttccctgcagcgaatggaagaaaagcttaaagccgtcacaaaggaaaatagcgagatgcgtgagaaaatcacgagtcacccacccctcaagaaattaaagagtctgaacgacctcgaccaggctaatgaggagcaagaaacagagttcctgaaattacaggttatcgagcagcagaacattatcgacgagctgacacgcgatcgcgagaagctgattcggcgacgcaagcatcggcgatcctctaaacctataaagaggcccgtactggaccccttcatcggctacgacgaagactcaatggattccgaaaccagttccatggcttcattccggaccgacaggacgccggcaacccccgacgatgatctggatgagtcactcgctgccgaggaaagcgagctgaggtttaggcagctgacgaaggagtaccaggctctgcagcgcgcttatgcactgttgcaagagcagaccggcggtatcattgatgcggaaagagaggcgaaggcccaagaacagttgcaggctgaggttcttagatacaaggccaaaatcgaggacctcgaagcaaccctggctcaaaaagggcaggattcccactgggtagaggacaaacagctgttcatcaaacgaaatcaagagcttttagagaagattgaaaagcaggaagcggagaatcacagattacagcaggaactccaggacgctcgggaccaaaatgaactgcttgagttccggaacctggagttagaggaacgggagcggagatctcctccatttaaccttcagatccaccccttttcagatggggtgtctgccctgcagatctactgcatgaaggagggagtcaaggacgttaacattcctgatctgattaagcagctggacatccttggggataacggaaatttgcgtaacgaggaacaggtcgcaatcattcaggcatccaccgtcctctccctggctgaaaagtggatccaacaaatcgaaggggctgaagccgcacttcatcagaagatgatggagctggagtccgacatggagcagttctgtaaaatcaaaggctacctggaggaggagcttgactacaggaagcaggcactggaccaagcttatatgcgcattcaagagctggaggccactctgtacaatgccttacagcaagagacagtcatcaagttcggcgagctgctgagcgaaaaacagcaggaggaattgcgcactgctgtcgagaagcttagaagacagatgctgagaaaatcaagagaatacgactgtcagatcctgcaggaaaggatggagctcttgcagcaagcccatcagcggatccgcgatcttgaggacaaaaccgacatccagaagagacagatcaaggatcttgaggaaaagagcaacaggaaacacggctag

SEQ ID NO: 50854 - DNA, 2337 bp, Artificial Sequence
  Description of Artificial Sequence: Synthetic coding sequence
atggtgtccaaactggagcgagagaaaacccaggaggccaaaagaattagggagctggagcagcgaaagcatacggtgttagtcacagaattgaaggccaagcttcacgaagaaaaaatgaaggagttacaggccgtcagagagaatttaatcaaacaacatgagcaggaaatgtctagaacagttaaggtgcgggacggagaaatccagcgcttgaaatccgccctttgtgctctccgggacggctccagcgataaagtgcgcaccgccctgacaatcgaggccagagaagaggctcgaaagctcttcgataccgagaggctcaagctgctacaggagatagccgacctaaagactgccaaaaagcaagtcgatgaggccctgtctaacatgatccaggccgataagatcaaagccggagatctgcgatctgagcaccagtctcaccaggaggccatcagcaaaattaagtgggaaagcgaacgggacatccgccgactcatggacgaaatcaaagctaaagaccgtatcatcttcagcttggagaaagaactggagactcagacggggtacgtccagaagctgcaactgcagaaagaggccctggatgaacagctgtttctcgtgaaggaggctgaatgcaacatgagttcaccgaagcgggagatcccagggagggcaggcgacggctctgagcactgttcttctcccgacctccgaaggaatcaaaagcgcattgctgagctcaacgcaacaatcagaaaactcgaggataggaacacgctcctcggagacgaaagaaatgaactgctcaaaagggttcgcgagacagaaaaacagtgtaagcccctgctagaaaggaataaatgtctagccaaaagaaacgatgagctgatggtgagccttcagaggatggaggaaaaacttaaggcagtgaccaaggagaacagtgagatgcgggaaaagattacctcacacccccctctcaagaagttgaagagcctaaacgacctagaccaggcgaatgaagaacaggagacagagttcttgaagctgcaagtgattgaacagcagaatatcatcgatgagctgacccgggacagggaaaaattaatccgtcgtaggaaacaccggagaagctccaagccgattaagcggccagttcttgatcctttcatcggatatgacgaggacagcatggattctgagacaagcagcatggctagcttccgaaccgaccggacacccgcaacacctgatgatgacctagacgaatctttggcggctgaggaatccgagttacgctttcgtcagttgaccaaggagtaccaggccctgcaaagagcttatgcattgctgcaggaacagactggaggcatcatcgatgcggaaagggaagcaaaggctcaggagcagctccaggcagaggtgttgcggtacaaagccaaaatagaggatctggaggccactttggcacaaaagggacaagactcgcactgggtggaggataagcagctgttcataaagcgaaaccaagagctgctggaaaaaatcgaaaaacaggaggctgaaaatcacagactgcagcaggagctccaagatgccagagatcagaacgaactcctcgagtttcgaaatctagagttggaagaaagagaacgacgatcccctccatttaacttacagattcatccttttagcgacggggtctcagccctgcagatttactgtatgaaagagggcgtcaaggatgtgaatattcccgacctgatcaaacagcttgacatcttgggtgacaatggtaacctccgaaatgaggaacaggttgcaattatacaagccagtaccgtgctgtctctcgcggaaaaatggattcaacagattgagggcgctgaggccgcattacaccagaagatgatggagctggagagcgatatggagcagttttgcaaaatcaaaggctacctggaagaggagttagattataggaaacaagcgcttgaccaggcgtatatgcgcatccaggagcttgaggccactttgtacaatgccctgcagcaagagaccgttataaagtttggcgaacttctctcggagaagcaacaggaggagctgcgaacggctgtggagaagctgcgaaggcagatgctgaggaagtcccgcgagtatgattgtcaaatactgcaagagcggatggagttgttgcagcaggcacatcaacggatcagagatctggaagataaaactgatattcagaaacggcagattaaagacttagaggaaaagtttttgtttctgttcctcttcttcagtctggcctttatcttgtggccttag

SEQ ID NO: 50855 - DNA, 2400 bp, Artificial Sequence
  Description of Artificial Sequence: Synthetic coding sequence
atgagcaaaaaaggaagaaataagggcgaaaaaccagaagctctaattgtagccctgcaggccgcaaatgaggacttaagaaccaagctgacggacatccagatcgagctccatcaagagaaatctaaagtttcaaaactcgagcgcgaaaagacccaagaggccaagaggatacgagagctggagcaaagaaaacacacggtgctcgttaccgaattaaaggcgaaactacacgaagagaagatgaaggagcttcaggcggttcgcgaaaacctgatcaaacagcatgaacaagagatgtcgcgcacagtcaaagttagagatggcgaaatacaacgattaaagtccgcgttgtgtgctctcagggatgggagcagtgataaggttagaacagcactgacaatcgaagcccgagaggaagcgaggaagctgtttgacaccgagagactgaagctgctccaggaaatcgcagatctgaaaactgcaaagaagcaggtagacgaagctttatctaacatgattcaagcggacaagatcaaggctggcgacctaagaagtgaacaccagtcccatcaagaagccatcagcaagattaaatgggaaagcgaacgggacatccgcaggctcatggacgagatcaaagcaaaggacagaattatcttctccctggaaaaggagctggagacacaaactggttacgtgcagaagctgcaactacaaaaggaggccttggacgaacaactcttcctcgtgaaggaggccgaatgtaatatgtcgagcccaaaaagggaaataccaggaagggccggtgatgggagcgaacactgctcctcacccgacctgagacgaaatcagaagcggattgccgagctgaacgccacgatccggaagctggaggacagaaacacactgttgggagacgagcgcaacgagctgttgaagagggtgagggaaaccgaaaaacagtgtaaaccacttctcgaacgcaacaagtgcctagcaaagcgaaacgatgagctaatggtctctttacagagaatggaagagaagttaaaggcagtcacgaaggaaaacagtgaaatgcgcgaaaaaatcacaagtcatcctccgttgaaaaaacttaagtcactaaatgatcttgaccaggccaacgaggagcaagagacggaatttctgaagttgcaagtcatcgaacagcagaacattatagacgagctgactcgtgatcgggagaagctcataagacgtcgtaagcaccgaagatcaagcaaacccattaagaggcccgtgctggacccattcatcgggtatgatgaagatagtatggatagtgaaaccagctctatggcttcattccgcaccgacaggacccctgctacccccgacgacgaccttgatgaatccctggcggcagaggaaagcgaattgaggttcagacaactgaccaaggaatatcaagccctgcaacgagcctacgcattacttcaggaacagacagggggtattattgacgctgaacgggaggccaaagcccaggaacagctgcaagccgaagtcctgcggtacaaagctaaaattgaggatctggaggctactctggcccagaagggtcaaattgaaaagcaggaagccgagaaccacagattgcagcaggaactgcaggacgctagagatcagaatgaactgctggaatttcggaacctcgagctggaggagagggagagaagatctcccccattcaatctccagatccatccctttagcgatggtgtgtccgccttacagatttattgcatgaaggagggggtgaaagacgtgaacatacccgatctgattaagcaactggatattctgggagataacgggaatcttaggaacgaggagcaggtcgccattatccaggccagcacggtgctgtctttggctgagaagtggatccagcagatcgagggtgcagaggccgcactgcaccaaaaaatgatggagctcgaatccgatatggagcagttctgcaaaatcaaagggtacctggaggaagagttggattaccgcaagcaggcgcttgatcaggcctatatgcggatacaggagctcgaagcaacactctacaatgcactgcagcaggaaacggtgattaagttcggtgaactgctgtccgagaagcaacaggaagagctacggacagcggtggaaaagcttaggcgccagatgctgcgcaaatcacgagaatacgattgtcagatcctgcaggaaaggatggaattgctacagcaggcacatcagaggattagagatctggaggacaagacagacatacaaaagagacagatcaaagaccttgaggaaaagttcttgttcctgtttctgtttttctctttggcgttcatcctgtggccatag

SEQ ID NO: 50856 - DNA, 2370 bp, Artificial Sequence
  Description of Artificial Sequence: Synthetic coding sequence
atgtcaaaaaaaggcagaaataagggggaaaagccggaggccttgatcgttgcgctgcaggctgcaaacgaggacctgaggaccaagctgaccgatattcaaattgagcttcatcaggagaagtcgaaggtgtcaaagctcgagagagaaaagactcaggaagcaaagagaattcgggagctggagcagagaaaacataccgtgttggttactgaactgaaagcaaaactgcatgaagagaagatgaaagaactccaggccgtgcgggaaaacctgattaaacaacacgaacaagaaatgagcaggactgtgaaagttagggacggcgaaattcagcggctgaagtctgccctgtgcgccctgagggatggcagttcagataaggtgcgcaccgccctcacgatcgaagctagagaggaagctcgcaagctatttgacacagagagactcaagctactgcaggagatcgcagaccttaagacggcaaagaaacaggttgatgaggcgttatccaatatgatccaggccgataagatcaaggcaggcgaccttcgaagtgagcatcagagccatcaggaggctataagtaagattaagtgggaaagcgaacgggacatccggcgtctcatggatgagattaaagcgaaagaccgcatcatcttctccctcgaaaaggagttggagacacagaccgggtatgttcagaagctgcagttgcagaaggaggctttggatgaacagttattcctggtgaaggaggccgagtgcaacatgtcaagtccgaagcgcgagatccccggaagggcgggtgatgggagtgagcattgctcaagccccgaccttcggaggaatcagaagagaattgctgaactcaatgccaccatcagaaagctcgaggatagaaacacactcctcggagatgaaagaaatgaactgctgaagcgcgtgagagagacagagaaacaatgcaaaccactgctggagagaaacaaatgtctggccaaaaggaacgatgagctgatggtgtctctgcagcggatggaggagaagttgaaagccgtgaccaaggaaaactccgaaatgagagaaaagataacttcacacccccctttgaagaagctcaaatcgctgaatgatttagaccaggccaacgaagagcaggagactgagttcctgaaactgcaggtcattgagcagcaaaatatcattgacgagctgaccagagacagggaaaagttgattaggagacgtaagcaccgacggagctccaaacccatcaagagaccagtcttagacccctttataggatatgatgaagactccatggactccgagactagctccatggccagctttagaaccgatcgaactcctgctacaccagatgatgatctggatgaatcccttgcagctgaggagtctgagcttcgttttagacagttaaccaaagagtatcaggcacttcagcgggcttacgccttactccaggaacaaacaggcggtattattgatgctgaacgcgaagccaaagcgcaggagcaactgcaggctgaggtgctgagatacaaggccaaaatcgaggatttagaggcaactctggcccagaaaggacagattgagaaacaggaggcggagaaccatcggctgcagcaggaacttcaggacgccagggatcagaacgagcttttagaatttcgaaacctcgagctggaagaacgcgagcgcagatcccctccattcaatttgcagatccacccatttagcgacggtgtatctgccttacagatctactgtatgaaggagggcgtgaaagacgtgaacattcccgatcttattaagcagctggatattttaggcgataacgggaaccttaggaacgaagaacaggtggccataatccaggcatcaactgttctgtccctggcggagaagtggattcaacagattgaaggtgccgaagccgcactgcatcagaaaatgatggagctggagtccgatatggagcagttttgtaaaatcaaggggtacctggaagaggagttagactaccggaaacaggctctcgaccaggcctatatgaggatccaagaactggaggctacgctatacaacgcgttgcaacaggagaccgtgattaagtttggagagctgctctcagaaaaacagcaggaagagctccggaccgctgttgagaaactcagaaggcaaatgcttagaaaaagtcgcgaatacgattgtcagattctgcaggaacgaatggagctgcttcagcaggcccatcagaggattcgcgacctagaggataagaccgacattcagaagcgtcagatcaaagatctggaagaaaagtctaataggatgcccgcttag

SEQ ID NO: 50857 - DNA, 2535 bp, Artificial Sequence
  Description of Artificial Sequence: Synthetic coding sequence
atgtccaagcgaggtatgagctcacgggctaagggagataaagctgaagctctcgctgcactgcaggctgcaaatgaggatcttcgggctaagctgacagatatccagatcgagctgcagcaggaaaaaagcaaagtgtctaaggtcgaaagagaaaaaaatcaggaacttcgccaagtcagggagcatgaacagcataaaactgccgtgctattgacagaattgaagactaaactgcacgaggagaagatgaaagagttgcaagctgtgcgagaaaccctcctcaggcaacacgaagcggagttactgcgggtgatcaagattaaagataatgagaaccagcgattacaggctctcttgtcggccctgcgggacggcggtcccgagaaagtgaaaacagtgcttttatcggaggctaaagaagaggccaagaagggtttcgaggttgagaaggtgaaaatgcagcaggagatatccgagctgaagggcgctaagagacaggtcgaggaggctctgactctcgtaatccaagccgacaaaataaaggcagcagagatcagatctgtgtatcatttacaccaggaggagatcacgagaatcaagaaagaatgtgagagagagattagaagactcatggaagagatcaaattcaaagaccgtgctgtcttcgtccttgaaagagagctcggcgttcaggcaggacacgctcagcggctgcagctgcaaaaggaagcactcgacgagcagctgtcacaggtccgtgaggccgacaggcaccctggctccccacgaagggagcttccccacgctgctggtgccggagacgcgtcagatcactctggatcccctgagcagcagttggacgaaaaggacgctagacgatttcagttgaagattgctgagctttccgccatcatcagaaagttggaagaccgcaatgcattattatctgaagaacggaatgaattgcttaaacgcgtgagggaagccgaatctcaatacaaacctctcttggataaaaacaagcggctctcccgtaaaaatgaagatctgtcgcatgccctgcggaggatggaaaacaagcttaagtttgttacacaagagaacattgagatgcgacagcgagccggtattattcgtcgaccatcatccctaaatgatctggaccagtcacaggatgaaagggaagttgacttcctgaaactccagatcgtcgagcagcagaacctcatcgatgaactctcaaagactctggagacagcaggatatgtaaaatccgtcctggagcgcgataagctgctgcggtttcggaagcagcggaaaaaaatggctaagcttcctaaaccagtcgttgtagaaacatttttcggatacgacgaggaggcaagccttgagagtgatggatcctccgtgtcctaccaaactgatcgtacagatcagaccccttgcactcccgatgatgacttggaggagggtatggctaaggaagagacggaactgcggttccgacaattgaccatggaataccaggccttacagcgggcttacgcactgctgcaggagcaggtcgggggtactctagacgctgaaagagaggtcaagacgagagaacagctccaggccgaggtgcagcgcgctcaggcaagaatagaggacctggaaaaggccctcgccgagcaggggcaagacatgaagtggattgaggaaaagcaggccctgtacagacgaaatcaggagctcgtggagaagataaaacaaatggagaccgaggaggcacgccttagacacgaggtccaagatgcacgggatcagaacgaactgttagagttccgcatcctagagcttgaggaaagagagcgaaagagtccggcaatctcatttcaccatacccccttcgtcgacggtaagtctccgcttcaagtttactgcgaagcggagggagtgaccgatattgtcgtggccgaactcatgaaaaaactcgacatactgggcgataacgcaaatctgacaaatgaagaacaggtggtggtgattcaggcccgtaccgtgctcactttggccgaaaagtggttgcagcagatcgaagagaccgaggcagcactgcagcgtaagatggttgatctggaatccgaaaaggaactgtttagcaagcagaaaggctacctggacgaagagctagactatcggaaacaggccttggaccaagcaaacaagcatatcctggagctggaggcaatgctttatgacgctttgcaacaagaggcaggggcaaaagtggctgaactattgagcgaagaagagcgcgaaaaacttaaggtagccgtggagcagtggaagagacaggtgatgagcgagctgagggaaagggacgcccagattctcagggaacgaatggagctcctgcagctggctcagcagagaatcaaagagttggaggagagaatagaggcccagaagaggcagatcaaggagttggaggaaaagtttctgttcctgtttttatttttttcccttgcattcattctgtggtcctag

SEQ ID NO: 50858 - DNA, 996 bp, Artificial Sequence
  Description of Artificial Sequence: Synthetic coding sequence
atgtctatgacgacacgggcatgggaggagctggacggcggacttggcagttgccaggccttggaggatcatagcgcgctggccgagacccaggaagatcgcgcatccgctacccctcggctggccgacagcggaagtgttcctcacgactcccaggtggcagaaggtccttccgtggatacgcgccctaaaaaaatggagaaggagcctgctgctcgaggtacacctggtacaggcaaggaaagactgaaagccggtgccagccccagaagtgtgcctgccagaaaaaaggcccagaccgctccgccattgcagccccctcctcccccacccgcactgagcgaagagcttccttggggtgacctgtctcttaacaagtgcctggttcttgcttctctggtggctctgttgggatctgcattccagctttgcagggatgccgtaccaggtgaggcagcacttcaggcacgggtgccagagccttgggtgcccccaagctccgccccacgggagcctagcagccccctgcctaagttcgaagcacaggcccctcctagcgccccaccggcacctcgggcagaggcagaggtgcgccctaagattccaggctctagggaagcagccgaaaacgacgaggaagagccaggagaggccaccggagaagctgttcgtgaagaccgcgtgacgctggccgaccgaggccctaaagagcgccctcgacgcgaaggcaaaccgaggaaggagaagccccgaaaagaggaacggccaaagaaagagcggccacgtaaggaggaaagaccaagagctgcccgtgagcccagagaggccctgccacagaggtgggagtcaagagagggcggtcatcgcccttgggctcgtgactcacgtgatgcggagcctaggaaaaaacaagcctgggtctcacccaggagaccagatgaagaacagagacccggttcaaggcaaaagctcagggctggaaagggaagggattag

SEQ ID NO: 50859 - DNA, 1887 bp, Artificial Sequence
  Description of Artificial Sequence: Synthetic coding sequence
atgagtccaggaggaaaatttgatttcgatgacggcggatgctacgtgggcggttgggaagcaggcagggcccatggttatggcgtgtgcaccggtcctggtgcacagggcgagtactccggatgctgggcccacggattcgagagccttggagttttcactgggccaggaggtcacagctatcaaggccattggcagcaggggaagcgagaagggctgggcgtagaacgaaagtcgagatggacctatcgaggcgagtggttgggtggactcaaaggacggtcaggggtctgggaaagcgtctcagggctccgctacgctggtctttggaaagacgggttccaggacggatatggcactgaaacctattcagacgggggtacttaccaggggcagtggcaagcaggcaagagacacggatacggggtgcgccaaagcgtcccctatcaccaggcagcactgctgcggtcgcccagacgtaccagccttgactctggtcactccgatccccctacaccccctccaccgctcccgctgccgggtgatgaggggggatcccccgctagtggttctcgagggggttttgttctggccggtccaggggacgccgacggcgcaagctcacgaaaacgtacaccagccgctgggggattctttaggagatcccttctgctttccggtttacgcgcaggaggccgacgctcatcccttggctccaaaagaggctctttgcgatccgaagttagctcagaggtcggcagtacaggccctcccggaagcgaggccagtggtccacccgctgcggctcctcccgcactcatcgaaggcagcgctacagaggtctatgccggagaatggcgggcagacaggcggtctggatttggggttagccagagatctaatgggctacggtatgagggagaatggctggggaatcggagacacgggtacgggcgtaccacccgcccagacgggtcccgggaagagggaaaatataagaggaacaggctggtgcacggtggcagggtgagatccctactgccactggccttaagaagaggcaaggtcaaagaaaaagttgaccgggctgtggagggggcacggcgagctgttagtgcagctagacaacgacaagagattgctgcagccagggcagcagatgctctgttgaaggctgttgccgctagctccgtggccgagaaggcagtggaggcagctcgaatggctaagttaatagctcaagatttacagcctatgttagaagcacctggccgtcggcctcgtcaggactccgaggggagcgacaccgagccactggatgaagattctccaggagtctacgagaacggacttaccccgagtgaggggtcgcccgagttaccaagttccccagcttcttctaggcaaccctggaggccaccagcctgcagatcacccctgcccccaggaggtgaccagggcccattttctagtccaaaggcgtggccagaagagtggggcggtgcaggcgctcaggccgaagaactggccggatacgaggccgaggacgaagccggaatgcaggggcctggtcccagggacggttcacccttactgggtggctgtagcgattcgtccggatccttaagggaagaagaaggagaagatgaagaaccattacctccacttcgcgcacccgcaggaacagagccagagccaattgctatgctggtgctcagaggcagcagtagtcgtggcccagatgcagggtgccttaccgaggagcttggcgaaccagctgcaacagagcgtcctgcccagccaggagccgctaaccccctggtggtcggtgcagtggctctattggacctgagcctggccttcttgttctcacaactgctcacatag

SEQ ID NO: 50860 - DNA, 1887 bp, Artificial Sequence
  Description of Artificial Sequence: Synthetic coding sequence
atgtcccccggaggcaaattcgattttgatgacggcggatgttacgtcggtggctgggaggcagggagagcccatggttacggggtatgtaccggccctggcgcacagggcgaatactccggttgctgggctcacggttttgagagcctgggtgtattcactggccctggtggccatagctatcaggggcactggcagcaaggtaagagagaaggtctaggggtggaaaggaaatcgagatggacttaccgcggtgagtggctcggcggactgaagggacgtagtggggtgtgggagagtgtaagtggactgcgctatgctggactgtggaaggatgggttccaagacggctatgggaccgaaacttactctgacgggggaacctatcagggccagtggcaggctgggaaaagacatggttacggcgtcagacaatctgtgccctaccaccaggctgcgctgctccgttccccccgtcgcactagcttggattccggccattccgacccaccaactccacccccacctcttccgctgccaggagacgagggcggaagccctgcctccggtagtcgcggaggctttgtgctcgctgggcctggggacgcagatggagctagctctagaaagaggacacctgctgccggagggttttttcggaggtctttactgctgtctggactcagggctgggggaagaagatctagtttaggttccaagcgagggtcactacggagcgaagtgagtagcgaggtcggctcaactgggccaccaggcagcgaagcgagtggtccccctgctgctgccccacctgccctgattgaggggtccgcaactgaggtatacgcaggcgagtggcgagcggaccgtaggtccggctttggcgtgtctcagaggagtaatggtctacgatacgagggggagtggcttggaaacagacggcacggctacggacgaacaaccagaccagacggctcccgagaggagggtaaatacaaaaggaatagattggtgcacggaggacgcgtgagatcactgctgcctttggctctgcggcgtggcaaagttaaggaaaaagtggacagagccgtcgagggggctcgccgtgcagtctccgcagccaggcagagacaagaaattgcggcagcaagagcagctgacgcccttctcaaggctgtcgcagcatcgtctgtggccgaaaaagctgtcgaggccgctcgcatggcgaaactgattgctcaggacctccagcccatgttggaggcgcctgggcgacgccctagacaggactctgagggaagtgacactgaacctctagatgaggactctccaggagtgtacgagaacggactgacacccagcgaaggatcccccgaacttccatctagcccagccagttcccgccaaccttggcggcctcctgcatgcagatcacccctgcccccaggcggtgaccagggtccatttagcagcccgaaggcctggcccgaggaatgggggggtgctggagcacaggccgaggaactcgccggatacgaagcagaagatgaggctggtatgcagggccctggcccaagggacgggagccctcttcttggtgggtgctccgacagctcgggatctctgagagaagaggagggggaggatgaggagcctttgccacccctgcgagctcctgcagggactgaacctgagcccatcgcaatgctcgtcctgcgtggcagtagcagtcgcggtcctgatgcaggctgtttgaccgaggaattgggcgaaccagctgccaccgaacgacctgctcaacccggagccgcaaatccccttgttgtgggagctgtggccctgctggacctttcattggcctttttgttttcccagttgttaacttag

SEQ ID NO: 50861 - DNA, 1887 bp, Artificial Sequence
  Description of Artificial Sequence: Synthetic coding sequence
atgtccccgggtgggaaattcgattttgatgacggtgggtgctatgtcgggggatgggaagccggtagggcacatggatatggggtctgcacaggcccaggcgcacagggagagtactcaggctgctgggcacatgggttcgagtccctgggtgtgttcaccgggccagggggacatagctatcagggccactggcagcaaggtaaacgggaagggttaggagtagaacggaagagcaggtggacgtacaggggcgagtggctggggggtctgaaaggaaggagcggtgtgtgggagagtgtatccggcctgcgctacgccggattatggaaggacggtttccaggatggatatggtacagaaacttattctgacggtgggacataccagggccagtggcaggccggaaaaagacatgggtatggtgtccgtcagtctgtaccttaccatcaggccgcattgctccggtcaccccgaaggacgtccctcgattcaggtcactccgatccaccaacaccccctccacctttgccgctgccaggggatgaaggaggctcgcccgcttcgggatccaggggcggatttgtgctggccggacccggagacgcggatggtgcatcttcgcggaaacgcacacccgctgcaggcggttttttccggcgttcattactgttgagcgggcttcgcgctgggggacggagatcgtctctcggaagtaaaagaggctccttgcgttctgaagtatcaagcgaggtgggatccaccggaccccctggaagcgaagctagtggcccacctgccgcagctcctcccgcattgattgaagggtccgctaccgaagtctatgccggtgaatggagagcagacaggaggagcggctttggggtaagccaaaggagtaatggtctgcgctacgagggcgagtggctcggtaataggaggcatggctacgggaggacaacaagacctgatggcagtcgcgaggagggcaaatacaaaaggaatcggctggtgcacggtgggcgtgtgcgctctctgcttccactggcactccggagagggaaggttaaggagaaagttgaccgggcagtggagggtgccaggagagccgtgtcagccgctcggcagaggcaggagattgcagccgcacgagctgccgacgcgctgctcaaagcggttgccgcaagctcagtggctgagaaggccgtcgaagcggctaggatggccaaattaatcgcccaggatcttcagccaatgctggaggccccagggaggaggccgcgacaggacagcgagggctctgacacagagcctctggacgaagacagtccgggagtgtatgaaaatggcttgaccccaagtgaaggtagtcctgaactgcccagcagtcctgcatcatcaaggcagccttggcgcccaccggcatgtaggtctcctctgcctccaggtggtgaccaggggcctttttcctctccaaaagcttggccagaggagtggggcggagccggtgcacaggcagaggaactggcaggctacgaagccgaagacgaggctggcatgcagggcccagggccacgcgacggcagcccactgctgggtgggtgcagcgactcatcaggcagcttgcgggaggaggagggagaggacgaagaaccacttcccccattgcgcgctcctgctgggaccgagcctgaacctattgctatgctggtgttgcgtggtagttcctcccgcggaccagacgccggatgtctgacagaagagttaggcgagccagcagccactgaacgtcctgcacagccaggcgcagccaacccactggtggtcggtgctgtcgctttactggacctgagcctggctttcctattttcccagctgctgacctag

SEQ ID NO: 50862 - DNA, 1524 bp, Artificial Sequence
  Description of Artificial Sequence: Synthetic coding sequence
atgaggagactgcccagggcactgttgctccagctgaggttagctcttttggtggcagccggtgcacctgaagtgctggtcagcgcgccacgaagcctggtttggggccctggactgcaagctgcagtcgtgttacctgtgcgctatttttacttgcaggctgtcaatagcgagggccagaacctgacaaggtcgccagctggcgaaacaccctttaaagtggtcgtcaagagcctatcaccaaaggaactcgtgcgaattcatgtgccaaagcccctggaccgcaacgacggaactttcctgatgcgataccggatgtacgagaccgtggacgaaggcttgaagatagaagttctttacggagatgagcatgtagctcagtccccttatatcctaaagggacctgtgtaccatgagtactgcgagtgccctgaggatccacaggcttggcagaagactctttcctgtccgacaaaggagccccagatcgccaaagatttcgcttcctttcccagtattaatctgcaacagatgctcaaagaggtgccaaaacgcttcggagacgaacggggagcaatcgtacactataccattttaaacaaccacgtgtatagacgctctctcggcaagtacactgacttcaaaatgttctcagatgagattctactgagtctgactcggaaggttttgctgcccgaccttgaattctacgtcaacctgggagactggcctcttgaacacaggaaagtcaacggcaccccaagcccaatcccaatcatatcctggtgtgggagtctggattcccgcgacgtggttctgccaacctatgacattacccattctatgctggaggcaatgcgcggtgtcaccaatgatctgttaagtatccaaggcaatacaggcccatcctggatcaataagaccgaacgagcattctttcggggacgagactcccgtgaggaacggctgcaacttgtccagctgtccaaggagaatccccagctcctggacgcaggcattacaggctacttcttctttcaagaaaaagagaaagagcttggtaaagcaaaactcatgggtttttttgacttcttcaagtataagtaccaggtaaatgtggacggaacagtcgctgcctaccgctatccttacctgatgcttggcgatagtctcgttcttaaacaggactcaccctattacgaacatttctacatggccctggaaccatggaagcattatgtccccatcaagcgtaacttgtcagatcttctcgaaaaagtcaaatgggccaaggagaatgacgaggaggccaagaagatagcaaaagagggacagctgatggcccgagatctactccaaccccatcgcctgtattgttactactatcaggtcctgcagaaatacgccgagagacagagcagcaagcctgaggtcagagacgggatggaactcgtcccacagccggaggattccacagccatttgtcaatgccatcgtaaaaaacccagtcgagaagagctgtag

SEQ ID NO: 50863 - DNA, 1230 bp, Artificial Sequence
  Description of Artificial Sequence: Synthetic coding sequence
atggtcgagctgttcatttttctctttttgctgggcgagactcctttcaaggtggtcgtcaagtcactgtctcctaaggaacttgttcgcatccacgtgccgaaaccactggaccggaacgacggtacattcttaatgaggtacaggatgtacgagaccgtggacgaggggctcaaaatcgaggtgctgtacggagacgagcatgtcgcacagtccccgtatatcctaaaaggtcccgtgtatcacgagtactgtgagtgtccagaagacccccaagcctggcagaaaactctaagttgtcccacaaaagaaccacagatagcaaaggatttcgcgtcatttccgtccataaatctgcagcaaatgttgaaagaagtccctaagaggtttggagatgagagaggcgcaatcgtgcattacactatcttaaataatcatgtgtaccgtcggtcgctgggcaaatatactgactttaagatgttcagcgacgagatcctgttaagcctcactcgcaaagtattgctccctgacctggagttctacgtgaatctcggggactggccactcgaacacaggaaagtgaatggcacccccagcccaattcccattatcagttggtgtggcagtcttgactcaagagatgtggtcctgccaacttacgacatcacccatagtatgctcgaggcaatgcgtggcgtaacgaacgatctgctttccatccagggcaacacaggtccatcgtggatcaacaagaccgaaagagccttttttcggggtagggatagcagggaggaacgactccagttagtccagctcagtaaagagaatccccagctgctggacgctggcattaccggctacttcttttttcaagaaaaagagaaagagctcggaaaggccaagctcatgggtttcttcgacttcttcaagtacaaataccaagtcaacgtggacggaactgtggcggcttaccgctacccctacctgatgctcggcgatagcttggttcttaagcaagacagcccctattacgagcacttctatatggccttagagccgtggaagcactacgttccaattaagagaaatctctcagacttgctggagaaagtgaagtgggccaaaagttttacactttccccacgattggagtgttccggaaccatctcaacacactgtaacctatgcctccccggatctcgcaactttgtgcctcagccgccagagtag

SEQ ID NO: 50864 - DNA, 1356 bp, Artificial Sequence
  Description of Artificial Sequence: Synthetic coding sequence
atggtggaactgttcatatttctctttctcctcggggaaactccctttaaagtggtcgtgaagtctttaagtcctaaggagctcgtaagaattcacgtgcccaaacctttagaccgtaacgacggtacctttttgatgcgataccggatgtatgagactgtagacgaagggctgaaaattgaggtattgtacggggacgaacatgtggcccagtccccctatatattgaaggggccagtataccacgagtactgtgaatgtcccgaagatccccaagcctggcagaagacactgtcctgtccaactaaggaaccacagatcgcaaaagactttgccagtttccccagtatcaatctgcagcaaatgctaaaagaagtgcccaaaagatttggcgatgaacgaggtgctatcgtccattatacaatcctgaacaaccacgtgtatagaagaagcttaggtaagtatactgacttcaagatgttctcagatgaaatactactctctctgacaagaaaagtgttgctacctgacctcgagttctacgtgaatctcggagattggccacttgaacaccgtaaagtgaatggcactccatctcccattcctattatctcctggtgcggctcacttgacagtagagatgtggtactgcccacatatgatattactcactctatgttggaggcaatgcggggagtgacaaacgatctgctttcaattcaggggaataccgggcctagttggattaacaagactgaaagagctttctttcgcggtagagatagtcgagaggaaaggctgcagttggtgcagctgtccaaagagaaccctcagttactggatgccggtattaccggttattttttctttcaggagaaggagaaggaattaggcaaagcaaagctcatggggttctttgacttctttaagtacaagtatcaggtcaatgtagacggaactgtcgccgcttatagatatccgtatctgatgctgggggacagtctggtgctaaaacaggatagcccatactacgagcatttctacatggccctggagccctggaagcattacgtccctatcaaaagaaatctctcagatctgctggagaaggtgaaatgggctaaggaaaacgatgaggaagccaagaagatagcaaaggagggacagctgatggcaagggatcttctccagcctcatcgtctgtactgttattactaccaggtcttacagaaatatgcagagcggcagtccagcaagcctgaagtcagagacggcatggagctagttccccagcctgaggatagtacagctatttgtcagtgccatcggaaaaaaccatcaagagaagagctgtag

SEQ ID NO: 50865 - DNA, 639 bp, Artificial Sequence
  Description of Artificial Sequence: Synthetic coding sequence
atgaatctgtttcgattcctcggagatctgagccatctcctggcaattatactgctgctcctcaagatttggaagagtcgctcttgtgccggaatcagcgggaaaagccaggtgctcttcgctgtggtattcacggctcggtatctcgacttatttaccaactatatctctttgtacaacacctgcatgaaggtggtgtacatcgcctgctcttttactaccgtgtggctgatctacagcaagtttaaagctacctacgatggaaaccatgatacgttcagggtcgagttccttgtggttcctaccgcaattctggcttttctcgtcaatcatgatttcacgcctttggaaattctctggaccttttccatttacctggagtcagtggccattttgccccagttgtttatggtatctaagaccggggaagctgaaactatcacgtctcattatctgttcgctctgggtgtgtaccgcaccctgtacttattcaactggatctggcggtaccattttgagggcttctttgatctgattgcgattgtggcgggactggtacagaccgtgttatactgcgatttcttctatctctatatcacaaaggtcctgaaaggtaaaaaactgtcgctcccggcttag

SEQ ID NO: 50866 - DNA, 639 bp, Artificial Sequence
  Description of Artificial Sequence: Synthetic coding sequence
atgaacatttttaggctgaccggtgatctaagtcatctggcggctatcgtgattctcttattgaagatctggaagacgaggtcctgtgcaggcattagtgggaagtctcagctacttttcgcactggtgtttacgacaaggtatcttgatctgtttaccagcttcattagcttgtacaatacctccatgaaagttatttacctggcgtgcagctacgctaccgtgtacctgatctacctcaagttcaaagcaacctatgatgggaaccacgatacctttagggttgagttcctagtggtgccggtcggtggattgagctttctggtgaatcacgatttctcgccgctggagattctgtggactttcagcatctatctggaaagcgtcgctattctgccccaactgtttatgatatcaaaaacaggggaggccgagactatcacaactcactaccttttctttctcggattatacagagccctgtacctggtaaactggatatggcgcttctatttcgaaggtttcttcgacctgattgccgttgtggcaggagtggtacaaacaattctgtactgcgattttttttacttatacattactaaggtgttaaaaggcaagaagctttcattgccggcatag

SEQ ID NO: 50867 - DNA, 561 bp, Artificial Sequence
  Description of Artificial Sequence: Synthetic coding sequence
atgaatattttccgcctgactggcgatctttctcatctagcagcgatcgtgattctcctgctcaaaatttggaagacaagatcatgtgccggtatatccggtaagtcccaacttctttttgcattagtctttaccactcggtacttggacctgttcactagttttatctcactatataacacatcaatgaaggtcatttatcttgcatgtagctatgccaccgtctatctgatttatctgaagtttaaagctacatatgatggaaatcacgataccttccgggtcgaattcttggtggtgcctgtgggcggtctgtcatttttagtgaaccacgatttctcaccgttagaatactctcgggaacggtccagcgtttgccaacacaagtgccagaggccaagccccgcttcagtgctccagggtgcccgtacagagttcttaccacagcagcggcacaagatgcttgacactgaaaatcagaaactgaatagcttcgtcgcagacagccatcagtggttatgtaaaaacgctgaagagaagtcccaaaaagtaagcgtgtag

SEQ ID NO: 50868 - DNA, 543 bp, Artificial Sequence
  Description of Artificial Sequence: Synthetic coding sequence
atgtctgtgttgcgcccactggataagcttccgggtctcaacaccgccactattctgctggttgggacagaggatgccctcctgcagcagctggcggattccatgttgaaggaggactgcgcaagcgagctcaaggtgcatcttgccaagagcctccccctgccctcctccgtaaatagaccgcgaattgatctcatcgtattcgtagttaacctgcattccaaatacagcctccagaatactgaggagagcctaaggcatgtcgatgcttccttcttcctgggtaaagtgtgctttcttgcaacaggggctggcagggaaagccactgtagtatccacaggcatacagtggtcaaacttgcccacacttatcagtcaccactgctttactgtgatctggaggtagaaggttttcgggctactatggctcagagactggtgcgggtgttacagatttgtgcaggacacgtcccaggcgtcagcgcgctgaatctcctgtcgctcctcagatctagcgagggtccttctctggaagacctctag

SEQ ID NO: 50869 - DNA, 663 bp, Artificial Sequence
  Description of Artificial Sequence: Synthetic coding sequence
atgaacgtgttccgcattctcggcgacttgtctcatcttctcgctatgattctcctgctcggtaagatttggaggtcaaagtgctgcaaagggataagtggcaagtcacagattctatttgccctggtcttcaccacccggtacttggatctctttaccaatttcatcagcatttacaacaccgtcatgaaagtcgtttttctgctctgcgcctatgtaaccgtttatatgatttatgggaagttcaggaaaacattcgattccgagaatgatacttttagactggaatttctgctagttcccgtgatcggactgtcttttctggaaaactactccttcacactgttagagatcctgtggacattctctatatatctggagagcgtggccattctgccccagttatttatgatctccaagacaggagaagctgaaactatcactactcactatcttttctttctcggcctgtatagggctctctacctcgctaattggatccgcaggtatcagacggaaaatttctatgaccaaatcgctgtcgtgtcaggcgtggtccagaccatattctattgtgactttttttatttatacgtgacgaaggggagatcttgggatgattctaacgctgatacagggttgcgcagctacagcagcatttag

SEQ ID NO: 50870 - DNA, 2334 bp, Artificial Sequence
  Description of Artificial Sequence: Synthetic coding sequence
atgtttccacggggagccgaagctcaggattggcacctggatatgcaactgaccggaaaggtggtgcttagtgctgcagcgctcctgctggtgaccgtggcctacagactatataaaagccggcctgctccagcccaacgatgggggggaaacggacaagccgaggccaaagaggaggccgagggttcagggcagcctgctgtccaggaggcctcacctggcgtactcctgcgcggaccaaggcgtagaagatctagcaagcgggctgaggcccctcagggctgctcatgtgagaatcctagaggaccctatgtcttggtgaccggggcaacctccaccgacagaaagccccagaggaaaggctccggtgaagagcggggagggcagggctctgactctgagcaggttcccccatgttgcccgtctcaagaaacccgcaccgcagtgggcagcaatccagatcctccgcactttcctcggcttggctccgagcctaaatcatccccagccggtctaatagccgctgctgatggctcatgcgctgggggagagccctccccttggcaggacagcaagccccgtgagcatcccggtttaggccagcttgagcctcctcactgtcactatgtggcacctctgcagggatctagcgacatgaatcagtcgtgggtatttaccagagttatcggcgtttccagggaggaggcaggagccctcgaagctgcatccgatgtcgatttgactcttcatcaacaggaaggtgctcccaattccagctatacattctccagtatcgcaagagtcaggatggaggaacatttcatccaaaaagccgaaggagtggagcctagactgaaaggaaaggtttacgattattatgtcgagtcgaccagccaggctattttccagggtcggctggcccctcggactgctgccttaactgaggttccctctcctcggcctccccctggttctctgggaacaggggctgcgtccggtgggcaggccggtgatacaaagggagcggcagagcgagcggcttcgccgcagaccggcccatggcccagtactcgtggcttttcccgtaaagaaagtttacttcagatcgctgagaatcccgaattgcagttacaacccgacggtttcaggctcccagccccaccgtgccctgaccccggtgcactgcctggcctaggtcgaagctcaagggagccacatgtgcagcccgtggctggaacaaacttctttcacatccccctcacgccagccagcgctccccaggtccggctcgatctgggcaattgttatgaggtgctcacccttgcaaagcgacagaacttggaggcacttaaggaggcagcttataaggttatgtcagagaactacctccaggttctgcgaagtcccgacatctatgggtgcctgtccggagccgaaagagagctgatccttcagagaagactgagaggcaggcaatacttggttgtggccgatgtttgtccaaaggaagatagcggcggactgtgttgttacgatgacgaacaggatgtttggaggcccctggccaggatgccacctgaggcagtttcccgcggttgtgctatctgctctctctttaactatctgtttgtggtgtctggctgccaggggccaggacaccaaccctcgagcagggtgttttgctacaatcctctcacaggaatctggtcagaagtgtgtcctctcaatcaagcccgaccccactgccgcttggtcgctctggatggacatctgtacgccatcggtggtgagtgcctgaattcagtggaacgctacgaccctcggctggatcgctgggattttgctccccctctgcctagcgacacttttgccctggcacacacggcaacagtgcgtgctaaagaaatctttgtcacaggagggtcactgcgctttctacttttccgcttctcagctcaggagcagcgttggtgggcaggcccaacgggaggatccaaggatcggacagcagagatggtagctgtgaacggctttctgtaccgtttcgatctgaataggtccctgggaattgcggtgtatcgctgttctgcctcaacccggctgtggtatgagtgcgcgacctataggaccccctaccccgacgcttttcagtgcgcggttgtggacaacctgatttactgtgtcggccgaaggagtaccctttgctttctggcggatagcgtatcccccagattcgtgccaaaggaacttcgaagcttcccagcgccacagggtacactgctacctacggtcctgacactccctacaccagatctcccccagacaagagtttag

SEQ ID NO: 50871 - DNA, 2088 bp, Artificial Sequence
  Description of Artificial Sequence: Synthetic coding sequence
ggccaaccagctgttcaagaagcgtctccaggggtgctgctgcgcggtccacgcaggcggaggtcaagtaagcgcgctgaagctccacaggggtgtagctgtgagaatcccagaggtccttatgtgctcgtgactggtgctactagtactgacagaaagccacaacgtaaaggatcaggtgaagaacgtggcggacaaggctctgacagcgagcaggtccccccttgctgtccttcacaggagacccgaactgccgtggggtctaaccccgatccccctcactttcctaggttaggctctgaacctaaatcctcaccagcaggacttattgccgcagctgatggctcatgtgctgggggagaaccctccccttggcaggactcgaagccacgcgaacacccaggcctgggtcaactcgaaccaccccactgccactacgtagcaccgttgcaaggctcaagtgacatgaatcagtcttgggtgtttacccgtgtaattggggtgagtcgggaagaggcgggtgctttggaggcagccagtgacgtggacttgacgctgcaccagcaagaaggcgcacctaatagtagttacaccttttccagcatcgcaagagttaggatggaagagcactttattcaaaaggcggaaggtgtggaacccaggctgaaaggtaaggtctacgattactatgttgagtctactagtcaggcaatattccaggggcgactcgcaccacgcacagcagcactcacagaagttcctagtcctcggccaccaccgggaagtctggggaccggtgctgcctctggaggccaggcaggggacaccaaaggagctgcggagcgcgctgcctccccccagaccgggccatggccgtctacaagaggcttcagtaggaaggagtcgctgctccagatcgctgagaatccagagcttcaactgcaaccggatggctttaggcttccagccccaccatgcccagatcccggtgccttgcctggactgggaagaagctctcgcgagcctcacgtccagcccgtggcagggactaatttcttccatatacctctaacgcctgcgtccgcaccacaggtcagattggacctgggaaattgttacgaggtcctgacactcgccaagcgtcaaaacctggaggctctcaaagaagccgcttataaggtgatgtccgaaaattacctgcaggtgcttaggtcgcctgacatctatgggtgcttatcaggggcagaaagggagcttatcctccaaagaaggctcaggggcagacaatacttggtggtagccgatgtttgccctaaagaggattcaggaggattgtgctgctacgacgacgaacaggacgtatggcgccctctggccagaatgcctcctgaggctgtgtcccgcggttgcgccatctgctcgctctttaactatttattcgtcgtgtcggggtgtcaagggccaggtcatcagccaagctcaagagtcttttgttataatcccttgaccggtatctggagcgaggtgtgcccgctgaatcaagcgcgtccacactgtcgtttagtggccctggacggacacctgtacgccataggaggggagtgtttgaactccgtggaacgctacgatccacgactggatcggtgggactttgccccacccctcccgtcagatacatttgccttggcacatacagctactgtcagagccaaagagatcttcgtcaccggagggtccttacgctttctcctgttccgcttcagcgctcaggagcagcgttggtgggcgggacctactggcggaagtaaagaccgtacagccgaaatggtcgctgtcaacggtttcttgtaccgcttcgatctgaaccgcagccttgggattgctgtgtaccggtgcagcgcgtcaacaagactttggtatgagtgtgccacctacaggacaccatacccagacgcattccaatgcgccgttgtcgataatctgatctactgcgttggtaggcgctccacattgtgcttcctggccgattctgtctctccacgggaagccgcaatcgtgccgagctatctcctggtcgaagtgtgctag

SEQ ID NO: 50872 - DNA, 1929 bp, Artificial Sequence
  Description of Artificial Sequence: Synthetic coding sequence
atgcagcccagatcagagagaccggctggcagaacgcagtctccagagcacggatctccgggaccgggtcccgaagctccccctcctccacctccgcaaccccctgcacccgaggccgagcggaccagacctcgacaggctaggccagctgccccaatggagggggctgtgcagttgctatctagagagggacatagtgtcgcccacaactcaaagcggcactatcacgatgcatttgtcgctatgtcccggatgcgccaacgaggactgctctgcgacatagtgctgcatgtcgctgctaaggagattagggcccacaaggtggtgctggcttcatgctctccttacttccacgccatgttcaccaatgagatgagtgaatcaaggcagacacatgtgaccctccatgatatcgatccacaggctctcgaccagctggtgcaatttgcctatactgcagaaattgtggtaggtgagggtaacgtgcagactttacttcccgcagctagtctcttacaactgaatggcgtgagggatgcttgctgtaaattcctgctgtcacagctggatccttccaattgcttaggaattagaggattcgcagatgcacacagctgctccgatctcctgaaagcggctcaccggtacgttctacagcacttcgttgacgtggcaaagactgaagagtttatgctgctgcctcttaagcaagtattggagctcgtgagctctgactccctgaacgtgccctcagaggaagaagtctatagagctgttctgagctgggtcaagcacgatgtggatgcccgacggcagcacgttcctagactaatgaaatgtgtgcggctcccccttctttcgagagactttctcttagggcacgtggacgccgagtcattggtacgccaccaccccgattgcaaggaccttctcatcgaagctctcaagtttcacctactcccagaacaacgaggagtgctgggtacttcgcgtacacgtcccagaagatgtgaaggagccggaccagtcctattcgcagttggagggggatcactgtttgcaatccacggtgactgcgaagcatatgatactcgcacggacagatggcacgttgtagcatcgatgtcgaccagaagggctcgagtgggtgttgctgccgtcgggaaccgactctacgcagtgggagggtacgatggaacttccgacctcgcgacagtggagtcctatgaccctgtgacgaacacatggcaacccgaggtgagcatgggcacgcggagaagctgtctgggggtcgccgctttgcacggtctcctctactcagctggcggatacgatggcgcttcatgcctaaattcagctgagaggtatgacccgctgacgggcacctggaccagcgtcgcagcaatgagtacccgtcggagatacgtgcgggtcgccaccctcgatggaaacctctacgcagtggggggatatgactcctcttctcatttggccacagtggaaaaatatgagcctcaggtgaatgtttggtcccctgtggctagcatgttatcgagacgctccagcgctggggtggccgtcttggagggtgccctctacgttgcgggaggcaatgacggaacgtcatgcctaaattctgtggaacgatactcaccgaaggcgggtgcttgggagtctgtggcccctatgaatatcagacggagtacacacgaccttgtcgcaatggatgggtggctgtacgccgtaggcggtaacgatggttcaagctctctgaacagcatcgagaagtacaaccctcggactaataaatgggtcgctgcatcatgcatgttcacacgtagaagttctgtcggagtggccgtgctcgagcttttaaatttcccgcctcctagttcgcccacattatccgtgtcttcgacctctttatag

SEQ ID NO: 50873 - DNA, 1557 bp, Artificial Sequence
  Description of Artificial Sequence: Synthetic coding sequence
atgagcgaaagtaggcagacacatgtcactcttcatgacatcgacccccaggccttggaccagcttgtccagtttgcttatactgctgagatcgttgtaggagagggaaacgttcagacactgctgcctgccgcttccctgctccagctgaacggtgttcgtgacgcatgttgcaaattcctacttagccagctcgacccaagcaattgtcttggaatcagagggttcgccgacgctcacagttgctccgatctgctgaaggctgcccacaggtacgttttgcagcacttcgtggatgtcgcgaagactgaggaatttatgttactccctctaaagcaggtgctggagctggtgtctagcgatagccttaatgtgccaagcgaagaagaggtgtacagggcagtcctatcttgggtcaagcacgatgttgacgcgaggcggcagcacgtacccagactgatgaaatgtgtgcgactcccgctcctgagcagggacttcctcctgggccatgtggacgccgagagcttagtgagacaccatccagactgcaaggatcttctcattgaggcactaaagttccaccttctgcctgaacagcggggagtcttaggaactagcaggactagacccagacgctgtgagggagcgggaccagtccttttcgccgtcggtggaggatcactatttgctattcacggggactgcgaagcttatgacaccagaaccgatcgatggcatgtggtggccagtatgtcgacgagaagggctagagtgggggtcgcagccgtgggcaaccggctctatgctgtgggcggatacgatggcacctccgacttggccaccgtggagagctacgaccccgtgactaatacctggcagcccgaggtgagtatgggtacccgcaggtcttgcctcggcgttgccgctcttcatgggctcctgtactcagctggaggatacgacggcgcatcatgtctgaactcagccgaacggtacgatcccctcacagggacgtggacaagtgtcgcggctatgtccactcggagaaggtatgtgagggtagcaacactcgatggcaatctgtatgctgtgggcggatacgattccagctcccaccttgcgaccgtggagaaatacgagccccaggtgaatgtatggagccccgtggcatccatgctgagccgccgttcatccgccggtgttgccgtcctggagggtgctctctacgttgccggtggcaatgacggtacgtcctgtctaaacagtgttgagagatactcccctaaggcaggagcatgggagagcgtggctccgatgaacataagaagatctacacacgacctggtggcaatggacggctggctgtacgctgtgggcggaaacgacggcagtagttctttaaatagcattgagaagtataaccctaggactaacaaatgggtagctgccagttgcatgtttacccgtaggtcgtccgttggcgtcgccgtgcttgaattgctgaattttccaccaccttcaagcccgacgttgagtgtttcttccacctcgctgtag

SEQ ID NO: 50874 - DNA, 678 bp, Artificial Sequence
  Description of Artificial Sequence: Synthetic coding sequence
atgaaatgcgtgcggctgcctctgttgagcagagactttttgctgggccacgtggatgccgaaagcctggtgcgccaccatccagactgcaaagacctgttgatcgaggcactcaaattccatttgctgcctgagcagcgtggcgtgttgggaacgagccgtacacggcctaggcggtgcgagggtgctggcccagtccttttcgctgtggggggaggctccctgtttgcaatccacggggactgtgaagcctacgacacgaggaccgacaggtggcatgtggtggccagcatgtccacacgtcgggctcgcgtgggagttgcggcagtggggaacaggctgtacgctgtgggcggatacgacggcacttctgatcttgctacggtcgaatcctatgaccccgtgacaaacacatggcagccagaagtgtctatggggacaaggagatcctgcctgggtgtagccgctctgcatggccttctatatagtgccggaggctacgacggcgcatcgtgtctgaacagcgcagaacgctatgaccctctgacgggaacctggacctccgtggccgcaatgtccacaaggcgtagatacgttcgggtcgccacccttgacggcaacctgtatgcagtcggaggatatgacagctcttcccacttagctacggtggaaaagtag

SEQ ID NO: 50875 - DNA, 489 bp, Artificial Sequence
  Description of Artificial Sequence: Synthetic coding sequence
atgcgcatcgctaaccggacacggttttcaagccccttcctggcgagaggggcagggtggacacacggcaggggtatgatggtagtgggcactgggactagcttggctctgtcatccctattgagcctgctgttgttcgccggaatgcaaatgtactcaagacagctagcatcaacagagtggctcacgattcagggcggactcctgggtagcggtctgttcgtcttcagtctgacagccttcaataacctcgagaaccttgtgttcggaaagggcttccaagctaagatcttccctgagatcctgctgtgtttactgctggcactgtttgccagcgggttaattcacagggtctgtgtaacgacatgtttcattttctcgatggtgggcttgtactatatcaacaaaatttcttctactctgtatcaagccgctgctcccgtactcacccctgcgaaggttaccggaaagagtaagaaacgcaactag

SEQ ID NO: 50876 - DNA, 723 bp, Artificial Sequence
  Description of Artificial Sequence: Synthetic coding sequence
atgagaagatgttccctgtgtgcttttgacgcagcaagagggccaaggcggcttatgcgagtaggtctggccctgattcttgtgggccacgtgaacctgcttcttggagcagtgctgcatggtaccgttctgagacacgtggctaacccacgcggagccgtcaccccagaatataccgtagccaacgtaatttccgtgggatccggattgctctcggttagtgtgggcctggtcgccctgttggcctcccggaatctgctccggcctccgctccactgggtactccttgcattagccctggtcaacctgctgctgtcggtagcctgcagcctgggattactactcgccgtgtccttaaccgtggcgaacggtgggaggaggctcatcgctgactgccacccgggtctcctcgaccccctggttcccttggatgagggaccagggcatacagactgtcccttcgaccccacacgcatctacgatacagccctagctctgtggatcccaagtctccttatgagcgcgggagaagcagcattatccggatattgttgtgtggccgcactgaccttacgcggagtcggcccatgccggaaagatggcctgcagggccagcttgaagaaatgaccgagctggagtccccgaagtgtaagcgacaggaaaatgagcaactgctggaccagaaccaggagattcgcgcatctcaacggagctgggtgtag

SEQ ID NO: 50877 - DNA, 669 bp, Artificial Sequence
  Description of Artificial Sequence: Synthetic coding sequence
atgagggttggactggcgctgattctcgtgggccacgtgaaccttcttctgggcgctgtcctccatggtaccgtactgcgacatgtggccaaccccaggggagcagtcacacctgagtacacagtggctaatgtcatcagtgtgggctccgggttgctgtccgtgagcgtcggattggtcgcactgctggcttccagaaaccttctgcgtccaccacttcattgggtgcttctagcccttgctctagtgaatctgctgctttcagtggcttgtagtctgggtctgttgctggcagtaagccttacggtagctaacggcggtcgcagactcatagcagactgtcaccctgggctccttgaccctctcgtgcctcttgacgagggccctggccacaccgattgccccttcgaccctacaaggatctacgacacagctctcgccttatggatcccgagcctgctgatgagcgcaggtgaagccgctctatctggttattgttgcgttgccgcattgactctgcgaggcgtggggccttgtagaaaagacgggctgcagggtcagctcgaggagatgacagaactcgaaagtcccaagtgcaagagacaggaaaacgaacagttgctcgaccagaatcaggaaatcagagcatctcagcgatcctgggtatag

SEQ ID NO: 50878 - DNA, 189 bp, Artificial Sequence
  Description of Artificial Sequence: Synthetic coding sequence
gccctttccgggtattgttgcgttgccgctctgacattacgcggagtcggaccgtgccgcaaggatggtctccagggccagctggaggaaatgactgaacttgagagccctaagtgcaaaaggcaggaaaatgagcagctgctggaccagaatcaggagattcgagcctcgcagcggtcctgggtctag

SEQ ID NO: 50879 - DNA, 723 bp, Artificial Sequence
  Description of Artificial Sequence: Synthetic coding sequence
atgaggaggtgcagcttgtgtgcctttgacgctgctcggggtccacgtaggttgatgcgggtgggcctcgccctgatccttgtaggacatgtcaatctcttgttgggagccgtactgcatgggactgtcctccgccacgtggccaacccccgtggcgcagtgacaccagagtacacagtagccaatgtgattagtgtgggttcggggctcctgagtgtttcagtgggtctggtggccctgctggcctcgcgcaatctgctccgacctcccctccattgggtgcttctggcgctcgcattggtcaacctcctgctctctgttgcttgcagtctaggtttgttgctggccgtatcactgaccgtggccaatgggggaaggcggctcattgcagactgtcatcccggactcctggatcctctggtgcctctcgacgaaggccctggacacactgattgcccattcgaccctacaagaatttatgacacggcacttgcattgtggatcccatccctcctgatgagtgctggcgaggccgctctgagcggctactgttgtgtggctgcgcttacgctgagaggcgttgggccatgtagaaaagacggtctgcaaggccagcttgaagagatgacagagctggaatcacccaagtgcaaacgacaggaaaatgagcagttgctcgatcagaaccaagaaattcgagcgtcccagcgatcatgggtgtag

SEQ ID NO: 50880 - DNA, 2982 bp, Artificial Sequence
  Description of Artificial Sequence: Synthetic coding sequence
atggctgctgaatgggcttctcgattctggctctgggctaccctcttgatccccgcagccgctgtgtacgaagatcaggtcggaaaattcgattggcggcagcagtatgtggggaaggtgaaatttgcctccctagagttctcacctggctcaaagaaactggtggttgcaacagagaagaatgtcattgcagctttaaacagccgaacgggtgaaatcctgtggaggcacgttgacaagggcacagcagagggggctgttgatgcaatgttacttcatggccaagatgtgatcacagtcagtaacgggggtcgtattatgcgaagttgggagactaacataggcggactgaattgggaaattaccttggatagcggctcttttcaggctctcggcctggtgggcttgcaggaatccgtacgatacattgccgtgctaaaaaaaactacattagcccttcatcacctgtcgtctggccacttaaaatgggttgagcatcttccggagtcggattccatccactatcagatggtgtactcatatggatccggggtcgtctgggccctgggcgtagtgcccttctctcacgtaaatatcgtaaagttcaatgtagaagacggggaaatagtgcagcaagtgcgcgtgtctactccatggctccagcacctttccggcgcttgcggcgtggttgacgaagctgtactggtgtgcccagacccttcctccagatcactgcagacactggctcttgagacagagtgggaactccgccagatcccattacagagcctggatctggagtttggaagcggcttccaaccgagggttctccccacccaacccaatccggtggatgcgtccagagcgcagttctttctgcatctttccccctcccactacgcccttctgcagtaccattacggaaccctaagtcttctgaaaaactttcctcaaacagccctggtctcctttgctacaactggagagaagaccgtagcagccgtgatggcatgcaggaatgaggtacagaagtccagctcatctgaggacgggtcaatggggtccttcagcgaaaagtctagctccaaagactcgctggcttgcttcaatcaaacttatactatcaacctatatctcgttgagaccggaaggaggctccttgatacgacaattacgttctctctggagcagagtggcactcgccctgagcgcttgtacatccaggtgttcctgaagaaggatgattccgtgggatatagagctctggtgcagaccgaggaccaccttcttttgtttcttcagcaattggcgggaaaggtcgtgctgtggtcccgcgaagaaagcctggcagaggtggtatgcctggagatggtcgacctgcctctgaccggagcgcaggccgaactggagggagaatttgggaagaaggccgacggtctcctcggcatgtttctgaagcgcctgtcttcacagcttatccttctgcaggcatggacgtcccatctttggaaaatgttttacgacgcacgaaagcctcgctctcagatcaagaatgaaattaacattgataccctggctcgcgatgaattcaatctgcagaagatgatggtgatggtgacagcaagcggaaaactgtttgggatcgagtcatcctctggcaccatcttatggaagcagtatctgcctaatgtgaagccagattcctcattcaagctgatggttcagaggacaacggcacactttccgcaccccccacagtgtaccctgctcgtgaaggacaaggagtccggaatgagtagtctttatgtctttaaccccatcttcggaaagtggagccaggtcgctccaccagtcttgaagcggccaatcctgcaatccctcttgctgccagtgatggatcaggattacgctaaggtgctccttctcatagatgatgaatacaaagtcacagctttcccagccacccgtaacgtattgcgacaattacacgagctggctcccagtatatttttctacctggtggatgccgagcaggggaggctgtgtggataccggctgcgcaaggatctgactaccgagctgtcatgggagcttacgattccccctgaagtccagagaattgttaaggtgaaagggaagagatcttcggaacatgttcattctcaagggagggtcatgggagaccgcagtgtgttgtataagtcattaaacccaaatctgctggctgtcgtaacggagagcacagatgcccaccatgagcgaacatttattgggatctttctgattgacggcgtgacggggaggattatccacagcagcgtgcagaagaaggccaagggccctgtgcacattgtccatagcgagaattgggttgtgtaccagtactggaacacaaaggccagacggaatgagttcactgttctcgagctgtatgagggcacagaacagtataacgcaactgccttcagctctctagaccgtcctcaactcccacaggtgcttcagcagtcatacatcttcccctcttccattagcgcaatggaggctacaattacagaacgcggaatcaccagtcggcatttactaattgggctgcctagcggagctattctgagcctgcccaaagctctactggaccctagacgtccagagatccctactgaacagagtcgggaggaaaatcttataccatacagccctgacgtgcagatccatgccgagcggttcatcaactacaatcaaacagtctcgaggatgcgaggcatatacaccgccccttctggcctagagagcacatgcctggtggtagcctacggcttggacatatatcagacaagggtttacccctcaaagcagttcgacgtgcttaaggatgactatgactacgtgctcatctcttcggtgttgttcgggttggtgttcgccactatgatcacaaaaaggttagcccaggtcaagttgcttaaccgggcttggcggtag

SEQ ID NO: 50881 - DNA, 4071 bp, Artificial Sequence
  Description of Artificial Sequence: Synthetic coding sequence
atggatctcaaagaaaagcatctaggggagccgccttctgcactgggtctctccactcggaaggctttgtccgtccttaaggaacagcttgaagccgtgctggaaggccacttacgggagagaaaaaagtgtttgacttggaaagaggtgtggaggtcgagcttcttacaccatagtaatagatgttcatgtttccattggcccggtgcttccctaatgctcctggccgtcctgctgctacttggctgctgcgggggacagcccgcaggaagcaggggagttggactagtcaatgcctccgccctctttctcctgctattgctaaatctagtgctgataggacgacaggaccggctgaagcgacgggaagtcgaaaggaggctccggggtatcattgaccagattcaagacgccctgcgggacggcagagaaatccagtggccctcagcaatgtaccctgaccttcatatgccatttgcgccaagttggagccttcactgggcttatagagatggtcacctggtgaatctgccagtgtccctgttggtggagggagacatcatcgccctgaggcccggacaggaatccttcgccagcctccggggaatcaaagacgatgagcacatcgtcctggagcccggagacttgttccccccattcagcccccctccttcaccacgtggggaagtggagcgaggcccacagtcacctcaacagcatcggctattcagggttttagaaactccggtgattgataatatccgctggtgcttggatatggctttaagccgtcctgttactgcactggataatgagaggttcacagtgcagagtgtgatgctccattatgcagtccctgtggtcctggcaggcttccttataacgaatgcactccggttcatttttagcgcccctggcgtcacatcctggcagtatacattgcttcagctgcaagtgaacggcgtgctcccaattctccctttgttgtttcccgtgctgtgggttctggccactgcctgtggtgaggcacgggtgctggcccagatgagcaaggccagccctagtagtctgttagccaaattcagtgaggataccctgagctcttatactgaagcagtgtcctcacaagaaatgttgaggtgtatctggggacactttcttagagttcttggcggaacaagtccgactctgagccatagttcgtccctgctgcacagccttggaagtgtaactgtgttatgctgcgtggacaagcagggcattctatcatggcctaatccctcaccggagaccgtgctgtttttctctggcaaagtcgagcccccacattcttcacacgaagacctgactgatggactgagcacacgaagcttttgccaccctgagccacacgagcgcgacgcactcttggcaggaagcctgaacaatacgctacatctatcaaacgaacaggagcgcggtgactggccaggggaagcccctaaacctcccgagccttattcccatcacaaagctcacggcagaagcaaacacccaagtggaagtaatgtgagctttagccgcgacacagaggggggtgaggaagaaccctcaaagacccagccaggcatggagtcagatccttatgaagcggaggactttgtttgtgactaccaccttgagatgctatctcttagccaggaccagcagaatccaagttgtatccagttcgacgactctaactggcagctccacttgacgtccttgaagcctcttggcttaaacgttcttctgaatctgtgtgatgcttcagtgaccgaacggctgtgccgcttttcggaccatctgtgcaacattgctcttcaggagagccacagtgctgtgctccccgtgcatgttccatggggcctctgcgagttggcccgactcattggtttcactcctggggctaaagaattgtttaagcaggagaaccatctcgccctgtatcgtctgccaagcgctgagacgatgaaggagaccagccttgggagactgagctgcgtgaccaagagacgccctccactgagtcacatgatatcactattcatcaaggataccaccacaagtacagagcagatgttgagtcatggaacggctgacgtagtgctcgaagcttgcaccgacttctgggatggtgccgacatttacccactgagtggtagtgacagaaagaaggtgttggacttctaccaaagggcctgtctttcaggctattgttccgcattcgcttacaaaccgatgaattgcgctctcagcagccagcttaacggaaaatgtatagagttggtacaggtccccggtcagtccagtatctttaccatgtgcgaactgccatccaccattccaatcaaacagaacgcgaggcggtcatcttggagctctgatgagggtataggggaagtactggaaaaggaagactgcatgcaggctctttctggccagatcttcatgggtatggtgtcatcccagtatcaggccaggctagacatagtccgcctgatcgacgggctggttaatgcatgcattcggttcgtttacttctcgcttgaggacgaactcaagagcaaggtctttgcggagaagatgggtcttgaaactgggtggaactgtcatatcagccttacgcctaacggagacatgcctgggtctgaaatccctccgtcttcaccctcccatgcaggcagccttcatgatgatcttaaccaggtatcccgcgacgacgctgagggcctcttgttgatggaagaggagggccacagcgacctcattagctttcaaccaacagatagcgacattccatcattcctggaggactccaaccgcgctaaactgcccagaggaattcaccaggtgaggccccaccttcagaatatcgacaacgtgccgctgctggtgccgttattcaccgattgcactccagagaccatgtgcgaaatgattaagatcatgcaggaatatggagaagtcacttgctgtctagggagctctgctaatctgagaaacagctgtttatttcttcagagtgacattagtatcgctctggatccactgtacccttcaagatgctcatgggagaccttcggctatgctacatccataagcatggcccaggcatccgacgggttaagtccactgcagctatcaggccagcttaactcattaccctgcagtctgacattcagacaggaggagaccattagtataattcggctgattgaacaggcgaggcatgcaacttatgggattaggaagtgctttctcttcctgttgcagtgtcagctcacactcgtggtgatccagttcctaagctgtctggtgcagcttcccccactacttagtaccaccgacatcctgtggctgagctgcttctgctatccgctcctatcaatatcattgctcggcaagccccctcacagcagcataatgtctatggccaccggaaaaaacctccagagcattcctaaaaaaacacagcactattttctgctctgctttctcctcaagttttcgctcacaatctcatcttgtctgatttgtttcggctttacactgcagtcgttctgtgatagttcacgggatcgcaacctcacaaactgtagttccgtgatgcttccgtcgaatgatgatagagcccctgcatggtttgaagatttcgccaatgggctacttagcgcccagaagctgaccgcagctctgattgtgctccataccgtatttataagcattacccacgtgcaccgcaccaagcccctatggaggaagtcacctctgacaaacttgtggtgggccgttacagtacccgtggtcctactaggccaggtggtgcagacggccgtcgacctccagctgtggacacatagagactcccatgtacactttggcttagaggatgtacctctgctgacctggctgctcgggtgtctgtcactggtgcttgtggttgtaactaacgagattgtgaaactgcatgagatcagagttagggtgaggtatcagaaaaggcagaaactgcagtttgaaactaagttgggtatgaattcgccattctag

SEQ ID NO: 50882 - DNA, 912 bp, Artificial Sequence
  Description of Artificial Sequence: Synthetic coding sequence
atgtgccatggtaggattgcccctaagtcaacgagtgtttttgctgtagcttccgtgggtcatggagtattccttccactggtgattttgtgcacgctgcttggcgacggtctcgcgtcagtgtgtccactgccccctgaacctgagaatgggggatacatttgccatccacggccatgccgtgacccactgaccgcgggtagtgtgattgaatacttatgtgcggaaggatacatgctcaagggggattacaagtacctaacctgcaagaacggtgaatggaaacccgctatggaaatctcttgtcgccttaacgaggacaaagatacgcatacatccttgggcgttcccactctgtccattgtggcctccactgcctcatctgtggccctgattctcttacttgttgtgctttttgtgctactgcagcctaagctaaaatcattccaccattccagacgggaccagggtgtgtctggagatcaggtttcaattatggttgacggcgtgcaggtggctctcccaagctatgaagaggcagtgtacgggtcttctgggcattgcgtgccacctgcagacccccgagtacagatcgttctgtccgagggcagcggcccttccgggcgaagcgttcctagagaacagcagctccctgaccagggagcatgctcctccgcaggaggtgaggatgaggcacccggacaatccggtttatgcgaggcctggggaagtagagccagcgagacagtgatggtgcaccaggcaaccacctcatcatgggtggccggttctggtaacagacagctggcccacaaggagacagcagattccgaaaacagcgatatccagagcctgctgagcctgactagcgaggagtatactgatgatatccctcttctgaaagaggcctag

SEQ ID NO: 50883 - DNA, 2472 bp, Artificial Sequence
  Description of Artificial Sequence: Synthetic coding sequence
atgttctacgttattggcggtattaccgtcagcgtggtggcattcttcttcaccatcaagttcctgtttgaactagctgcaagagtggtgagctttttgcagaacgaggaccgggagaggcgaggcgataggacaatctatgactacgtccgcggtaactatctggaccccagaagttgcaaagtgagttgggattggaaagacccctatgaagtgggccacagcatggcttttcgcgtccacttgttctataaaaacggtcagccattccctgcgcatcgcccagtgggtctgcgcgtccatatttcgcacgtggaactggccgtcgagattccagtgacgcaagaagttctgcaggaaccgaacagcaacgttgtgaaggtggcttttaccgtgcggaaagccggacgatacgagatcaccgtgaaactgggagggctgaacgtggcatatagtccttattacaagatctttcaaccaggaatggtggtccctagtaaaactaaaatcgtctgtcacttcagcacactggtgctcacctgcggacagccgcatacgctgcaaatcgtgccccgagacgagtacgataatcccaccaataatagtatgtctctgagagatgagcataactacaccctttctattcacgaattggggccacaggaggaggagtctactggcgtttcattcgaaaagtcggttacttctaaccgacaaacatttcaagtattcctgcgcctgactttgcattcccgcggttgttttcatgcttgcataagctatcagaatcaacccataaacaatggggagttcgacataatcgtcctgagtgaggacgagaaaaacatcgtggagaggaacgtgagtacatcgggcgtttcaatatactttgaagcctacctatataacgctacaaactgtagttccacaccctggcacctgcctcccatgcacatgactagcagccaaagaagaccttctactgcagtcgatgaggaagatgaggatagcccatcagagtgccatacacctgaaaaggtgaaaaaaccaaaaaaagtgtactgctacgtctcacctaagcagttctccgtgaaggaattttatctgaaaatcatcccttggcgtctgtatactttcagagtgtgcccaggtaccaagttttcctacctcggacccgatccagtgcataaactgcttaccctggttgttgacgacgggatccaacctcctgtcgagctcagttgcaaagagcgcaatattctggccgctactttcattcgctcactccacaagaacatcgggggtagcgaaacctttcaggacaaagtaaacttcttccagcgcgagctccgtcaagtgcatatgaagcggcctcacagcaaagtgactctaaaagtgagtcggcacgctctgttggaaagttcactaaaagccacaagaaacttcagcatctctgactggtcaaaaaatttcgaggtggtgtttcaggacgaggaagctttggattggggaggtccgcgacgcgagtggttcgagctcatctgcaaggcactattcgataccacgaatcagctgttcactcgcttctctgataataatcaagccctcgttcaccctaatcctaaccgtcctgctcatcttcgactgaaaatgtacgaattcgccggacgccttgttggcaagtgtctctatgagtcttcgcttggaggggcatacaagcagctagtacgggctcgattcacaagatccttcctcgcccagataatcggacttaggatgcactataagtacttcgagacagatgaccctgagttttataagtcaaaagtttgcttcatcctgaacaacgacatgtccgaaatggagttggttttcgcagaagagaaatataacaaaagcggacagctggacaaggtggtggagctgatgacaggaggggcacaaaccccagtcacgaatgccaacaagatattctatctcaacctgctggcccagtataggttagcatctcaggtcaaggaagaggtggagcacttcttgaaaggtctgaatgaactcgtcccagaaaacctcctggccatatttgacgaaaatgaacttgagctccttatgtgcggcaccggcgatatttcggtttcggatttcaaagcacacgccgtggtcgtgggtggttcctggcatttccgggagaaggttatgcggtggttctggacggtcgtctcctccttgacccaggaggaactagcaaggctgttacagtttactacaggttcttcccaactcccacctggaggtttcgccgctttgtgtcctagcttccagattatagctgcgccaactcactcgacactgcctactgcccatacctgcttcaaccagctttgcttacctacctacgactcatatgaggaggtgcatcggatgttacagttggccatcagcgaagggtgcgagggttttggtatgttatag

SEQ ID NO: 50884 - DNA, 3150 bp, Artificial Sequence
  Description of Artificial Sequence: Synthetic coding sequence
atggagaagcggctcggcgttaaaccaaatccagcttcctggattctgagcggttactattggcagaccagtgcgaaatggcttcggagtttgtatctgttttacacctgtttctgcttttccgtgttgtggctaagcaccgatgccagcgaatcccgttgccagcagggcaagacacaatttggagtcggtctccgatcaggaggagagaatcacctttggctcttagaggggacaccctcgttgcagtcttgctgggccgcttgctgccaggattctgcgtgtcacgttttttggtggcttgaagggatgtgcatccaggccgactgcagccgccctcagagttgtcgggcattccgaacccattcatcgaattccatgctagttttcctgaaaaagttccagacagcagacgaccttgggtttctccccgaggacgatgtaccccacctgctcggactcggatggaactgggcttcctggcgacagtctcctcctcgagccgcacttcggcctgctgtgagctcctctgaccagcaaagcctgatacgcaagcttcagaagcgtggcagcccttcggatgttgtgacacccatcgttacccagcattcgaaagtgaatgattcaaacgaactaggcggactgactaccagcgggtcagccgaggtgcacaaagcaattaccatctcctcacccttaaccacagacctgacggctgagctctctgggggtcccaaaaacgtgagtgtacaacctgagatatccgagggtctggccaccaccccctccacgcagcaggtgaaatccagcgagaaaactcagatcgccgtcccacagccggttgctcctagctactcgtacgctactccaacgccgcaggccagcttccaaagtacaagcgccccatatccagtgattaaagagcttgtggttagcgcaggtgagagcgtgcagatcaccctccccaagaacgaagtgcagctgaacgcgtacgttctgcaggaacctcctaaaggggagacttacacatatgactggcagttgatcacgcaccccagagattattccggagagatggaagggaagcactctcagatcctgaagttgtctaagctgacaccaggattgtatgagtttaaggtgattgttgaggggcagaatgcccatggcgagggatacgtgaacgtgacagtcaagcccgaacctaggaaaaaccgacccccaatcgcgatcgtatctccacagtttcaggaaatcagcttacctactactagcactgttattgatgggagccaatccacagatgacgacaaaattgtgcagtaccattgggaagagctgaaagggcctctgcgcgaggaaaagatcagcgaggataccgcaatcctcaaactgtccaagctggtgcccggaaactacacattttcgcttactgtggtggattccgacggtgccaccaatagcaccaccgcgaacttaaccgtgaataaggctgtcgattatcccccagtagccaacgctgggccaaaccaggtgattacgctcccacagaactccattaccctcttcggaaaccagtccaccgatgaccatggaattacctcttatgaatggtctctgtccccctcctcgaaaggcaaagtggtcgaaatgcaaggcgtcaggacaccgactcttcaactgtcagcaatgcaggagggcgattatacctaccagctgactgtgaccgacaccatcggccaacaagctaccgcccaggtcacggtgattgtccagcctgagaacaacaagcctccacaggccgacgccggtcccgacaaggaactgaccctgcccgtggatagtacgactctggacggttccaagtcaagcgacgatcagaagataatctcctatctgtgggagaagactcagggtcccgatggcgtccaactagagaatgccaatagtagtgtagccactgtgaccggactgcaggtcggcacctatgttttcacgttgacagtcaaggatgaaaggaatcttcaatcccagagttccgtgaacgttatcgtcaaagaagaaatcaacaaacctcccatcgccaagattacaggaaacgtggttattaccttgcctacaagcactgctgagcttgatggctctaagtcaagcgatgacaaggggatagtgtcgtatctatggactcgtgacgaggggtctcctgcagcaggggaggtgcttaatcatagcgatcaccaccccatcctgttcctctccaatttggtggaaggcacctatactttccacctgaaggtcactgacgctaagggggagtctgacaccgaccgcactacagtggaagtcaagcccgaccccaggaagaacaatcttgtcgagattattctcgacataaatgtgtcccaattgactgaacggctgaaaggtatgtttattcggcagatcggtgtgctgctcggcgtgcttgattctgatatcatcgttcaaaaaattcagccttacacagaacagtccacaaagatggtgttcttcgtgcagaacgagccaccacaccagattttcaagggccatgaggtggccgcaatgctgaaatcagagctgcggaaacaaaaggccgacttcctgatctttagagctctcgaagttaatacagtgacctgccagcttaattgttctgatcacggtcattgcgacagcttcaccaagcggtgcatttgcgatcctttttggatggaaaattttatcaaagtgcagttgcgcgacggggactccaattgtgagtggtctgtgctgtatgtaattattgccaccttcgtcatagttgttgccctcggcatcttatcttggacagtgatatgttgctgtaagcggcagaaggggaaaccaaaacggaagtctaagtataagatcttggacgctaccgaccaggaatccctggagctaaagcccacttcgcgggctgggatcaagcagaagggactgcttctctcctcctccttgatgcactctgaaagtgaactcgacagcgatgatgccatctttacctggcccgacagagagaagggcaagctgcttcacgggcagaacggatctgttccgaatggccagacccccctgaaggcgcgatccccacgtgaggagatcctttag

SEQ ID NO: 50885 - DNA, 4830 bp, Artificial Sequence
  Description of Artificial Sequence: Synthetic coding sequence
atggcaggcctgaggcggcctcagcccggttgttattgtagaactgcggctgccgtaaatcttttgcttggcgtgtttcaggtgttattgccttgctgtcggccaggcggtgcacagggtcaggccatcgaaccattacctaatgtagtcgagttatggcaggccgaggagggggagcttttactccccacacagggagattccgaggaagggctcgaagagccgtcgcaggagcaatctttttccgacaagctattctctgggaagggacttcacttccagcctagcgttcttgactttgggatacagtttttgggccacccagtcgccaagattcttcatgcctataaccctagtagagattctgaagtcgttgtcaactcggtttttgccgctgccggtcatttccatgtaccacccgtgccatgtagggtgatcccagctatggggaagacctcattccgcatcatttttctaccaaccgaggagggcagtattgaaagctcattgtttattaatacctctagctacggggtcctcagctaccacgtttccggcatcgggaccaggcgtatttccacagaaggcagcgcaaagcagctgcctaacgcttacttcctcttaccgaaagtgcagagcatacagttgagtcaaatgcaggctgagacaaccaacacatccctgctgcaggttcagcttgaatgtagtctccacaacaaggtgtgccagcaacttaaaggctgctatctggagtccgatgacgtgctgcgcctgcagatgagcattatggtcaccatggagaatttttctaaggagttcgaggagaacacacaacacttgctagatcatttgagcattgtatacgtcgcaactgatgaatctgaaacatctgacgactctgctgttaacatgtacattttgcattctggtaattccctcatctggatccaggatattagacattttagccagagggatgcgttgtcgctccagtttgagcctgttctgctgccaacatccacgacgaacttcacaaagattgccagcttcacctgtaaggctacaagctgcgacagcggtataatcgaagatgtcaaaaagacgacccacactcccacccttaaggcatgcttgttctcgtcagttgctcaggggtacttccggatggacagctcagctactcaatttcatattgaaactcacgaaaacacatccggcctatggtcaatttggtatcgaaatcacttcgaccggagcgttgtcttgaacgacgttttcctgtctaaagagacgaagcacatgctcaagattctcaatttcactggacctctgtttctgcctcctgggtgttggaacatcttctcgctcaagctggccgtcaaggacatcgcaatcaacctgttcaccaatgtcttccttaccacaaacattggggcaatatttgccattcccttacaaatctatagcgccccaacgaaagaagggtctctgggctttgaggttatagcccactgcgggatgcactacttcatgggtaagtccaaagccggaaaccccaattggaatgggtctctatcactggatcaatctacatggaatgtggattcagagctggcgaataaactgtatgagcgatggaagaagtacaaaaacggcgacgtgtgcaaaagaaacgtcctgggaacaacccgattcgcccacctgaagaagtctaaggagagtgagagtttcgtgttttttctgcctagactgatcgctgaaccagggctcatgctgaacttctccgccacagccctcaggtctaggatgatcaaatatttcgttgttcagaacccctcaagttggcctgtgagtctgcaattgctgccactgagcctgtaccccaagccggaagcactggtacatctccttcaccgttggttcgggaccgacatgcaaatgattaatttcacaaccggcgagttccagcttacagaggcgtgcccctatctgggcacccatagtgaagaatcaaggtttggtattctccatctgcaccttcaacccctggagatgaaacgcgtcggtgtagtattcacacctgcagattatggtaaggtgactagcctcatcctcatccggaacaacttgacagtaatcgacatgatcggggtcgagggttttggcgctcgggagctgctgaaggtgggcggaagactgccaggcgctggcggttccctgcggtttaaggtacccgaatctaccctcatggactgccgcagacagctgaaagactccaaacagatcttgagtataacaaagaattttaaagtggagaatatcgggccactcccgatcacagtctcgtccctgaagattaacggttacaactgccaggggtatgggttcgaagtcttggattgccatcagtttagcttggatccaaacacttcccgggatatcagcattgtgtttacgccagacttcaccagttcatgggttattcgcgacctcagtttggttactgccgctgacctggagtttcggttcacattaaacgtcacattgccacaccaccttctgccactctgcgcagacgttgtgcctggaccttcgtgggaggaatccttctggcgcctgacggtgttctttgtgtcgctgagtctcctgggagtcatcctcatcgcctttcaacaagcgcaatacatacttatggagttcatgaagactaggcaaaggcagaacgccagttcgtctagtcagcaaaataatggccctatggacgtgattagcccacactcgtacaagtccaactgtaaaaatttcctggatacatatggtccatcagataaaggccgaggcaaaaactgcttgcccgtgaatactcctcagtcccgcatccagaacgcggcaaaaaggtctcctgctacatacggccatagtcagaagaagcataagtgttccgtatactattcgaaacataagacctcaaccgccgcagcctcttcgacaagtactaccaccgaggagaaacagacctccccactgggaagtagtttacctgcggcaaaggaggacatctgcacagacgccatgcgggagaactggattagcctacggtatgcaagcggaatcaatgtaaacctgcagaaaaacctgaccctgccaaagaacctgctgaataaggaggaaaacaccctcaagaataccatagtgttttctaatccctcttccgaatgttccatgaaggagggcatacagacttgcatgttcccgaaggagactgatattaaaacaagcgaaaacactgccgaatttaaggagagagagctttgtcctttaaagacttcaaaaaaactgcctgagaatcacttgccaaggaatagcccccagtaccatcagcctgatctccccgaaatttctcggaaaaacaacggtaacaaccaacaggttccggtgaagaacgaggtggaccattgcgagaacctgaagaaggtagacacgaagcctagttcggagaaaaagattcataagactagccgggaggatatgttcagcgagaagcaggacatccctttcgtagagcaggaagacccatacagaaaaaaaaaattacaggagaagagggaaggtaatctacagaacctcaattggtctaagtctcggacctgtcgcaaaaacaagaagcggggagttgcacccgttagcaggccacctgaacagtcggatctgaagctggtgtgttctgactttgaaagatcggagctgtcaagcgatatcaatgtgagatcctggtgcatccaggagagtactagggaggtgtgtaaagccgatgctgaaattgccagctctctcccagccgctcagcgggaggctgaggggtattatcaaaaacctgagaaaaaatgtgtcgacaaattttgttccgacagttccagtgattgcgggtcctcttccggaagcgtgagggctagccggggtagctggggatcctggtctagtaccagctccagcgacggcgacaagaagcccatggtggatgcccaacatttcttgcccgctggagacagcgtatcccaaaacgatttcccctcagaggcccctatttcactcaacctctcccacaatatttgcaacccaatgacagtgaactccctaccacagtacgccgaacccagctgcccttctctcccagcaggtcctactggagtggaagaggacaagggcctttattcacccggagatctttggcccacacctccggtttgtgtgacaagctctttgaattgcacacttgaaaacggcgtaccatgcgttatacaggaatcagccccagtccataatagttttattgactggagcgctacatgtgagggccagttctcctctgcgtactgtcccttagagctgaacgactacaacgcttttcccgaggagaacatgaactacgcaaacgggttcccttgccctgcagatgtgcaaactgatttcatagatcataattcccaatctacctggaatactccccctaatatgcctgctgcctggggtcacgccagctttatatcctcccccccttacctgacctctactcggtcattgtcccccatgagcggcctgtttggaagtatttgggcaccgcagagcgacgtctatgagaactgctgcccgatcaacccgactacagaacacagtactcatatggaaaatcaggcagtggtgtgcaaggaatactaccccggattcaatccatttagagcatacatgaatctagatatatggactacgacagctaatcgtaatgccaacttcccccttagccgggatagcagttactgtggtaacgtttag

SEQ ID NO: 50886 - DNA, 4212 bp, Artificial Sequence
  Description of Artificial Sequence: Synthetic coding sequence
atggccaactgttcacaggaagagctcgacgaggaatttgagcagtttatgaaagagctgtctgatgattcctttgaaaactccgataagaccgctaggcagagtaaaaaagagatgaaaaagaaagatactgtgccatggtggatcacagaggacgactttaaggatgatggcttgctgggcacaaatgtgagctatcttaaaacaaaaaaaacctcgcaaccagtgatggaaattgaagaagaatccgccgagaagattcagttccttaaaagtagcggcactagtttactgtctacagacagcttggaaaccaacgaacttgttgtgtctgaactcaatcacagtagcttgggggtaggcctggacacgctagaagaacaagaagagaaggagcagtttttcgcacgattggagaaaggcttgacatcatcgatcgactacagccgccttaacaaggagcttgactccaacgatagtacccacttcaaggccttgcattcgaatcaggctaatgctgagctcaccgatgacgagcatgaaaatgaatccaagcacgaggaactcgccgagaattattctgacgacttcgaggacgagtatgtgggggcaccactgacaacgaaagacgaggagatgccctcaaaggagaattcgaagtccgagaagatatccgtccccaagcaggaggaggaaaagaccggaatgctcgccaatgtggtcctgctcgattctcttgacagcgtcgcagaagtgaacctcgacgagcaggacaagattactcccaagccaagatgcctgccagaaatgaccgagaacgagatgacgggcacaggagttagctacggtcagtcctcctcagacgttgaagctcttcaccaggcttattgtcacattgcacactcacttggcgacgaagataaacagaaaattgagagcaacaccgtggaggacatcaaaagcagtgtgaaagggcaccctcaggaaaacgaggagaattctaaaaacatttccaccatggaatctgacctgcctacggttgaggaactaatgaagcctatccggattgattcctttgggattagcggcttcgaccttcagccagtgagctctgagaaagtggctgagcgaaaagagacagaatttttcagttcgctgcccctcaagatgaacccaaatattctgtcacaagattctcagcatgtcaacctattcttcgacaagaatgacgaaaacgtgatactgcaaaagaccacaaacgagtcaatggaaaactcctgccctcaagtcaccgaggttaccgctacggaagagcacgttgataagatgtaccttaacatcctgcggaagaagattaccgtcaattcctccagtctcagtcaggacgataagatcaacaaaacctataggagccagttaagcagtgaagaggagggtgctgttatggggaaacaggtgccatacaaaaaggcacgatccgccccaccattgctgaaaaggaagccccagagtggactgtatgccagcgttagaagctctgggtacggaaagccatcctcacctctgaaaatgttttcgacactagagaagaagacatctgaggacatcattaagagcaaaaatctgagatcaatctctactagcaaccaaccccgtaagaaggagatcctgagtgggacgaagttgattaagccagcagccctggacaagccagcccacaaaaccgaaagctgtctgtcgacccgaaagaagagcgaaaatcccaccgagacagattcgtgcattcaattccagactgattcactgggctattgcggggagaataaagagaaaaagctgctgatgtttaagcgcgtgcaggaggccgaagataaatggagaggcgctcaagcattaatcgagcagataaaggcaacattctctgagaaggagaaagagctcgagaataagcttgaagagctgaaaaagcagcaagaaaaagaactgtttaaactaaatcaagacaattatattctccaagccaagttatctagttttgaagaaacaaacaaaaagcagcggtggctgcacttcggcgaggctgccgatcctgtgacaggcgaaaaactgaagcaaattcagaaagaaattcaggaacaggagaccttgctgcagggctaccaacaagagaacgaaagactctacaatcaggtcaaagatctccaggaacaaaacaaaaagaacgaggagagaatgtttaaagagaaccaatccctcttctctgaggtggcttccctgaaagagcaaatgcataagtcaaggttcttgagccaagttgtggaagactcagagcctacgcgcaaccagaattttactgacctgctcgccgaattacgcatggctcagaaggaaaaagattctctgctcgaagacatcaaacggctcaaacaggacaagcaggcactggaggtcgattttgagaagatgaagaaagaacgggatcaggcaaaggatcagatagcatacgtcaccggagaaaagttgtatgagattaagatacttgaggagactcataagcaggagatctctagactgcagaaacgccttcagtggtacgccgaaaaccaggagctgctggataaagatgcactgaggctgcgagaggcaaacgaggaaattgagaaactgaagctcgagatagaaaaactgaaggccgaatctggtaatccttccattagacagaaaatacggctgaaggataaggccgctgacgcaaaaaaaattcaagacctggaacggcaggtcaaggaaatggaaggcatacttaaaaggcggtatcccaactcgctgcccgcattgatcctcgcagcgagcgccgcaggcgatactgtggacaagaataccgtggagttcatggaaaagcggatcaaaaaattagaggcggacctggaggggaaggatgaagatgcgaagaagtctctaagaaccatggagcaacagtttcaaaagatgaaaatccagtacgaacagcgtttagaacagcaggaacagctcctggcttgtaaacttaatcagcacgattcccccaggatcaaggccctagagaaagagttggacgacattaaggaggcccatcagatcacggtgcggaatctagaggcagagattgacgtcctgaaacaccagaacgctgagctggatgttaagaagaatgataaagacgacgaggattttcagtccatagaatttcaggtggagcaggctcatgccaaagccaaactggttcggctgaacgaggagctcgctgccaagaagagagaaattcaggatctctctaaaacagtcgagcgcttgcagaaggacagaagaatgatgttgtctaatcaaaatagtaagggcagagaagagatgtcggccaaacgagccaagaaggatgtcctgcatagttccaaaggcaacgcaaacagctttccagggaccttggactctaagctttaccaacctcacacattcacagactcccacgtgtcagaggtgctccaagaaaattacaggctcaagaacgaactcgaaggcctgatcagcgaaaaaaacgaattaaaaatgaagagtgaagctgtgatgaaccagttcgagaattcaatgcgacgggtcaaagaagacactgctgctcacatcgcttccctgaaggcttcccatcaaagagagattgaaaaactgttgtgccagaacgccgttgaaaactcctctagtaaagtagccgagttaaataggaagattgccacacaggaggtgctgattcggcattttcagtctcaagttaacgagttacagtctaagcaggagtcactggtggtatccgaggtccgggaagagatactacagaaggaaattacaaaactcctcgaggagctccgggaggccaaagagaaccacacgccagaaatgaagcactttgtggggcttgagaagaagattaagcaaatggaaatgaggcacgcccaacgggaacaggagctgcagcaaatcatccagcagacgcaccaggtggtggaaactgagcagaacaaggaggtggagaaatggaagaggttggcccagctgaaaaatagggagctcgaaaagtttcggacagaactagactcaatactggatgttcttcgtgaattgcatcgccagggggtggtggtgccggtagcctttgccgacgaaatgaatgcacctgaatattag

SEQ ID NO: 50887 - DNA, 2751 bp, Artificial Sequence
  Description of Artificial Sequence: Synthetic coding sequence
atggagactagtcaagagacatcactctttctggtgaaaatactggaggaactggactccaaacagaacacagtcagctaccaggacctgtgcaagtccctctgcgctcgctttgacctgagccaacttgctaagctgcggagcgtgctgttctacaccgcctgtcttgaccccaatttccccgcaaccttgttcaaggataaaatgaagtgtacggtgaataaccaacaatccaaaaagatcatggttgccgcagacatcgtgaccatattcaatctgattcagatgaacggcggtgccgcaaaggaaaaactgccaactggcaggcagaaagtcaggaaaaaggaggcgtctttcgaatcctgtcggagtgatacggagatttgtaacgcagccgagtgtgagccgttaaattgtgaattgagtgaacgatcgtttagccggggatatcctatccggcagagttctaagtgtcgcaagatggactgtaaggactgccctcagttcgtacctgcttcagagcccaacttcttgcttggggtgagcaaggaagtcaagaacagggccgcatctctagatcggctccaggctttagccccttacagcgtaacttctccacagccgtgcgagatgcaaagaacatatttcccaatgaatatcgaaaacgagagcatcagcgaccaggatagcttacctattaaccagtctattaaggagacattcatcagtaatgaggaacctttcgtcgtacaaagttgtgtacagaaacgaaacatcttcaaagaagattttcataacctgatggcagtgtctccctcgctggtggggccaataagcaaggctgagaacgaacaccgtgagcctcagtctcggaaggagccacacaagccaccttttttcaatcattctttcgagatgccctacaattcacaatatctgaaccctgtctatagtcctgtgcccgataaaagaagagccaaacacgagtctttggatgatcttcaggcctccacatatttcggacccacccccgtgatgggcacccaagaagcccgaagatgcctcggcaagcctaataagcagaccccttggccagcaaagtcctggtcgttaaataccgaagaggtaccagatttcgagaggagcttttttaatcgtaaccctagtgaggagaaactgcattatccaaacgcttcctcacagacccccaatttcccagctcccgagcgcagacccacttacctcgtgccaaaggatcagcagcctattcttccaattgcctacgcagccaaacagaatggtctcaagtccaaggagataagctcccctgtggacctggaaaagcacgagcccgtcaagaaatttaaagataagtcaatcaattgtacttccggtcagttgtcttccgacacatcttccgtgggtacccagacagagcacgtgcttgaacccaagaaatgcagagacttgtgcacatccggtcaaggcaaatattccgaccggcataccatgaaacacagcgatgacgacagcgagatcgtgagcgacgacatctcagatatttttaggttcttggacgatatgtcaataagcgggtctactggcgttatccaaagctcctgttacaacagcacgggctcactgtctcaactgcataagagcgactgcgacagcagccctgaacacaaccttacaaaaatcgccaatggtgtaccaaactccaaaggagataaagggaatcgcccagaaaacacacatcactccgaggaggagctgaaaacctcagtgtgcaaactggtcctgagaataggagagatcgagcgaaagctcgagtccctgagcggggtgagggacgaaattagccaggtcttgggtaagctaaataagctggaccagaagatgcagcagcccgagaaggtgagcgtccaaatcgatttgaatagcttgacttccgaagggcctagtgacgattcggccagccctcgcatgtttcacgctcactcgggctctcacggacctaagctggaaaataatccagattggtgctgctccgacgcaagtggaagtaacagtgaatccctccgggtgaaggccctaaagaagtcactgttcactcgccctagtagcagaagcctgaccgaggaaaatagtgcgacggagagcaaaatcgcgtctattagtaacagtccacgggattggagaaccatcacgtacaccaatcgggtcgggctgaacgaggaggagataaaagacaccggccctggtgataataaggattggcacagaaagagtaaggaagctgatcggcaatatgatattcctccccaacaccgacttccaaagcaacctaaggatggtttccttgtagaacaggtgtttagcccacatccctacccagcttccctcaaggctcatatgaagtcaaaccctctatatacagacatgaggttgaccgaactagctgaagtgaaaagagggcagccaagctggacgatcgaggagtacgcgagaaatgctggggacaagggaaagctgaccgcgctggacctgcaaactcaggagagtctcaaccccaacaacctggagtattggatggaagacatttatacacctggctacgattctctattaaaaaggaaagaggccgaattcagacgtgcaaaggtctgtaagattgcggcactcattgctgccgcagcctgcactgttatcctggttatcgtcgtgcccatctgcacaatgaaaagctag

SEQ ID NO: 50888 - DNA, 6534 bp, Artificial Sequence
  Description of Artificial Sequence: Synthetic coding sequence
atggaagaaatactgcggaaactccaaaaggaggccagcgggtcaaagtataaggctattaaggaatcctgcacatgggccctcgaaactctaggcggacttgacactatcgtgaaaatcccccctcacgtactgagagagaagtgtctcctcccgctccagctcgccctagaatcaaagaatgtgaaactggcacagcacgcactagcaggcatgcagaagctgttgagcgaggaaaggttcgtgagcatggagaccgatagtgacgaaaagcaactgctgaatcagatccttaatgctgtgaaggtgactccttctctcaacgaagacctccaggtggaagtgatgaaggtcctgctttgcatcacatacacgcccactttcgatctgaatggctcagccgtccttaaaatcgccgaagtgtgtatcgaaacatacatctcttcgtgtcatcagagatctatcaatactgcagtgcgggctacgctctcccagatgttgtcagatcttacgttgcagctgcgacaacgccaagagaatactataatagagaatcccgatgtgcctcaggactttggaaaccagggatccacagtagagagtctctgcgacgacgtagtcagcgttctgacagttctgtgcgaaaaactccaagccgctataaacgactcccaacagctccaactgctgtatctggagtgtattctgagtgtcctttcatcctcttcttcctctatgcacctgcaccgaaggtttacagacttaatatggaagaacctttgccccgcactcatagtgatactgggaaatcccatccatgataagaccatcacaagtgcccacactagcagtacatcaacatccctggagtctgatagtgctagccctggtgtctcagaccacgggcgtggttccgggtgctcctgtactgctccagcactgagcggccctgtggcccgtacaatctattacattgcagccgagctagtgaggcttgtcggttctgttgatagcatgaaaccagtactgcagtcactataccatcgggtgcttctctatccacctccccaacatagggtagaagctatcaagattatgaaagaaatcctcggctccccacaaaggctttgcgatctggccggaccttcttccactgaatctgaatccaggaagcgctccattagcaagcggaagtcccacctcgacctgcttaaactcattatggacgggatgaccgaagcctgtattaaggggggaatagaggcctgctacgcagccgtctcctgtgtctgtacgctgttgggagctctggatgagctttcacagggcaaggggctatccgagggacaagtacagctgcttttgctccgcctcgaagagcttaaagacggcgcagaatggagccgtgactcaatggagatcaatgaggctgattttcgctggcagcgtcgggtgctgtcatctgagcatacaccatgggaaagcggcaatgagaggagcctcgatatttcaattagcgttactaccgataccggacagacaacactcgagggcgaactcggtcagacaacgccggaggaccatagcggaaatcacaaaaattctttaaagtctcctgctattccagaaggcaaagaaaccctgtcgaaagttctggaaaccgaggcagtggaccagcctgacgtggtccaaaggagccatactgtcccctatccagacataaccaacttcttatccgtggattgcaggacccggtcgtatggaagccgctactcagaatctaattttagcgtcgatgatcaggacctgagccgcaccgagttcgacagttgtgatcagtacagcatggccgcagaaaaagattcaggacgctccgatgtctccgatattggcagcgataactgtagcctagccgacgaggaacagacaccccgtgattgcttagggcacagatccctgagaacagccgctctgtccctcaagttgctcaaaaaccaggaggccgaccaacattctgcccgactgtttatacaatccctcgaaggcctgttgccgagactgttgtcactctccaatgtggaagaggtggacaccgcgctccaaaatttcgccagtacattctgctctggaatgatgcactccccaggcttcgacggcaattcgagcttgtcattccagatgttgatgaatgccgatagtctgtacaccgccgcacactgcgcacttttgctcaatcttaaacttagccatggtgactactatcgcaaacggccaacgcttgcacctggcgtcatgaaggattttatgaagcaggtccaaacatcaggtgtcctgatggtgttctctcaggcttggattgaagaactctaccaccaggtactggaccgtaacatgttgggtgaagcagggtattgggggagcccagaagataactcccttccgttgatcaccatgcttacagacatcgacggcttggaatccagtgcaattggtggccagttaatggcatcagcagctaccgagtctccctttgcccagagtaggcgcattgatgatagtactgttgcgggtgtggctttcgcacggtatatcctggttggttgttggaagaacctgatcgacaccctgtccacgcccctaacgggtcggatggccggtagcagcaaagggctagcatttatactgggcgcagaaggcattaaggaacagaaccagaaggaacgagatgccatctgtatgtcactggatggtctacggaaagcagctagattaagctgcgcgcttggcgtggccgcaaattgtgccagcgcactcgctcagatggcggctgcgtcgtgtgtccaagaggaaaaggaagaaagggaagcgcaagagccgagtgatgctattacacaggttaagttgaaggtagagcaaaagttagaacagattggaaaggttcagggagtgtggctgcacacagcacacgtgctgtgtatggaggcgattctctccgtgggacttgagatgggcagccacaatcccgattgctggcctcatgtgttccgcgtgtgtgagtacgtgggtaccctggaacacaaccacttcagtgacggcgcaagtcagccacccctgacaattagccagccccagaaggccacggggtccgctggcctcctgggggaccccgaatgcgagggcagccccccagagcactctcccgaacaagggagatcactaagcactgccccagtagtgcaaccactgagcatacaagatctggtacgggaggggtctcgcggtcgagcaagtgatttcaggggcggaagcctcatgagtgggtcctcagcagcaaaggttgtgctgaccctaagtacccaagctgacagactgttcgaagatgccacagataaactgaatctgatggccctgggaggatttctctaccagctgaaaaaagcaagccagtcgcagctctttcactcagtgaccgacaccgtggattattctctcgcaatgcccggagaggtgaaaagcacccaggaccggaagtccgctctccatttgtttagactaggcaacgcaatgttacgcatagtacgcagtaaggcgcgtcctttgctgcacgtcatgagatgttggtccttggtcgctcctcacctcgtggaggctgcctgccacaaagagcgccacgtttctcagaaggctgtgagtttcatacacgatatcctcaccgaagtccttacagactggaacgagccaccccacttccatttcaacgaggccttgttccgacctttcgagagaatcatgcaactcgagctgtgtgacgaggatgttcaagatcaggtagtcacttccatcggcgaattagtcgaggtgtgcagcactcagatacagtcaggttggagacctctattttccgctctggagacagtgcacggagggaacaaatcagaaatgaaggaatacctcgttggagattacagtatgggaaaaggacaggcccctgtgttcgacgtgtttgaggcctttttgaacaccgataatatacaagtgtttgccaacgccgcaacaagttacattatgtgtctaatgaaattcgtgaagggattgggggaggtggattgtaaagagatcggggactgtgctccagctcccggagccccttctactgatctgtgcctacctgctctggactacctgcgcagatgtagtcagctgctggcaaaaatatataaaatgcccctgaagcctatttttctgagtggacgtctagctgggctgcccaggcgcttgcaagagcagtctgccagctctgaagatggtattgagtccgtgctcagcgatttcgacgatgacactggcttgatcgaggtctggattatactgctagaacagctgaccgctgcagtgtcaaattgccctaggcagcatcagcctcccaccctggatctgttattcgagctgttgagagatgtcactaaaaccccgggaccgggattcggaatttatgcggtcgtgcacctactgctgcccgtcatgtctgtgtggctgcgcaggagtcataaggatcatagttactgggatatggccagcgccaattttaagcatgctattggactctcctgcgagctagtggtggaacacatccagtcatttcttcatagcgatatcaggtacgaatccatgattaacaccatgcttaaagatctatttgaacttctcgtggcctgcgtagcgaagcccaccgagaccatttctcgcgtgggatgcagctgcatccggtatgtcctcgttaccgccggtcctgtatttactgaagagatgtggcggcttgcctgttgcgccctgcaggacgcctttagtgcaacgctcaagcccgtgaaagatttattgggctgcttccactcaggcaccgagagctttagcggcgaaggttgccaagtacgtgtcgctgcaccatcatcttcaccatctgccgaagcggagtactggagaattagagcgatggcccagcaggtcttcatgttagatactcagtgctcaccgaaaacacctaacaactttgaccatgctcagagctgccagctgattattgaattaccccctgacgaaaaaccgaatggacacactaagaaatccgtgagcttccgggagatcgtcgttagcttgctatctcaccaagttttactgcaaaacttatacgacatcctcttggaagagtttgtcaagggtccctctccgggtgaagagaaaacgatacaggtgcccgaggccaagctggcaggattcctcagatacatcagtatgcagaacctggccgtgatttttgacctgctgttagactcttacaggacggcacgggaatttgacacatcaccaggactgaagtgcctacttaagaaagtgtcagggattgggggagccgctaacttatataggcagtcggcaatgtcttttaacatttactttcacgctctcgtctgtgctgtgctcaccaatcaggagacaataactgccgaacaggtgaagaaggtgctctttgaggatgatgagcgaagcactgattcgagccagcagtgcagctccgaggacgaggacatatttgaggagactgcccaggtatctcccccaagggggaaggaaaagcgacaatggagagccaggatgcccctcctgagcgtccagccagtgtctaacgcggattgggtgtggctggtcaagaggctccacaaactctgtatggagctctgtaataattatatccaaatgcatttagaccttgagaattgtatggaagaaccccctatctttaaaggtgacccattcttcatactgccatctttccaatccgaaagctccacaccatccacaggtggtttctcggggaaagagacaccatccgaggatgataggtcgcaaagtagagagcacatgggcgaatctctgtcactgaaggccggaggaggggacttacttctgcccccaagtccaaaggttgaaaaaaaggatccgagtcggaagaaagagtggtgggaaaatgcagggaataagatttacaccatggcagctgacaagaccataagcaagttgatgaccgagtacaaaaagcgcaagcagcagcacaacctgtccgccttcccgaaagaggtcaaggtggagaagaagggagagcccttggggcctaggggccaggacagtcctctgctgcagcggccacagcatctaatggaccagggacagatgcgccactcttttagcgcagggcctgagcttctcaggcaggacaaacggcctcggtctggctccaccgggtcctcactatctgttagcgtgagagatgcagaggctcaaatccaggcttggacgaacatggtcctcacagtgcttaaccagatacagattcttccggatcagacgtttaccgctttacagcctgcagtcttcccctgcattagccagctgacttgtcacgtcacggatatacgggttcgtcaagctgtgcgggagtggcttggaagggtgggtagggtatacgacatcatcgtctag

SEQ ID NO: 50889 - DNA, 3042 bp, Artificial Sequence
  Description of Artificial Sequence: Synthetic coding sequence
atggctgaacccggacactcccatcacctgtccgccagagtaagaggtagaactgagagacggatccctcggctgtggaggctgcttctctgggctggtactgccttccaggtgacgcaggggactggccctgagctccatgcctgcaaagagtcagagtaccactacgagtacactgcctgcgactctaccggaagccgctggcgtgtggccgtgccgcatacccctgggctctgcacctcgctgccagacccaatcaaggggactgagtgcagtttcagttgtaacgccggtgagtttcttgacatgaaagaccagtcttgcaagccctgcgcagaaggacggtattcgctgggcaccggaattaggtttgacgagtgggacgagctgcctcatggcttcgcatcgttgtcagccaacatggaattggacgactctgcagctgagtccactggcaattgtacgtcctccaagtgggtacctcggggagactatattgcctctaatacagatgaatgcacagcaaccttgatgtacgcagtcaacctgaagcagagtggcaccgtgaatttcgagtattactaccctgactcttccataatcttcgagttctttgttcaaaacgaccagtgtcagcctaatgctgacgactcacgatggatgaagactaccgagaaaggctgggagttccattcggtggaactcaatcggggaaataacgtcctctattggagaaccacagcgttttcagtttggacaaaagtacccaaacccgtgctggtgcgcaacattgccatcacaggagtggcttacacctccgaatgctttccctgcaaacctggcacctacgccgacaaacaaggctcatccttctgtaaactttgtcctgctaattcctatagtaacaagggggaaacatcatgtcatcaatgtgaccctgacaagtacagtgagaaggggagttcaagctgtaacgtgcgcccagcctgcacagacaaggactacttctacacccacactgcttgtgacgccaatggcgaaacccagctgatgtataagtgggcgaagcctaagatctgctcagaagacctcgagggcgcagtcaagttgccagcctccggagtgaaaacacactgccccccttgtaatccaggcttctttaaaacaaataactcgacctgtcagccctgcccctacggcagttattctaacgggtcagactgtaccaggtgcccggctggaacagagcctgctgtcggcttcgaatataaatggtggaacaccctcccaactaatatggaaaccactgtgttgagcggaatcaattttgagtacaaaggcatgactgggtgggaagtggccggtgatcatatatacacagccgcaggggcttcggataacgatttcatgattctcaccctcgtcgtccccggattcaggcccccacagagcgtgatggccgacacggaaaataaggaagtggcgaggattacattcgtgtttgagacgctatgcagcgtgaattgcgaactgtattttatggtgggggtgaatagccggaccaataccccagtggagacctggaaaggaagcaagggtaagcagtcttacacctatataatcgaagagaacaccaccacctcgttcacctgggctttccagagaaccacatttcacgaggctagtcgaaagtacacaaacgatgtggccaagatctattctataaatgtcacgaacgtgatgaacggtgtggcctcctattgcagaccctgtgcactcgaagcttccgatgtcgggagctcatgtacatcatgtcctgcgggatactatatagacagagatagtggaacgtgtcatagctgccccaccaatactattctgaaagctcaccaaccatacggcgtgcaggcatgtgtgccttgtggcccaggcacaaaaaataacaagatccattcattgtgttacaatgactgcactttctcccgcaacacaccaacacggactttcaactataacttctcggcattggccaacaccgtgacactggcagggggtccatccttcacgagcaaaggactgaaatatttccatcattttaccctctctctctgtggtaatcaggggagaaagatgagtgtctgtaccgacaacgttacagacctgaggatcccggagggagagagtggtttttccaaatctatcactgcttacgtttgccaagctgtcataattcctcctgaggtgacagggtacaaggctggcgtctcaagccagcctgtgagcctggcagaccggctaatcggcgtcactacagacatgactctagacgggatcacaagccctgcagaacttttccacctggaatctctgggaatcccggatgtaatcttcttttaccgaagtaacgatgtcacacagagttgtagcagcggcagaagtaccacgattagagtcaggtgttcaccccagaagaccgtgccaggatcgctgctgctccccggaacatgttcagacggcacatgcgacggctgtaatttccacttcctttgggaatcagctgccgcttgccccctgtgcagcgttgcggactatcatgctattgtttccagctgcgtcgcagggatccagaagactacgtacgtttggcgtgagccgaagttatgttcagggggtatctctcttcccgagcaacgtgtcaccatctgcaagaccatcgatttttggcttaaagttgggatctccgccggaacttgcacagctatcttgcttaccgtcctgacctgctatttttggaagaaaaaccaaaaactggagtataagtatagcaagcttgtaatgaacgcaactctcaaggattgtgatttgccagctgcggattcctgcgcaattatggaaggggaagacgtggaggacgatctcatctttacctcgaaaaagagcctgtttggtaaaataaagagcttcacctctaagcgaaccccagacggtttcgactccgtgcccctgaagactagctctggagggctggatatggatttgtag

SEQ ID NO: 50890 - DNA, 1869 bp, Artificial Sequence
  Description of Artificial Sequence: Synthetic coding sequence
atggctacagtactgtcacgggctttaaagttaccgggaaagaaatcccccgatttgggggaatatgatcctctaacccaagccgactcagacgaatctgaggatgatctcgtgctgaatttgcagaagaacggtggagtgaagaatgggaagagtccattaggcgaagcccctgagccagattcagacgcagaagtcgccgaggcggctaagccacacctgagcgaagtgaccacagagggctatccaagcgaacccctgggaggtctagagcagaaggccgcatcctcgctggtatcttatgtgcgaactagtgtgtttctgctcactctcggcatctctatgatactggtccttttatgcgcctttctcataccctgccccccacgggatcttcactcaacatggtccaggcatctcggtagtcagggaggtggagatctgtctcctctggaactcgcagatgtaaacggggacgggttgagagacgtgcttctgagcttcgtcatgtccaggaatgggtccgctgtcggtgtgtctaggccagcagccaacttggtgtgcttaagtggaatgaacggtagtactctttggtctagcctgttgcctgaagaagcacgagacattacatgtttagagctgatgcccggaagccttgccgagaccatctgtctggttactggcacacacaagatgctttcggcctttaacgccacttccggaaaagccatctggaccctgaaccccaattatctgtccaacgggaccttggccgctcccgtggtagtgcttccagatttagatgaggacggagtgcgggacctcgtggtgctggccattggtgaacttcagccggacttgtgttttctgctagtgagcggtaggacaggtaatcctgtaggccgtccggtgaagtataatattgttggtgtggggaacctgatcggacctcaagtgtacattaccaccaatggggcagtctatattctgtttggatttggaaacatccaggcagtggccttgcgggatattttcgtgcaggcccagaatcgcgattcctcccccccatcactacaaatcgaggaaccggaatgggagaaacgacgctctattaatctgagtgagctgattgatgtatattctgatggagtcgaactcctacaaatggtgaaagccccagactcaaattgttcaaacctactcatcacaactcgtcagtcattggtgttgctgcgcggacagaatcttacgccatactgggcactgcgtcttcaaggcctccgctcccagccgacccccggttacttcactgatgaccagacgctcgacttcctgctccagatccaggacggcgttgggatgaaaaagatgatggttgttgacggggattctggtagtatcgtgtggagttaccgtgcgccttgtcacatgaaggagacacccgcaacgtctgctgtgacctccgaccagaagtccgttttcctgttttgggccgaaggcctgagcgcagcgagccccaacagcgatatcatcctcggcacggagccacctagtctgcaccatctctatcttctccacccagccttcccctccattttgctagacctggctaacaccactggtaccgtgacggcctctgaggtcggaatcaacgatttatggaaggacgctttttacgtgactagaaccaccgggccatcaagtgaaggtcatcctgccgctctggtggtcagtaagctctccctcaggtgggcgttaatggaaggccagatggcacagctgcaggagagtactccaaaaataggcagaggcgaactacgacgcttcctgtcaagaattaagtttgtcgaggctccttacgaaatctag

SEQ ID NO: 50891 - DNA, 1869 bp, Artificial Sequence
  Description of Artificial Sequence: Synthetic coding sequence
atggccaccgtcctgagccgcgcattgaagttaccaggcaagaagagtcctgacctgggagaatatgaccccctgacccaggcggattccgacgaatccgaagacgacctcgtccttaacctgcagaagaatggaggggtaaagaacggaaagagtccccttggtgaagcacccgagccagattccgacgctgaggtcgcagaagctgccaagccccacctctccgaggtgacgactgaagggtacccatcagaaccgctgggcggactggagcaaaaggccgcaagcagtctagtgagctacgttcgcaccagcgtttttctgttgactttggggatttccatgatattggttctgttatgcgcctttctcatcccctgtcctcccagggacctgcactccacctggtcccgtcacttgggttctcagggcggtggtgacctgtctccactggagctcgccgacgtgaacggggacgggcttcgtgatgttcttctgtcgttcgtgatgagcaggaatggatccgctgttggtgttagcaggcccgctgctaacctagtttgtctgtccggcatgaacggctctaccctctggtccagtttactgccagaggaagcaagggacatcacatgcctggagctgatgccaggctctttggcagaaacgatttgtctggttaccgggactcataaaatgttgtcagcttttaacgccacctctggcaaggctatttggactcttaatcccaactacctgagcaatggcactcttgccgctcctgttgtggtgttgccagatctggatgaggatggcgtaagagaccttgtcgttttggctatcggcgaactacagcctgatctatgctttctcctggtcagtgggcgaaccggaaatcctgtcggcaggcccgttaagtataacatcgttggagtgggcaacctgatcggcccacaagtttacatcacgaccaacggtgcagtgtacattctgttcggctttgggaacatccaggcagtggcccttagggacatatttgtccaggcccaaaatagagactcatcacctccatctcttcagattgaggaacctgagtgggaaaagcgccgttccattaacctgtctgagctgatcgacgtttacagcgatggtgttgaactgttgcaaatggtgaaggctcctgattccaactgctcgaacctcctgatcactacgcgacagtctcttgtgctccttaggggtcagaatttaactccatattgggctctgcgactgcagggactgcggtcccagccaactcccggttacttcactgatgaccagacccttgattttttgctgcagatacaggacggtgtcggcatgaaaaaaatgatggttgtagatggcgattctggatccatcgtgtggtcataccgggcaccctgccatatgaaggaaacccctgccaccagcgccgtgaccagcgatcagaagagtgtgtttctgttctgggccgaggggctaagcgcggcttcacctaacagtgacattattttaggcactgagcctccgagcctgcatcatctgtatctgctgcaccccgcattcccctctatcttgctggatctagccaacacaacaggcacagttaccgccagcgaggttggtattaacgatctgtggaaagatgcgttttatgttacgcgcacaaccggaccttccagtgaaggccaccctgcagcgcttgtggttagtaaactcagcttgcggtgggcacttatggaaggccaaatggcccaacttcaggagtccacccccaaaataggccgtggcgagctgcgaaggttcttgtcccgaattaaatttgtggaggcaccctacgagatctag

SEQ ID NO: 50892 - DNA, 600 bp, Artificial Sequence
  Description of Artificial Sequence: Synthetic coding sequence
atgaccagctgcggtcaacagtccctgaacgttttggccgtgctgtttagcctgctcttctctgctgttctgtccgctcattttcgagtttgcgagccatacactgaccataaaggtcgatatcactttggatttcactgtcctcgcctgtccgacaacaaaacctttatactatgttgtcatcacaataataccgtcttcaagtactgttgcaacgagacagagtttcaggctgtgatgcaggccaatctgaccgcttcttctgagggctacatgcacaacaattataccgccctcctcggggtctggatctatggatttttcgtgctgatgctgctcgtcttagatctcctgtactactctgccatgaactatgacatttgcaaagtgtacctggcccgatgggggatccaggggagatggatgaaacaggacccaaggcgttggggcaaccccgctagggcaccacgacctggtcaacgggctccacaaccgcagccgccaccaggtcctctcccccaagcaccccaggctgtgcacaccttgcggggagacgcccactccccccctctgatgaccttccagtcatcgagcgcatag

SEQ ID NO: 50893 - DNA, 3543 bp, Artificial Sequence
  Description of Artificial Sequence: Synthetic coding sequence
atgaccctgcaaggcagggcagatctcagcggcaaccaggggaatgccgctggcaggttggctacggtgcacgaacccgttgtgacccagtgggcagtgcaccctcccgcacccgctcatcctagcttgctcgataaaatggaaaaggcccctcctcagccacagcacgaaggtctgaagtcaaaagaacacctgccccagcagccagcagagggcaaaaccgcatcccggcgagtgccccgactccgcgctgtggttgaaagccaggcctttaaaaacattttggtagatgaaatggatatgatgcacgccagagcagcaaccctgatccaggccaattggagagggtactggctgagacaaaaattgattagccaaatgatggctgcgaaggccatccaggaagcttggcgcaggttcaacaaaagacatatccttcattctagcaagagcctggtgaagaaaacacgggctgaagagggtgacatcccatatcacgccccacagcaggtgcgtttccagcaccctgaggaaaaccggttgctgagtccaccgatcatggtaaataaggagactcaatttccttcctgcgacaacttggtcttatgccggcctcagtcttcacctttgttgcaacctcctgccgcacagggaacccctgagccatgcgtgcaggggccacatgctgccagggttcgcggactggcctttctgccccatcagacagttacaatccggtttccttgtcctgtgagtctggacgctaagtgccaaccttgtctgctaacacggacaattcgtagtacctgcctggtgcatatagagggggattcagtgaagacaaaacgtgttagcgcacggactaacaaggccagagccccagagactcccctatctaggcgttatgatcaagctgttacacggccttctcgcgcacagacgcagggccctgtcaaggccgaaacaccgaaggccccatttcagatttgtcctgggccaatgattaccaagacactactgcagacttaccctgtggtctctgtgaccctgccacaaacttatcctgcaagtaccatgaccactaccccaccgaaaacgagcccagtgccaaaagttactatcattaagacccctgcccagatgtatcctggccctactgtgaccaagacagctccacatacatgccccatgccgacaatgaccaaaatccaggttcacccaaccgcttcaagaaccgggacccctcggcagacatgtcctgcaaccataacagcgaagaatcggccacaagtgtcactgctggcttccatcatgaagagcctcccacaggtatgcccagggcctgccatggcgaagaccccccctcagatgcacccagtcaccacacccgctaagaatccactccagacctgtctgtctgccactatgagtaagactagctcccaacggagtcctgtcggggttaccaaaccctctccacaaacaaggctgccagctatgataactaaaacacccgctcagctgcggtctgtagctacaatcctcaagaccctctgcctcgcatctccaacggtggcgaacgtcaaggcccctccacaggttgcagtcgcagctggcacaccaaacacaagtggctcaatccatgagaacccccctaaggccaaggctacagtgaacgtgaagcaggccgcaaaggtggtgaaagcctcctcaccgagctatttggctgaaggaaaaatcaggtgcttagctcagccccacccgggaacgggggtgccacgcgcagctgctgaattacctttagaggccgagaaaattaaaactggaactcagaaacaggccaagaccgacatggcttttaaaacctcagtggctgtcgaaatggccggtgcccctagttggactaaagtagccgaggagggtgacaagccaccccatgtttacgtgcctgtggatatggctgttaccttgcctcggggacagctggctgcccctctgacaaacgcttcttcacaacgccaccctccatgcctgtcacagcggcctctggccgcacccctgaccaaggccagtagccagggccacctacctactgaattgaccaagacaccgtctctcgcacacctggacacctgcctatcaaagatgcacagccagacacatctggccaccggagccgtaaaagtgcaatcacaggccccactagcaacctgtctgactaaaacccagtctagaggccagccgatcacggacattactacttgcctgattcctgctcaccaggccgctgacctgtcctccaatacccacagtcaggtgctccttacgggtagtaaggtttccaaccatgcctgtcaacggctcggaggattgtccgctccaccttgggccaaacccgaagaccgacagacccagccccagccacacggacacgttcccggaaagactactcagggtggaccctgcccagccgcatgcgaggtgcaggggatgctcgtgccaccgatggcaccgacagggcatagtacctgcaatgtggaaagttggggcgataatggggcaacacgtgcacagcctagcatgcccggacaggccgtgccatgtcaggaagataccggccctgcggatgcgggagttgtcgggggacaatcatggaaccgggcttgggagcctgcaaggggtgccgcatcctgggatacctggagaaacaaggccgtggtacctcctcgaaggagcggcgagccaatggtctccatgcaggctgccgaggagatccgaattctggccgttatcaccattcaggccggtgtgcggggttatctggcacgcaggcggattcgcctgtggcaccgaggggcaatggtgatacaagccacgtggcgcggatacagggtacggaggaacctggctcatttatgccgcgcaacaacgactatccaatcagcatggcggggatatagcaccaggcgcgatcaggcaagacactggcagatgctacatcctgtgacttgggtcgagctgggatctcgcgctggagtaatgtccgatcgaagctggttccaggacggtagagcgaggacggtctctgaccacagatgtttccaatcctgccaggctcatgcttgttcagtttgccactccctttccagtcgcatagggtctccccctagcgtggtgatgcttgttgggtctagtccacgtacctgccacacctgtggcagaactcagccaactcgggtggtgcagggaatgggacagggaacagaaggccctggggcagtgagttgggccagcgcttatcaactggccgctctgtctccgaggcagccccacaggcaggacaaagccgcaactgcgatccaaagcgcatggaggggttttaagatcagacagcagatgcgtcaacagcagatggccgcaaaaattgtgcaggccacatggcggggtcaccacacccgatcttgtctcaagaacaccgaagccctgctgggtccagcagatccttctgcttcttcacgtcacatgcattggcctgggatttag

SEQ ID NO: 50894 - DNA, 5405 bp, Artificial Sequence
  Description of Artificial Sequence: Synthetic coding sequence
atgtctgacgacattcgcaagcgctttgagtttccgaacagcctaattcaaagtcaggccgtagggcatctcatcgcagctgtgttaaaagaaaatggattttccgagaaaattcaccagtccactaaccagacccccgcactgaacctgttgtgggagaaatgttgctcggataatgtcgtggtccggacagcctgctgtgagggtcttgtagctctggtcgcccaagaccatgccgagttttcctacgtcctcaacggtattctaaatctgattccctccactcggaatactcatggactgattaaggcaatcatgcatctcctacagatgcaggcactgaaagagggccagggtggggaaaaaaacatacagtccatctataccatccggaaccacccacaccccctcattacagtgctagaacatagacctgactgctggccagtgttcctgcagcagctgaccgcattcttccaacaatgtcctgagcgcttggaggtgagctgtattcagatcatggccccattcctctggtacctatattgtgagccatctcaacttcaagaatatgcaaaactacggctggctctgcttaaagtgctactgcagccccaggttctgtgtgacaaagatcaacccagtattcttgaacagcagattctacaactgtgttgcgatattgttccttgtctgcaggtcaaagatctgatccagacgacagaggcgatgatgttcatcgaagaagtgtgcctgtcgctcctgagacacccggtcttttggaagatccaactgacccagatgtcgctgcagctgctgtgtgtgagcgaagtctcactaaaaatcacgggcgagtgctccagcagcatccatctgctggagcattcagtcgaactgctgaaggaggactttcctgtcgaattagtaattatcggtattgcccttctgctgctgcagactcctgcaagtcagcaaaagccaatcctcaatctggcgctgaagcttctgtcagtcaccgaggatcagaagatcccaaagagcagcctcctgttagtgatgcccatcctgcagatcctttccagtacagctctggaagattgcatttctgtcgacgaggaggggccttccaggcaacagcttgccctgaacctgctcgagatgatccagcaggagtgctatagggacgatcaccagaaactgtcatacaaactagtgtgcccagtgacttctatgtacggtaccatttttaccgcttggagaattctggaagtaatgacggacagttccgccgctagcgattggctcgcttctgtggagtctttactgcccatcacggccgttataccagccccagcgtttcttttactggcccacctgctggtggaagataaggggcagaatctgcaccaaatactgaaggttacgaccgagctcgcacaagctgactcaagtcaggtccctaatctgattcctgttctgatgttcaagctgggcagacctttggagccgatcctgtataacgatatcctgtatacacttcctaagttgggcgtacacaaagtctgcatcggacagatcttacggataatccagctgctggggaccaccccaagattgagggccgtgacccttagactgcttacctcactgtgggagaagcaggatagggtgtacccagaattacagcgcttcatggccgtgagcgacgtgccgagcctctcagttggcaaagaggtgcagtgggagaaattgattgcaaaggctgcaagtatccgcgatatctgtaagcagcgcccatatcagcacggggcagatatgctggcggctatttcacaagttttaaatgaatgcaccaagccggaccaggcgacacctgcagctttggtgctgcaaggtctgcacgcactctgccaggcagaagtagtgtgcattcggtctacatggaatgccctatctccaaagctgagctgcgatacgcggcctttaatactgaaaaccttgagtgagctgttctccctcgttccaagccttacagttaataccacagagtatgagaattttaaggtacaggtgctgtcctttctctggacgcacactcagaacaaggacccgattgtggcgaacgctgcttaccggtcattggcgaattttaccgcaggggagcacaccatcttacacctgccagagaagatccggcctgagatcccaatccctgaagagctggatgacgatgaagacgtggaagatgtcgatctctcagtgccaggtagctgttatctcaaattattgtcactgaccccacctcttgtgctgccagctctggaggaattcttcacatctctcgtgaagcaagagatggtgaacatgcccagaggtatctatcactcagcccttaagggcggagcgaggagtgatcaggggaaaaccgtcgccggaatccccaatttcattttgaaaatgtatgagaccaacaaacagcccggtctgaaaccaggactcgccggaggcatgctgttttgttatgatgtcagcatgtaccaaagcaaggatggaaaaccactcaatcgcctcatggcttctcggggtcgcagttttaagcagacctcgctcgcattggtacacgaggttcacattcagttgagcgagtggcaccgggctatcttcctgccccaggcatggctggcctacatgaacagggcctaccatgcgatcctgcaagggcgtctaggtgaactcgagctgcagcttaaacacggcaaagaggagccagaggaggtgcagtacaagaagagtacagcctggctttgggtccgtgacatgctaaccgatgagataactaaggcagctgccaaagaatcaccggtcgtcaaaggcaatgccctgttggccctctctagcctcgctgttgtggtttcccgacacgaagcctctctttcctctgactctgatggccttcttgaagtacagccaaatttcctctcgatgaaagagtgggtctccatggtactcgatacgttgctagtcattgtcgattcacattaccaacccaggggacaactgctgagctggttttactacaaatcatattccggagagaataccgccagtgctatcgcacgcagtgccgctgcaaccgctttgtcactcttggtgcctgtcttcatcatctcctgcaaagagaaggtggaggagatactgaacatgctgactgcacgattgcctgggaagccatcagccgatgaatctcaggccgtgcaaatccacatggggcttgccttaggaatgttcttgtcccgactgtgtgaagagaaactgagcgacatttccggccaggagatgaacctgctgctgatgaagagcctggatgctctggaaaactgttgtttcgacacctctctggagtacaatacgggctgtatcctcggcgttggcctggttctgagcctcatgagccactcctcccagatgcagagtagggtgcatgttgccgcacttcttagaaagctgagcgctcacgtggatgattcgggcagccaaagcagaaccttccaggaggtgctggcctacaccctgagctgcgtctgtactagtgcctttagtgccggaatcattgaagctacggaagctgaggacgttatgaacaaactcaggctgttggtagaaaactcgcaacagacaagcggatttgcactggcactgggtaatatcgttcacggcttaagcgtctgcggccatggaaaagccgaagacctggggtccaagctgctccccgcttggataaggattgtgctcaccgaggggacgcccactatgctgtgtcttgccgctttgcatggaatggtagctctcgtgggtagcgaaggagatgtgatgcaattaaaatccgaggctatacagaccagccacttccagggtagattaaacgaagtgataaggacgctgacacaggtcatctccgtcagtggcgtcatcggccttcagtctaacgctgtgtggctcctggggcaccttcacttatcaacgctttccagttctcagagccgcgcttcagtacccacggactatagctacctccccgagagcagttttataggagcagcaattgggtttttcattaccggtggaaagaagggaccggaaagcgtgcctccctcgttgctcaaggtcgttatgaagcccatagcaaccgtgggagagtcctaccaatacccacccgtcaactgggctgccctactctctcctctgatgcgactaaacttcggtgaagaaatacaacagctatgtcttgagatcatggttacccaggctcagagttcccagaatgccgctgccctgctggggctgtgggttactcccccactcattcattccttgtccttgaacaccaaacgttaccttctcatttcagcaccactatggattaagcacatctctgacgagcagatcttggggtttgttgagaatttgatggtggctgtgttcaaagctgcatccccactgggcagccctgagttatgcccttccgccctgcatggcttgtctcaggccatgaaactgccatcacctgcacaccacctttggtctcttttgtccgaggccactggcaagatattcgacttgcttcccaacaaaatcaggaggaaagacctggaactatatatctctatcgccaaatgcttactggagatgactgatgacgacgccaatcgcattgcccaggtgactaagtctaacatcgagaaagcagcattcgtgaagctgtatttagtgagccaaggaaggtttcctcttgtaaatctcaccgatatgttgtctgtcgctgtgcagcacagagagaaggaggttctggcctggatgatcctgcactctctgtatcaggcacggattgtcagccatgccaatacaggcgtcctgaaaagaatggagtggttacttgagctgatggggtacatccgcaatgtcgcctatcagagtacttcatttcacaatacagccttagataaggcgctggatttttttctgctgattttcgctaccgctgtggtggcttgggccgaccatactgcacctctgctgctgggcttatcggcaagctggctgccgtggcaccaggagaacggcccagccggaccggtgccttctttcctgggacgcagccctatgcacagggtcacattgcaggaagtgctgaccctacttcctaatagcatggccctcttgttacagaaagagccatggaaggagcagactcaaaaattcattgactggctgtttagcattatggagagtcctaaggaggctttgtctgcacagtcgcgcgatctgttaaaagccacactgttatccctgagagtgttgcctgaattcaagaaaaaagccgtgtggacccgcgcttatggatggta

SEQ ID NO: 50895 - DNA, 5405 bp, Artificial Sequence
  Description of Artificial Sequence: Synthetic coding sequence
atgtcagatgacatcagaaaacgattcgaattccctaattccctgatccagtcccaggccgtgggccacctgatcgcagctgtgttaaaagagaacggtttcagtgaaaagatccatcagtctaccaaccagacccctgctctgaatctcctgtgggagaaatgttgtagtgataacgtagtggtgcgcacggcatgctgtgaaggcttagtggcccttgtggcgcaggatcatgccgaattttcatacgttctgaacggtattcttaatctgataccgagcacaagaaacactcacgggcttatcaaggctatcatgcatcttctgcagatgcaagctctcaaggaggggcagggaggggagaagaacattcagtctatctatactatcagaaaccatccacatcctctgatcactgttcttgaacatcggcctgattgttggcctgtatttcttcagcagctgaccgctttttttcagcaatgcccagagcgcctcgaggtctcgtgtattcagattatggcccctttcctatggtacttgtactgtgagccatctcagcttcaggaatacgctaaactaagactggctctgctcaaggtgctgcttcagccccaggtgctatgtgacaaggaccagccgtccattctggaacaacaaatcctacagttgtgttgcgacattgtgccttgcctgcaggtcaaagatctcatccagaccacggaggcaatgatgttcatagaagaggtgtgtctgtctctgctaagacatcccgtcttctggaaaatccagcttactcagatgagtctgcagctgctgtgcgtcagcgaagtatccctgaaaatcacaggcgaatgctcctccagcattcacttactggaacatagcgtcgaactgctcaaagaggattttcccgtcgaactggtgataataggcattgccctcttgctattgcaaacgcccgcttcccagcagaagccgatcttaaacctcgccctgaaactgctgtccgtcaccgaggatcagaagatacctaaaagcagcctcctgctggttatgccaatcctgcagattctttctagtaccgctctggaggattgcatcagcgtagacgaggagggaccctcacgccagcagctggcccttaatctcttggagatgatacagcaggaatgctaccgagatgaccaccagaagctctcatacaaactggtgtgccctgttacctctatgtacggtacaatttttacggcgtggcgcattcttgaggtaatgaccgattcctccgccgcttccgattggctcgcaagcgtggagtcgctactgccgataaccgcagtcataccagccccagcttttttgctgctggcccatttgctcgtcgaggataaggggcagaatttgcatcaaattctgaaagttaccaccgaactggctcaagcagatagttcgcaggtgccaaatctgatcccagtgctgatgtttaaattaggccgaccattagagcccattttgtataatgacattctctacactctgcccaagctcggcgtccacaaggtctgcattgggcagatcctgaggatcatccaattgctcggaacgactccaagactgagagctgttaccctaaggctacttacgagcctctgggaaaaacaggatcgggtctatccagagctgcaacgtttcatggctgtctcagacgttccgagcctgtcggttggaaaggaagttcaatgggagaagctgatcgccaaggccgcaagcatccgggatatttgcaagcagagaccgtaccaacacggggctgatatgctggccgcaatctcccaggtgctcaacgagtgcaccaaacctgaccaggcaacgccggcagccctcgttttgcagggactgcacgcactctgccaggcagaggtggtatgcatacggagtacatggaatgcactctctccaaaactctcatgtgacacaagacctcttatcctgaaaacgttatctgagttgttctcgttggtcccgagtctcacagtgaacacaactgaatatgaaaactttaaagtccaggtgctttccttcctttggactcatacccagaacaaggacccaattgtggcgaatgcagcctacaggtcactcgccaactttactgccggagagcataccatcctgcacctgccggaaaaaatacgcccagaaatccccattcctgaggagcttgacgacgacgaggacgtggaggacgtggatctgtcggttccaggaagctgctatctgaaattactgtccttaactcccccactcgtgttgcccgcattagaggaattttttacctccctggtgaagcaggagatggtgaacatgccaagagggatataccattccgctcttaagggaggagcccgaagtgaccaggggaagactgtggccggtattcccaacttcattctgaaaatgtatgagaccaacaagcagcccggtctcaaacccggtttggccggagggatgcttttttgttacgatgtgagtatgtatcagtctaaagacgggaaacccctgaatcggttaatggcaagcaggggccgtagcttcaagcagacaagcctggcactggtgcacgaggtgcatattcagctgtcggaatggcatcgagcaatttttctgcctcaggcatggttggcttatatgaaccgcgcataccacgccatcctccagggacgcttgggtgagttggaactccagctcaaacacggcaaggaagaacccgaggaagttcagtacaagaagtccacagcatggctgtgggtgagggatatgttgactgatgagatcacaaaggctgcagcaaaagaaagccctgtcgttaaagggaatgcccttttggctctcagttcacttgccgttgtggtgtccagacatgaagcctccctcagttcggattccgatggccttctggaggtccagccaaactttttgtcaatgaaggagtgggtcagtatggtgttagatactctgctggtgatcgttgactcacattatcagccaagggggcagctcctgtcctggttttactataagtcctactccggagaaaacaccgccagtgccatcgcccgaagcgccgctgcaactgcccttagcctcctcgtgcccgtgtttattatctcatgcaaggagaaagtcgaagagatccttaacatgttaacagcccgtcttcctggcaagccatccgctgatgaaagccaggctgtccagatccacatggggctggccctgggaatgtttctgagccggctttgtgaagaaaagctttcggacatttccgggcaggaaatgaacctactactaatgaagtctctcgacgccctggagaattgctgtttcgatacgtccctagaatacaatacagggtgcatcctgggagtcggcctggtgttatctctgatgagtcactcgagtcagatgcagagccgagtgcacgtggccgcactgcttaggaaattgtccgcgcacgtggacgacagcggctctcagtcccggacgttccaggaggtgctggcgtataccctaagctgcgtgtgcacctcagcattttctgccggtattattgaggctacagaagcagaggacgtgatgaataagctgcgcctgctcgtggagaattcccaacagacttccggctttgccttggccctgggcaacatagtacatggacttagcgtttgcggccacggcaaagctgaagacttggggagtaagcttctgccagcctggattaggattgtactgactgaaggaacccctacgatgttgtgtcttgcggcactgcacgggatggtggccctcgtcggatcagagggggatgtcatgcagctcaaatcggaggccatacagacaagccactttcaaggcaggttgaatgaggtgattaggactctaacccaggtgatttccgtgtctggtgttatcggactgcaatctaacgccgtttggctgcttggacatctgcatctaagcacgctgagctccagccagagcagagcatctgtgccaacagactatagttacctgcctgagtcctcattcattggggcagcaatcgggttctttatcacaggcggtaagaagggtccagaaagcgtcccgccaagtcttctaaaagtcgtgatgaagccaattgcaactgtcggtgagtcctatcaataccctcccgtgaactgggcggctcttctctccccccttatgcgcctaaactttggtgaggaaatccaacagctgtgcctggaaattatggttacacaggctcaatcttcccagaatgccgcagcactattgggcctgtgggtgacacctcccctgattcattctctatctttgaatacgaagagatatcttctaatcagtgccccattgtggatcaaacacatttcggatgagcagattctggggtttgtggagaatctgatggtggcagtctttaaagccgcttcccccttagggtcacccgagctgtgtcccagcgcccttcatggcctgtcgcaggcaatgaagctgcctagcccagcacaccatctgtggagtctcctgtctgaagccacaggtaagattttcgatttgttgcccaataagattcgcagaaaggaccttgagctgtacatatcaatcgccaagtgcctgttagaaatgacagacgatgacgctaatagaatcgcccaggttacgaaaagtaacattgagaaggctgctttcgtgaaattgtatctggtgagccagggcaggttccctctggttaatctcaccgatatgttaagtgttgccgtccagcatcgagagaaggaggtgctggcctggatgatcctgcactccctctaccaggccaggattgtgtcccatgcgaacaccggggttctcaagcgtatggaatggctactagagttgatgggttacatccgcaatgtggcttaccagtctacatcatttcataataccgcccttgacaaggcattggattttttcctgctgatttttgcgaccgccgtggtcgcctgggcggatcacacagctcctctgctgctcggactcagcgccagttggctgccatggcaccaggaaaacggcccagcaggccctgtcccttcattcctcggaagaagtccaatgcatcgcgtaactctgcaggaggtgcttaccttgttgcccaatagcatggctctgttactccagaaggaaccctggaaggagcaaacccaaaagttcattgattggctgttctcaattatggagtcccccaaggaggcactcagtgctcagtccagagacctgctgaaagccaccttgctctctctacgcgtgctaccagagtttaagaagaaagccgtatggacccgggcttatggatggta

SEQ ID NO: 50896 - DNA, 1557 bp, Artificial Sequence
  Description of Artificial Sequence: Synthetic coding sequence
atgctatgcgcaagcttcctcggcctcggacttagtgtagcgattgtcggccctacttttcaagacctcgctaccaatgtgaacagaaatatcagttccctcagcttcatctttgtggggagagccctggggtacctctccggctccgtgattgggggatttctggtggacgttatgaactactttcttctgctcggcatcagtatgagtgcaacaaccgtggggctgtacctggtgccattctgtaaaaccgccatcttacttaccgtgatgatgtcaattttcggagtgagtataggcattctggacacagggggtaacgttctcattctggccatctggggagataagggtgcgccacatatgcaagcattgcatttctcattcgccctgggcgcatttctggcccctctcttggcgaaacttgcactgggacctaccgcctcagcagagaatcatacggagtcggatttccatccagctctaaatcagagttcagacgcagatagtgaagccctgttcggggtaccgaacgacaagaacctgctgtgggcgtacgccgtgatcggaacatatatgttcctcgtctccgtgattttcttttgtctgttcctcaagaactcaagcaagcaggaaaaagccagggctagtgctgaaaccttccgaagagcgaagtatcacaatgcccttctttgtctgctgttcctgttcttcttcttttacgtcggggcagaggtcacatacggaagctacgtattctctttcgcaaccactcatgccggaatgaaagagtcagaggctgccggactgaactccatattctggggcaccttcgcagcatgccgaggactggcaattttctttgctacatgtctgcagcccggaaccatgatcgtgctgtccaatatcggcagtttgaccagcagccttttcttagtgctctttgataaaaaccccatctgcctgtggatcgctacatctgtgtacggcgcttccatggcaactactttcccatcaggagtctcctggatagagcagtacactactattcatggcaaatctgctgccttctttgtaatcggcgcttctctcggagaaatggccatacctgctgtcatcgggatcctgcagggcaagtacccagatctcccagttgttctgtatacatcgctgggcgcatccatcgctacaggcattctgttcccggtactatataaattggctacctcccctctggacaggcagcggaaagaggataggaaaagtgaggatcagaaagctctattatccagcagtgggttgaacgaatacgaagaggagaatgaagaggaagatgccgagaaatggaatgagatggacttcgagatgatcgagaccaacgatacaatgaggcatagcattatagaaacatctagatcatccttgactgagccgactgccgaggtgtataaccagtacccctccaatgccctggttttcgagtcctcgccattcaacactggtagtgcccacgttaaacacctgccagaaacacgtaccaaaggtaccaacgtctag

SEQ ID NO: 50897 - DNA, 1905 bp, Artificial Sequence
  Description of Artificial Sequence: Synthetic coding sequence
atgtggctacaacaacgcctcaagggactgcctgggctactgagcagcagttgggccagaagactgctttgtctacttggcttgctcttgctgctgctctggtttggcggttccggagcacgcagagcagccggtggactacaccttctgccgtggtctcggggtgaaccaggcgcagcagagccttctgcctgtctggaagctgcaacgcgcgcatggagagggctgagagaacgcggagaagtcgtgcccctagggccaggtgtccccgctctggttgctaatggatttctggctctcgacgttgccgctaacagactctgggtaaccccaggggaacgcgagccagctgtggcccctgattttgtaccgttcgttcagctcagacctctttccgcgctggcagaggccggagaggctgtgctcctgctccgggaagggttgttgcggagagtgcgctgcttacagctggggtctcctggcccaggcccagttgcagcgggaccaggccctgcgtctgtctcaggtttagctgcaggctccggtagagactgtgtactgctccaagaggatttcctggcccacagggggcgaccccacgtttatttacagaggatccaactgaacaaccccaccgagcgggttgctgcactgcagactgtgggccctaccgccggtccggcaccaaaggcctttacatccacactggagaaagttggggatcaccagttcttactatattctggacgctctcctccgacccctactggccttgtgcaccttgtcgtcgtagctgcgaagaagctggttaaccgcctccaggtggctcccaagacccaactagacgaaacagtactctgggtagtgcacgtgagtggcccaatcaaccctcaggttctgaaaagcaaagccgctaaagaactgaaggcattgcaggacctggctcggaaagaaatgcttgaactactggatatgcctgctgcagagctgctgcaggaccaccaactgttatgggctcagttatttagcccaggcgtcgaaatgaaaaaaatcaccgatacgcacaccccatcagggctgacagtgaatttaactctgtattatatgctttcctgcagcccagcccctctacttagtccctccctgagccacagagagcgcgaccaaatggaatccacactcaattatgaagaccactgcttttctggacacgcaacaatgcatgccgaaaatttatggccgggtaggctaagttccgtgcagcagatcctgcagctatctgacctgtggaggctgaccctccagaagagagggtgcaagggactggtgaaggtgggtgcaccgggtattctgcaaggaatggttttgagttttggcggtcttcagtttaccgagaatcacctccagttccaggccgacccagacgtgcttcataactcttacgccttgcacggtattaggtacaagaacgaccatattaacctggccgtgctcgccgacgctgagggcaagccctacctccatgtgtccgtggaatcccggggtcagcctgtgaaaatttacgcatgcaaagccggttgtctcgacgaacccgttgagctcacgagtgctcccactggtcacacattttccgtgatggtaactcagcccataacgcctctactttacatttccacagatctgacccacctacaggatctgcgtcataccttacacctcaaagcaattcttgctcatgatgagcatatggcccagcaagatccaggtcttccatttcttttctggttttctgtggcatctctgattactctctttcacttattcctgttcaagctgatttacaacgaatattgcggccctggggcaaaaccactgttcagatcaaaagaggatccctctgtgtag

SEQ ID NO: 50898 - DNA, 1233 bp, Artificial Sequence
  Description of Artificial Sequence: Synthetic coding sequence
atgtctttgatggttgtctccatggcatgcgttggcttttttttactagagggcccatggccccatgtgggcggacaggataagccttttctgagcgcgtggcccggaaccgtggtaagtgaaggccagcatgttacactgcagtgcaggtccagacttggcttcaatgaattttcgctttccaaggaagacggcatgcccgtgcctgagttgtacaatcgcatcttcaggaatagttttctgatggggccagtgacccctgcacatgctggcacctaccgctgctgttcttcccatccccatagccccactggctggtcagccccatcaaatcccgtggtgataatggtcacgggggtccatagaaagccatccctgctggcccaccctgggcctcttgttaaaagcggtgagacagtaattctccagtgttggtctgatgtgagattcgagaggttcttgctgcaccgtgagggaattacagaagaccccctcaggctcgtgggccagcttcatgacgctgggtcccaggtcaattactctatgggtcctatgacccctgcccttgccggaacctaccggtgttttggctcagtgacgcatctgccatatgagctcagtgctcccagcgatcctctggatatcgttgttgttggcctctatgggaagcctagcctcagcgctcagccaggcccaaccgtgcaggccggtgagaatgttaccctcagttgctctagccgcagcttatttgatatctatcacctgagcagagaagccgaggctggtgaattaaggctgaccgcggtgctgcgggtaaatgggacttttcaagccaattttcccctcggacctgtcactcacggcggaaactaccgttgtttcgggtcctttagggctttgcctcacgcctggagcgaccccagcgatcctctgccggtgagcgtcactgggaattccaggcacctgcatgtgctgatcgggacatctgtggtgattatcccattcgcaattctcttgttcttcttgttgcatcggtggtgcgccaacaaaaagaatgcagttgtcatggatcaggagcctgcaggcaatcgcacagtcaacagagaagatagtgatgaacaggacccacaggaagtcacctatgcccagctcaatcactgcgtgttcacccagcggaaaattaccagaccctcccagcgacctaaaaccccaccaacagatacctctgtatag

SEQ ID NO: 50899 - DNA, 624 bp, Artificial Sequence
  Description of Artificial Sequence: Synthetic coding sequence
atggaaaacgaagacggctatatgaccctgagctttaaaaatcggtgtaaaagcaagcaaaagtctaaggacttcagcttgtatcctcagtattactgtttgttgctcatcttcggatgcatcgtgattttaatcttcattatgacaggaattgatcttaaattctggcataagaaaatggacttctcgcagaacgttaatgtaagcagcctgagcgggcacaattatctgtgccctaatgactggctcctgaatgaaggaaaatgctactggttttctacctcctttaagacatggaaagagagtcagcgcgattgcacacaactccaggctcacttgctcgtaatccagaatctcgatgagctagaatttattcagaactcactgaagcccggacacttcggttggatcggcttgtatgtgacttttcaggggaacttgtggatgtggatcgacgaacatttcttagtgcctgaactgttctctgttatcggaccgacagatgaccggagctgcgctgtgataaccggaaactgggtttattccgaggattgttcaagcaccttcaaagggatatgccagcgggacgcgattctcacacataatggcacgtctggcgtctag

SEQ ID NO: 50900 - DNA, 1230 bp, Artificial Sequence
  Description of Artificial Sequence: Synthetic coding sequence
atggaggaaagctgggaggcagcgccaggaggccaggctggagctgagctcccaatggagcccgtggggtccttagtcccaacactggagcagccacaggttccagcaaaagtacgccaaccagagggtcctgaatccagcccctcacccgctggtgccgttgagaaagctgctggcgctggcctggagccaagttctaaaaagaaaccacccagtcccagacccggtagccccagagtgccccctctgagtctggggtatggtgtgtgtccagaaccaccttctccaggcccagccttggttaagctgccacggaatggggaggcacctggtgcagagcccgcaccctcagcatgggcacccatggagttgcaggtggacgtgagagtcaagcccgttggggctgctggcggtagctccacacctagtcccagacctagcacccgattcctgaaggtgcctgttcccgagtccccggctttctcccgtcacgcagatcctgctcatcagctgctgttgcgagcccctagccaaggtggcacttggggacgtcgctccccgcttgctgcagccagaacagaaagcggttgcgacgccgagggtagagccagccccgctgaaggttcggcgggtagccccggatcacctacctgttgtcgctgcaaggaactgggtctggagaaggaagacgcagctctgttgcctagagcagggctggacggtgatgaaaagctgcctcgcgcagtgactctcaccggcctgccaatgtatgtcaagagtttgtactgggcgctggccttcatggcagtcttactcgctgtttccggcgttgtgatagtcgtgcttgccagccgcgcaggcgctcgctgccagcagtgtcctcccggatgggtactgtcggaagaacactgctactactttagcgccgaagcgcaggcctgggaagccagccaagcgttctgctccgcctaccatgccacattgccgttgcttagccacacgcaagatttcctcggacggtaccccgtgtcacgtcatagttgggtgggcgcatggcgaggacctcaaggatggcattggatcgacgaagcccctttgcctccacagctgctccccgaagacggggaggacaatcttgatattaactgtggggcactggaagaggggaccttggtcgcggcaaactgtagcacaccaagaccatgggtctgtgccaaaggcacacagtag

SEQ ID NO: 50901 - DNA, 945 bp, Artificial Sequence
  Description of Artificial Sequence: Synthetic coding sequence
atggaagagtcttgggaagcagcaccaggcggacaggccggtgcagaactccctatggaaccggtcggcagtcttgtaccaacactggagcagccacaagtgccagccaaggtgaggcagcccgagggaccagagtcttccccctcacctgccggagctgtggaaaaggccgctggcgctggcctggagccttcctcgaaaaagaaacccccttcccctaggcctggcagcccacgtgtgcccccactttctctggggtatggtgtttgtcctgaacccccttctcctggcccagcactggtgaaattgccacgcaacggagaggccccaggcgctgaacccgcaccgtctgcctgggcgcctatggagctacaggtcgacgtcagagtgaaacccgtaggcgctgcaggaggtagtagtacaccatcgccacgtccctcaactagattcctgaaagtacctgtcccagagtcccctgcattcagccgacacgctgaccctgctcaccaacttctgcttagggcgccaagccaagggggtacatggggacggagatcgcctttagccgcagcacggactgaaagcggatgtgatgccgagggcagggcatcgcctgcggaagggagcgctggtagcccgggaagcccaacatgttgcagatgtaaagagctgggactcgagaaagaggacgcggctctgctcccacgagccggactcgacggggacgaaaagctgccccgagcagtgactctgactgactctctcaggacagcaagaacaatctggatatccaccgtggggccttggagaaaagccaggtggtggttgcaaaccgcggcactgcaggatcccggatccgttccacgcggtccctctgatttgggctctgcttggagctccgcttgtcaggcagatgctgcaccgccaacaggcgaggcctcgtag

SEQ ID NO: 50902 - DNA, 2274 bp, Artificial Sequence
  Description of Artificial Sequence: Synthetic coding sequence
atgctgagtctgctggtgtggattctgacactatctgatactttctcacaggggactcagactcgtttctcacaggaacctgcagatcagaccgttgtcgcaggacaacgggctgtactgccttgtgtactcctgaactattcaggcatcgtccagtggaccaaggacggactggcactgggaatggggcagggcctcaaggcctggcccagataccgggtggtgggttccgcggatgccggacagtacaacctcgaaattacagacgccgagttgagcgacgacgcttcctacgaatgtcaggcgaccgaggccgctctgaggagcaggagggccaagttaactgtgctaatccccccagaagatacccgtattgatggcggtcccgtaatcctgcttcaagccggaacaccacacaacttgacctgcagggcctttaatgcaaaaccagctgcgaccatcatctggttccgagacggtacacagcaggagggagctgtcgcaagcactgagttgctgaaagatggtaagcgtgaaactacagtttcccaacttctgatcaaccctactgacttggacatcgggcgtgtgtttacatgtcgctcaatgaacgaagcgatcccctccggcaaggagacatccatcgagttagatgtgcatcacccaccaactgttacccttagtatagagccccaaaccgtgcaggaaggggaaagggtcgtatttacgtgccaagccactgctaatccagagattctcggttaccggtgggcaaagggcggtttcctgattgaggatgctcacgaatcacgttatgagaccaacgtggactacagttttttcaccgagcccgtctcatgtgaggtgcataacaaggtggggtccaccaatgtaagcacactcgttaacgtgcatttcgccccaagaatcgtcgtggaccccaaacccactacaactgacatcggcagtgacgtgactctgacctgcgtatgggttggcaacccacctcttacattgacgtggactaagaaggactccaatatggtattatcaaatagcaatcaactattgctgaagtccgtaactcaggccgatgcgggaacctacacatgccgggctatcgttcctcgaatcggagtggcagagagggaagttccattatatgtcaatggtccacccatcatatcctcggaagctgtgcagtatgccgtgcgaggggacgggggtaaggtagagtgcttcatcggcagcacgccaccccctgaccggatcgcctgggcatggaaggagaatttcctggaggtcggaaccctggagagatacacggtggagcgtacgaatagtggctcaggcgtgctgagtacgttaactattaacaatgtgatggaggcagattttcagacccactataattgtaccgcttggaattcttttggacctggaaccgccataattcagctggaggagcgagaagttttgccagtggggatcatcgccggtgctaccattggcgcttccatcctgttgatcttctttttcattgcactggtgttcttcctctacagaagacggaagggttcacggaaggatgtgactctccgcaagttagatattaaggtggaaacagttaaccgggagcccctgacaatgcactccgaccgggaggatgataccgccagcgtcagtacagcaaccagggttatgaaagctatctacagctccttcaaggatgatgtcgatttgaaacaggacctgcgatgtgataccatcgatacccgtgaggaatatgaaatgaaggaccccacaaacgggtactacaatgtgcgcgcacacgaggaccggccatcgtccagagccgtgctgtacgctgattatcgggctcccggtccagccaggtttgatggacgacccagtagcaggttatctcactctagtggttacgcacagcttaatacctatagccggggtccagcctccgattacggccctgagccaacccctcccggacctgctgctcctgctggtaccgatactaccagccagctgtcctatgagaattacgaaaagttcaattctcaccccttccccggagcagccggatatcctacctatcgcttgggttatccccaggcaccgccttctgggctggagagaaccccctatgaagcatatgatccaataggcaagtacgctacagccaccagattttcttacacatcccagcactcagactatgggcagcggttccagcagcggatgcagactcacgtttag

SEQ ID NO: 50903 - DNA, 1782 bp, Artificial Sequence
  Description of Artificial Sequence: Synthetic coding sequence
atgggccaaggcctgaaagcttggcccagatatcgggtggtggggtccgcagatgccggtcagtataatctggagattacggatgccgagctgtcggatgacgcctcttatgaatgtcaggccactgaggccgcattgcgctctaggcgtgcgaaactcactgtgctgaatccaccaactgtcaccctatccatcgagccccagaccgtccaggagggcgagcgggtggtgtttacctgccaggccacggcgaatcctgagattctgggatataggtgggctaaaggaggcttcctcattgaggatgcccatgagtccaggtatgagaccaacgtggattattctttcttcactgagcctgtgagctgtgaggtacacaataaggttgggtctactaatgtgagtacccttgttaacgtacacttcgccccacgaatcgtggtggatccaaagccaaccaccacagatatcggaagcgatgtgacactgacctgtgtctgggtgggaaaccccccactaactctgacctggaccaagaaggactccaacatggtcctttcaaactccaaccagctgttattaaaaagcgtgacccaggctgacgcaggtacttatacctgcagagccattgtgcctaggataggggtagctgagagggaagtgcctttgtatgtcaatgggcctcctatcatcagttcagaggcagtccagtacgccgtccgcggtgacggcggaaaggttgagtgttttatcggctccacaccaccacccgatcggattgcctgggcatggaaagaaaactttctcgaggtggggaccctggaacgatatactgttgagaggacaaatagcggaagcggcgtactcagcactcttactatcaacaatgtaatggaggcagatttccagacccattataattgcaccgcttggaactcgttcggcccaggaacggccattatccaactggaggagagggaggtcctacctgtgggcattatcgctggagccacaatcggagcctcaatcctgcttatcttcttcttcatagcactggtgtttttcctgtataggaggcggaagggtagtcgtaaggacgtgactctgcggaagctagatatcaaagttgagaccgtcaaccgcgagccacttaccatgcacagtgatagagaagatgatactgcatccgttagtacagccacaagagtcatgaaggctatctatagcagctttaaggacgatgttgatcttaaacaggatctgaggtgcgacactattgacactagagaggaatatgagatgaaagaccccaccaatggatactataacgtccgggctcacgaggatagacccagtagtcgggcagtgctttacgctgactaccgagcgccaggtcctgctcggtttgacggaagaccgtcaagcaggctgtcacacagcagcggttacgcccagcttaacacgtactcaagaggcccagctagtgattacgggcctgagcccacgccacctggaccggcagcaccagcaggaaccgataccacctcccagctttcatacgaaaattatgaaaaattcaactctcatccattcccaggtgctgcgggttaccccacatacagattagggtatccccaggctccaccatctggccttgaaaggactccatatgaggcttacgatccgataggaaagtatgctaccgcaacaaggtttagctatacctcacagcacagcgactatggccagaggtttcagcaaagaatgcagacacacgtgtag

SEQ ID NO: 50904 - DNA, 2322 bp, Artificial Sequence
  Description of Artificial Sequence: Synthetic coding sequence
atgttgagcctccttgtatggattctaaccctttctgacacattctcacaagggactcagacacgtttctctcaggagcctgctgatcaaactgtggtcgccggtcagcgtgcggtgctcccatgcgtgctgttaaattacagtggaattgtgcagtggacaaaggatgggctggcactgggaatgggacagggcctcaaagcatggcctcggtaccgcgtcgttggatcagcggatgcaggccagtacaatttggagatcaccgacgctgagctgagcgacgacgcctcttatgaatgccaggccacagaagcagctctgaggtcacgcagagccaaactcaccgtccttattccgcctgaggatacaagaattgatgggggtcctgtcatactgctccaggcgggaacaccgcataacttgacctgtagagccttcaacgctaagccagccgcaactataatctggtttcgcgacggcacacaacaggagggcgctgtcgcaagcactgagcttttgaaggacggtaaacgcgaaactacagtttcccaattgctgattaaccccacggatctagacatcggtagagtgttcacttgcagaagtatgaatgaggcgattccatctggtaaggagacatcaattgagctcgatgtgcaccacccacccacggtcacgttgagcatcgaacctcagaccgtccaggagggtgagcgagtggtctttacgtgccaggccactgcaaaccccgagatcctgggttacagatgggctaaagggggatttctgattgaggatgcgcatgaatcccgctacgaaacaaatgtggattatagcttctttaccgaaccggtcagttgcgaggtgcacaacaaggtgggatccaccaacgtttcaacgctggtcaatgtgcactttgccccacggatcgtcgtggatcctaaaccaacaaccacggatattgggagcgacgtaaccctaacttgtgtgtgggttgggaatccccctctgaccctgacctggacaaagaaggattcaaacatgggacccagaccaccagggtcaccaccagaagctgcattgtcagcccaagttctgagtaacagcaatcaactgttgctgaagagcgtgacccaggccgacgctgggacctacacgtgtagggccatcgtgcctcgcattggcgtggccgagcgggaggtgcccctgtatgtgaacgggccacctattatttcctctgaagccgttcagtacgctgtgcggggtgacggagggaaagtcgaatgtttcataggctccacacccccacccgataggatagcctgggcctggaaggagaatttcctggaggtggggaccttggaaaggtacactgtagagcggactaattcgggatctggggtactctccaccctaaccatcaacaatgtgatggaggcagattttcagacccactataattgcaccgcttggaattccttcggcccaggcactgcaatcatccagcttgaggagagagaagtgcttcctgtcggtattattgccggtgctaccataggagcatccatactgctgattttcttctttatcgccttggtattctttttataccggcgaaggaaaggaagccgcaaagacgtcaccctgagaaagctggacattaaagtagagacagtcaatcgagagccattgacgatgcactcagatagggaggatgacaccgcaagtgttagcaccgcaacaagggtgatgaaagctatatatagcagtttcaaggatgatgtcgacctgaagcaggaccttagatgtgataccatagacaccagagaggaatacgagatgaaagatccaaccaatgggtactataatgttagggcacatgaggacagaccctcttcacgtgccgttctatacgcagactatcgggctccaggacctgctcgattcgacgggaggccgagctcacgtttgtcacatagtagcgggtacgcccaattgaacacatactctaggggccctgcttctgattacgggcctgaacctacacctccagggccagcagcacccgcaggcacagacaccacttcacagctgtcttacgagaactatgagaagtttaacagccatcctttccccggtgcagctgggtatcctacctatcggcttggatatcctcaggcccctccttccggccttgagcgaacaccctacgaagcgtatgacccaattgggaaatacgccacagccactaggttctcttacacaagccagcatagtgactacggccagagatttcagcagaggatgcagacacatgtttag

SEQ ID NO: 50905 - DNA, 1965 bp, Artificial Sequence
  Description of Artificial Sequence: Synthetic coding sequence
atgctctcgctgctggtgtggattctcaccctgtctgataccttcagccaaggtacacaaaccaggttctctcaggaaccagccgaccagacagtggtggccggtcaaagagctgttttaccttgcgtcctgctgaattatagcggcatagtgcagtggaccaaagatggtctggctctgggcatgggccaaggtctcaaagcctggcccagatacagagttgtcggcagtgccgatgctggccagtataacctggaaataacggacgcagaactgtcggatgacgcttcttacgagtgtcaggccactgaagccgctttgcgatccaggagagcaaagctcaccgttctgaatcccccaacggtgacactgtctattgaaccacagaccgtgcaagagggggagagagttgtattcacgtgccaagcgacggccaacccagagatcctggggtatcgatgggctaagggtgggttcctgattgaagacgcccacgagtcccggtatgaaacaaatgttgactatagcttctttacagagcctgtctcttgtgaagtgcacaacaaggtgggatccactaacgtaagcactttggttaacgtacactttgcccctcgcatcgtcgtggacccaaaacctacaaccactgacattggctcggatgtaacactgacctgcgtatgggttggtaacccaccactgactctcacctggaccaagaaggatagcaacatggtcttaagcaactcgaatcagctcttgctgaagtctgttacccaggctgatgctggaacctatacctgtcgggctattgtgccaagaataggcgtggccgagcgggaggttcctctgtatgtcaatgggcctcctataatcagttctgaagctgttcagtacgccgtacgcggagatggagggaaggttgagtgttttatcggttctacccctccacctgacagaattgcctgggcctggaaagagaactttctggaagtgggcaccctggagcgctatacagttgaaagaaccaattccggttcaggcgtgctctcaacattaaccatcaacaacgtgatggaagcagatttccagacacattataactgcactgcctggaatagtttcggcccaggcaccgccattatccaacttgaagagagggaagtgctccccgtcggcattattgctggcgcaacaattggtgccagtatcctgctgatcttcttcttcatagcactggtgttcttcctctatcgacgacggaaggggagcaggaaggacgttacgctcagaaagcttgacataaaagtggagacagtgaaccgagaacctctcactatgcatagcgatcgcgaggacgataccgcctccgtgtcaactgccacccgcgtgatgaaagccatctactcctcgttcaaagacgatgtggatctcaagcaggacttgaggtgtgacacaatcgatactcgggaggagtatgaaatgaaggacccaacaaatggctactacaacgtcagggctcacgaggacaggcctagctcccgggctgtgctgtacgccgattacagagctccaggccctgcgagatttgatggcaggccatcatcgcggctgtctcatagttcaggatatgcccaactaaatacctactcccggggacctgcttcggattacggccctgaaccgacgccaccagggccagctgcccctgctggaactgacacaacaagccaattgtcctacgaaaactacgaaaaatttaactcgcacccgttcccgggagctgccggttacccaacctaccgattggggtacccacaggctccaccgagcgggctggagaggacaccgtacgaagcctacgatcccattggaaaatatgcgacagcaactaggttcagctatacgtcacagcacagcgactacggtcagaggtttcagcagcgtatgcaaactcatgtgtag

SEQ ID NO: 50906 - DNA, 1974 bp, Artificial Sequence
  Description of Artificial Sequence: Synthetic coding sequence
atgctcagtctgctggtctggatattaaccttgagcgataccttttctcaggtaccccctgaggacaccagaatcgatggcggtcctgttattctccttcaggcaggcacaccgcacaatctcacttgccgcgcttttaacgcgaagcccgctgcaacaataatttggtttagggatgggacacagcaagaaggagccgtggctagtactgaactgctgaaagacggcaagcgcgaaacgactgtgtctcaattgttgatcaatcccactgatctcgacataggaagagtctttacctgtagatctatgaatgaggcaatcccgtcaggaaaagagacaagtatcgagttggacgtacaccatccgcctactgtcaccttgtctatcgagccccaaactgttcaagagggcgagagggttgtgttcacatgccaggccactgcaaatccagaaatcctgggatatagatgggccaagggcggattcttgattgaggacgcacatgagtctagatacgagacaaacgtggactatagtttcttcaccgagcccgtgtcctgcgaggtgcacaataaagttgggtcaaccaatgtttccaccttggttaacgtgcatttcgccccaaggatcgtggtggatcctaaaccaaccaccactgacataggcagtgacgttactctgacttgcgtttgggtgggcaaccctccgttaactctgacttggacaaagaaagacagcaacatggtgctttcaaatagcaatcagttgttgctgaaaagcgtaacccaggctgatgccggaacatatacctgccgcgcaatcgttcctaggattggagttgcggagcgagaggtcccactctacgtcaatggccctcccatcattagcagtgaagccgttcagtatgcagtgaggggagacggaggtaaggtcgagtgtttcatcggcagcacacccccacctgaccggattgcatgggcctggaaggaaaacttcctcgaagtcggtactctcgaacgttacaccgtggaacgcactaattccggtagcggagttctgtccacattaaccatcaacaacgtgatggaagccgattttcagacacattataattgcactgcctggaactccttcgggccaggcaccgcaataatccagctggaggagcgagaagtgctaccggtgggcatcattgctggtgcgacaataggggcttccatcctgctcatcttcttcttcattgcgttggttttcttcctgtatcggaggagaaaaggttctaggaaggacgttacactacgtaaactcgatattaaggtcgagacggtcaatagggaaccattgactatgcattcggatcgggaagacgacaccgccagcgtgtcaacagccacaagggtaatgaaggcgatatattcaagcttcaaagacgacgtcgacctaaagcaggatttaagatgcgacaccatagatacacgggaagagtatgagatgaaagatccaaccaacgggtattacaacgtccgcgctcacgaggatagaccctcctcccgggctgttctttatgctgattaccgggcacctggcccagcccgatttgacggcaggccgtcaagccgtttgtcccactcctctgggtacgcacagctaaatacttactccagaggacctgctagtgattatgggcctgagcccacgcctcctggtccagctgcacccgctggcacagataccacttctcaactcagctacgagaactatgaaaagttcaattctcatccgttcccaggtgcggctggctatccaacctacaggctgggttacccccaggctccaccaagcgggctcgaacggaccccttatgaggcgtatgaccccatcggcaagtatgctacggcaacccgctttagttacactagccaacatagcgactacggtcagcgtttccagcagcggatgcagacccacgtttag

SEQ ID NO: 50907 - DNA, 5316 bp, Artificial Sequence
  Description of Artificial Sequence: Synthetic coding sequence
atgtcagttcttatttcccaatcagtgataaattacgtcgaggaggaaaacattcccgctcttaaggcgttactggaaaaatgcaaagacgtcgatgaaagaaacgaatgtgggcagacccccctgatgatcgctgcagagcagggtaaccttgaaatagttaaggagctgattaagaacggcgcaaactgcaacttagaggatttagataactggaccgcgctgatctccgcctctaaggagggacacgttcatatagtcgaggaacttctgaagtgcggggtaaacctcgagcaccgggatatggggggttggacggctttgatgtgggcttgttataagggccgaaccgacgttgtggagttgcttcttagccacggtgcgaacccatctgttactggcctctactcagtgtacccaatcatctgggcagccggtcggggtcatgcagacattgtccatctgctcttacagaatggcgcaaaggtgaattgctcggataagtacgggacgaccccacttgtttgggccgctagaaagggtcacctggagtgcgttaaacacctcctggccatgggcgctgatgtggatcaggaaggagctaattcaatgaccgcattgattgtggccgtgaagggtgggtacacccaaagcgtgaaagagattctgaaacgcaacccaaacgtgaacctgacggacaaggacggtaacaccgccctcatgatcgccagcaaagaggggcacaccgagattgtgcaggacctacttgatgccggaacctacgtcaatatccccgatagatctggcgataccgtgctgatcggggcagtgagagggggacacgtggaaattgtccgagctctcctccagaagtacgccgatatcgacataagaggccaggataacaagacagccttgtactgggcagtggaaaagggcaacgccacaatggtccgtgacattttacagtgcaacccggacactgaaatttgcacgaaggatggcgagacgccactcataaaggccactaagatgaggaacatcgaagtcgtggaactactgctcgacaagggcgctaaggtcagcgccgtcgacaaaaaaggggacacccctctgcatatcgccatcaggggccgtagcaggaagcttgccgaactgctactacgcaaccccaaggatgggagattactatatagaccaaataaggctggagagactccttacaatatagactgcagtcaccagaaatctatcttaactcagatattcggcgctaggcacctcagccccaccgagactgacggggacatgctgggctacgacctctattcaagtgctctagcagacatcttgtccgagccaaccatgcagccacctatctgtgtcggattgtacgcccagtggggctctgggaagtcttttctcctgaaaaagctcgaggacgaaatgaagacatttgcaggccaacagattgaaccactgttccagtttagctggctcattgtgttcctcacgctgctgctctgcggcggtttgggactgctgtttgcatttaccgtccatcccaatctcggtatcgcagtttccttgtcctttctggctcttctgtacatttttttcatagtaatctatttcggagggagaagagagggggagtcctggaattgggcttgggtgctttctacaaggctcgcccgtcacatcggctatctggagctgctgctgaagctcatgtttgttaaccctccagagctccccgaacagactaccaaggctctccctgtgcgctttctctttacagactacaatcgattgagttccgtgggcggagaaacgagtctggccgagatgatcgccacactgtccgatgcatgcgaaagagagtttggcttcctagccaccagactctttagagtgtttaagaccgaggacacccagggaaaaaaaaagtggaaaaagacttgttgccttcccagcttcgtcatttttctgttcatcattgggtgtatcatctccgggatcaccctcctggcaatctttagagtggatcccaaacaccttacagtgaatgccgtgttgatctcaatcgcctccgtcgtggggctcgcgttcgtgctgaactgcagaacatggtggcaggtcctggactcattactgaactcacagagaaagagactgcataacgcagcctccaaacttcacaagctgaagtccgaggggttcatgaaggtgttgaaatgcgaggtggagcttatggctcgaatggctaagactatcgactccttcacacagaatcaaacacgactcgtggtcatcattgatggattggacgcatgcgagcaggataaggtcctgcagatgctggatactgtgagggtgctattttctaagggtccattcattgcaatctttgcttccgatccccacattattataaaggctattaatcagaatctaaatagtgttcttagggacagtaacatcaacggtcacgattatatgagaaacatagttcatttaccagtgttcctcaatagcagagggttgtccaacgcacgaaaatttctggtaaccagcgctacaaatggggatgtgccgtgttcagataccaccggcatccaggaagacgccgacagacgagtgagccagaacagcctgggggagatgactaagttggggtccaaaaccgctctgaaccgacgggatacatacagaagaagacagatgcagaggactatcacgagacaaatgtctttcgatctgaccaagctgctagttactgaagactggttcagcgatataagccctcagaccatgcggagactcctaaatatcgtgtctgtgaccggaaggctgctcagagctaaccagatcagttttaactgggaccggctggccagctggataaacctcacggagcagtggccctacaggacgtcttggttgatcctgtacttggaggagactgagggcattccagatcaaatgactctaaagacaatctacgagcgaatttctaagaatatccctaccaccaaggacgttgagcccctactcgaaatagatggcgacatacgcaattttgaagtgtttttgtccagcaggactcctgtccttgtggcacgggatgtgaaagtttttcttccctgtacagttaacttagaccctaagctccgggaaattatcgcagacgtccgagccgcaagagaacagattagtatcggcggtctggcttacccacctctgccgctccacgagggacccccaagagccccatccgggtactcgcagccgccttctgtgtgttcttctaccagcttcaatggccctttcgccggtggggtcgtatctccacagccccattcgtcatattactctggtatgaccgggcctcaacatcccttttataaccgtccgttttttgccccttacctctacacccctaggtactaccccggaggctcccaacatctgatctcgcgtccttcagtgaaaactagcctaccacgcgaccagaacaatggcctggaagtgatcaaagaggatgccgcagagggtctgtccagtcctacagatagcagccggggatccggacctgcaccagggcctgttgtcctcctgaactccttgaacgtagacgctgtgtgtgagaagttgaagcagattgaggggctggatcaaagcatgctgccgcagtactgcactacaattaagaaggctaatatcaatggccgagtcctggctcagtgcaatatagacgagctgaaaaaggaaatgaatatgaatttcggcgattggcatcttttcaggtctaccgtgttggaaatgcggaacgccgaatcccacgtcgtcccagaggaccctcggttccttagtgaaagttcctctggccctgcacctcacggagaacctgccagacgggcttcgcataatgagttgcctcacactgaactttcttctcagactccctatactctgaacttttcattcgaagagttgaataccttgggcctggatgagggcgcacctcggcacagcaatctatcgtggcagtctcaaacgcggaggactccaagcctttcatcactcaactcacaagattcgagtatcgagatttcgaaattaacggacaaggtgcaagctgaatatagagacgcttatcgggagtacatcgcacagatgtctcagcttgagggaggccctggttctacaactattagtggtagatcaagtccacacagcacttactacatggggcagagtagttccgggggatcaatccacagtaacctggagcaggagaagggtaaagactccgaacccaaacctgatgatgggagaaagagttttctgatgaaacggggagatgtgatcgactactcaagctctggagtgagcactaacgatgcgtcacctctggaccctattactgaggaagacgagaaatctgaccaaagcggatccaagctgctacctgggaaaaagtcgagtgaaagatccagtctctttcaaaccgacctcaagttgaaaggttcaggacttagataccaaaaactcccgagcgacgaggatgaatccggcacagaagagtcggataatacgccactgttgaaagatgacaaggatcgcaaagcggagggaaaggtggagagggtcccgaaaagccccgagcatagcgccgagcctatccggacgttcataaaggctaaggagtatcttagcgatgctctcctcgataagaaggattcaagtgactccggcgtccgatccagcgagagctcaccaaatcatagcctacacaatgaagtggcagacgatagccagctagaaaaagccaatctgattgaactggaggacgatagccactccggtaagcggggaataccacattcactttccggactgcaggacccaatcatagcacgcatgtcaatttgcagtgaggataaaaagtcacccagcgagtgttcgctgattgcaagcagcccagaagagaattggcctgcctgtcagaaggcatataatttgaacaggacgccttcgaccgtcacgctgaataacaattctgctcccgctaatcgcgcaaaccaaaattttgacgaaatggagggcatcagagaaacatcacaggtcatactgcgaccgtcctcgagtcctaacccgactacaattcagaacgagaatctcaagtctatgactcacaagcggtctcagaggagtagttacacccgactctcaaaagacccccctgagctccacgccgcagccagctctgagagcacagggttcggtgaagagcgagaatcaattctgtaa

SEQ ID NO: 50908 - DNA, 3096 bp, Artificial Sequence
  Description of Artificial Sequence: Synthetic coding sequence
atgagcgttcttatttctcagtctgttataaactatgtggaagaggagaatattcccgctttgaaggcactgctcgagaagtgtaaggacgttgatgagcgtaacgaatgtgggcaaacaccactgatgattgccgcagagcagggaaatttggagatcgttaaggaactgatcaaaaacggagccaactgtaacctggaggatctcgataactggaccgcactgatctcagcttctaaggagggccacgttcacatcgtagaggagctcttaaagtgtggcgtgaatctagaacatagggacatgggaggctggacggctctgatgtgggcgtgttacaaaggaaggacggacgttgtggagctgctactctctcacggggctaaccccagcgtgaccggtttgcaatattctgtgtatcctatcatctgggctgccggtagagggcatgctgacatagtgcatttattgctgcaaaacggggctaaggtaaactgcagcgataagtacgggaccacacccctcgtatgggctgcacgcaagggccatctggagtgtgtgaaacacctactggccatgggagccgatgtggatcaggagggggcaaactctatgacagcattgattgttgccgtgaaaggtggctacacccagagtgttaaggaaattcttaaacgcaatcctaacgtgaatcttactgataaagatgggaacacggctctgatgattgctagcaaagaaggacatactgagattgtccaggacttgttagatgcagggacctacgttaacatccctgaccgatctggggatactgtgcttattggagccgtacgcggaggacatgtggagattgttagagcgcttctacagaagtacgctgatattgatatcaggggacaggataacaaaaccgccctctattgggccgtggagaaggggaacgccaccatggttagagacattctccagtgtaatcccgataccgagatctgcacgaaagatggcgaaaccccccttatcaaggctaccaagatgaggaatattgaagtggtggagctactcctggacaaaggggctaaagtgtcggctgtagacaaaaagggggatacacccctccacatcgccattcgaggcaggtcaagaaagctggccgagttgctcttacgcaaccctaaggacggccgattgttatatcgacctaacaaggccggtgagactccttacaacatcgactgctcccatcagaaaagcatactaacccagatctttggagcacgacacttgtctccaacggagacagacggggacatgttgggatacgacctgtattcatcggcactggccgatattctaagcgagccaaccatgcagcccccaatttgtgtcggtttgtacgcccaatgggggtccggcaagagcttccttctgaaaaaattagaagatgagatgaaaacattcgcaggccagcagattgagccactgttccagttttcatggctgatcgtgttcctgaccctgcttctgtgcggcggactaggactgttgtttgcttttacagttcatcccaacctagggattgccgtttccctatcatttctagccctgctgtacattttctttatcgtgatttactttgggggaaggcgcgagggggagagttggaattgggcatgggttctgagcacccgacttgccagacacatcggttacttagagctgcttctgaaactcatgtttgtgaacccacccgaactgcccgagcagaccacgaaggcactgcccgtaaggttcttgttcaccgactacaaccgactgtccagtgtgggaggagaaacctcactagctgagatgattgccacactctccgacgcctgtgaaagggaattcgggtttctggccacaaggctgttccgggtgtttaagacagaagatactcagggcaaaaagaagtggaagaagacttgttgcctccccagcttcgtgatctttctgtttattataggatgcataatttcagggatcactttattagccattttcagggtggatcctaaacatttaactgtcaacgcggtgcttatcagcattgcctccgtggtcggacttgcatttgtattaaattgtcggacctggtggcaggtcctagattcactgctcaacagccagcgtaagcgcctccataacgctgcctctaaactacacaaattgaaaagcgagggatttatgaaagtcctgaaatgtgaagtcgaactgatggctcggatggctaagaccattgacagctttacccagaatcagacgcgccttgtggttatcattgacggactagatgcttgtgagcaggacaaagtactgcaaatgctcgacaccgtgagagttttgtttagcaagggtccattcatagcgatttttgcatctgatccccacatcatcattaaagcaatcaaccaaaatctaaactcagtgctcagagatagcaatatcaacggtcacgactacatgaggaatattgtgcacttacctgttttcctgaatagtcgtggcctcagcaacgcacgcaagttccttgttacttctgccactaacggagatgtgccttgttctgacaccacaggcatccaggaggacgcggatcggcgagttagccagaactctctcggcgagatgactaagctgggttctaagaccgccctgaaccgcagggacacgtataggcggaggcaaatgcagcgaaccatcacgcggcaaatgtcatttgatctgacaaagttgctggttactgaagactggttctctgatattagcccccaaaccatgcggaggctgctgaacattgtcagcgtcacaggtcggcttttgcgagctaatcaaatttccttcaactgggataggctggctagctggatcaacctcactgagcagtggccctaccgaacctcttggctcattctctacctagaagaaactgaaggtatccccgatcagatgaccctgaagaccatctatgagcggtgttgcggcgctgatagttgcgatagagatcgcatcggaatatccaaatccgtcctggtggcgatgctgatggagtcctag

SEQ ID NO: 50909 - DNA, 5018 bp, Artificial Sequence
  Description of Artificial Sequence: Synthetic coding sequence
atgatcgccgctgaacaaggtaatctggaaattgtgaaagaattgattaaaaacggggctaattgcaatctcgaggacttggacaactggaccgccctgatcagcgcctcaaaggaagggcacgtccatattgtcgaagaactgcttaagtgcggagtgaacttagagcacagggacatgggcggttggaccgcactcatgtgggcttgttacaaaggcaggaccgatgttgtcgaactcctgctgtcccacggggctaatccctcggtgaccggcctgtatagcgtttatcctatcatttgggctgccggacgtggccatgctgacattgtgcacttgctgctgcagaatggggctaaagttaactgctcagataaatatggcactacacccctcgtctgggccgctaggaagggacacctggaatgcgtgaagcatctgctggcaatgggtgctgacgtggaccaagaaggtgctaactctatgacggcactgattgtagcagtcaagggtgggtatacacaatctgttaaggagatcttgaagcgtaatcccaatgtcaacctgacagacaaagatggtaataccgccctcatgatcgcaagcaaggagggccatactgaaattgtacaagatttgctggatgcgggtacatacgtgaacatcccagaccgctcaggggatacggtactcatcggcgcagtgagaggaggacacgtggaaatagttcgcgcactgctccagaaatacgctgacatcgacatccgagggcaagacaataaaaccgcgttgtactgggcggtcgagaaggggaatgccacaatggtgcgggacatccttcagtgcaatccggacacagaaatctgcaccaaggacggtgagacaccattaattaaagccactaagatgcgtaatatcgaagtggtagaactcctgctggataaaggcgctaaagtgtcagcagtcgataagaaaggcgacacgcctctgcatatcgccataagggggcgaagcagaaagctagcagagctcctgctacggaacccgaaggatggtaggctcctgtaccggccaaataaggcaggagagaccccgtataatatcgactgtagccaccagaaaagcatactgacccagatattcggggctagacacttgagccccaccgagacagacggagatatgctcgggtatgacttgtactccagtgcactcgctgatatactgtcggagccaaccatgcaacccccaatctgtgtggggctctatgctcagtggggtagtggaaagagcttcctgctgaaaaaactggaagacgaaatgaagacctttgccggacaacagatcgagcctctctttcagttttcttggcttatcgttttcctcacattgctgctgtgcggagggctcgggttgctgtttgcctttaccgtgcatcccaatctcggaattgccgtgtcactctctttcctggccctgctctacattttctttattgtcatttatttcggcggacgccgtgaaggcgagtcatggaactgggcctgggtcctctcaacccggctcgctagacacattggatatctggaattactgctgaagttgatgtttgtgaacccaccagaacttcccgagcaaacaaccaaggctctgcccgtccgtttcctgtttactgattataaccggctctcgtcagttggcggtgagacctcgctggccgaaatgatcgccacactttccgacgcgtgcgaaagggaatttggctttctggccacacggttgtttcgggtctttaagaccgaggatacccagggcaagaagaaatggaaaaaaacttgctgcttgccttcatttgtgatattcctattcataatcggctgcatcattagtggaataactctcctggccatcttccgcgtcgatcctaagcacttgacagtgaatgcagtgcttataagcatagcatccgtggttggtctggccttcgtgctgaactgtcggacctggtggcaggtcttggattctctgctgaattcacagcggaagcgtctgcacaacgccgcttccaagctgcacaaactgaaatctgaaggcttcatgaaggtcctgaagtgtgaagttgaattaatggccagaatggcaaaaactattgactcatttactcaaaaccagactaggctcgtggtcatcattgacgggttggatgcctgtgaacaagacaaggtcctccagatgctggatacagtccgcgttttattttcaaagggacctttcatcgcaattttcgctagcgatccacacattataatcaaggccatcaatcagaatctaaattccgtgttacgcgactctaacattaatggacacgactacatgagaaatatagtccatcttcccgtcttcctaaattcccgaggcctctcaaatgccaggaagttcctggtgaccagtgctaccaatggggatgttccttgctccgatacgactggcatacaagaggacgccgatcgcagggtatcccagaatagcctcggagagatgaccaagctaggatctaaaactgccctcaatcggcgagatacttatcggagacgccagatgcagcgaaccatcaccagacaaatgtcctttgacctcacaaaactgcttgtcaccgaagattggttttccgatatttccccccagacaatgaggagactgctgaacattgtgagcgtgacaggtcgcttacttagggctaaccaaataagcttcaactgggaccgactggccagctggattaacctgactgagcagtggccataccggacctcatggttgatcctgtaccttgaggagactgagggcattcctgaccagatgactctgaagacaatctacgaaagaatctcgaagaatatccccactactaaggacgtcgaacctctgcttgaaatcgacggggatatccgcaacttcgaagtcttcctctcttctaggacacccgttttggtggccagggacgtgaaagttttcctcccatgtactgtaaacctggatccaaagctacgcgaaatcattgcggatgtgcgagccgcaagggaacagatttctattggaggtcttgcatatcccccattgccactccacgaaggaccaccacgtgctccgagcgggtacagtcagccaccctccgtgtgtagcagcacctcattcaacgggccattcgccggaggtgtggtatctccacagccccacagtagttactactccggcatgactggaccacagcacccattttacaatagaggcagtggacccgctcctggtcccgtcgtgctcctgaattccctgaatgtagatgctgtgtgtgaaaagttgaaacagattgaaggactggaccagagcatgctaccccagtactgcactactatcaagaaagcgaacatcaatggtagagtcttagcccagtgcaatatcgacgagctcaagaaagagatgaatatgaactttggtgactggcatctgttcagatccaccgtgttagagatgagaaacgccgagtcacatgttgtaccagaggatccacgctttctttccgaatccagctctgggccagccccacacggagagcccgctcgcagagcatctcacaacgagctcccacacaccgagctgtcctctcagacaccatatacgctgaatttcagctttgaagaactgaatacattgggcctcgatgagggagcaccacggcactctaacttgtcctggcagtctcagacaagaagaacgccctcgcttagttctcttaacagtcaggatagcagcatagaaatcagtaagctcaccgacaaggtgcaggcagaataccgcgacgcttatcgggaatatatagctcaaatgagccagctggaagggggtcctggatccacgactatctccggaagatcatcacctcacagtacgtactacatgggacagagttcatcgggtggcagtatccactcaaacctcgaacaggagaagggcaaggacagcgaacccaagccggatgatggtcgtaaatcctttctaatgaaaagaggagacgtgatcgactattccagctccggtgtgagtaccaacgatgcttcccccctggaccctatcaccgaggaggacgaaaagtctgatcagagcggcagcaaactgctgcctggtaagaaatcctcagagaggtctagcctctttcagaccgatctcaaactgaagggttcaggtctgcggtatcagaagttgccgagcgacgaggacgagtccgggaccgaggagtcagataataccccactcctgaaagacgacaaggaccgtaaggcagaaggcaaagtggagagggtgcctaagtctcccgagcacagtgccgagccaatacgcacgttcataaaggctaaggagtacctgtccgatgccctgctggacaagaaagattcctcagactccggcgtccgcagcagcgaaagctcacccaatcatagcctacataacgaagtggctgatgattcccagctggagaaagccaatctcattgagctcgaggacgacagtcacagcggtaaacgaggcatccctcatagtctgtcaggactgcaagaccccattatagctcgaatgagcatttgctcggaggataaaaaatctccctctgagtgctctctcattgcatcctcgcccgaggagaactggcctgcctgtcagaaggcctataacttgaataggactcccagcaccgttacgctcaataataactcagccccagctaacagggccaaccagaactttgacgagatggaaggcatcagagagacatctcaggtgatcctgagaccatcatcttctccaaatcccaccaccatccagaacgagaacctcaagtcgatgacccataagaggagccagcggagtagctatacgaggctgtccaaagacccgcctgagttacatgctgccgcatccagcgagagtaccggattcggagaagaaagggagagtatattgta

SEQ ID NO: 50910 - DNA, 5258 bp, Artificial Sequence
  Description of Artificial Sequence: Synthetic coding sequence
atgagcgtgttaatctcgcaaagtgtcattaattacgtcgaggaggaaaacatacccgcactgaaagcgctactggagaagtgtaaggatgtggacgagagaaatgagtgcggtcaaaccccactgatgattgccgcagagcaaggcaacctcgaaattgtgaaggagttaataaaaaacggagcaaactgcaacctagaggatttggataattggactgcgctcatcagcgctagcaaggaaggccatgtgcacatcgtggaggagctgctcaagtgtggggttaatctagagcaccgagatatgggtgggtggaccgccttgatgtgggcgtgctataagggaagaacagatgtggtcgagctcttactctcacatggcgcaaacccttccgtcacgggattgtattctgtataccctataatctgggctgccggacggggacacgcagacatcgtgcatctcctgctacaaaacggagccaaagtcaattgttcagacaaatatggaaccaccccacttgtatgggccgctaggaagggtcatcttgaatgtgtgaaacacctcctagctatgggtgccgacgtggaccaggaaggcgctaactccatgaccgctctgatagtggcagtcaaaggagggtacacacagagcgtcaaggagatcctgaagcgaaaccccaatgtgaatttgaccgataaagatggaaatactgccttgatgatagcatccaaggagggccacaccgagatagtacaggacctgctcgacgccggaacctatgtgaacattccagataggtccggcgatacagtcctcattggcgcagtgaggggtgggcatgttgagattgtcagggccttgctgcagaagtatgctgacattgatattaggggccaggacaataaaacagccctctattgggccgtggaaaagggaaacgccactatggtacgagatattctccaatgtaaccccgacaccgaaatctgcaccaaggacggggaaacccctctgatcaaagctactaagatgagaaacatcgaggtggtggagttgctgttagacaaaggggcaaaggttagcgccgtggataagaagggtgatacgccgcttcacatcgctatcagaggccgatcccgtaagctggcggaacttctgttacgcaatccaaaggatggtagactgctgtatcggcctaataaagccggtgagacaccttacaacatcgactgctctcatcagaagagcatcctcactcagatctttggtgccagacacctctcccccactgaaacagacggtgatatgctgggatacgacttgtattcctccgcccttgcagacattctcagcgaacctaccatgcaacctcctatctgcgtcggactatatgcccagtgggggtcaggtaagtcgtttcttctcaagaaactcgaggacgagatgaagactttcgctggccagcagatcgagcccctgtttcaattttcctggctgatagtattcctgactctcttgttgtgcggcggactcggcctgcttttcgcctttacagtacacccaaacttaggcatcgctgtgtccctgagctttctcgcgttactgtacatcttcttcatcgtcatatatttcgggggtagacgagagggcgagtcctggaattgggcctgggtactaagcacacgcttggccaggcatatcggctacctcgagttgttgttaaaactgatgtttgtgaatcctcctgaacttcctgaacagaccacaaaggcgctgcccgtgagattcctgttcacagactataatcgtctgagttccgtgggtggggagacatcccttgctgaaatgattgcgaccctgtcagacgcctgcgagagggaatttggctttctggctacaagactgttccgtgtgtttaaaacagaagatacacagggcaaaaaaaagtggaagaagacctgctgcttaccgtcttttgtgatcttcctttttattattggctgtatcataagcggcatcaccctgttagcaatattcagagtagatccaaagcatctgaccgtgaacgcggtcttaatctctatcgcttccgtggtgggcctggcattcgtgctgaactgtagaacctggtggcaagtgttagactccctgttaaactctcaacggaaacgcctgcacaacgctgcatccaagctgcataaactgaagtctgaaggttttatgaaagtgttgaaatgcgaagtcgagttaatggctcggatggccaagaccattgattcatttactcagaaccagaccagactggtggtcataattgatggtctggacgcctgcgagcaggacaaagtgctacagatgttggatactgtgagagtactgtttagcaagggtccattcatcgccattttcgcttctgaccctcacatcataatcaaagctattaatcagaatttgaatagtgttctgcgagattcaaacatcaatggtcacgactacatgcgtaacatcgtgcaccttcctgtgtttctcaatagccgtggattaagtaatgctcgaaaattcctggtgacatccgcaaccaatggcgatgtgccttgctcagacactacaggtatccaggaagacgcagaccggagagtaagccaaaactccttaggcgagatgaccaagctgggctcgaagactgccctcaatcgacgagatacctaccgcagaagacagatgcagcggactatcactcggcagatgtcctttgacttaaccaaactactcgttacagaggactggtttagtgatattagcccccagacaatgcgcaggctcctgaacattgtgtctgtaacgggtcgacttctgcgggctaaccagatctcatttaattgggatcgcctcgcttcgtggataaatttgaccgagcagtggccttaccgaaccagttggctgattctgtatctggaagagacagaaggtataccagatcagatgactctgaaaacgatttatgagcggatctctaagaatatccctacaactaaggatgttgagcccctattggagattgatggcgatattcggaatttcgaggtgtttctttcctccagaacaccggttctagtggctagggacgtgaaggtgttcttgccctgcacagtgaatctggatcctaagctgcgggagattattgctgacgttcgggctgctagggagcaaatttccattggcggactggcctaccccccattacctctgcacgaggggccacctcgggcaccctccggttactcccagcccccatccgtgtgcagcagtaccagctttaacggccctttcgcaggcggagtagtgagtcctcagccccactcatcctattactcgggaatgactggtcctcagcatcctttctataacagaccatttttcgcaccctatttgtatactcccaggtactacccagggggtagccaacacctgatcagccgaccaagcgtcaaaacaagtcttcctagggaccaaaataatggattggggagtgggcctgctcccggtcccgtggttctgctcaacagcctcaatgtcgatgcagtttgtgagaagcttaagcagatcgagggattagaccaatctatgctgccccaatactgcaccaccattaaaaaagccaacataaacggtcgcgtcttggcccaatgcaacattgatgagctaaaaaaggaaatgaatatgaacttcggcgactggcatctgttcagatccaccgtgctggagatgcgcaacgcggagtcccatgttgtccctgaggacccccgattcttaagtgaatcatccagtggccctgcaccccacggagagcccgctagacgcgcatctcacaatgaactaccacacaccgagttgagctctcagaccccatacactctgaatttttcctttgaagagctcaacactctcggacttgatgaaggtgcacctagacatagtaatctgtcatggcagtcccagacccgacgcactccaagtctgtcaagcttaaacagtcaagacagtagtatagagattagtaagctcacggataaggtccaggccgagtatagagacgcttaccgcgagtacattgcccagatgtcacagctggaaggcggacctggtagcaccaccatctcggggaggtcatcacctcatagtacatattatatggggcagtcatcaagtgggggaagcatccactctaacctcgaacaggaaaagggtaaagattctgagcctaaacctgatgatggcagaaagagcttcctgatgaagaggggcgacgtgatagactattcctcctcgggcgtcagcactaatgacgcgtctcctctggaccctatcacggaagaggatgaaaaatcagatcaatctggcagcaaactgctgccaggcaaaaagtcctcagagaggagttctttgttccagaccgacctcaaactgaagggcagtggattgaggtatcagaagcttcccagtgacgaggacgagtcaggtacagaagaatcagacaacactcccttgcttaaagatgacaaggatagaaaagcagaggggaaagtcgagcgagttcccaagtccccggagcattccgccgaacctattagaacatttataaaagcaaaagagtatctaagtgatgcactcctcgacaagaaggattcctctgacagcggagtccgcagctctgagagtagtccgaaccacagtctccataacgaggttgccgacgattcccagttggaaaaagcgaatctgatcgagttagaggatgactcacattccgggaaaagggggattccccattccctatctgggttgcaggaccccattatcgctaggatgagcatttgtagtgaagacaaaaaatcacctagcgaatgttcactgatcgcctcctcaccagaagagaattggcctgcttgtcaaaaggcctataacctgaaccgcacacctagcaccgtgaccctcaacaataacagtgcaccagccaacagggccaaccagaacttcgatgaaatggaggggatcagagaaacttcacaggtaattctccgaccatcctcatcccccaaccccaccactattcagaacgaaaatttgaagtctatgactcacaagaggtcccaaaggagtagttacactaggctctcaaaggatccccctgaactgcatgccgcagcctcctcggaatccactggctttggcgaagagcgagaatctatcttata

SEQ ID NO: 50911 - DNA, 5258 bp, Artificial Sequence
  Description of Artificial Sequence: Synthetic coding sequence
atgtctgtcttaattagtcagagtgtgatcaactacgtggaagaagagaacatcccagctcttaaggctttgctggagaaatgcaaggatgtcgatgagcgcaacgagtgtggccaaacacccctgatgattgcagctgagcagggaaatctggaaattgttaaggaactcattaagaatggtgcaaactgcaatctggaggatctggataactggaccgcccttataagcgccagcaaggaggggcacgtacacatcgttgaagagcttctcaaatgtggcgtgaatttggaacaccgcgacatgggtggttggacagcactgatgtgggcatgttacaaaggtaggacagatgtggtcgagctcctgctctcccacggggcaaacccaagtgtaacggggttgtactctgtgtaccccataatctgggctgctggaaggggccatgccgacatagtacatctgctgcttcagaacggggctaaagttaactgtagcgataagtatggaaccacccccctcgtgtgggccgctcgtaagggtcacctggagtgcgtgaaacatctgctggcgatgggggcagatgtggaccaggaaggggcaaatagtatgaccgctctgatagtcgcggtgaaaggtggatacactcagagcgtcaaggaaatcctgaagcgcaacccgaacgtcaacctgactgacaaagacggaaataccgctcttatgattgcctctaaagagggacataccgagatagttcaagatttgcttgacgccggaacctacgttaacatccctgatcgaagcggggataccgtgctgatcggcgctgtgcgtggcggacatgtggagatcgtccgcgctctgctgcagaagtatgcagatattgatatccggggacaagacaacaaaaccgctctctactgggccgtagaaaagggtaatgccaccatggtgagggacattcttcagtgtaaccccgatactgagatctgcacaaaggacggagagacaccattgattaaggcgactaaaatgaggaacattgaagtcgtcgagctgctactggataaaggggcaaaagtaagtgctgtagacaagaagggtgataccccgctgcatattgccatacggggacgttcgaggaagctggccgaattgttgctgcggaaccctaaggacggcaggcttctttatcgccctaacaaagcaggggagaccccgtataacattgactgttctcatcagaagagtatcctcactcaaattttcggggctcggcacctgtctccaaccgagacagatggtgacatgctggggtatgacttgtacagctcggccctcgctgacatcctgtcagaacccactatgcagcccccaatctgcgtggggctgtatgcccaatggggtagtggaaagtcatttttgctaaaaaaactcgaagatgaaatgaaaacttttgcaggacagcagatcgaacctctattccagttctcttggctgattgtgttcctcactcttcttttatgcggcggtcttggactgctttttgcttttactgtccaccccaacctggggattgctgtgtctctgtcctttttggcgctgttatatatcttcttcatcgtcatctacttcggcggacgcagagagggagagtcatggaactgggcttgggtgctctcgacgcgcctcgctcgtcacattggctacctcgaacttttactaaaactgatgtttgtgaacccacctgaactaccagagcagaccaccaaggccctgcctgttagattcttgttcaccgattacaacagactttcaagtgtcggcggtgagacttcgctggcggagatgatcgctacactgtctgatgcatgcgagagagagtttggcttcttggctacaagattatttcgggtgtttaaaacagaggacactcaaggaaagaagaagtggaaaaagacttgttgccttccttcatttgtgatttttttgtttataattgggtgcatcattagcgggataactctgctagctatattcagggttgatcccaaacacctcacagttaatgctgtgttgatctctattgctagcgtggttggcctcgcatttgtgctgaactgcagaacctggtggcaggttttagactctctgcttaacagccagcgaaagcgactccataatgcagcctccaagcttcacaagctcaagtcggaaggcttcatgaaagtcttaaaatgtgaggtagagcttatggctagaatggccaagacgattgactctttcactcagaatcagacaaggcttgttgttatcattgatggcctcgacgcttgtgagcaagataaagtcctccagatgctagatacggtgagagtgctgttttcaaaaggtccattcattgccatttttgccagtgatcctcatatcattattaaggctattaatcagaatctgaacagcgtgctgcgcgatagtaacatcaacggacacgattatatgcgcaatattgtccatctgccagtctttcttaatagccgagggttgtccaacgccaggaagtttcttgttacatccgccacgaacggggacgtcccctgctcagatacaaccggaattcaggaggatgccgataggagagtgtctcaaaacagtctaggggagatgacaaagctaggctccaaaacagcccttaatcgacgcgacacttatcgaagaagacagatgcagcggactataacacggcagatgtctttcgacctgaccaagctgctcgtgaccgaagactggttctctgacattagtccgcagacaatgcggcgactgctgaacattgtttctgtgacagggaggcttctaagagctaatcagatctccttcaactgggatcgcttggcctcgtggattaaccttacagagcaatggccttacaggacaagctggttaatcttgtatctggaggaaacagaggggatccctgaccaaatgaccctaaaaactatttatgagcggataagcaaaaatattcctactacaaaagatgttgagcctttgctggagattgatggagacattaggaactttgaagtgtttctaagcagccgcaccccagtgctggtggccagggacgtcaaagtgtttctaccctgtaccgtgaatctcgaccctaaactgagggaaatcatcgctgacgtgcgtgcagcacgggagcagatttcgattggtggcttagcttatccgcctctcccactgcacgaaggcccacctcgggcaccttctggatattcccaacccccttccgtctgtagctcaaccagtttcaatggaccatttgctggcggagtggtgtccccacagccccattcgagctattattccggtatgacgggaccacagcaccctttttacaatagaccctttttcgctccttacctgtatacccctcgctattacccagggggatcgcaacacctgatcagccgcccaagcgtgaaaacctcactccctcgggaccagaacaacggcctgggttccggcccagccccaggtcccgtggttctcctgaactcactgaatgtggacgctgtgtgcgagaaactcaaacagattgagggtcttgatcagtcaatgttgccccagtactgtactaccatcaagaaggctaatataaacggtagggtcctcgcccaatgtaatatagatgagttgaagaaagagatgaacatgaacttcggcgactggcacttgtttcggtctaccgtgcttgagatgcgaaacgctgagtctcacgtggtgcccgaggatcctaggttcctcagtgagagctcttccggcccagcccctcacggggaaccagccagacgagcaagccataatgagctgccccacaccgagctcagttcacagacgccatacactttgaacttttcttttgaggaacttaataccctgggcctcgatgaaggagccccaagacatagcaacctcagttggcagagccagactcgtcgcacaccatctctttcttccctaaactctcaggactcatccatagaaatatccaagctgaccgacaaggtacaggcagagtatcgcgacgcttacagggagtatattgcccagatgtcccaactagagggaggaccagggtcgactactatcagtggtaggtcttcacctcatagcacttactacatgggacagtcctcatcaggcggttctattcactccaacctggagcaagagaaggggaaggactccgaacctaaacccgatgatggacgcaagtcgttcctgatgaaaagaggagacgtgattgattatagcagttctggggtgagcacaaatgacgcttcccctctggaccccatcaccgaggaggatgagaagagcgatcaaagcggctcaaagcttcttccgggaaaaaaaagcagcgagcgctccagcctgtttcagactgacctgaaactgaaagggtcaggcctccgatatcagaagctgccgtctgatgaggatgagtcaggaaccgaagaaagcgacaatacgcccctacttaaggacgataaagatcgtaaagctgagggcaaggtcgagcgtgtccccaagtccccagaacactccgcagaacccatcaggacgttcataaaagccaaggaatatctttcagacgccctgttagacaagaaagacagcagcgacagcggcgtgcgtagctctgagagttccccaaaccacagtctgcataatgaggtcgcagatgacagtcagttggaaaaagccaacctcattgaactggaggacgactcgcattctggtaagaggggtattccacattcattgtccgggctgcaggaccccattatcgcaagaatgtctatctgcagtgaggataagaagtccccttccgagtgctcactgatcgcatctagccctgaagagaactggcctgcctgccagaaagcctacaatctgaatcggacccctagtacagtgaccttaaacaacaactctgcccctgctaaccgcgctaaccagaatttcgacgaaatggaagggattagagagacgtcccaggtgatactgcggccttccagttctcccaacccaacaaccattcagaatgagaacctgaaatctatgacccacaaaagaagccagcgttcttcatacacccgcctatcgaaagatccccctgaactgcatgccgctgcttcttcagagagtactgggttcggggaggaaagagagtcaattctgta

SEQ ID NO: 50912 - DNA, 2985 bp, Artificial Sequence
  Description of Artificial Sequence: Synthetic coding sequence
atggtgcgtgacatcctgcaatgtaatcccgacaccgagatatgtactaaggacggagaaacgccccttatcaaagctacaaagatgcgtaatatagaggtggtggagctgctcctggacaagggagccaaagtgagtgccgttgacaagaaaggcgacacgcccctccatattgctatacgtggtagatctcgaaagctggccgagctgttactgcggaatcctaaggacggcagactactttaccggcctaacaaggccggtgaaacgccatacaatattgattgcagtcaccagaaaagcatccttacgcagatcttcggggctagacatctctctccaactgaaacagacggcgacatgctgggttacgacttgtattccagcgctctcgctgacatcttatccgagccaactatgcagccaccaatctgcgtcgggctttacgctcagtggggcagcggaaaaagtttcctgctgaagaaacttgaagatgaaatgaaaacatttgctggccaacagattgaacctttgttccagtttagctggcttattgttttccttacgctcctgctgtgtggcggtctgggcctgctgttcgccttcacagtgcaccccaatctcgggattgccgtttccttgtctttcctcgccctcctgtacatattctttatcgtgatctactttggaggacgcagagaaggcgaatcctggaactgggcttgggttctgtccacccggctggctcgccacataggttacctcgagctcttactcaagttgatgttcgtgaatcccccagaactccccgaacaaaccacaaaggcgttgcctgtgaggttcctgttcacagactacaatcgcctgtcttcagttggcggtgaaacaagcctcgccgagatgattgcgacactgtctgatgcctgtgagcgtgagttcgggtttctggcaacacgccttttcagggtgtttaaaacggaagacacgcagggcaaaaaaaaatggaaaaagacttgctgcctaccttctttcgtgatattcttattcattatcggttgcattatctccggtatcacactactggcaatttttagagttgacccaaaacacctgacagtcaacgccgttttaattagcattgcttccgtggtgggcttggctttcgtgttgaactgcaggacttggtggcaggtcctcgactcactcttgaactcccagcgaaaacggctccacaacgcggcatccaagctacataaattgaaatccgaagggtttatgaaggtcctcaagtgcgaagtggaattgatggccaggatggctaaaaccatcgacagtttcacacagaatcagacgaggctggtagtcattatcgacgggctggacgcttgtgaacaggacaaagtcttgcagatgctggataccgtccgggtcctattcagcaaagggccattcatagctatcttcgccagcgatcctcacattatcataaaggccatcaatcaaaacctgaatagtgtgctgagagattcaaacatcaatggacatgattacatgaggaacatcgtgcacctacccgtgtttctaaacagcagggggctctccaacgccaggaagttcctcgtgacatccgccaccaatggcgatgttccatgctctgataccacgggaatccaagaagacgctgatcggagagtcagtcagaactcattaggcgagatgaccaaactggggtcaaaaaccgctctaaaccgtcgggacacctatagaaggagacagatgcagcgaaccatcacgcggcagatgtccttcgacctgactaagttgctcgtgacagaggactggttctcagacatcagtccccagacaatgcggcgactcctcaatattgtgtcagtaacaggccgtctcctgagggctaaccagatctctttcaactgggatcggctggcaagctggatcaatctgactgaacagtggccctaccggacctcatggctcatcctatacttagaagagactgagggcattccagatcagatgaccctgaagacaatctacgagagaataagcaagaatataccgaccacaaaagacgtggaaccgctactggagatcgacggagacattcgtaatttcgaggtgtttctaagctcacgcacccccgtcctggttgcacgcgacgtgaaagtgttcttgccctgcacagtgaatcttgatccgaagcttcgcgagataatcgcagatgtgcgcgcagctcgcgaacagatttccattgggggtctggcctatcctccactgcccttgcacgaagggccacccagggcacccagtggatattctcaaccaccctccgtgtgctcctcaaccagttttaatggcccatttgcaggcggtgtggtgagcccacagcctcactctagttattactcagggatgactggccctcaacatccgttctacaatcgaggctccggaccagcgcctggcccagtggtgctgcttaattccctcaacgtggacgccgtctgtgaaaagctcaagcaaatcgaaggtctggaccaaagtatgctcccacagtactgtaccacgattaaaaaggctaacatcaatggacgcgtgcttgcgcagtgcaacatcgatgagctaaaaaaagagatgaatatgaattttggcgactggcatctgttccgcagcacagtgctagagatgagaaacgcggagtctcatgtggtaccagaggaccctcgctttttatctgaaagctcctcagggccagcccctcacggagaacctgccagaagagccagccataacgagctaccacacaccgagttaagcagccagacaccttatacgttgaacttcagctttgaagagctcaatactctcggattggatgaaggcgctcccagacactctaatctctcatggcaggaagaaaatgcaggtttggagatagactcaagcagcgaggaccccgattag

SEQ ID NO: 50913 - DNA, 3954 bp, Artificial Sequence
  Description of Artificial Sequence: Synthetic coding sequence
atggcctctgttaaggtcgcggtcagagtccggccaatgaataggagagaaaaagatcttgaggcgaagtttattatccaaatggaaaaaagcaagacaactataactaacctcaaaatccctgagggagggactggtgactccggccgagagaggacaaaaacatttacttacgatttctccttttactcagccgataccaagtcacctgattacgtcagccaggagatggtattcaagaccctggggactgatgtagtgaagtcggcctttgaagggtacaacgcgtgcgtgtttgcgtatggacaaacgggatctggtaagtcttacaccatgatgggcaacagcggcgactcgggactcataccccgaatctgcgagggacttttttcgagaatcaatgagaccacccgctgggatgaggcatcgttccgcaccgaggttagctatttggagatctacaacgagagggtgagggacctgttgcggaggaagtcctccaaaacctttaaccttcgcgtcagagagcatcccaaggaggggccatacgtagaggacttaagtaaacacctagtccagaactacggagacgttgaagagctgatggatgcaggtaacatcaatcggaccacagccgctaccgggatgaatgatgtctcatcgcgaagccacgctatcttcactatcaaattcacccaagccaagtttgactcggagatgccttgcgaaacagtgtcaaagatccacctggtcgacctggcaggatcagagagggctgacgctaccggggcaacaggcgtgcggctcaaagaagggggtaacatcaataagtccttggtaacccttgggaatgtgatcagtgctctcgctgacctgtcacaggacgccgctaatactctggcaaaaaagaagcaggtgttcgtgccataccgagattctgtgcttacatggctgcttaaggactctctcggcggaaacagcaagacgatcatgatcgcaactatcagtcccgctgacgtgaattacggggagaccttgtctacactgagatatgcaaatcgcgctaaaaacatcattaacaaaccaaccattaatgaggatgccaatgtcaaactcatcagggaactcagagccgagatcgcacggttgaagactcttctcgcccagggcaatcagattgcgcttctggactctccaacagctctgtccatggaggagaaattacagcaaaacgaggcaagagtgcaggagctgaccaaggaatggacaaacaagtggaacgagacacagaacatccttaaggagcagactctggccttgagaaaggaagggatcggcgtggttctggatagcgagctgccccacctcatcgggatcgatgacgatctcttatctaccggaattattctgtaccatcttaaagagggccagacctatgtggggagagatgacgcaagcacagaacaggacattgtgctccatgggctcgatctcgagagcgaacactgcattttcgaaaacataggtggcactgtgacactcatccctttgtctggtagtcaatgcagtgtgaacggcgttcagatcgtcgaggcaacccacttgaatcaaggggcagtgatccttcttgggaggacaaacatgtttaggtttaaccatccgaaggaggccgcaaagttgcgggaaaaacggaagagtggtctattatctagcttcagtctcagtatgacagaccttagtaagtctcgtgagaacctgagtgccgtgatgctttacaatcccggactggagtttgagaggcagcagcgtgaggaattggagaaactggagtcaaaacgcaagctcatcgaagaaatggaagagaaacagaagagcgataaggcggaactggaacgcatgcagcaggaggtggagactcagcgtaaggagaccgagattgtgcagttgcaaatccggaaacaggaggagtctctcaagagacgtagctttcatattgaaaacaaactgaaagacctgctggctgaaaaagaaaagtttgaagaggagagattgcgggagcaacaagaaatcgagctgcagaagaaacgacaggaagaagagacattcctccgggtacaggaagagttgcagcgcctgaaggaattaaacaataacgagaaagcagaaaaatttcagatcttccaggaacttgatcagctgcaaaaggaaaaggacgagcagtacgccaaactcgaactggaaaagaagaggctggaagagcaggagaaggagcaggtgatgctcgtcgcgcatctggaagaacagctgagagagaaacaagagatgattcagttgctacggaggggggaagttcagtgggtggaggaggagaagagggatctggaaggtatacgggaaagcctgctcagggttaaggaggccagagccggtggcgacgaggacggggaagagctggagaaggctcagttgcgtttctttgagttcaagagaagacagcttgtgaaactcgtgaacctggaaaaagacttggtccagcagaaggatattcttaagaaggaggtccaggaggagcaggagattctggagtgcctcaaatgcgagcacgataaggaatcgcgtctgctggaaaagcatgacgaaagtgttaccgacgtcacagaggtcccacaggacttcgagaagataaagcctgtcgagtaccggcttcagtacaaagagcgtcagttgcaatacctacttcagaatcaccttcccacactgctcgaggagaaacagagagccttcgagatcctagatcgaggcccactatctctggataataccttgtatcaagttgagaaggaaatggaggagaaagaggaacagctcgctcagtatcaggctaatgccaaccagcttcagaagctgcaggctactttcgagttcactgccaatatcgctagacaagaggagaaagtgagaaaaaaagaaaaagagatccttgagtccagagaaaaacagcagagagaggctcttgagcgagcactcgcgagattggagcgacgccatagtgccctccagagacactctacccttggtatggagatagaagagcagcgacaaaagctagccagcctgaattccggctcacgagagcagtctggactgcaagcctctctggaagccgagcaggaggcactcgaaaaggaccaagaacgcttggaatatgaaatccaacaattaaaacagaaaatctatgaagtggatggagtgcagaaagaccaccacggaactttggaggggaaagtcgcatctagctcacttccagtttctgccgagaaaagccacttggtgcctctgatggatgcacgaatcaatgcttatatcgaagaggaagtccagcgaagactgcaggacctacaccgagtcatcagtgaaggctgctccaccagtgccgacaccatgaaagataacgaaaagttgcacaacggtaccatccaacgcaaactgaagtacgagcggatggtctcacgctccctgggggctaaccccgacgacctaaaagacccaatcaagatttcaatcccaaggtacgtgctgtgtggacagggcaaagacgctcactttgagtttgaggtcaaaatcaccgtactggatgagacctggaccgtgttccgcaggtactccagattcagagagatgcataagacattaaaactgaaatacgcagaacttgccgctctggagttccctcccaaaaagctctttgggaacaaagacgagcgtgttatagcggagagacggtcccatctcgaaaagtacttgagggatttcttttccgtaatgttgcaatccgcaacatcccccctacacattaacaaagtcggcctaactctgtctaagcatacaatatgcgagttttctcccttttttaaaaagggcgtcttcgactacagctcacatggaactgggtag

SEQ ID NO: 50914 - DNA, 3864 bp, Artificial Sequence
  Description of Artificial Sequence: Synthetic coding sequence
atggctagtgtcaaagtcgctgtgcgggtcaggccaatgaataggcgcgaaaaggatttggaggctaagtttattatccagatggaaaagtcaaaaacgaccattaccaatttgaagatccctgagggaggaacaggggacagcggacgggaacgcaccaagacttttacgtatgacttcagcttttattctgccgacaccaagagcccagattacgtttcacaggagatggtgtttaagacccttggcacagatgtggttaaatctgcctttgaggggtataatgcctgcgtatttgcttacggccagaccggctccgggaagagttacaccatgatgggcaacagcggggactccggcctgatcccgagaatttgcgagggcctgttctcccgaatcaacgagaccaccaggtgggatgaggcttcctttagaaccgaagtgtcctatctggagatatataacgagagagtccgggacctgctccgccgtaagtctagtaagacctttaatctccgggtgagagaacatcctaaagagggaccatatgtcgaggacctgagcaaacacttggtgcaaaactatggcgacgtggaggagcttatggatgctggtaacatcaaccgtacgaccgctgcgaccggcatgaatgacgtttcctcgcggtcccacgcaatcttcactataaagttcacacaggctaaattcgatagcgagatgccttgtgaaaccgtgagcaagatccatctggtagacctggcaggctccgagcgagctgacgccaccggggctaccggcgtgagactgaaggagggtggaaacatcaacaaaagtctagtgacactcggcaatgtgattagcgctcttgccgacttatcacaagatgccgctaatacgctggcaaagaagaaacaggtgttcgttccctatcgggattcagttcttacctggttgttgaaagatagtttaggcggtaactctaaaaccatcatgatcgcaactatcagtccggcagacgtgaattacggggagactctgtccactctacgctacgccaaccgagccaagaatattataaacaagcccacaattaatgaggacgccaacgtcaaactcatcagggagttacgagccgaaatcgctcggcttaaaactctgctggcgcagggcaaccaaatagccctccttgacagtcctactgcactgagtatggaggagaaactgcaacaaaatgaagccagggttcaggagttaaccaaggaatggacaaacaaatggaacgagactcagaacatcctgaaagagcagactttggcactgcggaaggagggaattggagtggtgctggattccgagctcccacacctaatcggcattgacgatgacctgctgagtacaggaatcattttatatcatcttaaagaagggcagacctacgtcggacgggacgatgccagtaccgaacaggacatcgtccttcacggcctggatcttgaatccgaacactgcatatttgagaacataggtggcacagtaactctcatccctctgtctggaagccagtgttccgttaacggcgtgcaaatcgtggaggcgactcatctgaatcaaggcgcagtcatactgctggggaggaccaacatgttcaggtttaatcatccaaaagaagcagccaagctgagagaaaaacggaagagcggcctgctgagcagttttagccttagtatgactgaccttagcaagagccgtgagaacctcagcgccgtgatgctgtacaatccaggcctagagttcgagagacaacagagagaagagttggagaagttagaatctaagcgcaaattaattgaagagatggaggaaaaacaaaagtcggataaggcagaactcgaaaggatgcaacaggaagtagagacgcaacggaaggaaacagaaatcgtccagctacaaatacgaaagcaggaagagtcccttaagaggcgctctttccacatagagaataagctcaaggacctgctcgccgagaaggaaaaatttgaggaagagcgcttaagagagcagcaagaaattgagctgcagaaaaaaagacaggaggaggaaacgttcctgagggtgcaggaagagctgcaacgcttgaaagagctcaataacaacgagaaggcggagaaattccagatttttcaggaattagaccagctccagaaagagaaagatgagcagtacgcgaagctcgaattggagaagaaaagactggaagagcaggagaaagagcaggtaatgctggttgcacacctggaagagcaactcagagagaagcaagaaatgattcagttgctcagacgcggagaagtgcagtgggtagaggaggaaaaacgtgaccttgagggaattagggagagcctgctgcgtgtaaaagaggcaagagcaggcggtgatgaagacggcgaggaacttgaaaaagcccaactgcgtttcttcgagtttaagaggagacagcttgtgaaattggtcaacttggaaaaggacttggtccagcagaaggacatcctaaagaaagaggtacaagaagagcaggaaatcctggagtgcttgaagtgtgaacatgataaggagagtagactgctcgagaaacacgacgaaagcgtgactgacgtgacagaagttccccaagacttcgaaaaaattaagcctgttgagtatcgccttcagtataaggagcgccaattgcagtacctactgcagaaccatctccctacactacttgaagagaaacagcgggctttcgagatcctggacagggggccactgagcctggacaacactctgtaccaggtggagaaggagatggaggaaaaggaggaacagttggcgcagtatcaggctaacgcaaatcagctacaaaagctgcaggccacctttgagtttaccgccaatattgccaggcaagaagaaaaggttaggaaaaaagagaaggaaattctggaatcccgagagaagcagcagagggaagccctggaacgggctctggcgcgtttggaacgtcgacacagcgccttacagaggcatagtacgctgggtatggaaatcgaagagcagcgccaaaaactagcatcattgaactcaggctcccgagaacagtccggcctgcaggccagcttggaagccgagcaggaggccctagaaaaggatcaggagcggttagagtacgaaatccagcaacttaaacagaaaatttatgaggtggatggggtgcagaaggatcaccatgggaccctggagggtaaagtcgcctctagttccttgccagtatcagcggagaagtcccatctggtccctcttatggatgcgaggatcaatgcatatatcgaggaagaggtacagcggagactccaagacctgcaccgggttatatccgagggatgctccacctctgcggataccatgaaagataatgagaagctgcataacggaacaatccaacgtaaactgaaatacgaacgaatggtgagccggtctcttggcgctaaccctgacgaccttaaagatcccatcaaaatcagtatacccaggtacgtgctttgcggccaaggcaaagatgcgcacttcgagtttgaggtcaagcttgccgcattagaatttccacccaaaaaactgttcgggaataaagacgagcgcgtaattgctgagcgaagatcccacctggaaaagtacctgagagactttttctccgtaatgttgcaatctgcaacaagcccactccacatcaacaaagtgggactgaccctcagtaagcacactatatgcgagttttccccgttctttaagaaaggggttttcgattactcaagccacggtactgggtag

SEQ ID NO: 50915 - DNA, 3486 bp, Artificial Sequence
  Description of Artificial Sequence: Synthetic coding sequence
atggcctctgtgaaggtggccgtacgcgtgcggcctatgaatcggcgtgagaaggatctggaggccaagtttataatccagatggagaaatctaagacaacgattacgaacctgaagatcccagaggggggaaccggggacagtggcagagaacgcacaaagacattcacatatgatttttctttttattctgccgatacaaaatcccccgattacgtgagccaggagatggtgttcaaaactctgggcaccgacgttgtgaaaagtgcattcgaaggatataacgcctgcgtgtttgcttatgggcagacgggctcagggaaaagctatactatgatgggcaatagtggcgattctggcttaataccgaggatttgcgaggggttgttcagtaggatcaacgaaactacacgctgggacgaagcgagcttccgtaccgaggtatcctatctagaaatctataacgaaagggttagggatcttctccgtagaaaaagttcaaagacttttaacctcagggtccgtgaacatcctaaggagggaccttacgtggaggacctgtctaagcacctggttcagaactacggagatgtggaggaattaatggatgccggtaacattaaccgcacaaccgcagcaacagggatgaatgacgtatccagcaggtcgcacgctattttcacaattaagttcacgcaggccaagttcgactcagagatgccttgcgaaacagtgtcgaagatacacctggttgacctcgccggtagcgagagagcagacgccaccggggctaccggagtccggctaaaggaggggggaaacatcaacaaatcccttgttacattaggcaacgttatctctgcgcttgccgatctgtctcaagacgcggcaaatacacttgccaagaagaaacaggtttttgtgccataccgcgatagcgtgctcacttggctgctgaaagactctttgggcggtaactcgaagaccattatgattgcaactatatctcctgccgacgttaattacggagagacactgtcaaccctgcgatatgcaaacagggcaaagaacattatcaacaagcctacaattaatgaggacgctaacgtcaaattgatcagagaactgcgggctgaaattgcgcgactgaagacattactcgcgcagggcaaccaaattgccctgctcgatagtcccaccgccttaagtatggaggaaaagttgcagcagaatgaagccagagttcaggaactcaccaaagaatggaccaacaagtggaatgagacacagaacattctcaaggagcaaaccttggcgcttaggaaggaggggattggcgtcgtactcgactcggagctgcctcacctgatcggcatcgacgacgatctgctgagcaccgggatcattctttatcaccttaaggaaggccagacctacgtcgggagggacgatgcatcaacagagcaggacatcgtgctccacgggttagatctcgagtctgaacactgcatattcgaaaacattggtggtacagtgaccctgatccccttgagcggatcccagtgtagcgttaatggggtgcagatagtggaagcgacccatctgaaccaaggcgcagtgattctgctgggcaggacaaacatgtttcgttttaatcacccaaaagaggcggctaaactacgcgaaaagaggaagtcgggcctcctgagctcattttcgttatctatgactgacctgtcaaagagccgagagaatctaagtgctgtgatgctctacaaccccggattggagttcgagcggcagcagagggaggagctggaaaaattagaaagcaaaaggaagctgatcgaggaaatggaagaaaagcaaaaaagcgataaggctgagctagagcggatgcagcaggaggtggaaacgcaaaggaaggagaccgaaatcgtccagctgcagatccggaagcaagaggaatccctgaagaggaggtcatttcacatcgagaacaaattgaaagatctgctcgccgagaaagagaaatttgaggaggaaagacttaaagatctagtccagcagaaagacatcctgaaaaaggaggtgcaggaggaacaggaaattcttgagtgtctgaagtgcgagcatgacaaagagagccggctgctggagaaacatgacgaatccgtcaccgatgtgaccgaagtgccccaggatttcgagaagatcaaacccgtagagtaccggttgcaatataaggaaaggcagctccaatatctattgcagaatcaccttccaacactgctagaggagaaacagagagcctttgaaattctcgacaggggacccctatcgctggataacaccctttaccaggtggagaaggaaatggaagagaaggaggagcaattggctcagtatcaggcaaatgcaaaccaactacagaagctgcaagccacctttgagtttaccgcaaatatagcaagacaagaagaaaaagttcgcaagaaagagaaggagatcctggaaagtagggaaaagcagcagcgcgaagcactggagcgcgcactcgctaggctcgagcgcagacattcggctctgcagcgtcacagcaccctcgggatggagatagaggagcagcggcaaaagctggcctctctgaattccgggtcacgggagcagagcgggctccaggcctcattggaggcagagcaggaagctttagaaaaggaccaggagagactcgagtatgagatccagcagctgaagcagaagatttatgaggtggatggtgtgcagaaagatcaccacgggaccctggagggcaaggtggcttctagcagcctaccagtcagcgccgagaaatcccacctggtcccactgatggacgctagaataaatgcctatatcgaggaagaagtgcaacgcagactgcaggacttacacagggtcatcagcgagggatgctcaacgtccgcagacacaatgaaggataacgaaaaattgcacaatggaactatacagcgcaaattgaaatatgaacgtatggtgtctagatccctgggtgccaaccctgatgacctgaaggaccctattaaaattagcatcccgaggtatgtattatgcggtcagggaaaagacgctcactttgagtttgaggtgaaaattactgtactcgatgagacttggacggtatttcgcaggtatagcaggttcagggaaatgcacaaaaccctgaaactcaaatacgccgagttggccgcactagagttccctcctaagaaattgtttgggaacaaggacgagagggttattgctgagagaaggtctcacttggagaaatatcttcgagatttcttctccgtaatgcttcagtctgcaacttcacccctgcacattaacaaggtcggcttgacattatcgaagcacactatctgcgagtttagtccattctttaaaaaaggcgtctttgattactctagccatggtaccggatag

SEQ ID NO: 50916 - DNA, 1509 bp, Artificial Sequence
  Description of Artificial Sequence: Synthetic coding sequence
atgattcagcttctgcggaggggtgaggtgcagtgggtggaagaggaaaagcgcgatcttgaggggatccgcgaaagcctgcttagggtgaaggaagccagggccggaggagatgaggatggggaggaactggaaaaagcccaattgagattcttcgagttcaagcgcagacagttggtgaagctggtgaatctggaaaaagacctggtccagcagaaggatatcttgaagaaggaagtccaagaggagcaagaaatactggagtgcttaaaatgtgagcacgacaaggagagtcgcctgctggaaaaacacgatgaatccgtcacagacgtaactgaggtgcctcaggacttcgaaaagatcaagcctgtcgaatatagactgcagtacaaagagcggcagcttcagtacttactccagaaccacttgcctactctcctcgaagagaaacaaagggcctttgagattctggaccggggacccctctccctggacaacaccctctaccaggtggaaaaggaaatggaagaaaaggaggagcagcttgcgcaatatcaggcaaatgcgaaccagttgcagaagctacaggctacatttgaattcacagccaatatagcccgacaggaggagaaggttaggaagaaagagaaggaaattcttgagtctagggagaaacagcaacgtgaggccctggagcgggcactagccagactggagcgtcggcacagcgccctgcagcggcactctactctcggaatggaaatagaagagcagcgacagaagctcgctagccttaactctggatcaagagaacagtccggcctccaagcctctttagaagccgagcaggaggctctagaaaaggaccaggaaaggctcgagtatgaaattcagcagctcaagcaaaaaatttacgaagtcgatggagtccagaaagaccatcatggaactctcgaaggaaaggtcgcttcatcttccctgcccgtaagcgctgagaaatctcatctagtcccattaatggatgcccgaattaacgcgtacatagaggaagaggtgcaaagacgtttacaagacctccatcgcgtgatcagcgagggctgttcaacttcagctgacaccatgaaagacaatgaaaaactgcacaacgggaccattcagcgcaaactaaaatacgaaattaccgttctcgacgaaacgtggaccgtgttccgtcgttactctaggtttagagaaatgcacaagacattgaagctgaagtacgcagagctggcagccctggagttccctccaaagaagctcttcgggaacaaggacgagcgggtaattgccgagcgacgatcccacctggagaagtacttgcgggatttcttctctgttatgttgcagtcggctacttcaccacttcacattaataaagtgggcctgactttaagcaagcatacaatctgtgaattctcccctttttttaagaaaggtgtcttcgattacagttctcatggaacaggttag

SEQ ID NO: 50917 - DNA, 4179 bp, Artificial Sequence
  Description of Artificial Sequence: Synthetic coding sequence
atggcttcggttaaagtcgccgtccgtgtgcgaccaatgaatcgacgtgaaaaagacctggaggccaaattcataatccagatggagaaatcaaaaacaactataacaaatttaaaaatcccggaaggtggcactggcgacagtggaagagagaggactaaaacctttacctatgacttttctttctatagcgctgataccaagagtcccgactacgttagtcaggagatggtgttcaaaactctgggaactgatgtagttaaatcagcatttgagggctataacgcatgtgtttttgcctatgggcagaccggctccggaaagtcttacaccatgatgggaaattctggcgacagtggcctgatcccaagaatatgtgaaggattattttcacgcattaacgagacgactcggtgggacgaagcgtctttccggaccgaagtatcctatctcgaaatatataatgagcgcgtgagagacctgctcaggagaaagagctccaagacctttaacctcagagtacgggagcatccaaaagaaggcccttatgtggaggatctcagcaagcatctcgtgcagaattacggcgatgtcgaagagctgatggacgctggaaacatcaatagaaccactgccgctactggtatgaacgacgtgtcttcacgatcacatgccatcttcactatcaagttcactcaggccaaatttgactccgagatgccctgtgagaccgtgtcaaaaattcatttagtcgatctggccggttccgaacgtgccgacgccactggtgctaccggcgtcaggctgaaggagggcggtaacatcaataaatccctcgtgacccttgggaatgtgatcagtgcactggccgatctgtcccaagatgccgcaaataccctggcgaagaagaaacaggtcttcgtgccctaccgggatagtgtgctcacttggcttttaaaggactcactcggagggaacagcaagaccataatgatcgctaccatctctccagccgacgtcaactacggggagaccctgtctacccttcgatacgctaacagagccaagaacattatcaataaaccaaccattaacgaggacgccaatgtgaagctgatccgggaactacgcgctgaaattgctcgcttgaaaactctactggcccagggcaatcagattgccctgctagacagtcccaccgccttgtccatggaggaaaagttacaacaaaatgaggcccgtgtgcaggagttgactaaagaatggactaataagtggaatgaaacccagaatattctgaaggagcagactctggccctcagaaaagagggcatcggggtggtgttggatagtgaattgccacaccttatcggcattgatgacgatctcctgtccacaggtattatcctctatcatctgaaagaagggcagacatatgtgggacgggatgatgcctccaccgagcaggacattgtcttgcacggcttagacctggaatcagagcactgtattttcgaaaatatcggaggaactgtcacactgatccccctttcagggtcgcagtgtagcgtgaatggcgtgcagattgtggaggccacccatctcaatcaaggggcagttatcctgctcggtcgtacaaatatgttccgattcaaccatccaaaggaagctgccaaactccgagagaaaaggaagagcgggttactgagctcattctctcttagcatgacagacctgtcaaaatctcgggagaacctttcagccgttatgctctataatcccggtctagagttcgagcggcagcaacgcgaagaactggaaaagctggagtccaaacgcaaattgatcgaagagatggaagagaaacagaaaagcgataaggccgagctcgagcggatgcaacaggaggtggagacgcagcggaaggagacagaaatcgttcagctgcagattcgaaaacaagaagagtctctgaaacgccgaagctttcatattgagaacaagctaaaagatttactggctgagaaggagaagtttgaagaggaacgccttcgtgagcaacaggaaatcgagcttcagaaaaaaagacaggaagaagagacctttctgagagttcaggaagagcttcagcggctaaaagagttgaacaacaacgaaaaagctgagaagtttcagatcttccaggagctggaccagctgcagaaggagaaagatgagcagtacgcgaagctggagctggagaaaaagcgcttggaagaacaggagaaggaacaagtgatgttagtggctcacctagaagaacagcttcgcgagaaacaggagatgatccaactgctccgtcgcggtgaggtacagtgggtggaagaggaaaagcgtgatctagaggggataagggagagccttctgcgggtcaaggaggccagggccggaggagacgaggacggcgaagaactggaaaaagcccagctgaggttttttgaatttaaacgccgacagctcgttaagctggttaatctagagaaggacctcgtgcaacagaaggatatcctcaagaaggaagtacaggaggagcaggaaattctggagtgccttaaatgcgaacacgacaaagagtctcggttgcttgaaaagcacgacgagagcgtgactgatgtgaccgaggtccctcaagactttgagaagatcaaacccgtagagtaccgtctccagtacaaagagcgccaacttcagtacctgctgcagaaccatctgccgacattactcgaggagaagcagagggcctttgaaattctcgaccggggaccactgtcgctcgacaataccctctatcaggtggagaaggagatggaggagaaagaggagcagctcgcgcagtatcaggcaaacgccaatcaattacaaaagctgcaggctacattcgaatttaccgctaatattgccaggcaggaagagaaggtcagaaagaaggagaaggaaatcttggagtctagggaaaaacagcagcgagaggctttggagagagctctcgccagactggaaaggcggcatagcgccctgcaaaggcactcaaccctgggaatggagattgaagaacaaaggcagaagctggccagtctgaactcggggtctagggaacaaagcggtctccaggccagcttagaagccgaacaagaagccttggagaaagaccaagagcgcctggagtacgagattcagcaactaaaacagaaaatttacgaggttgacggcgtgcagaaagaccaccacggtaccctggaagggaaggtggccagctccagcctcccagtatccgccgaaaagagccatctggtcccacttatggatgcgcgtatcaacgcttatattgaggaagaagtgcagcgtcgcttgcaagaccttcacagggtgatcagtgaaggttgcagcacatctgccgacacaatgaaggacaacgagaagctgcacaatggcactattcagcgaaaactgaaatatgagctgtgtcgagacctgttatgtgtcctgatgcctgagcctgacgccgcagcgtgcgctaatcacccactcctgcagcaggatctggtgcagctgtctttggattggaagactgagatccctgatcttgtgctgccaaatggagtgcaggtaagctcaaaattccaaaccacactcgtggacatgatatacttccttcatgggaatatggaggtgaacgttccctccctcgcagaggtgcagctgctgctctataccactgttaaggtgatgggtgacagcggacacgaccagtgccagtcactcgtgctgcttaatacccacatcgctctcgtgaaagaagactgcgttttttatcctagaattcgctcacgaaacattccccctccaggtgcgcaattcgatgttattaagtgccacgccctctcagagtttaggtgtgtagtggttcccgaaaagaaaaatgtctcgacggtagaactcgtctttttgcaaaagctcaagccatcagttggaagcaggaatagccctccagagcacttgcaggaggcccctaatgtccagctcttcactaccccactgtacctgcagggttcccaaaatgtggcccctgaggtgtggaaactgactttcaactcccaggatgaagcgttatggctgatttcacatctaacacgcctttag

SEQ ID NO: 50918 - DNA, 2697 bp, Artificial Sequence
  Description of Artificial Sequence: Synthetic coding sequence
atgagtgtcaccgaggaagacctctgccatcatatgaaagtcgtggtgcgggtgcggccagaaaacaccaaggagaaagcggctgggtttcacaaggtcgtccacgtggtcgacaagcatatactcgtatttgatcctaagcaggaagaagttagttttttccatggaaagaagaccacaaatcaaaatgtaatcaaaaagcagaataaggatttgaaattcgtgttcgacgcagtgttcgatgagaccagcacacagtcagaggtattcgaacacaccaccaaacccattttaaggtcattcctgaacggatacaattgtacagtgcttgcttacggggctaccggagctggcaaaactcacacaatgctcgggtcagcagatgaacccggagtcatgtatctgactatgcttcacttgtacaagtgtatggatgaaattaaagaagagaagatctgttcgaccgcggtgagctatctcgaagtatacaatgaacaaatccgagacttgctggtgaatagtggacccctcgctgtgcgcgaggatactcagaagggtgtggttgtgcacgggctgactttgcaccagcctaaatcttccgaggagatcctgcacctgttggacaacgggaataagaaccggacccagcatcccactgatatgaatgctaccagttcacggtcccatgcggtatttcagatctatctgcgacagcaggataagactgcttccatcaaccagaatgtgagaatagccaagatgtctctcattgatttagcgggttctgaaagagccagcacgtctggagcaaagggcaccaggtttgtggagggtactaacattaatagatccctgctcgcgctcggtaacgtaattaacgcccttgctgactctaaacgcaagaatcagcacattccatacagaaattctaagctgacgcggctgttgaaggacagcctcgggggtaactgccagacaataatgattgctgccgtgagcccctccagtgtgttctatgatgatacctacaataccctcaaatacgccaatagagctaaggatatcaaaagctcactcaaatccaatgtgctgaacgtgaacaaccatatcacccagtacgtcaagatctgtaacgagcagaaggccgaaattctcctgctgaaagaaaagctgaaggcctacgaagagcagaaagctttcactaatgagaatgatcaggccaagctgatgatcagtaatcctcaagagaaagaaattgagcggtttcaggaaatactgaactgcctgttccagaacagagaggagatcagacaagagtacctcaagctggaaatgctccttaaagagaacgaactgaagtccttttaccagcagcagtgtcacaaacaaatcgagatgatgtgtagcgaggataaggtggagaaggccacagggaagcgcgatcatcgcttggcgatgctcaaaaccaggagaagttacctcgaaaaaaggcgcgaagaggaactcaagcagtttgacgaaaacacaaattggttgcatcgcgtggagaaggaaatgggcctgcttagccagaatggccacatccccaaggagctgaagaaggatcttcactgtcaccatctgcacttacagaacaaggacctaaaagcccagatcaggcacatgatggacctcgcctgcctgcaagagcagcagcacagacagacagaagctgtgttaaatgccctgttgcccaccctgcgaaagcaatattgtactctcaaggaggctggcctcagcaacgcagcgttcgagtctgacttcaaagaaatcgagcatttagtggagcggaaaaaagtggtggtgtgggcagatcagactgccgaacagcctaaacaaaatgatcttcccggtatttctgtcctcatgaccttcccacagcttggaccagttcagccgatcccctgttgctcctcatccggaggaaccaatctggtgaagatcccaaccgagaagaggactaggcgcaagttaatgccctcgcctctaaaaggccagcacacactcaaaagccctccgagccaaagcgtgcagttgaatgacagcctaagcaaggagttgcagccaatcgtctacaccccagaggattgtaggaaggcttttcagaacccttctaccgttaccctgatgaagccttcctcattcaccacaagttttcaggctattagctcaaacataaactcagataattgcctgaaaatgttatgcgaggtggccatcccccacaaccgacgcaaagaatgcggccaggaggaccttgactccacctttacaatttgtgaggacattaaaagctccaagtgcaagctcccagaacaggagtccctgcccaatgataataaggacattttacagcggcttgacccaagcagtttctccacaaagcattccatgcctgtgccaagcatggtccctagttacatggccatgaccacagcagcaaagcggaagaggaagctgacctcaagtactagtaatagcagtctgaccgctgatgtgaactcaggattcgccaagagagtgcgccaagataacagtagtgagaagcaccttcaggagaataaacctacaatggagcacaaacgcaatatatgcaagattaacccatccatggtccgaaaattcggaagaaatatttcaaagggtaacctcaggtag

SEQ ID NO: 50919 - DNA, 1479 bp, Artificial Sequence
  Description of Artificial Sequence: Synthetic coding sequence
atggccccacctgctgcaaggctagctctgcttagcgccgctgcccttacccttgcagcgagacccgcacccagccctggcctcggcccagggcctgagtgtttcactgccaatggcgctgattatcgcggaacacagaactggacagcacttcagggcggaaagccatgtctcttctggaacgaaacttttcagcatccttataacacgctgaagtatccgaatggagaaggcggactgggcgagcacaattattgtcgcaaccccgatggcgatgtttccccctggtgttatgtggcagaacacgaggatggagtgtattggaaatactgcgagatcccagcatgccagatgcccggaaacctcggttgttacaaagaccatggcaaccccccacctctcacaggaacatcaaaaacctcaaataagctaacaatccaaacatgcatcagcttttgccggtcacaaaggttcaagttcgccggtatggaaagcggctacgcttgcttctgcggtaataaccccgattactggaaatacggagaggccgctagtaccgagtgcaacagtgtctgtttcggcgaccacacgcagccatgcggcggagatggtcgcatcatcctgttcgacacgcttgttggcgcatgcggcggaaattattccgcaatgtcctctgttgtctattctccagattttccagacacctatgccaccgggagggtctgctattggaccatccgcgtccccggagcctcacatattcatttctcttttcccctcttcgatattcgcgattctgccgatatggtggagctcttggatggatacacacaccgggtgcttgcgcgattccacgggcgaagtcgaccaccactttctttcaatgttagcctggacttcgtcattctatatttttttagcgaccgtatcaaccaagcccaggggttcgcagtactataccaagcagtgaaggaggagctgccacaagagcgcccagccgtcaaccagacagttgccgaggtcataactgagcaggctaacctaagcgtttccgccgctaggagcagtaaagtgctgtacgtgattaccacatcaccttcacacccaccgcaaaccgtgcccggtagtaattcttgggcccctccaatgggagcagggagccatagggtagagggctggaccgtctacggactggcgacactactgatcctgaccgtcaccgccattgtcgccaagatactgctgcatgtaacatttaagtcccaccgtgtgcctgcttcaggtgacctgcgggactgccaccaacctggaacctccggcgaaatctggagtatcttttacaagccctcaacgagtatttcaatctttaagaagaaacttaaagggcaatcgcagcaggacgatagaaatccgctcgccattcaggactctgaagtgacctcattaatatggtcccagggtcaacctagaagcatttag

SEQ ID NO: 50920 - DNA, 1377 bp, Artificial Sequence
  Description of Artificial Sequence: Synthetic coding sequence
atggcaccccctgcagctcggctggcgttgctgagtgcggcagctcttactctggccgcacggcctgcaccttccccaggactaggacccggtcccgaatgcttcactgctaacggcgctgactacagaggaacccaaaattggactgctcttcagggaggaaaaccatgtctgttctggaacgagaccttccagcacccctataacacactgaagtacccaaatggtgagggaggcttaggagagcacaactactgcaggaatcccgacggagatgttagtccatggtgctacgtggccgaacacgaggatggagtctactggaagtattgtgagatacctgcttgccagatgcctggaaacttgggatgctataaggaccatggaaacccaccaccattgaccggaactagtaaaacctcgaataagctgacaatccagacctgcatcagcttctgccggagccagcggttcaagtttgcaggcatggaatcaggatatgcctgtttctgtggtaataatcccgattactggaagtatggggaagccgcaagcacagagtgtaatagtgtatgctttggagaccatacccaaccctgcggcggtgatggcagaatcatactttttgatacactggtgggggcatgtggcggaaactattctgccatgtcgtcggttgtttacagccctgacttcccagatacttatgcaactggcagagtttgttactggactatccgggtaccaggggctagccacatacatttctcgttcccactatttgacataagagacagcgccgatatggtagagttactcgacgggtacacgcaccgggtgctggccagattccacgggaggtccagaccacctctgtcctttaacgtctctctcgacttcgttatcctgtatttttttagcgatcggataaaccaagctcaggggttcgccgtgttgtaccaagccgtgaaagaggagctaccacaggaacgtcccgctgtcaatcaaaccgtcgcggaggtaattaccgaacaagccaacctgagtgtgtcagccgctcgcagttcgaaggtgttgtatgttattacaacatccccttcccacccccctcaaactgtcccaggatggaccgtgtacggcctcgccacgttgctgattttaaccgtcacagccatcgtggcaaaaattttattacatgtgacttttaaatcacatcgagtgccagcgagcggggacctgcgagactgtcaccagcctggaacgagcggcgagatatggagcattttttacaagccctcaacatctatttccatcttcaaaaaaaagctgaagggccagagccagcaggacgaccgtaatccactggtgtcagattag

SEQ ID NO: 50921 - DNA, 1428 bp, Artificial Sequence
  Description of Artificial Sequence: Synthetic coding sequence
atggcccctccggctgctagacttgccctgcttagcgctgcagcactgacactggccgcaagaccagcacctagccctggcttaggcccagggccagagtgtttcaccgcaaacggagctgattatcgcggaacccagaactggactgcacttcagggtggaaagccatgccttttctggaatgagacctttcagcacccctacaacactttgaagtaccctaacggcgagggagggctgggcgagcacaactactgccgcaatccagacggcgatgtatctccttggtgttatgtagcggagcatgaagatggggtgtactggaaatattgtgagattcccgcatgccagatgcccggtaacctgggatgttataaggatcacgggaatcccccaccactgaccggcactagcaaaacaagtaacaaactgaccattcagacatgcatttccttttgtcgtagccagcggtttaagtttgccggtatggaatccggctatgcctgtttttgcgggaataaccctgactattggaaatacggcgaggccgcttccactgagtgcaactctgtgtgctttggggaccatacgcagccatgcggcggagacggtcgaataattctctttgatactctggtcggggcttgcggtgggaactattccgcgatgagctccgtggtctactctcctgactttcccgacacgtatgccaccggccgagtttgctattggacaatccgggtcccaggtgcctcacacatccatttctcattcccactgtttgatatcagggattccgcggatatggtcgagctgctggacgggtatacgcatcgcgttctcgccagatttcacggcagatcgcgccctcctctatcctttaacgtctcactggattttgtcatcctttactttttctccgatcgcatcaaccaggcccaggggtttgccgtgctgtaccaggcggtgaaagaggagttaccgcaggaacgccctgctgtgaaccagacagtcgccgaagttatcaccgagcaagccaacctgtctgtcagcgccgcacgaagtagcaaggtgctctacgtcatcacaacaagcccttcacacccccctcagaccgtgcccggtagtaattcttgggccccacctatgggcgctggatcacaccgcgttgaaggctggacagtgtacggcctagctaccctgctaatactgacagtgaccgcgattgtggcaaagatccttctgcacgtcactttcaagtcccaccgagtgcccgcatccggagatttaagagactgccatcagccaggtacctcgggtgagatatggtcgatcttctacaagccctctactagcattagtatatttaaaaaaaaactcaaagggcagagtcagcaggacgataggaatcctctggtgtctgactag

SEQ ID NO: 50922 - DNA, 1422 bp, Artificial Sequence
  Description of Artificial Sequence: Synthetic coding sequence
atggcaccacccgctgcacgattggctcttctgagcgcggctgctctcactctggccgcacggcctgcgccatctccaggcctgggccctgagtgcttcactgccaatggcgcagactaccgaggcacccagaattggaccgcattgcagggtgggaaaccctgtctcttctggaacgagacgtttcagcatccctacaatacactgaagtacccaaatggagagggaggcctcggcgagcacaactattgtaggaacccagacggcgacgtatccccatggtgttatgtggccgagcacgaagacggcgtgtattggaagtattgtgagatccccgcatgtcagatgcctggaaatcttggatgctacaaggatcatggaaatccgcctcccctgaccggcactagtaagacttcaaataagctcacaatccaaacctgtatctctttttgccgaagccagagattcaagttcgctggcatggagagtgggtacgcatgcttctgcggaaataatcctgactactggaagtatggggaagctgcatctaccgagtgcaactctgtatgttttggagaccatacgcagccgtgcggcggagatggtcggatcattctgttcgatacactagtaggcgcttgcgggggaaattacagcgccatgtccagcgtggtttatagccccgacttcccagatacctatgccacgggtcgagtgtgctattggacaattagggttcccggtgcttcccacatccatttttcatttccactatttgatatcagagatagcgccgacatggtggagctgttggacggctatacacatagagtgctagcccgatttcacggcagatcacgacctcctttgtcattcaacgttagccttgatttcgttatcctgtacttcttcagtgatcgcataaaccaggctcagggcttcgcagtgttgtatcaagcagtcaaagaggaactaccccaggaaaggccagcagtgaaccagaccgtcgcagaagtgatcactgagcaagctaatctgtccgtatctgcagcacgatctagcaaggtcctttacgtaatcacaactagtcccagtcacccgcctcagactgtgcctggaagcaattcctgggcaccccctatgggcgcaggctcgcaccgggtcgaagggtggaccgtgtatggcctcgccacattactgatcctgactgttacagctattgtcgccaaaatcctcctccatgttactttcaagtcccaccgtgtaccagccagcggagacttgagagactgccatcagccaggaacaagcggggagatatggagcattttctataagccctccacaagcattagcatctttaagaaaaagcttaaaggccaaagccagcaagatgatagaaatcctctcgttagtgactag

SEQ ID NO: 50923 - DNA, 867 bp, Artificial Sequence
  Description of Artificial Sequence: Synthetic coding sequence
atggccgctgtgttacagcgggtcgaacgcttgagtaacagggttgtgagggtactcggctgcaacccagggcctatgacactgcaaggcaccaacacctacctggtcgggacaggcccacggaggattctgattgatacaggggagccagcaattcctgagtatatctcatgtttgaagcaggcactgacagagtttaacaccgccatacaggagatagtggtgactcactggcaccgtgaccactccggtggtatcggggacatttgcaaatctatcaataacgacactacgtattgtatcaagaaacttccaaggaatcctcagagggaagaaataataggcaacggtgaacagcagtacgtctacctgaaagacggagatgtgatcaagacagagggggcaactctgcgggtcctgtatactcccggtcacaccgatgaccatatggctcttttgctcgaggaggagaatgcaattttttccggagactgtatcctcggcgaggggaccaccgtcttcgaggacctttatgattacatgaattcccttaaggagttgcttaagattaaagcagatatcatttacccgggtcatggcccagttattcataacgctgaggctaagatacagcaatacatttcgcaccgcaacatcagagagcagcaaattctgacactttttagagaaaatttcgagaagtccttcacagtcatggaactggtgaaaattatttacaaaaatacacccgaaaacttgcatgagatggcgaaacacaatctcctcctccatctgaagaagctggaaaaggagggtaaaattttctctaacacagatcctgataaaaagtggaaggcacacttatag

SEQ ID NO: 50924 - DNA, 867 bp, Artificial Sequence
  Description of Artificial Sequence: Synthetic coding sequence
atggctgccgtactccagcgggtggaacgtcttagcaatagggtggtgagggtgcttggctgcaacccaggccctatgactctccagggtacaaacacctacctggtggggactggcccacgaagaatcctgatcgacacgggggaacctgcaattcccgaatacattagttgcctgaagcaggccctgaccgaattcaacaccgccatccaggagatcgtagtaacacattggcatagggaccactcagggggtataggggacatctgtaagagcattaacaatgataccacttactgtatcaaaaaactgccacgaaacccccaaagagaggagattattggcaatggggaacagcagtacgtttatctcaaggatggggatgtgattaaaacagaaggggcaacgctccgggttctgtacacacccggacatacggatgatcacatggccctactgttggaggaggagaacgccatcttcagcggagattgtattttaggcgaagggacaaccgtatttgaagatttgtacgactacatgaacagccttaaggaactactcaagataaaggctgacataatttaccctggccatggcccagtgatccacaatgctgaggccaagattcagcagtacatttcgcacaggaatatcagggaacagcagatactaacattatttagagaaaactttgaaaaaagttttacagtcatggagctcgtgaagatcatatataagaacactccagagaatctccacgagatggctaagcataacttgttgttacatttgaaaaagctggagaaagaaggcaagattttcagtaatacagatccggacaaaaagtggaaagcccatctttag

SEQ ID NO: 50925 - DNA, 1704 bp, Artificial Sequence
  Description of Artificial Sequence: Synthetic coding sequence
atgaagccggtgtgggtagcgacactcttgtggatgctgctccttgttcctcgacttggcgctgccagaaagggaagccccgaagaagcctccttctattatggcaccttccctctgggcttctcttggggcgtcggctcatcagcctaccagaccgagggggcatgggaccaggacggtaagggaccctcgatttgggatgttttcacacattcagggaagggcaaagtgcttgggaacgaaactgcagatgttgcatgtgacggatactacaaagtacaggaggacataattttgctgagagagctgcatgtcaatcactaccgattttctttatcatggccacggttgcttcctacaggcatacgcgcagaacaggtcaacaagaaggggattgagttttactcagacctgatcgacgccttgctttcctccaacatcacaccaatcgtgactctgcatcactgggaccttccccaactccttcaggtcaagtacggtggttggcaaaacgtgtcaatggcaaattatttcagggactacgctaatctgtgtttcgaggcattcggcgatcgagtgaaacattggatcactttcagcgatcccagggctatggcagagaaggggtatgaaaccggccatcacgcccctggactgaaactgcggggaaccggcctctataaagccgctcaccacatcatcaaagcacacgctaaggcttggcactcctataataccacctggaggtcaaagcaacaggggctggtgggaataagcctgaattgtgactggggggaacccgttgatatctcaaacccgaaggatctggaagcggcagaacgatatctccagttctgtttgggctggttcgctaatcccatctatgctggggattaccctcaggtaatgaaggactatatagggcgtaagagcgcagagcaaggtcttgagatgagcagattgcccgtatttagtctgcaggagaaaagttacattaagggtacatccgacttcctgggccttgggcactttactacccgttacataactgaaaggaactatccttcccgacagggtccttcataccaaaatgaccgcgacctgatcgaactggtggaccccaactggcccgatcttgggagcaagtggctctactcggtgccatgggggtttagacggctgcttaactttgcacagacccagtatggtgacccacctatctatgtgatggagaacggcgcttcacagaaatttcactgtacccagctgtgcgacgagtggcggattcaatatctgaagggttatataaacgaaatgctgaaagctatcaaagatggcgcaaacataaaaggctacacctcctggagtctcctggacaagtttgagtgggaaaaaggctactccgaccggtacgggttctactacgtggaattcaacgatcgaaacaaacctagataccctaaggcgtccgttcagtactacaaaaaaattatcatcgcaaacgggtttcctaacccacgcgaggtagaaagctggtatctaaaggccctggagacatgcagcattaataaccaaatgctcgctgccgaaccactcctctcccacatgcagatggtgacggagatcgtggtacctaccgtgtgttccctatgcgtgcttattacggccgtgctgctgatgctcctcctcagaaggcagtcttag

SEQ ID NO: 50926 - DNA, 1185 bp, Artificial Sequence
  Description of Artificial Sequence: Synthetic coding sequence
atggctaactacttccgggactatgcgaacttgtgtttcgaagcctttggtgaccgcgtcaaacactggattacattttctgacccacgggcaatggctgaaaaggggtacgagaccgggcaccacgcaccgggtctaaagctgaggggaactggcctgtataaggccgcacaccacattatcaaagcacacgcgaaagcttggcactcatacaataccacctggcggtctaaacagcagggactcgtggggattagtcttaactgcgactggggcgagcccgttgatatcagtaatccaaaggatttagaggccgctgagaggtaccttcagttctgtcttggttggtttgctaatccaatatacgcgggagactacccccaggtaatgaaagattacatcggcagaaagtcggcagagcagggcctggaaatgagtcggttgcctgtgtttagccttcaggagaaatcttacattaaaggcacttctgattttctgggattgggacactttacaaccaggtatataactgaacgcaattacccttccaggcaggggcctagttaccagaacgaccgcgatcttatcgaactggtggacccgaattggccagacctggggtccaagtggctttattctgtcccttggggcttcaggagactgctgaatttcgcccaaacgcagtacggagatccacctatatatgtgatggagaacggggctagtcaaaagtttcattgtactcaactgtgcgatgagtggaggattcagtatctcaagggctacattaatgaaatgctgaaggccatcaaggatggggctaacatcaaggggtacactagctggagcctcctggacaagtttgaatgggagaaggggtattctgaccgttacggcttctactacgtggaattcaacgatcggaacaaaccgagatacccgaaggcttctgtccagtactataaaaagataattattgccaacgggtttcctaatcctcgagaagtagagtcgtggtacctgaaagcgctagaaacatgctccataaataaccagatgctcgcggctgagcctcttctcagtcatatgcagatggtaactgaaatcgtcgttcctactgtttgtagtttatgtgtgttaattaccgcggtcctcctcatgttgctacttcgacgccaatcctag

SEQ ID NO: 50927 - DNA, 1446 bp, Artificial Sequence
  Description of Artificial Sequence: Synthetic coding sequence
atggctgcctcatggagcctgcttgtgacactgcgccctctcgcccagagccctttgagaggccgttgcgtcgggtgcggcgcttgggcagcagctctggcccctttggctactgccccagggaagcccttctggaaagcatatactgtgcaaacctccgaatctatgacacctactgctactagtgagacttacttgaaagctctggcagtgtgtcacgggcctctagatcactacgattttttgattaaagcccacgagttgaaggacgacgagcatcaacgtagagtgatacaatgcctacagaagctgcacgaagaccttaaaggttataacatcgaagccgaaggactcttctctaaactatttagtaggtccaaacctcccagggggttgtatgtttatggggatgtgggcaccggaaagactatggtcatggacatgttctatgcgtatgtggagatgaagaggaaaaaacgtgttcactttcacggttttatgctcgacgtacacaagcggatccaccggctgaagcagtccctcccgaaaagaaagccgggattcatggccaaaagctacgaccccattgccccaatcgccgaggaaataagtgaggaggcctgcctcctctgtttcgacgaatttcaagtaacagacattgctgatgctatgattctgaaacaactgttcgagaacctattcaagaatggagttgtggtcgtagccaccagtaatagaccaccggaggatttatataaaaacggcctacagagggcaaacttcgtgccatttattgcagtcctgaaggagtactgcaacacagtccaacttgactctgggatcgactataggaaacgtgagctcccggctgctgggaaattatactatctgacgtccgaagccgacgtggaggccgtaatggataaactgttcgatgagctggcccagaaacaaaatgatcttacgagacccaggatcttaaaggtgcaaggaagagaactgcgactgaataaggcttgtggcaccgtggcagattgcaccttcgaggaactctgcgaaaggccgctgggggctagcgattacttagagttgtccaagaacttcgatacaatcttcctccggaacatcccccagttcaccttagcaaaccgcactcaggggagaaggtttatcacactcattgacaatttctatgacctgaaggtgcgcataatatgtagtgcctcaactccaatttcaagcctatttctgcaccagcatcacgactctgaactagagcagagcagaattttgatggatgacttggggctttctcaagattccgctgaggggctctctatgtttacaggcgaagaggagattttcgccttccagcggacgatttccaggcttaccgagatgcagactgagcagtactggaatgaaggtgatcggacaaaaaaatag

SEQ ID NO: 50928 - DNA, 486 bp, Artificial Sequence
  Description of Artificial Sequence: Synthetic coding sequence
atggggtgctgctacagtagcgagaatgaagactcagatcaggaccgggaggaacggaagctcctcctagaccctagctccccccctacgaaggccctcaatggcgcagaacccaactatcacagcctgcccagtgctaggaccgacgagcaggctctcctctcgtcaatcttggctaagactgcctccaacatcattgatgtgagcgccgcagactcccaagggatggaacagcacgaatacatggacagggcgagacaatattctaccaggctggctgtccttagtagtagcctgacccattggaagaagcttccccctcttccatctctcacctctcaaccacaccaggttctggctagcgaacctatccccttttccgacttgcagcaggtgtccagaattgccgcatatgcatactccgcactttcacagattcgtgttgacgctaaagaggagttagtcgtgcagtttggaattccctag

SEQ ID NO: 50929 - DNA, 453 bp, Artificial Sequence
  Description of Artificial Sequence: Synthetic coding sequence
atgctccggccaaaagctttaacccaggtgctctcgcaggctaacacgggcggagtgcagagcaccctcctgttgaacaatgaggggtccctactggcttactccggctacggagacacggatgccagagttaccgcggctatcgcgtctaacatctgggcggcttacgacagaaacggtaaccaggcttttaacgaggataaccttaagtttatcctcatggattgtatggaaggtagagtcgctattaccagagtcgcaaacttgctgctttgcatgtatgcgaaagagaccgtggggttcggtatgctgaaggcaaaggccgtgtgtggcacggacctgtgcagccctagcgcgggtcccggattcggcgctgtgccaggaggcgcaccccatcccagcgggggaatcctcacagccctcgtggaggccggtgtgcgtaaagaaaaatag

SEQ ID NO: 50930 - DNA, 288 bp, Artificial Sequence
  Description of Artificial Sequence: Synthetic coding sequence
atgctgagacccaaagctctcacccaagtgctttctcaggcaaacaccggtggcgtccagagtaccctgctgcttaataacgagggctccctgcttgcgtactcaggatacggagacactgacgccagggttaccgcggctattgctagtaacatttgggcagcctatgaccggaacgggaaccaagcatttaacgaggacaatttgaagtttatcctgatggattgcatggctcaggcattggtccagtatctcgaggagcctctgacacaggtagcagcaagctag

SEQ ID NO: 50931 - DNA, 378 bp, Artificial Sequence
  Description of Artificial Sequence: Synthetic coding sequence
atgctccgtcctaaggctttgactcaggtgctcagccaggcgaatacaggaggcgttcaaagcactctcctccttaacaatgaaggttccctgcttgcctatagcggttacggggacaccgacgcccgagtaacagcagctattgcgagcaatatttgggcagcctacgacagaaatgggaaccaggctttcaatgaggataatttgaaattcatactgatggactgtatggagggtcgggtggccatcacgcgcgtcgcaaacctcctgctatgcatgtatgcgaaggagaccgtgggctttgggatgttaaaggccaaggcgcaggctctcgtgcagtatcttgaagagccactaacgcaggtagccgctagctag

SEQ ID NO: 50932 - DNA, 375 bp, Artificial Sequence
  Description of Artificial Sequence: Synthetic coding sequence
atggctgatgacctgaagaggttcctttataagaaactgcccagcgtggagggactgcacgcaattgtggtgtcagaccgggatggcgtacccgttattaaagtggccaatgacaatgccccagagcacgccctgcgcccaggtttccttagtaccttcgcattggccactgatcaggggagcaagcttgggctgtctaagaataaatcaattatctgctattataacacataccaggtagtacagtttaatagactccccttggtggtctcattcatcgcctctagttcagcgaacaccggtctgattgtgtccctagaaaaagaattggctcctctgtttgaagaactcagacaagtggtggaggtcagctag

SEQ ID NO: 50933 - DNA, 4425 bp, Artificial Sequence
  Description of Artificial Sequence: Synthetic coding sequence
atggccaggttggctgccgtattgtggaatctgtgcgtgaccgcagtactggtgactagcgcaactcagggtttaagccgcgcaggcctgccatttggtctcatgcgtagggaattagcgtgtgaaggataccccattgagctgaggtgcccagggtcagacgttattatggtagagaatgccaactatggcaggaccgatgataaaatttgtgacgctgacccgtttcaaatggaaaatgtccagtgttatctccccgatgcctttaagattatgtctcagcgatgtaataaccggactcagtgcgtcgtggtggccggtagcgacgcatttccggatccatgtcctggcacctacaagtacctggaggtgcagtatgactgcgtgccctataaggtcgaacagaaagtgtttgtgtgtccaggcactctgcagaaagtcctggagccgactagtacccatgaaagcgagcatcaaagtggcgcttggtgtaaggatcccctccaggcgggtgaccgcatatacgtcatgccttggattccttaccgaaccgacactttgacagaatatgcctcctgggaggactacgtggccgcacgtcacacgacgacatatcgtttgccgaatcgagtggacggcacaggctttgtcgtgtacgacggagccgtgttctacaataaagagcgaacacgcaacatcgtgaagtacgacctcaggaccagaatcaaaagtggcgaaactgtcatcaacacagctaattaccacgatacctctccctacagatggggtggcaagacagatatagacctggcagtggacgagaacggcctgtgggtgatctacgcgaccgaggggaataacgggagactggtggtgtctcagcttaatccatacacacttcgattcgagggaacatgggaaacaggatacgacaagcggtcggctagcaatgcctttatggtttgtggagttttgtacgtgttgaggtcagtgtatgtcgatgacgattcggaagccgctgggaacagggtcgattacgcattcaatactaatgccaatagggaagaacccgttagcctgacgttccctaacccataccagtttatatcctcagtcgattataacccgagagacaatcagctgtacgtatggaataactattttgtggtgaggtatagtctcgaatttgggccacccgacccgtcggctggccctgccacttctccccctctgtctaccactaccaccgcaaggcctacacctctcacaagcaccgcaagccctgcggcaaccactcccctcagacgagccccactcaccacccacccagtgggggcaataaaccagctgggaccagacctcccccctgcaactgctccggtgcccagtaccagacggcctccggcaccaaacttgcatgtgtctcccgagctgttttgtgagccaagagaggtccggcgagttcagtggccagccacccaacagggcatgctggtcgaaagaccatgtcccaaaggaaccagaggcattgccagctttcaatgcctgcctgccctggggctttggaaccctcgtggcccagacctctccaattgtacaagcccctgggtaaatcaggtggctcagaagatcaagagcggggagaatgccgctaatattgccagcgagctggctcggcatactagaggctctatctacgctggtgacgtgtcatcttcggtcaagctgatggagcagcttctggacatattggacgctcaactgcaagctctgcgcccaatcgagcgagagagtgcgggtaaaaactacaataaaatgcacaagcgtgagcggacttgcaaagactatatcaaggcagtcgtggagacagtcgataatctgctgcgccctgaagccctggagtcctggaaggatatgaacgccactgagcaggtgcacacagctacgatgctcctagatgtccttgaggaaggagctttccttttggccgataatgtgcgggagcccgcacggttcctggccgctaaggagaacgtcgtcctggaagtgaccgtgctcaatacagagggacaggtgcaggagctagtgttcccccaagaggagtaccctcgaaaaaactctattcaactgtccgcgaagactattaaacagaattcaaggaacggagttgtgaaagtggtgttcattctgtacaataatctgggcctctttctctcgactgaaaacgccacagtgaagctggccggtgaggccggtcctggtgggccaggtggcgcttcccttgtggtaaatagtcaagttatcgccgcaagtatcaacaaggagtctagtagagtgtttcttatggacccagtcatctttactgtggcccaccttgaggacaaaaatcatttcaacgccaattgctcattttggaattattcagagcgaagcatgctgggctattggagcacccagggttgtagactggtggaatccaacaagactcacactacctgcgcttgttcccacctaacaaactttgcagttctcatggcacaccgtgagatataccagggtcggatcaatgagctgcttctttcagtcattacatgggtcggcattgtcatatcactcgtgtgcttggctatatgcatctctaccttctgtttcctgcgcggtctgcagacagatcgcaatacaattcataaaaacctttgtattaacttatttctggctgagctactgtttcttgttggaatcgacaagactcagtacgagattgcctgtcctatatttgctggtctattgcattactttttcttggcggctttctcctggctgtgccttgaaggtgtccacctctacctgctgttagttgaggtgttcgagtcagagtactcacggactaagtattactacttaggaggctactgcttcccagccctagttgtcgggatagctgccgctatagattatcggtcctatggcactgagaaagcctgctggctgcgcgtggacaattactttatctggtccttcattggacctgtgagtttcgtgatagtggtaaatctggtctttttgatggtgacactccacaagatgataaggtcgagctccgttttaaaaccagacagtagccgtctggataacataaagtcatgggcattgggcgctatcgcgcttctgtttctgctggggctcacatgggcatttggactgttgtttataaacaaggagtcagtcgtgatggcctacctgttcacgacattcaacgctttccaaggcgtgtttatctttgtgtttcattgtgccctccaaaagaaagttcataaggaatattccaagtgtttgagacatagttactgctgcataagaagccctcccggaggtactcacggctcacttaaaactagtgccatgagaagcaacaccaggtactacactggcacacagtcccggatcaggcgtatgtggaatgataccgtgcgcaagcaaactgagtctagcttcatggccggagatattaatagcacccccactctgaacagggggaccatgggcaaccacttgttgaccaacccggtcctacagccaagggggggaacaagcccgtataatactctcattgccgagtcagtgggtttcaaccccagctcaccccctgtttttaattcccccggaagctatagagagcccaaacacccattagggggaagggaagcttgcggcatggatacactgcccttgaacggtaatttcaacaactcttattctctgcgttctggcgactttccgccaggcgatggagggcctgagccccctagagggcgaaatctggccgacgctgccgcttttgaaaagatgattatctctgaattagtgcacaacaacctcaggggcagctcatcagctgcaaagggccctcccccaccagagcctcccgtgcccccagtgcccggtggaggtggggaagaagaagcaggcggtccaggcggtgctgatagggccgaaattgagctgctttacaaagccctcgaagagccactgctactgcctagggcccagagcgtgttataccagagtgacctggatgagagcgaaagctgtacagccgaagacggtgctaccagtaggcctttgtcatctcccccaggtcgcgattcactgtatgcctctggcgctaatctacgggactctccctcttaccccgactcctcacctgaaggcccaagtgaagctctgcctccacctccaccagccccaccgggacctccagagatctattatactagccggcctcccgctctcgtagctagaaacccgctgcaggggtattaccaagtgcgaaggccaagccacgaggggtatctggctgccccaggccttgaaggccctgggcctgacggggatgggcagatgcagcttgtaacatccctgtag

SEQ ID NO: 50934 - DNA, 4410 bp, Artificial Sequence
  Description of Artificial Sequence: Synthetic coding sequence
atggccaggctggcggcagttttgtggaacctctgcgttacagcggtcctggttactagcgctactcaagggctcagcagagcaggattgccctttggactgatgagaagagagctggcctgtgagggttaccccatcgaactgaggtgccctggaagcgatgtcattatggtggagaacgcgaactatgggaggaccgacgacaaaatctgcgacgccgatcctttccagatggagaatgtgcaatgttatttaccggatgccttcaaaattatgtcgcagcggtgcaataatagaacccagtgcgtcgtggtcgccggaagcgacgcatttccagacccttgccccggaacctacaagtacctagaggtccagtatgattgcgttccttatatattcgtgtgtcccggtacacttcagaaagtgctggagcctacctcaacgcacgagtccgaacaccaatccggggcatggtgcaaagaccctttgcaggcaggtgatcggatctatgttatgccctggatcccttatagaaccgacacccttaccgaatatgcttcctgggaggactacgtggccgcaaggcacaccaccacatatcgactgcccaatcgtgtggacggaacgggatttgtggtctacgatggcgctgtcttttataataaagagagaactcgcaatattgtaaagtacgaccttcggacccgaatcaagtctggggaaaccgtcatcaacacagctaactatcacgatactagcccgtatcgatggggtggtaaaaccgacatcgacctggccgtggatgaaaacggtctgtgggttatctacgccacagagggcaataatggccgattggtcgtgtcacaactaaatccttatacactcagattcgaaggcacctgggaaacgggttatgataaacgctcagcatccaacgccttcatggtatgtggcgtgctctacgtactgcgttcagtatacgttgacgatgatagcgaggcggctggcaatagggtcgactacgcctttaatacgaacgcgaatagggaggaacctgtttccctgacctttccaaatccataccaattcatctcttctgtggattataacccccgagacaatcagctatatgtgtggaataattattttgtggtcaggtactccctagaatttggccctcctgatcccagcgctggcccagcgacctctccccctctcagtaccactaccacagcaaggcccactcctctgacctcaactgcgagccccgcagcaaccactcctttgcggagagcacctttgacaactcacccagtaggcgcaatcaaccagttaggacccgatctgcctccggctacagcgccagtaccttctacacgacggcctccagccccaaatttgcacgtctctcccgagctcttttgcgaaccacgcgaagtaagacgggtgcagtggcccgcaacgcaacagggtatgctggtggaacgtccttgtccaaaggggactcgagggatagcatcttttcagtgcctcccagctctgggactttggaaccctagaggcccagacctgtccaattgcacctccccttgggtgaaccaagtggcccagaagatcaaaagtggtgaaaacgccgcaaatattgcaagcgagcttgccaggcacactcgaggcagcatctacgcaggtgatgtgtcatccagcgtgaagctcatggaacaactcctggacatcctggacgcacagttgcaggccctccgccctattgagagagagtctgctggcaagaattacaacaaaatgcacaagcgcgaacgcacttgcaaagactatatcaaagcagtcgtggagacggtcgacaatctcctgaggcctgaggcactggagagctggaaggacatgaatgccactgaacaggttcataccgccaccatgttgctggacgtgctggaggagggagccttcctgctggcggacaacgtacgtgagcccgctcgcttcctggccgctaaagaaaacgtggtgctcgaggttacggtcctgaacactgagggccaggtacaagagctggtatttcctcaggaggaatatcccagaaagaacagcatacagctttctgccaagacaatcaaacagaattctcggaacggcgtggtgaaggtcgtgtttatcctttacaataacctgggcctattcctaagcactgaaaatgctaccgtgaaactggccggtgaggctggcccaggcggacccggtggcgcttctctggtcgtgaacagccaggttatcgctgcatcaattaataaagagtctagccgggtattcttaatggatcccgtgattttcaccgttgcccatctggaggacaagaatcacttcaatgctaattgcagcttctggaactactctgaaagatcaatgttaggatattggagcacacaggggtgtcggttagtagaatcgaacaagacccacaccacctgcgcttgctctcaccttaccaacttcgcagtgctgatggcccaccgggagatttaccaaggacgtattaatgagttgctactatcagtaatcacctgggtcggtatcgtcatctccctggtgtgtctggccatctgtatctccaccttttgcttcctgaggggtttgcaaactgaccgaaatacaatccacaagaatctgtgcatcaatctgttcttagctgaacttctatttctggtcggaatagacaaaacccaatacgagatcgcatgtcctattttcgcaggccttttgcactacttttttctcgccgctttctcatggctctgtctggaaggagtgcacttgtatttactcctcgtggaagttttcgagagtgagtactcacgtaccaagtactactatctgggcggatattgtttccctgccttggtggtggggatcgccgcagccatcgactataggtcctacggaactgagaaggcttgctggctgagagtggataattatttcatatggtcatttatcggtcctgttagcttcgtaatcgtcgtgaaccttgtcttcttgatggttacactccacaagatgattagatcctcttccgtcctgaaacccgattcctcacggctagacaacataaagagttgggcattaggggcaattgcgctcctcttcctcctaggcctgacatgggcattcggtctcctctttatcaataaagaaagtgtcgtcatggcctacctcttcactacgttcaacgcatttcagggcgtgtttatcttcgtgtttcactgtgctctgcaaaagaaggtgcataaagagtacagcaaatgcttacggcatagctactgttgcatcagatctcccccaggaggcacgcacggtagtctcaagacctccgctatgcgttccaataccagatactacacagggacacaatcccgcatccggcgaatgtggaatgacacagtccgaaaacagactgaaagcagtttcatggccggagacatcaattccacacctacgctgaacaggggaaccatgggaaaccacctcctcaccaaccctgtgctgcaaccccgtggaggcacatccccatacaacactttaatcgccgagtccgttggattcaacccaagctccccacctgtgttcaacagtcccggatcctaccgggaaccgaagcatcctttagggggacgggaggcttgtgggatggatacactaccccttaatggtaattttaacaactcatatagcttaagaagcggagattttccacctggggatggcggacctgagccgccacggggacggaaccttgcagatgcagccgctttcgagaagatgatcatctctgaacttgtgcacaacaatcttcgcggaagctcttcagctgcaaaagggccaccgccacctgagcctcccgtcccccctgttccagggggtggcggtgaggaagaggcaggaggccctggcggtgccgaccgcgctgagattgagctgttgtacaaagctctggaggagcccctcctgttgccacgcgcacagagcgtgctgtaccagtccgacctcgacgaatcggaaagctgcacagcagaggacggtgctacctcgcgcccattgtctagtcctcctggtcgagatagtctttacgcgtcaggcgctaatctccgcgattccccttcttaccctgatagttctccagaaggccctagcgaggccttgccaccaccgccacccgctccacccggaccgccagagatctactatacttccagaccacccgctcttgtcgcccgtaaccctttgcaaggctattatcaggttcggagaccttctcatgaagggtatctggctgccccaggccttgaaggtcctgggccagacggagacggccagatgcaactagtgacgtctctgtag

SEQ ID NO: 50935 - DNA, 4296 bp, Artificial Sequence
  Description of Artificial Sequence: Synthetic coding sequence
atggtctcatccgggtgccggatgagatccctgtggtttattattgtaatcagcttcctgccaaacaccgagggcttctcgcgcgctgcgttgccgttcggtctggtccggagagagctcagttgcgaaggctacagcattgacctccgctgtcctgggagcgacgtgatcatgattgaatcagctaattacggcaggactgatgacaaaatctgcgatgcggatcctttccagatggagaatactgactgctatctgccagacgcctttaagatcatgacccaacggtgcaacaatcgtacccagtgtatcgtggtgacaggctccgatgtgtttccggatccttgtccgggtacatacaagtacctggaggtgcagtacgagtgtgtgccatacatcttcgtgtgtccgggaacgcttaaggctatcgtggactccccttgtatttacgaagccgagcaaaaggctggggcatggtgcaaggatccgctccaggctgccgataagatctatttcatgccctggaccccttaccggaccgatacgttaattgaatatgcatcattagaggactttcagaactctcgccagaccacaacatacaaactgccaaatcgcgttgacggtaccgggttcgtcgtgtatgatggcgctgtctttttcaataaggagaggacacggaacatagtgaagtttgatcttaggactcggattaaaagcggagaggcaatcatcaactacgcaaattatcatgacacaagcccatatagatggggcggaaaaactgacattgacctggccgttgatgagaacggcctctgggtgatatacgccactgagcagaataatggcatgatagtgattagccaacttaatccatatacactacggttcgaggccacttgggagacagtgtatgacaagcgcgcagctagtaacgcgtttatgatctgcggcgtcttatatgtcgtgaggagtgtttatcaagataatgagtccgaaactggcaaaaattctattgattacatctacaatacgaggttgaatagaggcgagtatgtggacgtgccgtttccgaaccagtatcaatacattgccgcagtagattacaacccgagggataaccagctttatgtctggaacaacaactttatcctgcggtactcactggaattcggccctccggacccagcccaggtccccaccaccgccgtgaccatcacctcctccgccgagctgttcaaaaccattatctcaactacaagtactacctcccaaaaaggacctatgtccactactgttgccggtagccaagaaggaagcaagggtaccaagccgccaccggctgtatctacaaccaagattccacctataaccaatatttttcccctgcctgagcgtttctgcgaagccttggattctaaggggattaaatggcctcagacccagcgtggcatgatggttgaacggccttgtcccaagggcaccaggggcaccgcatcctatctgtgtatgattagcaccggtacgtggaatccgaagggtccggatctttccaattgtacttcgcactgggtgaaccagttggcgcagaagatccgttctggggagaatgccgcatccctcgctaacgaactggctaagcacacaaagggccctgtttttgccggtgacgtttctagttctgttcgtctgatggaacagctcgttgatatcctggacgctcagctccaggaactgaaaccttcagagaaggactctgccggacgtagctataataaattacagaagcgagagaagacctgtcgggcatacctcaaggcgattgtggacaccgtagataatctgctgcggccagaggcccttgaaagctggaagcacatgaatagctctgaacaggctcatacggcaacgatgctgctggataccctggaggaaggagccttcgtgctggcagataaccttttggagcctactagggtcagcatgccaacagagaacatagtgctggaggtggcagttctgtcaaccgaagggcagatccaggatttcaagttccccttaggaataaagggcgcaggatcctctatacagctgtccgccaacaccgtgaaacagaactcccggaacggactggcaaaactggtcttcatcatctatcgatccctcgggcagtttctgtccaccgaaaacgcaactattaaattgggagcggattttattggaaggaacagcacaatcgcagtcaacagtcacgtgatctcagtctccatcaataaagagtcttcacgggtgtatttaaccgacccggtgctctttacactcccgcacatcgacccagataattattttaatgctaactgctctttctggaattacagtgagaggacgatgatggggtattggtcaactcagggatgcaaacttgtcgacacaaacaaaactcggacaacatgcgcctgctcccacttgaccaatttcgccattctgatggcccaccgcgagatagcatacaaggacggagtccatgaactgttgttgacagtcatcacatgggtgggtattgtgataagcctggtgtgtctggcaatttgtatcttcacattttgttttttcaggggtctgcagagtgataggaatacgatacacaagaatttgtgtattaatttgtttatagccgaatttatatttcttatcgggatagataaaaccaagtacgccattgcttgccccattttcgccggattgctccactttttttttttggcagcctttgcgtggatgtgtctggaaggcgtccagctgtacctgatgctggttgaggtctttgaatccgagtacagtcgcaagaagtactattatgttgccggatacctattcccagccaccgttgtgggggtaagcgctgccatagactataagagctacggcacggagaaagcttgttggctccatgtggacaactatttcatctggtctttcattgggccagtaacgttcataatcctgttaaacattatattcctcgtcatcactctgtgtaagatggtgaagcactctaacaccctcaagcctgactcttcccgactagaaaacataaataattacagagtttgcgacgggtattataacacagatttacctgggagctgggtgttgggcgcatttgccctgctctgcctacttggcctgacttggtcattcggcttgctttttattaatgaggagacaatcgtgatggcataccttttcaccattttcaacgctttccagggcgtctttatatttatctttcattgcgcgctgcaaaaaaaggtgcgaaaggaatacggtaaatgttttcgccacagctactgctgtgggggacttcctacggagagcccgcactcaagcgtgaaggcaagcaccactaggacaagcgccaggtattcatccggaactcagagcagaattaggcggatgtggaatgatactgtcaggaagcaaagcgagtcttcgtttatcagcggagatatcaacagcactagcacactgaaccaggggcatagccttaacaacgctcgggatacttctgcaatggataccctgccactcaatggaaactttaacaatagctacagcctccataaaggagattataatgacagcgtccaggtcgtggattgcgggctctctttgaacgatactgcgttcgaaaaaatgataattagtgagctggtccataataatttgcgtgggtccagcaagacacataaccttgagcttactctcccggtcaaacccgtgataggcggaagcagcagcgaggacgacgctatcgtggcagatgcgagctctctgatgcacagcgacaacccgggacttgaactccaccacaaggagctggaggccccattaattcctcaaaggacccattctttattgtaccagccccagaagaaggttaagagtgagggcaccgattcatacgtaagtcagctcacagccgaagcagaagatcacctccagtccccaaatcgggactcactctacacttctatgccaaacctcagggactcaccatatccagagtcctccccagacatggaggaggacctcagcccttctagaaggtccgagaatgaggatatctattacaagtccatgcccaatctgggagcgggtcaccagctacaaatgtgctatcagatcagtagaggtaactcggacggatatatcattccgataaataaagagggttgtatccctgaaggtgatgtacgggagggccagatgcagctcgtaactagtctttag

SEQ ID NO: 50936 - DNA, 4212 bp, Artificial Sequence
  Description of Artificial Sequence: Synthetic coding sequence
atggtcagtagtggctgccgtatgcgaagtctgtggttcatcatagtcatcagtttcctcccaaacaccgaagggttttctcgcgctgcactgccctttggattggtgaggcgtgagctgtcttgtgagggctactcaattgatcttcggtgcccagggtccgatgtaatcatgatcgaatccgcaaattacggcaggacggacgacaaaatatgtgatgctgatccctttcagatggagaatacagactgctatctgcctgacgcctttaagattatgacacaacggtgcaataacagaactcagtgcattgtcgttaccggaagcgacgtgttccctgacccatgtcccggaacttacaaatacctcgaggttcaatatgagtgtgtaccctacattttcgtctgcccgggaacactgaaggcaattgtggactcgccctgcatatatgaggctgagcaaaaagccggtgcttggtgcaaagatcctctacaggcagcagataagatttacttcatgccgtggactccttataggacggacacactaatagaatacgcgagcctggaagatttccagaactctcgccagactaccacctataagttacctaatagggttgacggcacaggctttgttgtgtacgacggtgccgtattcttcaacaaggagcggacccggaatattgtcaaatttgatttaaggactcggatcaaaagtggagaggctatcattaactatgccaattaccacgatacctccccttatagatggggcggaaagacggatattgacctcgcggtggacgaaaacgggttatgggttatctacgccactgagcagaataatggcatgattgtgattagccaactgaatccttacactttgcgctttgaggccacctgggagactgtctacgataagcgggctgcaagtaacgcgttcatgatctgtggcgtgctatatgtcgtgagaagcgtctaccaagataacgaaagtgaaactggcaaaaacagtattgactacatttacaatactcggctcaataggggagagtacgtcgatgtaccttttccgaatcagtaccagtacatcgccgctgtggactacaatccccgagataaccagctgtacgtgtggaataacaactttatcttgagatactccctagaattcgggccacccgaccccgctcaagttcctaccacagccgttacgatcacctcctccgccgaactcttcaaaaccattatctcaaccacgagcaccacttcccagaaaggtcctatgtccacaaccgttgccggaagccaagaagggtctaagggaactaagcccccacccgctgtgagtacgacaaaaatccctcctattactaatatctttccacttccagaacgcttttgtgaggcgttagactctaaggggatcaagtggccgcagacgcagcgcggaatgatggtagagcgcccttgcccgaaaggtacccggggtaccgcctcctatctttgcatgatttccaccggcacatggaatcctaaaggacccgatctgtccaattgtacttcacactgggtgaatcagctggctcagaaaatcaggagtggcgagaacgcagcgtcgcttgcaaacgagcttgccaaacacacaaagggacctgtgtttgctggagatgtgtctagcagtgtgaggctgatggagcagttagttgatatccttgacgctcagctccaagagcttaagccttccgagaaagattcagcaggacggtcatataacaaagccatcgttgataccgtcgataatctacttcgacccgaggccttggaatcatggaagcacatgaatagctccgaacaggcccatacagccaccatgctcctcgacacattggaagaaggtgcctttgtgcttgctgataatctcctcgagcccacacgtgttagcatgcctaccgagaacatcgtgctggaggtggccgttctttccacagaaggtcaaatacaggacttcaagttccccctaggcatcaaaggggctggcagttctatccaacttagcgccaacaccgtgaaacagaactctcgcaacgggctggccaagctcgtctttattatatacaggtcattgggccagtttctctctacggagaacgccacaatcaagctgggcgctgacttcatcggcagaaattccactattgctgtgaattctcacgttatctcagtcagcattaacaaagaatccagccgtgtgtatctgactgaccccgtactgttcaccctgccccacatcgaccccgacaactatttcaatgccaactgttctttctggaattatagcgagagaaccatgatgggctattggagtactcaagggtgtaaactcgtagatacgaataaaacccgcaccacatgcgcctgctcccacttgacaaacttcgccattctgatggctcatcgagagattgcgtataaggacggggtccatgaactgttactgacagtcatcacttgggtagggatcgtgatctctctggtttgcctggcaatctgcatttttacattttgtttcttcaggggactgcagagtgacaggaacactattcataaaaacctctgcataaatttattcatcgcagagtttatcttcctgatcggcatcgataagaccaaatatgccatagcctgccccattttcgccggtctcttgcacttctttttcctggcggcattcgcatggatgtgtttagagggtgtacagctatacctgatgctagtggaggtgttcgaatcagagtatagtcggaagaaatattattacgtggccggatacctttttccagccaccgtggtcggcgtgtcagctgcaatcgattataagtcatatggcacagaaaaagcttgttggcttcatgtagacaactatttcatttggagctttatcggccctgtgacattcatcatcttgttgaacataatcttcctcgtcataaccttatgtaaaatggtgaagcattcaaatactctgaagcctgactccagccgcctggaaaatatcaagagctgggttctcggcgcttttgcgttgctgtgtctacttggattgacatggagctttgggttgttgtttatcaacgaggaaacaattgtcatggcttacctgttcacaatctttaacgcttttcaaggcgtgttcatctttatcttccactgcgcactccagaagaaagtcaggaaggaatacggtaagtgttttaggcactcctactgttgcggtggcctccctacggaaagccctcatagctctgtcaaggcatcaaccacccgcacatctgcacgatattcaagcgggacacagagccgcatccgcaggatgtggaacgacacggtgcggaagcagtctgaatcttccttcatttcaggggatatcaatagcacgtccaccttgaaccagggccacagcctgaacaacgctagagataccagcgcaatggacaccctccctttaaatggtaattttaacaacagctactccttgcacaagggggactataacgactccgtgcaagtggtggactgcggccttagtctgaatgacactgcctttgagaagatgattattagtgagctggtacacaacaatttgcgcggtagcagcaagacacacaatctcgagctcacactcccggtcaaaccggttatcggcggaagttcttcagaggatgatgccatagtggccgacgccagttccttaatgcactcagataacccgggactggagctgcaccacaaggagctggaagcccctctcattccacagcgcacgcatagtttattgtaccagccgcaaaagaaagtgaagtctgaggggacagatagttacgtgagccagttaacagcagaagcagaggatcatcttcagtccccaaaccgcgactcattgtatacgtcaatgcccaaccttcgcgactccccctatcccgaatcatctcccgatatggaagaggatttgagcccgtcccggcgtagcgagaacgaagatatctactataaatctatgcccaatctcggagctggtcatcaactgcagatgtgttatcagatctctcgcggaaattcggatggctacattatccccattaataaagagggttgtatcccagagggcgatgtaagggagggacagatgcagttggtaacctcgctgtag

SEQ ID NO: 50937 - DNA, 4251 bp, Artificial Sequence
  Description of Artificial Sequence: Synthetic coding sequence
atggtgtcctccggttgccggatgaggagtttatggtttatcattgtgatcagctttctcccaaacacagagggcttttcccgggctgctttgcccttcggtcttgtgagaagagaactgagctgcgaaggctactcaatcgatcttaggtgcccagggagcgatgtcatcatgatcgagagtgcaaactacggtaggaccgacgataagatctgtgacgcagatccattccagatggagaacactgactgctacttgcctgacgctttcaaaattatgacgcagcggtgtaataaccggacgcagtgcattgttgttacaggaagtgacgtcttcccggacccttgtcctgggacctacaaatatttagaagtacaatacgaatgtgtcccctatattttcgtttgcccagggaccctgaaagcgatagtcgacagcccttgtatctacgaggctgaacagaaggctggggcttggtgcaaagatcccctacaggcagccgacaagatatacttcatgccgtggaccccttaccggacagatactctgatagaatatgcatcactggaagatttccagaactctaggcagacaactacgtacaagctccccaatagggtcgatggaacaggcttcgtggtgtacgatggcgcagtctttttcaataaggagaggactagaaacattgtcaaattcgatctgcgcacacgcatcaagagcggcgaagctatcataaattatgcaaattaccatgatacaagtccctataggtggggaggcaaaacggatatagatttagctgtcgacgaaaatggtctctgggtaatttacgccacagagcagaataacgggatgatagtgattagtcagctgaatccttacactctgcgtttcgaggctacctgggaaacagtatacgataagagggcggcttccaacgcttttatgatatgtggtgtgctctacgtagttagatctgtgtaccaggacaacgaatccgagactggtaagaacagcatagactacatctataacactcggctgaatagaggagagtatgttgacgtcccgttccccaatcaatatcagtatattgccgctgtggactacaacccacgggacaatcagctgtatgtctggaataacaattttattctccggtattccctcgagttcgggccaccagaccctgctcaggtgcctaccactgctgtgaccataacttctagtgcagagctctttaagaccatcatttcaactacaagtaccactagccaaaaaggacccatgtctacgacggtagctggcagccaggaaggatcaaaggggacaaaacctcctcccgcagtatctacaactaagatccctccaattacgaatatctttccactgcccgaaaggttttgtgaagcactggattccaaggggattaagtggccacagacacagcggggaatgatggtggaacgaccctgccccaaaggcacaaggggtactgcatcgtacctttgcatgatcagcacagggacatggaaccctaagggtccggacttgtctaactgtaccagtcactgggtgaatcagcttgcacaaaaaatacgctccggggaaaatgctgcctccctcgcaaacgagctcgctaaacacaccaaaggccctgtattcgcgggagatgtgagcagttccgtacggctgatggaacagctggtggacatcctcgatgcacagcttcaagagttaaaaccctccgagaaggatagcgctggcaggagctataataagctccagaagcgagagaaaacatgtcgggcttacctaaaggctattgtcgacacagtggataaccttctgaggcctgaagccctggagagctggaaacatatgaactcttctgagcaggctcatactgcaacaatgctgctggataccttggaagagggcgctttcgtgctcgccgacaatcttttggagcccacaagagtctcaatgcccacagaaaatattgttcttgaggtggctgtgctgagtacagagggtcagatccaggacttcaagttccctcttggaatcaagggcgcagggtccagtatacagctctccgccaacacagtgaagcagaattccagaaatggcctggcgaagctagtctttattatctacagaagcttggggcagttcctgtcaaccgagaatgccactatcaagttaggggctgatttcatcgggaggaactcaacaatcgctgtcaattctcatgttatttctgtgagtataaacaaggagagttctagagtttacctgacagacccagtgctgtttaccctgccacacatcgatccagacaattactttaacgcaaattgttctttctggaactattccgagagaaccatgatggggtactggagtactcagggatgtaagctggtcgacaccaacaaaaccaggaccacctgcgcatgcagccacctgacaaatttcgctatccttatggctcacagggagattgcgtacaaggacggggttcatgagctactgttaaccgtgatcacctgggtcgggatcgtcataagcttggtgtgtttggccatctgtatattcactttttgcttctttagggggctgcagtctgaccggaacaccatccataagaacctctgcataaatctgttcatcgcggagttcatttttctcatcggcattgataaaacgaaatatgccatcgcttgcccaatcttcgccggtctcctacatttcttcttcctggctgcttttgcttggatgtgtctggaaggtgtgcaactttatctgatgctggtggaggtgttcgaatccgaatacagtaggaagaaatactattatgtagccggttacttgtttcccgctactgtggtgggcgtgagtgctgctattgattacaaaagttatggcacagaaaaggcatgttggcttcacgtagacaattatttcatttggagtttcatcggccctgtaacctttattattctcctgaatatcattttccttgtgattaccctgtgcaagatggtgaagcactcaaataccttaaagcccgattcttcccgactggaaaacataaagtcgtgggtcctgggcgcattcgcgctcctttgtctgctcggtctgacgtggagctttggtttactgtttatcaacgaggagacgatcgtgatggcctacctcttcaccattttcaatgcatttcagggcgtcttcatcttcatcttccattgtgcgctgcagaaaaaggtccgtaaagaatatggcaaatgctttagacactcatattgctgcggaggcttaccaactgagagcccgcacagctcagtgaaggcaagcacaactcgaacctctgcgagatactcctccggtacgcagagccggattagaaggatgtggaatgacaccgtgcggaaacagagcgagagcagcttcatctccggggacataaactccacaagtacattgaatcagggccactccctaaacaacgcgagggacacctccgctatggacacgctgcccctgaatggaaactttaataactcctattcactacacaagggggattacaatgacagtgtgcaggtggtagactgtggactgtctctcaatgataccgcatttgaaaagatgatcatctctgaattagtgcacaataacctaagaggctcttcaaaaacccataatctcgagttgaccctcccagtcaaacccgtgatcggaggatcctcgtctgaggacgatgcaatagttgctgacgctagctccctcatgcacagcgataatcctggcctggagctgcaccacaaagaactagaagctcctttgattccgcagaggacacacagcctcctctaccagccccaaaaaaaagtcaagagcgaaggcaccgacagctacgtctcccagctcaccgccgaagctgaggaccacctccagagcccaaatcgcgacagcttgtataccagcatgcccaatctaagagatagtccatatcctgaaagcagccctgatatggaggaggatctgtcaccttcacgccgaagtgagaacgaggacatttactacaaatccatgccaaacctgggagcaggtcatcagttacaaatgtgctatcagatcagtcgcggtaactccgacggatacatcataccgatcaataaagaaggctgtatcccagagggagatgtacgagagggccagatgcagctggttacatccttgtag

SEQ ID NO: 50938 - DNA, 4212 bp, Artificial Sequence
  Description of Artificial Sequence: Synthetic coding sequence
atggtctcctctggctgtcggatgagatctctgtggttcataatcgttatcagcttcctgcccaacacagagggcttttctagagccgcactcccttttgggctggtcagacgagaattatcctgtgaaggatactcgatcgacttaagatgccctggtagcgatgtcatcatgatcgagtcggctaattacggccgtacagatgataagatctgcgacgctgatccattccaaatggaaaacacagactgctatcttcccgacgcctttaagataatgactcaaagatgtaacaatagaacccagtgtattgttgtgaccgggtcggatgtgttcccagatccttgtccaggtacttacaagtacctggaagtccagtatgagtgtgtgccttatattttcgtgtgcccgggaactctgaaggcgatcgtggactccccgtgcatttatgaggctgagcagaaggctggggcttggtgcaaggaccccctccaggcagcagataaaatctactttatgccctggactccataccggaccgacaccttaattgagtacgcgtctctcgaagatttccagaattcgcgccaaaccaccacttataagctgccgaatcgggttgatgggacaggcttcgtcgtgtacgatggagctgtgtttttcaacaaagagcgaactcgaaacattgtgaaatttgatcttagaactaggataaaaagcggggaggctatcattaattatgcaaattaccacgacacttcgccataccgctggggagggaagactgatatcgatctagctgtggacgagaatggcctgtgggtgatatatgctactgagcagaacaatggaatgattgtgatatcccaactcaacccgtatactcttcgtttcgaggctacatgggaaaccgtgtacgacaaacgtgccgcatcaaatgcgttcatgatatgcggggttctatatgttgtgcgtagtgtttatcaggacaatgagagcgaaaccgggaaaaactcgatcgactacatttacaacacacgcttgaatcggggtgagtacgtcgatgtgccctttccgaaccaataccagtacatcgcagccgttgactacaatccacgcgataatcaactctatgtttggaacaacaacttcattcttcggtactcactcgagttcggtcctcccgatcctgctcaagtccctaccaccgcagtaacaattacctcttcagccgagctttttaagaccattatcagcaccacatccacaacatcccaaaagggcccaatgagtaccacggtcgccggatcccaagagggcagcaagggaacgaaaccaccgcctgcggtgagtaccactaagatccctcccatcaccaacatatttcccctgccggagcgattctgcgaggcccttgacagcaaaggcatcaagtggcctcaaacccagcggggtatgatggtggagcgtccttgtccaaaggggacccgcggaactgcgtcttatttatgtatgatcagtaccggaacctggaatccaaaggggcctgacctgtcaaattgcacaagtcactgggtcaaccaattggcccagaaaattcgcagcggcgagaatgcagccagtctggcaaacgagctcgccaaacacaccaaaggcccagtgttcgctggtgatgtatcttcttcagtgcgcctgatggaacagctggtggacatcttagatgcacagctccaggaactgaaaccctcagagaaagattccgccggaaggagttacaataaggccatcgtcgataccgtggacaacctcttacgcccagaagctctggaaagttggaagcacatgaactcttccgagcaggcgcacactgctacgatgctgctggacaccttagaggaaggggcatttgtccttgctgacaacttgctggagcccacccgcgtctccatgcctactgagaatattgtcctcgaagtggctgtgttaagtactgagggacagatccaggattttaagttccctttagggatcaagggggctggatcaagtatccagctttctgctaatactgtgaagcagaactcccgcaacggcctggctaagctggtattcattatttatagatcactgggccagtttctatccacggagaacgcgactattaagctcggagccgattttatcggcaggaacagcacaattgcagtcaactcccatgtgatcagcgtgagcataaataaagaatccagtagagtttacctcacggaccccgtgttgttcactctgccgcatatcgacccggataactactttaacgctaattgttcattctggaattacagcgaaagaactatgatgggatactggagcacccagggctgtaaactagtggatactaataagaccaggactacctgcgcgtgcagccacctaaccaatttcgctatccttatggcccatcgtgagattgcctataaggacggagtccatgagcttcttttgactgtgatcacctgggttggcattgtcatctcgcttgtgtgccttgccatctgcatcttcacattctgcttcttcagaggactccagtccgatcggaatacaattcacaaaaatctgtgcatcaatcttttcattgccgaattcatcttcttaatcgggatcgacaaaacaaaatatgctattgcatgtccgattttcgcgggtctgttgcatttcttttttctggctgccttcgcctggatgtgcctggagggggtccagctgtacctcatgctggtagaggtctttgagtcagagtattcccgcaaaaaatattactacgtcgcgggatacttatttccagccacggtagtgggggtgtcagccgctatcgactacaaaagctacgggacagagaaggcatgctggctgcatgtagacaattattttatctggtccttcatcggaccagtgaccttcattatcttgctcaatataatcttcctggtcatcaccttgtgtaagatggtaaaacattctaatacgctgaagcccgacagctctcgattagagaatattaagtcctgggtgttgggtgccttcgcccttctatgtcttctgggattgacgtggagcttcgggctgctctttattaatgaagagacaatcgtgatggcatacctctttaccatttttaacgctttccagggcgtgtttattttcattttccattgcgccttgcaaaaaaaagttcgaaaggagtatggcaagtgtttcagacactcttattgctgtggaggcctacccacggaatctcctcactccagtgtgaaagccagcacaacacgcacgagcgcaaggtattcctcagggacacagagccgaatacggcgtatgtggaatgataccgtacgcaaacagtcagagagttctttcatttcaggtgacatcaactctacatcgacattgaatcaaggccactccttaaataatgcaagggacaccagcgccatggacaccctcccgttaaatggtaattttaataatagctatagtttacacaaaggcgattataatgattctgttcaggtggtggattgcgggctttcgctcaacgataccgctttcgaaaagatgatcatctcggagttggttcacaacaacctgcgcggttcctcgaagactcacaatctggagttgacccttcccgtgaagcccgtgattggcggtagctctagtgaagatgacgcgatagtagccgatgcgtcgtccctaatgcattctgataacccagggctcgaacttcaccataaggagctagaggccccactcattccacagcggactcatagtcttttataccagccccaaaagaaggtaaaaagcgagggcaccgatagctatgtctcccagcttaccgccgaggccgaggaccaccttcagtcgccaaacagggactccctctacacatcaatgcctaacctacgcgacagtccgtatcctgaatcctctcccgacatggaagaggacctgagcccatcaagaagaagcgaaaacgaggacatctattataaaagcatgccaaacctcggtgccggacatcaactacagatgtgttaccagatttctcgcggtaatagcgatggctacattattccaattaacaaagagggctgcataccagagggggacgttcgcgaaggccagatgcagctcgtgacatcactgtag

SEQ ID NO: 50939 - DNA, 3372 bp, Artificial Sequence
  Description of Artificial Sequence: Synthetic coding sequence
atggtcagtagcgggtgcaggatgcgctcgttgtggttcatcatcgtgatatccttcttacctaataccgagggcttctccagggctgctctccctttcgggctggtccgaagagaactgtcgtgtgaggggtactccattgacctgaggtgccccggatcggatgtgattatgatcgagagcgctaattatggcagaactgacgacaaaatttgtgacgcagatccattccagatggaaaatactgattgctatcttcccgacgctttcaaaatcatgacccagcgctgcaacaatcgaacacagtgcattgtggtcactgggtctgatgtctttccagacccatgccccggaacctataaatatctagaagtacagtatgagtgcgtaccgtacatctttgtgtgtcccggaaccctgaaggcaatcgtggattcaccatgtatctacgaggcggagcaaaaggctggggcatggtgcaaagacccattgcaagccgctgacaaaatttactttatgccttggaccccttaccggacagacactcttatcgagtacgcctcgctggaggattttcagaatagcagacagaccaccacatacaaactgcctaatcgagtagatggcaccggctttgtggtgtatgatggcgctgtgttttttaacaaggaaagaacgcgcaatatagtgaagttcgatctgcggacccgaatcaaatctggcgaagccattattaactatgccaattaccatgacacatccccttatagatggggaggaaaaacagatatcgatctagctgtcgacgagaacgggttgtgggtaatctatgccacagaacaaaacaatggaatgattgttatcagccagcttaatccctatacactgaggtttgaggctacctgggagactgtatatgataagagggccgcttccaacgcattcatgatctgtggagtcctgtacgtcgtccggtccgtataccaggataatgagagtgagaccggtaaaaatagtatcgattatatttataatactagactcaaccgtggtgaatatgtggatgtgccgttccccaaccagtatcagtacattgctgccgtagattacaatccccgtgacaatcaactttacgtttggaacaataattttattctacggtattccctcgagttcgggcctcctgacccagcccaggtccccacaactgctgttactatcacaagcagtgccgaactttttaagacgatcatctctaccacaagcacaacgtcacagaagggaccgatgtcaacaactgtcgcaggtagtcaggaagggagcaaagggaccaaaccaccccctgcagtatctacaaccaagatccccccaattaccaacatcttccctctgcccgaacggttctgcgaagcactggattctaagggaataaagtggccccagacccagagaggaatgatggtggaacggccatgccctaagggaacccggggtacggccagctatctttgtatgattagcacggggacttggaaccctaagggaccagacctctcaaattgtacctcacattgggtgaatcagttggctcagaagatccgctctggcgaaaacgcagcatctctggccaatgagcttgccaagcacactaaaggaccagtatttgcaggggatgtgtccagtagtgtgaggctaatggaacagttagttgacattttagatgcgcaactgcaagagctcaagccttcagagaaagactccgccggacgctcttacaacaaggctatcgtcgacacggtggacaatctcctgagaccagaggcgctggaatcgtggaagcacatgaacagctccgagcaggcacatacagctactatgctgctggataccctcgaagaaggagcctttgtcctggcagacaatctgctggagccaacgcgcgtctcgatgccgaccgagaatatcgtgctggaggtagcggtcctcagcactgaggggcaaattcaggattttaagtttcctttgggcatcaaaggtgctggttcaagcatccaactgtcggcaaatactgtcaaacaaaatagccgaaatggcctggctaagctcgtcttcatcatctataggagcctgggtcagttcctttcaacagagaatgccaccataaagttgggagctgattttatcggccgaaactcaacaatagcagtgaacagccatgttatctccgtgtctattaacaaggaatcaagccgcgtttacttgactgatcctgtgttattcacactaccacacatagatcccgacaattactttaatgcaaattgctcattttggaattatagcgaaaggacgatgatggggtattggtccacacaaggttgtaagctcgtggatacaaataagacacggaccacatgtgcctgctcacacctgacgaacttcgctatcctcatggcccacagagagatcgcatacaaggatggtgtccatgaactcctgctcaccgtcatcacatgggtaggaattgtgataagcctggtttgcttggcaatttgcatatttacgttctgcttcttcaggggccttcagtcagataggaacacaatacacaaaaatctgtgcatcaacctgtttatcgcagaatttatttttctgatcggcattgacaagactaaatacgctatcgcgtgccctatattcgccggtcttttgcatttttttttcctggccgcattcgcatggatgtgcttggaaggtgtgcagttatacctgatgttagtggaggtctttgaatccgaatattcacgaaaaaagtactactacgttgccggttatctgtttccagcgaccgtggttggggtgtcggccgcaatcgattataagagctacggtacagagaaggcttgctggctccatgtggataattacttcatctggagcttcataggtccagtgacatttattattcttctgaacatcatttttttagtgatcacactgtgcaaaatggtcaaacactcaaatacattgaaaccagattcctcaagactcgagaacatcaagtcctgggtcctcggcgcatttgcgctgctatgcctgcttggactgacatggtcattcgggctgctgttcatcaatgaagagactatcgtgatggcctacctctttactatatttaacgcctttcaaggcgtgttcatctttattttccactgtgcactgcagaaaaaagttcggaaggaatacggtaagtgttttcgacatagttactgttgtggtggactccccacagaaagcccacactcttcagtgaaggcctccacaacaagaaccagcgcaagatacagtagtgggacacaagacatccattag
